United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 169

SEQ ID NO: 7066458 - DNA, 22 bp, Homo sapiens
ttctgatgatggcggctggagc

SEQ ID NO: 7066459 - DNA, 22 bp, Homo sapiens
ttctgattgctgatgaggccca

SEQ ID NO: 7066460 - DNA, 23 bp, Homo sapiens
ttctctttagatttacattactc

SEQ ID NO: 7066461 - DNA, 22 bp, Homo sapiens
ttctcttctgttcagtgcccaa

SEQ ID NO: 7066462 - DNA, 22 bp, Homo sapiens
ttctcttctgttcagtgcccaa

SEQ ID NO: 7066463 - DNA, 22 bp, Homo sapiens
ttctcttcccactttctgtatt

SEQ ID NO: 7066464 - DNA, 22 bp, Homo sapiens
ttctcttccagccgggcttgca

SEQ ID NO: 7066465 - DNA, 22 bp, Homo sapiens
ttctctggtttgctgtttctga

SEQ ID NO: 7066466 - DNA, 22 bp, Homo sapiens
ttctctgtagttgcctggtgga

SEQ ID NO: 7066467 - DNA, 22 bp, Homo sapiens
ttctctgtgagggtgctggatt

SEQ ID NO: 7066468 - DNA, 22 bp, Homo sapiens
ttctcttatctggcattattgg

SEQ ID NO: 7066469 - DNA, 22 bp, Homo sapiens
ttctcttcatctcagtaaatgt

SEQ ID NO: 7066470 - DNA, 22 bp, Homo sapiens
ttctcctcactgcagcctttca

SEQ ID NO: 7066471 - DNA, 22 bp, Homo sapiens
ttctcctcagcaaggcagcttt

SEQ ID NO: 7066472 - DNA, 22 bp, Homo sapiens
ttctcctcagcaaggcagcttt

SEQ ID NO: 7066473 - DNA, 21 bp, Homo sapiens
ttctcctccaagttgctcctg

SEQ ID NO: 7066474 - DNA, 22 bp, Homo sapiens
ttctccgctaagttctctgcag

SEQ ID NO: 7066475 - DNA, 22 bp, Homo sapiens
ttctcctctgttggccttccct

SEQ ID NO: 7066476 - DNA, 22 bp, Homo sapiens
ttctcctctgttggccttccct

SEQ ID NO: 7066477 - DNA, 21 bp, Homo sapiens
ttctccagggggagctctctc

SEQ ID NO: 7066478 - DNA, 22 bp, Homo sapiens
ttctcccactccgtgcttcagt

SEQ ID NO: 7066479 - DNA, 22 bp, Homo sapiens
ttctcccactccgtgcttcagt

SEQ ID NO: 7066480 - DNA, 21 bp, Homo sapiens
ttctccccagcgaatcctcgg

SEQ ID NO: 7066481 - DNA, 22 bp, Homo sapiens
ttctaaattttggaagatgcag

SEQ ID NO: 7066482 - DNA, 22 bp, Homo sapiens
ttcctttagtgtcatatacttt

SEQ ID NO: 7066483 - DNA, 22 bp, Homo sapiens
ttccctgatcacgtgtcaggag

SEQ ID NO: 7066484 - DNA, 22 bp, Homo sapiens
ttccctcccccagcctggcagg

SEQ ID NO: 7066485 - DNA, 22 bp, Homo sapiens
ttccctccctggctgccatttc

SEQ ID NO: 7066486 - DNA, 22 bp, Homo sapiens
ttccctccgaacctcagtgctg

SEQ ID NO: 7066487 - DNA, 22 bp, Homo sapiens
ttccctccgaacctcagtgctg

SEQ ID NO: 7066488 - DNA, 22 bp, Homo sapiens
ttccctctccaggagccctgag

SEQ ID NO: 7066489 - DNA, 22 bp, Homo sapiens
ttccctctcctactcaggaaag

SEQ ID NO: 7066490 - DNA, 22 bp, Homo sapiens
ttccctctctccagggctgcct

SEQ ID NO: 7066491 - DNA, 22 bp, Homo sapiens
ttctatgaaggtaagatgtacg

SEQ ID NO: 7066492 - DNA, 19 bp, Homo sapiens
ttctatgattaacatgaga

SEQ ID NO: 7066493 - DNA, 22 bp, Homo sapiens
ttctcaaggacaaaatgacatg

SEQ ID NO: 7066494 - DNA, 22 bp, Homo sapiens
ttctcacaattcttgtatttgc

SEQ ID NO: 7066495 - DNA, 22 bp, Homo sapiens
ttctcacaggctggaatgatga

SEQ ID NO: 7066496 - DNA, 22 bp, Homo sapiens
ttctcacagtacctaacatgta

SEQ ID NO: 7066497 - DNA, 22 bp, Homo sapiens
ttctcactatgtatgtagattg

SEQ ID NO: 7066498 - DNA, 22 bp, Homo sapiens
ttctcagaaaagcaagctttct

SEQ ID NO: 7066499 - DNA, 22 bp, Homo sapiens
ttctcagaaaatgtagagaaaa

SEQ ID NO: 7066500 - DNA, 22 bp, Homo sapiens
ttctcagaattgactgggagca

SEQ ID NO: 7066501 - DNA, 22 bp, Homo sapiens
ttctcagaattgactgggagca

SEQ ID NO: 7066502 - DNA, 22 bp, Homo sapiens
ttctcagaattgactgggagca

SEQ ID NO: 7066503 - DNA, 22 bp, Homo sapiens
ttctcagacttccagcaccagc

SEQ ID NO: 7066504 - DNA, 18 bp, Homo sapiens
ttctcagactttggaagt

SEQ ID NO: 7066505 - DNA, 22 bp, Homo sapiens
ttctcagagcactgctgacaaa

SEQ ID NO: 7066506 - DNA, 22 bp, Homo sapiens
ttctcagagcactgctgacaaa

SEQ ID NO: 7066507 - DNA, 22 bp, Homo sapiens
ttctcagagctcactgtagtaa

SEQ ID NO: 7066508 - DNA, 22 bp, Homo sapiens
ttctcagagctcactgtagtaa

SEQ ID NO: 7066509 - DNA, 19 bp, Homo sapiens
ttctcagagcttgcagcac

SEQ ID NO: 7066510 - DNA, 22 bp, Homo sapiens
ttctcagaggagtcgggagctg

SEQ ID NO: 7066511 - DNA, 22 bp, Homo sapiens
ttctcagaggagtcgggagctg

SEQ ID NO: 7066512 - DNA, 22 bp, Homo sapiens
ttctcagaggctgctaagtgca

SEQ ID NO: 7066513 - DNA, 21 bp, Homo sapiens
ttctcagagtctattacagtt

SEQ ID NO: 7066514 - DNA, 21 bp, Homo sapiens
ttctcagagtctattacagtt

SEQ ID NO: 7066515 - DNA, 22 bp, Homo sapiens
ttctcagagtgaccaagtcttt

SEQ ID NO: 7066516 - DNA, 22 bp, Homo sapiens
ttctcagagtgaccaagtcttt

SEQ ID NO: 7066517 - DNA, 22 bp, Homo sapiens
ttctcagatatttactgagcat

SEQ ID NO: 7066518 - DNA, 22 bp, Homo sapiens
ttctcagatatttactgagcat

SEQ ID NO: 7066519 - DNA, 22 bp, Homo sapiens
ttctcagatatttgtatggaac

SEQ ID NO: 7066520 - DNA, 22 bp, Homo sapiens
ttctcagatccatcagaagtcc

SEQ ID NO: 7066521 - DNA, 22 bp, Homo sapiens
ttctccagagtttctctcactg

SEQ ID NO: 7066522 - DNA, 19 bp, Homo sapiens
ttctccagcctgacctgag

SEQ ID NO: 7066523 - DNA, 19 bp, Homo sapiens
ttctccagcctgacctgag

SEQ ID NO: 7066524 - DNA, 22 bp, Homo sapiens
ttctccaggccgcgcagggggc

SEQ ID NO: 7066525 - DNA, 19 bp, Homo sapiens
ttctccaggctgcagaggg

SEQ ID NO: 7066526 - DNA, 22 bp, Homo sapiens
ttctccaggcttgggccaggtc

SEQ ID NO: 7066527 - DNA, 22 bp, Homo sapiens
ttatggcatattcctcattgta

SEQ ID NO: 7066528 - DNA, 22 bp, Homo sapiens
ttatgttatgaatggatgatct

SEQ ID NO: 7066529 - DNA, 22 bp, Homo sapiens
ttatgcatgagataaaaattgg

SEQ ID NO: 7066530 - DNA, 22 bp, Homo sapiens
ttataagactgtagtgagtatt

SEQ ID NO: 7066531 - DNA, 23 bp, Homo sapiens
ttataagaagcatcacaggaaga

SEQ ID NO: 7066532 - DNA, 22 bp, Homo sapiens
ttataagagtatatagtgtact

SEQ ID NO: 7066533 - DNA, 22 bp, Homo sapiens
ttataagagtatatagtgtact

SEQ ID NO: 7066534 - DNA, 22 bp, Homo sapiens
ttataattctggcataggctgt

SEQ ID NO: 7066535 - DNA, 22 bp, Homo sapiens
ttataactttggatatgacaag

SEQ ID NO: 7066536 - DNA, 22 bp, Homo sapiens
ttagttagaataatacaagtaa

SEQ ID NO: 7066537 - DNA, 22 bp, Homo sapiens
ttataattctggcataggctgt

SEQ ID NO: 7066538 - DNA, 22 bp, Homo sapiens
ttatacagcattgctagtgatg

SEQ ID NO: 7066539 - DNA, 22 bp, Homo sapiens
tcctctgggcctatttgttcac

SEQ ID NO: 7066540 - DNA, 22 bp, Homo sapiens
tcctctggatataagcctcacc

SEQ ID NO: 7066541 - DNA, 22 bp, Homo sapiens
tcctctggcccagctgcctctg

SEQ ID NO: 7066542 - DNA, 22 bp, Homo sapiens
tcctctggcccagctgcctctg

SEQ ID NO: 7066543 - DNA, 22 bp, Homo sapiens
tcctctggaacctcacccttgc

SEQ ID NO: 7066544 - DNA, 22 bp, Homo sapiens
tcctctggatataagcctcacc

SEQ ID NO: 7066545 - DNA, 23 bp, Homo sapiens
ttagtgtaaggcaggcacagttg

SEQ ID NO: 7066546 - DNA, 22 bp, Homo sapiens
ttagtgtattttcaaatgtaga

SEQ ID NO: 7066547 - DNA, 22 bp, Homo sapiens
tcctctccaggtgagccgaaat

SEQ ID NO: 7066548 - DNA, 22 bp, Homo sapiens
tcctctgctcagcattcctcac

SEQ ID NO: 7066549 - DNA, 22 bp, Homo sapiens
tcctccttgttttgtctctgct

SEQ ID NO: 7066550 - DNA, 22 bp, Homo sapiens
tcctcggctgggccccaggctt

SEQ ID NO: 7066551 - DNA, 21 bp, Homo sapiens
tcctcctgtagagggtcctgg

SEQ ID NO: 7066552 - DNA, 21 bp, Homo sapiens
tcctcctgtagagggtcctgg

SEQ ID NO: 7066553 - DNA, 22 bp, Homo sapiens
tcctcctgtctaccagttcctg

SEQ ID NO: 7066554 - DNA, 22 bp, Homo sapiens
tcctcctgtttctcaggcctgg

SEQ ID NO: 7066555 - DNA, 22 bp, Homo sapiens
tcctcctgtttctcaggcctgg

SEQ ID NO: 7066556 - DNA, 22 bp, Homo sapiens
tcctcctgtttctcaggcctgg

SEQ ID NO: 7066557 - DNA, 22 bp, Homo sapiens
ttcaaaattgttctaagctctg

SEQ ID NO: 7066558 - DNA, 22 bp, Homo sapiens
ttcaagcagggattggtgatgg

SEQ ID NO: 7066559 - DNA, 22 bp, Homo sapiens
ttattttggtaaatgtttgcct

SEQ ID NO: 7066560 - DNA, 22 bp, Homo sapiens
ttattttctcctcagaaagtgg

SEQ ID NO: 7066561 - DNA, 22 bp, Homo sapiens
ttattttctcctcagaaagtgg

SEQ ID NO: 7066562 - DNA, 22 bp, Homo sapiens
ttattttctcctcagaaagtgg

SEQ ID NO: 7066563 - DNA, 22 bp, Homo sapiens
ttattttcagctaggaaagcca

SEQ ID NO: 7066564 - DNA, 22 bp, Homo sapiens
ttattttcagctaggaaagcca

SEQ ID NO: 7066565 - DNA, 22 bp, Homo sapiens
ttattttctcctcagaaagtgg

SEQ ID NO: 7066566 - DNA, 22 bp, Homo sapiens
ttattttaccttcctctgagct

SEQ ID NO: 7066567 - DNA, 22 bp, Homo sapiens
ttattttaccttcctctgagct

SEQ ID NO: 7066568 - DNA, 22 bp, Homo sapiens
ttattttaccttcctctgagct

SEQ ID NO: 7066569 - DNA, 22 bp, Homo sapiens
ttatttgtggcatatgagacga

SEQ ID NO: 7066570 - DNA, 22 bp, Homo sapiens
ttatttgtggcatatgagacga

SEQ ID NO: 7066571 - DNA, 22 bp, Homo sapiens
ttatttatatctctgcagttta

SEQ ID NO: 7066572 - DNA, 22 bp, Homo sapiens
ttatttatggcactgttggtgg

SEQ ID NO: 7066573 - DNA, 22 bp, Homo sapiens
ttatttatggcactgttggtgg

SEQ ID NO: 7066574 - DNA, 22 bp, Homo sapiens
ttatttacaactcttctcttcc

SEQ ID NO: 7066575 - DNA, 22 bp, Homo sapiens
ttatttaattttctcactcaga

SEQ ID NO: 7066576 - DNA, 22 bp, Homo sapiens
ttatttaattttctcactcaga

SEQ ID NO: 7066577 - DNA, 22 bp, Homo sapiens
ttatttaaaagtggtaagattc

SEQ ID NO: 7066578 - DNA, 22 bp, Homo sapiens
ttattgtttgggtataatttga

SEQ ID NO: 7066579 - DNA, 22 bp, Homo sapiens
ttattgtttgggtataatttga

SEQ ID NO: 7066580 - DNA, 22 bp, Homo sapiens
ttattgtttgggtataatttga

SEQ ID NO: 7066581 - DNA, 22 bp, Homo sapiens
ttatgtttgagtatatgactca

SEQ ID NO: 7066582 - DNA, 22 bp, Homo sapiens
ttatgtttgagtatatgactca

SEQ ID NO: 7066583 - DNA, 22 bp, Homo sapiens
ttatgtttgagtatatgactca

SEQ ID NO: 7066584 - DNA, 22 bp, Homo sapiens
ttatgttttatggctatatcat

SEQ ID NO: 7066585 - DNA, 22 bp, Homo sapiens
ttatgttttatggctatatcat

SEQ ID NO: 7066586 - DNA, 22 bp, Homo sapiens
ttattgttagtgagactgtaga

SEQ ID NO: 7066587 - DNA, 22 bp, Homo sapiens
ttattgttagtgagactgtaga

SEQ ID NO: 7066588 - DNA, 22 bp, Homo sapiens
ttcatattcaaatactctgctt

SEQ ID NO: 7066589 - DNA, 22 bp, Homo sapiens
ttcatagagcagctcactgaat

SEQ ID NO: 7066590 - DNA, 22 bp, Homo sapiens
ttcatagagcagctcactgaat

SEQ ID NO: 7066591 - DNA, 23 bp, Homo sapiens
ttcatacagaaacatcacttcat

SEQ ID NO: 7066592 - DNA, 22 bp, Homo sapiens
ttcagaaatgaatattggtatt

SEQ ID NO: 7066593 - DNA, 20 bp, Homo sapiens
ttcagaaataaggaatgagg

SEQ ID NO: 7066594 - DNA, 17 bp, Homo sapiens
ttcaatgattaatgcat

SEQ ID NO: 7066595 - DNA, 22 bp, Homo sapiens
ttcaatgatttttagggatcat

SEQ ID NO: 7066596 - DNA, 22 bp, Homo sapiens
ttcaagtcaaggaaagaggtct

SEQ ID NO: 7066597 - DNA, 22 bp, Homo sapiens
ttcaagtcaatttttgaatgac

SEQ ID NO: 7066598 - DNA, 22 bp, Homo sapiens
ttcaagtcagagcaagccaagt

SEQ ID NO: 7066599 - DNA, 22 bp, Homo sapiens
ttcaagtcatgttaactgcttc

SEQ ID NO: 7066600 - DNA, 22 bp, Homo sapiens
ttcaagtcctttggaaggcctg

SEQ ID NO: 7066601 - DNA, 21 bp, Homo sapiens
ttcaagtctctaggacttctc

SEQ ID NO: 7066602 - DNA, 22 bp, Homo sapiens
ttcaatatctctaagaatgagg

SEQ ID NO: 7066603 - DNA, 22 bp, Homo sapiens
ttccaaggcaacagcctaggct

SEQ ID NO: 7066604 - DNA, 22 bp, Homo sapiens
ttccaagagctttaattgttga

SEQ ID NO: 7066605 - DNA, 22 bp, Homo sapiens
ttccaactttgtcatatattat

SEQ ID NO: 7066606 - DNA, 22 bp, Homo sapiens
ttccaatatttacaatgcatta

SEQ ID NO: 7066607 - DNA, 22 bp, Homo sapiens
ttccaatggaatcatgtcttga

SEQ ID NO: 7066608 - DNA, 22 bp, Homo sapiens
ttccatattgtactctttggag

SEQ ID NO: 7066609 - DNA, 22 bp, Homo sapiens
ttcccagacctgtaggatcaga

SEQ ID NO: 7066610 - DNA, 22 bp, Homo sapiens
ttcccagactccacactgaggc

SEQ ID NO: 7066611 - DNA, 22 bp, Homo sapiens
ttcccagagaaggatgaaaaag

SEQ ID NO: 7066612 - DNA, 22 bp, Homo sapiens
ttcccagagataagacgtctta

SEQ ID NO: 7066613 - DNA, 19 bp, Homo sapiens
ttcccagagccatgagtga

SEQ ID NO: 7066614 - DNA, 22 bp, Homo sapiens
ttcccagaggagatttgcttat

SEQ ID NO: 7066615 - DNA, 22 bp, Homo sapiens
ttccccaggctggagtgcagtg

SEQ ID NO: 7066616 - DNA, 22 bp, Homo sapiens
ttccccagggaagctcctgcgc

SEQ ID NO: 7066617 - DNA, 22 bp, Homo sapiens
ttccccaggggctcctgccttt

SEQ ID NO: 7066618 - DNA, 22 bp, Homo sapiens
ttcccctgtcacagtggttctc

SEQ ID NO: 7066619 - DNA, 22 bp, Homo sapiens
ttccccttgataatgcagtaag

SEQ ID NO: 7066620 - DNA, 22 bp, Homo sapiens
ttgcgcgcggctaggtctcggt

SEQ ID NO: 7066621 - DNA, 22 bp, Homo sapiens
ttgcctttgacggtgcagcagt

SEQ ID NO: 7066622 - DNA, 22 bp, Homo sapiens
ttgcctttaagtataactgctg

SEQ ID NO: 7066623 - DNA, 22 bp, Homo sapiens
ttgcctgtgaacgctgagtcct

SEQ ID NO: 7066624 - DNA, 22 bp, Homo sapiens
ttgcctgtgaggattctggttg

SEQ ID NO: 7066625 - DNA, 22 bp, Homo sapiens
ttgcctgtgtcagcaggtggaa

SEQ ID NO: 7066626 - DNA, 22 bp, Homo sapiens
ttgcctgtttgagagctgtgtt

SEQ ID NO: 7066627 - DNA, 22 bp, Homo sapiens
ttgcctgctacggtcttcactg

SEQ ID NO: 7066628 - DNA, 22 bp, Homo sapiens
ttgctagctggtgtatgcattg

SEQ ID NO: 7066629 - DNA, 22 bp, Homo sapiens
ttgctcagcactggagccagct

SEQ ID NO: 7066630 - DNA, 22 bp, Homo sapiens
ttgctcagcactggagccagct

SEQ ID NO: 7066631 - DNA, 22 bp, Homo sapiens
ttgctcaggctggtgtgcagtg

SEQ ID NO: 7066632 - DNA, 22 bp, Homo sapiens
ttgctcaggcttagagctacta

SEQ ID NO: 7066633 - DNA, 22 bp, Homo sapiens
ttgcatttgacaaattatttaa

SEQ ID NO: 7066634 - DNA, 22 bp, Homo sapiens
ttgcatttgagaaagttctcct

SEQ ID NO: 7066635 - DNA, 22 bp, Homo sapiens
ttgcatttgatcttgggttctc

SEQ ID NO: 7066636 - DNA, 22 bp, Homo sapiens
ttgcatttcctgtactgtttga

SEQ ID NO: 7066637 - DNA, 22 bp, Homo sapiens
ttgaggtctttgagcaaacgca

SEQ ID NO: 7066638 - DNA, 22 bp, Homo sapiens
ttgcatttcccattgagtaatg

SEQ ID NO: 7066639 - DNA, 22 bp, Homo sapiens
ttgaggtcaaagaagtgagtgg

SEQ ID NO: 7066640 - DNA, 22 bp, Homo sapiens
ttgaggtcaaagaagtgagtgg

SEQ ID NO: 7066641 - DNA, 20 bp, Homo sapiens
ttgaggtcaaggactaggcc

SEQ ID NO: 7066642 - DNA, 22 bp, Homo sapiens
ttgaggtcaagtaaccactgga

SEQ ID NO: 7066643 - DNA, 22 bp, Homo sapiens
ttgaggtcaattctgtttcctg

SEQ ID NO: 7066644 - DNA, 22 bp, Homo sapiens
ttgaggtcatatatatttggca

SEQ ID NO: 7066645 - DNA, 22 bp, Homo sapiens
ttgaggtcatctgaagtactag

SEQ ID NO: 7066646 - DNA, 22 bp, Homo sapiens
ttgaggtccaggtgtgggcagg

SEQ ID NO: 7066647 - DNA, 22 bp, Homo sapiens
ttgaggtccagtctccacccac

SEQ ID NO: 7066648 - DNA, 22 bp, Homo sapiens
ttgaggtcccaaacccactgag

SEQ ID NO: 7066649 - DNA, 22 bp, Homo sapiens
ttgaggtccccagtacccactg

SEQ ID NO: 7066650 - DNA, 22 bp, Homo sapiens
ttgaggtccctgccttgccttc

SEQ ID NO: 7066651 - DNA, 23 bp, Homo sapiens
ttgaggtcggctctctgagcctg

SEQ ID NO: 7066652 - DNA, 22 bp, Homo sapiens
ttgaggtctctacagaagagtg

SEQ ID NO: 7066653 - DNA, 22 bp, Homo sapiens
ttgaggtctctacagaagagtg

SEQ ID NO: 7066654 - DNA, 22 bp, Homo sapiens
ttgaggtctgagactgtgcagg

SEQ ID NO: 7066655 - DNA, 22 bp, Homo sapiens
ttgaggtctggcagtagcgttg

SEQ ID NO: 7066656 - DNA, 22 bp, Homo sapiens
ttgaggtctgtgataaaagtca

SEQ ID NO: 7066657 - DNA, 22 bp, Homo sapiens
ttgaggtctgtgtaggcagcaa

SEQ ID NO: 7066658 - DNA, 22 bp, Homo sapiens
ttgaggtcttcagctgacacct

SEQ ID NO: 7066659 - DNA, 22 bp, Homo sapiens
ttgaggtcttcaggatcaggct

SEQ ID NO: 7066660 - DNA, 22 bp, Homo sapiens
ttgaggtcttcattcttgggca

SEQ ID NO: 7066661 - DNA, 22 bp, Homo sapiens
ttgaggtcttgagtactgggga

SEQ ID NO: 7066662 - DNA, 22 bp, Homo sapiens
ttgcatttttagatgcttctgt

SEQ ID NO: 7066663 - DNA, 22 bp, Homo sapiens
ttgcatttttacaagtagccag

SEQ ID NO: 7066664 - DNA, 22 bp, Homo sapiens
ttgcatttttagatgcttctgt

SEQ ID NO: 7066665 - DNA, 22 bp, Homo sapiens
ttggaactcaataattcttctt

SEQ ID NO: 7066666 - DNA, 22 bp, Homo sapiens
ttggaactcgtgttacttgtat

SEQ ID NO: 7066667 - DNA, 22 bp, Homo sapiens
ttggaactggatttcatgtagc

SEQ ID NO: 7066668 - DNA, 22 bp, Homo sapiens
ttgctttattcacatctatatt

SEQ ID NO: 7066669 - DNA, 22 bp, Homo sapiens
ttgctttagggcaaatatttca

SEQ ID NO: 7066670 - DNA, 22 bp, Homo sapiens
ttgctttaggtatagaatccat

SEQ ID NO: 7066671 - DNA, 23 bp, Homo sapiens
ttgcttctgtgcaattcagtact

SEQ ID NO: 7066672 - DNA, 22 bp, Homo sapiens
ttgctttaatgagattttgcca

SEQ ID NO: 7066673 - DNA, 22 bp, Homo sapiens
ttgctttactttgccattcgtt

SEQ ID NO: 7066674 - DNA, 22 bp, Homo sapiens
ttggaatctgcaatttaacaaa

SEQ ID NO: 7066675 - DNA, 22 bp, Homo sapiens
ttggaatcctgagatgagaatt

SEQ ID NO: 7066676 - DNA, 22 bp, Homo sapiens
ttggaatcattcttaaaggtct

SEQ ID NO: 7066677 - DNA, 20 bp, Homo sapiens
ttggaatcacctggagaggt

SEQ ID NO: 7066678 - DNA, 22 bp, Homo sapiens
ttggaagagtagagttgaataa

SEQ ID NO: 7066679 - DNA, 22 bp, Homo sapiens
ttggaagaccagaggccttgtc

SEQ ID NO: 7066680 - DNA, 21 bp, Homo sapiens
ttggaatcttaggagtgtggg

SEQ ID NO: 7066681 - DNA, 22 bp, Homo sapiens
ttggaattcagcttgcttataa

SEQ ID NO: 7066682 - DNA, 22 bp, Homo sapiens
ttggaggatgcaatgagggagt

SEQ ID NO: 7066683 - DNA, 22 bp, Homo sapiens
ttggcacaaatttctgaaataa

SEQ ID NO: 7066684 - DNA, 22 bp, Homo sapiens
ttggcagaatgggcagcttgag

SEQ ID NO: 7066685 - DNA, 22 bp, Homo sapiens
ttggcagaattaaccactgaag

SEQ ID NO: 7066686 - DNA, 22 bp, Homo sapiens
ttggcagactgacaatctgttt

SEQ ID NO: 7066687 - DNA, 22 bp, Homo sapiens
ttggcagactgggtcctgggga

SEQ ID NO: 7066688 - DNA, 22 bp, Homo sapiens
ttgttcatctggaacccagagc

SEQ ID NO: 7066689 - DNA, 22 bp, Homo sapiens
ttgtggcagaccatgagtctaa

SEQ ID NO: 7066690 - DNA, 22 bp, Homo sapiens
ttgtgctctgtgttatttaagg

SEQ ID NO: 7066691 - DNA, 22 bp, Homo sapiens
ttgtgagtagtgccgcaataaa

SEQ ID NO: 7066692 - DNA, 22 bp, Homo sapiens
ttgtgcatttctctgagtgtgt

SEQ ID NO: 7066693 - DNA, 22 bp, Homo sapiens
ttgtattaattgaaatgaatgc

SEQ ID NO: 7066694 - DNA, 22 bp, Homo sapiens
ttgtattagctgtaaattttct

SEQ ID NO: 7066695 - DNA, 22 bp, Homo sapiens
ttgtagtggccaaagaactctt

SEQ ID NO: 7066696 - DNA, 22 bp, Homo sapiens
ttgtatatattcttaaagatgt

SEQ ID NO: 7066697 - DNA, 22 bp, Homo sapiens
ttgtatgagtatggtgtatagg

SEQ ID NO: 7066698 - DNA, 22 bp, Homo sapiens
ttgtatgatcaaaagaaatgta

SEQ ID NO: 7066699 - DNA, 22 bp, Homo sapiens
ttgtagacatctgtatcatttt

SEQ ID NO: 7066700 - DNA, 22 bp, Homo sapiens
ttgggctgaaccctgcagctga

SEQ ID NO: 7066701 - DNA, 22 bp, Homo sapiens
ttgggctcaggagtttgagacc

SEQ ID NO: 7066702 - DNA, 22 bp, Homo sapiens
ttgggctgaagtagagggcaga

SEQ ID NO: 7066703 - DNA, 22 bp, Homo sapiens
ttgggctgaggagggcgtggcc

SEQ ID NO: 7066704 - DNA, 22 bp, Homo sapiens
ttgggctgatctgtggaagaag

SEQ ID NO: 7066705 - DNA, 22 bp, Homo sapiens
ttgggctttaattccagagagg

SEQ ID NO: 7066706 - DNA, 22 bp, Homo sapiens
ttggggcagagaggatacggca

SEQ ID NO: 7066707 - DNA, 22 bp, Homo sapiens
ttggctttagacctgagactgt

SEQ ID NO: 7066708 - DNA, 18 bp, Homo sapiens
ttggctttgagaactggt

SEQ ID NO: 7066709 - DNA, 22 bp, Homo sapiens
ttggcttcccagagcttacgct

SEQ ID NO: 7066710 - DNA, 22 bp, Homo sapiens
ttggcttcctgcacttgagttt

SEQ ID NO: 7066711 - DNA, 22 bp, Homo sapiens
ttggctggtaagccaaatgaaa

SEQ ID NO: 7066712 - DNA, 22 bp, Homo sapiens
ttggctggtttcaagaaggcat

SEQ ID NO: 7066713 - DNA, 22 bp, Homo sapiens
ttggctatgcttgtgttcagtt

SEQ ID NO: 7066714 - DNA, 22 bp, Homo sapiens
ttggcagagagtatgctgaaga

SEQ ID NO: 7066715 - DNA, 22 bp, Homo sapiens
ttggcagagccccagccttgga

SEQ ID NO: 7066716 - DNA, 22 bp, Homo sapiens
ttggcagagggaccagcctaca

SEQ ID NO: 7066717 - DNA, 22 bp, Homo sapiens
ttggcagaggggccacctgccc

SEQ ID NO: 7066718 - DNA, 22 bp, Homo sapiens
ttggcagatgaacacaactgga

SEQ ID NO: 7066719 - DNA, 21 bp, Homo sapiens
ttggcctgatatcttggagca

SEQ ID NO: 7066720 - DNA, 22 bp, Homo sapiens
tttatgtttgacaatgatctgg

SEQ ID NO: 7066721 - DNA, 22 bp, Homo sapiens
tttatgtttgacaatgatctgg

SEQ ID NO: 7066722 - DNA, 22 bp, Homo sapiens
tttatgttcctcttgagctttc

SEQ ID NO: 7066723 - DNA, 22 bp, Homo sapiens
tttattgccctgtagtacagga

SEQ ID NO: 7066724 - DNA, 21 bp, Homo sapiens
tttatgtacttcatagagtag

SEQ ID NO: 7066725 - DNA, 22 bp, Homo sapiens
tttatctttggatcttcagaaa

SEQ ID NO: 7066726 - DNA, 22 bp, Homo sapiens
tttatctttggatcttcagaaa

SEQ ID NO: 7066727 - DNA, 22 bp, Homo sapiens
tttatgaactacagatataact

SEQ ID NO: 7066728 - DNA, 22 bp, Homo sapiens
tttatgacaagcattactgatt

SEQ ID NO: 7066729 - DNA, 22 bp, Homo sapiens
tttatgacattacaatatcaag

SEQ ID NO: 7066730 - DNA, 22 bp, Homo sapiens
tttatgacccaagaagatacca

SEQ ID NO: 7066731 - DNA, 22 bp, Homo sapiens
tttatgagcctcaaatctgagt

SEQ ID NO: 7066732 - DNA, 22 bp, Homo sapiens
tttagtgtggcactgatgttca

SEQ ID NO: 7066733 - DNA, 22 bp, Homo sapiens
tttatctgtggtaaataacatt

SEQ ID NO: 7066734 - DNA, 22 bp, Homo sapiens
tttatctttaggactttgcaga

SEQ ID NO: 7066735 - DNA, 22 bp, Homo sapiens
tttatctttaggactttgcaga

SEQ ID NO: 7066736 - DNA, 22 bp, Homo sapiens
tttaggatattaatgttcagag

SEQ ID NO: 7066737 - DNA, 22 bp, Homo sapiens
tttaggatctctcttgttacat

SEQ ID NO: 7066738 - DNA, 22 bp, Homo sapiens
tttaggaagtttcagataggaa

SEQ ID NO: 7066739 - DNA, 21 bp, Homo sapiens
tttaggaagtttaaggcaggt

SEQ ID NO: 7066740 - DNA, 22 bp, Homo sapiens
tttaggaagatctgaaggaaga

SEQ ID NO: 7066741 - DNA, 22 bp, Homo sapiens
tttagcattaagcttttcaaat

SEQ ID NO: 7066742 - DNA, 22 bp, Homo sapiens
tttacagcttctatactatgtg

SEQ ID NO: 7066743 - DNA, 22 bp, Homo sapiens
tttagcttgaaagttttggagg

SEQ ID NO: 7066744 - DNA, 22 bp, Homo sapiens
tttacagagaatgtacataaag

SEQ ID NO: 7066745 - DNA, 22 bp, Homo sapiens
tttacacttgaggaaactgagg

SEQ ID NO: 7066746 - DNA, 22 bp, Homo sapiens
tttacactgacagcacataagg

SEQ ID NO: 7066747 - DNA, 22 bp, Homo sapiens
tttacactcctggaaatgatat

SEQ ID NO: 7066748 - DNA, 22 bp, Homo sapiens
tttacaagtttacagaatgatg

SEQ ID NO: 7066749 - DNA, 22 bp, Homo sapiens
tttacacattattttcagtgtg

SEQ ID NO: 7066750 - DNA, 22 bp, Homo sapiens
tttacacattattttcagtgtg

SEQ ID NO: 7066751 - DNA, 22 bp, Homo sapiens
tttaagagctagtatgtcattt

SEQ ID NO: 7066752 - DNA, 22 bp, Homo sapiens
tttaagagcctgtacaaatatt

SEQ ID NO: 7066753 - DNA, 22 bp, Homo sapiens
tttaagagctagtatgtcattt

SEQ ID NO: 7066754 - DNA, 22 bp, Homo sapiens
tttaagagttaaactttgacct

SEQ ID NO: 7066755 - DNA, 22 bp, Homo sapiens
tttaagaagttatgttataaat

SEQ ID NO: 7066756 - DNA, 22 bp, Homo sapiens
tttaagagcatttgcaatttat

SEQ ID NO: 7066757 - DNA, 22 bp, Homo sapiens
ttgttcttgccaagacatgaag

SEQ ID NO: 7066758 - DNA, 22 bp, Homo sapiens
ttgttcttggagcaggcagaga

SEQ ID NO: 7066759 - DNA, 22 bp, Homo sapiens
ttgttctttatcctggaagcct

SEQ ID NO: 7066760 - DNA, 22 bp, Homo sapiens
ttgttcttttgcttagacagat

SEQ ID NO: 7066761 - DNA, 22 bp, Homo sapiens
ttgttgaatggataaataaatt

SEQ ID NO: 7066762 - DNA, 22 bp, Homo sapiens
ttgtttaaaagaaatcatagaa

SEQ ID NO: 7066763 - DNA, 22 bp, Homo sapiens
ttgttggtgaatagggtggaat

SEQ ID NO: 7066764 - DNA, 22 bp, Homo sapiens
ttgttggtggaattgatgctag

SEQ ID NO: 7066765 - DNA, 22 bp, Homo sapiens
tttaacagatgtgaaattttca

SEQ ID NO: 7066766 - DNA, 22 bp, Homo sapiens
tttaacaggtaaagtaaatgtg

SEQ ID NO: 7066767 - DNA, 22 bp, Homo sapiens
tttaacatgttcaagaaacata

SEQ ID NO: 7066768 - DNA, 22 bp, Homo sapiens
tttaaattatagttaatgtctg

SEQ ID NO: 7066769 - DNA, 22 bp, Homo sapiens
tttaacatgttcaagaaacata

SEQ ID NO: 7066770 - DNA, 23 bp, Homo sapiens
tttaacatttgaacatgtggcca

SEQ ID NO: 7066771 - DNA, 22 bp, Homo sapiens
tttcacattggcttctatttct

SEQ ID NO: 7066772 - DNA, 22 bp, Homo sapiens
tttcacattcttctgaatctac

SEQ ID NO: 7066773 - DNA, 22 bp, Homo sapiens
tttcacatgtggaatgccaggt

SEQ ID NO: 7066774 - DNA, 22 bp, Homo sapiens
tttcacaatcaaatggtgaaat

SEQ ID NO: 7066775 - DNA, 22 bp, Homo sapiens
tttcacaatcaaatggtgaaat

SEQ ID NO: 7066776 - DNA, 22 bp, Homo sapiens
tttcacatcagaggtagattag

SEQ ID NO: 7066777 - DNA, 22 bp, Homo sapiens
tttcaatcaccataaagcaact

SEQ ID NO: 7066778 - DNA, 22 bp, Homo sapiens
tttcacaacgttgtggtgagag

SEQ ID NO: 7066779 - DNA, 22 bp, Homo sapiens
tttcacaagacagctactgttg

SEQ ID NO: 7066780 - DNA, 22 bp, Homo sapiens
tttcataatatccagagatttt

SEQ ID NO: 7066781 - DNA, 22 bp, Homo sapiens
tttcatcatgttggcagattgg

SEQ ID NO: 7066782 - DNA, 22 bp, Homo sapiens
tttcatctaacactacataggg

SEQ ID NO: 7066783 - DNA, 22 bp, Homo sapiens
tttccaggtattaatactgtat

SEQ ID NO: 7066784 - DNA, 17 bp, Homo sapiens
tttcatctgggaccacc

SEQ ID NO: 7066785 - DNA, 22 bp, Homo sapiens
tttcatcttcccagagaccttg

SEQ ID NO: 7066786 - DNA, 22 bp, Homo sapiens
tttctaaaatagattttatggt

SEQ ID NO: 7066787 - DNA, 22 bp, Homo sapiens
tttctaacgtagacagggaggt

SEQ ID NO: 7066788 - DNA, 22 bp, Homo sapiens
tttctaagacatttgtcatctt

SEQ ID NO: 7066789 - DNA, 22 bp, Homo sapiens
tttctaagcttagtatgaggca

SEQ ID NO: 7066790 - DNA, 22 bp, Homo sapiens
tttctaaggccagagactgctg

SEQ ID NO: 7066791 - DNA, 22 bp, Homo sapiens
tttccttgcacattggtttcca

SEQ ID NO: 7066792 - DNA, 22 bp, Homo sapiens
tttcccaattgagaggttctgt

SEQ ID NO: 7066793 - DNA, 22 bp, Homo sapiens
tttcccaacagtctctctcaaa

SEQ ID NO: 7066794 - DNA, 22 bp, Homo sapiens
tttcccaagaaaaataattgga

SEQ ID NO: 7066795 - DNA, 22 bp, Homo sapiens
tttcccaagtgtaaacatggca

SEQ ID NO: 7066796 - DNA, 22 bp, Homo sapiens
tttcccaattgagaggttctgt

SEQ ID NO: 7066797 - DNA, 21 bp, Homo sapiens
ttttttcttgcgtgaggcctg

SEQ ID NO: 7066798 - DNA, 22 bp, Homo sapiens
tttgacattgccaatttgctca

SEQ ID NO: 7066799 - DNA, 22 bp, Homo sapiens
tttgacattggcttattctgtt

SEQ ID NO: 7066800 - DNA, 22 bp, Homo sapiens
tttgacatgcaaagcactttag

SEQ ID NO: 7066801 - DNA, 22 bp, Homo sapiens
tttgacatggaataactcattt

SEQ ID NO: 7066802 - DNA, 22 bp, Homo sapiens
tttgacatgtgcttataacttt

SEQ ID NO: 7066803 - DNA, 22 bp, Homo sapiens
tttgacattatcctgttactgg

SEQ ID NO: 7066804 - DNA, 22 bp, Homo sapiens
tttgacatcaataccctagaat

SEQ ID NO: 7066805 - DNA, 22 bp, Homo sapiens
tttgacatctaagaattcttac

SEQ ID NO: 7066806 - DNA, 22 bp, Homo sapiens
tttgacaggactaacatatggc

SEQ ID NO: 7066807 - DNA, 22 bp, Homo sapiens
tttgacagcttgttacaaagtt

SEQ ID NO: 7066808 - DNA, 22 bp, Homo sapiens
tttgaagactactgggagtgaa

SEQ ID NO: 7066809 - DNA, 22 bp, Homo sapiens
tttgaagaagctgacctatttt

SEQ ID NO: 7066810 - DNA, 22 bp, Homo sapiens
tttgaagacatattgttacata

SEQ ID NO: 7066811 - DNA, 22 bp, Homo sapiens
tttgaacaggagtatctatagt

SEQ ID NO: 7066812 - DNA, 22 bp, Homo sapiens
tttgaacatgctgcatgataat

SEQ ID NO: 7066813 - DNA, 21 bp, Homo sapiens
tttgaaagtgggtgattcttt

SEQ ID NO: 7066814 - DNA, 22 bp, Homo sapiens
tttctattggcgtcactgttgt

SEQ ID NO: 7066815 - DNA, 22 bp, Homo sapiens
tttctattgatctaataaacat

SEQ ID NO: 7066816 - DNA, 22 bp, Homo sapiens
tttgaaagtgtttacttgggaa

SEQ ID NO: 7066817 - DNA, 22 bp, Homo sapiens
tttgaaagttcttctgacacta

SEQ ID NO: 7066818 - DNA, 22 bp, Homo sapiens
tttgaaatatgaggcattatga

SEQ ID NO: 7066819 - DNA, 22 bp, Homo sapiens
tttgaaatctaatcaaggaaca

SEQ ID NO: 7066820 - DNA, 22 bp, Homo sapiens
tttctagacatttctatgtaca

SEQ ID NO: 7066821 - DNA, 22 bp, Homo sapiens
tttctagactcaaagaggatat

SEQ ID NO: 7066822 - DNA, 22 bp, Homo sapiens
tttctagctgacaaaaatgttt

SEQ ID NO: 7066823 - DNA, 22 bp, Homo sapiens
tttctagtcagccatatctagt

SEQ ID NO: 7066824 - DNA, 22 bp, Homo sapiens
tttctagtctcgatctcttaat

SEQ ID NO: 7066825 - DNA, 22 bp, Homo sapiens
tttctagtggttaagatttaca

SEQ ID NO: 7066826 - DNA, 22 bp, Homo sapiens
tttctataactggactggattg

SEQ ID NO: 7066827 - DNA, 22 bp, Homo sapiens
tttgtcatgttttgtaatgtct

SEQ ID NO: 7066828 - DNA, 22 bp, Homo sapiens
tttgtcctataatcctcttaca

SEQ ID NO: 7066829 - DNA, 22 bp, Homo sapiens
tttgggttcagacatgattaca

SEQ ID NO: 7066830 - DNA, 22 bp, Homo sapiens
tttggggctcagcaggctgttt

SEQ ID NO: 7066831 - DNA, 22 bp, Homo sapiens
tttgagatggagtcttgctctg

SEQ ID NO: 7066832 - DNA, 22 bp, Homo sapiens
tttgcagtttcattgctgaaat

SEQ ID NO: 7066833 - DNA, 22 bp, Homo sapiens
tttgcataaaggagcatttctc

SEQ ID NO: 7066834 - DNA, 22 bp, Homo sapiens
tttgcataagtcatgtccagtg

SEQ ID NO: 7066835 - DNA, 22 bp, Homo sapiens
tttgcataggatggacatttta

SEQ ID NO: 7066836 - DNA, 22 bp, Homo sapiens
tttgcataggatggacatttta

SEQ ID NO: 7066837 - DNA, 22 bp, Homo sapiens
tttgcattgcagtggtttacag

SEQ ID NO: 7066838 - DNA, 22 bp, Homo sapiens
tttgcattgcctctgacttatg

SEQ ID NO: 7066839 - DNA, 22 bp, Homo sapiens
tttgcattgtaatatttagttc

SEQ ID NO: 7066840 - DNA, 22 bp, Homo sapiens
tttgctgaatagattgtaaact

SEQ ID NO: 7066841 - DNA, 22 bp, Homo sapiens
tttgctgtgaatccattactgt

SEQ ID NO: 7066842 - DNA, 22 bp, Homo sapiens
tttgcttaaagttctttctggt

SEQ ID NO: 7066843 - DNA, 22 bp, Homo sapiens
tttgcttcacaagtatggttct

SEQ ID NO: 7066844 - DNA, 22 bp, Homo sapiens
ttttttccagcttctagaggcc

SEQ ID NO: 7066845 - DNA, 22 bp, Homo sapiens
ttttttatctatggtagtacca

SEQ ID NO: 7066846 - DNA, 22 bp, Homo sapiens
ttttttatctatggtagtacca

SEQ ID NO: 7066847 - DNA, 22 bp, Homo sapiens
ttttttcagcctgtctgtgcca

SEQ ID NO: 7066848 - DNA, 22 bp, Homo sapiens
ttttttatatcaactgaagtct

SEQ ID NO: 7066849 - DNA, 22 bp, Homo sapiens
ttttttatatcaactgaagtct

SEQ ID NO: 7066850 - DNA, 22 bp, Homo sapiens
ttttttagttaggtcagaatgt

SEQ ID NO: 7066851 - DNA, 22 bp, Homo sapiens
ttttttatagcaatgaacccac

SEQ ID NO: 7066852 - DNA, 22 bp, Homo sapiens
tttttgtgatatgacactgtat

SEQ ID NO: 7066853 - DNA, 22 bp, Homo sapiens
tttttgtgtatcctgctccatg

SEQ ID NO: 7066854 - DNA, 22 bp, Homo sapiens
tttttgttcccagagaatttgt

SEQ ID NO: 7066855 - DNA, 22 bp, Homo sapiens
tttttgtagtcattagaagagg

SEQ ID NO: 7066856 - DNA, 22 bp, Homo sapiens
ttttgtgagcccataaatgcca

SEQ ID NO: 7066857 - DNA, 22 bp, Homo sapiens
ttttgtgagcccataaatgcca

SEQ ID NO: 7066858 - DNA, 22 bp, Homo sapiens
ttttgtgagctgagaaatgtat

SEQ ID NO: 7066859 - DNA, 22 bp, Homo sapiens
ttttgtatgagaagtgctttac

SEQ ID NO: 7066860 - DNA, 22 bp, Homo sapiens
ttttgtcagtgagaacagagtt

SEQ ID NO: 7066861 - DNA, 22 bp, Homo sapiens
ttttgtgaatagtttatctaag

SEQ ID NO: 7066862 - DNA, 22 bp, Homo sapiens
ttttgtgacagaaagattaagt

SEQ ID NO: 7066863 - DNA, 22 bp, Homo sapiens
ttttgtgagatgcgtatgaatg

SEQ ID NO: 7066864 - DNA, 22 bp, Homo sapiens
ttttccttctagagcagatttc

SEQ ID NO: 7066865 - DNA, 18 bp, Homo sapiens
ttttccttccaccttgaa

SEQ ID NO: 7066866 - DNA, 19 bp, Homo sapiens
ttttccttctatatgtttc

SEQ ID NO: 7066867 - DNA, 22 bp, Homo sapiens
ttttggttctgggatacagaga

SEQ ID NO: 7066868 - DNA, 22 bp, Homo sapiens
ttttggtttcccttcttatggt

SEQ ID NO: 7066869 - DNA, 22 bp, Homo sapiens
ttttcctctgtatgcgtgagat

SEQ ID NO: 7066870 - DNA, 22 bp, Homo sapiens
ttttcctcaggaatgctaagct

SEQ ID NO: 7066871 - DNA, 20 bp, Homo sapiens
ttttcctcgtgtttgttcta

SEQ ID NO: 7066872 - DNA, 22 bp, Homo sapiens
ttttcctctgagctttgaataa

SEQ ID NO: 7066873 - DNA, 22 bp, Homo sapiens
ttttcctctgagctttgaataa

SEQ ID NO: 7066874 - DNA, 22 bp, Homo sapiens
ttttcctctgcagagcagttag

SEQ ID NO: 7066875 - DNA, 22 bp, Homo sapiens
ttttcctctgcagagcagttag

SEQ ID NO: 7066876 - DNA, 22 bp, Homo sapiens
ttttcctctgtatgcgtgagat

SEQ ID NO: 7066877 - DNA, 22 bp, Homo sapiens
ttttcctactgataaacagtta

SEQ ID NO: 7066878 - DNA, 22 bp, Homo sapiens
ttttcctagtaggcctattaga

SEQ ID NO: 7066879 - DNA, 22 bp, Homo sapiens
ttttcctatatgcaaagaatgc

SEQ ID NO: 7066880 - DNA, 22 bp, Homo sapiens
ttttcctcacctaactcaaggt

SEQ ID NO: 7066881 - DNA, 22 bp, Homo sapiens
ttttcctcacctaactcaaggt

SEQ ID NO: 7066882 - DNA, 22 bp, Homo sapiens
ttttcctcaggaatgctaagct

SEQ ID NO: 7066883 - DNA, 22 bp, Homo sapiens
ttttcaagggcagggaaatcat

SEQ ID NO: 7066884 - DNA, 22 bp, Homo sapiens
ttttcacacaaggtgataagtt

SEQ ID NO: 7066885 - DNA, 22 bp, Homo sapiens
ttttcaaagactggaggctgat

SEQ ID NO: 7066886 - DNA, 22 bp, Homo sapiens
ttttagaagtgcctatcctatg

SEQ ID NO: 7066887 - DNA, 22 bp, Homo sapiens
ttttagaagtgcctatcctatg

SEQ ID NO: 7066888 - DNA, 22 bp, Homo sapiens
ttttattggtaatgataaaagt

SEQ ID NO: 7066889 - DNA, 22 bp, Homo sapiens
ttttagaaatactgatttagtg

SEQ ID NO: 7066890 - DNA, 22 bp, Homo sapiens
ttttagaaggaatgctatggtg

SEQ ID NO: 7066891 - DNA, 22 bp, Homo sapiens
ttttagaaagatccctggcagg

SEQ ID NO: 7066892 - DNA, 22 bp, Homo sapiens
ttttagaaagatccctggcagg

SEQ ID NO: 7066893 - DNA, 22 bp, Homo sapiens
ttttacttaattcttggtcatg

SEQ ID NO: 7066894 - DNA, 22 bp, Homo sapiens
ttttacattgggaaatgcctct

SEQ ID NO: 7066895 - DNA, 22 bp, Homo sapiens
ttttacaggtcataggtatagt

SEQ ID NO: 7066896 - DNA, 22 bp, Homo sapiens
ttttacagttccatgcaaagcg

SEQ ID NO: 7066897 - DNA, 22 bp, Homo sapiens
ttttacaaatgaggagctggag

SEQ ID NO: 7066898 - DNA, 22 bp, Homo sapiens
ttttacaagctgagtcgttaaa

SEQ ID NO: 7066899 - DNA, 22 bp, Homo sapiens
ttttacaagctgagtcgttaaa

SEQ ID NO: 7066900 - DNA, 23 bp, Homo sapiens
ttttaatttggacataagaagat

SEQ ID NO: 7066901 - DNA, 23 bp, Homo sapiens
ttttaatttggacataagaagat

SEQ ID NO: 7066902 - DNA, 22 bp, Homo sapiens
tttgtcttccccctttaatcag

SEQ ID NO: 7066903 - DNA, 22 bp, Homo sapiens
tttgtcttaaatcttgttactg

SEQ ID NO: 7066904 - DNA, 22 bp, Homo sapiens
tttgtccttgaatcaattcaca

SEQ ID NO: 7066905 - DNA, 20 bp, Homo sapiens
tttgtctgttaagtgtttct

SEQ ID NO: 7066906 - DNA, 20 bp, Homo sapiens
tttgtctgttaagtgtttct

SEQ ID NO: 7066907 - DNA, 22 bp, Homo sapiens
tttgtggaactctcttcttgca

SEQ ID NO: 7066908 - DNA, 22 bp, Homo sapiens
cagcattgatcccaggctgtgg

SEQ ID NO: 7066909 - DNA, 22 bp, Homo sapiens
cagcatttaatgcagtgcttcc

SEQ ID NO: 7066910 - DNA, 22 bp, Homo sapiens
cagcatttagaatttgaagtgt

SEQ ID NO: 7066911 - DNA, 22 bp, Homo sapiens
cagcatttatcttgtagcagga

SEQ ID NO: 7066912 - DNA, 22 bp, Homo sapiens
cagcatttggaggagaggcttt

SEQ ID NO: 7066913 - DNA, 22 bp, Homo sapiens
cagcatttggtgatcatcttaa

SEQ ID NO: 7066914 - DNA, 22 bp, Homo sapiens
gtattttactgctcaaagctct

SEQ ID NO: 7066915 - DNA, 22 bp, Homo sapiens
gtattttactgctcaaagctct

SEQ ID NO: 7066916 - DNA, 22 bp, Homo sapiens
gtattttaagtgactactaggt

SEQ ID NO: 7066917 - DNA, 22 bp, Homo sapiens
gtattttactgctcaaagctct

SEQ ID NO: 7066918 - DNA, 22 bp, Homo sapiens
gtattttactgctcaaagctct

SEQ ID NO: 7066919 - DNA, 22 bp, Homo sapiens
gtattttaagtgactactaggt

SEQ ID NO: 7066920 - DNA, 22 bp, Homo sapiens
gtatttgtagtagcatagaatt

SEQ ID NO: 7066921 - DNA, 22 bp, Homo sapiens
cagcattttcttaatgtaggtg

SEQ ID NO: 7066922 - DNA, 22 bp, Homo sapiens
cagccaccatacagcagaagct

SEQ ID NO: 7066923 - DNA, 22 bp, Homo sapiens
cagccactcggccataaaggct

SEQ ID NO: 7066924 - DNA, 22 bp, Homo sapiens
cagccactctcagacagtccca

SEQ ID NO: 7066925 - DNA, 22 bp, Homo sapiens
cagccactgaactcctggctat

SEQ ID NO: 7066926 - DNA, 22 bp, Homo sapiens
cagccactgaactcctggctat

SEQ ID NO: 7066927 - DNA, 22 bp, Homo sapiens
cagccactgaactcctggctat

SEQ ID NO: 7066928 - DNA, 22 bp, Homo sapiens
cagccactgacaggaatggtcc

SEQ ID NO: 7066929 - DNA, 22 bp, Homo sapiens
cagccactgacaggaatggtcc

SEQ ID NO: 7066930 - DNA, 22 bp, Homo sapiens
cagccactggtgccaggctgtt

SEQ ID NO: 7066931 - DNA, 22 bp, Homo sapiens
cagccactgtggaatagccccc

SEQ ID NO: 7066932 - DNA, 22 bp, Homo sapiens
cagccacttcgagcttcctgat

SEQ ID NO: 7066933 - DNA, 22 bp, Homo sapiens
cagccacttgtgatgctgggga

SEQ ID NO: 7066934 - DNA, 22 bp, Homo sapiens
cagccacttgtgatgctgggga

SEQ ID NO: 7066935 - DNA, 22 bp, Homo sapiens
cagccagtggttgaagatgcag

SEQ ID NO: 7066936 - DNA, 22 bp, Homo sapiens
cagcaggcaggtgggccaagtc

SEQ ID NO: 7066937 - DNA, 22 bp, Homo sapiens
cagcaggcagccatttcactgt

SEQ ID NO: 7066938 - DNA, 22 bp, Homo sapiens
cagcaggcccaggtgctggtga

SEQ ID NO: 7066939 - DNA, 22 bp, Homo sapiens
cagcaggcggcccgcgggcccg

SEQ ID NO: 7066940 - DNA, 22 bp, Homo sapiens
gtatttctagaaaatgcagatt

SEQ ID NO: 7066941 - DNA, 22 bp, Homo sapiens
gtatttctagaatggtagcact

SEQ ID NO: 7066942 - DNA, 22 bp, Homo sapiens
gtatttctggttaaatgtgcta

SEQ ID NO: 7066943 - DNA, 22 bp, Homo sapiens
gtatttctttatctggtcagaa

SEQ ID NO: 7066944 - DNA, 22 bp, Homo sapiens
cagcagcctggagggggccacg

SEQ ID NO: 7066945 - DNA, 22 bp, Homo sapiens
cagcagcctggagggggccacg

SEQ ID NO: 7066946 - DNA, 22 bp, Homo sapiens
cagcagcctggcccctcctcgg

SEQ ID NO: 7066947 - DNA, 22 bp, Homo sapiens
cagcagagctgtgtgggaaggg

SEQ ID NO: 7066948 - DNA, 22 bp, Homo sapiens
cagcagagctgtgtgggaaggg

SEQ ID NO: 7066949 - DNA, 21 bp, Homo sapiens
cagcagagtaatgcattcgta

SEQ ID NO: 7066950 - DNA, 22 bp, Homo sapiens
cagcagagtaattctcacctct

SEQ ID NO: 7066951 - DNA, 22 bp, Homo sapiens
cagcagagtaggtgctacttct

SEQ ID NO: 7066952 - DNA, 22 bp, Homo sapiens
cagcagagtatggcactcaact

SEQ ID NO: 7066953 - DNA, 22 bp, Homo sapiens
cagcagagtttggcttctaatg

SEQ ID NO: 7066954 - DNA, 22 bp, Homo sapiens
cagcagagtttggcttctaatg

SEQ ID NO: 7066955 - DNA, 22 bp, Homo sapiens
cagcagcaacaacggaagcctt

SEQ ID NO: 7066956 - DNA, 19 bp, Homo sapiens
gtatatttatatggctgta

SEQ ID NO: 7066957 - DNA, 22 bp, Homo sapiens
gtatattttgatcaccctctat

SEQ ID NO: 7066958 - DNA, 22 bp, Homo sapiens
gtatcacttttgagagtgagaa

SEQ ID NO: 7066959 - DNA, 22 bp, Homo sapiens
gggtgggagaaatgagtatcta

SEQ ID NO: 7066960 - DNA, 20 bp, Homo sapiens
gggtgggagagtctgagggt

SEQ ID NO: 7066961 - DNA, 22 bp, Homo sapiens
ggtggggctaggacctcaggat

SEQ ID NO: 7066962 - DNA, 22 bp, Homo sapiens
gggtgggatctgtggagcctca

SEQ ID NO: 7066963 - DNA, 22 bp, Homo sapiens
gggtgggactctttggcctgag

SEQ ID NO: 7066964 - DNA, 22 bp, Homo sapiens
gggtgggactgaagtctgaggg

SEQ ID NO: 7066965 - DNA, 22 bp, Homo sapiens
gggtgggagaaatgagtatcta

SEQ ID NO: 7066966 - DNA, 22 bp, Homo sapiens
cagagtcagagcacctgggatt

SEQ ID NO: 7066967 - DNA, 22 bp, Homo sapiens
ggtggggttttaggctgctgca

SEQ ID NO: 7066968 - DNA, 22 bp, Homo sapiens
cagcaaggccattggatgcagt

SEQ ID NO: 7066969 - DNA, 22 bp, Homo sapiens
cagcacaattttcaggagtcca

SEQ ID NO: 7066970 - DNA, 22 bp, Homo sapiens
ggtgtgccacttcactgagcag

SEQ ID NO: 7066971 - DNA, 22 bp, Homo sapiens
ggtgtgcctggggcttagctgc

SEQ ID NO: 7066972 - DNA, 22 bp, Homo sapiens
ggtgtggatcatctgaggtcag

SEQ ID NO: 7066973 - DNA, 22 bp, Homo sapiens
cagcaataactcaaagccattt

SEQ ID NO: 7066974 - DNA, 22 bp, Homo sapiens
gtaaaattgcaattacttttgc

SEQ ID NO: 7066975 - DNA, 22 bp, Homo sapiens
ggttgcaaactcctgggatcaa

SEQ ID NO: 7066976 - DNA, 22 bp, Homo sapiens
ggttggacactaggtaggagcg

SEQ ID NO: 7066977 - DNA, 22 bp, Homo sapiens
cagacagggtcctgtccgtcac

SEQ ID NO: 7066978 - DNA, 22 bp, Homo sapiens
gggatgagagtagggtgtgaaa

SEQ ID NO: 7066979 - DNA, 22 bp, Homo sapiens
cagacagggccctgtgatggta

SEQ ID NO: 7066980 - DNA, 22 bp, Homo sapiens
cagacagggacctcgctccaga

SEQ ID NO: 7066981 - DNA, 22 bp, Homo sapiens
cagacagggacctcgctccaga

SEQ ID NO: 7066982 - DNA, 17 bp, Homo sapiens
cagacaggctgtcaccc

SEQ ID NO: 7066983 - DNA, 20 bp, Homo sapiens
gggatgagagtcctagctct

SEQ ID NO: 7066984 - DNA, 22 bp, Homo sapiens
gggcaaggcagaagagttggag

SEQ ID NO: 7066985 - DNA, 22 bp, Homo sapiens
gggcaaggcagaagagttggag

SEQ ID NO: 7066986 - DNA, 22 bp, Homo sapiens
gggagcagttaaaatgattcct

SEQ ID NO: 7066987 - DNA, 22 bp, Homo sapiens
gggagggtctgagagctgcacc

SEQ ID NO: 7066988 - DNA, 22 bp, Homo sapiens
cagacaggctagccagactcac

SEQ ID NO: 7066989 - DNA, 22 bp, Homo sapiens
cagacaggctagccagactcac

SEQ ID NO: 7066990 - DNA, 22 bp, Homo sapiens
cagacaggcaggtgagagctcc

SEQ ID NO: 7066991 - DNA, 22 bp, Homo sapiens
cagacaggcaggtgagagctcc

SEQ ID NO: 7066992 - DNA, 22 bp, Homo sapiens
cagacaggcaggtgctgctttg

SEQ ID NO: 7066993 - DNA, 22 bp, Homo sapiens
cagacaggcaggtgagagctcc

SEQ ID NO: 7066994 - DNA, 22 bp, Homo sapiens
cagacaggagactggatcatgg

SEQ ID NO: 7066995 - DNA, 22 bp, Homo sapiens
gggagcagcctgcctcccacct

SEQ ID NO: 7066996 - DNA, 19 bp, Homo sapiens
gggagcaggaaagctgtgg

SEQ ID NO: 7066997 - DNA, 22 bp, Homo sapiens
gggagcaggagcctgcctgcca

SEQ ID NO: 7066998 - DNA, 22 bp, Homo sapiens
cagacaggaattctggcgtggt

SEQ ID NO: 7066999 - DNA, 22 bp, Homo sapiens
cagacaggaagttcagaagaaa

SEQ ID NO: 7067000 - DNA, 22 bp, Homo sapiens
gggactgtccggcagaaggtac

SEQ ID NO: 7067001 - DNA, 22 bp, Homo sapiens
gggactgtcctacatggagagg

SEQ ID NO: 7067002 - DNA, 22 bp, Homo sapiens
cagaagtggcctcagagggagt

SEQ ID NO: 7067003 - DNA, 22 bp, Homo sapiens
cagaagtggcctcagagggagt

SEQ ID NO: 7067004 - DNA, 22 bp, Homo sapiens
cagaaggtttacactggactgt

SEQ ID NO: 7067005 - DNA, 22 bp, Homo sapiens
cagaagtaagattactgtgaga

SEQ ID NO: 7067006 - DNA, 22 bp, Homo sapiens
cagaagtaagattactgtgagt

SEQ ID NO: 7067007 - DNA, 21 bp, Homo sapiens
cagaagtaagggtaacttctc

SEQ ID NO: 7067008 - DNA, 22 bp, Homo sapiens
cactgggaatctgggaaagaga

SEQ ID NO: 7067009 - DNA, 22 bp, Homo sapiens
cactgggacctaggactgagct

SEQ ID NO: 7067010 - DNA, 22 bp, Homo sapiens
cagaaggcatagatgaaggcct

SEQ ID NO: 7067011 - DNA, 22 bp, Homo sapiens
cagaaggcatagatgaaggcct

SEQ ID NO: 7067012 - DNA, 22 bp, Homo sapiens
cagaaggctggcagattgagat

SEQ ID NO: 7067013 - DNA, 22 bp, Homo sapiens
cagaaggctttgtggagtagac

SEQ ID NO: 7067014 - DNA, 22 bp, Homo sapiens
gggacacagccatctgtgtttt

SEQ ID NO: 7067015 - DNA, 22 bp, Homo sapiens
gggacacaggtatctcaaatga

SEQ ID NO: 7067016 - DNA, 22 bp, Homo sapiens
gggactggccagggtttggaat

SEQ ID NO: 7067017 - DNA, 22 bp, Homo sapiens
gggactgggagatcctcctggc

SEQ ID NO: 7067018 - DNA, 19 bp, Homo sapiens
gggactggaggatgtggag

SEQ ID NO: 7067019 - DNA, 22 bp, Homo sapiens
gggactggaactactggtgcag

SEQ ID NO: 7067020 - DNA, 22 bp, Homo sapiens
gggactctgagagcctgagggt

SEQ ID NO: 7067021 - DNA, 22 bp, Homo sapiens
gggactggaactactggtgcag

SEQ ID NO: 7067022 - DNA, 23 bp, Homo sapiens
gggaagctccatggaggtgctgg

SEQ ID NO: 7067023 - DNA, 22 bp, Homo sapiens
gggaaggaaagttattagcaga

SEQ ID NO: 7067024 - DNA, 22 bp, Homo sapiens
gggaaggaaagttattagcaga

SEQ ID NO: 7067025 - DNA, 22 bp, Homo sapiens
gggaaggacacagccatgactg

SEQ ID NO: 7067026 - DNA, 22 bp, Homo sapiens
gggaaggacattctgggctcag

SEQ ID NO: 7067027 - DNA, 22 bp, Homo sapiens
gggaaggagcctgcttgctaga

SEQ ID NO: 7067028 - DNA, 22 bp, Homo sapiens
gggaaggagcctgcttgctaga

SEQ ID NO: 7067029 - DNA, 22 bp, Homo sapiens
gggaaggaggtggacctgcccc

SEQ ID NO: 7067030 - DNA, 22 bp, Homo sapiens
gggaaggaggtggcttgaagtg

SEQ ID NO: 7067031 - DNA, 22 bp, Homo sapiens
gggaaggaggtggcttgaagtg

SEQ ID NO: 7067032 - DNA, 22 bp, Homo sapiens
gggcagagaaatggacagttgg

SEQ ID NO: 7067033 - DNA, 22 bp, Homo sapiens
gggcagagaaatggacagttgg

SEQ ID NO: 7067034 - DNA, 22 bp, Homo sapiens
gggcagagaaatggacagttgg

SEQ ID NO: 7067035 - DNA, 22 bp, Homo sapiens
cagagcccagggcctacgtccc

SEQ ID NO: 7067036 - DNA, 22 bp, Homo sapiens
cagagcccagggcctacgtccc

SEQ ID NO: 7067037 - DNA, 22 bp, Homo sapiens
cagagcccatcctatactctcc

SEQ ID NO: 7067038 - DNA, 22 bp, Homo sapiens
gggcacagaagtctaagacatc

SEQ ID NO: 7067039 - DNA, 22 bp, Homo sapiens
gggcacagaagtctaagacatc

SEQ ID NO: 7067040 - DNA, 22 bp, Homo sapiens
gggcacagagggtcttgaagaa

SEQ ID NO: 7067041 - DNA, 22 bp, Homo sapiens
gggcactgtgctgggtgcttta

SEQ ID NO: 7067042 - DNA, 22 bp, Homo sapiens
gggcactgtggggcccatgctg

SEQ ID NO: 7067043 - DNA, 22 bp, Homo sapiens
gggcactgtgttcagagtgcag

SEQ ID NO: 7067044 - DNA, 22 bp, Homo sapiens
gggcactgtgttcagagtgcag

SEQ ID NO: 7067045 - DNA, 22 bp, Homo sapiens
gggcactgtgttcagagtgcag

SEQ ID NO: 7067046 - DNA, 22 bp, Homo sapiens
cagagcccctcagctctctccc

SEQ ID NO: 7067047 - DNA, 22 bp, Homo sapiens
cagagcccctcagctctctccc

SEQ ID NO: 7067048 - DNA, 22 bp, Homo sapiens
cagagcccctcagctctctccc

SEQ ID NO: 7067049 - DNA, 22 bp, Homo sapiens
cagagcccctcgtctccaccac

SEQ ID NO: 7067050 - DNA, 22 bp, Homo sapiens
cagagccctagtcctgatggcc

SEQ ID NO: 7067051 - DNA, 22 bp, Homo sapiens
cagagccctgtgtgccatgtga

SEQ ID NO: 7067052 - DNA, 22 bp, Homo sapiens
gggcgagggcgaaagcgagagc

SEQ ID NO: 7067053 - DNA, 21 bp, Homo sapiens
gggcgaggcctgatgtggctc

SEQ ID NO: 7067054 - DNA, 22 bp, Homo sapiens
ggggaacaccgggcagaggcgc

SEQ ID NO: 7067055 - DNA, 20 bp, Homo sapiens
ggggaagaaaaggatgtgat

SEQ ID NO: 7067056 - DNA, 22 bp, Homo sapiens
gggctgtgtactatgaggaggg

SEQ ID NO: 7067057 - DNA, 23 bp, Homo sapiens
ggggaaagaccatgcttgaggac

SEQ ID NO: 7067058 - DNA, 22 bp, Homo sapiens
cagagctgcagattgaaggcat

SEQ ID NO: 7067059 - DNA, 22 bp, Homo sapiens
cagagctgcgctttttcctggt

SEQ ID NO: 7067060 - DNA, 22 bp, Homo sapiens
cagagctgcgctttttcctggt

SEQ ID NO: 7067061 - DNA, 22 bp, Homo sapiens
cagagctgctcatggtggccag

SEQ ID NO: 7067062 - DNA, 19 bp, Homo sapiens
cagagctgctggcctcgtc

SEQ ID NO: 7067063 - DNA, 22 bp, Homo sapiens
cagagctgcaaatgcccctccg

SEQ ID NO: 7067064 - DNA, 22 bp, Homo sapiens
cagagctgagtcttcaaggttg

SEQ ID NO: 7067065 - DNA, 22 bp, Homo sapiens
gggcgccgtgggaaacagccgg

SEQ ID NO: 7067066 - DNA, 22 bp, Homo sapiens
gggcgccgtgggaaacagccgg

SEQ ID NO: 7067067 - DNA, 22 bp, Homo sapiens
cagaggtggggagtatttcaag

SEQ ID NO: 7067068 - DNA, 21 bp, Homo sapiens
cagaggtggcctgacctctga

SEQ ID NO: 7067069 - DNA, 22 bp, Homo sapiens
cagaggtagggagctatgttat

SEQ ID NO: 7067070 - DNA, 22 bp, Homo sapiens
cagaggtgtacagagggaggcc

SEQ ID NO: 7067071 - DNA, 22 bp, Homo sapiens
cagaggtgtacagagggaggcc

SEQ ID NO: 7067072 - DNA, 23 bp, Homo sapiens
cagaggtgtcagtgcccagtgtc

SEQ ID NO: 7067073 - DNA, 23 bp, Homo sapiens
cagaggtgtcagtgcccagtgtc

SEQ ID NO: 7067074 - DNA, 22 bp, Homo sapiens
cagaggtgttggtgaatggaga

SEQ ID NO: 7067075 - DNA, 22 bp, Homo sapiens
cagaggttacctagagcaagaa

SEQ ID NO: 7067076 - DNA, 22 bp, Homo sapiens
cagaggtttgatcgagtaggtc

SEQ ID NO: 7067077 - DNA, 22 bp, Homo sapiens
cagagtaaacctgtcatcaaga

SEQ ID NO: 7067078 - DNA, 22 bp, Homo sapiens
cagaggcttggcattatcatgc

SEQ ID NO: 7067079 - DNA, 22 bp, Homo sapiens
cagaggctttgccctggaaacc

SEQ ID NO: 7067080 - DNA, 22 bp, Homo sapiens
cagaggctgtgtaggcagactg

SEQ ID NO: 7067081 - DNA, 22 bp, Homo sapiens
cagaggctgtgtaggcagactg

SEQ ID NO: 7067082 - DNA, 22 bp, Homo sapiens
cagaggcttatacctgattagg

SEQ ID NO: 7067083 - DNA, 22 bp, Homo sapiens
cagaggcttcaagtcattctcc

SEQ ID NO: 7067084 - DNA, 22 bp, Homo sapiens
cagaggctgtgtaggcagactg

SEQ ID NO: 7067085 - DNA, 22 bp, Homo sapiens
cagaggctgggacctcaggcat

SEQ ID NO: 7067086 - DNA, 22 bp, Homo sapiens
cagaggctggatggacttgcct

SEQ ID NO: 7067087 - DNA, 22 bp, Homo sapiens
cagaggctggcggccgccccga

SEQ ID NO: 7067088 - DNA, 22 bp, Homo sapiens
cagaggctgggacctcaggcat

SEQ ID NO: 7067089 - DNA, 22 bp, Homo sapiens
cagaggctgggacctcaggcat

SEQ ID NO: 7067090 - DNA, 22 bp, Homo sapiens
cagaggctgggacctcaggcat

SEQ ID NO: 7067091 - DNA, 22 bp, Homo sapiens
gggtctaggagacatgggcaag

SEQ ID NO: 7067092 - DNA, 22 bp, Homo sapiens
gggtgcagggtctccagcagct

SEQ ID NO: 7067093 - DNA, 22 bp, Homo sapiens
cagaggctgctctgggtggcat

SEQ ID NO: 7067094 - DNA, 22 bp, Homo sapiens
cagaggctgctctgggtggcat

SEQ ID NO: 7067095 - DNA, 22 bp, Homo sapiens
cagaggctggatggacttgcct

SEQ ID NO: 7067096 - DNA, 22 bp, Homo sapiens
cagagctggtgtgtcctggcat

SEQ ID NO: 7067097 - DNA, 20 bp, Homo sapiens
ggggaagaaaaggatgtgat

SEQ ID NO: 7067098 - DNA, 22 bp, Homo sapiens
cagagctggtgttacaagtcca

SEQ ID NO: 7067099 - DNA, 21 bp, Homo sapiens
cagaggcaggctctgtgtgtg

SEQ ID NO: 7067100 - DNA, 20 bp, Homo sapiens
cagaggcattttcagactct

SEQ ID NO: 7067101 - DNA, 22 bp, Homo sapiens
cagaggcccagtgagagggctg

SEQ ID NO: 7067102 - DNA, 22 bp, Homo sapiens
cagaggccccagaactagctct

SEQ ID NO: 7067103 - DNA, 22 bp, Homo sapiens
cagaggcctcacttccagccag

SEQ ID NO: 7067104 - DNA, 21 bp, Homo sapiens
cagaggcctcatgctctgtgc

SEQ ID NO: 7067105 - DNA, 22 bp, Homo sapiens
caacatataatatttgagttct

SEQ ID NO: 7067106 - DNA, 22 bp, Homo sapiens
caacattatatagccacatgcc

SEQ ID NO: 7067107 - DNA, 22 bp, Homo sapiens
caacatttcaaggtctttagga

SEQ ID NO: 7067108 - DNA, 22 bp, Homo sapiens
caacatttcaaggtctttagga

SEQ ID NO: 7067109 - DNA, 22 bp, Homo sapiens
gctgcagtgagccaagatcgtg

SEQ ID NO: 7067110 - DNA, 22 bp, Homo sapiens
gctgcagtgagccaagatcgtg

SEQ ID NO: 7067111 - DNA, 21 bp, Homo sapiens
gctgcatcaatctacccaggg

SEQ ID NO: 7067112 - DNA, 22 bp, Homo sapiens
gctgcaggtttgtctagtctgg

SEQ ID NO: 7067113 - DNA, 21 bp, Homo sapiens
gctgccaccgcgtgctccagg

SEQ ID NO: 7067114 - DNA, 22 bp, Homo sapiens
gctgccaccgtggagatgagtg

SEQ ID NO: 7067115 - DNA, 19 bp, Homo sapiens
caacagtactggtttgtcc

SEQ ID NO: 7067116 - DNA, 22 bp, Homo sapiens
gctgcagccaaattcattgtca

SEQ ID NO: 7067117 - DNA, 22 bp, Homo sapiens
gctgcagcagaagttctcagag

SEQ ID NO: 7067118 - DNA, 22 bp, Homo sapiens
gctgcagagggaggggctcgca

SEQ ID NO: 7067119 - DNA, 22 bp, Homo sapiens
gctgcagagacagctgccgatg

SEQ ID NO: 7067120 - DNA, 22 bp, Homo sapiens
gctgaggtggaggaaggagacc

SEQ ID NO: 7067121 - DNA, 20 bp, Homo sapiens
gctgaggtggaggaaggaga

SEQ ID NO: 7067122 - DNA, 22 bp, Homo sapiens
caaaggttatgaaccacttgta

SEQ ID NO: 7067123 - DNA, 22 bp, Homo sapiens
caaaggttggaaatgtttacca

SEQ ID NO: 7067124 - DNA, 22 bp, Homo sapiens
caaaggttgttgagagtgcagg

SEQ ID NO: 7067125 - DNA, 22 bp, Homo sapiens
caaaggtttcacagtagcccat

SEQ ID NO: 7067126 - DNA, 22 bp, Homo sapiens
caaagtatattggattgaatgg

SEQ ID NO: 7067127 - DNA, 22 bp, Homo sapiens
gctcctcttctcccactgaatg

SEQ ID NO: 7067128 - DNA, 22 bp, Homo sapiens
gctcctgcagagatgttccatg

SEQ ID NO: 7067129 - DNA, 22 bp, Homo sapiens
gctcctgcaggacccaggagac

SEQ ID NO: 7067130 - DNA, 17 bp, Homo sapiens
gctcctgcaggtcagga

SEQ ID NO: 7067131 - DNA, 22 bp, Homo sapiens
caaggaggaagatgcaggggac

SEQ ID NO: 7067132 - DNA, 22 bp, Homo sapiens
caaggaggcagtgggacttgaa

SEQ ID NO: 7067133 - DNA, 22 bp, Homo sapiens
caaggagataaaatgttgagct

SEQ ID NO: 7067134 - DNA, 22 bp, Homo sapiens
caaggacactgatgttcatcct

SEQ ID NO: 7067135 - DNA, 22 bp, Homo sapiens
caaggacactgatgttcatcct

SEQ ID NO: 7067136 - DNA, 22 bp, Homo sapiens
caaggagaaaacggcttctgaa

SEQ ID NO: 7067137 - DNA, 22 bp, Homo sapiens
caagatgcccctggtagggatc

SEQ ID NO: 7067138 - DNA, 22 bp, Homo sapiens
caagatggagaagcagcaaggg

SEQ ID NO: 7067139 - DNA, 22 bp, Homo sapiens
caaggaagttttaggagaggaa

SEQ ID NO: 7067140 - DNA, 22 bp, Homo sapiens
caaggacactccctgctgggca

SEQ ID NO: 7067141 - DNA, 22 bp, Homo sapiens
caaggacactgagctttgtaaa

SEQ ID NO: 7067142 - DNA, 22 bp, Homo sapiens
caagatatcaatgacatagtat

SEQ ID NO: 7067143 - DNA, 22 bp, Homo sapiens
caagatcaaggtatcagcagat

SEQ ID NO: 7067144 - DNA, 22 bp, Homo sapiens
caagatcaaggtgtcagcaggt

SEQ ID NO: 7067145 - DNA, 22 bp, Homo sapiens
caagatgaaactacagggagga

SEQ ID NO: 7067146 - DNA, 22 bp, Homo sapiens
caagatgacaaggctggaggct

SEQ ID NO: 7067147 - DNA, 22 bp, Homo sapiens
caagatgatccctgaaggcagc

SEQ ID NO: 7067148 - DNA, 22 bp, Homo sapiens
caagagctttagaaatgctcat

SEQ ID NO: 7067149 - DNA, 22 bp, Homo sapiens
caagaggcaaattgtctagaag

SEQ ID NO: 7067150 - DNA, 22 bp, Homo sapiens
caagaggctaaactgggctatt

SEQ ID NO: 7067151 - DNA, 22 bp, Homo sapiens
gctgctggccccacatgctcca

SEQ ID NO: 7067152 - DNA, 22 bp, Homo sapiens
caagagctcaccggagagcatt

SEQ ID NO: 7067153 - DNA, 22 bp, Homo sapiens
caagagctgaggctggagaggt

SEQ ID NO: 7067154 - DNA, 22 bp, Homo sapiens
gctgctggcactggagtgagcc

SEQ ID NO: 7067155 - DNA, 22 bp, Homo sapiens
gctgccttttgctcctcccacc

SEQ ID NO: 7067156 - DNA, 20 bp, Homo sapiens
gctgccttgtcctgcttggt

SEQ ID NO: 7067157 - DNA, 22 bp, Homo sapiens
gctgccttcccaggcctttgct

SEQ ID NO: 7067158 - DNA, 22 bp, Homo sapiens
gctgcctgccttgcctggagga

SEQ ID NO: 7067159 - DNA, 22 bp, Homo sapiens
caactacaggaaaagtcattca

SEQ ID NO: 7067160 - DNA, 22 bp, Homo sapiens
caactacatccacactttgtta

SEQ ID NO: 7067161 - DNA, 18 bp, Homo sapiens
cacaatttacagatgaca

SEQ ID NO: 7067162 - DNA, 22 bp, Homo sapiens
cacaatttccaagtcatgttat

SEQ ID NO: 7067163 - DNA, 22 bp, Homo sapiens
cacaatttccttgcttcacttt

SEQ ID NO: 7067164 - DNA, 22 bp, Homo sapiens
cacaatttggacttcactggtt

SEQ ID NO: 7067165 - DNA, 22 bp, Homo sapiens
cacacatcaacctagacattgt

SEQ ID NO: 7067166 - DNA, 22 bp, Homo sapiens
cacacattagagccaatgtcag

SEQ ID NO: 7067167 - DNA, 22 bp, Homo sapiens
cacacattccaaaatcaagggt

SEQ ID NO: 7067168 - DNA, 22 bp, Homo sapiens
cacacattgaattcattcttgt

SEQ ID NO: 7067169 - DNA, 22 bp, Homo sapiens
cacacattggttttactccttt

SEQ ID NO: 7067170 - DNA, 22 bp, Homo sapiens
cacacatttcagatgctacaat

SEQ ID NO: 7067171 - DNA, 22 bp, Homo sapiens
cacacatttcagatgctacaat

SEQ ID NO: 7067172 - DNA, 21 bp, Homo sapiens
cacaccaaacaggaacaggga

SEQ ID NO: 7067173 - DNA, 19 bp, Homo sapiens
cacacccatgcttgccaag

SEQ ID NO: 7067174 - DNA, 22 bp, Homo sapiens
cacacctgtaataccagctact

SEQ ID NO: 7067175 - DNA, 22 bp, Homo sapiens
cacaagtcattttcagcaggct

SEQ ID NO: 7067176 - DNA, 22 bp, Homo sapiens
ggaaaaggccacagggacacat

SEQ ID NO: 7067177 - DNA, 22 bp, Homo sapiens
cacaaaatatcaagcactttta

SEQ ID NO: 7067178 - DNA, 22 bp, Homo sapiens
cacaaaatctttctcgattatt

SEQ ID NO: 7067179 - DNA, 22 bp, Homo sapiens
ggaaaactgtatttgaataact

SEQ ID NO: 7067180 - DNA, 21 bp, Homo sapiens
ggaaaactttccttgtctgaa

SEQ ID NO: 7067181 - DNA, 22 bp, Homo sapiens
caaggcagctattgtctccata

SEQ ID NO: 7067182 - DNA, 22 bp, Homo sapiens
caaggcagcgttcctttctgga

SEQ ID NO: 7067183 - DNA, 22 bp, Homo sapiens
caaggcagaattcagactcagg

SEQ ID NO: 7067184 - DNA, 20 bp, Homo sapiens
caaggcagaccagagtgagt

SEQ ID NO: 7067185 - DNA, 22 bp, Homo sapiens
gctgtctgagaacatggtggaa

SEQ ID NO: 7067186 - DNA, 22 bp, Homo sapiens
gctgtctgagaacatggtggaa

SEQ ID NO: 7067187 - DNA, 22 bp, Homo sapiens
gctgtctgcatctctagagctt

SEQ ID NO: 7067188 - DNA, 22 bp, Homo sapiens
gctgtgcttgggaagaatctct

SEQ ID NO: 7067189 - DNA, 22 bp, Homo sapiens
gcttggcattgaccattatcat

SEQ ID NO: 7067190 - DNA, 22 bp, Homo sapiens
gcttctcttaatgcctggcttt

SEQ ID NO: 7067191 - DNA, 22 bp, Homo sapiens
gcttctctttctcccctggcgg

SEQ ID NO: 7067192 - DNA, 22 bp, Homo sapiens
gcttctctttctcccctggcgg

SEQ ID NO: 7067193 - DNA, 22 bp, Homo sapiens
gcttggccagcagccgggatgc

SEQ ID NO: 7067194 - DNA, 22 bp, Homo sapiens
gcttggctgtgagctttgctgt

SEQ ID NO: 7067195 - DNA, 22 bp, Homo sapiens
caatttctcgaactctaatcca

SEQ ID NO: 7067196 - DNA, 22 bp, Homo sapiens
caatttctctttatatctcaca

SEQ ID NO: 7067197 - DNA, 22 bp, Homo sapiens
gctgtggcctggcgcagagctg

SEQ ID NO: 7067198 - DNA, 22 bp, Homo sapiens
gcttctctggctggtctgccac

SEQ ID NO: 7067199 - DNA, 22 bp, Homo sapiens
gcttctcttaatgcctggcttt

SEQ ID NO: 7067200 - DNA, 22 bp, Homo sapiens
ggctagggatctagaccaggac

SEQ ID NO: 7067201 - DNA, 22 bp, Homo sapiens
ggctatggaaatggcaggacat

SEQ ID NO: 7067202 - DNA, 22 bp, Homo sapiens
ggctatggaagataaggctgaa

SEQ ID NO: 7067203 - DNA, 22 bp, Homo sapiens
ggctatggcaaagaactcagat

SEQ ID NO: 7067204 - DNA, 22 bp, Homo sapiens
ggctcaagcagtctgcctgcct

SEQ ID NO: 7067205 - DNA, 22 bp, Homo sapiens
ggctcaatgcaacttctgcctc

SEQ ID NO: 7067206 - DNA, 22 bp, Homo sapiens
ggctagggagacagagggcatg

SEQ ID NO: 7067207 - DNA, 22 bp, Homo sapiens
ggctagggagacagagggcatg

SEQ ID NO: 7067208 - DNA, 22 bp, Homo sapiens
ggctagggactcctcctcaggg

SEQ ID NO: 7067209 - DNA, 21 bp, Homo sapiens
cactggaattttctgtgacat

SEQ ID NO: 7067210 - DNA, 22 bp, Homo sapiens
cactggaccaaggaaactcttc

SEQ ID NO: 7067211 - DNA, 22 bp, Homo sapiens
cactggaatgttgaggagacaa

SEQ ID NO: 7067212 - DNA, 22 bp, Homo sapiens
cactggaggtcagtggagcact

SEQ ID NO: 7067213 - DNA, 22 bp, Homo sapiens
cactggcaaatggagagaatgt

SEQ ID NO: 7067214 - DNA, 22 bp, Homo sapiens
cactggcattagtcacgaggca

SEQ ID NO: 7067215 - DNA, 22 bp, Homo sapiens
cactggaatggatagagcagag

SEQ ID NO: 7067216 - DNA, 22 bp, Homo sapiens
cactggaaccatccacatagtg

SEQ ID NO: 7067217 - DNA, 22 bp, Homo sapiens
ggctcaatgcaacttctgcctc

SEQ ID NO: 7067218 - DNA, 22 bp, Homo sapiens
cactgagaccagagtccctgac

SEQ ID NO: 7067219 - DNA, 23 bp, Homo sapiens
ggcctcctggtctaggctagact

SEQ ID NO: 7067220 - DNA, 22 bp, Homo sapiens
cactgaggctgggggagaaggt

SEQ ID NO: 7067221 - DNA, 22 bp, Homo sapiens
ggcctcgcggcttctggtggct

SEQ ID NO: 7067222 - DNA, 22 bp, Homo sapiens
ggcctctcatgtcctgggcttc

SEQ ID NO: 7067223 - DNA, 22 bp, Homo sapiens
cactgcactccatcctgggaaa

SEQ ID NO: 7067224 - DNA, 22 bp, Homo sapiens
cactgcagcaccatgcagggct

SEQ ID NO: 7067225 - DNA, 22 bp, Homo sapiens
cactgcagcaccatgcagggct

SEQ ID NO: 7067226 - DNA, 23 bp, Homo sapiens
cactgcagcgtggtctggcagga

SEQ ID NO: 7067227 - DNA, 23 bp, Homo sapiens
cactgcagcgtggtctggcagga

SEQ ID NO: 7067228 - DNA, 22 bp, Homo sapiens
caccccagtctaaaaccagcct

SEQ ID NO: 7067229 - DNA, 22 bp, Homo sapiens
caccccagcttctcaggataga

SEQ ID NO: 7067230 - DNA, 22 bp, Homo sapiens
caccccagcttctcaggataga

SEQ ID NO: 7067231 - DNA, 22 bp, Homo sapiens
cacccagtgaaggagcaagagg

SEQ ID NO: 7067232 - DNA, 22 bp, Homo sapiens
cacccagttgactacaaagggg

SEQ ID NO: 7067233 - DNA, 22 bp, Homo sapiens
ggcagtttcatcaggagaaaag

SEQ ID NO: 7067234 - DNA, 22 bp, Homo sapiens
ggcagtttctcaggcaggggta

SEQ ID NO: 7067235 - DNA, 22 bp, Homo sapiens
ggcatagatttctttaggttta

SEQ ID NO: 7067236 - DNA, 22 bp, Homo sapiens
cacccaggttggagtgcagtgg

SEQ ID NO: 7067237 - DNA, 20 bp, Homo sapiens
caccctcccagcacctatgc

SEQ ID NO: 7067238 - DNA, 20 bp, Homo sapiens
caccctcccagcacctatgc

SEQ ID NO: 7067239 - DNA, 22 bp, Homo sapiens
caccctcccgtcagcccctggg

SEQ ID NO: 7067240 - DNA, 22 bp, Homo sapiens
caccctgctacaaagcctcctg

SEQ ID NO: 7067241 - DNA, 22 bp, Homo sapiens
caccctgctctgctgtgcggcc

SEQ ID NO: 7067242 - DNA, 22 bp, Homo sapiens
caccatgactggttgagagagg

SEQ ID NO: 7067243 - DNA, 22 bp, Homo sapiens
caccattttctaaaaatatgac

SEQ ID NO: 7067244 - DNA, 22 bp, Homo sapiens
cacccacatggaaattcacagt

SEQ ID NO: 7067245 - DNA, 22 bp, Homo sapiens
cacccacattccatcactctgc

SEQ ID NO: 7067246 - DNA, 20 bp, Homo sapiens
ggcagttaaggcacagtcat

SEQ ID NO: 7067247 - DNA, 22 bp, Homo sapiens
ggcagccagagggcagctggat

SEQ ID NO: 7067248 - DNA, 22 bp, Homo sapiens
caccaggctggagtgcagtggc

SEQ ID NO: 7067249 - DNA, 22 bp, Homo sapiens
caccaggctggagtgcagtggc

SEQ ID NO: 7067250 - DNA, 22 bp, Homo sapiens
cacagcttgggctctgacaata

SEQ ID NO: 7067251 - DNA, 22 bp, Homo sapiens
cacagcttgtttagtgactcac

SEQ ID NO: 7067252 - DNA, 22 bp, Homo sapiens
cacagcttctccccgctgcggc

SEQ ID NO: 7067253 - DNA, 22 bp, Homo sapiens
cacagcttctccttgatatcgc

SEQ ID NO: 7067254 - DNA, 22 bp, Homo sapiens
cacagcttctgagtgaggattt

SEQ ID NO: 7067255 - DNA, 22 bp, Homo sapiens
cacagcttctgagtgaggattt

SEQ ID NO: 7067256 - DNA, 22 bp, Homo sapiens
cacagcttctgtctgacccatg

SEQ ID NO: 7067257 - DNA, 22 bp, Homo sapiens
cacagcttcttccattccactc

SEQ ID NO: 7067258 - DNA, 20 bp, Homo sapiens
cacagcttgccttttatgac

SEQ ID NO: 7067259 - DNA, 20 bp, Homo sapiens
cacagcttgccttttatgac

SEQ ID NO: 7067260 - DNA, 22 bp, Homo sapiens
cacagcttgggctctgacaata

SEQ ID NO: 7067261 - DNA, 22 bp, Homo sapiens
ggaggcgcggctcggctgtgcc

SEQ ID NO: 7067262 - DNA, 22 bp, Homo sapiens
ggaggcggaagttgcagtgagc

SEQ ID NO: 7067263 - DNA, 22 bp, Homo sapiens
ggaggcggaagttgcagtgagc

SEQ ID NO: 7067264 - DNA, 22 bp, Homo sapiens
ggaggcggacacaggtagtgtt

SEQ ID NO: 7067265 - DNA, 22 bp, Homo sapiens
ggaggcggagcttgcagtgagc

SEQ ID NO: 7067266 - DNA, 22 bp, Homo sapiens
ggaggcggagcttgcagtgagc

SEQ ID NO: 7067267 - DNA, 22 bp, Homo sapiens
ggaggcggaggctgcagtgagc

SEQ ID NO: 7067268 - DNA, 22 bp, Homo sapiens
cacagcttagaaaagaagccat

SEQ ID NO: 7067269 - DNA, 22 bp, Homo sapiens
cacagcttatgccactgattgg

SEQ ID NO: 7067270 - DNA, 22 bp, Homo sapiens
cacagcttatgccactgattgg

SEQ ID NO: 7067271 - DNA, 22 bp, Homo sapiens
cacagcttcagtttctgacttg

SEQ ID NO: 7067272 - DNA, 22 bp, Homo sapiens
cacagcttccattagaatgaga

SEQ ID NO: 7067273 - DNA, 22 bp, Homo sapiens
cacagcttccattagaatgaga

SEQ ID NO: 7067274 - DNA, 22 bp, Homo sapiens
cacagcttcccaaagtggacct

SEQ ID NO: 7067275 - DNA, 22 bp, Homo sapiens
cacagcttcccgtgcatggaga

SEQ ID NO: 7067276 - DNA, 22 bp, Homo sapiens
cacactcattagtcatttctct

SEQ ID NO: 7067277 - DNA, 22 bp, Homo sapiens
cacactcattagtcatttctct

SEQ ID NO: 7067278 - DNA, 22 bp, Homo sapiens
cacactgtcaggtaaataacac

SEQ ID NO: 7067279 - DNA, 22 bp, Homo sapiens
cacactgtccccttctccccag

SEQ ID NO: 7067280 - DNA, 22 bp, Homo sapiens
cacagctggtgcactagctctg

SEQ ID NO: 7067281 - DNA, 22 bp, Homo sapiens
ggaggcggaggctgcagtgagc

SEQ ID NO: 7067282 - DNA, 22 bp, Homo sapiens
ggaggcggaggttgcagtgagc

SEQ ID NO: 7067283 - DNA, 22 bp, Homo sapiens
ggagggagtcagctgattagaa

SEQ ID NO: 7067284 - DNA, 22 bp, Homo sapiens
ggatgtagtgcaaggagtgaat

SEQ ID NO: 7067285 - DNA, 22 bp, Homo sapiens
ggatgtgaatctgggctgagac

SEQ ID NO: 7067286 - DNA, 22 bp, Homo sapiens
ggatgttctggggttctcttgt

SEQ ID NO: 7067287 - DNA, 22 bp, Homo sapiens
ggatgttctggggttctcttgt

SEQ ID NO: 7067288 - DNA, 22 bp, Homo sapiens
cacagggaggcggtcactggct

SEQ ID NO: 7067289 - DNA, 22 bp, Homo sapiens
ggcacagggaggccctggtgtg

SEQ ID NO: 7067290 - DNA, 22 bp, Homo sapiens
ggcacagggggctgaggactag

SEQ ID NO: 7067291 - DNA, 22 bp, Homo sapiens
ggcacagggaggccctggtgtg

SEQ ID NO: 7067292 - DNA, 22 bp, Homo sapiens
ggcacagggtgatgttgcagtt

SEQ ID NO: 7067293 - DNA, 22 bp, Homo sapiens
ggcacagggtgatgttgcagtt

SEQ ID NO: 7067294 - DNA, 22 bp, Homo sapiens
ggcacagggtgatgttgcagtt

SEQ ID NO: 7067295 - DNA, 22 bp, Homo sapiens
cacagggcagagacctgggtgc

SEQ ID NO: 7067296 - DNA, 22 bp, Homo sapiens
cacagggcaggccccaggcctc

SEQ ID NO: 7067297 - DNA, 22 bp, Homo sapiens
ggcacagggagccgcagttgca

SEQ ID NO: 7067298 - DNA, 22 bp, Homo sapiens
ggcagagccttctggagctcgc

SEQ ID NO: 7067299 - DNA, 22 bp, Homo sapiens
ggcagagccttctggagctcgc

SEQ ID NO: 7067300 - DNA, 22 bp, Homo sapiens
ggcagagcagccccagggtttg

SEQ ID NO: 7067301 - DNA, 22 bp, Homo sapiens
ggcactgggagaggtgagacgg

SEQ ID NO: 7067302 - DNA, 22 bp, Homo sapiens
ggcactgggaatgcagtgatga

SEQ ID NO: 7067303 - DNA, 22 bp, Homo sapiens
ggcacatggagacttggcatca

SEQ ID NO: 7067304 - DNA, 22 bp, Homo sapiens
ggcacatgtatgtgggagtgtg

SEQ ID NO: 7067305 - DNA, 22 bp, Homo sapiens
ggcacatgtatgtgggagtgtg

SEQ ID NO: 7067306 - DNA, 17 bp, Homo sapiens
ggcagagctgacagggc

SEQ ID NO: 7067307 - DNA, 22 bp, Homo sapiens
ggcagagctgcatgagcactca

SEQ ID NO: 7067308 - DNA, 22 bp, Homo sapiens
ggcagagcgcatgcgtcgcaga

SEQ ID NO: 7067309 - DNA, 22 bp, Homo sapiens
ggcagagctagtggcttctctt

SEQ ID NO: 7067310 - DNA, 22 bp, Homo sapiens
ggcagagcttgcagtgagccga

SEQ ID NO: 7067311 - DNA, 20 bp, Homo sapiens
ggcagccaatcagcgtgccg

SEQ ID NO: 7067312 - DNA, 20 bp, Homo sapiens
ggcagccaatcagcgtgccg

SEQ ID NO: 7067313 - DNA, 22 bp, Homo sapiens
ggcagccaccctgggaggcaga

SEQ ID NO: 7067314 - DNA, 22 bp, Homo sapiens
ggcagccagagggcagctggat

SEQ ID NO: 7067315 - DNA, 22 bp, Homo sapiens
atttccttgcaagtttctgtaa

SEQ ID NO: 7067316 - DNA, 22 bp, Homo sapiens
atttcatgtgaagaagagataa

SEQ ID NO: 7067317 - DNA, 22 bp, Homo sapiens
atttcatgtgaagaagagataa

SEQ ID NO: 7067318 - DNA, 22 bp, Homo sapiens
atttcctagcctctcttgcagt

SEQ ID NO: 7067319 - DNA, 22 bp, Homo sapiens
atttcctagggtagatgtcaca

SEQ ID NO: 7067320 - DNA, 22 bp, Homo sapiens
atttcctaggtgctcgagtgct

SEQ ID NO: 7067321 - DNA, 22 bp, Homo sapiens
atttcctttgcaaagactgtgc

SEQ ID NO: 7067322 - DNA, 18 bp, Homo sapiens
atttctactactataaag

SEQ ID NO: 7067323 - DNA, 22 bp, Homo sapiens
atttctactgtgagaaacatga

SEQ ID NO: 7067324 - DNA, 21 bp, Homo sapiens
atttcatggtgcttttaagaa

SEQ ID NO: 7067325 - DNA, 22 bp, Homo sapiens
atttcatgagttattatagtgg

SEQ ID NO: 7067326 - DNA, 22 bp, Homo sapiens
atttcagcccagtatgagcccc

SEQ ID NO: 7067327 - DNA, 19 bp, Homo sapiens
gccaggcctggacctgcag

SEQ ID NO: 7067328 - DNA, 22 bp, Homo sapiens
atttcacaaaccatcctgattt

SEQ ID NO: 7067329 - DNA, 22 bp, Homo sapiens
atttcagaatgtcctaatttag

SEQ ID NO: 7067330 - DNA, 22 bp, Homo sapiens
gccaggagtgtgtggctatgtt

SEQ ID NO: 7067331 - DNA, 22 bp, Homo sapiens
gccaggagtgtcccactcattt

SEQ ID NO: 7067332 - DNA, 20 bp, Homo sapiens
gccaggagggtgtgatgagc

SEQ ID NO: 7067333 - DNA, 22 bp, Homo sapiens
atttagaaattccaaaagtatt

SEQ ID NO: 7067334 - DNA, 22 bp, Homo sapiens
atttagaaccccttccaacctg

SEQ ID NO: 7067335 - DNA, 22 bp, Homo sapiens
atttagaactttgtttgccaat

SEQ ID NO: 7067336 - DNA, 22 bp, Homo sapiens
atttagaactttgtttgccaat

SEQ ID NO: 7067337 - DNA, 22 bp, Homo sapiens
atttagaagctaatttttcaga

SEQ ID NO: 7067338 - DNA, 22 bp, Homo sapiens
gccaggagggaaaggacaattt

SEQ ID NO: 7067339 - DNA, 22 bp, Homo sapiens
gccaggaggcttaactggacag

SEQ ID NO: 7067340 - DNA, 22 bp, Homo sapiens
gccaggaggcttaactggacag

SEQ ID NO: 7067341 - DNA, 22 bp, Homo sapiens
gccagctggctgcaggtcccag

SEQ ID NO: 7067342 - DNA, 21 bp, Homo sapiens
atttacaaaacagtcccttcc

SEQ ID NO: 7067343 - DNA, 22 bp, Homo sapiens
atttacacattcataagatttc

SEQ ID NO: 7067344 - DNA, 22 bp, Homo sapiens
atttaattttctcaacagtgct

SEQ ID NO: 7067345 - DNA, 22 bp, Homo sapiens
atttaattttctcaacagtgct

SEQ ID NO: 7067346 - DNA, 21 bp, Homo sapiens
atttacaaaacagtcccttcc

SEQ ID NO: 7067347 - DNA, 22 bp, Homo sapiens
atttaatttacatttgacagag

SEQ ID NO: 7067348 - DNA, 22 bp, Homo sapiens
atttaaattttctgatggagag

SEQ ID NO: 7067349 - DNA, 22 bp, Homo sapiens
atttaaattttctgatggagag

SEQ ID NO: 7067350 - DNA, 22 bp, Homo sapiens
attggaaatacagtagaaaaat

SEQ ID NO: 7067351 - DNA, 22 bp, Homo sapiens
attgcttatctatctttaagtc

SEQ ID NO: 7067352 - DNA, 22 bp, Homo sapiens
attgcttttgagctagaatttt

SEQ ID NO: 7067353 - DNA, 22 bp, Homo sapiens
gcctggagctactggacactga

SEQ ID NO: 7067354 - DNA, 22 bp, Homo sapiens
gcctggagctcatgtgggcatt

SEQ ID NO: 7067355 - DNA, 19 bp, Homo sapiens
gcctctgagggcaggacac

SEQ ID NO: 7067356 - DNA, 18 bp, Homo sapiens
gcctgcctagagcttgcc

SEQ ID NO: 7067357 - DNA, 18 bp, Homo sapiens
gcctgcctagagcttgcc

SEQ ID NO: 7067358 - DNA, 18 bp, Homo sapiens
gcctgctctgctctcccc

SEQ ID NO: 7067359 - DNA, 22 bp, Homo sapiens
gcctgctctggaatccatgtaa

SEQ ID NO: 7067360 - DNA, 22 bp, Homo sapiens
gcctgctggaggagcctcaggg

SEQ ID NO: 7067361 - DNA, 22 bp, Homo sapiens
atttctcacaaagttgcttatc

SEQ ID NO: 7067362 - DNA, 22 bp, Homo sapiens
atttctcagtgaaatgacaggc

SEQ ID NO: 7067363 - DNA, 22 bp, Homo sapiens
atttctcagtgaaatgacaggc

SEQ ID NO: 7067364 - DNA, 22 bp, Homo sapiens
atttctcagtgtacattatgtt

SEQ ID NO: 7067365 - DNA, 21 bp, Homo sapiens
gcctccagccagatggcctcc

SEQ ID NO: 7067366 - DNA, 22 bp, Homo sapiens
gcctccagcccacgcaggcctg

SEQ ID NO: 7067367 - DNA, 22 bp, Homo sapiens
gcctccagcccacgcaggcctg

SEQ ID NO: 7067368 - DNA, 22 bp, Homo sapiens
gcctccagctggggcatttcag

SEQ ID NO: 7067369 - DNA, 22 bp, Homo sapiens
gcctccagggatgattccttcc

SEQ ID NO: 7067370 - DNA, 22 bp, Homo sapiens
gcctccagggtagaggaggaag

SEQ ID NO: 7067371 - DNA, 22 bp, Homo sapiens
gcctccagtttttttctgaact

SEQ ID NO: 7067372 - DNA, 22 bp, Homo sapiens
gcctccccaaagtgctgacagc

SEQ ID NO: 7067373 - DNA, 21 bp, Homo sapiens
gcctctccaaatcctgccttc

SEQ ID NO: 7067374 - DNA, 21 bp, Homo sapiens
gcctctccaaatcctgccttc

SEQ ID NO: 7067375 - DNA, 22 bp, Homo sapiens
gcctctccgagccactgcctct

SEQ ID NO: 7067376 - DNA, 22 bp, Homo sapiens
gcctctcctcttaataccatta

SEQ ID NO: 7067377 - DNA, 22 bp, Homo sapiens
caaaaagcttaggtaacaagcc

SEQ ID NO: 7067378 - DNA, 22 bp, Homo sapiens
attttttagaacctggcctgat

SEQ ID NO: 7067379 - DNA, 22 bp, Homo sapiens
gcgagcctctggagtcctctgg

SEQ ID NO: 7067380 - DNA, 19 bp, Homo sapiens
gcgaggaagtcactgtggc

SEQ ID NO: 7067381 - DNA, 19 bp, Homo sapiens
gcgaggaagtcactgtggt

SEQ ID NO: 7067382 - DNA, 22 bp, Homo sapiens
gctcaggatttcatccatgtgt

SEQ ID NO: 7067383 - DNA, 22 bp, Homo sapiens
caaactttcagttataacatga

SEQ ID NO: 7067384 - DNA, 22 bp, Homo sapiens
gctcaggaaacagcagggcttg

SEQ ID NO: 7067385 - DNA, 22 bp, Homo sapiens
gctcaggaccgaggggtgggaa

SEQ ID NO: 7067386 - DNA, 22 bp, Homo sapiens
gcgaggaggggtgctgggcccc

SEQ ID NO: 7067387 - DNA, 22 bp, Homo sapiens
gcgagggcacgcggttgaaggc

SEQ ID NO: 7067388 - DNA, 22 bp, Homo sapiens
gcgcacatgttcagatgtgtga

SEQ ID NO: 7067389 - DNA, 22 bp, Homo sapiens
gcgcaggagccgcggagggccg

SEQ ID NO: 7067390 - DNA, 22 bp, Homo sapiens
caaactatttacaatggaatca

SEQ ID NO: 7067391 - DNA, 22 bp, Homo sapiens
attaaatgttggcatattttgt

SEQ ID NO: 7067392 - DNA, 22 bp, Homo sapiens
attaaatgttggacgtatacat

SEQ ID NO: 7067393 - DNA, 22 bp, Homo sapiens
attaaattagcaaactgtgaaa

SEQ ID NO: 7067394 - DNA, 18 bp, Homo sapiens
gatgaggctgtctgagaa

SEQ ID NO: 7067395 - DNA, 22 bp, Homo sapiens
gatgaggggtcattggctggga

SEQ ID NO: 7067396 - DNA, 22 bp, Homo sapiens
attaaatactgcaggctaagca

SEQ ID NO: 7067397 - DNA, 22 bp, Homo sapiens
attaaatgatggcatgtcttat

SEQ ID NO: 7067398 - DNA, 22 bp, Homo sapiens
attaaatggtggtcattcattt

SEQ ID NO: 7067399 - DNA, 22 bp, Homo sapiens
attaaatgttccttaaattata

SEQ ID NO: 7067400 - DNA, 22 bp, Homo sapiens
atgtttttggcttcaagtttct

SEQ ID NO: 7067401 - DNA, 22 bp, Homo sapiens
attaaaagcttcccaagagtta

SEQ ID NO: 7067402 - DNA, 22 bp, Homo sapiens
atgtttttgagatacaaacaga

SEQ ID NO: 7067403 - DNA, 22 bp, Homo sapiens
atgtttttgagatacaaacaga

SEQ ID NO: 7067404 - DNA, 22 bp, Homo sapiens
atgtttttcataccagtgttgg

SEQ ID NO: 7067405 - DNA, 22 bp, Homo sapiens
atgttttctagagtttaaaatc

SEQ ID NO: 7067406 - DNA, 22 bp, Homo sapiens
atgtttctgaagtttacagata

SEQ ID NO: 7067407 - DNA, 22 bp, Homo sapiens
atgttaaaaaccagtacagttg

SEQ ID NO: 7067408 - DNA, 22 bp, Homo sapiens
atgttaaaaaccagtacagttg

SEQ ID NO: 7067409 - DNA, 22 bp, Homo sapiens
atgtgtgtgtatatacacacat

SEQ ID NO: 7067410 - DNA, 22 bp, Homo sapiens
atgtgtgtgtgcgcgcgcagga

SEQ ID NO: 7067411 - DNA, 22 bp, Homo sapiens
atgtgtgtgtttaatcctcaaa

SEQ ID NO: 7067412 - DNA, 22 bp, Homo sapiens
atgtgttaatgtcaaccagaaa

SEQ ID NO: 7067413 - DNA, 22 bp, Homo sapiens
atgtgttagtttgtgattatac

SEQ ID NO: 7067414 - DNA, 22 bp, Homo sapiens
gcaaggctgagcacatttgcat

SEQ ID NO: 7067415 - DNA, 22 bp, Homo sapiens
gcaaggctgctgccacccatct

SEQ ID NO: 7067416 - DNA, 22 bp, Homo sapiens
gcaaggctgtgcactttgcatt

SEQ ID NO: 7067417 - DNA, 22 bp, Homo sapiens
attacaataaggtttatttgta

SEQ ID NO: 7067418 - DNA, 22 bp, Homo sapiens
attacaataatacatgctcatt

SEQ ID NO: 7067419 - DNA, 22 bp, Homo sapiens
attacaacaagaaaagggtaag

SEQ ID NO: 7067420 - DNA, 22 bp, Homo sapiens
attacaactacataatctcaga

SEQ ID NO: 7067421 - DNA, 22 bp, Homo sapiens
attacaactatgtgctctgcaa

SEQ ID NO: 7067422 - DNA, 22 bp, Homo sapiens
attacaactggaatggtgctgg

SEQ ID NO: 7067423 - DNA, 22 bp, Homo sapiens
attacaactgttcccactgtct

SEQ ID NO: 7067424 - DNA, 22 bp, Homo sapiens
attaattgggaacttgttgaaa

SEQ ID NO: 7067425 - DNA, 22 bp, Homo sapiens
attaatgtgtagccaacttaat

SEQ ID NO: 7067426 - DNA, 22 bp, Homo sapiens
gatgatctgaggtacatgaaac

SEQ ID NO: 7067427 - DNA, 22 bp, Homo sapiens
gatgatgagataaggataactt

SEQ ID NO: 7067428 - DNA, 22 bp, Homo sapiens
gatgatgaggccatgaggcagg

SEQ ID NO: 7067429 - DNA, 22 bp, Homo sapiens
attaagatgtgggaaaatttaa

SEQ ID NO: 7067430 - DNA, 22 bp, Homo sapiens
gcaaggctttgtgaattttaaa

SEQ ID NO: 7067431 - DNA, 21 bp, Homo sapiens
gcaaggcttttgtgtttccca

SEQ ID NO: 7067432 - DNA, 22 bp, Homo sapiens
gcaagtcctttgcatgcaggga

SEQ ID NO: 7067433 - DNA, 22 bp, Homo sapiens
gcaagttatttccatttaaagc

SEQ ID NO: 7067434 - DNA, 22 bp, Homo sapiens
gcaataaaatgtaatgattggg

SEQ ID NO: 7067435 - DNA, 21 bp, Homo sapiens
attagaaggtatttagggcct

SEQ ID NO: 7067436 - DNA, 22 bp, Homo sapiens
attagaattatgcttgctaatg

SEQ ID NO: 7067437 - DNA, 22 bp, Homo sapiens
attagaattatgcttgctaatg

SEQ ID NO: 7067438 - DNA, 23 bp, Homo sapiens
attagacactttgggttgtcttc

SEQ ID NO: 7067439 - DNA, 22 bp, Homo sapiens
attagacatcatatgattcagc

SEQ ID NO: 7067440 - DNA, 22 bp, Homo sapiens
attattcaatgttatttcagtg

SEQ ID NO: 7067441 - DNA, 22 bp, Homo sapiens
attagagagagcatattactgg

SEQ ID NO: 7067442 - DNA, 22 bp, Homo sapiens
attattcttgaggtgtttattg

SEQ ID NO: 7067443 - DNA, 22 bp, Homo sapiens
attcttattatagtaaaacagt

SEQ ID NO: 7067444 - DNA, 22 bp, Homo sapiens
attcttaattgccatgctgtat

SEQ ID NO: 7067445 - DNA, 22 bp, Homo sapiens
attcttaattccaaagactgag

SEQ ID NO: 7067446 - DNA, 22 bp, Homo sapiens
attcttaattccaaagactgag

SEQ ID NO: 7067447 - DNA, 22 bp, Homo sapiens
attcttcaaagagtgtcaaagt

SEQ ID NO: 7067448 - DNA, 22 bp, Homo sapiens
attcttcacaaatatatagaag

SEQ ID NO: 7067449 - DNA, 22 bp, Homo sapiens
attcttcactgtttcagaatga

SEQ ID NO: 7067450 - DNA, 22 bp, Homo sapiens
attcttcactgtttcagaatga

SEQ ID NO: 7067451 - DNA, 22 bp, Homo sapiens
attctgtctaagctggctacgt

SEQ ID NO: 7067452 - DNA, 22 bp, Homo sapiens
attctggaattctaagattctg

SEQ ID NO: 7067453 - DNA, 22 bp, Homo sapiens
attctcaaagccagagtcaacg

SEQ ID NO: 7067454 - DNA, 22 bp, Homo sapiens
attctcaatggctactttcata

SEQ ID NO: 7067455 - DNA, 22 bp, Homo sapiens
attctcaatggctactttcata

SEQ ID NO: 7067456 - DNA, 22 bp, Homo sapiens
attctcagatcttagaggaata

SEQ ID NO: 7067457 - DNA, 22 bp, Homo sapiens
attctcagctttcaaatagaca

SEQ ID NO: 7067458 - DNA, 22 bp, Homo sapiens
attctattttttaagaagtagt

SEQ ID NO: 7067459 - DNA, 22 bp, Homo sapiens
attctattaatatttctaggaa

SEQ ID NO: 7067460 - DNA, 22 bp, Homo sapiens
attctatagacagaaggtcaat

SEQ ID NO: 7067461 - DNA, 22 bp, Homo sapiens
attgaaaaatgactattgctta

SEQ ID NO: 7067462 - DNA, 20 bp, Homo sapiens
attgaaatttttctgagatt

SEQ ID NO: 7067463 - DNA, 22 bp, Homo sapiens
attgctggtagtcagtgtccct

SEQ ID NO: 7067464 - DNA, 22 bp, Homo sapiens
attgctgtaaattatcttatta

SEQ ID NO: 7067465 - DNA, 22 bp, Homo sapiens
attgctgtacacttctagatct

SEQ ID NO: 7067466 - DNA, 22 bp, Homo sapiens
attgctgtggaaatataagatg

SEQ ID NO: 7067467 - DNA, 22 bp, Homo sapiens
attatttatcctcttggtctat

SEQ ID NO: 7067468 - DNA, 22 bp, Homo sapiens
attatttcagtcagacactggc

SEQ ID NO: 7067469 - DNA, 22 bp, Homo sapiens
attattgttttaatagtagaga

SEQ ID NO: 7067470 - DNA, 22 bp, Homo sapiens
attattgtactttcaataaggt

SEQ ID NO: 7067471 - DNA, 22 bp, Homo sapiens
attattgtactttcaataaggt

SEQ ID NO: 7067472 - DNA, 23 bp, Homo sapiens
gcagagctgccctattgccttgg

SEQ ID NO: 7067473 - DNA, 22 bp, Homo sapiens
gcagagctgggtctgtatccaa

SEQ ID NO: 7067474 - DNA, 20 bp, Homo sapiens
gcagagctgttctgtgggga

SEQ ID NO: 7067475 - DNA, 22 bp, Homo sapiens
gcagagctgttaatggagctga

SEQ ID NO: 7067476 - DNA, 22 bp, Homo sapiens
gcagagctgtctaagtcacttc

SEQ ID NO: 7067477 - DNA, 22 bp, Homo sapiens
attctacacctctctcatttag

SEQ ID NO: 7067478 - DNA, 22 bp, Homo sapiens
attctagaacagaggtttctaa

SEQ ID NO: 7067479 - DNA, 22 bp, Homo sapiens
gcagcaggtccgcatcatcatc

SEQ ID NO: 7067480 - DNA, 22 bp, Homo sapiens
gcagcagggagcaggggtgtca

SEQ ID NO: 7067481 - DNA, 22 bp, Homo sapiens
gcagcagggagcaggggtgtca

SEQ ID NO: 7067482 - DNA, 22 bp, Homo sapiens
gcagcagggtgccagctttgca

SEQ ID NO: 7067483 - DNA, 22 bp, Homo sapiens
attcctcatttgttgagaacca

SEQ ID NO: 7067484 - DNA, 22 bp, Homo sapiens
gcagagcttctgtccttcagga

SEQ ID NO: 7067485 - DNA, 22 bp, Homo sapiens
gcagagcttctgtccttcagga

SEQ ID NO: 7067486 - DNA, 22 bp, Homo sapiens
attcctaaagtaatacactaga

SEQ ID NO: 7067487 - DNA, 22 bp, Homo sapiens
attcctaaggaaggctggcaag

SEQ ID NO: 7067488 - DNA, 22 bp, Homo sapiens
attcctcaaaggtagcccatta

SEQ ID NO: 7067489 - DNA, 19 bp, Homo sapiens
attcctcaaggacagaaat

SEQ ID NO: 7067490 - DNA, 22 bp, Homo sapiens
attcctcagcaggccttttgtt

SEQ ID NO: 7067491 - DNA, 20 bp, Homo sapiens
attcctcagccccagcctca

SEQ ID NO: 7067492 - DNA, 22 bp, Homo sapiens
attcctcattatttactgagga

SEQ ID NO: 7067493 - DNA, 22 bp, Homo sapiens
attcctcattatttactgagga

SEQ ID NO: 7067494 - DNA, 22 bp, Homo sapiens
attcctcatttgttgagaacca

SEQ ID NO: 7067495 - DNA, 22 bp, Homo sapiens
cttttcaaacgctgatgtcagt

SEQ ID NO: 7067496 - DNA, 19 bp, Homo sapiens
cttttcaagccatcagttt

SEQ ID NO: 7067497 - DNA, 22 bp, Homo sapiens
cttttcagagctgagatcaccg

SEQ ID NO: 7067498 - DNA, 22 bp, Homo sapiens
cttttattttgaattaagggct

SEQ ID NO: 7067499 - DNA, 22 bp, Homo sapiens
cttttactgtgaaaagaaactg

SEQ ID NO: 7067500 - DNA, 22 bp, Homo sapiens
cttttattttgaattaagggct

SEQ ID NO: 7067501 - DNA, 22 bp, Homo sapiens
cttttattttgaattaagggct

SEQ ID NO: 7067502 - DNA, 22 bp, Homo sapiens
atgaaattaatcaacacataca

SEQ ID NO: 7067503 - DNA, 22 bp, Homo sapiens
cttttacatttgttgaagagta

SEQ ID NO: 7067504 - DNA, 22 bp, Homo sapiens
atgaaatatcttgaagaaattc

SEQ ID NO: 7067505 - DNA, 22 bp, Homo sapiens
atgaaatatcttgaagaaattc

SEQ ID NO: 7067506 - DNA, 22 bp, Homo sapiens
atgaaatatcttgaagaaattc

SEQ ID NO: 7067507 - DNA, 22 bp, Homo sapiens
atgaaatatcttgaagaaattc

SEQ ID NO: 7067508 - DNA, 22 bp, Homo sapiens
atgaaatatcttgaagaaattc

SEQ ID NO: 7067509 - DNA, 22 bp, Homo sapiens
atgaaatatcttgaagaaattc

SEQ ID NO: 7067510 - DNA, 22 bp, Homo sapiens
atgaaatattctttggtaagaa

SEQ ID NO: 7067511 - DNA, 22 bp, Homo sapiens
atgaaatgattgaaatctttac

SEQ ID NO: 7067512 - DNA, 22 bp, Homo sapiens
atgaaatatcttgaagaaattc

SEQ ID NO: 7067513 - DNA, 22 bp, Homo sapiens
cttgtttaaataagatagcagt

SEQ ID NO: 7067514 - DNA, 22 bp, Homo sapiens
cttgtgttgtacattctatggg

SEQ ID NO: 7067515 - DNA, 20 bp, Homo sapiens
cttgttaaatatgcaggtag

SEQ ID NO: 7067516 - DNA, 22 bp, Homo sapiens
cttgtggccaatgtttgttata

SEQ ID NO: 7067517 - DNA, 22 bp, Homo sapiens
atctttttgacatggtgatggt

SEQ ID NO: 7067518 - DNA, 22 bp, Homo sapiens
atcttttttgtcttggtcactg

SEQ ID NO: 7067519 - DNA, 22 bp, Homo sapiens
atgaaaacagcctcctgtgata

SEQ ID NO: 7067520 - DNA, 22 bp, Homo sapiens
atgaaaacggaccagagctatt

SEQ ID NO: 7067521 - DNA, 22 bp, Homo sapiens
atgaaaactttagcctcattag

SEQ ID NO: 7067522 - DNA, 22 bp, Homo sapiens
atctttttatctgtttggaaca

SEQ ID NO: 7067523 - DNA, 22 bp, Homo sapiens
atctttttactaacactgctta

SEQ ID NO: 7067524 - DNA, 22 bp, Homo sapiens
atctttttactaacactgctta

SEQ ID NO: 7067525 - DNA, 22 bp, Homo sapiens
atcttttctgtttgctatgtct

SEQ ID NO: 7067526 - DNA, 22 bp, Homo sapiens
atcttgatcaaggctatcatga

SEQ ID NO: 7067527 - DNA, 22 bp, Homo sapiens
atcttgcatttgctaaaatgca

SEQ ID NO: 7067528 - DNA, 22 bp, Homo sapiens
atcttgcatttgctaaaatgca

SEQ ID NO: 7067529 - DNA, 22 bp, Homo sapiens
atctagcagtgttataattgga

SEQ ID NO: 7067530 - DNA, 22 bp, Homo sapiens
atctagaagtggcatgaattac

SEQ ID NO: 7067531 - DNA, 22 bp, Homo sapiens
atctacagctgtctgcacagta

SEQ ID NO: 7067532 - DNA, 22 bp, Homo sapiens
atctacaggatagtttaatatt

SEQ ID NO: 7067533 - DNA, 22 bp, Homo sapiens
atctacaggattttacagagtt

SEQ ID NO: 7067534 - DNA, 22 bp, Homo sapiens
atctacaggattttacagagtt

SEQ ID NO: 7067535 - DNA, 22 bp, Homo sapiens
atctacaggctgaggtgggagg

SEQ ID NO: 7067536 - DNA, 22 bp, Homo sapiens
atctacagtgcacaggacagcc

SEQ ID NO: 7067537 - DNA, 22 bp, Homo sapiens
atctacataaaacgaatacata

SEQ ID NO: 7067538 - DNA, 22 bp, Homo sapiens
atctatacccatcatgatttaa

SEQ ID NO: 7067539 - DNA, 23 bp, Homo sapiens
cttgcctggcctctctgcccaga

SEQ ID NO: 7067540 - DNA, 22 bp, Homo sapiens
cttgcctgtggctagttggctc

SEQ ID NO: 7067541 - DNA, 19 bp, Homo sapiens
cttgcctgttcctacagct

SEQ ID NO: 7067542 - DNA, 22 bp, Homo sapiens
cttgccttcagtgtccctttgc

SEQ ID NO: 7067543 - DNA, 22 bp, Homo sapiens
cttgcctttgtcttcaaaggct

SEQ ID NO: 7067544 - DNA, 22 bp, Homo sapiens
atcttctggtcaaatttttgca

SEQ ID NO: 7067545 - DNA, 22 bp, Homo sapiens
cttgtaattataatgtactgtt

SEQ ID NO: 7067546 - DNA, 22 bp, Homo sapiens
atcttctcaagcagcatcctgt

SEQ ID NO: 7067547 - DNA, 22 bp, Homo sapiens
atcttctcatgtgtaatgaggt

SEQ ID NO: 7067548 - DNA, 22 bp, Homo sapiens
atcttctgatttatggagcaat

SEQ ID NO: 7067549 - DNA, 22 bp, Homo sapiens
cttgggtgttttaaaactagat

SEQ ID NO: 7067550 - DNA, 22 bp, Homo sapiens
cttggtaaaactgtcttaaatt

SEQ ID NO: 7067551 - DNA, 22 bp, Homo sapiens
cttggcagtttcggaaggatga

SEQ ID NO: 7067552 - DNA, 22 bp, Homo sapiens
cttggcccagttgccaaggaaa

SEQ ID NO: 7067553 - DNA, 20 bp, Homo sapiens
cttggcctacttagctttgt

SEQ ID NO: 7067554 - DNA, 22 bp, Homo sapiens
atgaggcagtacacacaaagcc

SEQ ID NO: 7067555 - DNA, 22 bp, Homo sapiens
atgaggcagtctggcctgaggg

SEQ ID NO: 7067556 - DNA, 22 bp, Homo sapiens
atgaggcaggtggaggctgcca

SEQ ID NO: 7067557 - DNA, 22 bp, Homo sapiens
atgaggcaggtggaggctgcca

SEQ ID NO: 7067558 - DNA, 22 bp, Homo sapiens
atgaggcaggagtgcagtggca

SEQ ID NO: 7067559 - DNA, 22 bp, Homo sapiens
atgaggcagctgctggagaacg

SEQ ID NO: 7067560 - DNA, 22 bp, Homo sapiens
atgaagcagaatttcccactct

SEQ ID NO: 7067561 - DNA, 22 bp, Homo sapiens
atgaggcagatgttgcatgagg

SEQ ID NO: 7067562 - DNA, 22 bp, Homo sapiens
atgaggcagatgttgcatgagg

SEQ ID NO: 7067563 - DNA, 22 bp, Homo sapiens
atgaggcagcacatgggattgt

SEQ ID NO: 7067564 - DNA, 22 bp, Homo sapiens
atgaggcagctgacagctgttc

SEQ ID NO: 7067565 - DNA, 20 bp, Homo sapiens
atgattttgcactaacttca

SEQ ID NO: 7067566 - DNA, 20 bp, Homo sapiens
atgattttgcactaacttca

SEQ ID NO: 7067567 - DNA, 22 bp, Homo sapiens
atgattcagcaattttatatct

SEQ ID NO: 7067568 - DNA, 22 bp, Homo sapiens
atgagtgtttagaaaacactgg

SEQ ID NO: 7067569 - DNA, 22 bp, Homo sapiens
atgagttaggggcctgagtgga

SEQ ID NO: 7067570 - DNA, 22 bp, Homo sapiens
atgagttcaattgtttcagtca

SEQ ID NO: 7067571 - DNA, 22 bp, Homo sapiens
atgatacaagcaaaactaatca

SEQ ID NO: 7067572 - DNA, 22 bp, Homo sapiens
gaaagcagtaaatgggtcccat

SEQ ID NO: 7067573 - DNA, 23 bp, Homo sapiens
atgaggtaaagatcagctttaaa

SEQ ID NO: 7067574 - DNA, 22 bp, Homo sapiens
atgaggtactagtatatacgta

SEQ ID NO: 7067575 - DNA, 22 bp, Homo sapiens
atgaggtagtattagaaggaga

SEQ ID NO: 7067576 - DNA, 22 bp, Homo sapiens
atgaggtatctcatttcctgaa

SEQ ID NO: 7067577 - DNA, 22 bp, Homo sapiens
atgaggtattcgtaatatttcc

SEQ ID NO: 7067578 - DNA, 22 bp, Homo sapiens
atgaggtcacagtgtttggcat

SEQ ID NO: 7067579 - DNA, 23 bp, Homo sapiens
atgaggtcagccataagacggaa

SEQ ID NO: 7067580 - DNA, 22 bp, Homo sapiens
atgaggtcatcctggagtaagg

SEQ ID NO: 7067581 - DNA, 22 bp, Homo sapiens
atgaggtcatcttgaagtaggg

SEQ ID NO: 7067582 - DNA, 17 bp, Homo sapiens
atgaggtcattaagata

SEQ ID NO: 7067583 - DNA, 22 bp, Homo sapiens
atgaggtcattcttggattaca

SEQ ID NO: 7067584 - DNA, 22 bp, Homo sapiens
atgaggtccagggaagttaaat

SEQ ID NO: 7067585 - DNA, 22 bp, Homo sapiens
atgaggtctggcaatcagaaac

SEQ ID NO: 7067586 - DNA, 22 bp, Homo sapiens
atgaggtcttattgcagtagtt

SEQ ID NO: 7067587 - DNA, 22 bp, Homo sapiens
atgcatttatgtgtgtacattg

SEQ ID NO: 7067588 - DNA, 22 bp, Homo sapiens
gacactgaccccaagctgtcct

SEQ ID NO: 7067589 - DNA, 22 bp, Homo sapiens
atgcaggagaccaattggatgg

SEQ ID NO: 7067590 - DNA, 22 bp, Homo sapiens
atgcatatgcatggacactcag

SEQ ID NO: 7067591 - DNA, 22 bp, Homo sapiens
atgcatatgccgtagaataagt

SEQ ID NO: 7067592 - DNA, 22 bp, Homo sapiens
atgcatatgccgtagaataagt

SEQ ID NO: 7067593 - DNA, 22 bp, Homo sapiens
atgcaaagcaccacactaagat

SEQ ID NO: 7067594 - DNA, 22 bp, Homo sapiens
atgcaaaagtaattgcaatttt

SEQ ID NO: 7067595 - DNA, 22 bp, Homo sapiens
atgcaaaataaggcagaaacat

SEQ ID NO: 7067596 - DNA, 22 bp, Homo sapiens
atgcacttcaagcatctctctg

SEQ ID NO: 7067597 - DNA, 22 bp, Homo sapiens
atgcacagtatgtagggtctat

SEQ ID NO: 7067598 - DNA, 22 bp, Homo sapiens
atgcacagtatgtagggtctat

SEQ ID NO: 7067599 - DNA, 19 bp, Homo sapiens
atgcagagaatggcagtag

SEQ ID NO: 7067600 - DNA, 22 bp, Homo sapiens
atggaagttggaaccattcata

SEQ ID NO: 7067601 - DNA, 22 bp, Homo sapiens
atggaagaacgctcagggttac

SEQ ID NO: 7067602 - DNA, 22 bp, Homo sapiens
atggaagactaacagaaacatg

SEQ ID NO: 7067603 - DNA, 22 bp, Homo sapiens
atggaagctgaaaaagacacgg

SEQ ID NO: 7067604 - DNA, 23 bp, Homo sapiens
atggaagtcactgttttcttgtc

SEQ ID NO: 7067605 - DNA, 22 bp, Homo sapiens
atggagccattcctgaagactt

SEQ ID NO: 7067606 - DNA, 20 bp, Homo sapiens
atggaggaagggcaagagaa

SEQ ID NO: 7067607 - DNA, 20 bp, Homo sapiens
atggaggaagggcaagagaa

SEQ ID NO: 7067608 - DNA, 22 bp, Homo sapiens
atggaggatgtgcagcatgggc

SEQ ID NO: 7067609 - DNA, 18 bp, Homo sapiens
gagaaagtttgggcagaa

SEQ ID NO: 7067610 - DNA, 22 bp, Homo sapiens
gagaaatgcatgcatgtcatca

SEQ ID NO: 7067611 - DNA, 21 bp, Homo sapiens
atggaaattggcaaatgctac

SEQ ID NO: 7067612 - DNA, 22 bp, Homo sapiens
atggaaatgttccatatattga

SEQ ID NO: 7067613 - DNA, 22 bp, Homo sapiens
atggaaatgttaagtcagtccg

SEQ ID NO: 7067614 - DNA, 22 bp, Homo sapiens
atggaaatggagtgtgcttgct

SEQ ID NO: 7067615 - DNA, 22 bp, Homo sapiens
atgccacttcattccagcctcg

SEQ ID NO: 7067616 - DNA, 22 bp, Homo sapiens
atggaaaaggctgatttcatta

SEQ ID NO: 7067617 - DNA, 22 bp, Homo sapiens
atggaaatgatggaacattaaa

SEQ ID NO: 7067618 - DNA, 22 bp, Homo sapiens
atggaaatggagggtgctagaa

SEQ ID NO: 7067619 - DNA, 22 bp, Homo sapiens
atgccactgcgctccagcctgg

SEQ ID NO: 7067620 - DNA, 23 bp, Homo sapiens
gacagagtgagaccttgtcttac

SEQ ID NO: 7067621 - DNA, 23 bp, Homo sapiens
gacagagtgagaccttgtcttac

SEQ ID NO: 7067622 - DNA, 23 bp, Homo sapiens
gacagagtgagaccttgtcttac

SEQ ID NO: 7067623 - DNA, 22 bp, Homo sapiens
gacagagttgttgatgtatgct

SEQ ID NO: 7067624 - DNA, 22 bp, Homo sapiens
gagccaggagatacctaagggg

SEQ ID NO: 7067625 - DNA, 22 bp, Homo sapiens
gagccaggaggcagagactgca

SEQ ID NO: 7067626 - DNA, 22 bp, Homo sapiens
gagccaggaggcagagactgca

SEQ ID NO: 7067627 - DNA, 22 bp, Homo sapiens
gagccagctacatggtctgcaa

SEQ ID NO: 7067628 - DNA, 22 bp, Homo sapiens
gagccaggcccgtacttgctgt

SEQ ID NO: 7067629 - DNA, 22 bp, Homo sapiens
gagccagggctgtgagctgagc

SEQ ID NO: 7067630 - DNA, 22 bp, Homo sapiens
gagcagtgactggagcatgaga

SEQ ID NO: 7067631 - DNA, 22 bp, Homo sapiens
atggcagggcacagctctagtt

SEQ ID NO: 7067632 - DNA, 22 bp, Homo sapiens
atggcagtcagagacaggcaga

SEQ ID NO: 7067633 - DNA, 22 bp, Homo sapiens
atggcagtagaatgggggaaaa

SEQ ID NO: 7067634 - DNA, 22 bp, Homo sapiens
atggcagagggattgaacagct

SEQ ID NO: 7067635 - DNA, 22 bp, Homo sapiens
gagagctgtggtttgaccaggc

SEQ ID NO: 7067636 - DNA, 22 bp, Homo sapiens
gagagctgtccggctgagcagc

SEQ ID NO: 7067637 - DNA, 22 bp, Homo sapiens
atggcagttgcccagccaatcc

SEQ ID NO: 7067638 - DNA, 22 bp, Homo sapiens
gagaggaaagatatatacttct

SEQ ID NO: 7067639 - DNA, 20 bp, Homo sapiens
gaggctgcggactgctggac

SEQ ID NO: 7067640 - DNA, 21 bp, Homo sapiens
atgtgaaaccttccacgctga

SEQ ID NO: 7067641 - DNA, 22 bp, Homo sapiens
atgtgaaacgcaatgggatcat

SEQ ID NO: 7067642 - DNA, 22 bp, Homo sapiens
atgtctttcttatggtctgttg

SEQ ID NO: 7067643 - DNA, 22 bp, Homo sapiens
atgtcttttatgattacgggat

SEQ ID NO: 7067644 - DNA, 22 bp, Homo sapiens
atgtgaaaaatttcttattaca

SEQ ID NO: 7067645 - DNA, 22 bp, Homo sapiens
gaggccagggtaccatcaacat

SEQ ID NO: 7067646 - DNA, 22 bp, Homo sapiens
gaggcctggctctgccctcctg

SEQ ID NO: 7067647 - DNA, 22 bp, Homo sapiens
gaggcctggctgtcagtcccca

SEQ ID NO: 7067648 - DNA, 22 bp, Homo sapiens
gaggcctgggagcctgtcctcc

SEQ ID NO: 7067649 - DNA, 22 bp, Homo sapiens
atgtctgctttccttttaatca

SEQ ID NO: 7067650 - DNA, 22 bp, Homo sapiens
atgtctggaggtcatctggtta

SEQ ID NO: 7067651 - DNA, 19 bp, Homo sapiens
atgtctgggtaacagctgc

SEQ ID NO: 7067652 - DNA, 22 bp, Homo sapiens
atgtctggtggtcgatgctaca

SEQ ID NO: 7067653 - DNA, 22 bp, Homo sapiens
gaggctgctttgatgacaggag

SEQ ID NO: 7067654 - DNA, 22 bp, Homo sapiens
gaggggagaggcttatggatca

SEQ ID NO: 7067655 - DNA, 22 bp, Homo sapiens
gaggggagaaggcactaaccag

SEQ ID NO: 7067656 - DNA, 22 bp, Homo sapiens
gaggggagacagggaaatcagt

SEQ ID NO: 7067657 - DNA, 22 bp, Homo sapiens
gaggggagcatgatctagattg

SEQ ID NO: 7067658 - DNA, 22 bp, Homo sapiens
gaggggagcccccatcctccag

SEQ ID NO: 7067659 - DNA, 22 bp, Homo sapiens
gaggggagcccccatcctccag

SEQ ID NO: 7067660 - DNA, 22 bp, Homo sapiens
atgtgtgtatatatagtcattt

SEQ ID NO: 7067661 - DNA, 22 bp, Homo sapiens
atgtgtgtatgtgcctatatct

SEQ ID NO: 7067662 - DNA, 22 bp, Homo sapiens
atgtgtgtgatgggcgccgcca

SEQ ID NO: 7067663 - DNA, 22 bp, Homo sapiens
atgtgtgtgcatttctctccct

SEQ ID NO: 7067664 - DNA, 19 bp, Homo sapiens
atgtacccagtgtcaatcc

SEQ ID NO: 7067665 - DNA, 17 bp, Homo sapiens
gaggagctccagtaggt

SEQ ID NO: 7067666 - DNA, 22 bp, Homo sapiens
gaggccagggtaccatcaacat

SEQ ID NO: 7067667 - DNA, 22 bp, Homo sapiens
gaggccagggtaccatcaacat

SEQ ID NO: 7067668 - DNA, 22 bp, Homo sapiens
gaggccaggggcctggagatga

SEQ ID NO: 7067669 - DNA, 22 bp, Homo sapiens
gaggagctgggctgagagggtc

SEQ ID NO: 7067670 - DNA, 22 bp, Homo sapiens
gaggagctgggaccctgtcatc

SEQ ID NO: 7067671 - DNA, 22 bp, Homo sapiens
atggctggcactggcctgggtt

SEQ ID NO: 7067672 - DNA, 22 bp, Homo sapiens
atggctggaggccgggcttcct

SEQ ID NO: 7067673 - DNA, 22 bp, Homo sapiens
gagctgggcctgcgagtgctgc

SEQ ID NO: 7067674 - DNA, 22 bp, Homo sapiens
gagctgggcctgcgagtgctgc

SEQ ID NO: 7067675 - DNA, 22 bp, Homo sapiens
gagctgggctggcttcctccct

SEQ ID NO: 7067676 - DNA, 22 bp, Homo sapiens
gagctggggcagcttaggagtg

SEQ ID NO: 7067677 - DNA, 22 bp, Homo sapiens
gagctgggcgagccggggaagt

SEQ ID NO: 7067678 - DNA, 20 bp, Homo sapiens
ctgggcacctgtctgcagtt

SEQ ID NO: 7067679 - DNA, 22 bp, Homo sapiens
atatatatcgagttcatgtctc

SEQ ID NO: 7067680 - DNA, 22 bp, Homo sapiens
atatatatgctgatggctgcca

SEQ ID NO: 7067681 - DNA, 22 bp, Homo sapiens
ctgggcacaggggagcagagtc

SEQ ID NO: 7067682 - DNA, 22 bp, Homo sapiens
ctgggcacactctgctccagct

SEQ ID NO: 7067683 - DNA, 22 bp, Homo sapiens
ctgggcacaagtggccctggat

SEQ ID NO: 7067684 - DNA, 22 bp, Homo sapiens
ctgggcacacagtgactctgca

SEQ ID NO: 7067685 - DNA, 22 bp, Homo sapiens
ctgggactttgtaggccagttg

SEQ ID NO: 7067686 - DNA, 22 bp, Homo sapiens
atatatagagctagatgttaaa

SEQ ID NO: 7067687 - DNA, 22 bp, Homo sapiens
atatatactttgacacattctg

SEQ ID NO: 7067688 - DNA, 22 bp, Homo sapiens
atatatacaactagattaaaag

SEQ ID NO: 7067689 - DNA, 22 bp, Homo sapiens
atatataacctggataaggctt

SEQ ID NO: 7067690 - DNA, 22 bp, Homo sapiens
atatataagctgatgagccaca

SEQ ID NO: 7067691 - DNA, 22 bp, Homo sapiens
atatataatacttgctgtgggc

SEQ ID NO: 7067692 - DNA, 22 bp, Homo sapiens
atataatacaacctgctaagtg

SEQ ID NO: 7067693 - DNA, 22 bp, Homo sapiens
atataacatacatacagaaaag

SEQ ID NO: 7067694 - DNA, 22 bp, Homo sapiens
ctgggacacccaaggaaagagc

SEQ ID NO: 7067695 - DNA, 22 bp, Homo sapiens
ctgggaagggacgccagtgcct

SEQ ID NO: 7067696 - DNA, 22 bp, Homo sapiens
ctgggaagtagaatcagatgag

SEQ ID NO: 7067697 - DNA, 22 bp, Homo sapiens
ctggcagctggaggctagaggc

SEQ ID NO: 7067698 - DNA, 22 bp, Homo sapiens
ctggcagctggaggctagaggc

SEQ ID NO: 7067699 - DNA, 22 bp, Homo sapiens
ctggcttgaagttatgcaccag

SEQ ID NO: 7067700 - DNA, 22 bp, Homo sapiens
ctgggaagcatggtgatggtat

SEQ ID NO: 7067701 - DNA, 22 bp, Homo sapiens
ctgggaagccacagggtgtggg

SEQ ID NO: 7067702 - DNA, 22 bp, Homo sapiens
atatgacataaaatcatttttg

SEQ ID NO: 7067703 - DNA, 22 bp, Homo sapiens
atatgacataaaatcatttttg

SEQ ID NO: 7067704 - DNA, 22 bp, Homo sapiens
atatgagagaggaaagatttta

SEQ ID NO: 7067705 - DNA, 22 bp, Homo sapiens
atatgagagtaaatgccgatct

SEQ ID NO: 7067706 - DNA, 22 bp, Homo sapiens
atatgaagaattccaatttgga

SEQ ID NO: 7067707 - DNA, 22 bp, Homo sapiens
atatgaagtcagacaaactggg

SEQ ID NO: 7067708 - DNA, 22 bp, Homo sapiens
atatgaatttggctggaaaggt

SEQ ID NO: 7067709 - DNA, 22 bp, Homo sapiens
atatgacagcggattcacatat

SEQ ID NO: 7067710 - DNA, 22 bp, Homo sapiens
atatcattctgatgtatatctt

SEQ ID NO: 7067711 - DNA, 22 bp, Homo sapiens
atatcattctgatgtatatctt

SEQ ID NO: 7067712 - DNA, 22 bp, Homo sapiens
atatatcatgagtaaaacttga

SEQ ID NO: 7067713 - DNA, 22 bp, Homo sapiens
atatatattgcccaggctggtt

SEQ ID NO: 7067714 - DNA, 22 bp, Homo sapiens
atatatcatgagtaaaacttga

SEQ ID NO: 7067715 - DNA, 22 bp, Homo sapiens
atatatctgcagtactgaagaa

SEQ ID NO: 7067716 - DNA, 22 bp, Homo sapiens
ctgggcagtggtggcatctttg

SEQ ID NO: 7067717 - DNA, 22 bp, Homo sapiens
ctgggcagtatgaatattcaaa

SEQ ID NO: 7067718 - DNA, 22 bp, Homo sapiens
ctgggcagtatgaatattcaaa

SEQ ID NO: 7067719 - DNA, 22 bp, Homo sapiens
ctgggcaggtatacaaaaaatg

SEQ ID NO: 7067720 - DNA, 22 bp, Homo sapiens
ctgggcaggatacttcatggga

SEQ ID NO: 7067721 - DNA, 22 bp, Homo sapiens
atatgattccactattgtatgg

SEQ ID NO: 7067722 - DNA, 22 bp, Homo sapiens
atatttgtagtgggtaagaagt

SEQ ID NO: 7067723 - DNA, 22 bp, Homo sapiens
atatttcttgagcacctggtat

SEQ ID NO: 7067724 - DNA, 20 bp, Homo sapiens
atatttcttaagaactttca

SEQ ID NO: 7067725 - DNA, 22 bp, Homo sapiens
atatttctgggggtgtgtttct

SEQ ID NO: 7067726 - DNA, 20 bp, Homo sapiens
atatttcttaagaactttca

SEQ ID NO: 7067727 - DNA, 22 bp, Homo sapiens
atatttctgggggtgtgtttct

SEQ ID NO: 7067728 - DNA, 22 bp, Homo sapiens
atatgtttttcacaggtttaag

SEQ ID NO: 7067729 - DNA, 22 bp, Homo sapiens
atatttctctcagacatggaag

SEQ ID NO: 7067730 - DNA, 22 bp, Homo sapiens
atatgtttcagtattcaagtca

SEQ ID NO: 7067731 - DNA, 22 bp, Homo sapiens
atatgtattttaacgtgtaagg

SEQ ID NO: 7067732 - DNA, 22 bp, Homo sapiens
atatgtatgtacgcacatattc

SEQ ID NO: 7067733 - DNA, 22 bp, Homo sapiens
atatgggggggcgtgcagagga

SEQ ID NO: 7067734 - DNA, 22 bp, Homo sapiens
atatgtgtaaatgcatttgttt

SEQ ID NO: 7067735 - DNA, 22 bp, Homo sapiens
atatgtgtgcacatatgtattt

SEQ ID NO: 7067736 - DNA, 22 bp, Homo sapiens
atatgtgtgtgtgagaaaagct

SEQ ID NO: 7067737 - DNA, 22 bp, Homo sapiens
atcatgttcatcgtatttaggc

SEQ ID NO: 7067738 - DNA, 22 bp, Homo sapiens
atcatcatgcactctcaggttt

SEQ ID NO: 7067739 - DNA, 22 bp, Homo sapiens
ctgtgattgttagttcctatac

SEQ ID NO: 7067740 - DNA, 22 bp, Homo sapiens
ctgtgcacttctctttatttgt

SEQ ID NO: 7067741 - DNA, 18 bp, Homo sapiens
ctgtgcagcaaactgagc

SEQ ID NO: 7067742 - DNA, 19 bp, Homo sapiens
ctgtgcaggccgggctgag

SEQ ID NO: 7067743 - DNA, 22 bp, Homo sapiens
ctgtcttcccgaggccctggag

SEQ ID NO: 7067744 - DNA, 22 bp, Homo sapiens
ctgtctgttttaccttctccag

SEQ ID NO: 7067745 - DNA, 22 bp, Homo sapiens
ctgtctgtttctgattcaacct

SEQ ID NO: 7067746 - DNA, 22 bp, Homo sapiens
ctgtctttttagagagtaggat

SEQ ID NO: 7067747 - DNA, 22 bp, Homo sapiens
atcacatatttaagaaacatgt

SEQ ID NO: 7067748 - DNA, 18 bp, Homo sapiens
ctgggtctccaggctgcc

SEQ ID NO: 7067749 - DNA, 22 bp, Homo sapiens
ctgtcccttcccaagcccagcc

SEQ ID NO: 7067750 - DNA, 22 bp, Homo sapiens
ctgggtcctggtgctgagttct

SEQ ID NO: 7067751 - DNA, 18 bp, Homo sapiens
ctgggtctccaggctgcc

SEQ ID NO: 7067752 - DNA, 22 bp, Homo sapiens
ctgggtacctcaccgctgctgc

SEQ ID NO: 7067753 - DNA, 22 bp, Homo sapiens
ctgggtagaagattcctcagga

SEQ ID NO: 7067754 - DNA, 22 bp, Homo sapiens
ctgggtagggcaaggaactggc

SEQ ID NO: 7067755 - DNA, 22 bp, Homo sapiens
ctgggtcccacagcctgctggg

SEQ ID NO: 7067756 - DNA, 22 bp, Homo sapiens
atccaaatcatgtcagaagaac

SEQ ID NO: 7067757 - DNA, 22 bp, Homo sapiens
atcatttttaagagactcttct

SEQ ID NO: 7067758 - DNA, 22 bp, Homo sapiens
atcatttttaagagactcttct

SEQ ID NO: 7067759 - DNA, 22 bp, Homo sapiens
atcattttgtgacaatgcctgt

SEQ ID NO: 7067760 - DNA, 22 bp, Homo sapiens
atcattttgtgacaatgcctgt

SEQ ID NO: 7067761 - DNA, 22 bp, Homo sapiens
atcattttatggctgagaggac

SEQ ID NO: 7067762 - DNA, 22 bp, Homo sapiens
ctgtggagtgcttggctcagtg

SEQ ID NO: 7067763 - DNA, 22 bp, Homo sapiens
ctgtggagtgcttggctcagtg

SEQ ID NO: 7067764 - DNA, 22 bp, Homo sapiens
ctgtggagtggggagtactggt

SEQ ID NO: 7067765 - DNA, 22 bp, Homo sapiens
ctgtggagtggggagtactggt

SEQ ID NO: 7067766 - DNA, 22 bp, Homo sapiens
ctgtggaggtaggagcaggaca

SEQ ID NO: 7067767 - DNA, 22 bp, Homo sapiens
ctgtggagcagggcagggtcac

SEQ ID NO: 7067768 - DNA, 22 bp, Homo sapiens
atcattaaatataagcttcaca

SEQ ID NO: 7067769 - DNA, 22 bp, Homo sapiens
atcatgttgtatgtaatctttt

SEQ ID NO: 7067770 - DNA, 22 bp, Homo sapiens
atcatgttttaattagcaaact

SEQ ID NO: 7067771 - DNA, 22 bp, Homo sapiens
atcatgttccagaaacagtgat

SEQ ID NO: 7067772 - DNA, 22 bp, Homo sapiens
atcatgttgctcaaaattaaac

SEQ ID NO: 7067773 - DNA, 22 bp, Homo sapiens
atcatgttggctctgacaaaaa

SEQ ID NO: 7067774 - DNA, 22 bp, Homo sapiens
atcctcagtgtttctgacatct

SEQ ID NO: 7067775 - DNA, 22 bp, Homo sapiens
atccctgccctcatggagctta

SEQ ID NO: 7067776 - DNA, 22 bp, Homo sapiens
atccctgccctcatggagctta

SEQ ID NO: 7067777 - DNA, 23 bp, Homo sapiens
atcccttctccagtgtggtgagg

SEQ ID NO: 7067778 - DNA, 22 bp, Homo sapiens
atcctcagacctcagcaaagcc

SEQ ID NO: 7067779 - DNA, 22 bp, Homo sapiens
atcctcagcatctagcatgaag

SEQ ID NO: 7067780 - DNA, 22 bp, Homo sapiens
atccccaggggcattcaagctt

SEQ ID NO: 7067781 - DNA, 22 bp, Homo sapiens
atccccttgtgggctggcagca

SEQ ID NO: 7067782 - DNA, 22 bp, Homo sapiens
atacttcctgcttccctgatct

SEQ ID NO: 7067783 - DNA, 22 bp, Homo sapiens
ctggcagctctactcagagcct

SEQ ID NO: 7067784 - DNA, 22 bp, Homo sapiens
atacttatgataaataattgct

SEQ ID NO: 7067785 - DNA, 22 bp, Homo sapiens
ctggagtgatactcagaatgtg

SEQ ID NO: 7067786 - DNA, 22 bp, Homo sapiens
ctggagggctgcagcgaggctg

SEQ ID NO: 7067787 - DNA, 22 bp, Homo sapiens
ctggagtcttcagcttgctgcc

SEQ ID NO: 7067788 - DNA, 22 bp, Homo sapiens
ctggagtgaagtctggcagctt

SEQ ID NO: 7067789 - DNA, 22 bp, Homo sapiens
ctggagtgaggtctgggagcct

SEQ ID NO: 7067790 - DNA, 22 bp, Homo sapiens
ctggagtgaggtctgggagcct

SEQ ID NO: 7067791 - DNA, 22 bp, Homo sapiens
atacagatgagatcaggcataa

SEQ ID NO: 7067792 - DNA, 22 bp, Homo sapiens
atacagaattcactacagtttc

SEQ ID NO: 7067793 - DNA, 22 bp, Homo sapiens
atacagaatttgcccttttcat

SEQ ID NO: 7067794 - DNA, 22 bp, Homo sapiens
atacagatgcttgctcgtgact

SEQ ID NO: 7067795 - DNA, 22 bp, Homo sapiens
ctggagggaggaggctgctatt

SEQ ID NO: 7067796 - DNA, 22 bp, Homo sapiens
ctggagggagttaggacccgga

SEQ ID NO: 7067797 - DNA, 22 bp, Homo sapiens
ctggagggatgtagggtgtatt

SEQ ID NO: 7067798 - DNA, 22 bp, Homo sapiens
atacagaagttttccacttatt

SEQ ID NO: 7067799 - DNA, 22 bp, Homo sapiens
ctggagccccagacagggagag

SEQ ID NO: 7067800 - DNA, 22 bp, Homo sapiens
ctggagcatccatgcccagggt

SEQ ID NO: 7067801 - DNA, 22 bp, Homo sapiens
ctggagagaccgaaagaggctg

SEQ ID NO: 7067802 - DNA, 22 bp, Homo sapiens
ataatacatggttgatcttttc

SEQ ID NO: 7067803 - DNA, 22 bp, Homo sapiens
ctgctctggctgtgtacttcag

SEQ ID NO: 7067804 - DNA, 21 bp, Homo sapiens
ctgctctggggaccggctgtg

SEQ ID NO: 7067805 - DNA, 22 bp, Homo sapiens
ctgctctgagaggctcttccta

SEQ ID NO: 7067806 - DNA, 22 bp, Homo sapiens
ctgctctgctgatcagtgtctc

SEQ ID NO: 7067807 - DNA, 22 bp, Homo sapiens
ctgctctgctgatcagtgtctc

SEQ ID NO: 7067808 - DNA, 20 bp, Homo sapiens
ctgctctgctttgcaggtgg

SEQ ID NO: 7067809 - DNA, 22 bp, Homo sapiens
ctgctctggcgtactcggcatc

SEQ ID NO: 7067810 - DNA, 22 bp, Homo sapiens
ctgcccagaatcactcactcga

SEQ ID NO: 7067811 - DNA, 22 bp, Homo sapiens
ctgcccagaatcactcactcga

SEQ ID NO: 7067812 - DNA, 22 bp, Homo sapiens
ctgctcagtaatagtcctatct

SEQ ID NO: 7067813 - DNA, 22 bp, Homo sapiens
ctgcccacttggccaccttcta

SEQ ID NO: 7067814 - DNA, 22 bp, Homo sapiens
ctgcccagaagcttagagctta

SEQ ID NO: 7067815 - DNA, 22 bp, Homo sapiens
ctgcccagaatcactcactcga

SEQ ID NO: 7067816 - DNA, 22 bp, Homo sapiens
ataaatatcactgttgtccctc

SEQ ID NO: 7067817 - DNA, 22 bp, Homo sapiens
ataaatatcactgttgtccctc

SEQ ID NO: 7067818 - DNA, 22 bp, Homo sapiens
ataaatatcactgttgtccctc

SEQ ID NO: 7067819 - DNA, 22 bp, Homo sapiens
ataaatatcactgttgtccctc

SEQ ID NO: 7067820 - DNA, 22 bp, Homo sapiens
ctgcccacagttctctgccatg

SEQ ID NO: 7067821 - DNA, 22 bp, Homo sapiens
ctgcccacagttctctgccatg

SEQ ID NO: 7067822 - DNA, 22 bp, Homo sapiens
ctgcccaccacacctgctcctg

SEQ ID NO: 7067823 - DNA, 22 bp, Homo sapiens
ctgcccaccccgaggcaggaag

SEQ ID NO: 7067824 - DNA, 22 bp, Homo sapiens
ctgcccactatgttgtcatggg

SEQ ID NO: 7067825 - DNA, 22 bp, Homo sapiens
ataatataatcctacttcccat

SEQ ID NO: 7067826 - DNA, 22 bp, Homo sapiens
ataatatttgcattactgtgat

SEQ ID NO: 7067827 - DNA, 22 bp, Homo sapiens
ataatatttgcattactgtgat

SEQ ID NO: 7067828 - DNA, 22 bp, Homo sapiens
ctgctgtgtgaccatggacagg

SEQ ID NO: 7067829 - DNA, 22 bp, Homo sapiens
ataatatttggataggacagta

SEQ ID NO: 7067830 - DNA, 22 bp, Homo sapiens
ctgctgtgtgcttacttgggtt

SEQ ID NO: 7067831 - DNA, 22 bp, Homo sapiens
ctgcttctagcaccaagtccct

SEQ ID NO: 7067832 - DNA, 22 bp, Homo sapiens
ctgcttctagcaccaagtccct

SEQ ID NO: 7067833 - DNA, 22 bp, Homo sapiens
ctgcttctccaaagtaggactt

SEQ ID NO: 7067834 - DNA, 22 bp, Homo sapiens
ctgcttctgggatgatggagta

SEQ ID NO: 7067835 - DNA, 18 bp, Homo sapiens
ctgcttctgtctgccagt

SEQ ID NO: 7067836 - DNA, 18 bp, Homo sapiens
ctgcttctgtctgccagt

SEQ ID NO: 7067837 - DNA, 18 bp, Homo sapiens
ctgcttgggagacgtcag

SEQ ID NO: 7067838 - DNA, 22 bp, Homo sapiens
ctgcttgggtcctggcatgggt

SEQ ID NO: 7067839 - DNA, 22 bp, Homo sapiens
ctgctttaatgtaagatatacc

SEQ ID NO: 7067840 - DNA, 19 bp, Homo sapiens
atacaagactagcatttac

SEQ ID NO: 7067841 - DNA, 22 bp, Homo sapiens
atacaagactcagcacagacgg

SEQ ID NO: 7067842 - DNA, 22 bp, Homo sapiens
ctgaggcctctgttcaccagaa

SEQ ID NO: 7067843 - DNA, 22 bp, Homo sapiens
ctgaggctgggctgagggtata

SEQ ID NO: 7067844 - DNA, 22 bp, Homo sapiens
ctgaggcctcgttggctggaac

SEQ ID NO: 7067845 - DNA, 22 bp, Homo sapiens
ctgaggcctctctcctgggctt

SEQ ID NO: 7067846 - DNA, 22 bp, Homo sapiens
ctgaggcctctctcctgggctt

SEQ ID NO: 7067847 - DNA, 22 bp, Homo sapiens
ctgaggctgggctgagggtata

SEQ ID NO: 7067848 - DNA, 22 bp, Homo sapiens
ctgaggctgggcttgccttctt

SEQ ID NO: 7067849 - DNA, 22 bp, Homo sapiens
ctgaggctggggaagggaagtg

SEQ ID NO: 7067850 - DNA, 18 bp, Homo sapiens
ctgaggcttagagaggtt

SEQ ID NO: 7067851 - DNA, 18 bp, Homo sapiens
ctgaggcttagagaggtt

SEQ ID NO: 7067852 - DNA, 22 bp, Homo sapiens
ctgaggcttctctagttcagct

SEQ ID NO: 7067853 - DNA, 22 bp, Homo sapiens
ctgaggcttctctagttcagct

SEQ ID NO: 7067854 - DNA, 22 bp, Homo sapiens
ctgaggcttggaggggtctggt

SEQ ID NO: 7067855 - DNA, 22 bp, Homo sapiens
ctgaggcttgtcctctcagctt

SEQ ID NO: 7067856 - DNA, 22 bp, Homo sapiens
ctgaggcttgtcctctcagctt

SEQ ID NO: 7067857 - DNA, 22 bp, Homo sapiens
ctgaggctttgtgtgcatgcct

SEQ ID NO: 7067858 - DNA, 22 bp, Homo sapiens
ctgaggctttgtgtgcatgcct

SEQ ID NO: 7067859 - DNA, 22 bp, Homo sapiens
ctgaggctttgtgtgcatgcct

SEQ ID NO: 7067860 - DNA, 20 bp, Homo sapiens
ctgaggggtctgacttggac

SEQ ID NO: 7067861 - DNA, 23 bp, Homo sapiens
ctgaggtaaaatattctgaagga

SEQ ID NO: 7067862 - DNA, 22 bp, Homo sapiens
ctgaggtagctgtgaatgttct

SEQ ID NO: 7067863 - DNA, 22 bp, Homo sapiens
ctgaggtatgtgggactagcct

SEQ ID NO: 7067864 - DNA, 22 bp, Homo sapiens
ctgaggtatgtgggactagcct

SEQ ID NO: 7067865 - DNA, 22 bp, Homo sapiens
ctgaggtcaattaatcaacaac

SEQ ID NO: 7067866 - DNA, 22 bp, Homo sapiens
ctgaggtcaccccactggctgt

SEQ ID NO: 7067867 - DNA, 22 bp, Homo sapiens
ctgaggtcagagtttagtctgg

SEQ ID NO: 7067868 - DNA, 22 bp, Homo sapiens
ctgaggtcagagtttagtctgg

SEQ ID NO: 7067869 - DNA, 22 bp, Homo sapiens
ctgaggcaggagaattgctgga

SEQ ID NO: 7067870 - DNA, 22 bp, Homo sapiens
ctgaggcaggagagttgcttga

SEQ ID NO: 7067871 - DNA, 22 bp, Homo sapiens
ctgaggcaggatggcctggctg

SEQ ID NO: 7067872 - DNA, 22 bp, Homo sapiens
ctgaggcaggcagatcacttga

SEQ ID NO: 7067873 - DNA, 22 bp, Homo sapiens
ctgaggcaggggcagctggaga

SEQ ID NO: 7067874 - DNA, 22 bp, Homo sapiens
ctgaggcaggggcagctggaga

SEQ ID NO: 7067875 - DNA, 22 bp, Homo sapiens
ctgaggcagtttaatttttgaa

SEQ ID NO: 7067876 - DNA, 22 bp, Homo sapiens
ctgaggcatgaatgtgggcttt

SEQ ID NO: 7067877 - DNA, 22 bp, Homo sapiens
ctgaggcatgaatgtgggcttt

SEQ ID NO: 7067878 - DNA, 21 bp, Homo sapiens
ctgaggcatgcaggcctgggc

SEQ ID NO: 7067879 - DNA, 22 bp, Homo sapiens
ctgaggcctaagacatgaatga

SEQ ID NO: 7067880 - DNA, 21 bp, Homo sapiens
agttgctgctgctgcaggtga

SEQ ID NO: 7067881 - DNA, 22 bp, Homo sapiens
agttgctgcttctctctagaga

SEQ ID NO: 7067882 - DNA, 22 bp, Homo sapiens
agttggcgggacatgtggaaag

SEQ ID NO: 7067883 - DNA, 22 bp, Homo sapiens
agttgggtttgtgtcagttgca

SEQ ID NO: 7067884 - DNA, 22 bp, Homo sapiens
ataaaggataatccattagact

SEQ ID NO: 7067885 - DNA, 22 bp, Homo sapiens
ataaatagtgaagggagccggt

SEQ ID NO: 7067886 - DNA, 22 bp, Homo sapiens
ataaatagtgctgccatgagta

SEQ ID NO: 7067887 - DNA, 22 bp, Homo sapiens
ataaatagtgctgccatgagta

SEQ ID NO: 7067888 - DNA, 22 bp, Homo sapiens
ataaatagtgtgtcataaagtc

SEQ ID NO: 7067889 - DNA, 22 bp, Homo sapiens
ataaatagtgtgtcataaagtc

SEQ ID NO: 7067890 - DNA, 22 bp, Homo sapiens
ataaatagtgtgtcataaagtc

SEQ ID NO: 7067891 - DNA, 22 bp, Homo sapiens
ataaatatcactgttgtccctc

SEQ ID NO: 7067892 - DNA, 22 bp, Homo sapiens
ataaatatcactgttgtccctc

SEQ ID NO: 7067893 - DNA, 22 bp, Homo sapiens
ctgccaggactgacgtcttcag

SEQ ID NO: 7067894 - DNA, 22 bp, Homo sapiens
ctgccaggcacgtgcagcatca

SEQ ID NO: 7067895 - DNA, 22 bp, Homo sapiens
ctgccaggcactgggctctgca

SEQ ID NO: 7067896 - DNA, 22 bp, Homo sapiens
ctgccaggcctcatcccagcca

SEQ ID NO: 7067897 - DNA, 22 bp, Homo sapiens
ctgccaggcctcatcccagcca

SEQ ID NO: 7067898 - DNA, 22 bp, Homo sapiens
ctgccaggcctccgctgtcccc

SEQ ID NO: 7067899 - DNA, 22 bp, Homo sapiens
ataaaagtaggaccaacttaca

SEQ ID NO: 7067900 - DNA, 22 bp, Homo sapiens
agtttgtactgaattcaattta

SEQ ID NO: 7067901 - DNA, 17 bp, Homo sapiens
ctgcagctggagggcca

SEQ ID NO: 7067902 - DNA, 22 bp, Homo sapiens
ctgcagctatattttcccacag

SEQ ID NO: 7067903 - DNA, 22 bp, Homo sapiens
agttgtcacctctattcaaatc

SEQ ID NO: 7067904 - DNA, 20 bp, Homo sapiens
agtttaagaaaaagctccag

SEQ ID NO: 7067905 - DNA, 22 bp, Homo sapiens
ctctcctttactgcagagagcg

SEQ ID NO: 7067906 - DNA, 20 bp, Homo sapiens
ctctccttgccgacttggca

SEQ ID NO: 7067907 - DNA, 22 bp, Homo sapiens
ctctcgccagcggggctgcgct

SEQ ID NO: 7067908 - DNA, 20 bp, Homo sapiens
ctctcccagcacagcttcct

SEQ ID NO: 7067909 - DNA, 20 bp, Homo sapiens
ctctcccagcacagcttcct

SEQ ID NO: 7067910 - DNA, 20 bp, Homo sapiens
ctctcccagcacagcttcct

SEQ ID NO: 7067911 - DNA, 22 bp, Homo sapiens
ctctcccagtcaggctcaggat

SEQ ID NO: 7067912 - DNA, 22 bp, Homo sapiens
agtgctggcccatagctgctgg

SEQ ID NO: 7067913 - DNA, 22 bp, Homo sapiens
agtgctggcccatagctgctgg

SEQ ID NO: 7067914 - DNA, 22 bp, Homo sapiens
agtgctggcccatagctgctgg

SEQ ID NO: 7067915 - DNA, 22 bp, Homo sapiens
agtgctgggattacaggcataa

SEQ ID NO: 7067916 - DNA, 22 bp, Homo sapiens
agtgctgggattacaggcataa

SEQ ID NO: 7067917 - DNA, 22 bp, Homo sapiens
agtgctgggattgcaggcatga

SEQ ID NO: 7067918 - DNA, 22 bp, Homo sapiens
agtgctgggattgcaggcatga

SEQ ID NO: 7067919 - DNA, 22 bp, Homo sapiens
agtgctgggctatctactgcta

SEQ ID NO: 7067920 - DNA, 19 bp, Homo sapiens
ctctccacctaacaggtat

SEQ ID NO: 7067921 - DNA, 23 bp, Homo sapiens
ctctccaccttcccacccaggga

SEQ ID NO: 7067922 - DNA, 22 bp, Homo sapiens
ctctccatctgtgtgacctccc

SEQ ID NO: 7067923 - DNA, 22 bp, Homo sapiens
ctctccattccctacagttttc

SEQ ID NO: 7067924 - DNA, 22 bp, Homo sapiens
ctctccattccctacagttttc

SEQ ID NO: 7067925 - DNA, 20 bp, Homo sapiens
ctctcccagcacagcttcct

SEQ ID NO: 7067926 - DNA, 18 bp, Homo sapiens
ctcctttccctacacctc

SEQ ID NO: 7067927 - DNA, 18 bp, Homo sapiens
ctcctttccctacacctc

SEQ ID NO: 7067928 - DNA, 22 bp, Homo sapiens
ctcctttgatcccaaatgaccc

SEQ ID NO: 7067929 - DNA, 22 bp, Homo sapiens
ctcctgagtagtagcattgtca

SEQ ID NO: 7067930 - DNA, 22 bp, Homo sapiens
ctccagagagtccagctctggg

SEQ ID NO: 7067931 - DNA, 23 bp, Homo sapiens
agtgctgaattgaaagctccagg

SEQ ID NO: 7067932 - DNA, 22 bp, Homo sapiens
agtgctgactctgggcacagtg

SEQ ID NO: 7067933 - DNA, 22 bp, Homo sapiens
agtgctgactctgggcacagtg

SEQ ID NO: 7067934 - DNA, 22 bp, Homo sapiens
agtgctgaggccatactccata

SEQ ID NO: 7067935 - DNA, 22 bp, Homo sapiens
agtgctgagtgattgcaaagga

SEQ ID NO: 7067936 - DNA, 23 bp, Homo sapiens
agtgctggagaagcttctggctt

SEQ ID NO: 7067937 - DNA, 22 bp, Homo sapiens
agtgctggagggaggcaggttc

SEQ ID NO: 7067938 - DNA, 22 bp, Homo sapiens
agtgctggattacaggcgtgag

SEQ ID NO: 7067939 - DNA, 22 bp, Homo sapiens
agtgctggattacaggcgtgag

SEQ ID NO: 7067940 - DNA, 22 bp, Homo sapiens
agtgctggattacaggcgtgag

SEQ ID NO: 7067941 - DNA, 22 bp, Homo sapiens
ctcctgaggaaaagcttggtca

SEQ ID NO: 7067942 - DNA, 22 bp, Homo sapiens
ctcctgaggacttctattgggt

SEQ ID NO: 7067943 - DNA, 22 bp, Homo sapiens
ctcctgagggatgcttaggctt

SEQ ID NO: 7067944 - DNA, 21 bp, Homo sapiens
ctcttgtctttgctcagtagc

SEQ ID NO: 7067945 - DNA, 22 bp, Homo sapiens
ctcttgggagtgctctggagaa

SEQ ID NO: 7067946 - DNA, 19 bp, Homo sapiens
ctcttgggtggcagaggcc

SEQ ID NO: 7067947 - DNA, 22 bp, Homo sapiens
ctcttctttccatccctagcca

SEQ ID NO: 7067948 - DNA, 22 bp, Homo sapiens
ctcttagctgctgttctttgag

SEQ ID NO: 7067949 - DNA, 22 bp, Homo sapiens
ctcttgccagagatgagactct

SEQ ID NO: 7067950 - DNA, 21 bp, Homo sapiens
ctcttgctgatgtctccttta

SEQ ID NO: 7067951 - DNA, 22 bp, Homo sapiens
agtggtggagccaggaaatgtg

SEQ ID NO: 7067952 - DNA, 22 bp, Homo sapiens
agtggtggagccaggaaatgtg

SEQ ID NO: 7067953 - DNA, 22 bp, Homo sapiens
agtggtgctgcgcgcggagctc

SEQ ID NO: 7067954 - DNA, 22 bp, Homo sapiens
agtggtggagagatgaggacac

SEQ ID NO: 7067955 - DNA, 22 bp, Homo sapiens
ctctgtgaacccctcctttctt

SEQ ID NO: 7067956 - DNA, 22 bp, Homo sapiens
ctctgtgagggtctgtacagaa

SEQ ID NO: 7067957 - DNA, 22 bp, Homo sapiens
ctctgtcccagacccacctctc

SEQ ID NO: 7067958 - DNA, 22 bp, Homo sapiens
ctctgtcccagacccacctctc

SEQ ID NO: 7067959 - DNA, 22 bp, Homo sapiens
ctctgtcctccacctgctttca

SEQ ID NO: 7067960 - DNA, 22 bp, Homo sapiens
ctctgtcctccacctgctttca

SEQ ID NO: 7067961 - DNA, 22 bp, Homo sapiens
ctctggagatggttctcaattg

SEQ ID NO: 7067962 - DNA, 22 bp, Homo sapiens
ctctggagaggttcccatggga

SEQ ID NO: 7067963 - DNA, 22 bp, Homo sapiens
ctctggagatggttctcaattg

SEQ ID NO: 7067964 - DNA, 22 bp, Homo sapiens
ctctggagaactccttgtgtct

SEQ ID NO: 7067965 - DNA, 23 bp, Homo sapiens
ctctggagatcctctgcctgggt

SEQ ID NO: 7067966 - DNA, 19 bp, Homo sapiens
ctctctccagtggctggct

SEQ ID NO: 7067967 - DNA, 20 bp, Homo sapiens
ctctctccatctcagtggcc

SEQ ID NO: 7067968 - DNA, 22 bp, Homo sapiens
ctctgctgcaggaaggcgtgca

SEQ ID NO: 7067969 - DNA, 22 bp, Homo sapiens
agtgggagaatgaataagggcc

SEQ ID NO: 7067970 - DNA, 22 bp, Homo sapiens
agtgggagagaagcaagtagta

SEQ ID NO: 7067971 - DNA, 22 bp, Homo sapiens
ctctggggttagatctgatgct

SEQ ID NO: 7067972 - DNA, 22 bp, Homo sapiens
ctctgtagaaacagggcagaag

SEQ ID NO: 7067973 - DNA, 22 bp, Homo sapiens
ctctgtagaaagagcccaggtg

SEQ ID NO: 7067974 - DNA, 22 bp, Homo sapiens
agtggctgttccaggtgaggac

SEQ ID NO: 7067975 - DNA, 22 bp, Homo sapiens
agtggctgttccaggtgaggac

SEQ ID NO: 7067976 - DNA, 22 bp, Homo sapiens
agtggctgtttataggtgggta

SEQ ID NO: 7067977 - DNA, 22 bp, Homo sapiens
agtggcttgctctgcctcagcc

SEQ ID NO: 7067978 - DNA, 22 bp, Homo sapiens
agtggctttttagtggcagatg

SEQ ID NO: 7067979 - DNA, 22 bp, Homo sapiens
agtatcatgttggaattaatca

SEQ ID NO: 7067980 - DNA, 22 bp, Homo sapiens
agtatgaagaatacatagatga

SEQ ID NO: 7067981 - DNA, 22 bp, Homo sapiens
cggggttcatccatgctgtggc

SEQ ID NO: 7067982 - DNA, 22 bp, Homo sapiens
cggggttcatccatgctgtggc

SEQ ID NO: 7067983 - DNA, 22 bp, Homo sapiens
cggggttcatccatgctgtggc

SEQ ID NO: 7067984 - DNA, 22 bp, Homo sapiens
cgggttcacgccattctcctgc

SEQ ID NO: 7067985 - DNA, 22 bp, Homo sapiens
cgggttcacgccattctcctgc

SEQ ID NO: 7067986 - DNA, 22 bp, Homo sapiens
ctcaaatataagctaaatgtgg

SEQ ID NO: 7067987 - DNA, 22 bp, Homo sapiens
agtcccagactccagttttctg

SEQ ID NO: 7067988 - DNA, 22 bp, Homo sapiens
agtcccagagaggtcggggcca

SEQ ID NO: 7067989 - DNA, 20 bp, Homo sapiens
agtcccagatcaaatttctg

SEQ ID NO: 7067990 - DNA, 22 bp, Homo sapiens
agtcccagatctacaggaggga

SEQ ID NO: 7067991 - DNA, 22 bp, Homo sapiens
agtcccagatctccattcggtc

SEQ ID NO: 7067992 - DNA, 22 bp, Homo sapiens
agtcccagatgacccagctact

SEQ ID NO: 7067993 - DNA, 22 bp, Homo sapiens
agtcccagcccagtcctgtaag

SEQ ID NO: 7067994 - DNA, 22 bp, Homo sapiens
agtcccagcctaggctgtgctg

SEQ ID NO: 7067995 - DNA, 22 bp, Homo sapiens
agtcccagcctgtaggattggg

SEQ ID NO: 7067996 - DNA, 22 bp, Homo sapiens
ctcagaaatcccactctgtgta

SEQ ID NO: 7067997 - DNA, 22 bp, Homo sapiens
ctcagaaattacaaaagggaca

SEQ ID NO: 7067998 - DNA, 22 bp, Homo sapiens
ctcagaagaacaaaggctctac

SEQ ID NO: 7067999 - DNA, 22 bp, Homo sapiens
ctcagaagccttcagtcttggc

SEQ ID NO: 7068000 - DNA, 22 bp, Homo sapiens
ctcagaatttagggctctgagg

SEQ ID NO: 7068001 - DNA, 22 bp, Homo sapiens
ctcagagaaaaggagcaagggt

SEQ ID NO: 7068002 - DNA, 22 bp, Homo sapiens
ctcagagggttgaaggtgctct

SEQ ID NO: 7068003 - DNA, 22 bp, Homo sapiens
ctcagaggtcaagagcagagct

SEQ ID NO: 7068004 - DNA, 22 bp, Homo sapiens
ctcagaggtcaagagcagagct

SEQ ID NO: 7068005 - DNA, 23 bp, Homo sapiens
ctcagaggtgtttttcacttact

SEQ ID NO: 7068006 - DNA, 22 bp, Homo sapiens
ctcagagtccccacatctgggt

SEQ ID NO: 7068007 - DNA, 22 bp, Homo sapiens
ctcagataatctttgagtcttc

SEQ ID NO: 7068008 - DNA, 17 bp, Homo sapiens
agtgaaatttacattgc

SEQ ID NO: 7068009 - DNA, 17 bp, Homo sapiens
agtgaaatttacattgc

SEQ ID NO: 7068010 - DNA, 21 bp, Homo sapiens
agtgacagaggaaggtgcata

SEQ ID NO: 7068011 - DNA, 21 bp, Homo sapiens
agtgacagaggaaggtgcata

SEQ ID NO: 7068012 - DNA, 22 bp, Homo sapiens
agtgacagattaccggcagagc

SEQ ID NO: 7068013 - DNA, 22 bp, Homo sapiens
agtgacagccaaatccatccat

SEQ ID NO: 7068014 - DNA, 22 bp, Homo sapiens
agtgacagctgggaaggtgaaa

SEQ ID NO: 7068015 - DNA, 22 bp, Homo sapiens
agtgacaggggaggcaggtgtg

SEQ ID NO: 7068016 - DNA, 22 bp, Homo sapiens
ctccagaaattcaacagcaaat

SEQ ID NO: 7068017 - DNA, 22 bp, Homo sapiens
ctccagaaatttggatgcagca

SEQ ID NO: 7068018 - DNA, 22 bp, Homo sapiens
agtctccttaaatatttcccag

SEQ ID NO: 7068019 - DNA, 22 bp, Homo sapiens
agtctccttggcctcaatgcct

SEQ ID NO: 7068020 - DNA, 22 bp, Homo sapiens
ctcagggacaaggggagacccc

SEQ ID NO: 7068021 - DNA, 22 bp, Homo sapiens
ctcagggacggaggcttgcgga

SEQ ID NO: 7068022 - DNA, 22 bp, Homo sapiens
ctcagggacgttagaggacagg

SEQ ID NO: 7068023 - DNA, 22 bp, Homo sapiens
ctcagggacttggatcctggcc

SEQ ID NO: 7068024 - DNA, 22 bp, Homo sapiens
ctcagggagagccaagagttcc

SEQ ID NO: 7068025 - DNA, 22 bp, Homo sapiens
ctcagggaggagcttctgggcc

SEQ ID NO: 7068026 - DNA, 22 bp, Homo sapiens
ctcagggaggcctctgctggtt

SEQ ID NO: 7068027 - DNA, 22 bp, Homo sapiens
ctcagggaggtcctgtgctgaa

SEQ ID NO: 7068028 - DNA, 22 bp, Homo sapiens
ctcagcccggtgctcgtgccac

SEQ ID NO: 7068029 - DNA, 22 bp, Homo sapiens
ctcagcctgtgaagagcagagg

SEQ ID NO: 7068030 - DNA, 22 bp, Homo sapiens
ctcagctccagccctcagcagc

SEQ ID NO: 7068031 - DNA, 22 bp, Homo sapiens
ctcagctccaggtgtgcatctt

SEQ ID NO: 7068032 - DNA, 23 bp, Homo sapiens
agggtgagcaagctatggagacc

SEQ ID NO: 7068033 - DNA, 23 bp, Homo sapiens
agggtgagcaagctatggagacc

SEQ ID NO: 7068034 - DNA, 20 bp, Homo sapiens
agggtgagacatgagcctcc

SEQ ID NO: 7068035 - DNA, 20 bp, Homo sapiens
agggtgagacatgagcctcc

SEQ ID NO: 7068036 - DNA, 20 bp, Homo sapiens
agggtgagacatgagcctcc

SEQ ID NO: 7068037 - DNA, 22 bp, Homo sapiens
agggtgaatctcacaactctta

SEQ ID NO: 7068038 - DNA, 22 bp, Homo sapiens
agggtgaatctcacaactctta

SEQ ID NO: 7068039 - DNA, 22 bp, Homo sapiens
agggtctgtggatgcatctggg

SEQ ID NO: 7068040 - DNA, 22 bp, Homo sapiens
agggtctctggagagctgagga

SEQ ID NO: 7068041 - DNA, 22 bp, Homo sapiens
agggtctgaccaccagtaggga

SEQ ID NO: 7068042 - DNA, 22 bp, Homo sapiens
agggtctgactgaatggaaaag

SEQ ID NO: 7068043 - DNA, 20 bp, Homo sapiens
agggtctgctgggtaggaca

SEQ ID NO: 7068044 - DNA, 17 bp, Homo sapiens
agggtcaggtgaagttc

SEQ ID NO: 7068045 - DNA, 22 bp, Homo sapiens
agggtcaggttaagggagtcat

SEQ ID NO: 7068046 - DNA, 22 bp, Homo sapiens
agggtcaggagacactggcaac

SEQ ID NO: 7068047 - DNA, 22 bp, Homo sapiens
agggtcagggagtgagtattta

SEQ ID NO: 7068048 - DNA, 22 bp, Homo sapiens
agggtcaggagacactggcaac

SEQ ID NO: 7068049 - DNA, 22 bp, Homo sapiens
agggtcagagtcaggtgcagta

SEQ ID NO: 7068050 - DNA, 22 bp, Homo sapiens
agggtcacctgcttgccagggc

SEQ ID NO: 7068051 - DNA, 22 bp, Homo sapiens
agggtcagagatcggccatgtg

SEQ ID NO: 7068052 - DNA, 22 bp, Homo sapiens
cctgccctatgaccagcttcac

SEQ ID NO: 7068053 - DNA, 22 bp, Homo sapiens
cctgccctagagatgacacaat

SEQ ID NO: 7068054 - DNA, 22 bp, Homo sapiens
cctgcccctcaaggcctggtgc

SEQ ID NO: 7068055 - DNA, 22 bp, Homo sapiens
cctgcccagggtcaccacagag

SEQ ID NO: 7068056 - DNA, 22 bp, Homo sapiens
cctgcccatactgacctctaat

SEQ ID NO: 7068057 - DNA, 22 bp, Homo sapiens
cctgcccaggagtctctctgtg

SEQ ID NO: 7068058 - DNA, 22 bp, Homo sapiens
cctgcccaggagtctctctgtg

SEQ ID NO: 7068059 - DNA, 19 bp, Homo sapiens
cctctgccagcccgcctct

SEQ ID NO: 7068060 - DNA, 22 bp, Homo sapiens
cctgccaggacattgcttgaag

SEQ ID NO: 7068061 - DNA, 22 bp, Homo sapiens
cctgcccagcttcacctcaggc

SEQ ID NO: 7068062 - DNA, 22 bp, Homo sapiens
cctctgcacttcaccttagctc

SEQ ID NO: 7068063 - DNA, 22 bp, Homo sapiens
cctctgccacctcccacgaggc

SEQ ID NO: 7068064 - DNA, 22 bp, Homo sapiens
cctctctctgcatctggagggc

SEQ ID NO: 7068065 - DNA, 22 bp, Homo sapiens
cctctctctcctgcacacacac

SEQ ID NO: 7068066 - DNA, 22 bp, Homo sapiens
cctctctccaattttcacctca

SEQ ID NO: 7068067 - DNA, 23 bp, Homo sapiens
cctctctccctgtttggcaaata

SEQ ID NO: 7068068 - DNA, 22 bp, Homo sapiens
cctctctccttcctttgccaaa

SEQ ID NO: 7068069 - DNA, 22 bp, Homo sapiens
cctgctgaggtcagccacccaa

SEQ ID NO: 7068070 - DNA, 22 bp, Homo sapiens
cctgctcttatagctgtttcca

SEQ ID NO: 7068071 - DNA, 22 bp, Homo sapiens
cctggaaagctgccctgtgaca

SEQ ID NO: 7068072 - DNA, 22 bp, Homo sapiens
cctgctctgccaagtcctcttt

SEQ ID NO: 7068073 - DNA, 22 bp, Homo sapiens
cctgctctgccaagtcctcttt

SEQ ID NO: 7068074 - DNA, 22 bp, Homo sapiens
cctgctctgccaagtcctcttt

SEQ ID NO: 7068075 - DNA, 22 bp, Homo sapiens
cctgctctgccaagtcctcttt

SEQ ID NO: 7068076 - DNA, 22 bp, Homo sapiens
cctgctctggtttagtcagtct

SEQ ID NO: 7068077 - DNA, 22 bp, Homo sapiens
cctgcctggcttccagaagaga

SEQ ID NO: 7068078 - DNA, 22 bp, Homo sapiens
cctgctctagactctgggaagg

SEQ ID NO: 7068079 - DNA, 22 bp, Homo sapiens
cctgctctccatacactttcta

SEQ ID NO: 7068080 - DNA, 22 bp, Homo sapiens
cctgctctccatacactttcta

SEQ ID NO: 7068081 - DNA, 22 bp, Homo sapiens
cctggaaggacaatagatagtg

SEQ ID NO: 7068082 - DNA, 22 bp, Homo sapiens
cctggctggatggagcccctgg

SEQ ID NO: 7068083 - DNA, 22 bp, Homo sapiens
cctggctggactggaccgtggc

SEQ ID NO: 7068084 - DNA, 22 bp, Homo sapiens
cctgggaaggggaagagaattc

SEQ ID NO: 7068085 - DNA, 22 bp, Homo sapiens
cctgggaaggtgaggccctgga

SEQ ID NO: 7068086 - DNA, 22 bp, Homo sapiens
cctgggaagtcagccaaggacg

SEQ ID NO: 7068087 - DNA, 22 bp, Homo sapiens
cctggcagctcctccccggcgg

SEQ ID NO: 7068088 - DNA, 19 bp, Homo sapiens
cctggccagacttctgccc

SEQ ID NO: 7068089 - DNA, 22 bp, Homo sapiens
aggtggggtgagctgcagacta

SEQ ID NO: 7068090 - DNA, 22 bp, Homo sapiens
cctttggtggttttcagagatc

SEQ ID NO: 7068091 - DNA, 22 bp, Homo sapiens
cgagcatgatgacggctgtggc

SEQ ID NO: 7068092 - DNA, 22 bp, Homo sapiens
agtatattggtgttattcctca

SEQ ID NO: 7068093 - DNA, 22 bp, Homo sapiens
agtatatttgttaagattattc

SEQ ID NO: 7068094 - DNA, 22 bp, Homo sapiens
cggctcactgcagctccgcctc

SEQ ID NO: 7068095 - DNA, 22 bp, Homo sapiens
cggctcactgcagctccgcctc

SEQ ID NO: 7068096 - DNA, 22 bp, Homo sapiens
cggaggcaaactcacctggctc

SEQ ID NO: 7068097 - DNA, 22 bp, Homo sapiens
cggaggggatacattttctgaa

SEQ ID NO: 7068098 - DNA, 22 bp, Homo sapiens
cggaggggtttgaacagaggag

SEQ ID NO: 7068099 - DNA, 22 bp, Homo sapiens
cggccaagccggggccccgaag

SEQ ID NO: 7068100 - DNA, 22 bp, Homo sapiens
ccttgcgttttacagcttctag

SEQ ID NO: 7068101 - DNA, 22 bp, Homo sapiens
ccttgctgaccatcacctttga

SEQ ID NO: 7068102 - DNA, 22 bp, Homo sapiens
ccttgctgcgtgctagcacaga

SEQ ID NO: 7068103 - DNA, 22 bp, Homo sapiens
ccttggagcggtcagcactggt

SEQ ID NO: 7068104 - DNA, 22 bp, Homo sapiens
aggtgggacccgtggggtgcga

SEQ ID NO: 7068105 - DNA, 22 bp, Homo sapiens
aggtgggaacccagcagggccc

SEQ ID NO: 7068106 - DNA, 22 bp, Homo sapiens
aggtgggaacccagcagggccc

SEQ ID NO: 7068107 - DNA, 22 bp, Homo sapiens
aggtggcttctggccaggtgtg

SEQ ID NO: 7068108 - DNA, 21 bp, Homo sapiens
aggtgggagaccatgtaggtc

SEQ ID NO: 7068109 - DNA, 22 bp, Homo sapiens
aggtgggcaatgaggcctgagt

SEQ ID NO: 7068110 - DNA, 21 bp, Homo sapiens
aggtggctgcatcctcagaag

SEQ ID NO: 7068111 - DNA, 22 bp, Homo sapiens
aggtggctggtccaggctgcag

SEQ ID NO: 7068112 - DNA, 22 bp, Homo sapiens
aggtggctgtattcagctgtaa

SEQ ID NO: 7068113 - DNA, 22 bp, Homo sapiens
aggtggcttctggccaggtgtg

SEQ ID NO: 7068114 - DNA, 22 bp, Homo sapiens
cctgggactcggccaggacaga

SEQ ID NO: 7068115 - DNA, 22 bp, Homo sapiens
cctgggagaactgctgggttgg

SEQ ID NO: 7068116 - DNA, 22 bp, Homo sapiens
cctgggaagttgtggctgcagt

SEQ ID NO: 7068117 - DNA, 22 bp, Homo sapiens
aggtgctggagtagaagaaaaa

SEQ ID NO: 7068118 - DNA, 22 bp, Homo sapiens
aggtgctggagtagaagaaaaa

SEQ ID NO: 7068119 - DNA, 22 bp, Homo sapiens
aggtgctggagtctgggcagga

SEQ ID NO: 7068120 - DNA, 22 bp, Homo sapiens
aggtgctgggcagcagtcattg

SEQ ID NO: 7068121 - DNA, 22 bp, Homo sapiens
aggtgctgtgctatgcacttgt

SEQ ID NO: 7068122 - DNA, 22 bp, Homo sapiens
aggtgctgttggcagcgggcag

SEQ ID NO: 7068123 - DNA, 22 bp, Homo sapiens
aggtgctgtttgtcagcagttt

SEQ ID NO: 7068124 - DNA, 22 bp, Homo sapiens
aggtgctgtttgtcagcagttt

SEQ ID NO: 7068125 - DNA, 22 bp, Homo sapiens
aggtggcagttgtggaaccatc

SEQ ID NO: 7068126 - DNA, 22 bp, Homo sapiens
aggtggctctgacagctctggt

SEQ ID NO: 7068127 - DNA, 22 bp, Homo sapiens
aggtggctctgacagctctggt

SEQ ID NO: 7068128 - DNA, 20 bp, Homo sapiens
aggtggctcttcctgggctt

SEQ ID NO: 7068129 - DNA, 22 bp, Homo sapiens
ccagtttttccagtgctttctg

SEQ ID NO: 7068130 - DNA, 21 bp, Homo sapiens
ccataattttgtttcagaagt

SEQ ID NO: 7068131 - DNA, 22 bp, Homo sapiens
ccatcctgtctgtggcctcagg

SEQ ID NO: 7068132 - DNA, 22 bp, Homo sapiens
ccatctccagtttattcttcct

SEQ ID NO: 7068133 - DNA, 22 bp, Homo sapiens
ccatctccagtttattcttcct

SEQ ID NO: 7068134 - DNA, 22 bp, Homo sapiens
ccatctgactgccacccaggcc

SEQ ID NO: 7068135 - DNA, 22 bp, Homo sapiens
cccagcagtacccaagcccttg

SEQ ID NO: 7068136 - DNA, 22 bp, Homo sapiens
cccagcagtggttctcaaactt

SEQ ID NO: 7068137 - DNA, 22 bp, Homo sapiens
aggctgtggtgggctttgagcc

SEQ ID NO: 7068138 - DNA, 22 bp, Homo sapiens
aggctgtgtttaagtggtaatg

SEQ ID NO: 7068139 - DNA, 22 bp, Homo sapiens
aggctgtgtttaagtggtaatg

SEQ ID NO: 7068140 - DNA, 22 bp, Homo sapiens
aggctgtgtggtcatggtggct

SEQ ID NO: 7068141 - DNA, 22 bp, Homo sapiens
aggctgtgtggtcatggtggct

SEQ ID NO: 7068142 - DNA, 22 bp, Homo sapiens
aggctgtgtttcccctggagct

SEQ ID NO: 7068143 - DNA, 19 bp, Homo sapiens
agggaatccggctgaggga

SEQ ID NO: 7068144 - DNA, 22 bp, Homo sapiens
agggaagggcagggtctatgca

SEQ ID NO: 7068145 - DNA, 23 bp, Homo sapiens
agggaagggggcttattccacag

SEQ ID NO: 7068146 - DNA, 22 bp, Homo sapiens
agggagaggttgaaacctcagt

SEQ ID NO: 7068147 - DNA, 22 bp, Homo sapiens
agggagaggttgaaacctcagt

SEQ ID NO: 7068148 - DNA, 22 bp, Homo sapiens
aggcttaatgagttaaatcact

SEQ ID NO: 7068149 - DNA, 18 bp, Homo sapiens
aggcttacagcagcaggc

SEQ ID NO: 7068150 - DNA, 22 bp, Homo sapiens
aggcttagaaattcagctgagt

SEQ ID NO: 7068151 - DNA, 22 bp, Homo sapiens
aggcttatagcttatatttaag

SEQ ID NO: 7068152 - DNA, 20 bp, Homo sapiens
aggcttcaaccatacacctt

SEQ ID NO: 7068153 - DNA, 22 bp, Homo sapiens
aggcttcaaggacagcagccac

SEQ ID NO: 7068154 - DNA, 22 bp, Homo sapiens
aggcttcaaggacctgagggaa

SEQ ID NO: 7068155 - DNA, 22 bp, Homo sapiens
aggcttcaaggttcttggcagg

SEQ ID NO: 7068156 - DNA, 22 bp, Homo sapiens
agggaagcttgttactgagaag

SEQ ID NO: 7068157 - DNA, 22 bp, Homo sapiens
agggaaggaaaagctgtcgctt

SEQ ID NO: 7068158 - DNA, 22 bp, Homo sapiens
agggaaggaggttagaacccac

SEQ ID NO: 7068159 - DNA, 22 bp, Homo sapiens
ccccagggaagctttgcttact

SEQ ID NO: 7068160 - DNA, 22 bp, Homo sapiens
ccccagggactggtttcatgga

SEQ ID NO: 7068161 - DNA, 22 bp, Homo sapiens
ccccagggactggtttcatgga

SEQ ID NO: 7068162 - DNA, 19 bp, Homo sapiens
ccccagggtaggctagggg

SEQ ID NO: 7068163 - DNA, 19 bp, Homo sapiens
ccccagggtaggctagggg

SEQ ID NO: 7068164 - DNA, 22 bp, Homo sapiens
ccccagggtcagtgtgtggagg

SEQ ID NO: 7068165 - DNA, 22 bp, Homo sapiens
ccccagggtcagtgtgtggagg

SEQ ID NO: 7068166 - DNA, 22 bp, Homo sapiens
ccccaggtggatggctcgcata

SEQ ID NO: 7068167 - DNA, 22 bp, Homo sapiens
agggagcaaaggtttcagggtt

SEQ ID NO: 7068168 - DNA, 22 bp, Homo sapiens
agggagcagggctcctttgggt

SEQ ID NO: 7068169 - DNA, 18 bp, Homo sapiens
agggagcatctggttgcc

SEQ ID NO: 7068170 - DNA, 22 bp, Homo sapiens
agggagcatgggtgaagcaggc

SEQ ID NO: 7068171 - DNA, 22 bp, Homo sapiens
agggagccaggaacgcaggtcg

SEQ ID NO: 7068172 - DNA, 22 bp, Homo sapiens
agggagcatgggtgaagcaggc

SEQ ID NO: 7068173 - DNA, 22 bp, Homo sapiens
agggagcatgggtgaagcaggc

SEQ ID NO: 7068174 - DNA, 21 bp, Homo sapiens
agggagcatgttagctttcga

SEQ ID NO: 7068175 - DNA, 22 bp, Homo sapiens
agggagccagagttgggagctc

SEQ ID NO: 7068176 - DNA, 22 bp, Homo sapiens
agggcagctgtgagccactgtg

SEQ ID NO: 7068177 - DNA, 22 bp, Homo sapiens
agggcagcctctcagcctaggt

SEQ ID NO: 7068178 - DNA, 22 bp, Homo sapiens
agggcagcctgagtgctggccc

SEQ ID NO: 7068179 - DNA, 22 bp, Homo sapiens
agggcagcctgagtgctggccc

SEQ ID NO: 7068180 - DNA, 22 bp, Homo sapiens
agggcagctagctgtagaaaga

SEQ ID NO: 7068181 - DNA, 22 bp, Homo sapiens
agggaggagaatggactccttc

SEQ ID NO: 7068182 - DNA, 22 bp, Homo sapiens
agggaggagaatggactccttc

SEQ ID NO: 7068183 - DNA, 22 bp, Homo sapiens
agggaggagtcctcaaagtcat

SEQ ID NO: 7068184 - DNA, 22 bp, Homo sapiens
agggaggagtcctcaaagtcat

SEQ ID NO: 7068185 - DNA, 22 bp, Homo sapiens
agggccaggctcccatgtcagg

SEQ ID NO: 7068186 - DNA, 22 bp, Homo sapiens
agggccaggaacacctgaaggg

SEQ ID NO: 7068187 - DNA, 22 bp, Homo sapiens
agggccaggaacacctgaaggg

SEQ ID NO: 7068188 - DNA, 22 bp, Homo sapiens
agggccagctagagccctcgcc

SEQ ID NO: 7068189 - DNA, 22 bp, Homo sapiens
agggccagctagagccctcgcc

SEQ ID NO: 7068190 - DNA, 22 bp, Homo sapiens
agggccagctagagccctcgcc

SEQ ID NO: 7068191 - DNA, 18 bp, Homo sapiens
agggccagctgtgagtag

SEQ ID NO: 7068192 - DNA, 22 bp, Homo sapiens
ccctgggctcagagcaggtagc

SEQ ID NO: 7068193 - DNA, 22 bp, Homo sapiens
agggccagggaagctgtatttt

SEQ ID NO: 7068194 - DNA, 22 bp, Homo sapiens
ccctggcccctcactccgaggc

SEQ ID NO: 7068195 - DNA, 22 bp, Homo sapiens
ccctggcccctcactccgaggc

SEQ ID NO: 7068196 - DNA, 22 bp, Homo sapiens
ccctgtgtcttcttgcctttgt

SEQ ID NO: 7068197 - DNA, 22 bp, Homo sapiens
cccttagctcaatttcttgccc

SEQ ID NO: 7068198 - DNA, 22 bp, Homo sapiens
cccttagctccaaggggtttgg

SEQ ID NO: 7068199 - DNA, 22 bp, Homo sapiens
cctagactagaggcagggagcc

SEQ ID NO: 7068200 - DNA, 22 bp, Homo sapiens
cctcaaaggcctggcaccagaa

SEQ ID NO: 7068201 - DNA, 20 bp, Homo sapiens
cctcaagcagactgacagct

SEQ ID NO: 7068202 - DNA, 22 bp, Homo sapiens
cctcacacagttatctcttcat

SEQ ID NO: 7068203 - DNA, 22 bp, Homo sapiens
cctcagaatagtcctcagatca

SEQ ID NO: 7068204 - DNA, 18 bp, Homo sapiens
cctcacagacttccatgt

SEQ ID NO: 7068205 - DNA, 22 bp, Homo sapiens
cctcagagaaatgtctattcaa

SEQ ID NO: 7068206 - DNA, 22 bp, Homo sapiens
cctcagagacagtaactggaat

SEQ ID NO: 7068207 - DNA, 22 bp, Homo sapiens
cctccagctgcctcagtctctt

SEQ ID NO: 7068208 - DNA, 22 bp, Homo sapiens
cctccaggataagtcagggcct

SEQ ID NO: 7068209 - DNA, 23 bp, Homo sapiens
cctcccaggctgcgagtcccgag

SEQ ID NO: 7068210 - DNA, 22 bp, Homo sapiens
cctcccagtgcctccagagcag

SEQ ID NO: 7068211 - DNA, 22 bp, Homo sapiens
cctccccacagcccaggagact

SEQ ID NO: 7068212 - DNA, 22 bp, Homo sapiens
cctccccacagcccaggagact

SEQ ID NO: 7068213 - DNA, 22 bp, Homo sapiens
cctccccacagcccaggagact

SEQ ID NO: 7068214 - DNA, 22 bp, Homo sapiens
cctccccacccacggctggtgg

SEQ ID NO: 7068215 - DNA, 22 bp, Homo sapiens
cctctccttgcacccgtcccgc

SEQ ID NO: 7068216 - DNA, 22 bp, Homo sapiens
cctctccttgcacccgtcccgc

SEQ ID NO: 7068217 - DNA, 22 bp, Homo sapiens
cctctccttgcacccgtcccgc

SEQ ID NO: 7068218 - DNA, 22 bp, Homo sapiens
cctctctcagcttgctgcaact

SEQ ID NO: 7068219 - DNA, 21 bp, Homo sapiens
cctctctcattgtaatgaagt

SEQ ID NO: 7068220 - DNA, 22 bp, Homo sapiens
cctctctccaagggaaatccta

SEQ ID NO: 7068221 - DNA, 22 bp, Homo sapiens
aggccctgaagtcggcccctca

SEQ ID NO: 7068222 - DNA, 22 bp, Homo sapiens
aggccctgacctgggagatcta

SEQ ID NO: 7068223 - DNA, 22 bp, Homo sapiens
aggcccagtgtggcttcctgga

SEQ ID NO: 7068224 - DNA, 22 bp, Homo sapiens
aggcccagttatcctacttgtt

SEQ ID NO: 7068225 - DNA, 22 bp, Homo sapiens
aggccaggatagcatggatcag

SEQ ID NO: 7068226 - DNA, 20 bp, Homo sapiens
aggccaggaaatgtagttct

SEQ ID NO: 7068227 - DNA, 22 bp, Homo sapiens
aggccacaaccaccctgtgccc

SEQ ID NO: 7068228 - DNA, 22 bp, Homo sapiens
aggcatttttgttaatctttgg

SEQ ID NO: 7068229 - DNA, 23 bp, Homo sapiens
aggccagcgcagacaccgagcac

SEQ ID NO: 7068230 - DNA, 22 bp, Homo sapiens
aggcatggcatggggcagatgt

SEQ ID NO: 7068231 - DNA, 22 bp, Homo sapiens
aggcatgtgaccctggactcag

SEQ ID NO: 7068232 - DNA, 22 bp, Homo sapiens
aggcattacatctaaatattta

SEQ ID NO: 7068233 - DNA, 22 bp, Homo sapiens
aggcattctagaagtagaagta

SEQ ID NO: 7068234 - DNA, 22 bp, Homo sapiens
ccactgctctgccaggagctgg

SEQ ID NO: 7068235 - DNA, 22 bp, Homo sapiens
ccactgctctgccaggagctgg

SEQ ID NO: 7068236 - DNA, 21 bp, Homo sapiens
ccactgctcttccctagggcc

SEQ ID NO: 7068237 - DNA, 22 bp, Homo sapiens
ccactgctgttacttacgcaaa

SEQ ID NO: 7068238 - DNA, 22 bp, Homo sapiens
ccactggcatccagctgccatc

SEQ ID NO: 7068239 - DNA, 22 bp, Homo sapiens
aggcagttgtagagagggctct

SEQ ID NO: 7068240 - DNA, 20 bp, Homo sapiens
aggcatctgagtcacatctt

SEQ ID NO: 7068241 - DNA, 22 bp, Homo sapiens
aggcatctgagtttgcaagctt

SEQ ID NO: 7068242 - DNA, 22 bp, Homo sapiens
aggcatgactttggctgaagaa

SEQ ID NO: 7068243 - DNA, 22 bp, Homo sapiens
aggcagtggctgagaccagggg

SEQ ID NO: 7068244 - DNA, 22 bp, Homo sapiens
aggcagtggagctggaataggc

SEQ ID NO: 7068245 - DNA, 22 bp, Homo sapiens
aggcagtggagctggaataggc

SEQ ID NO: 7068246 - DNA, 22 bp, Homo sapiens
aggcagtgagcagggtgtcatg

SEQ ID NO: 7068247 - DNA, 22 bp, Homo sapiens
aggcagtgcagagtcctcttct

SEQ ID NO: 7068248 - DNA, 22 bp, Homo sapiens
aggcagtgctcaagacagcagc

SEQ ID NO: 7068249 - DNA, 22 bp, Homo sapiens
aggcagccatccaggaggctca

SEQ ID NO: 7068250 - DNA, 22 bp, Homo sapiens
aggcagccatctgcaggaagga

SEQ ID NO: 7068251 - DNA, 22 bp, Homo sapiens
aggcagccattaccaagggcat

SEQ ID NO: 7068252 - DNA, 22 bp, Homo sapiens
aggcagcctatggggagctcag

SEQ ID NO: 7068253 - DNA, 22 bp, Homo sapiens
aggcagcctggtttgaatggaa

SEQ ID NO: 7068254 - DNA, 22 bp, Homo sapiens
aggcagcctggtttgaatggaa

SEQ ID NO: 7068255 - DNA, 22 bp, Homo sapiens
aggcagcctttagacagtctgc

SEQ ID NO: 7068256 - DNA, 18 bp, Homo sapiens
aggcaggtgctggaagtc

SEQ ID NO: 7068257 - DNA, 22 bp, Homo sapiens
aggcagtcagccctgctagggt

SEQ ID NO: 7068258 - DNA, 19 bp, Homo sapiens
aggcagtcattggaatata

SEQ ID NO: 7068259 - DNA, 22 bp, Homo sapiens
aggcagtctagtccccaggcaa

SEQ ID NO: 7068260 - DNA, 22 bp, Homo sapiens
aggctgaggcgggaggatcact

SEQ ID NO: 7068261 - DNA, 22 bp, Homo sapiens
aggctgaggcgggaggatcact

SEQ ID NO: 7068262 - DNA, 22 bp, Homo sapiens
aggctgaggcgggaggatcact

SEQ ID NO: 7068263 - DNA, 22 bp, Homo sapiens
ccagtttaggtactaggctcta

SEQ ID NO: 7068264 - DNA, 22 bp, Homo sapiens
ccagtgcaccaagaggcctaga

SEQ ID NO: 7068265 - DNA, 22 bp, Homo sapiens
ccagtgcaggtgagcaccaggt

SEQ ID NO: 7068266 - DNA, 22 bp, Homo sapiens
aggctgaggcaggtggatcact

SEQ ID NO: 7068267 - DNA, 22 bp, Homo sapiens
aggctgaggcaggtggatcact

SEQ ID NO: 7068268 - DNA, 22 bp, Homo sapiens
aggctgaggcaggtggatcact

SEQ ID NO: 7068269 - DNA, 22 bp, Homo sapiens
aggctgaggcaggtggatcatt

SEQ ID NO: 7068270 - DNA, 22 bp, Homo sapiens
aggctgaggcaggtggatcatt

SEQ ID NO: 7068271 - DNA, 22 bp, Homo sapiens
aggctgaggcaggtggatcatt

SEQ ID NO: 7068272 - DNA, 22 bp, Homo sapiens
aggctgaggcgggaggatcact

SEQ ID NO: 7068273 - DNA, 22 bp, Homo sapiens
aggctgaggcgggaggatcact

SEQ ID NO: 7068274 - DNA, 22 bp, Homo sapiens
ccagtctgtgtgccagcctgcg

SEQ ID NO: 7068275 - DNA, 22 bp, Homo sapiens
ccagtgcacagccaggcaggtg

SEQ ID NO: 7068276 - DNA, 22 bp, Homo sapiens
aggctgagctgacctggtttgg

SEQ ID NO: 7068277 - DNA, 23 bp, Homo sapiens
aggctgagctctcccagcttcag

SEQ ID NO: 7068278 - DNA, 22 bp, Homo sapiens
ccagtctgtactttgctctgtt

SEQ ID NO: 7068279 - DNA, 22 bp, Homo sapiens
aggctgagcctgggcgtggtgg

SEQ ID NO: 7068280 - DNA, 22 bp, Homo sapiens
aggctgagcggggtcccagagc

SEQ ID NO: 7068281 - DNA, 22 bp, Homo sapiens
aggctgagcggggtcccagagc

SEQ ID NO: 7068282 - DNA, 22 bp, Homo sapiens
aggctgagcggggtcccagagc

SEQ ID NO: 7068283 - DNA, 23 bp, Homo sapiens
aggctgagctctcccagcttcag

SEQ ID NO: 7068284 - DNA, 23 bp, Homo sapiens
aggctgagctctcccagcttcag

SEQ ID NO: 7068285 - DNA, 22 bp, Homo sapiens
aggctgagccacggggctggct

SEQ ID NO: 7068286 - DNA, 22 bp, Homo sapiens
aggctgagcaaagggccttacc

SEQ ID NO: 7068287 - DNA, 22 bp, Homo sapiens
aggctgagccacggggctggct

SEQ ID NO: 7068288 - DNA, 22 bp, Homo sapiens
aggctgagccacggggctggct

SEQ ID NO: 7068289 - DNA, 22 bp, Homo sapiens
aggctgagcctgggcgtggtgg

SEQ ID NO: 7068290 - DNA, 22 bp, Homo sapiens
aggctgagagcaacgtgtcaga

SEQ ID NO: 7068291 - DNA, 22 bp, Homo sapiens
aggctgagagcaacgtgtcaga

SEQ ID NO: 7068292 - DNA, 22 bp, Homo sapiens
aggctgagataggtggatcatt

SEQ ID NO: 7068293 - DNA, 22 bp, Homo sapiens
aggctgagataggtggatcatt

SEQ ID NO: 7068294 - DNA, 22 bp, Homo sapiens
aggctgagataggtggatcatt

SEQ ID NO: 7068295 - DNA, 22 bp, Homo sapiens
aggctgagcaaagggccttacc

SEQ ID NO: 7068296 - DNA, 22 bp, Homo sapiens
aggctgagcaaagggccttacc

SEQ ID NO: 7068297 - DNA, 20 bp, Homo sapiens
aggctctgcctgcaggccca

SEQ ID NO: 7068298 - DNA, 22 bp, Homo sapiens
aggctgagactgtgcattagtg

SEQ ID NO: 7068299 - DNA, 22 bp, Homo sapiens
aggctgagactgtgcattagtg

SEQ ID NO: 7068300 - DNA, 22 bp, Homo sapiens
aggctgagagcaacgtgtcaga

SEQ ID NO: 7068301 - DNA, 22 bp, Homo sapiens
aggctgagagcaacgtgtcaga

SEQ ID NO: 7068302 - DNA, 22 bp, Homo sapiens
aggctctgcagtccatcccgtg

SEQ ID NO: 7068303 - DNA, 22 bp, Homo sapiens
aggctctgcagtgctggaggac

SEQ ID NO: 7068304 - DNA, 22 bp, Homo sapiens
aggctctgcagtgctggaggac

SEQ ID NO: 7068305 - DNA, 22 bp, Homo sapiens
aggctctgatcaggtggctgtg

SEQ ID NO: 7068306 - DNA, 22 bp, Homo sapiens
ccaggcacttcatcattagggt

SEQ ID NO: 7068307 - DNA, 22 bp, Homo sapiens
ccaggcacttgtttgccaggca

SEQ ID NO: 7068308 - DNA, 22 bp, Homo sapiens
ccaggcagggctcaaggaacct

SEQ ID NO: 7068309 - DNA, 22 bp, Homo sapiens
aggcctcatagtagacctgccc

SEQ ID NO: 7068310 - DNA, 22 bp, Homo sapiens
ccaggcctagcccctgagggta

SEQ ID NO: 7068311 - DNA, 22 bp, Homo sapiens
ccaggccctgctcctcacacca

SEQ ID NO: 7068312 - DNA, 22 bp, Homo sapiens
ccaggccctgctcctcacacca

SEQ ID NO: 7068313 - DNA, 22 bp, Homo sapiens
aggctccatgcaaaggctgttt

SEQ ID NO: 7068314 - DNA, 22 bp, Homo sapiens
aggctccattttcctgcagctg

SEQ ID NO: 7068315 - DNA, 21 bp, Homo sapiens
aggctcccagaaatgggcatc

SEQ ID NO: 7068316 - DNA, 22 bp, Homo sapiens
aggctcccatggtgtggcagga

SEQ ID NO: 7068317 - DNA, 22 bp, Homo sapiens
ccaggctctgagcctcactctt

SEQ ID NO: 7068318 - DNA, 22 bp, Homo sapiens
ccaggctctgcaaaatcaggct

SEQ ID NO: 7068319 - DNA, 22 bp, Homo sapiens
ccaggctctgcgctggacatgg

SEQ ID NO: 7068320 - DNA, 22 bp, Homo sapiens
aggctccttgctcacaggctca

SEQ ID NO: 7068321 - DNA, 22 bp, Homo sapiens
aggagaattaggaactcaagat

SEQ ID NO: 7068322 - DNA, 22 bp, Homo sapiens
aggagacagccaggggcctgag

SEQ ID NO: 7068323 - DNA, 22 bp, Homo sapiens
cagtctcttgcttcattagttg

SEQ ID NO: 7068324 - DNA, 22 bp, Homo sapiens
cagtctctgtcatctcatggga

SEQ ID NO: 7068325 - DNA, 22 bp, Homo sapiens
cagtctctggcagctgctggcc

SEQ ID NO: 7068326 - DNA, 22 bp, Homo sapiens
cagtctctctgaagtattaaga

SEQ ID NO: 7068327 - DNA, 22 bp, Homo sapiens
aggagaagccaagttgtgagca

SEQ ID NO: 7068328 - DNA, 19 bp, Homo sapiens
aggagaagactctctcccc

SEQ ID NO: 7068329 - DNA, 23 bp, Homo sapiens
aggagaagagatttccacatgca

SEQ ID NO: 7068330 - DNA, 22 bp, Homo sapiens
aggagaagccaagttgtgagca

SEQ ID NO: 7068331 - DNA, 22 bp, Homo sapiens
aggagaaagactggacagccaa

SEQ ID NO: 7068332 - DNA, 22 bp, Homo sapiens
aggacaggattccttgccttgc

SEQ ID NO: 7068333 - DNA, 22 bp, Homo sapiens
aggactgacttttgccatgaaa

SEQ ID NO: 7068334 - DNA, 22 bp, Homo sapiens
aggactgatgatggtgctgaca

SEQ ID NO: 7068335 - DNA, 22 bp, Homo sapiens
aggactttagagccagaaagac

SEQ ID NO: 7068336 - DNA, 22 bp, Homo sapiens
aggacagcccccaacagcaaca

SEQ ID NO: 7068337 - DNA, 22 bp, Homo sapiens
aggacagcatatgggaaccagt

SEQ ID NO: 7068338 - DNA, 21 bp, Homo sapiens
aggacaggaactggctgaata

SEQ ID NO: 7068339 - DNA, 21 bp, Homo sapiens
aggacaggaactggctgaata

SEQ ID NO: 7068340 - DNA, 22 bp, Homo sapiens
aggacagcagccattggcagtc

SEQ ID NO: 7068341 - DNA, 22 bp, Homo sapiens
aggacagcagtgctggcacttg

SEQ ID NO: 7068342 - DNA, 22 bp, Homo sapiens
aggaaggactgcagcatttggt

SEQ ID NO: 7068343 - DNA, 20 bp, Homo sapiens
aggaagctgagatgtagagg

SEQ ID NO: 7068344 - DNA, 22 bp, Homo sapiens
aggaagctgctaagaaacaatg

SEQ ID NO: 7068345 - DNA, 22 bp, Homo sapiens
aggaagctgggaaactgacatt

SEQ ID NO: 7068346 - DNA, 22 bp, Homo sapiens
aggaagctgggaaactgacatt

SEQ ID NO: 7068347 - DNA, 19 bp, Homo sapiens
aggaaggaacctgagtctg

SEQ ID NO: 7068348 - DNA, 19 bp, Homo sapiens
aggaaggaacctgagtctg

SEQ ID NO: 7068349 - DNA, 20 bp, Homo sapiens
aggaaggaagtttgcatgga

SEQ ID NO: 7068350 - DNA, 20 bp, Homo sapiens
aggaaggaagtttgcatgga

SEQ ID NO: 7068351 - DNA, 22 bp, Homo sapiens
aggaaggactgcagcatttggt

SEQ ID NO: 7068352 - DNA, 22 bp, Homo sapiens
aggaaggactgcagcatttggt

SEQ ID NO: 7068353 - DNA, 22 bp, Homo sapiens
aggagcctggctggcccacagg

SEQ ID NO: 7068354 - DNA, 19 bp, Homo sapiens
aggagccttgagcagtgag

SEQ ID NO: 7068355 - DNA, 22 bp, Homo sapiens
aggagacagccaggggcctgag

SEQ ID NO: 7068356 - DNA, 22 bp, Homo sapiens
aggagagaatgttccaggcttg

SEQ ID NO: 7068357 - DNA, 22 bp, Homo sapiens
aggagagaattactgggtgtca

SEQ ID NO: 7068358 - DNA, 22 bp, Homo sapiens
aggagagcaggccagccgtccc

SEQ ID NO: 7068359 - DNA, 22 bp, Homo sapiens
aggagaggctctaactctgtgt

SEQ ID NO: 7068360 - DNA, 22 bp, Homo sapiens
aggagaggctctaactctgtgt

SEQ ID NO: 7068361 - DNA, 20 bp, Homo sapiens
aggaggcaatgtagataagc

SEQ ID NO: 7068362 - DNA, 17 bp, Homo sapiens
aggaggatcagagagta

SEQ ID NO: 7068363 - DNA, 22 bp, Homo sapiens
aggaggaggtgggacacagtga

SEQ ID NO: 7068364 - DNA, 22 bp, Homo sapiens
aggaggaggtgggacacagtga

SEQ ID NO: 7068365 - DNA, 22 bp, Homo sapiens
aggaggaggctggagtacaccc

SEQ ID NO: 7068366 - DNA, 22 bp, Homo sapiens
aggaggaggctggagtacaccc

SEQ ID NO: 7068367 - DNA, 21 bp, Homo sapiens
aggaggagagcttggcctacc

SEQ ID NO: 7068368 - DNA, 22 bp, Homo sapiens
aggaggaatacaatccagcagc

SEQ ID NO: 7068369 - DNA, 22 bp, Homo sapiens
aggagctgagtcagcccgacag

SEQ ID NO: 7068370 - DNA, 22 bp, Homo sapiens
aggagctctgggcagggcctcc

SEQ ID NO: 7068371 - DNA, 20 bp, Homo sapiens
aggagctgaattagagggtt

SEQ ID NO: 7068372 - DNA, 20 bp, Homo sapiens
aggagctgaattagagggtt

SEQ ID NO: 7068373 - DNA, 22 bp, Homo sapiens
aggagctgagggagcgcccttg

SEQ ID NO: 7068374 - DNA, 21 bp, Homo sapiens
aggcagcaggatccagggaca

SEQ ID NO: 7068375 - DNA, 21 bp, Homo sapiens
aggcagcaggatccagggaca

SEQ ID NO: 7068376 - DNA, 22 bp, Homo sapiens
catttacagcagactgatgaaa

SEQ ID NO: 7068377 - DNA, 22 bp, Homo sapiens
catttacagtgagagtttttac

SEQ ID NO: 7068378 - DNA, 22 bp, Homo sapiens
catttacataacagtaacgctg

SEQ ID NO: 7068379 - DNA, 22 bp, Homo sapiens
aggcagcagactgttaatcaga

SEQ ID NO: 7068380 - DNA, 22 bp, Homo sapiens
aggcagcagaggttgaggaaag

SEQ ID NO: 7068381 - DNA, 18 bp, Homo sapiens
aggcagcagcatcttctc

SEQ ID NO: 7068382 - DNA, 21 bp, Homo sapiens
catttacatgacagattggtt

SEQ ID NO: 7068383 - DNA, 22 bp, Homo sapiens
catttacatttaaggttaatat

SEQ ID NO: 7068384 - DNA, 19 bp, Homo sapiens
aggcagcattctggggctt

SEQ ID NO: 7068385 - DNA, 22 bp, Homo sapiens
aggcagcatttctgcttatcca

SEQ ID NO: 7068386 - DNA, 22 bp, Homo sapiens
aggcagcatttgaatccaggtc

SEQ ID NO: 7068387 - DNA, 22 bp, Homo sapiens
aggcagcatttgaatccaggtc

SEQ ID NO: 7068388 - DNA, 22 bp, Homo sapiens
aggcagccaatcagaggctgac

SEQ ID NO: 7068389 - DNA, 22 bp, Homo sapiens
aggcagccagatggcagcctgc

SEQ ID NO: 7068390 - DNA, 22 bp, Homo sapiens
aggcagccagttcaggtttctt

SEQ ID NO: 7068391 - DNA, 22 bp, Homo sapiens
cattccttaacgtggggagtct

SEQ ID NO: 7068392 - DNA, 19 bp, Homo sapiens
aggcagaggcttggctagc

SEQ ID NO: 7068393 - DNA, 19 bp, Homo sapiens
aggcagcacccagtccttg

SEQ ID NO: 7068394 - DNA, 22 bp, Homo sapiens
cattccagagctgcctctgcta

SEQ ID NO: 7068395 - DNA, 22 bp, Homo sapiens
cattccagctctcatactctgg

SEQ ID NO: 7068396 - DNA, 22 bp, Homo sapiens
cattcaaaagctccatgtttgt

SEQ ID NO: 7068397 - DNA, 22 bp, Homo sapiens
cattcaaagcaggaaaggcctt

SEQ ID NO: 7068398 - DNA, 22 bp, Homo sapiens
cattatggcagccaggatattg

SEQ ID NO: 7068399 - DNA, 20 bp, Homo sapiens
cattatggttgggcacagtg

SEQ ID NO: 7068400 - DNA, 22 bp, Homo sapiens
aggaggcactcactctcagggt

SEQ ID NO: 7068401 - DNA, 22 bp, Homo sapiens
aggaggcagatgcttggctgta

SEQ ID NO: 7068402 - DNA, 17 bp, Homo sapiens
catctttaaaatcctga

SEQ ID NO: 7068403 - DNA, 22 bp, Homo sapiens
catctttaaaatgggaacaaca

SEQ ID NO: 7068404 - DNA, 22 bp, Homo sapiens
catgaaatattagtaactgttt

SEQ ID NO: 7068405 - DNA, 22 bp, Homo sapiens
catgaaatctgagtatgtttcc

SEQ ID NO: 7068406 - DNA, 22 bp, Homo sapiens
catgaaatgttagaattagaca

SEQ ID NO: 7068407 - DNA, 22 bp, Homo sapiens
aggaggtgctagagaagatgtt

SEQ ID NO: 7068408 - DNA, 22 bp, Homo sapiens
aggaggtgctagagaagatgtt

SEQ ID NO: 7068409 - DNA, 22 bp, Homo sapiens
aggaggtgctgtttgtcctgga

SEQ ID NO: 7068410 - DNA, 22 bp, Homo sapiens
aggaggtgctgtttgtcctgga

SEQ ID NO: 7068411 - DNA, 22 bp, Homo sapiens
aggaggtgctgtttgtcctgga

SEQ ID NO: 7068412 - DNA, 22 bp, Homo sapiens
aggaggtggcaactgtcgacag

SEQ ID NO: 7068413 - DNA, 22 bp, Homo sapiens
aggaggtggcctgagcgtgccc

SEQ ID NO: 7068414 - DNA, 22 bp, Homo sapiens
aggaggtggcctgagcgtgccc

SEQ ID NO: 7068415 - DNA, 22 bp, Homo sapiens
aggaggtggcctgagcgtgccc

SEQ ID NO: 7068416 - DNA, 22 bp, Homo sapiens
aggaggtggctgaacttgaggg

SEQ ID NO: 7068417 - DNA, 22 bp, Homo sapiens
aggaggtggctgaacttgaggg

SEQ ID NO: 7068418 - DNA, 22 bp, Homo sapiens
aggaggtggctgaacttgaggg

SEQ ID NO: 7068419 - DNA, 22 bp, Homo sapiens
aggaggtgtagatttcctgtca

SEQ ID NO: 7068420 - DNA, 22 bp, Homo sapiens
aggaggtgtagatttcctgtca

SEQ ID NO: 7068421 - DNA, 22 bp, Homo sapiens
aggaggtgttgatagaaggttt

SEQ ID NO: 7068422 - DNA, 22 bp, Homo sapiens
catgaggtgataaagctgggat

SEQ ID NO: 7068423 - DNA, 22 bp, Homo sapiens
catgaggtgataaagctgggat

SEQ ID NO: 7068424 - DNA, 22 bp, Homo sapiens
catgcggctctttccaaaccgg

SEQ ID NO: 7068425 - DNA, 22 bp, Homo sapiens
aggcacagcctcccttcacatg

SEQ ID NO: 7068426 - DNA, 22 bp, Homo sapiens
aggcacaggaacaggaaaagag

SEQ ID NO: 7068427 - DNA, 22 bp, Homo sapiens
aggcacaggaatgtcatccagt

SEQ ID NO: 7068428 - DNA, 22 bp, Homo sapiens
aggcacaggaatgtcatccagt

SEQ ID NO: 7068429 - DNA, 22 bp, Homo sapiens
aggcacaggaggtggtaagaag

SEQ ID NO: 7068430 - DNA, 22 bp, Homo sapiens
catgccagttttgagatgcacc

SEQ ID NO: 7068431 - DNA, 22 bp, Homo sapiens
catgcagatgtcatgaggcatg

SEQ ID NO: 7068432 - DNA, 22 bp, Homo sapiens
catgcaggcctatggagcagtg

SEQ ID NO: 7068433 - DNA, 18 bp, Homo sapiens
aggaagcaggaggaaggc

SEQ ID NO: 7068434 - DNA, 22 bp, Homo sapiens
aggaactggggctattcaccct

SEQ ID NO: 7068435 - DNA, 22 bp, Homo sapiens
aggaactgtcatgtattgctca

SEQ ID NO: 7068436 - DNA, 22 bp, Homo sapiens
aggaagctcattttgacatatc

SEQ ID NO: 7068437 - DNA, 22 bp, Homo sapiens
aggaagctcctggagagccagt

SEQ ID NO: 7068438 - DNA, 22 bp, Homo sapiens
aggaagctcggagagggcaaat

SEQ ID NO: 7068439 - DNA, 22 bp, Homo sapiens
aggaaccagaggttgagcaact

SEQ ID NO: 7068440 - DNA, 20 bp, Homo sapiens
aggaactggaagggaggaaa

SEQ ID NO: 7068441 - DNA, 23 bp, Homo sapiens
cagggccaggcagcagctgtcac

SEQ ID NO: 7068442 - DNA, 23 bp, Homo sapiens
cagggccaggcagcagctgtcac

SEQ ID NO: 7068443 - DNA, 22 bp, Homo sapiens
aggaaaggggtaggtgtggacg

SEQ ID NO: 7068444 - DNA, 22 bp, Homo sapiens
aggaaaggggtaggtgtggacg

SEQ ID NO: 7068445 - DNA, 22 bp, Homo sapiens
cagggccagcgcccaggcccag

SEQ ID NO: 7068446 - DNA, 22 bp, Homo sapiens
aggaaatgctgatgctcctgga

SEQ ID NO: 7068447 - DNA, 22 bp, Homo sapiens
aggaacaagggagccttttctc

SEQ ID NO: 7068448 - DNA, 22 bp, Homo sapiens
aggaacacaacttcctgagagc

SEQ ID NO: 7068449 - DNA, 22 bp, Homo sapiens
cagggccagcgcccaggcccag

SEQ ID NO: 7068450 - DNA, 22 bp, Homo sapiens
cagggccagcccactagcgagg

SEQ ID NO: 7068451 - DNA, 22 bp, Homo sapiens
cagggccagccatcctgctggg

SEQ ID NO: 7068452 - DNA, 22 bp, Homo sapiens
cagggccagagagggctggctg

SEQ ID NO: 7068453 - DNA, 22 bp, Homo sapiens
aggaaagctcccagtagggctc

SEQ ID NO: 7068454 - DNA, 21 bp, Homo sapiens
aggaaaggaagtccccagggt

SEQ ID NO: 7068455 - DNA, 22 bp, Homo sapiens
aggaaagatggaaggaggataa

SEQ ID NO: 7068456 - DNA, 22 bp, Homo sapiens
agctttaaaaatccaatatcca

SEQ ID NO: 7068457 - DNA, 21 bp, Homo sapiens
agcttgtgtgtatcacagtgt

SEQ ID NO: 7068458 - DNA, 22 bp, Homo sapiens
agctttacctgccttggggcac

SEQ ID NO: 7068459 - DNA, 22 bp, Homo sapiens
agctttagagagccaagactca

SEQ ID NO: 7068460 - DNA, 22 bp, Homo sapiens
agctttatataaaagagtacat

SEQ ID NO: 7068461 - DNA, 18 bp, Homo sapiens
aggaaagacgaagagggc

SEQ ID NO: 7068462 - DNA, 22 bp, Homo sapiens
aggaaagactggggccccagaa

SEQ ID NO: 7068463 - DNA, 17 bp, Homo sapiens
agcttggagcagcatga

SEQ ID NO: 7068464 - DNA, 22 bp, Homo sapiens
agcttgggcaacacagcaagac

SEQ ID NO: 7068465 - DNA, 23 bp, Homo sapiens
agcttgcttttcccagtactgca

SEQ ID NO: 7068466 - DNA, 22 bp, Homo sapiens
agcttgcctccccctcttagga

SEQ ID NO: 7068467 - DNA, 22 bp, Homo sapiens
agcttgagttttggatgaagtg

SEQ ID NO: 7068468 - DNA, 18 bp, Homo sapiens
agcttgcctcaagctttt

SEQ ID NO: 7068469 - DNA, 22 bp, Homo sapiens
agcttggtgttgcctgcttgag

SEQ ID NO: 7068470 - DNA, 22 bp, Homo sapiens
agcttaaactctttgaagttat

SEQ ID NO: 7068471 - DNA, 22 bp, Homo sapiens
agcttcttttacagctcatgct

SEQ ID NO: 7068472 - DNA, 22 bp, Homo sapiens
agctgttttcttctaggaagac

SEQ ID NO: 7068473 - DNA, 22 bp, Homo sapiens
agctgttttcctggttagagac

SEQ ID NO: 7068474 - DNA, 22 bp, Homo sapiens
agctgtttgtacttagatagta

SEQ ID NO: 7068475 - DNA, 20 bp, Homo sapiens
agctgtttacatggatttct

SEQ ID NO: 7068476 - DNA, 22 bp, Homo sapiens
agctgtttaaatgacttacttt

SEQ ID NO: 7068477 - DNA, 22 bp, Homo sapiens
caggcctggagtgcaatggcac

SEQ ID NO: 7068478 - DNA, 22 bp, Homo sapiens
caggcctggagtgcaatggcac

SEQ ID NO: 7068479 - DNA, 22 bp, Homo sapiens
caggcctggctgcagctcgcct

SEQ ID NO: 7068480 - DNA, 21 bp, Homo sapiens
caggccccaggcctggggtgc

SEQ ID NO: 7068481 - DNA, 23 bp, Homo sapiens
agctgggaattttctgaagcttt

SEQ ID NO: 7068482 - DNA, 22 bp, Homo sapiens
agctgggacagacaactatgtt

SEQ ID NO: 7068483 - DNA, 22 bp, Homo sapiens
agctgggactcaactgtctggg

SEQ ID NO: 7068484 - DNA, 22 bp, Homo sapiens
agctgggaagagttttctgcag

SEQ ID NO: 7068485 - DNA, 23 bp, Homo sapiens
agctgggaattttctgaagcttt

SEQ ID NO: 7068486 - DNA, 22 bp, Homo sapiens
caggaggttgtaagagcaggcc

SEQ ID NO: 7068487 - DNA, 22 bp, Homo sapiens
caggaggttggtagcagtagat

SEQ ID NO: 7068488 - DNA, 22 bp, Homo sapiens
caggaggttggtagcagtagat

SEQ ID NO: 7068489 - DNA, 22 bp, Homo sapiens
caggaggttgtaagagcaggcc

SEQ ID NO: 7068490 - DNA, 22 bp, Homo sapiens
caggaggtacatagattcagat

SEQ ID NO: 7068491 - DNA, 22 bp, Homo sapiens
caggaggtgacttccaggggtt

SEQ ID NO: 7068492 - DNA, 22 bp, Homo sapiens
agctggcattacaggagcatgc

SEQ ID NO: 7068493 - DNA, 22 bp, Homo sapiens
agctggcatctgaagtcagggc

SEQ ID NO: 7068494 - DNA, 22 bp, Homo sapiens
agctggcatactttgctaggaa

SEQ ID NO: 7068495 - DNA, 22 bp, Homo sapiens
caggagtctgttcctcatttgt

SEQ ID NO: 7068496 - DNA, 22 bp, Homo sapiens
agctggctgccttctccttagg

SEQ ID NO: 7068497 - DNA, 22 bp, Homo sapiens
agctggctgccttctccttagg

SEQ ID NO: 7068498 - DNA, 23 bp, Homo sapiens
agctggaggctgtctactcccaa

SEQ ID NO: 7068499 - DNA, 22 bp, Homo sapiens
agctggaggataactcacttct

SEQ ID NO: 7068500 - DNA, 22 bp, Homo sapiens
caggacagagcccagactgtgt

SEQ ID NO: 7068501 - DNA, 22 bp, Homo sapiens
agctggcatactttgctaggaa

SEQ ID NO: 7068502 - DNA, 22 bp, Homo sapiens
agctggcagtcatcctagtgag

SEQ ID NO: 7068503 - DNA, 22 bp, Homo sapiens
agctggcagtatgactggtgac

SEQ ID NO: 7068504 - DNA, 22 bp, Homo sapiens
caggacagaaataaggaatata

SEQ ID NO: 7068505 - DNA, 22 bp, Homo sapiens
caggacagaaataaggaatata

SEQ ID NO: 7068506 - DNA, 22 bp, Homo sapiens
caggacagacagaatgcctaac

SEQ ID NO: 7068507 - DNA, 22 bp, Homo sapiens
caggacagacagaatgcctaac

SEQ ID NO: 7068508 - DNA, 22 bp, Homo sapiens
caggacagaccaagatcgtgct

SEQ ID NO: 7068509 - DNA, 22 bp, Homo sapiens
caggacagaccaagatcgtgct

SEQ ID NO: 7068510 - DNA, 19 bp, Homo sapiens
caggacagacttcaaagcc

SEQ ID NO: 7068511 - DNA, 19 bp, Homo sapiens
caggacagacttcaaagcc

SEQ ID NO: 7068512 - DNA, 22 bp, Homo sapiens
caggacagagcccagactgtgt

SEQ ID NO: 7068513 - DNA, 22 bp, Homo sapiens
caggaaaaatgccaggagtcag

SEQ ID NO: 7068514 - DNA, 22 bp, Homo sapiens
caggaaaaggagactttagcac

SEQ ID NO: 7068515 - DNA, 22 bp, Homo sapiens
agctgctccttggctgtggttc

SEQ ID NO: 7068516 - DNA, 22 bp, Homo sapiens
cagctttgtcatttgatttggg

SEQ ID NO: 7068517 - DNA, 21 bp, Homo sapiens
agctgcagtcaagccagaggt

SEQ ID NO: 7068518 - DNA, 22 bp, Homo sapiens
agctgcagtatgaggctggtgg

SEQ ID NO: 7068519 - DNA, 22 bp, Homo sapiens
agctgcagtaaagctctccagg

SEQ ID NO: 7068520 - DNA, 22 bp, Homo sapiens
agctgcaggcctctcctgggga

SEQ ID NO: 7068521 - DNA, 22 bp, Homo sapiens
agctgcaggcccatgctcagtc

SEQ ID NO: 7068522 - DNA, 22 bp, Homo sapiens
agctgcaggcccatgctcagtc

SEQ ID NO: 7068523 - DNA, 23 bp, Homo sapiens
agctgaggctgtgggtgtcagag

SEQ ID NO: 7068524 - DNA, 22 bp, Homo sapiens
agctgaggctctgagagggaag

SEQ ID NO: 7068525 - DNA, 22 bp, Homo sapiens
agctgaggctctgagagggaag

SEQ ID NO: 7068526 - DNA, 22 bp, Homo sapiens
agctgaggctctgagagggaag

SEQ ID NO: 7068527 - DNA, 23 bp, Homo sapiens
agctgaggctgtgggtgtcagag

SEQ ID NO: 7068528 - DNA, 23 bp, Homo sapiens
cagcttctttgggattctttata

SEQ ID NO: 7068529 - DNA, 23 bp, Homo sapiens
agctgaggcagaggggcattctc

SEQ ID NO: 7068530 - DNA, 22 bp, Homo sapiens
agctgaggcatgatgctatcag

SEQ ID NO: 7068531 - DNA, 22 bp, Homo sapiens
agctgaggcatggacaggctgc

SEQ ID NO: 7068532 - DNA, 22 bp, Homo sapiens
agctgaggcatggacaggctgc

SEQ ID NO: 7068533 - DNA, 22 bp, Homo sapiens
agctgaggcatggacaggctgc

SEQ ID NO: 7068534 - DNA, 22 bp, Homo sapiens
agctgaggcatggacaggctgc

SEQ ID NO: 7068535 - DNA, 22 bp, Homo sapiens
agctgaggccacgagtgaaggg

SEQ ID NO: 7068536 - DNA, 22 bp, Homo sapiens
agctgaggcctgatttcgccgt

SEQ ID NO: 7068537 - DNA, 22 bp, Homo sapiens
agctctcttccagatccacttg

SEQ ID NO: 7068538 - DNA, 22 bp, Homo sapiens
agctctggaactcccggctgct

SEQ ID NO: 7068539 - DNA, 23 bp, Homo sapiens
agctctgctcgggcatgccctgc

SEQ ID NO: 7068540 - DNA, 22 bp, Homo sapiens
cagctctcacaccctcctccca

SEQ ID NO: 7068541 - DNA, 22 bp, Homo sapiens
cagctctcacaccctcctccca

SEQ ID NO: 7068542 - DNA, 22 bp, Homo sapiens
cagctctcacacttagcttcta

SEQ ID NO: 7068543 - DNA, 22 bp, Homo sapiens
cagctctcacacttagcttcta

SEQ ID NO: 7068544 - DNA, 22 bp, Homo sapiens
cagctctcacacttagcttcta

SEQ ID NO: 7068545 - DNA, 22 bp, Homo sapiens
cagctctctaaggtcttgcttt

SEQ ID NO: 7068546 - DNA, 22 bp, Homo sapiens
cagctctgaagaaaggtgtcta

SEQ ID NO: 7068547 - DNA, 22 bp, Homo sapiens
agacacagcagtgcctgcctca

SEQ ID NO: 7068548 - DNA, 22 bp, Homo sapiens
agacagtaataaaataggtaag

SEQ ID NO: 7068549 - DNA, 22 bp, Homo sapiens
agacagtgagaatgagttgaaa

SEQ ID NO: 7068550 - DNA, 17 bp, Homo sapiens
agacagtgagtgccttg

SEQ ID NO: 7068551 - DNA, 22 bp, Homo sapiens
agacagtgatggacaggcagac

SEQ ID NO: 7068552 - DNA, 22 bp, Homo sapiens
agacagtgatgtaagcaggagt

SEQ ID NO: 7068553 - DNA, 22 bp, Homo sapiens
agacagtgcaagaagagcaggc

SEQ ID NO: 7068554 - DNA, 22 bp, Homo sapiens
agacagtgcaagaagagcaggc

SEQ ID NO: 7068555 - DNA, 22 bp, Homo sapiens
agacagtgctatcccatctgtg

SEQ ID NO: 7068556 - DNA, 22 bp, Homo sapiens
agaattacataaatacatgaat

SEQ ID NO: 7068557 - DNA, 22 bp, Homo sapiens
agaatgaattaatcaactggaa

SEQ ID NO: 7068558 - DNA, 22 bp, Homo sapiens
agaatgataatgccatgatgga

SEQ ID NO: 7068559 - DNA, 22 bp, Homo sapiens
agaatgcattttgtgtagctat

SEQ ID NO: 7068560 - DNA, 22 bp, Homo sapiens
agaatgtagtcttggagattta

SEQ ID NO: 7068561 - DNA, 22 bp, Homo sapiens
agaatacatctagtgctgcatg

SEQ ID NO: 7068562 - DNA, 22 bp, Homo sapiens
agaatagaattctcatagaatt

SEQ ID NO: 7068563 - DNA, 21 bp, Homo sapiens
atctttattacgcagagaaga

SEQ ID NO: 7068564 - DNA, 22 bp, Homo sapiens
agaatacaattgttcagtaata

SEQ ID NO: 7068565 - DNA, 22 bp, Homo sapiens
agaatacagtatgcaaaaagat

SEQ ID NO: 7068566 - DNA, 22 bp, Homo sapiens
agaagaaatgtgaaggccactg

SEQ ID NO: 7068567 - DNA, 22 bp, Homo sapiens
agaagaatacttgatgttcatg

SEQ ID NO: 7068568 - DNA, 22 bp, Homo sapiens
agaagagaactgccaaacactt

SEQ ID NO: 7068569 - DNA, 22 bp, Homo sapiens
agaagagcctggggaccatggc

SEQ ID NO: 7068570 - DNA, 22 bp, Homo sapiens
agaagatgttgcagttgatgcg

SEQ ID NO: 7068571 - DNA, 23 bp, Homo sapiens
agaagcaatgctttttttcctct

SEQ ID NO: 7068572 - DNA, 22 bp, Homo sapiens
atcttatgagacccataaagat

SEQ ID NO: 7068573 - DNA, 22 bp, Homo sapiens
atcttatgttgtattcaaaatc

SEQ ID NO: 7068574 - DNA, 22 bp, Homo sapiens
atcttgttataagagataatgg

SEQ ID NO: 7068575 - DNA, 22 bp, Homo sapiens
atctttagcattactttattca

SEQ ID NO: 7068576 - DNA, 22 bp, Homo sapiens
atgtcaaatcagttttatcaga

SEQ ID NO: 7068577 - DNA, 22 bp, Homo sapiens
atgtacagtttctagactcaaa

SEQ ID NO: 7068578 - DNA, 22 bp, Homo sapiens
atgtacatactgcattttcaaa

SEQ ID NO: 7068579 - DNA, 20 bp, Homo sapiens
atgtaaaattataaggctga

SEQ ID NO: 7068580 - DNA, 22 bp, Homo sapiens
atgtaaacaaggttattgtcca

SEQ ID NO: 7068581 - DNA, 22 bp, Homo sapiens
atgtaaactttaccagctctga

SEQ ID NO: 7068582 - DNA, 20 bp, Homo sapiens
atgtaaaagacagggagtag

SEQ ID NO: 7068583 - DNA, 22 bp, Homo sapiens
atgggaggaaggaggcccttga

SEQ ID NO: 7068584 - DNA, 22 bp, Homo sapiens
atgggaggaaggaggcccttga

SEQ ID NO: 7068585 - DNA, 22 bp, Homo sapiens
atgggaggatcacttgaggcca

SEQ ID NO: 7068586 - DNA, 22 bp, Homo sapiens
atgggaggatcacttgaggcca

SEQ ID NO: 7068587 - DNA, 22 bp, Homo sapiens
atgggaggatgctcgggtgctc

SEQ ID NO: 7068588 - DNA, 22 bp, Homo sapiens
atgggaggatgctcgggtgctc

SEQ ID NO: 7068589 - DNA, 22 bp, Homo sapiens
atgggaggcaaagatcgcagaa

SEQ ID NO: 7068590 - DNA, 22 bp, Homo sapiens
atgggaggcagacactaagttc

SEQ ID NO: 7068591 - DNA, 22 bp, Homo sapiens
atgggaggcagacactaagttc

SEQ ID NO: 7068592 - DNA, 22 bp, Homo sapiens
atgggaggcagcagagcccagc

SEQ ID NO: 7068593 - DNA, 22 bp, Homo sapiens
atgggaggcaggctcagaaccg

SEQ ID NO: 7068594 - DNA, 22 bp, Homo sapiens
atggctggtgatactggagtga

SEQ ID NO: 7068595 - DNA, 22 bp, Homo sapiens
atggctgggtcaccatcagggt

SEQ ID NO: 7068596 - DNA, 22 bp, Homo sapiens
atggctgggtcaccatcagggt

SEQ ID NO: 7068597 - DNA, 22 bp, Homo sapiens
atggcagcctgagcagaggaat

SEQ ID NO: 7068598 - DNA, 22 bp, Homo sapiens
atggagtgggccaattttagtg

SEQ ID NO: 7068599 - DNA, 22 bp, Homo sapiens
atggagtggggactgcagtgga

SEQ ID NO: 7068600 - DNA, 22 bp, Homo sapiens
atggataagaacaaatatctga

SEQ ID NO: 7068601 - DNA, 22 bp, Homo sapiens
atggataagtcaaagagtatcc

SEQ ID NO: 7068602 - DNA, 22 bp, Homo sapiens
atggataatggtgatagttgca

SEQ ID NO: 7068603 - DNA, 22 bp, Homo sapiens
atggataatggtgatagttgca

SEQ ID NO: 7068604 - DNA, 22 bp, Homo sapiens
atggcagatggctggagcaggt

SEQ ID NO: 7068605 - DNA, 22 bp, Homo sapiens
atggcagatggctggagcaggt

SEQ ID NO: 7068606 - DNA, 22 bp, Homo sapiens
atggaaatatctttagagctta

SEQ ID NO: 7068607 - DNA, 22 bp, Homo sapiens
atggaaatcaggttcatccaag

SEQ ID NO: 7068608 - DNA, 22 bp, Homo sapiens
atggaaatccaagtcaccgtag

SEQ ID NO: 7068609 - DNA, 22 bp, Homo sapiens
agacggattacctgaggtcagg

SEQ ID NO: 7068610 - DNA, 22 bp, Homo sapiens
agactattacctaaaagataca

SEQ ID NO: 7068611 - DNA, 22 bp, Homo sapiens
agactattacctaaaagataca

SEQ ID NO: 7068612 - DNA, 20 bp, Homo sapiens
agcaaaatgcaagattttca

SEQ ID NO: 7068613 - DNA, 22 bp, Homo sapiens
atttgctttcagccttaaggat

SEQ ID NO: 7068614 - DNA, 22 bp, Homo sapiens
atttgctggtgaaatagtgaca

SEQ ID NO: 7068615 - DNA, 20 bp, Homo sapiens
atttgcttaccttgtttcta

SEQ ID NO: 7068616 - DNA, 22 bp, Homo sapiens
atttgcttcatagatctgtgga

SEQ ID NO: 7068617 - DNA, 22 bp, Homo sapiens
atttgcttgactatggcttgca

SEQ ID NO: 7068618 - DNA, 22 bp, Homo sapiens
atttgcttgtaaatgtatgcct

SEQ ID NO: 7068619 - DNA, 22 bp, Homo sapiens
atttgcttgtaaatgtatgcct

SEQ ID NO: 7068620 - DNA, 22 bp, Homo sapiens
atttgcttgtgctatgaaagtt

SEQ ID NO: 7068621 - DNA, 19 bp, Homo sapiens
agatggggaagagtgtgag

SEQ ID NO: 7068622 - DNA, 19 bp, Homo sapiens
agatggggaagagtgtgag

SEQ ID NO: 7068623 - DNA, 20 bp, Homo sapiens
agatggtgaaggccagggag

SEQ ID NO: 7068624 - DNA, 22 bp, Homo sapiens
agatggtgatagagctgggatt

SEQ ID NO: 7068625 - DNA, 22 bp, Homo sapiens
atttccaaaaccacttattgcc

SEQ ID NO: 7068626 - DNA, 22 bp, Homo sapiens
atttccaagaaagctttaggat

SEQ ID NO: 7068627 - DNA, 19 bp, Homo sapiens
atttccaagaattggagag

SEQ ID NO: 7068628 - DNA, 19 bp, Homo sapiens
atttccaagaattggagag

SEQ ID NO: 7068629 - DNA, 21 bp, Homo sapiens
atttccaagggtacctaagat

SEQ ID NO: 7068630 - DNA, 22 bp, Homo sapiens
atttccaatctctgcatatggg

SEQ ID NO: 7068631 - DNA, 22 bp, Homo sapiens
atttccacataagggaaataag

SEQ ID NO: 7068632 - DNA, 22 bp, Homo sapiens
atttccaccggctcaggaagtt

SEQ ID NO: 7068633 - DNA, 22 bp, Homo sapiens
agatgaaaagataagcagcaat

SEQ ID NO: 7068634 - DNA, 23 bp, Homo sapiens
agatgaaagcttcccatcacagt

SEQ ID NO: 7068635 - DNA, 22 bp, Homo sapiens
agatgaagactcaggagcaggt

SEQ ID NO: 7068636 - DNA, 22 bp, Homo sapiens
agatgaatccacacatggcaaa

SEQ ID NO: 7068637 - DNA, 22 bp, Homo sapiens
atttcattgaagttaattcttc

SEQ ID NO: 7068638 - DNA, 22 bp, Homo sapiens
atttagcaaaaaatgatgaagc

SEQ ID NO: 7068639 - DNA, 22 bp, Homo sapiens
atttagacaacaagccttctcc

SEQ ID NO: 7068640 - DNA, 22 bp, Homo sapiens
atttagacacaaaagtgccatg

SEQ ID NO: 7068641 - DNA, 22 bp, Homo sapiens
atttagacaccagcttgtaagg

SEQ ID NO: 7068642 - DNA, 22 bp, Homo sapiens
atttagacatgtatctgatagc

SEQ ID NO: 7068643 - DNA, 22 bp, Homo sapiens
atttagactctcacctccacct

SEQ ID NO: 7068644 - DNA, 22 bp, Homo sapiens
atttagacttcccagcactgtg

SEQ ID NO: 7068645 - DNA, 22 bp, Homo sapiens
atttagacttcccagcactgtg

SEQ ID NO: 7068646 - DNA, 22 bp, Homo sapiens
atttagacttcttgcaggtaat

SEQ ID NO: 7068647 - DNA, 22 bp, Homo sapiens
agagtgggacacgggcgctgtc

SEQ ID NO: 7068648 - DNA, 22 bp, Homo sapiens
agagtgggcaggagcctcgact

SEQ ID NO: 7068649 - DNA, 22 bp, Homo sapiens
agagtggggaaggtgttgagaa

SEQ ID NO: 7068650 - DNA, 22 bp, Homo sapiens
atttagtttaggaaaagtaggt

SEQ ID NO: 7068651 - DNA, 22 bp, Homo sapiens
atttattattgtggttacttct

SEQ ID NO: 7068652 - DNA, 23 bp, Homo sapiens
atttaatgctgagttgaatgtta

SEQ ID NO: 7068653 - DNA, 18 bp, Homo sapiens
atttaatgaactgaaagc

SEQ ID NO: 7068654 - DNA, 22 bp, Homo sapiens
atttaaattttctgatggagag

SEQ ID NO: 7068655 - DNA, 22 bp, Homo sapiens
atttaaattttctgatggagag

SEQ ID NO: 7068656 - DNA, 22 bp, Homo sapiens
atttaaattttctgatggagag

SEQ ID NO: 7068657 - DNA, 22 bp, Homo sapiens
atttaagactgacttcaccagt

SEQ ID NO: 7068658 - DNA, 22 bp, Homo sapiens
atttaagactgacttcaccagt

SEQ ID NO: 7068659 - DNA, 22 bp, Homo sapiens
atttaagattgcgtattcatgt

SEQ ID NO: 7068660 - DNA, 22 bp, Homo sapiens
atttaagattgcgtattcatgt

SEQ ID NO: 7068661 - DNA, 22 bp, Homo sapiens
attcttctcccttagggcccag

SEQ ID NO: 7068662 - DNA, 23 bp, Homo sapiens
attcttcattatcttctagaaaa

SEQ ID NO: 7068663 - DNA, 22 bp, Homo sapiens
attcttcatgttgaagctgtca

SEQ ID NO: 7068664 - DNA, 22 bp, Homo sapiens
agagggtgggcacgtgatggat

SEQ ID NO: 7068665 - DNA, 22 bp, Homo sapiens
agaggtatatattctccatatt

SEQ ID NO: 7068666 - DNA, 22 bp, Homo sapiens
agaggtatgtgtcagtgcttat

SEQ ID NO: 7068667 - DNA, 22 bp, Homo sapiens
attcttcatacagacaagtcct

SEQ ID NO: 7068668 - DNA, 22 bp, Homo sapiens
attcttcatcactaccttgtga

SEQ ID NO: 7068669 - DNA, 22 bp, Homo sapiens
atgttacaatccaacaaaatta

SEQ ID NO: 7068670 - DNA, 22 bp, Homo sapiens
atgtttatgttgggctatattt

SEQ ID NO: 7068671 - DNA, 20 bp, Homo sapiens
atgttaaatagcatttagag

SEQ ID NO: 7068672 - DNA, 22 bp, Homo sapiens
atgttaaatggtttattattaa

SEQ ID NO: 7068673 - DNA, 22 bp, Homo sapiens
atgttaaatggtttattattaa

SEQ ID NO: 7068674 - DNA, 22 bp, Homo sapiens
atgtgtgtaaacaagtataatt

SEQ ID NO: 7068675 - DNA, 22 bp, Homo sapiens
atgtgtgtacacacgtgactct

SEQ ID NO: 7068676 - DNA, 22 bp, Homo sapiens
attagcagctttctggtctcta

SEQ ID NO: 7068677 - DNA, 22 bp, Homo sapiens
attagcatattaaatagtcatt

SEQ ID NO: 7068678 - DNA, 22 bp, Homo sapiens
attagcaacatggtgaatatgt

SEQ ID NO: 7068679 - DNA, 22 bp, Homo sapiens
attagattgtaaatgttttcac

SEQ ID NO: 7068680 - DNA, 22 bp, Homo sapiens
attaaagtgaagttctcagatg

SEQ ID NO: 7068681 - DNA, 22 bp, Homo sapiens
attaaatactgcaggctaagca

SEQ ID NO: 7068682 - DNA, 22 bp, Homo sapiens
attaaactgagcaaattaacat

SEQ ID NO: 7068683 - DNA, 22 bp, Homo sapiens
attaaacaatgtaaagttcttg

SEQ ID NO: 7068684 - DNA, 22 bp, Homo sapiens
attaaacaatgtaaagttcttg

SEQ ID NO: 7068685 - DNA, 22 bp, Homo sapiens
attaaagtgaagttctcagatg

SEQ ID NO: 7068686 - DNA, 22 bp, Homo sapiens
attaaagtgaagttctcagatg

SEQ ID NO: 7068687 - DNA, 22 bp, Homo sapiens
attaaagacagcagatggatgg

SEQ ID NO: 7068688 - DNA, 22 bp, Homo sapiens
attaaagctatccagtcatgaa

SEQ ID NO: 7068689 - DNA, 22 bp, Homo sapiens
attcacagttcattagctgtaa

SEQ ID NO: 7068690 - DNA, 22 bp, Homo sapiens
attcacagttactgctgaacca

SEQ ID NO: 7068691 - DNA, 22 bp, Homo sapiens
attcacagtttcctcatattct

SEQ ID NO: 7068692 - DNA, 22 bp, Homo sapiens
attcagatcatatttatagctt

SEQ ID NO: 7068693 - DNA, 22 bp, Homo sapiens
attcacagggacaatgggagag

SEQ ID NO: 7068694 - DNA, 22 bp, Homo sapiens
attcacagggggagaagggtat

SEQ ID NO: 7068695 - DNA, 22 bp, Homo sapiens
attcagcagttcctgcttcagt

SEQ ID NO: 7068696 - DNA, 22 bp, Homo sapiens
attcagcataatcagtagcttg

SEQ ID NO: 7068697 - DNA, 22 bp, Homo sapiens
attcacagaatagttttaccag

SEQ ID NO: 7068698 - DNA, 22 bp, Homo sapiens
attcaaagcccagtaaacattg

SEQ ID NO: 7068699 - DNA, 22 bp, Homo sapiens
attcacaattagaagtagataa

SEQ ID NO: 7068700 - DNA, 22 bp, Homo sapiens
attataaatattttctaggggt

SEQ ID NO: 7068701 - DNA, 22 bp, Homo sapiens
attataaacctttgagggtggg

SEQ ID NO: 7068702 - DNA, 22 bp, Homo sapiens
attataaagaacatgtgtgtgg

SEQ ID NO: 7068703 - DNA, 22 bp, Homo sapiens
attataaagaacatgtgtgtgg

SEQ ID NO: 7068704 - DNA, 22 bp, Homo sapiens
agagggtgctggagagacattg

SEQ ID NO: 7068705 - DNA, 23 bp, Homo sapiens
agagggtgcaacatggggatcta

SEQ ID NO: 7068706 - DNA, 22 bp, Homo sapiens
agaggggctcatatcctgtcat

SEQ ID NO: 7068707 - DNA, 22 bp, Homo sapiens
agagggatcaccctgtttctgg

SEQ ID NO: 7068708 - DNA, 22 bp, Homo sapiens
agagggatcaccctgtttctgg

SEQ ID NO: 7068709 - DNA, 22 bp, Homo sapiens
attcagggaggaaaggggcctc

SEQ ID NO: 7068710 - DNA, 22 bp, Homo sapiens
attctggacaaggcaagctcct

SEQ ID NO: 7068711 - DNA, 22 bp, Homo sapiens
attctggacaatgagaaactgg

SEQ ID NO: 7068712 - DNA, 22 bp, Homo sapiens
attctggatattacttatctat

SEQ ID NO: 7068713 - DNA, 22 bp, Homo sapiens
attctggattatcagtccacca

SEQ ID NO: 7068714 - DNA, 22 bp, Homo sapiens
attctgtaattgaactgtgttg

SEQ ID NO: 7068715 - DNA, 22 bp, Homo sapiens
caaatgcatagaaagatgaaac

SEQ ID NO: 7068716 - DNA, 22 bp, Homo sapiens
caaatgcaggtcataacctgag

SEQ ID NO: 7068717 - DNA, 22 bp, Homo sapiens
caaatgcaggtcagcaggtgtc

SEQ ID NO: 7068718 - DNA, 22 bp, Homo sapiens
caaatgatgcatggctagtgag

SEQ ID NO: 7068719 - DNA, 22 bp, Homo sapiens
caaatgatgcatggctagtgag

SEQ ID NO: 7068720 - DNA, 22 bp, Homo sapiens
caaatattccaggtacatccct

SEQ ID NO: 7068721 - DNA, 22 bp, Homo sapiens
caaatattccaggtacatccct

SEQ ID NO: 7068722 - DNA, 22 bp, Homo sapiens
caaatgatactgtttttagtct

SEQ ID NO: 7068723 - DNA, 22 bp, Homo sapiens
caaatgatactgtttttagtct

SEQ ID NO: 7068724 - DNA, 22 bp, Homo sapiens
caaatgatactgtttttagtct

SEQ ID NO: 7068725 - DNA, 22 bp, Homo sapiens
caaatgatagagccgattatca

SEQ ID NO: 7068726 - DNA, 22 bp, Homo sapiens
caaatgatagagccgattatca

SEQ ID NO: 7068727 - DNA, 22 bp, Homo sapiens
caaatgatccttgcaagctgtg

SEQ ID NO: 7068728 - DNA, 22 bp, Homo sapiens
caaatgatccttgcaagctgtg

SEQ ID NO: 7068729 - DNA, 22 bp, Homo sapiens
caaattaatgtgtctcaaaata

SEQ ID NO: 7068730 - DNA, 22 bp, Homo sapiens
attttctctcaaaccttaaaat

SEQ ID NO: 7068731 - DNA, 21 bp, Homo sapiens
attttctctggatgatggtca

SEQ ID NO: 7068732 - DNA, 22 bp, Homo sapiens
attttctatgttgtaattgtta

SEQ ID NO: 7068733 - DNA, 22 bp, Homo sapiens
attttctatgttgtaattgtta

SEQ ID NO: 7068734 - DNA, 22 bp, Homo sapiens
attttctattctgctggtttag

SEQ ID NO: 7068735 - DNA, 22 bp, Homo sapiens
attttctgagtccagaatttac

SEQ ID NO: 7068736 - DNA, 22 bp, Homo sapiens
attttctgtaactatttctata

SEQ ID NO: 7068737 - DNA, 22 bp, Homo sapiens
agcacagagttgcagagagcgt

SEQ ID NO: 7068738 - DNA, 22 bp, Homo sapiens
agcacagattctgaagagtcct

SEQ ID NO: 7068739 - DNA, 22 bp, Homo sapiens
agcagcagaaagttgatggcag

SEQ ID NO: 7068740 - DNA, 22 bp, Homo sapiens
agcagcagaagggagacccagg

SEQ ID NO: 7068741 - DNA, 22 bp, Homo sapiens
caaggcaggaagcctgtcttat

SEQ ID NO: 7068742 - DNA, 22 bp, Homo sapiens
agcagcaacttatttttcttat

SEQ ID NO: 7068743 - DNA, 22 bp, Homo sapiens
caactgaactgatatcaactat

SEQ ID NO: 7068744 - DNA, 22 bp, Homo sapiens
caactgctgacaccatcactcc

SEQ ID NO: 7068745 - DNA, 22 bp, Homo sapiens
caactgtgaattttatgatacc

SEQ ID NO: 7068746 - DNA, 22 bp, Homo sapiens
agcagaatctgtccttggaaga

SEQ ID NO: 7068747 - DNA, 18 bp, Homo sapiens
agcagaattctagggttc

SEQ ID NO: 7068748 - DNA, 22 bp, Homo sapiens
caaggcaggtctgaggaggttg

SEQ ID NO: 7068749 - DNA, 22 bp, Homo sapiens
caaggcaggccagtttcaaggc

SEQ ID NO: 7068750 - DNA, 22 bp, Homo sapiens
caaggcaggtctgaggaggttg

SEQ ID NO: 7068751 - DNA, 22 bp, Homo sapiens
caaggcagttccccagagggct

SEQ ID NO: 7068752 - DNA, 22 bp, Homo sapiens
caatgaaaatgaggactcctgt

SEQ ID NO: 7068753 - DNA, 22 bp, Homo sapiens
caatgaaaatttaagttgcagc

SEQ ID NO: 7068754 - DNA, 22 bp, Homo sapiens
caatgaaattgagatccagaga

SEQ ID NO: 7068755 - DNA, 22 bp, Homo sapiens
cacaggagctgtggggcagtgt

SEQ ID NO: 7068756 - DNA, 22 bp, Homo sapiens
cacaggagctgtggggcagtgt

SEQ ID NO: 7068757 - DNA, 22 bp, Homo sapiens
cacaggagccctgaggcctccc

SEQ ID NO: 7068758 - DNA, 22 bp, Homo sapiens
agcagcttctttcactcctgga

SEQ ID NO: 7068759 - DNA, 22 bp, Homo sapiens
cacaggaagctgactgctggca

SEQ ID NO: 7068760 - DNA, 22 bp, Homo sapiens
caatgacactctgcacagtgct

SEQ ID NO: 7068761 - DNA, 22 bp, Homo sapiens
agcagctgtcccttaacatcag

SEQ ID NO: 7068762 - DNA, 18 bp, Homo sapiens
agcagctgtgccacactg

SEQ ID NO: 7068763 - DNA, 22 bp, Homo sapiens
cacaggagggagcgggcagcca

SEQ ID NO: 7068764 - DNA, 22 bp, Homo sapiens
agcaggagaacactgtggctct

SEQ ID NO: 7068765 - DNA, 22 bp, Homo sapiens
cacaggagggagcgggcagcca

SEQ ID NO: 7068766 - DNA, 22 bp, Homo sapiens
agcaggagaacactgtggctct

SEQ ID NO: 7068767 - DNA, 22 bp, Homo sapiens
agcaggagacatgggggtggtg

SEQ ID NO: 7068768 - DNA, 22 bp, Homo sapiens
agcaggagacatgggggtggtg

SEQ ID NO: 7068769 - DNA, 22 bp, Homo sapiens
agcaggagagcagtgcgtggtc

SEQ ID NO: 7068770 - DNA, 22 bp, Homo sapiens
agcaggagagcagtgcgtggtc

SEQ ID NO: 7068771 - DNA, 22 bp, Homo sapiens
agcaggagagcagtgcgtggtc

SEQ ID NO: 7068772 - DNA, 22 bp, Homo sapiens
agcaggagagcagtgcgtggtc

SEQ ID NO: 7068773 - DNA, 22 bp, Homo sapiens
agcaggagatggggcgtgatgt

SEQ ID NO: 7068774 - DNA, 22 bp, Homo sapiens
agcaggagatggggcgtgatgt

SEQ ID NO: 7068775 - DNA, 22 bp, Homo sapiens
agcaggagcatttccatgattc

SEQ ID NO: 7068776 - DNA, 22 bp, Homo sapiens
agcaggagcatttccatgattc

SEQ ID NO: 7068777 - DNA, 22 bp, Homo sapiens
cacaggctgcccgcagctggga

SEQ ID NO: 7068778 - DNA, 22 bp, Homo sapiens
cacaggctgcccgcagctggga

SEQ ID NO: 7068779 - DNA, 22 bp, Homo sapiens
cacagggctttgatggctgagt

SEQ ID NO: 7068780 - DNA, 22 bp, Homo sapiens
cacagggctttgatggctgagt

SEQ ID NO: 7068781 - DNA, 22 bp, Homo sapiens
cacagggctttgatggctgagt

SEQ ID NO: 7068782 - DNA, 22 bp, Homo sapiens
cacagggctaaatgaagggttg

SEQ ID NO: 7068783 - DNA, 22 bp, Homo sapiens
cacagtatcttttgagtaagca

SEQ ID NO: 7068784 - DNA, 22 bp, Homo sapiens
cacagtattcactgggcagatt

SEQ ID NO: 7068785 - DNA, 22 bp, Homo sapiens
cactctgatggtttctgttcaa

SEQ ID NO: 7068786 - DNA, 22 bp, Homo sapiens
cactctgcagctgaagggctgg

SEQ ID NO: 7068787 - DNA, 22 bp, Homo sapiens
cactctgggggctgccgctgcc

SEQ ID NO: 7068788 - DNA, 22 bp, Homo sapiens
agcagttttagggagacacatt

SEQ ID NO: 7068789 - DNA, 22 bp, Homo sapiens
agcataaactcagggacacaca

SEQ ID NO: 7068790 - DNA, 22 bp, Homo sapiens
agcagtggctgacagacttacc

SEQ ID NO: 7068791 - DNA, 22 bp, Homo sapiens
caccaggtggaaatgtcacagc

SEQ ID NO: 7068792 - DNA, 22 bp, Homo sapiens
agcagttgagtgggaatcaggc

SEQ ID NO: 7068793 - DNA, 22 bp, Homo sapiens
caccagggctctgagctctgaa

SEQ ID NO: 7068794 - DNA, 22 bp, Homo sapiens
caccaggtgctggaggacatca

SEQ ID NO: 7068795 - DNA, 22 bp, Homo sapiens
agcaggtgcgttacttcactct

SEQ ID NO: 7068796 - DNA, 21 bp, Homo sapiens
agcaggtgctgttggaggaaa

SEQ ID NO: 7068797 - DNA, 21 bp, Homo sapiens
agcaggtgctgttggaggaaa

SEQ ID NO: 7068798 - DNA, 22 bp, Homo sapiens
agcaggtggacagaggaagaaa

SEQ ID NO: 7068799 - DNA, 22 bp, Homo sapiens
caccaggctggagtgcagtggc

SEQ ID NO: 7068800 - DNA, 22 bp, Homo sapiens
agcaggtggacagaggaagaaa

SEQ ID NO: 7068801 - DNA, 22 bp, Homo sapiens
caccagggacaatgctaggggt

SEQ ID NO: 7068802 - DNA, 22 bp, Homo sapiens
caccagggacaatgctaggggt

SEQ ID NO: 7068803 - DNA, 22 bp, Homo sapiens
caccagggcagcagcctagtct

SEQ ID NO: 7068804 - DNA, 22 bp, Homo sapiens
cacagtcacatatctatgtgtg

SEQ ID NO: 7068805 - DNA, 16 bp, Homo sapiens
agcagggcgggaagga

SEQ ID NO: 7068806 - DNA, 22 bp, Homo sapiens
agcagggcctgagtgacctaac

SEQ ID NO: 7068807 - DNA, 22 bp, Homo sapiens
cacatattgtagttcaccagga

SEQ ID NO: 7068808 - DNA, 22 bp, Homo sapiens
cacatatttgatgaagctttgt

SEQ ID NO: 7068809 - DNA, 23 bp, Homo sapiens
agcaggtaggttgaaattttcct

SEQ ID NO: 7068810 - DNA, 22 bp, Homo sapiens
agcaggtgatgtgagtctggaa

SEQ ID NO: 7068811 - DNA, 22 bp, Homo sapiens
cagccctggcgcccccagatct

SEQ ID NO: 7068812 - DNA, 22 bp, Homo sapiens
cagccctggctagggcgagggc

SEQ ID NO: 7068813 - DNA, 22 bp, Homo sapiens
cagccctgggtccctgccctgg

SEQ ID NO: 7068814 - DNA, 22 bp, Homo sapiens
agctcctgtgtgaagcctccct

SEQ ID NO: 7068815 - DNA, 22 bp, Homo sapiens
cagccagctggcactgtgagta

SEQ ID NO: 7068816 - DNA, 23 bp, Homo sapiens
cagcaggagggtgcctgggctgc

SEQ ID NO: 7068817 - DNA, 22 bp, Homo sapiens
agccttctaggatgtcatctgc

SEQ ID NO: 7068818 - DNA, 22 bp, Homo sapiens
agctcagaacctcctcatccca

SEQ ID NO: 7068819 - DNA, 22 bp, Homo sapiens
agctcagaactgcagacatgtg

SEQ ID NO: 7068820 - DNA, 22 bp, Homo sapiens
agctcagaagcctatgcatagt

SEQ ID NO: 7068821 - DNA, 22 bp, Homo sapiens
cagcagaggcacgtctgtgaat

SEQ ID NO: 7068822 - DNA, 22 bp, Homo sapiens
cagcagagcttattaactaaaa

SEQ ID NO: 7068823 - DNA, 22 bp, Homo sapiens
cagcagagcttattaactaaaa

SEQ ID NO: 7068824 - DNA, 22 bp, Homo sapiens
cagcagaggaaagcaaatctaa

SEQ ID NO: 7068825 - DNA, 22 bp, Homo sapiens
cagcagaggaaagcaaatctaa

SEQ ID NO: 7068826 - DNA, 22 bp, Homo sapiens
cagcagagggagccattgaaat

SEQ ID NO: 7068827 - DNA, 22 bp, Homo sapiens
cagcagagggagccattgaaat

SEQ ID NO: 7068828 - DNA, 22 bp, Homo sapiens
cagcagaggtggttcacattgt

SEQ ID NO: 7068829 - DNA, 22 bp, Homo sapiens
cagcagaggtggttcacattgt

SEQ ID NO: 7068830 - DNA, 22 bp, Homo sapiens
cagcagaggttggaacagttct

SEQ ID NO: 7068831 - DNA, 22 bp, Homo sapiens
cagcagaggttggaacagttct

SEQ ID NO: 7068832 - DNA, 22 bp, Homo sapiens
cagcagagcttatgttgggtca

SEQ ID NO: 7068833 - DNA, 22 bp, Homo sapiens
cagcagagcttattaactaaaa

SEQ ID NO: 7068834 - DNA, 22 bp, Homo sapiens
cagcagaggttttgctccatga

SEQ ID NO: 7068835 - DNA, 22 bp, Homo sapiens
cagcagaggttttgctccatga

SEQ ID NO: 7068836 - DNA, 22 bp, Homo sapiens
agcctggtttaagcattttata

SEQ ID NO: 7068837 - DNA, 22 bp, Homo sapiens
cagaggctcagatggccctggc

SEQ ID NO: 7068838 - DNA, 22 bp, Homo sapiens
cagaggctcttcctcactgccc

SEQ ID NO: 7068839 - DNA, 22 bp, Homo sapiens
cagaggctcagatggccctggc

SEQ ID NO: 7068840 - DNA, 22 bp, Homo sapiens
cagaggctcaccagcctttcac

SEQ ID NO: 7068841 - DNA, 22 bp, Homo sapiens
cagaggctcaccagcctttcac

SEQ ID NO: 7068842 - DNA, 22 bp, Homo sapiens
cagaggctagactgtgcttcct

SEQ ID NO: 7068843 - DNA, 22 bp, Homo sapiens
cagaggctagactgtgcttcct

SEQ ID NO: 7068844 - DNA, 22 bp, Homo sapiens
cagaggctaagggtagcttggg

SEQ ID NO: 7068845 - DNA, 22 bp, Homo sapiens
cagaggctaagatgagtgggtg

SEQ ID NO: 7068846 - DNA, 22 bp, Homo sapiens
cagaggctaagggtagcttggg

SEQ ID NO: 7068847 - DNA, 22 bp, Homo sapiens
cagaggctaagatgagtgggtg

SEQ ID NO: 7068848 - DNA, 22 bp, Homo sapiens
cagaggctaagatgagtgggtg

SEQ ID NO: 7068849 - DNA, 22 bp, Homo sapiens
cagaggctaagatgagtgggtg

SEQ ID NO: 7068850 - DNA, 22 bp, Homo sapiens
cagaggctaagatgagtgggtg

SEQ ID NO: 7068851 - DNA, 22 bp, Homo sapiens
agccctccaaaggttgggggag

SEQ ID NO: 7068852 - DNA, 22 bp, Homo sapiens
agccctcctcacatcagcgtcc

SEQ ID NO: 7068853 - DNA, 22 bp, Homo sapiens
cagaggcgaggcagctgaacct

SEQ ID NO: 7068854 - DNA, 22 bp, Homo sapiens
cagaggctaagagtgtccaaag

SEQ ID NO: 7068855 - DNA, 22 bp, Homo sapiens
cagcacaggaagtgggccttca

SEQ ID NO: 7068856 - DNA, 22 bp, Homo sapiens
cagcacaggaatatggtggaca

SEQ ID NO: 7068857 - DNA, 22 bp, Homo sapiens
cagcacagggacaatagcagat

SEQ ID NO: 7068858 - DNA, 22 bp, Homo sapiens
cagcacagtacaaggcacggat

SEQ ID NO: 7068859 - DNA, 22 bp, Homo sapiens
agcctcagcacgcagctctgtg

SEQ ID NO: 7068860 - DNA, 23 bp, Homo sapiens
agcctcagccggtggcagaagtg

SEQ ID NO: 7068861 - DNA, 22 bp, Homo sapiens
agcctcagggctctgcgcagac

SEQ ID NO: 7068862 - DNA, 22 bp, Homo sapiens
agccaggatggtctcgatcggc

SEQ ID NO: 7068863 - DNA, 22 bp, Homo sapiens
cagaagctttgctcataaccat

SEQ ID NO: 7068864 - DNA, 22 bp, Homo sapiens
agccagctgcctttcacatctg

SEQ ID NO: 7068865 - DNA, 21 bp, Homo sapiens
agccaggcaagcacccccact

SEQ ID NO: 7068866 - DNA, 22 bp, Homo sapiens
agccaggcagactctctttctt

SEQ ID NO: 7068867 - DNA, 22 bp, Homo sapiens
agccaggcagggctctcgctct

SEQ ID NO: 7068868 - DNA, 22 bp, Homo sapiens
cagacagaaggctccttgaggt

SEQ ID NO: 7068869 - DNA, 22 bp, Homo sapiens
cagaacttcatattgacgttag

SEQ ID NO: 7068870 - DNA, 22 bp, Homo sapiens
cagaagcattccagcaaatagt

SEQ ID NO: 7068871 - DNA, 22 bp, Homo sapiens
cagaagcattgactccttgctc

SEQ ID NO: 7068872 - DNA, 22 bp, Homo sapiens
cagaagcctgcctcagatgcac

SEQ ID NO: 7068873 - DNA, 22 bp, Homo sapiens
agccacacagcttaatgacaga

SEQ ID NO: 7068874 - DNA, 22 bp, Homo sapiens
agccacacctgtcctgccagct

SEQ ID NO: 7068875 - DNA, 22 bp, Homo sapiens
cactgaaaattagctttcctga

SEQ ID NO: 7068876 - DNA, 22 bp, Homo sapiens
cactgaaaggaaaccagagcat

SEQ ID NO: 7068877 - DNA, 22 bp, Homo sapiens
cactgaaaggcaatgctgacag

SEQ ID NO: 7068878 - DNA, 22 bp, Homo sapiens
cactgaaatattaatatcttat

SEQ ID NO: 7068879 - DNA, 22 bp, Homo sapiens
cactgaaatcgaaaaatgtagg

SEQ ID NO: 7068880 - DNA, 19 bp, Homo sapiens
agccacagaacttgcagga

SEQ ID NO: 7068881 - DNA, 19 bp, Homo sapiens
agccacagaacttgcagga

SEQ ID NO: 7068882 - DNA, 22 bp, Homo sapiens
agccacagagagggagctgcaa

SEQ ID NO: 7068883 - DNA, 22 bp, Homo sapiens
agccacagagcaggagaccttt

SEQ ID NO: 7068884 - DNA, 22 bp, Homo sapiens
agccacagcacattgtaagaaa

SEQ ID NO: 7068885 - DNA, 22 bp, Homo sapiens
agccacagcatgtgtgtatgta

SEQ ID NO: 7068886 - DNA, 22 bp, Homo sapiens
cagaaatgacaaagtaagagga

SEQ ID NO: 7068887 - DNA, 22 bp, Homo sapiens
agccagggttagaagatagtca

SEQ ID NO: 7068888 - DNA, 19 bp, Homo sapiens
agccagtgagcctctgggt

SEQ ID NO: 7068889 - DNA, 22 bp, Homo sapiens
agccagtgatgaagactctgga

SEQ ID NO: 7068890 - DNA, 22 bp, Homo sapiens
cagagaggatggattccatagc

SEQ ID NO: 7068891 - DNA, 22 bp, Homo sapiens
cagagagggagcagtagtctct

SEQ ID NO: 7068892 - DNA, 22 bp, Homo sapiens
cagagagggcggccctggcttc

SEQ ID NO: 7068893 - DNA, 22 bp, Homo sapiens
agcccaggagtttgaggctgtg

SEQ ID NO: 7068894 - DNA, 22 bp, Homo sapiens
cagagctgcttcccagtttgtg

SEQ ID NO: 7068895 - DNA, 22 bp, Homo sapiens
agcccggcttccccggttgcta

SEQ ID NO: 7068896 - DNA, 22 bp, Homo sapiens
cagagctggagggaaccctggc

SEQ ID NO: 7068897 - DNA, 22 bp, Homo sapiens
cagagctggcggtgagaagaca

SEQ ID NO: 7068898 - DNA, 23 bp, Homo sapiens
cagagctggctcagagctgcctg

SEQ ID NO: 7068899 - DNA, 22 bp, Homo sapiens
agcccctgtttttccagtcaga

SEQ ID NO: 7068900 - DNA, 20 bp, Homo sapiens
agggtggggacgttctgact

SEQ ID NO: 7068901 - DNA, 22 bp, Homo sapiens
agggtgcgttctatgagaatct

SEQ ID NO: 7068902 - DNA, 22 bp, Homo sapiens
agggcttgtggtcgtggctgtg

SEQ ID NO: 7068903 - DNA, 22 bp, Homo sapiens
agggctgtttttggcacctggg

SEQ ID NO: 7068904 - DNA, 22 bp, Homo sapiens
agggctgtttttggcacctggg

SEQ ID NO: 7068905 - DNA, 22 bp, Homo sapiens
agggtggggtgctacatcttta

SEQ ID NO: 7068906 - DNA, 20 bp, Homo sapiens
agggtggggacgttctgact

SEQ ID NO: 7068907 - DNA, 22 bp, Homo sapiens
agggtgtcagccacggaatggg

SEQ ID NO: 7068908 - DNA, 22 bp, Homo sapiens
acctcccagctctgagcttggg

SEQ ID NO: 7068909 - DNA, 22 bp, Homo sapiens
agggttaattggtgtcctgagg

SEQ ID NO: 7068910 - DNA, 22 bp, Homo sapiens
acctcccagctctgagcttggg

SEQ ID NO: 7068911 - DNA, 22 bp, Homo sapiens
agggtgtgctgttgggtctttc

SEQ ID NO: 7068912 - DNA, 22 bp, Homo sapiens
agggtgtgttctcctatgagaa

SEQ ID NO: 7068913 - DNA, 22 bp, Homo sapiens
aggtagaggcctccaggcagca

SEQ ID NO: 7068914 - DNA, 22 bp, Homo sapiens
aggtacatctatggggatagaa

SEQ ID NO: 7068915 - DNA, 22 bp, Homo sapiens
aggtactaccagggattttcag

SEQ ID NO: 7068916 - DNA, 22 bp, Homo sapiens
acctgtctataaaagtgaatac

SEQ ID NO: 7068917 - DNA, 22 bp, Homo sapiens
aggtagctatccagacgctgaa

SEQ ID NO: 7068918 - DNA, 22 bp, Homo sapiens
acctccctggccttctgattcc

SEQ ID NO: 7068919 - DNA, 22 bp, Homo sapiens
acctgcccacacttccttccca

SEQ ID NO: 7068920 - DNA, 22 bp, Homo sapiens
acctgcccacttcccatgacat

SEQ ID NO: 7068921 - DNA, 22 bp, Homo sapiens
acctgcccagactcagatccta

SEQ ID NO: 7068922 - DNA, 22 bp, Homo sapiens
acctgcccatgaaaatggggag

SEQ ID NO: 7068923 - DNA, 22 bp, Homo sapiens
acctgcccggggacattccttt

SEQ ID NO: 7068924 - DNA, 22 bp, Homo sapiens
acctgccttctcaaggacatga

SEQ ID NO: 7068925 - DNA, 22 bp, Homo sapiens
acctgctcaactggcttctcgc

SEQ ID NO: 7068926 - DNA, 23 bp, Homo sapiens
acctgctccatgtcaccttcact

SEQ ID NO: 7068927 - DNA, 22 bp, Homo sapiens
acctggaagtgggtgctatggc

SEQ ID NO: 7068928 - DNA, 22 bp, Homo sapiens
acctggaagtgggtgctatggc

SEQ ID NO: 7068929 - DNA, 22 bp, Homo sapiens
acctggacacctgctgtcatct

SEQ ID NO: 7068930 - DNA, 22 bp, Homo sapiens
actatagctcgggttataatgt

SEQ ID NO: 7068931 - DNA, 22 bp, Homo sapiens
actatatacacattatcttgtt

SEQ ID NO: 7068932 - DNA, 20 bp, Homo sapiens
actatgaagttagccctcca

SEQ ID NO: 7068933 - DNA, 22 bp, Homo sapiens
actattagcatatcatgaatgg

SEQ ID NO: 7068934 - DNA, 22 bp, Homo sapiens
actatactgtctcttatagata

SEQ ID NO: 7068935 - DNA, 22 bp, Homo sapiens
actaaatagttttgacagaaca

SEQ ID NO: 7068936 - DNA, 22 bp, Homo sapiens
actaaatacacacatttgttca

SEQ ID NO: 7068937 - DNA, 22 bp, Homo sapiens
actaaatacacacatttgttca

SEQ ID NO: 7068938 - DNA, 18 bp, Homo sapiens
actcaagggtggagagaa

SEQ ID NO: 7068939 - DNA, 19 bp, Homo sapiens
actcaagtctaatgaaatc

SEQ ID NO: 7068940 - DNA, 23 bp, Homo sapiens
actcacaaagcaggatcatgttg

SEQ ID NO: 7068941 - DNA, 22 bp, Homo sapiens
actcacagcagactatgaggga

SEQ ID NO: 7068942 - DNA, 22 bp, Homo sapiens
actcacagcagactatgaggga

SEQ ID NO: 7068943 - DNA, 22 bp, Homo sapiens
actcacagcatgagcttggcag

SEQ ID NO: 7068944 - DNA, 22 bp, Homo sapiens
actcacagcatgagcttggcag

SEQ ID NO: 7068945 - DNA, 22 bp, Homo sapiens
actcacaggactctgcatatag

SEQ ID NO: 7068946 - DNA, 22 bp, Homo sapiens
actcagtacatctggagttggc

SEQ ID NO: 7068947 - DNA, 22 bp, Homo sapiens
actcattgaaacttaagatcta

SEQ ID NO: 7068948 - DNA, 22 bp, Homo sapiens
actaaagatgtctaaatatatt

SEQ ID NO: 7068949 - DNA, 22 bp, Homo sapiens
actaaagctcacagagttgaac

SEQ ID NO: 7068950 - DNA, 22 bp, Homo sapiens
acgtttgctttctttggcctgg

SEQ ID NO: 7068951 - DNA, 22 bp, Homo sapiens
acgttatatctgaaaaaagtga

SEQ ID NO: 7068952 - DNA, 22 bp, Homo sapiens
acgttaaacatttagcatagta

SEQ ID NO: 7068953 - DNA, 22 bp, Homo sapiens
accttcaggtgagcacacagat

SEQ ID NO: 7068954 - DNA, 22 bp, Homo sapiens
accttcacctccacaccttggg

SEQ ID NO: 7068955 - DNA, 22 bp, Homo sapiens
accttcaagattgtgggtcaat

SEQ ID NO: 7068956 - DNA, 22 bp, Homo sapiens
accttcaagtatgtgggctgaa

SEQ ID NO: 7068957 - DNA, 22 bp, Homo sapiens
accttaaaactgacacatggag

SEQ ID NO: 7068958 - DNA, 22 bp, Homo sapiens
accttaaaggccgaagtaaaga

SEQ ID NO: 7068959 - DNA, 22 bp, Homo sapiens
accttaaatgtgacatagtcta

SEQ ID NO: 7068960 - DNA, 22 bp, Homo sapiens
accttagaaaatcaaaattaga

SEQ ID NO: 7068961 - DNA, 22 bp, Homo sapiens
actcttcattcaagtatgcaaa

SEQ ID NO: 7068962 - DNA, 22 bp, Homo sapiens
actgaaaatgaattagaaacag

SEQ ID NO: 7068963 - DNA, 22 bp, Homo sapiens
actgaaaatgaattagaaacag

SEQ ID NO: 7068964 - DNA, 22 bp, Homo sapiens
actgaaatgaaatctatcatct

SEQ ID NO: 7068965 - DNA, 19 bp, Homo sapiens
agtctcttcggaggaggtt

SEQ ID NO: 7068966 - DNA, 22 bp, Homo sapiens
agtctcttattccctattgctg

SEQ ID NO: 7068967 - DNA, 22 bp, Homo sapiens
agtctcttccttcaaggctggt

SEQ ID NO: 7068968 - DNA, 20 bp, Homo sapiens
agtctggcacctattcctgt

SEQ ID NO: 7068969 - DNA, 22 bp, Homo sapiens
agtctggccttgccttgtcgag

SEQ ID NO: 7068970 - DNA, 22 bp, Homo sapiens
agtctgggagaaggtgagatta

SEQ ID NO: 7068971 - DNA, 22 bp, Homo sapiens
agtctgggaggcttataaacag

SEQ ID NO: 7068972 - DNA, 22 bp, Homo sapiens
agtctgggcatttaggatgttg

SEQ ID NO: 7068973 - DNA, 22 bp, Homo sapiens
agtctgggctgtctgcaggagt

SEQ ID NO: 7068974 - DNA, 22 bp, Homo sapiens
agtctgggtggctgagctacag

SEQ ID NO: 7068975 - DNA, 22 bp, Homo sapiens
agtctgggtgtgaatgaacttg

SEQ ID NO: 7068976 - DNA, 22 bp, Homo sapiens
agtctctgtcgtagatcagcgt

SEQ ID NO: 7068977 - DNA, 22 bp, Homo sapiens
agtctctgggcatggttgtgac

SEQ ID NO: 7068978 - DNA, 22 bp, Homo sapiens
agtctctgcatgcctgctgtgc

SEQ ID NO: 7068979 - DNA, 22 bp, Homo sapiens
agtctctgcatgcctgctgtgc

SEQ ID NO: 7068980 - DNA, 22 bp, Homo sapiens
agtctctgccagcttgtcctct

SEQ ID NO: 7068981 - DNA, 22 bp, Homo sapiens
agtctctgctggttgtgcctat

SEQ ID NO: 7068982 - DNA, 22 bp, Homo sapiens
actccagggctgaacgaggccc

SEQ ID NO: 7068983 - DNA, 22 bp, Homo sapiens
actccaggggttgctatttaca

SEQ ID NO: 7068984 - DNA, 22 bp, Homo sapiens
agtcgcagacatggtccccttt

SEQ ID NO: 7068985 - DNA, 22 bp, Homo sapiens
actcatttaaacatttactgaa

SEQ ID NO: 7068986 - DNA, 22 bp, Homo sapiens
actcatttgacactttaaactg

SEQ ID NO: 7068987 - DNA, 22 bp, Homo sapiens
actccaaggccacatgcattcc

SEQ ID NO: 7068988 - DNA, 22 bp, Homo sapiens
actccaggcatctgcttctgct

SEQ ID NO: 7068989 - DNA, 22 bp, Homo sapiens
actgatttcagggatgagaaga

SEQ ID NO: 7068990 - DNA, 22 bp, Homo sapiens
actgattacacgagttctgact

SEQ ID NO: 7068991 - DNA, 22 bp, Homo sapiens
actgaggtaattgtgaggatta

SEQ ID NO: 7068992 - DNA, 23 bp, Homo sapiens
actgaggtactgaggttgtgaca

SEQ ID NO: 7068993 - DNA, 22 bp, Homo sapiens
actgatctgttttcagattctg

SEQ ID NO: 7068994 - DNA, 22 bp, Homo sapiens
actgatggcccaccttggtctc

SEQ ID NO: 7068995 - DNA, 22 bp, Homo sapiens
actgaagtagtcattgtcatta

SEQ ID NO: 7068996 - DNA, 22 bp, Homo sapiens
actgaagtctcttttgttctct

SEQ ID NO: 7068997 - DNA, 22 bp, Homo sapiens
actgcaaagggaagccctttct

SEQ ID NO: 7068998 - DNA, 22 bp, Homo sapiens
actgcaacacctcctgggttca

SEQ ID NO: 7068999 - DNA, 22 bp, Homo sapiens
actgcaacctccacctcctggg

SEQ ID NO: 7069000 - DNA, 22 bp, Homo sapiens
actgcaacacctcctgggttca

SEQ ID NO: 7069001 - DNA, 22 bp, Homo sapiens
actgcaacctccacctcctggg

SEQ ID NO: 7069002 - DNA, 22 bp, Homo sapiens
actgcaacctccacctcctggg

SEQ ID NO: 7069003 - DNA, 22 bp, Homo sapiens
actgcaacctccgcctgccagg

SEQ ID NO: 7069004 - DNA, 22 bp, Homo sapiens
actgcctgtagctcttcatctc

SEQ ID NO: 7069005 - DNA, 22 bp, Homo sapiens
actgcctgtgcactggtctttt

SEQ ID NO: 7069006 - DNA, 22 bp, Homo sapiens
actgctcacgcattacttgagc

SEQ ID NO: 7069007 - DNA, 22 bp, Homo sapiens
actgctctgttttcatatgttt

SEQ ID NO: 7069008 - DNA, 22 bp, Homo sapiens
actgctgacctcaggtcatcct

SEQ ID NO: 7069009 - DNA, 22 bp, Homo sapiens
actgctgagcacacaagagtgt

SEQ ID NO: 7069010 - DNA, 22 bp, Homo sapiens
actgctgatataagaaaagatt

SEQ ID NO: 7069011 - DNA, 22 bp, Homo sapiens
actgctgattatgaaagtgaca

SEQ ID NO: 7069012 - DNA, 22 bp, Homo sapiens
actgctgattattgaagtagag

SEQ ID NO: 7069013 - DNA, 22 bp, Homo sapiens
actgctgatttagctttgtggg

SEQ ID NO: 7069014 - DNA, 22 bp, Homo sapiens
actgctgattttaggactgtta

SEQ ID NO: 7069015 - DNA, 22 bp, Homo sapiens
actgcttacaaaaggaaagaat

SEQ ID NO: 7069016 - DNA, 22 bp, Homo sapiens
actgcttacccggcctgacttc

SEQ ID NO: 7069017 - DNA, 20 bp, Homo sapiens
actgcttctttctctgacct

SEQ ID NO: 7069018 - DNA, 22 bp, Homo sapiens
agtggctgctggagtggagatg

SEQ ID NO: 7069019 - DNA, 22 bp, Homo sapiens
actggcagagaccctgatggcc

SEQ ID NO: 7069020 - DNA, 22 bp, Homo sapiens
actggcagcagcagcccttggg

SEQ ID NO: 7069021 - DNA, 22 bp, Homo sapiens
actggcagccacaactggcagg

SEQ ID NO: 7069022 - DNA, 22 bp, Homo sapiens
acttggagagcattgctgggga

SEQ ID NO: 7069023 - DNA, 21 bp, Homo sapiens
acttggcagaacgcagaaggc

SEQ ID NO: 7069024 - DNA, 20 bp, Homo sapiens
acttgctgggctttgttacc

SEQ ID NO: 7069025 - DNA, 22 bp, Homo sapiens
acttgctggtggcatttacagt

SEQ ID NO: 7069026 - DNA, 22 bp, Homo sapiens
acttgcattatatttatcacaa

SEQ ID NO: 7069027 - DNA, 22 bp, Homo sapiens
acttgccccagaattgctgctg

SEQ ID NO: 7069028 - DNA, 22 bp, Homo sapiens
acttcttttcaaatcatgcaaa

SEQ ID NO: 7069029 - DNA, 22 bp, Homo sapiens
acttgcaaagtgagggagtgtt

SEQ ID NO: 7069030 - DNA, 22 bp, Homo sapiens
acttcatgcagaagagagctgt

SEQ ID NO: 7069031 - DNA, 22 bp, Homo sapiens
acttcatgctttagagagatga

SEQ ID NO: 7069032 - DNA, 22 bp, Homo sapiens
acttcagcccagaggaagggat

SEQ ID NO: 7069033 - DNA, 22 bp, Homo sapiens
acttcagtaggtgatatgtgca

SEQ ID NO: 7069034 - DNA, 22 bp, Homo sapiens
acttcaaattttcagaagaaat

SEQ ID NO: 7069035 - DNA, 22 bp, Homo sapiens
acttcacagaaattttatgagg

SEQ ID NO: 7069036 - DNA, 22 bp, Homo sapiens
acttcacagatatttatttggt

SEQ ID NO: 7069037 - DNA, 22 bp, Homo sapiens
acttcagagactttatggtcca

SEQ ID NO: 7069038 - DNA, 22 bp, Homo sapiens
acttcaaacaattaacagagaa

SEQ ID NO: 7069039 - DNA, 22 bp, Homo sapiens
acttcaaaatgagtttcctggt

SEQ ID NO: 7069040 - DNA, 22 bp, Homo sapiens
acttcaaatgtgacaatgtgaa

SEQ ID NO: 7069041 - DNA, 22 bp, Homo sapiens
acttagaattaaatatttttgg

SEQ ID NO: 7069042 - DNA, 22 bp, Homo sapiens
acttagaattaaatatttttgg

SEQ ID NO: 7069043 - DNA, 18 bp, Homo sapiens
actgtgtgaattagctcc

SEQ ID NO: 7069044 - DNA, 22 bp, Homo sapiens
actgtgtgactgttattactgt

SEQ ID NO: 7069045 - DNA, 22 bp, Homo sapiens
actgtgtggaccactctgaggc

SEQ ID NO: 7069046 - DNA, 22 bp, Homo sapiens
agtttatgtaaaattagtaatg

SEQ ID NO: 7069047 - DNA, 22 bp, Homo sapiens
agtttagaaaatctgtttcttc

SEQ ID NO: 7069048 - DNA, 22 bp, Homo sapiens
agtttagaagaggaacttgtta

SEQ ID NO: 7069049 - DNA, 22 bp, Homo sapiens
agtttagacaaagtcttgcatt

SEQ ID NO: 7069050 - DNA, 22 bp, Homo sapiens
agtttacatgacgtgtatttca

SEQ ID NO: 7069051 - DNA, 22 bp, Homo sapiens
agtttacacttttgattcttat

SEQ ID NO: 7069052 - DNA, 22 bp, Homo sapiens
actggcagtgtcgtttacatga

SEQ ID NO: 7069053 - DNA, 19 bp, Homo sapiens
actggcagtttctgcatgg

SEQ ID NO: 7069054 - DNA, 22 bp, Homo sapiens
actggcagtttgagaatgcatt

SEQ ID NO: 7069055 - DNA, 22 bp, Homo sapiens
actggcagtttgagaatgcatt

SEQ ID NO: 7069056 - DNA, 22 bp, Homo sapiens
agttgctcaatgtggctgtgga

SEQ ID NO: 7069057 - DNA, 22 bp, Homo sapiens
actggcaggctgctggccggcg

SEQ ID NO: 7069058 - DNA, 22 bp, Homo sapiens
actggcagtagagggagcgcat

SEQ ID NO: 7069059 - DNA, 22 bp, Homo sapiens
actggcagtagagggagcgcat

SEQ ID NO: 7069060 - DNA, 22 bp, Homo sapiens
actggcagtggcagcagaaaga

SEQ ID NO: 7069061 - DNA, 20 bp, Homo sapiens
actgtgaatgctgaattagc

SEQ ID NO: 7069062 - DNA, 22 bp, Homo sapiens
actgtaaaggtttgtagcccag

SEQ ID NO: 7069063 - DNA, 22 bp, Homo sapiens
agtttccactggagacactgtg

SEQ ID NO: 7069064 - DNA, 22 bp, Homo sapiens
agtttccaaatattgttttagc

SEQ ID NO: 7069065 - DNA, 22 bp, Homo sapiens
agtttccttggattcaatttgg

SEQ ID NO: 7069066 - DNA, 22 bp, Homo sapiens
agtttccttgggcatttgttta

SEQ ID NO: 7069067 - DNA, 22 bp, Homo sapiens
actgtgctatctactgaattat

SEQ ID NO: 7069068 - DNA, 22 bp, Homo sapiens
atatcttttagagcaagcttgt

SEQ ID NO: 7069069 - DNA, 22 bp, Homo sapiens
atatctttgtttttgccaagat

SEQ ID NO: 7069070 - DNA, 22 bp, Homo sapiens
agaaaatttaaagagacacaca

SEQ ID NO: 7069071 - DNA, 22 bp, Homo sapiens
agaaacagaaccaggtgtcatt

SEQ ID NO: 7069072 - DNA, 22 bp, Homo sapiens
atatcttctttattttgtgagg

SEQ ID NO: 7069073 - DNA, 22 bp, Homo sapiens
atatattttgaatagcctctgt

SEQ ID NO: 7069074 - DNA, 22 bp, Homo sapiens
atatatttgagaatattcatga

SEQ ID NO: 7069075 - DNA, 22 bp, Homo sapiens
atatatttgagaatattcatga

SEQ ID NO: 7069076 - DNA, 22 bp, Homo sapiens
atatatttgagaatattcatga

SEQ ID NO: 7069077 - DNA, 22 bp, Homo sapiens
atatatttactctcctgttgca

SEQ ID NO: 7069078 - DNA, 22 bp, Homo sapiens
atatatttgagaatattcatga

SEQ ID NO: 7069079 - DNA, 22 bp, Homo sapiens
atatatttgagaatattcatga

SEQ ID NO: 7069080 - DNA, 22 bp, Homo sapiens
atatacacatctttttaaatat

SEQ ID NO: 7069081 - DNA, 22 bp, Homo sapiens
atatacacagagcttatggtga

SEQ ID NO: 7069082 - DNA, 22 bp, Homo sapiens
atatacaaagggcaacctcgct

SEQ ID NO: 7069083 - DNA, 22 bp, Homo sapiens
atatacaaagggcaacctcgct

SEQ ID NO: 7069084 - DNA, 18 bp, Homo sapiens
acttgggacttttgcatt

SEQ ID NO: 7069085 - DNA, 22 bp, Homo sapiens
acttgggtcaagtagctcacag

SEQ ID NO: 7069086 - DNA, 22 bp, Homo sapiens
acttggttgatgtcataaggtt

SEQ ID NO: 7069087 - DNA, 22 bp, Homo sapiens
atataatagtttcataaaggct

SEQ ID NO: 7069088 - DNA, 22 bp, Homo sapiens
atataatagtttcataaaggct

SEQ ID NO: 7069089 - DNA, 22 bp, Homo sapiens
atataatagtttcataaaggct

SEQ ID NO: 7069090 - DNA, 22 bp, Homo sapiens
atatataacctggataaggctt

SEQ ID NO: 7069091 - DNA, 22 bp, Homo sapiens
actttgtaaattgttgtgactc

SEQ ID NO: 7069092 - DNA, 20 bp, Homo sapiens
actttggggtctttctcaga

SEQ ID NO: 7069093 - DNA, 22 bp, Homo sapiens
atatacacatgtgtatacattt

SEQ ID NO: 7069094 - DNA, 22 bp, Homo sapiens
atatacacatgtgtatacattt

SEQ ID NO: 7069095 - DNA, 22 bp, Homo sapiens
atcactgagcttcagtgctggc

SEQ ID NO: 7069096 - DNA, 22 bp, Homo sapiens
atcacattgttagcatagactg

SEQ ID NO: 7069097 - DNA, 21 bp, Homo sapiens
atcaccagcagaagctgcaga

SEQ ID NO: 7069098 - DNA, 22 bp, Homo sapiens
atcaccaggcaaaatgtcagag

SEQ ID NO: 7069099 - DNA, 22 bp, Homo sapiens
atcaccattgaaaaacaggttt

SEQ ID NO: 7069100 - DNA, 22 bp, Homo sapiens
atcactgtcgtcatctgagatt

SEQ ID NO: 7069101 - DNA, 22 bp, Homo sapiens
atcactgtgtatgtatatgcag

SEQ ID NO: 7069102 - DNA, 22 bp, Homo sapiens
agaaacagaagggaaagctttt

SEQ ID NO: 7069103 - DNA, 20 bp, Homo sapiens
agaaacagcacaattctgtt

SEQ ID NO: 7069104 - DNA, 20 bp, Homo sapiens
agaaacagcacaattctgtt

SEQ ID NO: 7069105 - DNA, 22 bp, Homo sapiens
agaaacagcattagcatcaatt

SEQ ID NO: 7069106 - DNA, 22 bp, Homo sapiens
atcacaaaggctgcttcatgat

SEQ ID NO: 7069107 - DNA, 22 bp, Homo sapiens
atcacattgccagtgattaccc

SEQ ID NO: 7069108 - DNA, 21 bp, Homo sapiens
atcacattggctgttattatt

SEQ ID NO: 7069109 - DNA, 22 bp, Homo sapiens
atcattggaggcactgtgcagt

SEQ ID NO: 7069110 - DNA, 22 bp, Homo sapiens
atcatttacaaactcagcattg

SEQ ID NO: 7069111 - DNA, 19 bp, Homo sapiens
atcagcaaggtaggatgtg

SEQ ID NO: 7069112 - DNA, 20 bp, Homo sapiens
atcatctttacaatgtcagt

SEQ ID NO: 7069113 - DNA, 22 bp, Homo sapiens
atcattctgatggtcaatgcta

SEQ ID NO: 7069114 - DNA, 22 bp, Homo sapiens
atccagcacttgttcatgtgaa

SEQ ID NO: 7069115 - DNA, 22 bp, Homo sapiens
atccagcacttgttcatgtgaa

SEQ ID NO: 7069116 - DNA, 22 bp, Homo sapiens
agaacctttctttagaaattca

SEQ ID NO: 7069117 - DNA, 22 bp, Homo sapiens
atccagagactggggctgggat

SEQ ID NO: 7069118 - DNA, 22 bp, Homo sapiens
atccagagaggttaggtgacat

SEQ ID NO: 7069119 - DNA, 22 bp, Homo sapiens
atcatttccctttagatcacaa

SEQ ID NO: 7069120 - DNA, 22 bp, Homo sapiens
atcatttggggaattgtggaca

SEQ ID NO: 7069121 - DNA, 22 bp, Homo sapiens
atccagagacccaaggacagaa

SEQ ID NO: 7069122 - DNA, 22 bp, Homo sapiens
aggctgatgctggctgaggctg

SEQ ID NO: 7069123 - DNA, 22 bp, Homo sapiens
aggctgagtttctcattctcgc

SEQ ID NO: 7069124 - DNA, 22 bp, Homo sapiens
aggctgagtttctcattctcgc

SEQ ID NO: 7069125 - DNA, 22 bp, Homo sapiens
aggctgagtttctcattctcgc

SEQ ID NO: 7069126 - DNA, 22 bp, Homo sapiens
aggctgatgctggctgaggctg

SEQ ID NO: 7069127 - DNA, 22 bp, Homo sapiens
aggctgagtttctcattctcgc

SEQ ID NO: 7069128 - DNA, 20 bp, Homo sapiens
aggctgagttctatgcactt

SEQ ID NO: 7069129 - DNA, 22 bp, Homo sapiens
aggctgagtgctcccctagatg

SEQ ID NO: 7069130 - DNA, 20 bp, Homo sapiens
aggctgagttctatgcactt

SEQ ID NO: 7069131 - DNA, 20 bp, Homo sapiens
aggctgagttctatgcactt

SEQ ID NO: 7069132 - DNA, 22 bp, Homo sapiens
aggctgaggggcgagggaccct

SEQ ID NO: 7069133 - DNA, 22 bp, Homo sapiens
aggctgagggctcctgagggca

SEQ ID NO: 7069134 - DNA, 22 bp, Homo sapiens
aggctgagggctcctgagggca

SEQ ID NO: 7069135 - DNA, 22 bp, Homo sapiens
aggctgagggctcctgagggca

SEQ ID NO: 7069136 - DNA, 22 bp, Homo sapiens
aggctgaggctttccttggaga

SEQ ID NO: 7069137 - DNA, 22 bp, Homo sapiens
aggctgaggctttccttggaga

SEQ ID NO: 7069138 - DNA, 22 bp, Homo sapiens
aggctgaggctttccttggaga

SEQ ID NO: 7069139 - DNA, 22 bp, Homo sapiens
aggctgaggctttccttggaga

SEQ ID NO: 7069140 - DNA, 22 bp, Homo sapiens
aggctgagggctcctgagggca

SEQ ID NO: 7069141 - DNA, 22 bp, Homo sapiens
aggctgagggctcctgagggca

SEQ ID NO: 7069142 - DNA, 22 bp, Homo sapiens
aggctgaggatccctgtgttct

SEQ ID NO: 7069143 - DNA, 22 bp, Homo sapiens
aggctgaggctggcagctccag

SEQ ID NO: 7069144 - DNA, 22 bp, Homo sapiens
aggctgaggctggcagctccag

SEQ ID NO: 7069145 - DNA, 22 bp, Homo sapiens
aggctgaggctggcagctccag

SEQ ID NO: 7069146 - DNA, 22 bp, Homo sapiens
acatttacagtgctagacaatc

SEQ ID NO: 7069147 - DNA, 22 bp, Homo sapiens
acatttacattttctctggcct

SEQ ID NO: 7069148 - DNA, 19 bp, Homo sapiens
acatttagaatgtacttgc

SEQ ID NO: 7069149 - DNA, 22 bp, Homo sapiens
acatttagagttctttactcca

SEQ ID NO: 7069150 - DNA, 22 bp, Homo sapiens
acatttagctgtacaatctatg

SEQ ID NO: 7069151 - DNA, 22 bp, Homo sapiens
acatttatataactcactagga

SEQ ID NO: 7069152 - DNA, 22 bp, Homo sapiens
aggctatttccactcttctcat

SEQ ID NO: 7069153 - DNA, 22 bp, Homo sapiens
aggctatttccactcttctcat

SEQ ID NO: 7069154 - DNA, 22 bp, Homo sapiens
aggctagggtaacagatgtggc

SEQ ID NO: 7069155 - DNA, 22 bp, Homo sapiens
aggctagggccatggctggtga

SEQ ID NO: 7069156 - DNA, 22 bp, Homo sapiens
acatttaaccaaactgtttaat

SEQ ID NO: 7069157 - DNA, 22 bp, Homo sapiens
acatttaacctttgaggaactg

SEQ ID NO: 7069158 - DNA, 22 bp, Homo sapiens
aggccttgccaatgagagaact

SEQ ID NO: 7069159 - DNA, 22 bp, Homo sapiens
aggccttggaagccagggagcc

SEQ ID NO: 7069160 - DNA, 22 bp, Homo sapiens
aggcgcctgcgggatccttgcc

SEQ ID NO: 7069161 - DNA, 22 bp, Homo sapiens
aggcagggctcatttcttaggc

SEQ ID NO: 7069162 - DNA, 17 bp, Homo sapiens
aggcaggcagagcggga

SEQ ID NO: 7069163 - DNA, 22 bp, Homo sapiens
aggcaggcagggctcactgtct

SEQ ID NO: 7069164 - DNA, 22 bp, Homo sapiens
aggcagggctgggattagactc

SEQ ID NO: 7069165 - DNA, 22 bp, Homo sapiens
aggcaggggagctggaagggta

SEQ ID NO: 7069166 - DNA, 22 bp, Homo sapiens
aggcaggggagctggaagggta

SEQ ID NO: 7069167 - DNA, 22 bp, Homo sapiens
aggcaggggagctggaagggta

SEQ ID NO: 7069168 - DNA, 22 bp, Homo sapiens
acatgagaggctgtggagtaca

SEQ ID NO: 7069169 - DNA, 22 bp, Homo sapiens
acatgagaggctgtggagtaca

SEQ ID NO: 7069170 - DNA, 22 bp, Homo sapiens
acatgcagaattcttagagagc

SEQ ID NO: 7069171 - DNA, 22 bp, Homo sapiens
acatgcaggaaaatgcacagat

SEQ ID NO: 7069172 - DNA, 22 bp, Homo sapiens
aggccctgtaaggtgtggagat

SEQ ID NO: 7069173 - DNA, 22 bp, Homo sapiens
aggccctgtccatggtgctgaa

SEQ ID NO: 7069174 - DNA, 22 bp, Homo sapiens
aggccctgtccatggtgctgaa

SEQ ID NO: 7069175 - DNA, 22 bp, Homo sapiens
aggccctgttatgagccactgt

SEQ ID NO: 7069176 - DNA, 22 bp, Homo sapiens
aggccctgttatgagccactgt

SEQ ID NO: 7069177 - DNA, 22 bp, Homo sapiens
aggccctgttatgagccactgt

SEQ ID NO: 7069178 - DNA, 22 bp, Homo sapiens
aggcccttcttggtggctcagg

SEQ ID NO: 7069179 - DNA, 22 bp, Homo sapiens
acatggaagcaaagttctattt

SEQ ID NO: 7069180 - DNA, 22 bp, Homo sapiens
acatggagaccagatggaagta

SEQ ID NO: 7069181 - DNA, 20 bp, Homo sapiens
acatggatcaaatgtcagtt

SEQ ID NO: 7069182 - DNA, 19 bp, Homo sapiens
acatggcatcccaggaggt

SEQ ID NO: 7069183 - DNA, 22 bp, Homo sapiens
aggcctgcctggagcctggctg

SEQ ID NO: 7069184 - DNA, 22 bp, Homo sapiens
accaggcctagcaagtacatta

SEQ ID NO: 7069185 - DNA, 19 bp, Homo sapiens
accaggcctcagaggccct

SEQ ID NO: 7069186 - DNA, 22 bp, Homo sapiens
accaggccctccagctgcgtgg

SEQ ID NO: 7069187 - DNA, 19 bp, Homo sapiens
accaggcctcagaggccct

SEQ ID NO: 7069188 - DNA, 20 bp, Homo sapiens
accaggcccggtgtctcctc

SEQ ID NO: 7069189 - DNA, 22 bp, Homo sapiens
accaggcccgctgctatggtgg

SEQ ID NO: 7069190 - DNA, 22 bp, Homo sapiens
accaggcccaccgcatgctcct

SEQ ID NO: 7069191 - DNA, 22 bp, Homo sapiens
agggacagtatccatctcacag

SEQ ID NO: 7069192 - DNA, 22 bp, Homo sapiens
agggaattcactggaacgccct

SEQ ID NO: 7069193 - DNA, 22 bp, Homo sapiens
agggacacgaggtcctgctggg

SEQ ID NO: 7069194 - DNA, 22 bp, Homo sapiens
agggacacttgctttcaggccc

SEQ ID NO: 7069195 - DNA, 22 bp, Homo sapiens
agggacagatgaatgactgagt

SEQ ID NO: 7069196 - DNA, 22 bp, Homo sapiens
agggacagatgaatgactgagt

SEQ ID NO: 7069197 - DNA, 22 bp, Homo sapiens
agggaagcaatattagatatca

SEQ ID NO: 7069198 - DNA, 22 bp, Homo sapiens
agggaagccaagccttagagaa

SEQ ID NO: 7069199 - DNA, 22 bp, Homo sapiens
aggctggatttatggggacttc

SEQ ID NO: 7069200 - DNA, 22 bp, Homo sapiens
aggctggagtgtgcagtggcgc

SEQ ID NO: 7069201 - DNA, 22 bp, Homo sapiens
aggctggagtgtgcagtggcgc

SEQ ID NO: 7069202 - DNA, 22 bp, Homo sapiens
aggctggcaaggcagatgtgtg

SEQ ID NO: 7069203 - DNA, 20 bp, Homo sapiens
aggctggcactcctggccag

SEQ ID NO: 7069204 - DNA, 23 bp, Homo sapiens
aggctttatggtagaaagtttgc

SEQ ID NO: 7069205 - DNA, 22 bp, Homo sapiens
aggctttatttgatctatatgc

SEQ ID NO: 7069206 - DNA, 22 bp, Homo sapiens
aggctttcctgtcactcatgct

SEQ ID NO: 7069207 - DNA, 22 bp, Homo sapiens
agggaagaatcactgggatgtt

SEQ ID NO: 7069208 - DNA, 22 bp, Homo sapiens
acattttttagagtcccacatt

SEQ ID NO: 7069209 - DNA, 22 bp, Homo sapiens
acatttttattcatcaaagcag

SEQ ID NO: 7069210 - DNA, 22 bp, Homo sapiens
acatttgtcttctttcagatta

SEQ ID NO: 7069211 - DNA, 22 bp, Homo sapiens
accctcaacaaattcactctat

SEQ ID NO: 7069212 - DNA, 22 bp, Homo sapiens
agggcctgggtctgtactcctc

SEQ ID NO: 7069213 - DNA, 22 bp, Homo sapiens
agggcctggtgacctgggtcct

SEQ ID NO: 7069214 - DNA, 22 bp, Homo sapiens
agggcctggttctgtgtaggga

SEQ ID NO: 7069215 - DNA, 22 bp, Homo sapiens
accccaggaagtggaggtcatg

SEQ ID NO: 7069216 - DNA, 22 bp, Homo sapiens
acccaggcgggagtgcagtgtc

SEQ ID NO: 7069217 - DNA, 22 bp, Homo sapiens
acccaggctagagtgcagtggt

SEQ ID NO: 7069218 - DNA, 22 bp, Homo sapiens
acccaggctagggtgcagtggc

SEQ ID NO: 7069219 - DNA, 22 bp, Homo sapiens
acccaggctggagtgcagtgac

SEQ ID NO: 7069220 - DNA, 22 bp, Homo sapiens
agggcctgggatgtcctcctag

SEQ ID NO: 7069221 - DNA, 22 bp, Homo sapiens
agggcctgggccagcacccttt

SEQ ID NO: 7069222 - DNA, 22 bp, Homo sapiens
agggcctgggccagcacccttt

SEQ ID NO: 7069223 - DNA, 22 bp, Homo sapiens
agggcctggggtagcttactgc

SEQ ID NO: 7069224 - DNA, 22 bp, Homo sapiens
accattgccccctagtgtctgt

SEQ ID NO: 7069225 - DNA, 22 bp, Homo sapiens
agggcatctctaacagtctcct

SEQ ID NO: 7069226 - DNA, 23 bp, Homo sapiens
agggcatgaagcagaggacgtgg

SEQ ID NO: 7069227 - DNA, 22 bp, Homo sapiens
agggcagcttccatagtctggc

SEQ ID NO: 7069228 - DNA, 20 bp, Homo sapiens
agggcagcttgaggagccgg

SEQ ID NO: 7069229 - DNA, 22 bp, Homo sapiens
agggcagtgggaaagcctgctc

SEQ ID NO: 7069230 - DNA, 22 bp, Homo sapiens
accattttgggtattttcagag

SEQ ID NO: 7069231 - DNA, 22 bp, Homo sapiens
acaggtgggcttaagagtcggc

SEQ ID NO: 7069232 - DNA, 22 bp, Homo sapiens
acaggtggcttattggctgatt

SEQ ID NO: 7069233 - DNA, 22 bp, Homo sapiens
acaggtggtaaaatggactgtc

SEQ ID NO: 7069234 - DNA, 22 bp, Homo sapiens
acaggtggtctttgctcctttt

SEQ ID NO: 7069235 - DNA, 22 bp, Homo sapiens
aggagctggagtccaggcaagt

SEQ ID NO: 7069236 - DNA, 22 bp, Homo sapiens
acaggtggacacagcagcagtc

SEQ ID NO: 7069237 - DNA, 18 bp, Homo sapiens
acagggatggggtaagtg

SEQ ID NO: 7069238 - DNA, 18 bp, Homo sapiens
acagggatggggtaagtg

SEQ ID NO: 7069239 - DNA, 22 bp, Homo sapiens
acagggagtctgaggggatagt

SEQ ID NO: 7069240 - DNA, 22 bp, Homo sapiens
acagtaatgcatacaagttagt

SEQ ID NO: 7069241 - DNA, 20 bp, Homo sapiens
aggaggaaaaaatgacgagc

SEQ ID NO: 7069242 - DNA, 21 bp, Homo sapiens
aggaggaacccgtggctgggc

SEQ ID NO: 7069243 - DNA, 22 bp, Homo sapiens
aggagggtgatccgggctggtc

SEQ ID NO: 7069244 - DNA, 22 bp, Homo sapiens
aggagtcactcagggcttcatc

SEQ ID NO: 7069245 - DNA, 22 bp, Homo sapiens
aggagtcagattgtttgaatgt

SEQ ID NO: 7069246 - DNA, 22 bp, Homo sapiens
aggagtgagctttggggtcaga

SEQ ID NO: 7069247 - DNA, 22 bp, Homo sapiens
aggagtgagtgtcctcagcaga

SEQ ID NO: 7069248 - DNA, 22 bp, Homo sapiens
aggagtgcaaatagtccagaga

SEQ ID NO: 7069249 - DNA, 22 bp, Homo sapiens
aggagtggaattactgggttct

SEQ ID NO: 7069250 - DNA, 22 bp, Homo sapiens
acagtgaggacagggactgtgt

SEQ ID NO: 7069251 - DNA, 22 bp, Homo sapiens
acagttattctttatgcaacca

SEQ ID NO: 7069252 - DNA, 22 bp, Homo sapiens
acagttacattaaacaaaagga

SEQ ID NO: 7069253 - DNA, 19 bp, Homo sapiens
aggcagcattctggggctt

SEQ ID NO: 7069254 - DNA, 22 bp, Homo sapiens
aggcagcatgggccccagctcc

SEQ ID NO: 7069255 - DNA, 22 bp, Homo sapiens
aggcagcatgggccccagctcc

SEQ ID NO: 7069256 - DNA, 22 bp, Homo sapiens
aggcagcagtgataagatagga

SEQ ID NO: 7069257 - DNA, 22 bp, Homo sapiens
aggcagcatccagaggagaatg

SEQ ID NO: 7069258 - DNA, 22 bp, Homo sapiens
aggcagcatccagaggagaatg

SEQ ID NO: 7069259 - DNA, 21 bp, Homo sapiens
aggcagcatctgatttatatg

SEQ ID NO: 7069260 - DNA, 22 bp, Homo sapiens
aggcagcatgctctgcttctac

SEQ ID NO: 7069261 - DNA, 22 bp, Homo sapiens
acagttttttcaacattggaat

SEQ ID NO: 7069262 - DNA, 22 bp, Homo sapiens
acataaatagattattgggagg

SEQ ID NO: 7069263 - DNA, 22 bp, Homo sapiens
acataaatagattattgggagg

SEQ ID NO: 7069264 - DNA, 22 bp, Homo sapiens
aggcagctggaggcagagacta

SEQ ID NO: 7069265 - DNA, 22 bp, Homo sapiens
aggcaggcaagttcatatgagg

SEQ ID NO: 7069266 - DNA, 19 bp, Homo sapiens
aggaatggaattaattctg

SEQ ID NO: 7069267 - DNA, 23 bp, Homo sapiens
aggaatggctagaagtgtgaccc

SEQ ID NO: 7069268 - DNA, 22 bp, Homo sapiens
acaggctggtttgtaaaagatg

SEQ ID NO: 7069269 - DNA, 22 bp, Homo sapiens
acaggctgtacttctaatcatc

SEQ ID NO: 7069270 - DNA, 22 bp, Homo sapiens
acaggctgtacttctaatcatc

SEQ ID NO: 7069271 - DNA, 18 bp, Homo sapiens
acaggctgtgggaatggt

SEQ ID NO: 7069272 - DNA, 22 bp, Homo sapiens
acaggctgttggggtccagggt

SEQ ID NO: 7069273 - DNA, 22 bp, Homo sapiens
acaggctgttggggtccagggt

SEQ ID NO: 7069274 - DNA, 22 bp, Homo sapiens
aggaagggctgtttctccaaga

SEQ ID NO: 7069275 - DNA, 22 bp, Homo sapiens
aggaatgatagtaaaagagaat

SEQ ID NO: 7069276 - DNA, 22 bp, Homo sapiens
aggaatgattcaagacttggct

SEQ ID NO: 7069277 - DNA, 22 bp, Homo sapiens
acaggctctggggcaggatggc

SEQ ID NO: 7069278 - DNA, 22 bp, Homo sapiens
acaggctgccacttgcatccaa

SEQ ID NO: 7069279 - DNA, 22 bp, Homo sapiens
acaggctgcccgctccccacct

SEQ ID NO: 7069280 - DNA, 22 bp, Homo sapiens
acaggctgcccgctccccacct

SEQ ID NO: 7069281 - DNA, 22 bp, Homo sapiens
acaggctgcccgctccccacct

SEQ ID NO: 7069282 - DNA, 22 bp, Homo sapiens
acaggctgcctaccaagtatca

SEQ ID NO: 7069283 - DNA, 22 bp, Homo sapiens
acaggctgcctaccaagtatca

SEQ ID NO: 7069284 - DNA, 22 bp, Homo sapiens
acaggctgctgagccatttgct

SEQ ID NO: 7069285 - DNA, 22 bp, Homo sapiens
acaggctgctgagccatttgct

SEQ ID NO: 7069286 - DNA, 22 bp, Homo sapiens
acaggctgctgggctccgtgct

SEQ ID NO: 7069287 - DNA, 22 bp, Homo sapiens
acaggctgctgggctccgtgct

SEQ ID NO: 7069288 - DNA, 22 bp, Homo sapiens
acaggctgctgggctccgtgct

SEQ ID NO: 7069289 - DNA, 22 bp, Homo sapiens
acaggctggaggaggaccaaga

SEQ ID NO: 7069290 - DNA, 22 bp, Homo sapiens
acaggctggaggaggaccaaga

SEQ ID NO: 7069291 - DNA, 22 bp, Homo sapiens
acaggctgggcgcttcctgcgg

SEQ ID NO: 7069292 - DNA, 22 bp, Homo sapiens
acaggctggtggtcctggccat

SEQ ID NO: 7069293 - DNA, 22 bp, Homo sapiens
acaggctggtggtcctggccat

SEQ ID NO: 7069294 - DNA, 22 bp, Homo sapiens
acagcttcgaggatctcatccc

SEQ ID NO: 7069295 - DNA, 22 bp, Homo sapiens
acaggcaggtaatttacatatt

SEQ ID NO: 7069296 - DNA, 22 bp, Homo sapiens
acaggccataaaggcaggccct

SEQ ID NO: 7069297 - DNA, 22 bp, Homo sapiens
acaggccataaaggcaggccct

SEQ ID NO: 7069298 - DNA, 22 bp, Homo sapiens
agctttatcacaatattggcta

SEQ ID NO: 7069299 - DNA, 22 bp, Homo sapiens
agctttatgcttcctacaagct

SEQ ID NO: 7069300 - DNA, 22 bp, Homo sapiens
agctggggctgtggttgtgatt

SEQ ID NO: 7069301 - DNA, 22 bp, Homo sapiens
agctgggggtagtgagaaataa

SEQ ID NO: 7069302 - DNA, 22 bp, Homo sapiens
agctgggggttggataagggta

SEQ ID NO: 7069303 - DNA, 22 bp, Homo sapiens
agctggggttgcacacattttg

SEQ ID NO: 7069304 - DNA, 22 bp, Homo sapiens
agctggggctgcagagaacagg

SEQ ID NO: 7069305 - DNA, 22 bp, Homo sapiens
agctggggctgcagagaacagg

SEQ ID NO: 7069306 - DNA, 22 bp, Homo sapiens
agctgggcaccccgctgcgtct

SEQ ID NO: 7069307 - DNA, 23 bp, Homo sapiens
acagctgcacctggccgcctggc

SEQ ID NO: 7069308 - DNA, 22 bp, Homo sapiens
acagctcctactgaagccatgt

SEQ ID NO: 7069309 - DNA, 22 bp, Homo sapiens
acagctcttaggcagaaccaac

SEQ ID NO: 7069310 - DNA, 22 bp, Homo sapiens
acagctcttaggcagaaccaac

SEQ ID NO: 7069311 - DNA, 22 bp, Homo sapiens
acagctatctgactttgactca

SEQ ID NO: 7069312 - DNA, 22 bp, Homo sapiens
acagctcagacatcactgctct

SEQ ID NO: 7069313 - DNA, 22 bp, Homo sapiens
acagctcatttgtaaaacggag

SEQ ID NO: 7069314 - DNA, 22 bp, Homo sapiens
agctgcccaatcctgcagggcg

SEQ ID NO: 7069315 - DNA, 21 bp, Homo sapiens
agctgcccagagtagggaagg

SEQ ID NO: 7069316 - DNA, 22 bp, Homo sapiens
agctgcccagataggaggaggc

SEQ ID NO: 7069317 - DNA, 22 bp, Homo sapiens
agctgcccagctaggaagaagg

SEQ ID NO: 7069318 - DNA, 22 bp, Homo sapiens
agctgccccatgagaggcaggt

SEQ ID NO: 7069319 - DNA, 22 bp, Homo sapiens
agctgccccatgagaggcaggt

SEQ ID NO: 7069320 - DNA, 22 bp, Homo sapiens
agctgcccccagggctgtgctt

SEQ ID NO: 7069321 - DNA, 22 bp, Homo sapiens
agctgcctgtcctaggccatca

SEQ ID NO: 7069322 - DNA, 22 bp, Homo sapiens
agctgccttatggagtatgaaa

SEQ ID NO: 7069323 - DNA, 17 bp, Homo sapiens
agctgccttgcttgagc

SEQ ID NO: 7069324 - DNA, 22 bp, Homo sapiens
agctgctactgctctgccagag

SEQ ID NO: 7069325 - DNA, 22 bp, Homo sapiens
agctgctatgacaacaccagcc

SEQ ID NO: 7069326 - DNA, 22 bp, Homo sapiens
aaaactgaaccttgagatcttt

SEQ ID NO: 7069327 - DNA, 19 bp, Homo sapiens
aaaaggagagatcagagtt

SEQ ID NO: 7069328 - DNA, 22 bp, Homo sapiens
aaaaggaggacatggttacaga

SEQ ID NO: 7069329 - DNA, 22 bp, Homo sapiens
aaaaggtagttgccaaataagg

SEQ ID NO: 7069330 - DNA, 22 bp, Homo sapiens
aaaaggttttgagtacaaatat

SEQ ID NO: 7069331 - DNA, 22 bp, Homo sapiens
aaaagtaattgatgcaatcgta

SEQ ID NO: 7069332 - DNA, 22 bp, Homo sapiens
aaaagtaattgcaattttgtag

SEQ ID NO: 7069333 - DNA, 22 bp, Homo sapiens
aaaagtaattgcagttttgtca

SEQ ID NO: 7069334 - DNA, 22 bp, Homo sapiens
aaacagcttgtttcaggaaagt

SEQ ID NO: 7069335 - DNA, 22 bp, Homo sapiens
aaacagctttcagaatctctca

SEQ ID NO: 7069336 - DNA, 22 bp, Homo sapiens
aaacagctttcagaatctctca

SEQ ID NO: 7069337 - DNA, 22 bp, Homo sapiens
aaaactctgcagttagtttcta

SEQ ID NO: 7069338 - DNA, 22 bp, Homo sapiens
aaaaggcagtgcaagagagggt

SEQ ID NO: 7069339 - DNA, 22 bp, Homo sapiens
aaaaggatgttttcatgaaaca

SEQ ID NO: 7069340 - DNA, 22 bp, Homo sapiens
aaaaggctaatccagagcaact

SEQ ID NO: 7069341 - DNA, 22 bp, Homo sapiens
aaaaggctaatccagagcaact

SEQ ID NO: 7069342 - DNA, 22 bp, Homo sapiens
aaaaggctcttcaaaatggaag

SEQ ID NO: 7069343 - DNA, 22 bp, Homo sapiens
aaaaactgcaattacttttgtc

SEQ ID NO: 7069344 - DNA, 22 bp, Homo sapiens
aaaaagatgtcctgaagtttag

SEQ ID NO: 7069345 - DNA, 21 bp, Homo sapiens
aaaaagctggggcatgcatgc

SEQ ID NO: 7069346 - DNA, 22 bp, Homo sapiens
aaaaagcttaaatgagcagttc

SEQ ID NO: 7069347 - DNA, 22 bp, Homo sapiens
aaaaagtttcaactgccaactc

SEQ ID NO: 7069348 - DNA, 22 bp, Homo sapiens
aaaaggaggcaaacagcctaga

SEQ ID NO: 7069349 - DNA, 22 bp, Homo sapiens
aaaaggaggtcactttattcct

SEQ ID NO: 7069350 - DNA, 22 bp, Homo sapiens
aaaaggatcagattttgagcag

SEQ ID NO: 7069351 - DNA, 22 bp, Homo sapiens
aaaatattttagggccaggaga

SEQ ID NO: 7069352 - DNA, 22 bp, Homo sapiens
aaaatattttagggccaggaga

SEQ ID NO: 7069353 - DNA, 22 bp, Homo sapiens
aaaatatgtataactcttctgc

SEQ ID NO: 7069354 - DNA, 22 bp, Homo sapiens
aaaatatgtataactcttctgc

SEQ ID NO: 7069355 - DNA, 22 bp, Homo sapiens
aaaatattttagggccaggaga

SEQ ID NO: 7069356 - DNA, 22 bp, Homo sapiens
aaaatattttagggccaggaga

SEQ ID NO: 7069357 - DNA, 22 bp, Homo sapiens
aaactgcactttattttgtcaa

SEQ ID NO: 7069358 - DNA, 22 bp, Homo sapiens
aaactgctggttgctggccagc

SEQ ID NO: 7069359 - DNA, 23 bp, Homo sapiens
aaactgcttccaattcctgccat

SEQ ID NO: 7069360 - DNA, 22 bp, Homo sapiens
aaactgctttccacagtggcta

SEQ ID NO: 7069361 - DNA, 18 bp, Homo sapiens
aaactggcttggcctgtg

SEQ ID NO: 7069362 - DNA, 22 bp, Homo sapiens
aaaattgaagtgatcaggaact

SEQ ID NO: 7069363 - DNA, 22 bp, Homo sapiens
aaagagcatggaaagttcagga

SEQ ID NO: 7069364 - DNA, 22 bp, Homo sapiens
aaacacatcattcatgtcgtca

SEQ ID NO: 7069365 - DNA, 22 bp, Homo sapiens
aaacacattagccctgtggaaa

SEQ ID NO: 7069366 - DNA, 22 bp, Homo sapiens
aaacacattagccctgtggaaa

SEQ ID NO: 7069367 - DNA, 22 bp, Homo sapiens
aaacacattttaggaaaatcta

SEQ ID NO: 7069368 - DNA, 22 bp, Homo sapiens
aaacaccaagagctagctatta

SEQ ID NO: 7069369 - DNA, 22 bp, Homo sapiens
aaacactcatgtgttactctcc

SEQ ID NO: 7069370 - DNA, 22 bp, Homo sapiens
aaacattgagcacttgctattt

SEQ ID NO: 7069371 - DNA, 22 bp, Homo sapiens
aaacattgtaattttagcatgg

SEQ ID NO: 7069372 - DNA, 20 bp, Homo sapiens
aaacattcatgtacaagtga

SEQ ID NO: 7069373 - DNA, 22 bp, Homo sapiens
aaacatgtttagaaagcagctg

SEQ ID NO: 7069374 - DNA, 22 bp, Homo sapiens
aaacatgctggatttagaatat

SEQ ID NO: 7069375 - DNA, 22 bp, Homo sapiens
aaacagataatgctataaatgg

SEQ ID NO: 7069376 - DNA, 22 bp, Homo sapiens
aaacactgtgggacatcttact

SEQ ID NO: 7069377 - DNA, 22 bp, Homo sapiens
aaagccagggacagtgtgcatg

SEQ ID NO: 7069378 - DNA, 22 bp, Homo sapiens
aaacactgtgggacatcttact

SEQ ID NO: 7069379 - DNA, 22 bp, Homo sapiens
aaacactgaagacctatctggt

SEQ ID NO: 7069380 - DNA, 22 bp, Homo sapiens
aaacactgaagacctatctggt

SEQ ID NO: 7069381 - DNA, 22 bp, Homo sapiens
aaagccagagcaagctgtcaca

SEQ ID NO: 7069382 - DNA, 22 bp, Homo sapiens
aaagccagagtgtgttagagac

SEQ ID NO: 7069383 - DNA, 22 bp, Homo sapiens
aaagccagcaaggtgagtttca

SEQ ID NO: 7069384 - DNA, 22 bp, Homo sapiens
aaagccagctctgagctgcacc

SEQ ID NO: 7069385 - DNA, 21 bp, Homo sapiens
aaacatctctgcttttgtgtc

SEQ ID NO: 7069386 - DNA, 22 bp, Homo sapiens
aaacagctggtctcaaatgttc

SEQ ID NO: 7069387 - DNA, 22 bp, Homo sapiens
aaacagctgtcattgttttaaa

SEQ ID NO: 7069388 - DNA, 22 bp, Homo sapiens
aaacagctgtcattgttttaaa

SEQ ID NO: 7069389 - DNA, 22 bp, Homo sapiens
aaacagctcaagaagttactct

SEQ ID NO: 7069390 - DNA, 22 bp, Homo sapiens
aaacagctccttagtttccatc

SEQ ID NO: 7069391 - DNA, 22 bp, Homo sapiens
aaacagctgcactgctgatgtc

SEQ ID NO: 7069392 - DNA, 22 bp, Homo sapiens
aaacagctgcagtacacggcct

SEQ ID NO: 7069393 - DNA, 22 bp, Homo sapiens
aaacagctgggaggtagaggcg

SEQ ID NO: 7069394 - DNA, 22 bp, Homo sapiens
aaacagcaatggagaagccagg

SEQ ID NO: 7069395 - DNA, 22 bp, Homo sapiens
aaacagcaggaacatcttgcca

SEQ ID NO: 7069396 - DNA, 20 bp, Homo sapiens
aaacagctaaaccagctctc

SEQ ID NO: 7069397 - DNA, 22 bp, Homo sapiens
aaacagctaagtacattcaagg

SEQ ID NO: 7069398 - DNA, 22 bp, Homo sapiens
aaacagctaatggccaggaata

SEQ ID NO: 7069399 - DNA, 22 bp, Homo sapiens
aaacagctacttctgtataatg

SEQ ID NO: 7069400 - DNA, 22 bp, Homo sapiens
aaacagctacttctgtataatg

SEQ ID NO: 7069401 - DNA, 22 bp, Homo sapiens
aaagaaacctatcagccacatg

SEQ ID NO: 7069402 - DNA, 22 bp, Homo sapiens
aaagaaacctatcagccacatg

SEQ ID NO: 7069403 - DNA, 22 bp, Homo sapiens
aaagaaatacctttctcagctt

SEQ ID NO: 7069404 - DNA, 22 bp, Homo sapiens
aaagaacaaattagctgtttta

SEQ ID NO: 7069405 - DNA, 22 bp, Homo sapiens
aaatagttcagcttgtaaaccc

SEQ ID NO: 7069406 - DNA, 22 bp, Homo sapiens
aaatagttcagcttgtaaaccc

SEQ ID NO: 7069407 - DNA, 22 bp, Homo sapiens
aaatagttagccctgcatatat

SEQ ID NO: 7069408 - DNA, 22 bp, Homo sapiens
aaatagttagccctgcatatat

SEQ ID NO: 7069409 - DNA, 22 bp, Homo sapiens
aaatagttagccctgcatatat

SEQ ID NO: 7069410 - DNA, 22 bp, Homo sapiens
aaatagttcagccacggtgact

SEQ ID NO: 7069411 - DNA, 22 bp, Homo sapiens
aaatagttcagccacggtgact

SEQ ID NO: 7069412 - DNA, 22 bp, Homo sapiens
aaatagttcagccacggtgact

SEQ ID NO: 7069413 - DNA, 22 bp, Homo sapiens
aaactgtgaagcaagtacaagg

SEQ ID NO: 7069414 - DNA, 22 bp, Homo sapiens
aaactgtgaagcaagtacaagg

SEQ ID NO: 7069415 - DNA, 22 bp, Homo sapiens
aaactgtgagctagtaaatagg

SEQ ID NO: 7069416 - DNA, 22 bp, Homo sapiens
aaatagttacttctgctgtctt

SEQ ID NO: 7069417 - DNA, 22 bp, Homo sapiens
aaacttcattttcaactgcaaa

SEQ ID NO: 7069418 - DNA, 22 bp, Homo sapiens
aaacttcattttcaactgcaaa

SEQ ID NO: 7069419 - DNA, 22 bp, Homo sapiens
aaatagtttagctctcatttca

SEQ ID NO: 7069420 - DNA, 22 bp, Homo sapiens
aaatagtttagctctcatttca

SEQ ID NO: 7069421 - DNA, 22 bp, Homo sapiens
aaatagttgtttggatcaataa

SEQ ID NO: 7069422 - DNA, 22 bp, Homo sapiens
aaagaacaatgtggaatctcct

SEQ ID NO: 7069423 - DNA, 22 bp, Homo sapiens
aaagacatgacacattggagag

SEQ ID NO: 7069424 - DNA, 22 bp, Homo sapiens
aaagacttgggagcagtatgct

SEQ ID NO: 7069425 - DNA, 22 bp, Homo sapiens
aaagactttcacctagcaaaga

SEQ ID NO: 7069426 - DNA, 22 bp, Homo sapiens
aaagagatgtgccaaatagcct

SEQ ID NO: 7069427 - DNA, 22 bp, Homo sapiens
aagaacatgaacacaatgttta

SEQ ID NO: 7069428 - DNA, 22 bp, Homo sapiens
aagaacatgaacctcttctaac

SEQ ID NO: 7069429 - DNA, 22 bp, Homo sapiens
aagaacagttgggaggtgagcc

SEQ ID NO: 7069430 - DNA, 22 bp, Homo sapiens
aagaacataacagaagctgtgt

SEQ ID NO: 7069431 - DNA, 22 bp, Homo sapiens
aaaggttttgttcatcgatttt

SEQ ID NO: 7069432 - DNA, 22 bp, Homo sapiens
aaaggtttttatttatcctgga

SEQ ID NO: 7069433 - DNA, 22 bp, Homo sapiens
aaaggtttttcagcagggagat

SEQ ID NO: 7069434 - DNA, 22 bp, Homo sapiens
aaagtaacctagtaatagtgtc

SEQ ID NO: 7069435 - DNA, 22 bp, Homo sapiens
aactgtggacttgagactgatg

SEQ ID NO: 7069436 - DNA, 22 bp, Homo sapiens
aactgtgggatgcattaattca

SEQ ID NO: 7069437 - DNA, 22 bp, Homo sapiens
aaaggttttctgacccttagta

SEQ ID NO: 7069438 - DNA, 22 bp, Homo sapiens
aaaggttttgccctgggtattc

SEQ ID NO: 7069439 - DNA, 22 bp, Homo sapiens
aaaggttttggtaaggctttaa

SEQ ID NO: 7069440 - DNA, 22 bp, Homo sapiens
aaaggcagtgggtatgtggatc

SEQ ID NO: 7069441 - DNA, 18 bp, Homo sapiens
aaaggcatatatagaagt

SEQ ID NO: 7069442 - DNA, 22 bp, Homo sapiens
aaaggcagagttgttggaggca

SEQ ID NO: 7069443 - DNA, 22 bp, Homo sapiens
aaccccaggctggaggagtctc

SEQ ID NO: 7069444 - DNA, 22 bp, Homo sapiens
aacccagggtgaggggagtcta

SEQ ID NO: 7069445 - DNA, 22 bp, Homo sapiens
aacccatgttggaagcttatca

SEQ ID NO: 7069446 - DNA, 22 bp, Homo sapiens
aaagcctcccaggttatgagta

SEQ ID NO: 7069447 - DNA, 22 bp, Homo sapiens
aaagccattacaaaatttcata

SEQ ID NO: 7069448 - DNA, 22 bp, Homo sapiens
aacatacagtgagcagtggact

SEQ ID NO: 7069449 - DNA, 19 bp, Homo sapiens
aaagcagaggagcatctga

SEQ ID NO: 7069450 - DNA, 22 bp, Homo sapiens
aacacttctgttgataataagc

SEQ ID NO: 7069451 - DNA, 22 bp, Homo sapiens
aacacttctcatcactgcaagc

SEQ ID NO: 7069452 - DNA, 22 bp, Homo sapiens
aacacttcaagcagaaggttgg

SEQ ID NO: 7069453 - DNA, 22 bp, Homo sapiens
aacacttcccatcagagggaca

SEQ ID NO: 7069454 - DNA, 22 bp, Homo sapiens
aacactgtgcccaccctagtcc

SEQ ID NO: 7069455 - DNA, 22 bp, Homo sapiens
aacactgtggtcttttcagtaa

SEQ ID NO: 7069456 - DNA, 22 bp, Homo sapiens
aacactgtcttatacttcaatg

SEQ ID NO: 7069457 - DNA, 22 bp, Homo sapiens
aaagatttaagaataatttgtg

SEQ ID NO: 7069458 - DNA, 22 bp, Homo sapiens
aaagatttgagttctgcttata

SEQ ID NO: 7069459 - DNA, 22 bp, Homo sapiens
aagaggaggatgctttacagct

SEQ ID NO: 7069460 - DNA, 22 bp, Homo sapiens
aaagtttggattagcagttaga

SEQ ID NO: 7069461 - DNA, 22 bp, Homo sapiens
aaagtttgaatgatatattagt

SEQ ID NO: 7069462 - DNA, 22 bp, Homo sapiens
aagaggggtggtctgtgaggat

SEQ ID NO: 7069463 - DNA, 22 bp, Homo sapiens
aagaggggtggtctgtgaggat

SEQ ID NO: 7069464 - DNA, 22 bp, Homo sapiens
aagaggtaaccatagcaaccac

SEQ ID NO: 7069465 - DNA, 22 bp, Homo sapiens
aagaggtaatgactgcttgagt

SEQ ID NO: 7069466 - DNA, 22 bp, Homo sapiens
aagaggtagcagtcacaaaaga

SEQ ID NO: 7069467 - DNA, 22 bp, Homo sapiens
aaatacatttacagtcgtggct

SEQ ID NO: 7069468 - DNA, 22 bp, Homo sapiens
aaatactagaattcagagttga

SEQ ID NO: 7069469 - DNA, 22 bp, Homo sapiens
aaatactgctgctattcctttt

SEQ ID NO: 7069470 - DNA, 22 bp, Homo sapiens
aagactgtgtctatggctactc

SEQ ID NO: 7069471 - DNA, 22 bp, Homo sapiens
aagactgtcttttctgagtgac

SEQ ID NO: 7069472 - DNA, 22 bp, Homo sapiens
aaagtttacagtgcacatgggt

SEQ ID NO: 7069473 - DNA, 22 bp, Homo sapiens
aagactgtacattttccagtct

SEQ ID NO: 7069474 - DNA, 22 bp, Homo sapiens
aagacgcaccctttgagggcac

SEQ ID NO: 7069475 - DNA, 22 bp, Homo sapiens
aagaccctacccctggagagga

SEQ ID NO: 7069476 - DNA, 17 bp, Homo sapiens
aagaccctagtctaccc

SEQ ID NO: 7069477 - DNA, 17 bp, Homo sapiens
aagaccctagtctaccc

SEQ ID NO: 7069478 - DNA, 22 bp, Homo sapiens
aagaccctatactcagtgaccc

SEQ ID NO: 7069479 - DNA, 22 bp, Homo sapiens
aagacctctgaagtacctggtg

SEQ ID NO: 7069480 - DNA, 22 bp, Homo sapiens
aagcaggcatcttggaggtcaa

SEQ ID NO: 7069481 - DNA, 22 bp, Homo sapiens
aagattctcactgctcaacttt

SEQ ID NO: 7069482 - DNA, 22 bp, Homo sapiens
aagattctacaaactctggtaa

SEQ ID NO: 7069483 - DNA, 22 bp, Homo sapiens
aagattctacagtaggtacatt

SEQ ID NO: 7069484 - DNA, 22 bp, Homo sapiens
aagattctagaggaacttctta

SEQ ID NO: 7069485 - DNA, 22 bp, Homo sapiens
aagattatggcagataacaatt

SEQ ID NO: 7069486 - DNA, 22 bp, Homo sapiens
aagattatggcagataacaatt

SEQ ID NO: 7069487 - DNA, 22 bp, Homo sapiens
aagatattcaaagatttattag

SEQ ID NO: 7069488 - DNA, 22 bp, Homo sapiens
aagatattcaaagatttattag

SEQ ID NO: 7069489 - DNA, 22 bp, Homo sapiens
aagatattttagaacattcact

SEQ ID NO: 7069490 - DNA, 22 bp, Homo sapiens
aagatcaccttgacatgaaaag

SEQ ID NO: 7069491 - DNA, 22 bp, Homo sapiens
aagatcataatatttatctcat

SEQ ID NO: 7069492 - DNA, 22 bp, Homo sapiens
aaatctgagaaatattgtccag

SEQ ID NO: 7069493 - DNA, 22 bp, Homo sapiens
aagcaggcgagggcctggagca

SEQ ID NO: 7069494 - DNA, 22 bp, Homo sapiens
aaatctcaatttgaattgtagc

SEQ ID NO: 7069495 - DNA, 22 bp, Homo sapiens
aagcaggcattccagagacaat

SEQ ID NO: 7069496 - DNA, 22 bp, Homo sapiens
aaatctcagcccttattttaga

SEQ ID NO: 7069497 - DNA, 22 bp, Homo sapiens
aaatctctgaacttaataatgc

SEQ ID NO: 7069498 - DNA, 22 bp, Homo sapiens
aaatgcatgtagaataatagag

SEQ ID NO: 7069499 - DNA, 22 bp, Homo sapiens
aaatgcatggtaaatgattgcc

SEQ ID NO: 7069500 - DNA, 22 bp, Homo sapiens
aagccctggggttgcacaaggc

SEQ ID NO: 7069501 - DNA, 22 bp, Homo sapiens
aagccctgttaggcactgggga

SEQ ID NO: 7069502 - DNA, 22 bp, Homo sapiens
aagcccttggcgcacaccgggc

SEQ ID NO: 7069503 - DNA, 22 bp, Homo sapiens
aagccgaggccacacagcagga

SEQ ID NO: 7069504 - DNA, 22 bp, Homo sapiens
aaccttcctgaggaaagtctaa

SEQ ID NO: 7069505 - DNA, 22 bp, Homo sapiens
aacctttgaggggagctctttc

SEQ ID NO: 7069506 - DNA, 22 bp, Homo sapiens
aacctgaatttaattgaaatga

SEQ ID NO: 7069507 - DNA, 22 bp, Homo sapiens
aacctgaaactacattcttgat

SEQ ID NO: 7069508 - DNA, 22 bp, Homo sapiens
aaccatttgcagttactgagac

SEQ ID NO: 7069509 - DNA, 22 bp, Homo sapiens
aaccatttgccattatcttaag

SEQ ID NO: 7069510 - DNA, 22 bp, Homo sapiens
aatgacagagatagaagggatg

SEQ ID NO: 7069511 - DNA, 22 bp, Homo sapiens
aactagaaagaacatatttcca

SEQ ID NO: 7069512 - DNA, 22 bp, Homo sapiens
aactagaaccacttgtatttcc

SEQ ID NO: 7069513 - DNA, 22 bp, Homo sapiens
aactagagcttccagcttcttg

SEQ ID NO: 7069514 - DNA, 22 bp, Homo sapiens
aactagtcagtgattctcagaa

SEQ ID NO: 7069515 - DNA, 22 bp, Homo sapiens
aactataatggggttaggaaat

SEQ ID NO: 7069516 - DNA, 22 bp, Homo sapiens
aatggctgccagggcaggaggt

SEQ ID NO: 7069517 - DNA, 22 bp, Homo sapiens
aatggctgccagggcaggaggt

SEQ ID NO: 7069518 - DNA, 21 bp, Homo sapiens
aatggctgggcaaggtctctc

SEQ ID NO: 7069519 - DNA, 22 bp, Homo sapiens
aacatgtctgggtattcacaag

SEQ ID NO: 7069520 - DNA, 22 bp, Homo sapiens
aatagattcatggttaagagca

SEQ ID NO: 7069521 - DNA, 22 bp, Homo sapiens
aacatgtaaccagcattcatct

SEQ ID NO: 7069522 - DNA, 22 bp, Homo sapiens
aacatgtacctacaatcagaat

SEQ ID NO: 7069523 - DNA, 22 bp, Homo sapiens
aatagatactacttagatgtag

SEQ ID NO: 7069524 - DNA, 22 bp, Homo sapiens
aatagatactacttagatgtag

SEQ ID NO: 7069525 - DNA, 22 bp, Homo sapiens
aatagatactacttagatgtag

SEQ ID NO: 7069526 - DNA, 22 bp, Homo sapiens
aacatctaggttctcatcgata

SEQ ID NO: 7069527 - DNA, 22 bp, Homo sapiens
aacatctttttgtttgctgaaa

SEQ ID NO: 7069528 - DNA, 22 bp, Homo sapiens
aacagctagtaccaatccacta

SEQ ID NO: 7069529 - DNA, 22 bp, Homo sapiens
aacagctagtggtctagacttt

SEQ ID NO: 7069530 - DNA, 22 bp, Homo sapiens
aacagcttactcaatggtgatt

SEQ ID NO: 7069531 - DNA, 22 bp, Homo sapiens
aacagcttagaaatgttgctaa

SEQ ID NO: 7069532 - DNA, 22 bp, Homo sapiens
aacagcttcatcacatggcata

SEQ ID NO: 7069533 - DNA, 22 bp, Homo sapiens
aacagcttgagactggatatgc

SEQ ID NO: 7069534 - DNA, 22 bp, Homo sapiens
aacataaatttgaagtggcaaa

SEQ ID NO: 7069535 - DNA, 22 bp, Homo sapiens
aacatatcataggatgtcattg

SEQ ID NO: 7069536 - DNA, 22 bp, Homo sapiens
aacatatttggctgatattccc

SEQ ID NO: 7069537 - DNA, 22 bp, Homo sapiens
aacagaaaaggtaggtggcttt

SEQ ID NO: 7069538 - DNA, 22 bp, Homo sapiens
aacacagggggttacaaattgt

SEQ ID NO: 7069539 - DNA, 22 bp, Homo sapiens
aacactgtatcagtcttcaata

SEQ ID NO: 7069540 - DNA, 22 bp, Homo sapiens
aacactttcttccttgctcagg

SEQ ID NO: 7069541 - DNA, 22 bp, Homo sapiens
aacactttcttccttgctcagg

SEQ ID NO: 7069542 - DNA, 22 bp, Homo sapiens
aacactttggaatagagatagg

SEQ ID NO: 7069543 - DNA, 22 bp, Homo sapiens
aacacagggggttacaaattgt

SEQ ID NO: 7069544 - DNA, 22 bp, Homo sapiens
aacacagacatagtgattacag

SEQ ID NO: 7069545 - DNA, 22 bp, Homo sapiens
aaatttctgttgttttgagcca

SEQ ID NO: 7069546 - DNA, 22 bp, Homo sapiens
aaggctggtcagatgtggtgaa

SEQ ID NO: 7069547 - DNA, 22 bp, Homo sapiens
aaggctggtggattatgaggtc

SEQ ID NO: 7069548 - DNA, 22 bp, Homo sapiens
aaggctggtggattatgaggtc

SEQ ID NO: 7069549 - DNA, 22 bp, Homo sapiens
aaggctggttccatccctggtg

SEQ ID NO: 7069550 - DNA, 22 bp, Homo sapiens
aaggctggttccatccctggtg

SEQ ID NO: 7069551 - DNA, 22 bp, Homo sapiens
aaggctggtttccttgatgttt

SEQ ID NO: 7069552 - DNA, 22 bp, Homo sapiens
aaatttctaagtcaagaagaac

SEQ ID NO: 7069553 - DNA, 22 bp, Homo sapiens
aaatttctggaagtgtcagagt

SEQ ID NO: 7069554 - DNA, 22 bp, Homo sapiens
aaatgtcagaggaacatattga

SEQ ID NO: 7069555 - DNA, 22 bp, Homo sapiens
aaatgtcagaagctttacttct

SEQ ID NO: 7069556 - DNA, 22 bp, Homo sapiens
aaatgtcagaaaacatggagtg

SEQ ID NO: 7069557 - DNA, 22 bp, Homo sapiens
aaatgtcagaaaacatggagtg

SEQ ID NO: 7069558 - DNA, 22 bp, Homo sapiens
aaatgtcagaaaacatggagtg

SEQ ID NO: 7069559 - DNA, 22 bp, Homo sapiens
aaatgtcagaagctttacttct

SEQ ID NO: 7069560 - DNA, 22 bp, Homo sapiens
aaatgtcagaagctttacttct

SEQ ID NO: 7069561 - DNA, 22 bp, Homo sapiens
aaatgtcaaggtgatagatgca

SEQ ID NO: 7069562 - DNA, 22 bp, Homo sapiens
aaatgtcaaggtgatagatgca

SEQ ID NO: 7069563 - DNA, 22 bp, Homo sapiens
aaggaagatatatcaagcttaa

SEQ ID NO: 7069564 - DNA, 22 bp, Homo sapiens
aaggaagagtctagaacaggca

SEQ ID NO: 7069565 - DNA, 22 bp, Homo sapiens
aaatgcatttcactaatgtttc

SEQ ID NO: 7069566 - DNA, 22 bp, Homo sapiens
aaggaaagacaggacggaattc

SEQ ID NO: 7069567 - DNA, 22 bp, Homo sapiens
aaatgcattggtttctacttgt

SEQ ID NO: 7069568 - DNA, 22 bp, Homo sapiens
aaatgcattctgttttcactag

SEQ ID NO: 7069569 - DNA, 22 bp, Homo sapiens
aaatgcattaagtcagaacaat

SEQ ID NO: 7069570 - DNA, 22 bp, Homo sapiens
aaggaagacacagatgaagtga

SEQ ID NO: 7069571 - DNA, 22 bp, Homo sapiens
aaggaagacttgagaaggttcc

SEQ ID NO: 7069572 - DNA, 22 bp, Homo sapiens
aaggaagagaatccttctcaga

SEQ ID NO: 7069573 - DNA, 22 bp, Homo sapiens
aaattattcaaaaagctgtgtt

SEQ ID NO: 7069574 - DNA, 22 bp, Homo sapiens
aaggcagcagtgcacgactgat

SEQ ID NO: 7069575 - DNA, 22 bp, Homo sapiens
aaggcacttaacgtgggaggat

SEQ ID NO: 7069576 - DNA, 22 bp, Homo sapiens
aaggcagatataaagactagag

SEQ ID NO: 7069577 - DNA, 22 bp, Homo sapiens
aaggcagcaactaatggatctc

SEQ ID NO: 7069578 - DNA, 22 bp, Homo sapiens
aaggcagcaagaattccaggtt

SEQ ID NO: 7069579 - DNA, 22 bp, Homo sapiens
aaggcagcacagcaactgctca

SEQ ID NO: 7069580 - DNA, 22 bp, Homo sapiens
aaggctggtcagatgtggtgaa

SEQ ID NO: 7069581 - DNA, 19 bp, Homo sapiens
aaggctggtaccataggtt

SEQ ID NO: 7069582 - DNA, 19 bp, Homo sapiens
aaggctggtaccataggtt

SEQ ID NO: 7069583 - DNA, 19 bp, Homo sapiens
aaggctggtaccataggtt

SEQ ID NO: 7069584 - DNA, 22 bp, Homo sapiens
aaggctgggtttgggatgtgat

SEQ ID NO: 7069585 - DNA, 22 bp, Homo sapiens
aaggctgggtaacctgtccact

SEQ ID NO: 7069586 - DNA, 22 bp, Homo sapiens
aaggctgggtttgggatgtgat

SEQ ID NO: 7069587 - DNA, 22 bp, Homo sapiens
aaggctgagagtcacagtccta

SEQ ID NO: 7069588 - DNA, 22 bp, Homo sapiens
aaggctgagccagggcccctat

SEQ ID NO: 7069589 - DNA, 22 bp, Homo sapiens
aaggctggggtgcagacggcct

SEQ ID NO: 7069590 - DNA, 22 bp, Homo sapiens
aaggctgggtaacctgtccact

SEQ ID NO: 7069591 - DNA, 22 bp, Homo sapiens
aagcagaggtagggtgtgcagt

SEQ ID NO: 7069592 - DNA, 22 bp, Homo sapiens
aagcagagggtatggccaggtt

SEQ ID NO: 7069593 - DNA, 22 bp, Homo sapiens
aagcagaggtagggtgtgcagt

SEQ ID NO: 7069594 - DNA, 22 bp, Homo sapiens
aagcagaggaccgacggaggga

SEQ ID NO: 7069595 - DNA, 22 bp, Homo sapiens
aagcagaggccacagagtgggc

SEQ ID NO: 7069596 - DNA, 22 bp, Homo sapiens
acagcagagacactcaggaggc

SEQ ID NO: 7069597 - DNA, 21 bp, Homo sapiens
acagcagagatcaagactaag

SEQ ID NO: 7069598 - DNA, 22 bp, Homo sapiens
acagcagagcaccagggccact

SEQ ID NO: 7069599 - DNA, 22 bp, Homo sapiens
acagcagagcctagcttaatct

SEQ ID NO: 7069600 - DNA, 22 bp, Homo sapiens
acagcagaggaaaagtctgata

SEQ ID NO: 7069601 - DNA, 22 bp, Homo sapiens
aagcagcttaaattagagcctg

SEQ ID NO: 7069602 - DNA, 22 bp, Homo sapiens
aagcagcttttgaagagtgagg

SEQ ID NO: 7069603 - DNA, 22 bp, Homo sapiens
acagcctggactggctctctgc

SEQ ID NO: 7069604 - DNA, 22 bp, Homo sapiens
aagcacctctatgattgctttt

SEQ ID NO: 7069605 - DNA, 22 bp, Homo sapiens
aagcagaatttaatagaaaggt

SEQ ID NO: 7069606 - DNA, 22 bp, Homo sapiens
aagcagagaaaagcttaggttc

SEQ ID NO: 7069607 - DNA, 22 bp, Homo sapiens
aagcagagaccggctaatggag

SEQ ID NO: 7069608 - DNA, 22 bp, Homo sapiens
aagcagagagcagaattaagtt

SEQ ID NO: 7069609 - DNA, 22 bp, Homo sapiens
aagcagagcaagcgtatttatt

SEQ ID NO: 7069610 - DNA, 22 bp, Homo sapiens
aagcagagcaagcgtatttatt

SEQ ID NO: 7069611 - DNA, 22 bp, Homo sapiens
aagcagagccaccagctttgga

SEQ ID NO: 7069612 - DNA, 22 bp, Homo sapiens
aagcagagccaccagctttgga

SEQ ID NO: 7069613 - DNA, 22 bp, Homo sapiens
aagcagagccaccagctttgga

SEQ ID NO: 7069614 - DNA, 22 bp, Homo sapiens
aagcagagcctgagacagggat

SEQ ID NO: 7069615 - DNA, 22 bp, Homo sapiens
aagcagagcctgagacagggat

SEQ ID NO: 7069616 - DNA, 22 bp, Homo sapiens
aagatgtgtctcatcagggtgt

SEQ ID NO: 7069617 - DNA, 22 bp, Homo sapiens
aagatgcacaatgtggcaatta

SEQ ID NO: 7069618 - DNA, 22 bp, Homo sapiens
aagatgcagcaaactacttttt

SEQ ID NO: 7069619 - DNA, 22 bp, Homo sapiens
aagatgcagctttacaataagg

SEQ ID NO: 7069620 - DNA, 22 bp, Homo sapiens
aagatgcatgctgaagctggct

SEQ ID NO: 7069621 - DNA, 22 bp, Homo sapiens
aagatgatagatctgtcaatgt

SEQ ID NO: 7069622 - DNA, 22 bp, Homo sapiens
aagatgataggacttgcttaag

SEQ ID NO: 7069623 - DNA, 22 bp, Homo sapiens
aagatgatgttgtgttttcact

SEQ ID NO: 7069624 - DNA, 22 bp, Homo sapiens
aagatgcttgcaaatttctgaa

SEQ ID NO: 7069625 - DNA, 22 bp, Homo sapiens
aagatgtatcagttaagtcttc

SEQ ID NO: 7069626 - DNA, 23 bp, Homo sapiens
aagatgtatttttaccaaatgtc

SEQ ID NO: 7069627 - DNA, 22 bp, Homo sapiens
acacatttattacatgcatgtg

SEQ ID NO: 7069628 - DNA, 22 bp, Homo sapiens
acacatttagcaccaggtttat

SEQ ID NO: 7069629 - DNA, 22 bp, Homo sapiens
acacatttctaaatttttaccg

SEQ ID NO: 7069630 - DNA, 22 bp, Homo sapiens
acacatttctaaatttttaccg

SEQ ID NO: 7069631 - DNA, 22 bp, Homo sapiens
acacatttacatgtttacgtat

SEQ ID NO: 7069632 - DNA, 22 bp, Homo sapiens
acacattctttaaatgtctgtt

SEQ ID NO: 7069633 - DNA, 22 bp, Homo sapiens
acacattcatgagtgcatgcac

SEQ ID NO: 7069634 - DNA, 22 bp, Homo sapiens
acacattcctgcagacatgatg

SEQ ID NO: 7069635 - DNA, 22 bp, Homo sapiens
aagagcaggctgctgtggagta

SEQ ID NO: 7069636 - DNA, 22 bp, Homo sapiens
acacatatatacatatttgtgc

SEQ ID NO: 7069637 - DNA, 22 bp, Homo sapiens
acacatatatacatatttgtgc

SEQ ID NO: 7069638 - DNA, 22 bp, Homo sapiens
acacatgaaagacattaaggtg

SEQ ID NO: 7069639 - DNA, 22 bp, Homo sapiens
acacatgaatcactggtggaag

SEQ ID NO: 7069640 - DNA, 22 bp, Homo sapiens
acacatgagaaacatcagttgt

SEQ ID NO: 7069641 - DNA, 22 bp, Homo sapiens
acacatgataagaaagtttaaa

SEQ ID NO: 7069642 - DNA, 22 bp, Homo sapiens
aatttcactggaaaagataatt

SEQ ID NO: 7069643 - DNA, 22 bp, Homo sapiens
aatttcactgtggagcacattt

SEQ ID NO: 7069644 - DNA, 22 bp, Homo sapiens
aagaaatgtgaatattgaatag

SEQ ID NO: 7069645 - DNA, 22 bp, Homo sapiens
aagaacaactgctttaaaagca

SEQ ID NO: 7069646 - DNA, 22 bp, Homo sapiens
aagaacaactgctttaaaagca

SEQ ID NO: 7069647 - DNA, 22 bp, Homo sapiens
aagaacaactgctttaaaagca

SEQ ID NO: 7069648 - DNA, 22 bp, Homo sapiens
aattctacattggttcacattt

SEQ ID NO: 7069649 - DNA, 22 bp, Homo sapiens
aattctataggcaagctatttt

SEQ ID NO: 7069650 - DNA, 22 bp, Homo sapiens
aattctgaaagattccttattc

SEQ ID NO: 7069651 - DNA, 20 bp, Homo sapiens
aagaaacttgaaagtacaag

SEQ ID NO: 7069652 - DNA, 22 bp, Homo sapiens
aactttctgtctgagctgcaga

SEQ ID NO: 7069653 - DNA, 22 bp, Homo sapiens
aatgggaaagagactagatgct

SEQ ID NO: 7069654 - DNA, 22 bp, Homo sapiens
aatgggaagccagaagacaagg

SEQ ID NO: 7069655 - DNA, 22 bp, Homo sapiens
aactgcttgtaaataatgttga

SEQ ID NO: 7069656 - DNA, 17 bp, Homo sapiens
aactgctttttttagcc

SEQ ID NO: 7069657 - DNA, 22 bp, Homo sapiens
aagaaaagaaacctgaggcttt

SEQ ID NO: 7069658 - DNA, 22 bp, Homo sapiens
aagaaaagaaacctgaggcttt

SEQ ID NO: 7069659 - DNA, 22 bp, Homo sapiens
aagaaactgttgcgtgacagcg

SEQ ID NO: 7069660 - DNA, 20 bp, Homo sapiens
aattttatctccatcctttg

SEQ ID NO: 7069661 - DNA, 22 bp, Homo sapiens
aagactttccctcatcagaacg

SEQ ID NO: 7069662 - DNA, 22 bp, Homo sapiens
aagactttctcccaaatcctca

SEQ ID NO: 7069663 - DNA, 22 bp, Homo sapiens
aattttaatcagtggtgctgag

SEQ ID NO: 7069664 - DNA, 22 bp, Homo sapiens
aattttaatcagtggtgctgag

SEQ ID NO: 7069665 - DNA, 22 bp, Homo sapiens
aattttacaaaatacctccgat

SEQ ID NO: 7069666 - DNA, 22 bp, Homo sapiens
aattttaagcatatgactggtt

SEQ ID NO: 7069667 - DNA, 22 bp, Homo sapiens
aattttaagcatatgactggtt

SEQ ID NO: 7069668 - DNA, 22 bp, Homo sapiens
aatttcagatgtcataaatata

SEQ ID NO: 7069669 - DNA, 22 bp, Homo sapiens
aagagacatgaatactcgaagg

SEQ ID NO: 7069670 - DNA, 21 bp, Homo sapiens
aagagacatttctcatcagca

SEQ ID NO: 7069671 - DNA, 22 bp, Homo sapiens
aagagactggaaactagggtca

SEQ ID NO: 7069672 - DNA, 22 bp, Homo sapiens
aagagaatacaagcaggcagga

SEQ ID NO: 7069673 - DNA, 22 bp, Homo sapiens
aagagcaacttggaaacactca

SEQ ID NO: 7069674 - DNA, 22 bp, Homo sapiens
aagagcagcctccaggggtgga

SEQ ID NO: 7069675 - DNA, 22 bp, Homo sapiens
acaagcataagtgagatgaata

SEQ ID NO: 7069676 - DNA, 22 bp, Homo sapiens
acaagcatcaggttcagcaata

SEQ ID NO: 7069677 - DNA, 22 bp, Homo sapiens
acaagcatgtggtaaaaagacc

SEQ ID NO: 7069678 - DNA, 22 bp, Homo sapiens
acaatagacaaagtgaatggct

SEQ ID NO: 7069679 - DNA, 22 bp, Homo sapiens
acaatcattccgttcacaacag

SEQ ID NO: 7069680 - DNA, 22 bp, Homo sapiens
acaatgaaaaaatttactgtgg

SEQ ID NO: 7069681 - DNA, 22 bp, Homo sapiens
acaatgaacgctttttaactgt

SEQ ID NO: 7069682 - DNA, 22 bp, Homo sapiens
acaatgaagataatgttgcagt

SEQ ID NO: 7069683 - DNA, 19 bp, Homo sapiens
acaatgaatgtgttctctt

SEQ ID NO: 7069684 - DNA, 22 bp, Homo sapiens
acaagaattatttctagttaac

SEQ ID NO: 7069685 - DNA, 22 bp, Homo sapiens
acaagagacaagaggttcttct

SEQ ID NO: 7069686 - DNA, 22 bp, Homo sapiens
acaagagattatctacagatga

SEQ ID NO: 7069687 - DNA, 22 bp, Homo sapiens
agataacttttgggtattcatg

SEQ ID NO: 7069688 - DNA, 22 bp, Homo sapiens
agaggggttaagtgctagtccg

SEQ ID NO: 7069689 - DNA, 22 bp, Homo sapiens
acaacaatctaccctagcttct

SEQ ID NO: 7069690 - DNA, 22 bp, Homo sapiens
acaacacatgtgtatatgtgtg

SEQ ID NO: 7069691 - DNA, 22 bp, Homo sapiens
agagggggaaaatagaggtgtt

SEQ ID NO: 7069692 - DNA, 22 bp, Homo sapiens
agagggggtgtcagcactgcag

SEQ ID NO: 7069693 - DNA, 22 bp, Homo sapiens
agagggggtgttccagaagcat

SEQ ID NO: 7069694 - DNA, 22 bp, Homo sapiens
acaaaggtgagcagaagacaca

SEQ ID NO: 7069695 - DNA, 18 bp, Homo sapiens
acaaaggtctgcaagacc

SEQ ID NO: 7069696 - DNA, 19 bp, Homo sapiens
acaaagctgtgagcagctt

SEQ ID NO: 7069697 - DNA, 20 bp, Homo sapiens
agaggcttccttgggaggag

SEQ ID NO: 7069698 - DNA, 22 bp, Homo sapiens
agaggctgagaaaccctcttct

SEQ ID NO: 7069699 - DNA, 22 bp, Homo sapiens
agaggctgatggagtagtgtct

SEQ ID NO: 7069700 - DNA, 22 bp, Homo sapiens
agaggctgtgcagagggagtgc

SEQ ID NO: 7069701 - DNA, 22 bp, Homo sapiens
agaggctgtgcccaccaggcaa

SEQ ID NO: 7069702 - DNA, 22 bp, Homo sapiens
agaggctgtgcccaccaggcaa

SEQ ID NO: 7069703 - DNA, 22 bp, Homo sapiens
agaggctgttacactcccagat

SEQ ID NO: 7069704 - DNA, 22 bp, Homo sapiens
agaggctgttacactcccagat

SEQ ID NO: 7069705 - DNA, 22 bp, Homo sapiens
agaggctctttgagctgggaga

SEQ ID NO: 7069706 - DNA, 22 bp, Homo sapiens
agaggctgaatgatgtcatcat

SEQ ID NO: 7069707 - DNA, 22 bp, Homo sapiens
agaggctgaatgatgtcatcat

SEQ ID NO: 7069708 - DNA, 22 bp, Homo sapiens
agaggctgagaaaccctcttct

SEQ ID NO: 7069709 - DNA, 22 bp, Homo sapiens
aattgctagactatactgtaat

SEQ ID NO: 7069710 - DNA, 22 bp, Homo sapiens
aattgctaaagattatgttttc

SEQ ID NO: 7069711 - DNA, 22 bp, Homo sapiens
aattgcaacaggtagacttttc

SEQ ID NO: 7069712 - DNA, 22 bp, Homo sapiens
aattgcaattttcttaaggtct

SEQ ID NO: 7069713 - DNA, 22 bp, Homo sapiens
aattcttaatcccataaagtga

SEQ ID NO: 7069714 - DNA, 22 bp, Homo sapiens
aattcttaatcccataaagtga

SEQ ID NO: 7069715 - DNA, 22 bp, Homo sapiens
aatgtaaaatatcttgtacttg

SEQ ID NO: 7069716 - DNA, 18 bp, Homo sapiens
aatgtgaatatttacttc

SEQ ID NO: 7069717 - DNA, 22 bp, Homo sapiens
aatgtgactgaatatttactct

SEQ ID NO: 7069718 - DNA, 22 bp, Homo sapiens
aatgggaagtcactactgttac

SEQ ID NO: 7069719 - DNA, 22 bp, Homo sapiens
aatggcagaggcaaagatggta

SEQ ID NO: 7069720 - DNA, 22 bp, Homo sapiens
aatggcagaatgggccagaagc

SEQ ID NO: 7069721 - DNA, 22 bp, Homo sapiens
aatggcagtagttgcatgagag

SEQ ID NO: 7069722 - DNA, 22 bp, Homo sapiens
aatggagacttcaaaatggatt

SEQ ID NO: 7069723 - DNA, 20 bp, Homo sapiens
agacaatgagtgacagagtt

SEQ ID NO: 7069724 - DNA, 22 bp, Homo sapiens
agacaatggagagcagagtact

SEQ ID NO: 7069725 - DNA, 22 bp, Homo sapiens
agaagcagctttcaaggtgatt

SEQ ID NO: 7069726 - DNA, 22 bp, Homo sapiens
aatgtgtacatgacagatagaa

SEQ ID NO: 7069727 - DNA, 22 bp, Homo sapiens
agaccctgcattttccagggtt

SEQ ID NO: 7069728 - DNA, 22 bp, Homo sapiens
agaccctgcattttccagggtt

SEQ ID NO: 7069729 - DNA, 22 bp, Homo sapiens
agaccctgcattttccagggtt

SEQ ID NO: 7069730 - DNA, 22 bp, Homo sapiens
agaccctggggaaagtcacttc

SEQ ID NO: 7069731 - DNA, 22 bp, Homo sapiens
agaccctggggaaagtcacttc

SEQ ID NO: 7069732 - DNA, 22 bp, Homo sapiens
aattaaaaaaggagagcttgct

SEQ ID NO: 7069733 - DNA, 22 bp, Homo sapiens
agaccctggtaaacactccagg

SEQ ID NO: 7069734 - DNA, 22 bp, Homo sapiens
agacccttgcagtctggttgtc

SEQ ID NO: 7069735 - DNA, 22 bp, Homo sapiens
aattaaaagataacccatgagt

SEQ ID NO: 7069736 - DNA, 22 bp, Homo sapiens
agagacagatctgagggacctc

SEQ ID NO: 7069737 - DNA, 22 bp, Homo sapiens
agagacagatctgagggacctc

SEQ ID NO: 7069738 - DNA, 22 bp, Homo sapiens
agagacagatctgagggacctc

SEQ ID NO: 7069739 - DNA, 18 bp, Homo sapiens
agagacagcagcaaaaga

SEQ ID NO: 7069740 - DNA, 18 bp, Homo sapiens
agagacagcagcaaaaga

SEQ ID NO: 7069741 - DNA, 22 bp, Homo sapiens
agagacaggaatggcattaaga

SEQ ID NO: 7069742 - DNA, 22 bp, Homo sapiens
agagacaggaatggcattaaga

SEQ ID NO: 7069743 - DNA, 22 bp, Homo sapiens
agagacaggagttctgtttcca

SEQ ID NO: 7069744 - DNA, 22 bp, Homo sapiens
agagacaggatatctgctcatg

SEQ ID NO: 7069745 - DNA, 22 bp, Homo sapiens
agagccagttacaactgtggag

SEQ ID NO: 7069746 - DNA, 22 bp, Homo sapiens
agagccagttacaactgtggag

SEQ ID NO: 7069747 - DNA, 22 bp, Homo sapiens
agagccagttacaactgtggag

SEQ ID NO: 7069748 - DNA, 22 bp, Homo sapiens
agagccaggctcccatggggca

SEQ ID NO: 7069749 - DNA, 22 bp, Homo sapiens
agagccaggctctacctgggtt

SEQ ID NO: 7069750 - DNA, 22 bp, Homo sapiens
agagacaggatatctgctcatg

SEQ ID NO: 7069751 - DNA, 22 bp, Homo sapiens
agagacaggatatctgctcatg

SEQ ID NO: 7069752 - DNA, 22 bp, Homo sapiens
agagacagggttttgccatgtt

SEQ ID NO: 7069753 - DNA, 22 bp, Homo sapiens
agagacagggttttgccatgtt

SEQ ID NO: 7069754 - DNA, 22 bp, Homo sapiens
agagacagggttttgccatgtt

SEQ ID NO: 7069755 - DNA, 22 bp, Homo sapiens
agagccaggcggctgggcacct

SEQ ID NO: 7069756 - DNA, 22 bp, Homo sapiens
aattccatccatttgtttcaac

SEQ ID NO: 7069757 - DNA, 22 bp, Homo sapiens
agagcctggcaaaaggtcctgc

SEQ ID NO: 7069758 - DNA, 22 bp, Homo sapiens
aattccagggggtaccattcat

SEQ ID NO: 7069759 - DNA, 22 bp, Homo sapiens
agagccagttgttaagcactta

SEQ ID NO: 7069760 - DNA, 22 bp, Homo sapiens
agagccagttacaactgtggag

SEQ ID NO: 7069761 - DNA, 22 bp, Homo sapiens
agagcctgcatctagcctcaga

SEQ ID NO: 7069762 - DNA, 22 bp, Homo sapiens
agagcctgctgtgtaagtcaca

SEQ ID NO: 7069763 - DNA, 22 bp, Homo sapiens
agagcctggacctgagctacaa

SEQ ID NO: 7069764 - DNA, 22 bp, Homo sapiens
agagcctggacctgagctacaa

SEQ ID NO: 7069765 - DNA, 22 bp, Homo sapiens
agagcctggacctgggctctga

SEQ ID NO: 7069766 - DNA, 22 bp, Homo sapiens
acacagagtttgacacatggga

SEQ ID NO: 7069767 - DNA, 22 bp, Homo sapiens
acacagagtttgacacatggga

SEQ ID NO: 7069768 - DNA, 22 bp, Homo sapiens
acacagagttattatgtgaact

SEQ ID NO: 7069769 - DNA, 22 bp, Homo sapiens
acacagagtccttactgaggta

SEQ ID NO: 7069770 - DNA, 22 bp, Homo sapiens
acacagaggcatgacagtggct

SEQ ID NO: 7069771 - DNA, 22 bp, Homo sapiens
acacagagcttctcaactggga

SEQ ID NO: 7069772 - DNA, 22 bp, Homo sapiens
agcagctgagccccagctgtga

SEQ ID NO: 7069773 - DNA, 22 bp, Homo sapiens
agcagctggggcctgtgacgat

SEQ ID NO: 7069774 - DNA, 17 bp, Homo sapiens
agcagctgggttgatct

SEQ ID NO: 7069775 - DNA, 23 bp, Homo sapiens
agcagcaaaaatttatctttctg

SEQ ID NO: 7069776 - DNA, 22 bp, Homo sapiens
agcagatgtgtctctgcactgt

SEQ ID NO: 7069777 - DNA, 22 bp, Homo sapiens
agcagagcctgggctaggggtg

SEQ ID NO: 7069778 - DNA, 22 bp, Homo sapiens
agcagagcctgggctaggggtg

SEQ ID NO: 7069779 - DNA, 22 bp, Homo sapiens
agcagagtgtgaaggcagggct

SEQ ID NO: 7069780 - DNA, 22 bp, Homo sapiens
agcagataggacatttcattct

SEQ ID NO: 7069781 - DNA, 22 bp, Homo sapiens
agcagatatgatacttaattta

SEQ ID NO: 7069782 - DNA, 22 bp, Homo sapiens
agcagatgagcctcatgactgg

SEQ ID NO: 7069783 - DNA, 22 bp, Homo sapiens
acaatgcacctattttaaaact

SEQ ID NO: 7069784 - DNA, 22 bp, Homo sapiens
acaatgctcatatttatgccaa

SEQ ID NO: 7069785 - DNA, 22 bp, Homo sapiens
agcagagaggaggtggccctgt

SEQ ID NO: 7069786 - DNA, 18 bp, Homo sapiens
agcagagagtgaatggga

SEQ ID NO: 7069787 - DNA, 19 bp, Homo sapiens
agcagagcaaagtggctga

SEQ ID NO: 7069788 - DNA, 22 bp, Homo sapiens
agcagagcatggtgggaagggc

SEQ ID NO: 7069789 - DNA, 22 bp, Homo sapiens
acacatgtatgttttgtatttg

SEQ ID NO: 7069790 - DNA, 22 bp, Homo sapiens
acacatgtgattctaagacagc

SEQ ID NO: 7069791 - DNA, 19 bp, Homo sapiens
acacatgtaacagtttttc

SEQ ID NO: 7069792 - DNA, 22 bp, Homo sapiens
acacatgtgtctgcatgcagtg

SEQ ID NO: 7069793 - DNA, 22 bp, Homo sapiens
agcagctgtactttcatctgtt

SEQ ID NO: 7069794 - DNA, 22 bp, Homo sapiens
acacagggcggaaagcatgaga

SEQ ID NO: 7069795 - DNA, 22 bp, Homo sapiens
acactgaagagcactttcaaag

SEQ ID NO: 7069796 - DNA, 22 bp, Homo sapiens
acactgaatatacaatgaatat

SEQ ID NO: 7069797 - DNA, 22 bp, Homo sapiens
acactgaatatacaatgaatat

SEQ ID NO: 7069798 - DNA, 22 bp, Homo sapiens
acactttagaaaaaagaatggt

SEQ ID NO: 7069799 - DNA, 22 bp, Homo sapiens
acactttagaaaaaagaatggt

SEQ ID NO: 7069800 - DNA, 22 bp, Homo sapiens
acactttagaaaaaagaatggt

SEQ ID NO: 7069801 - DNA, 22 bp, Homo sapiens
acactttagatattcccttctg

SEQ ID NO: 7069802 - DNA, 22 bp, Homo sapiens
acacttcagcagtatgcttggg

SEQ ID NO: 7069803 - DNA, 22 bp, Homo sapiens
acactttactcttacaccattg

SEQ ID NO: 7069804 - DNA, 22 bp, Homo sapiens
acacttcacccctgctcccagt

SEQ ID NO: 7069805 - DNA, 19 bp, Homo sapiens
acactgaatgtagaattgg

SEQ ID NO: 7069806 - DNA, 22 bp, Homo sapiens
acactgaatgtttaagaacttg

SEQ ID NO: 7069807 - DNA, 22 bp, Homo sapiens
acactgaatgtttaagaacttg

SEQ ID NO: 7069808 - DNA, 22 bp, Homo sapiens
acactgaatgtttaagaacttg

SEQ ID NO: 7069809 - DNA, 22 bp, Homo sapiens
acagactgttggcctactgagc

SEQ ID NO: 7069810 - DNA, 22 bp, Homo sapiens
acagagaaagtgggctgaagat

SEQ ID NO: 7069811 - DNA, 22 bp, Homo sapiens
agccagggtaaggtacttagta

SEQ ID NO: 7069812 - DNA, 19 bp, Homo sapiens
agccagggtgagaaggagc

SEQ ID NO: 7069813 - DNA, 22 bp, Homo sapiens
acagagactgggagcaagaggc

SEQ ID NO: 7069814 - DNA, 22 bp, Homo sapiens
acagaaagaaggtgtatttgag

SEQ ID NO: 7069815 - DNA, 22 bp, Homo sapiens
acagaaagaccttgtaacactt

SEQ ID NO: 7069816 - DNA, 22 bp, Homo sapiens
acactttatcaatattcaaaaa

SEQ ID NO: 7069817 - DNA, 22 bp, Homo sapiens
acactttatctcatctcagaca

SEQ ID NO: 7069818 - DNA, 22 bp, Homo sapiens
acactttgatagataatgcagg

SEQ ID NO: 7069819 - DNA, 20 bp, Homo sapiens
acagaaagagagaatgtcag

SEQ ID NO: 7069820 - DNA, 22 bp, Homo sapiens
acagacaagtagttcagacaag

SEQ ID NO: 7069821 - DNA, 22 bp, Homo sapiens
acagacacaggcgtggagtcgc

SEQ ID NO: 7069822 - DNA, 22 bp, Homo sapiens
acagatgatgtgcacagataga

SEQ ID NO: 7069823 - DNA, 22 bp, Homo sapiens
acagatgatttttatgaaaaca

SEQ ID NO: 7069824 - DNA, 22 bp, Homo sapiens
acagatgatttttatgaaaaca

SEQ ID NO: 7069825 - DNA, 20 bp, Homo sapiens
acagatatttgattttcagt

SEQ ID NO: 7069826 - DNA, 22 bp, Homo sapiens
agcctctgatgatcacaggggg

SEQ ID NO: 7069827 - DNA, 22 bp, Homo sapiens
agcctctgactgtcagcaaggt

SEQ ID NO: 7069828 - DNA, 22 bp, Homo sapiens
agcctctctttctggtggctaa

SEQ ID NO: 7069829 - DNA, 22 bp, Homo sapiens
acagagcatttgggacagagag

SEQ ID NO: 7069830 - DNA, 22 bp, Homo sapiens
acagagccactttggtgcctac

SEQ ID NO: 7069831 - DNA, 22 bp, Homo sapiens
agcctcctgtagccctcaccca

SEQ ID NO: 7069832 - DNA, 22 bp, Homo sapiens
agcctcctgtagccctcaccca

SEQ ID NO: 7069833 - DNA, 20 bp, Homo sapiens
agccctgtttcctggagaga

SEQ ID NO: 7069834 - DNA, 22 bp, Homo sapiens
agcctcctgtagccctcaccca

SEQ ID NO: 7069835 - DNA, 22 bp, Homo sapiens
acagatgttagcaatgatgatg

SEQ ID NO: 7069836 - DNA, 22 bp, Homo sapiens
acagatgtacactcatatataa

SEQ ID NO: 7069837 - DNA, 19 bp, Homo sapiens
agctcctgattgtgcctcg

SEQ ID NO: 7069838 - DNA, 22 bp, Homo sapiens
agctcctgcgcacggtgcacac

SEQ ID NO: 7069839 - DNA, 22 bp, Homo sapiens
agctcctgcagactcctgctca

SEQ ID NO: 7069840 - DNA, 22 bp, Homo sapiens
acagcacaatctgagtcccaga

SEQ ID NO: 7069841 - DNA, 22 bp, Homo sapiens
acagcctggcctgagttaaggc

SEQ ID NO: 7069842 - DNA, 21 bp, Homo sapiens
acagcctgtcatctcatggtc

SEQ ID NO: 7069843 - DNA, 22 bp, Homo sapiens
acagcctgtttgatctggtgct

SEQ ID NO: 7069844 - DNA, 22 bp, Homo sapiens
aagctatacaatgcacaaatga

SEQ ID NO: 7069845 - DNA, 22 bp, Homo sapiens
aagccctgggatgttcagcagt

SEQ ID NO: 7069846 - DNA, 17 bp, Homo sapiens
acagggcagaaacagct

SEQ ID NO: 7069847 - DNA, 22 bp, Homo sapiens
aagctctggggtacacatctgc

SEQ ID NO: 7069848 - DNA, 22 bp, Homo sapiens
acagggcagagaggcaggcttg

SEQ ID NO: 7069849 - DNA, 22 bp, Homo sapiens
acagggcagagaggcaggcttg

SEQ ID NO: 7069850 - DNA, 22 bp, Homo sapiens
acagggcagcaactttgtgcct

SEQ ID NO: 7069851 - DNA, 19 bp, Homo sapiens
acagggcagcaataggata

SEQ ID NO: 7069852 - DNA, 22 bp, Homo sapiens
aagctgcctgccacgctagata

SEQ ID NO: 7069853 - DNA, 22 bp, Homo sapiens
aagctgccttccatgtgaggaa

SEQ ID NO: 7069854 - DNA, 23 bp, Homo sapiens
aagctgccttcgcagttggtctg

SEQ ID NO: 7069855 - DNA, 22 bp, Homo sapiens
aagctgctggtgactgggctga

SEQ ID NO: 7069856 - DNA, 22 bp, Homo sapiens
aagctggaacatcttgaggaag

SEQ ID NO: 7069857 - DNA, 22 bp, Homo sapiens
aaggagagtacaggagttggta

SEQ ID NO: 7069858 - DNA, 22 bp, Homo sapiens
aaggagctatgcataactgatc

SEQ ID NO: 7069859 - DNA, 17 bp, Homo sapiens
aaggagctgagagatgg

SEQ ID NO: 7069860 - DNA, 22 bp, Homo sapiens
aagctggagagttaggtgaata

SEQ ID NO: 7069861 - DNA, 22 bp, Homo sapiens
aagctggagagtttcacagatg

SEQ ID NO: 7069862 - DNA, 22 bp, Homo sapiens
aaggacaggctaacctgacatt

SEQ ID NO: 7069863 - DNA, 22 bp, Homo sapiens
aaggacaggctaacctgacatt

SEQ ID NO: 7069864 - DNA, 22 bp, Homo sapiens
aaggagacatttgcagagcacc

SEQ ID NO: 7069865 - DNA, 22 bp, Homo sapiens
acagtcttgctgtatggtcagg

SEQ ID NO: 7069866 - DNA, 22 bp, Homo sapiens
acagtcttgagcatcagccaga

SEQ ID NO: 7069867 - DNA, 22 bp, Homo sapiens
acagtctgtcccccaggtgcta

SEQ ID NO: 7069868 - DNA, 22 bp, Homo sapiens
acatagaacctggcacatagta

SEQ ID NO: 7069869 - DNA, 22 bp, Homo sapiens
aaggaggacacccaggactggg

SEQ ID NO: 7069870 - DNA, 22 bp, Homo sapiens
aaggcagagattagcagaatga

SEQ ID NO: 7069871 - DNA, 22 bp, Homo sapiens
acatatgtgttgtacatgcatg

SEQ ID NO: 7069872 - DNA, 22 bp, Homo sapiens
aaggcagagggctggatcagag

SEQ ID NO: 7069873 - DNA, 22 bp, Homo sapiens
acatatgctcatctgcattccc

SEQ ID NO: 7069874 - DNA, 22 bp, Homo sapiens
acatatgtatatgtacacagtc

SEQ ID NO: 7069875 - DNA, 22 bp, Homo sapiens
acatatgatattgaggatctca

SEQ ID NO: 7069876 - DNA, 22 bp, Homo sapiens
acatatgatattgaggatctca

SEQ ID NO: 7069877 - DNA, 22 bp, Homo sapiens
acatatgcgatcataggatgca

SEQ ID NO: 7069878 - DNA, 22 bp, Homo sapiens
acatatgtgcttatatccatga

SEQ ID NO: 7069879 - DNA, 19 bp, Homo sapiens
acatatgtggatatacatg

SEQ ID NO: 7069880 - DNA, 22 bp, Homo sapiens
acatatgtctatttcatgtaaa

SEQ ID NO: 7069881 - DNA, 22 bp, Homo sapiens
acatatgtgtctgcacatgccc

SEQ ID NO: 7069882 - DNA, 22 bp, Homo sapiens
acccagagtcatgtttattccc

SEQ ID NO: 7069883 - DNA, 22 bp, Homo sapiens
acccaggaggtggaggctgcag

SEQ ID NO: 7069884 - DNA, 22 bp, Homo sapiens
accctgccgtgggctgcttgtg

SEQ ID NO: 7069885 - DNA, 22 bp, Homo sapiens
accctgccgtgggctgcttgtg

SEQ ID NO: 7069886 - DNA, 22 bp, Homo sapiens
accgggaagtcctgcactgggc

SEQ ID NO: 7069887 - DNA, 21 bp, Homo sapiens
acattttctgttttaggaagt

SEQ ID NO: 7069888 - DNA, 21 bp, Homo sapiens
acattttctgttttaggaagt

SEQ ID NO: 7069889 - DNA, 22 bp, Homo sapiens
accaggcttaatcctttgctat

SEQ ID NO: 7069890 - DNA, 22 bp, Homo sapiens
accaggcttgataccaagaaat

SEQ ID NO: 7069891 - DNA, 22 bp, Homo sapiens
accaggcttgatgatttgctta

SEQ ID NO: 7069892 - DNA, 22 bp, Homo sapiens
accaggcttgatgatttgctta

SEQ ID NO: 7069893 - DNA, 21 bp, Homo sapiens
accaggcttgtgggagggagc

SEQ ID NO: 7069894 - DNA, 21 bp, Homo sapiens
accaggcttgtgggagggagc

SEQ ID NO: 7069895 - DNA, 21 bp, Homo sapiens
accaggcttgtgggagggagc

SEQ ID NO: 7069896 - DNA, 22 bp, Homo sapiens
accagggcaaatgtttgtactc

SEQ ID NO: 7069897 - DNA, 22 bp, Homo sapiens
accagggcacaggagtctgaag

SEQ ID NO: 7069898 - DNA, 22 bp, Homo sapiens
accagggcacaggagtctgaag

SEQ ID NO: 7069899 - DNA, 22 bp, Homo sapiens
aagggctgggtctggttaaccc

SEQ ID NO: 7069900 - DNA, 22 bp, Homo sapiens
aagggctggtctagaaagggag

SEQ ID NO: 7069901 - DNA, 22 bp, Homo sapiens
aagggctgtaagccaagtaaag

SEQ ID NO: 7069902 - DNA, 22 bp, Homo sapiens
aagggctgtaagccaagtaaag

SEQ ID NO: 7069903 - DNA, 22 bp, Homo sapiens
aagggctgtagacaagattgct

SEQ ID NO: 7069904 - DNA, 22 bp, Homo sapiens
aagggctgtagtttgttgatca

SEQ ID NO: 7069905 - DNA, 22 bp, Homo sapiens
aagggctgttatgtttttatac

SEQ ID NO: 7069906 - DNA, 22 bp, Homo sapiens
aaggggaaaaagtgttaggagt

SEQ ID NO: 7069907 - DNA, 19 bp, Homo sapiens
acccagagccctttgcagg

SEQ ID NO: 7069908 - DNA, 22 bp, Homo sapiens
acccagagctgggcttggcaaa

SEQ ID NO: 7069909 - DNA, 22 bp, Homo sapiens
aaggctctctgatggcagcagt

SEQ ID NO: 7069910 - DNA, 22 bp, Homo sapiens
aaggcctgctcagctgtctgtg

SEQ ID NO: 7069911 - DNA, 20 bp, Homo sapiens
aaggcagagtgggttggagc

SEQ ID NO: 7069912 - DNA, 22 bp, Homo sapiens
acatttaaatacctatgtttct

SEQ ID NO: 7069913 - DNA, 19 bp, Homo sapiens
acatttaaattcagatctc

SEQ ID NO: 7069914 - DNA, 22 bp, Homo sapiens
aaggctggacctggatgaatct

SEQ ID NO: 7069915 - DNA, 22 bp, Homo sapiens
aaggctggacctggatgaatct

SEQ ID NO: 7069916 - DNA, 22 bp, Homo sapiens
aaggctggacctggatgaatct

SEQ ID NO: 7069917 - DNA, 19 bp, Homo sapiens
aaggctggagaaggcctct

SEQ ID NO: 7069918 - DNA, 19 bp, Homo sapiens
aaggctggagaaggcctct

SEQ ID NO: 7069919 - DNA, 19 bp, Homo sapiens
aaggctggagaaggcctct

SEQ ID NO: 7069920 - DNA, 21 bp, Homo sapiens
aaggctggagatgcaggtctg

SEQ ID NO: 7069921 - DNA, 21 bp, Homo sapiens
aaggctggagatgcaggtctg

SEQ ID NO: 7069922 - DNA, 21 bp, Homo sapiens
aaggctggagatgcaggtctg

SEQ ID NO: 7069923 - DNA, 22 bp, Homo sapiens
aaggctggagatggttggaatg

SEQ ID NO: 7069924 - DNA, 22 bp, Homo sapiens
aaggctggagatggttggaatg

SEQ ID NO: 7069925 - DNA, 22 bp, Homo sapiens
aaggctgggaaacatgcaggcc

SEQ ID NO: 7069926 - DNA, 22 bp, Homo sapiens
aaggctgggaaacatgcaggcc

SEQ ID NO: 7069927 - DNA, 22 bp, Homo sapiens
aaggctggcaatatatttgtta

SEQ ID NO: 7069928 - DNA, 22 bp, Homo sapiens
aaggctggcaatatatttgtta

SEQ ID NO: 7069929 - DNA, 22 bp, Homo sapiens
aaggctgggaaacatgcaggcc

SEQ ID NO: 7069930 - DNA, 22 bp, Homo sapiens
acatttctggagtttctcaaca

SEQ ID NO: 7069931 - DNA, 22 bp, Homo sapiens
actggactcacgtattcctgag

SEQ ID NO: 7069932 - DNA, 18 bp, Homo sapiens
actggagcattagcagct

SEQ ID NO: 7069933 - DNA, 22 bp, Homo sapiens
aatacagaggaaacatttaata

SEQ ID NO: 7069934 - DNA, 22 bp, Homo sapiens
aatacatgttttctactattct

SEQ ID NO: 7069935 - DNA, 20 bp, Homo sapiens
actgaggttagataacaggt

SEQ ID NO: 7069936 - DNA, 21 bp, Homo sapiens
actgaggttagatgccttgcc

SEQ ID NO: 7069937 - DNA, 22 bp, Homo sapiens
actgaggttattgcaataaaat

SEQ ID NO: 7069938 - DNA, 22 bp, Homo sapiens
actgaggttgaaatagtgatgt

SEQ ID NO: 7069939 - DNA, 22 bp, Homo sapiens
actgaggttgtagtaggaattc

SEQ ID NO: 7069940 - DNA, 22 bp, Homo sapiens
actgaggtttacttgaaggaga

SEQ ID NO: 7069941 - DNA, 22 bp, Homo sapiens
actgaggtttcattttatcgct

SEQ ID NO: 7069942 - DNA, 22 bp, Homo sapiens
actgaggtttttagtgttaaat

SEQ ID NO: 7069943 - DNA, 22 bp, Homo sapiens
actgagagaacgggctgctccc

SEQ ID NO: 7069944 - DNA, 22 bp, Homo sapiens
actgaggtagggcacacctagg

SEQ ID NO: 7069945 - DNA, 22 bp, Homo sapiens
actgaggtataattgacataac

SEQ ID NO: 7069946 - DNA, 22 bp, Homo sapiens
actgaggtcaggggtatgtgat

SEQ ID NO: 7069947 - DNA, 22 bp, Homo sapiens
actgaggtcatgcatagtttct

SEQ ID NO: 7069948 - DNA, 22 bp, Homo sapiens
actgaggtctatcatgagccag

SEQ ID NO: 7069949 - DNA, 22 bp, Homo sapiens
actgaggtctcaggtggggaag

SEQ ID NO: 7069950 - DNA, 22 bp, Homo sapiens
actgaggtggggtctgcttgga

SEQ ID NO: 7069951 - DNA, 22 bp, Homo sapiens
actctgcttgggccatatctgg

SEQ ID NO: 7069952 - DNA, 22 bp, Homo sapiens
actctgcttattgctgcaggca

SEQ ID NO: 7069953 - DNA, 22 bp, Homo sapiens
actctggagatggatgtcagga

SEQ ID NO: 7069954 - DNA, 22 bp, Homo sapiens
actctggcaagcttccacttcc

SEQ ID NO: 7069955 - DNA, 22 bp, Homo sapiens
actctgctcttatagtgttata

SEQ ID NO: 7069956 - DNA, 21 bp, Homo sapiens
actctgctgcgggcttggcct

SEQ ID NO: 7069957 - DNA, 22 bp, Homo sapiens
actctcccacgttcgactctaa

SEQ ID NO: 7069958 - DNA, 22 bp, Homo sapiens
actctcccagctatatgtggtg

SEQ ID NO: 7069959 - DNA, 22 bp, Homo sapiens
actctccctgctatccacttcc

SEQ ID NO: 7069960 - DNA, 22 bp, Homo sapiens
actcagagaatatctagaagga

SEQ ID NO: 7069961 - DNA, 22 bp, Homo sapiens
actatacaccaaaatattaagg

SEQ ID NO: 7069962 - DNA, 22 bp, Homo sapiens
actataacccatggaatataag

SEQ ID NO: 7069963 - DNA, 23 bp, Homo sapiens
actataaagttgttctgatttac

SEQ ID NO: 7069964 - DNA, 22 bp, Homo sapiens
actataaaaggataaaccagaa

SEQ ID NO: 7069965 - DNA, 22 bp, Homo sapiens
actataaaaggataaaccagaa

SEQ ID NO: 7069966 - DNA, 22 bp, Homo sapiens
actatacagtatgtacgtgcac

SEQ ID NO: 7069967 - DNA, 22 bp, Homo sapiens
actatacattgaatgttaaggt

SEQ ID NO: 7069968 - DNA, 22 bp, Homo sapiens
actatacattgaatgttaaggt

SEQ ID NO: 7069969 - DNA, 22 bp, Homo sapiens
actcactgcactttgaaatgtg

SEQ ID NO: 7069970 - DNA, 22 bp, Homo sapiens
actcactgggtcccggaagccc

SEQ ID NO: 7069971 - DNA, 22 bp, Homo sapiens
actcagaaccatttactctgag

SEQ ID NO: 7069972 - DNA, 22 bp, Homo sapiens
actcagaagatataatgactca

SEQ ID NO: 7069973 - DNA, 22 bp, Homo sapiens
actcagaagatataatgactca

SEQ ID NO: 7069974 - DNA, 22 bp, Homo sapiens
actcagaatgactgatgctgtg

SEQ ID NO: 7069975 - DNA, 22 bp, Homo sapiens
aagtctctgactcacacaatgt

SEQ ID NO: 7069976 - DNA, 22 bp, Homo sapiens
acgtggagagaatagggcacca

SEQ ID NO: 7069977 - DNA, 22 bp, Homo sapiens
acgtggagccacagatggagca

SEQ ID NO: 7069978 - DNA, 20 bp, Homo sapiens
acgtggccaccagtggctta

SEQ ID NO: 7069979 - DNA, 22 bp, Homo sapiens
aagtctagtatccttcttgact

SEQ ID NO: 7069980 - DNA, 22 bp, Homo sapiens
acctaacttacctaggtccaca

SEQ ID NO: 7069981 - DNA, 22 bp, Homo sapiens
acctagaatttaaaacattgct

SEQ ID NO: 7069982 - DNA, 22 bp, Homo sapiens
acgtagtgtgttgtggaaagag

SEQ ID NO: 7069983 - DNA, 22 bp, Homo sapiens
actttcttggtcccatgtttga

SEQ ID NO: 7069984 - DNA, 22 bp, Homo sapiens
actttcttcttatgcattaagg

SEQ ID NO: 7069985 - DNA, 22 bp, Homo sapiens
actttctgttagatgaatggat

SEQ ID NO: 7069986 - DNA, 22 bp, Homo sapiens
actttcttaggctgtataaatg

SEQ ID NO: 7069987 - DNA, 22 bp, Homo sapiens
actttatgtttgatatctatgg

SEQ ID NO: 7069988 - DNA, 20 bp, Homo sapiens
actttatgagttcaattttg

SEQ ID NO: 7069989 - DNA, 23 bp, Homo sapiens
actttattgaccccaggtcagtt

SEQ ID NO: 7069990 - DNA, 22 bp, Homo sapiens
actgttgaagtgccagcttgat

SEQ ID NO: 7069991 - DNA, 22 bp, Homo sapiens
aatatagttctagaaatatttt

SEQ ID NO: 7069992 - DNA, 22 bp, Homo sapiens
aatatagttctagaaatatttt

SEQ ID NO: 7069993 - DNA, 22 bp, Homo sapiens
aatatactatactactttctgg

SEQ ID NO: 7069994 - DNA, 19 bp, Homo sapiens
actgggcttgtcctcgtgg

SEQ ID NO: 7069995 - DNA, 22 bp, Homo sapiens
aatagtatttatttggaaaaag

SEQ ID NO: 7069996 - DNA, 22 bp, Homo sapiens
aatagtatttatttggaaaaag

SEQ ID NO: 7069997 - DNA, 22 bp, Homo sapiens
aatataattttattcctagagt

SEQ ID NO: 7069998 - DNA, 22 bp, Homo sapiens
aatactatgttgtgacacatga

SEQ ID NO: 7069999 - DNA, 22 bp, Homo sapiens
aatactgaattagttgagacaa

SEQ ID NO: 7070000 - DNA, 20 bp, Homo sapiens
aatactaaacacaaagcagt

SEQ ID NO: 7070001 - DNA, 22 bp, Homo sapiens
aatactatgtagccaaaataat

SEQ ID NO: 7070002 - DNA, 22 bp, Homo sapiens
aatactatgtagccaaaataat

SEQ ID NO: 7070003 - DNA, 22 bp, Homo sapiens
actgggcttcacttggcacatc

SEQ ID NO: 7070004 - DNA, 22 bp, Homo sapiens
agaaatactttgtaaatctcac

SEQ ID NO: 7070005 - DNA, 22 bp, Homo sapiens
agaaatagaggaaaggtttgac

SEQ ID NO: 7070006 - DNA, 22 bp, Homo sapiens
agaaatgaaaccaaagcctaga

SEQ ID NO: 7070007 - DNA, 22 bp, Homo sapiens
agaaatgaaaccaaagcctaga

SEQ ID NO: 7070008 - DNA, 22 bp, Homo sapiens
agaaatgaagagagtcaaggtt

SEQ ID NO: 7070009 - DNA, 22 bp, Homo sapiens
agaaatgaagcaggagttatta

SEQ ID NO: 7070010 - DNA, 22 bp, Homo sapiens
agaaatgaatatgtagtggtta

SEQ ID NO: 7070011 - DNA, 22 bp, Homo sapiens
agaaatgacaagactgatcagg

SEQ ID NO: 7070012 - DNA, 22 bp, Homo sapiens
agaaatgacaagactgatcagg

SEQ ID NO: 7070013 - DNA, 22 bp, Homo sapiens
aatcagagccctctgagcttca

SEQ ID NO: 7070014 - DNA, 22 bp, Homo sapiens
aatcagagtcccaagatctgta

SEQ ID NO: 7070015 - DNA, 22 bp, Homo sapiens
aatcaggacccactctacagtt

SEQ ID NO: 7070016 - DNA, 22 bp, Homo sapiens
aatcaggatgactgtcatttca

SEQ ID NO: 7070017 - DNA, 23 bp, Homo sapiens
aatgatttcatgatgatagcagc

SEQ ID NO: 7070018 - DNA, 22 bp, Homo sapiens
aatgatggttaaacactggagg

SEQ ID NO: 7070019 - DNA, 23 bp, Homo sapiens
aatgatttcatgatgatagcagc

SEQ ID NO: 7070020 - DNA, 22 bp, Homo sapiens
aatgatttcccctacacagaag

SEQ ID NO: 7070021 - DNA, 22 bp, Homo sapiens
aatgatttcccctacacagaag

SEQ ID NO: 7070022 - DNA, 22 bp, Homo sapiens
agaaatgacacacatgagacat

SEQ ID NO: 7070023 - DNA, 22 bp, Homo sapiens
aatgatgagaactggagtaatt

SEQ ID NO: 7070024 - DNA, 22 bp, Homo sapiens
taaatagaatctaaactgctca

SEQ ID NO: 7070025 - DNA, 22 bp, Homo sapiens
taaatgaagaaatggagattgt

SEQ ID NO: 7070026 - DNA, 22 bp, Homo sapiens
taaatgacattcttaagtcttg

SEQ ID NO: 7070027 - DNA, 22 bp, Homo sapiens
taaatgacattcttaagtcttg

SEQ ID NO: 7070028 - DNA, 22 bp, Homo sapiens
taaatgacccatgctgacctca

SEQ ID NO: 7070029 - DNA, 22 bp, Homo sapiens
taaatgagatgtacataactca

SEQ ID NO: 7070030 - DNA, 22 bp, Homo sapiens
taaatgagggctgacatgattg

SEQ ID NO: 7070031 - DNA, 22 bp, Homo sapiens
taaatgagggctgacatgattg

SEQ ID NO: 7070032 - DNA, 22 bp, Homo sapiens
taaatgataataatgctagtgt

SEQ ID NO: 7070033 - DNA, 22 bp, Homo sapiens
taacactgatttgttctcaggg

SEQ ID NO: 7070034 - DNA, 22 bp, Homo sapiens
taacactggcttttgctgaggc

SEQ ID NO: 7070035 - DNA, 22 bp, Homo sapiens
taacactggttatccctgtgca

SEQ ID NO: 7070036 - DNA, 22 bp, Homo sapiens
taacactgtaaacctagatgtt

SEQ ID NO: 7070037 - DNA, 22 bp, Homo sapiens
taacactgtccaaagaattcca

SEQ ID NO: 7070038 - DNA, 22 bp, Homo sapiens
taacagagatagaaatgtaaag

SEQ ID NO: 7070039 - DNA, 22 bp, Homo sapiens
taacagcaaccacagtgctggt

SEQ ID NO: 7070040 - DNA, 22 bp, Homo sapiens
taacagcactggcaggcactgt

SEQ ID NO: 7070041 - DNA, 22 bp, Homo sapiens
taacagcagggttacaggcatt

SEQ ID NO: 7070042 - DNA, 22 bp, Homo sapiens
taacagcagtcctcttctcatg

SEQ ID NO: 7070043 - DNA, 22 bp, Homo sapiens
taagaaatttagttatagaatg

SEQ ID NO: 7070044 - DNA, 22 bp, Homo sapiens
taaatactttacaggatgtctc

SEQ ID NO: 7070045 - DNA, 18 bp, Homo sapiens
taaaggaagtgggagagg

SEQ ID NO: 7070046 - DNA, 22 bp, Homo sapiens
taaaggaggagttaatgagact

SEQ ID NO: 7070047 - DNA, 22 bp, Homo sapiens
taaaggataactttcaagaatt

SEQ ID NO: 7070048 - DNA, 22 bp, Homo sapiens
taaaggattttgtataatataa

SEQ ID NO: 7070049 - DNA, 22 bp, Homo sapiens
taaaggcacggagttgttatgg

SEQ ID NO: 7070050 - DNA, 22 bp, Homo sapiens
taaagcaggccacatatgtgat

SEQ ID NO: 7070051 - DNA, 21 bp, Homo sapiens
taaagctagaaccttagcttt

SEQ ID NO: 7070052 - DNA, 22 bp, Homo sapiens
taaagctagaaggtgctgtaca

SEQ ID NO: 7070053 - DNA, 22 bp, Homo sapiens
taaagctagaattgttccagca

SEQ ID NO: 7070054 - DNA, 22 bp, Homo sapiens
taaaggaacagaggactcattt

SEQ ID NO: 7070055 - DNA, 22 bp, Homo sapiens
gttgttttgcaggatccttaca

SEQ ID NO: 7070056 - DNA, 22 bp, Homo sapiens
gttgtttttgttctctatagct

SEQ ID NO: 7070057 - DNA, 22 bp, Homo sapiens
gtttaaagtcttggaaggagga

SEQ ID NO: 7070058 - DNA, 22 bp, Homo sapiens
gtttaaataattaggggcctgt

SEQ ID NO: 7070059 - DNA, 22 bp, Homo sapiens
gtttaaataattaggggcctgt

SEQ ID NO: 7070060 - DNA, 22 bp, Homo sapiens
gtttaagaaaattcatgttgtt

SEQ ID NO: 7070061 - DNA, 22 bp, Homo sapiens
gtttttctaggaccatgtgatt

SEQ ID NO: 7070062 - DNA, 22 bp, Homo sapiens
gtttttctttgtgtgaagacaa

SEQ ID NO: 7070063 - DNA, 22 bp, Homo sapiens
gtttttctttgtgtgaagacaa

SEQ ID NO: 7070064 - DNA, 22 bp, Homo sapiens
gtgggccactgggaggcaaggg

SEQ ID NO: 7070065 - DNA, 19 bp, Homo sapiens
gtgggccaggcagaaggct

SEQ ID NO: 7070066 - DNA, 22 bp, Homo sapiens
gtgggccacatcccagggctct

SEQ ID NO: 7070067 - DNA, 22 bp, Homo sapiens
gtgggcagttggtgattctcgt

SEQ ID NO: 7070068 - DNA, 22 bp, Homo sapiens
gtgggcagttcaattctgggag

SEQ ID NO: 7070069 - DNA, 22 bp, Homo sapiens
gtgggcagcctcctttattttc

SEQ ID NO: 7070070 - DNA, 22 bp, Homo sapiens
gtgggcagattaatttctcaat

SEQ ID NO: 7070071 - DNA, 22 bp, Homo sapiens
gtgggcagcaccagggaagtgt

SEQ ID NO: 7070072 - DNA, 22 bp, Homo sapiens
gtgggcagacagtgctttgcag

SEQ ID NO: 7070073 - DNA, 22 bp, Homo sapiens
gtgggcagaacatttgtaggct

SEQ ID NO: 7070074 - DNA, 22 bp, Homo sapiens
gtgggcagacagtgctttgcag

SEQ ID NO: 7070075 - DNA, 22 bp, Homo sapiens
gtgggctggagcaatgatttca

SEQ ID NO: 7070076 - DNA, 22 bp, Homo sapiens
gtgggctggaccctcctgctcc

SEQ ID NO: 7070077 - DNA, 22 bp, Homo sapiens
gtgggctgcttcctccttccac

SEQ ID NO: 7070078 - DNA, 22 bp, Homo sapiens
gtgggccagttcctcacaggta

SEQ ID NO: 7070079 - DNA, 22 bp, Homo sapiens
gtgggctgcccttgaggtcagc

SEQ ID NO: 7070080 - DNA, 22 bp, Homo sapiens
gtgggctgcccttgaggtcagc

SEQ ID NO: 7070081 - DNA, 22 bp, Homo sapiens
gtgggggacccaggtgctgtcc

SEQ ID NO: 7070082 - DNA, 22 bp, Homo sapiens
gtggggaggcctaagcaagttg

SEQ ID NO: 7070083 - DNA, 22 bp, Homo sapiens
gtggggaaaggagtggggctca

SEQ ID NO: 7070084 - DNA, 22 bp, Homo sapiens
gtggggaaaggagtggggctca

SEQ ID NO: 7070085 - DNA, 22 bp, Homo sapiens
gtggtcatcattagtattatta

SEQ ID NO: 7070086 - DNA, 22 bp, Homo sapiens
gtgggtggaggcgtcgagggca

SEQ ID NO: 7070087 - DNA, 22 bp, Homo sapiens
gtgggtggagactgggtgcaag

SEQ ID NO: 7070088 - DNA, 22 bp, Homo sapiens
gtgggtgctgtcaggcagggaa

SEQ ID NO: 7070089 - DNA, 22 bp, Homo sapiens
gtgggtggacggtgcttttgtt

SEQ ID NO: 7070090 - DNA, 22 bp, Homo sapiens
gtgggtgcggggagccgaggcg

SEQ ID NO: 7070091 - DNA, 18 bp, Homo sapiens
gtggggtgttgtgaggat

SEQ ID NO: 7070092 - DNA, 18 bp, Homo sapiens
gtggggtgttgtgaggat

SEQ ID NO: 7070093 - DNA, 18 bp, Homo sapiens
gtggggtgttgtgaggat

SEQ ID NO: 7070094 - DNA, 22 bp, Homo sapiens
gtggggtctctctgtacctccc

SEQ ID NO: 7070095 - DNA, 22 bp, Homo sapiens
gtggggtgggctgagttaggcc

SEQ ID NO: 7070096 - DNA, 22 bp, Homo sapiens
gtggggtgtccagcagcgagct

SEQ ID NO: 7070097 - DNA, 22 bp, Homo sapiens
gtggggggagctgcaagctgga

SEQ ID NO: 7070098 - DNA, 22 bp, Homo sapiens
gtgggggtggaaaggcaagttg

SEQ ID NO: 7070099 - DNA, 22 bp, Homo sapiens
gtggggtagatctttctcagga

SEQ ID NO: 7070100 - DNA, 22 bp, Homo sapiens
gtgtcacaggcccagctcttca

SEQ ID NO: 7070101 - DNA, 22 bp, Homo sapiens
gtggttttctccaacccagaac

SEQ ID NO: 7070102 - DNA, 22 bp, Homo sapiens
gtggttttgccattacaagtaa

SEQ ID NO: 7070103 - DNA, 22 bp, Homo sapiens
gtggtgagttcaggctggggtg

SEQ ID NO: 7070104 - DNA, 22 bp, Homo sapiens
gtggtgcaggccagcaggggcg

SEQ ID NO: 7070105 - DNA, 21 bp, Homo sapiens
gtggttctagagaaacagaat

SEQ ID NO: 7070106 - DNA, 22 bp, Homo sapiens
gtggtgagattgctggatcaaa

SEQ ID NO: 7070107 - DNA, 22 bp, Homo sapiens
gtggtgaagccccatctctgct

SEQ ID NO: 7070108 - DNA, 22 bp, Homo sapiens
gtggtctggggtcaggcctgag

SEQ ID NO: 7070109 - DNA, 22 bp, Homo sapiens
gtggtcatctaactaaattttc

SEQ ID NO: 7070110 - DNA, 22 bp, Homo sapiens
gtggtcatctgggtttgtggca

SEQ ID NO: 7070111 - DNA, 22 bp, Homo sapiens
gtggtcatggaaggtcctacct

SEQ ID NO: 7070112 - DNA, 22 bp, Homo sapiens
gtggtcatgttaattatgatcc

SEQ ID NO: 7070113 - DNA, 22 bp, Homo sapiens
gtggtcatttgtctgagctcca

SEQ ID NO: 7070114 - DNA, 22 bp, Homo sapiens
gtggtccatcatgcagagctcc

SEQ ID NO: 7070115 - DNA, 22 bp, Homo sapiens
gtggtcccttctggccctggtc

SEQ ID NO: 7070116 - DNA, 19 bp, Homo sapiens
gtgtccatggagcatggag

SEQ ID NO: 7070117 - DNA, 22 bp, Homo sapiens
gtgtcctgagtgaggcctggcc

SEQ ID NO: 7070118 - DNA, 22 bp, Homo sapiens
gtgtcctgtttccctgtctata

SEQ ID NO: 7070119 - DNA, 22 bp, Homo sapiens
gtgtctgcaagatagccaagtc

SEQ ID NO: 7070120 - DNA, 22 bp, Homo sapiens
gtgtgagggacagagaaagggg

SEQ ID NO: 7070121 - DNA, 21 bp, Homo sapiens
gtgtgagtagcatgtgtctca

SEQ ID NO: 7070122 - DNA, 22 bp, Homo sapiens
gtgtgcacagagctccagtgtt

SEQ ID NO: 7070123 - DNA, 22 bp, Homo sapiens
gtgtgcagaagacacaagacat

SEQ ID NO: 7070124 - DNA, 22 bp, Homo sapiens
gtgtgcagcagagacaggactc

SEQ ID NO: 7070125 - DNA, 22 bp, Homo sapiens
gtgtgcaggccacaggccaggg

SEQ ID NO: 7070126 - DNA, 22 bp, Homo sapiens
gtgtgcagggatgagtgcaggt

SEQ ID NO: 7070127 - DNA, 22 bp, Homo sapiens
gtgtgcagggctgcctgtgccg

SEQ ID NO: 7070128 - DNA, 22 bp, Homo sapiens
gtgtgcagggggccagcgcagc

SEQ ID NO: 7070129 - DNA, 22 bp, Homo sapiens
gtgtgcaggtgtcagtgcagct

SEQ ID NO: 7070130 - DNA, 22 bp, Homo sapiens
gtgtgcagtagagaaagagcag

SEQ ID NO: 7070131 - DNA, 22 bp, Homo sapiens
gtgtgcagtctgctaggcaggg

SEQ ID NO: 7070132 - DNA, 22 bp, Homo sapiens
gtgtgcagtgagcaaaagatct

SEQ ID NO: 7070133 - DNA, 22 bp, Homo sapiens
gtgtgggctgcagaggcacagc

SEQ ID NO: 7070134 - DNA, 22 bp, Homo sapiens
gtgtggggagctgcagccacat

SEQ ID NO: 7070135 - DNA, 22 bp, Homo sapiens
gttcaaggaagggaggaaagcc

SEQ ID NO: 7070136 - DNA, 18 bp, Homo sapiens
gttcaaggtcaagagaga

SEQ ID NO: 7070137 - DNA, 22 bp, Homo sapiens
gttcaaggttttacagagtgta

SEQ ID NO: 7070138 - DNA, 22 bp, Homo sapiens
gttcaaatggctgcagttacca

SEQ ID NO: 7070139 - DNA, 22 bp, Homo sapiens
gttattttatctctgagaggtt

SEQ ID NO: 7070140 - DNA, 22 bp, Homo sapiens
gttattttatctctgagaggtt

SEQ ID NO: 7070141 - DNA, 21 bp, Homo sapiens
gttattttaagtgagctttgc

SEQ ID NO: 7070142 - DNA, 21 bp, Homo sapiens
gttattttaagtgagctttgc

SEQ ID NO: 7070143 - DNA, 22 bp, Homo sapiens
gttattttcattggctcagact

SEQ ID NO: 7070144 - DNA, 22 bp, Homo sapiens
gttattttcattggctcagact

SEQ ID NO: 7070145 - DNA, 22 bp, Homo sapiens
gttattttaacttctcagtaat

SEQ ID NO: 7070146 - DNA, 22 bp, Homo sapiens
gttattttaacttctcagtaat

SEQ ID NO: 7070147 - DNA, 22 bp, Homo sapiens
gtgtgtcctcagtagtggcatg

SEQ ID NO: 7070148 - DNA, 22 bp, Homo sapiens
gttgtatagagggcatgaatct

SEQ ID NO: 7070149 - DNA, 22 bp, Homo sapiens
gttctgagtcctcctttgaagg

SEQ ID NO: 7070150 - DNA, 21 bp, Homo sapiens
gttctgagttagagttggcca

SEQ ID NO: 7070151 - DNA, 22 bp, Homo sapiens
gttctgcagacttggaaggtgg

SEQ ID NO: 7070152 - DNA, 22 bp, Homo sapiens
gttctgctgtaatatctctgct

SEQ ID NO: 7070153 - DNA, 22 bp, Homo sapiens
gttctattccccttatctgtga

SEQ ID NO: 7070154 - DNA, 22 bp, Homo sapiens
gttctattctccagttacatat

SEQ ID NO: 7070155 - DNA, 22 bp, Homo sapiens
gttctcagtggggagcagggtt

SEQ ID NO: 7070156 - DNA, 22 bp, Homo sapiens
gttctccactgcagagtctctc

SEQ ID NO: 7070157 - DNA, 22 bp, Homo sapiens
gttctccactgcagagtctctc

SEQ ID NO: 7070158 - DNA, 22 bp, Homo sapiens
gttctccaggggctgttcatct

SEQ ID NO: 7070159 - DNA, 22 bp, Homo sapiens
gttctccttgtggctgcagcag

SEQ ID NO: 7070160 - DNA, 22 bp, Homo sapiens
gttctctcaaactttgtgtttg

SEQ ID NO: 7070161 - DNA, 16 bp, Homo sapiens
gttctctcactgtacc

SEQ ID NO: 7070162 - DNA, 22 bp, Homo sapiens
gttctctggagtccctgggccc

SEQ ID NO: 7070163 - DNA, 22 bp, Homo sapiens
gttctgaggcaaaggcagcagc

SEQ ID NO: 7070164 - DNA, 22 bp, Homo sapiens
gttctgagtcctcctttgaagg

SEQ ID NO: 7070165 - DNA, 22 bp, Homo sapiens
gttctctcagcctttgttatta

SEQ ID NO: 7070166 - DNA, 22 bp, Homo sapiens
gttctctcagcgatagtgatgg

SEQ ID NO: 7070167 - DNA, 22 bp, Homo sapiens
gttctctctcttgcctgggtgg

SEQ ID NO: 7070168 - DNA, 22 bp, Homo sapiens
gttctctctgcttccaagatgg

SEQ ID NO: 7070169 - DNA, 23 bp, Homo sapiens
ggtggtggtgagtcacgggctca

SEQ ID NO: 7070170 - DNA, 22 bp, Homo sapiens
ggtggccatggtcaggtagcgg

SEQ ID NO: 7070171 - DNA, 22 bp, Homo sapiens
ggtggttcacgcctataatccc

SEQ ID NO: 7070172 - DNA, 22 bp, Homo sapiens
ggtgtagctctgtgtcccactg

SEQ ID NO: 7070173 - DNA, 21 bp, Homo sapiens
ggtgtccagaggagtccccag

SEQ ID NO: 7070174 - DNA, 22 bp, Homo sapiens
ggtgtccatcaggctgtgcttc

SEQ ID NO: 7070175 - DNA, 22 bp, Homo sapiens
ggtgtccgcgctgtagaaggtc

SEQ ID NO: 7070176 - DNA, 22 bp, Homo sapiens
ggtggcagcgtctatctgacat

SEQ ID NO: 7070177 - DNA, 23 bp, Homo sapiens
ggtggcaggagtggatgctgagc

SEQ ID NO: 7070178 - DNA, 23 bp, Homo sapiens
ggtggcaggagtggatgctgagc

SEQ ID NO: 7070179 - DNA, 22 bp, Homo sapiens
ggtggcaggccctgagcatccc

SEQ ID NO: 7070180 - DNA, 22 bp, Homo sapiens
ggtggcaggccctgagcatccc

SEQ ID NO: 7070181 - DNA, 22 bp, Homo sapiens
ggtggcaggctggcattggcaa

SEQ ID NO: 7070182 - DNA, 22 bp, Homo sapiens
ggtggcaggctggcattggcaa

SEQ ID NO: 7070183 - DNA, 22 bp, Homo sapiens
ggtggcagttacaggggcaaat

SEQ ID NO: 7070184 - DNA, 22 bp, Homo sapiens
ggtgcaggcggtggggcaagta

SEQ ID NO: 7070185 - DNA, 22 bp, Homo sapiens
ggtggcagaggtgcatcagccc

SEQ ID NO: 7070186 - DNA, 22 bp, Homo sapiens
ggtggcagaggtgcatcagccc

SEQ ID NO: 7070187 - DNA, 22 bp, Homo sapiens
ggtggcagcatggtcccagtgt

SEQ ID NO: 7070188 - DNA, 22 bp, Homo sapiens
ggtgcaggagcggggtgctcgg

SEQ ID NO: 7070189 - DNA, 22 bp, Homo sapiens
ggtgcaggacgaagtgggggtt

SEQ ID NO: 7070190 - DNA, 22 bp, Homo sapiens
ggtgcaggaatctgcaattgaa

SEQ ID NO: 7070191 - DNA, 22 bp, Homo sapiens
ggtgagtgcctggcctggccac

SEQ ID NO: 7070192 - DNA, 22 bp, Homo sapiens
ggtgagtgtcaatggttagagt

SEQ ID NO: 7070193 - DNA, 22 bp, Homo sapiens
ggtgattctgtgaggggctgac

SEQ ID NO: 7070194 - DNA, 22 bp, Homo sapiens
ggtgaggggagagtgaaagaaa

SEQ ID NO: 7070195 - DNA, 22 bp, Homo sapiens
ggtgagggtaaatataggcaaa

SEQ ID NO: 7070196 - DNA, 22 bp, Homo sapiens
gtatatcaccccaagcagctga

SEQ ID NO: 7070197 - DNA, 22 bp, Homo sapiens
gtatatcagacactcatatgta

SEQ ID NO: 7070198 - DNA, 22 bp, Homo sapiens
gtatatatgtgtgaacatgtat

SEQ ID NO: 7070199 - DNA, 22 bp, Homo sapiens
gtatatattggataaaccagag

SEQ ID NO: 7070200 - DNA, 20 bp, Homo sapiens
gtatataaccatagtgacta

SEQ ID NO: 7070201 - DNA, 22 bp, Homo sapiens
gtatataaggtaaagcgattgt

SEQ ID NO: 7070202 - DNA, 22 bp, Homo sapiens
gtatatatcggcactattttaa

SEQ ID NO: 7070203 - DNA, 22 bp, Homo sapiens
gtatatatgtgtgaacatgtat

SEQ ID NO: 7070204 - DNA, 22 bp, Homo sapiens
gtacatgtatgagatatgtgta

SEQ ID NO: 7070205 - DNA, 22 bp, Homo sapiens
gtacatgtcaaaaaatgcataa

SEQ ID NO: 7070206 - DNA, 22 bp, Homo sapiens
gtacatgtgcacaacatgcatg

SEQ ID NO: 7070207 - DNA, 22 bp, Homo sapiens
gtacatgtgcacaatgtgcagg

SEQ ID NO: 7070208 - DNA, 22 bp, Homo sapiens
gtacatgtgcacaatgtgcagg

SEQ ID NO: 7070209 - DNA, 22 bp, Homo sapiens
gtaaacattactgtgctgtata

SEQ ID NO: 7070210 - DNA, 22 bp, Homo sapiens
gtaaacattttcatctgtgccc

SEQ ID NO: 7070211 - DNA, 22 bp, Homo sapiens
gtaaacatgctgtgtactcagc

SEQ ID NO: 7070212 - DNA, 22 bp, Homo sapiens
ggtgtcctcatgattttctaga

SEQ ID NO: 7070213 - DNA, 22 bp, Homo sapiens
ggtgtcctcactatagcaagtc

SEQ ID NO: 7070214 - DNA, 23 bp, Homo sapiens
gtaaaatacgcagtgcagtgtga

SEQ ID NO: 7070215 - DNA, 22 bp, Homo sapiens
gtaaataactggtaattggggt

SEQ ID NO: 7070216 - DNA, 22 bp, Homo sapiens
gtaaataactggtaattggggt

SEQ ID NO: 7070217 - DNA, 22 bp, Homo sapiens
gtaaataactggtaattggggt

SEQ ID NO: 7070218 - DNA, 22 bp, Homo sapiens
gtaaatataaatgctagctgcc

SEQ ID NO: 7070219 - DNA, 22 bp, Homo sapiens
gtaaatataaatgctagctgcc

SEQ ID NO: 7070220 - DNA, 22 bp, Homo sapiens
gtaaatataaatgctagctgcc

SEQ ID NO: 7070221 - DNA, 22 bp, Homo sapiens
gtaaatataaatgctagctgcc

SEQ ID NO: 7070222 - DNA, 22 bp, Homo sapiens
gtaaatattaaaggctgctaga

SEQ ID NO: 7070223 - DNA, 22 bp, Homo sapiens
gtaaatattaaaggctgctaga

SEQ ID NO: 7070224 - DNA, 22 bp, Homo sapiens
gtaaatattaaaggctgctaga

SEQ ID NO: 7070225 - DNA, 22 bp, Homo sapiens
gtaaatattaaaggctgctaga

SEQ ID NO: 7070226 - DNA, 22 bp, Homo sapiens
gtaaatattccctcggttccta

SEQ ID NO: 7070227 - DNA, 22 bp, Homo sapiens
gtacagaatgcttggtaaggca

SEQ ID NO: 7070228 - DNA, 22 bp, Homo sapiens
gtacagcatttgaaattactgg

SEQ ID NO: 7070229 - DNA, 22 bp, Homo sapiens
gtcaggaagtggcattggagaa

SEQ ID NO: 7070230 - DNA, 19 bp, Homo sapiens
gtcaggcacgtgagagcat

SEQ ID NO: 7070231 - DNA, 22 bp, Homo sapiens
gtattacatttagtaattaggc

SEQ ID NO: 7070232 - DNA, 22 bp, Homo sapiens
gtcagaggaggctgagtaggaa

SEQ ID NO: 7070233 - DNA, 18 bp, Homo sapiens
gtcagaggatggggaaat

SEQ ID NO: 7070234 - DNA, 22 bp, Homo sapiens
gtcagaggggacaagacacaga

SEQ ID NO: 7070235 - DNA, 22 bp, Homo sapiens
gtatgtgaggttggtttccagg

SEQ ID NO: 7070236 - DNA, 22 bp, Homo sapiens
gtcagaggggacaagacacaga

SEQ ID NO: 7070237 - DNA, 22 bp, Homo sapiens
gtcaggaaaacccgggttgact

SEQ ID NO: 7070238 - DNA, 22 bp, Homo sapiens
gtccaggtctggaccctgagcc

SEQ ID NO: 7070239 - DNA, 22 bp, Homo sapiens
gtcccagaaacatattgctggt

SEQ ID NO: 7070240 - DNA, 22 bp, Homo sapiens
gtcctgggtccccgcaggtcag

SEQ ID NO: 7070241 - DNA, 22 bp, Homo sapiens
gtccttaaagagagcatcattc

SEQ ID NO: 7070242 - DNA, 22 bp, Homo sapiens
gtccttaacaaacggggaaaag

SEQ ID NO: 7070243 - DNA, 21 bp, Homo sapiens
gtctgatgcttgatgcagttg

SEQ ID NO: 7070244 - DNA, 22 bp, Homo sapiens
gtctgagggttgtgctggagga

SEQ ID NO: 7070245 - DNA, 22 bp, Homo sapiens
gtctgccatgtggagaaagcca

SEQ ID NO: 7070246 - DNA, 18 bp, Homo sapiens
gtctgccaacaactatca

SEQ ID NO: 7070247 - DNA, 22 bp, Homo sapiens
gtctggccatttgcccattgtg

SEQ ID NO: 7070248 - DNA, 22 bp, Homo sapiens
gtctgggggtccgggtgcctgc

SEQ ID NO: 7070249 - DNA, 22 bp, Homo sapiens
gtctctgagctctgagctggct

SEQ ID NO: 7070250 - DNA, 22 bp, Homo sapiens
gtctctgcctggggggatcaga

SEQ ID NO: 7070251 - DNA, 19 bp, Homo sapiens
gtctctgctccagggtctc

SEQ ID NO: 7070252 - DNA, 22 bp, Homo sapiens
gtctctgctctagagtctgtga

SEQ ID NO: 7070253 - DNA, 22 bp, Homo sapiens
gtctcttttatggtgagttgat

SEQ ID NO: 7070254 - DNA, 22 bp, Homo sapiens
gtctgagggacagagtcctggc

SEQ ID NO: 7070255 - DNA, 22 bp, Homo sapiens
gtctgagggtcatgggtctcac

SEQ ID NO: 7070256 - DNA, 20 bp, Homo sapiens
gtggcaggcagtgaaggagc

SEQ ID NO: 7070257 - DNA, 22 bp, Homo sapiens
gtggcaggggcgggctgttccg

SEQ ID NO: 7070258 - DNA, 22 bp, Homo sapiens
gtggcagggctttgctgttctt

SEQ ID NO: 7070259 - DNA, 22 bp, Homo sapiens
gtggcagggcaatgctccctct

SEQ ID NO: 7070260 - DNA, 22 bp, Homo sapiens
gtggcaggagagacacagccat

SEQ ID NO: 7070261 - DNA, 22 bp, Homo sapiens
gtggcaggagtgggccttgaag

SEQ ID NO: 7070262 - DNA, 22 bp, Homo sapiens
gtggcaggatcacggctcactg

SEQ ID NO: 7070263 - DNA, 22 bp, Homo sapiens
gtggcaggagactggaagatgg

SEQ ID NO: 7070264 - DNA, 22 bp, Homo sapiens
gtggcaggagagacacagccat

SEQ ID NO: 7070265 - DNA, 22 bp, Homo sapiens
gtggcagctggtatgcagacag

SEQ ID NO: 7070266 - DNA, 22 bp, Homo sapiens
gtggcatgacagtgaatgggca

SEQ ID NO: 7070267 - DNA, 22 bp, Homo sapiens
gtggcatggagaaggaggcagt

SEQ ID NO: 7070268 - DNA, 22 bp, Homo sapiens
gtggcaggggtattccagctga

SEQ ID NO: 7070269 - DNA, 22 bp, Homo sapiens
gtggcagggtgctcatcatgca

SEQ ID NO: 7070270 - DNA, 22 bp, Homo sapiens
gtggccaggacattgccaggca

SEQ ID NO: 7070271 - DNA, 22 bp, Homo sapiens
gtggcccaggcttggcgctggc

SEQ ID NO: 7070272 - DNA, 21 bp, Homo sapiens
gtggctctgccaggactgaaa

SEQ ID NO: 7070273 - DNA, 22 bp, Homo sapiens
gtggctgagcagcagagagctg

SEQ ID NO: 7070274 - DNA, 22 bp, Homo sapiens
gtggctcatctttgggaagtaa

SEQ ID NO: 7070275 - DNA, 19 bp, Homo sapiens
gtggctcatgtagtgggcc

SEQ ID NO: 7070276 - DNA, 22 bp, Homo sapiens
gtggcctagaggtgcaaggaac

SEQ ID NO: 7070277 - DNA, 23 bp, Homo sapiens
gtggcctccccggaatgcctcgc

SEQ ID NO: 7070278 - DNA, 22 bp, Homo sapiens
gtggcctctgtgctcctgccta

SEQ ID NO: 7070279 - DNA, 22 bp, Homo sapiens
gtggcctctgttggctcctagg

SEQ ID NO: 7070280 - DNA, 22 bp, Homo sapiens
gtgggagctttggcatcaggct

SEQ ID NO: 7070281 - DNA, 22 bp, Homo sapiens
gtgggatgcagtggtgagtggc

SEQ ID NO: 7070282 - DNA, 22 bp, Homo sapiens
gtgggatgcttaggatcttgcc

SEQ ID NO: 7070283 - DNA, 22 bp, Homo sapiens
gtgggagctgcggaggcctggg

SEQ ID NO: 7070284 - DNA, 22 bp, Homo sapiens
gtgggagcatggtcccagtgcc

SEQ ID NO: 7070285 - DNA, 22 bp, Homo sapiens
gtgggagccctcagggaggtgc

SEQ ID NO: 7070286 - DNA, 22 bp, Homo sapiens
gtgggagaaattagctctagtt

SEQ ID NO: 7070287 - DNA, 22 bp, Homo sapiens
gtgggagaaattagctctagtt

SEQ ID NO: 7070288 - DNA, 22 bp, Homo sapiens
gtggctgggctccgagcggctt

SEQ ID NO: 7070289 - DNA, 22 bp, Homo sapiens
gtggctggtttcctgcatgcaa

SEQ ID NO: 7070290 - DNA, 22 bp, Homo sapiens
gtggctggtttcctgcatgcaa

SEQ ID NO: 7070291 - DNA, 22 bp, Homo sapiens
gtggaattgctggataatatca

SEQ ID NO: 7070292 - DNA, 22 bp, Homo sapiens
gtggaccaaggtggaagataaa

SEQ ID NO: 7070293 - DNA, 22 bp, Homo sapiens
gtggacgttaggattgtgtaga

SEQ ID NO: 7070294 - DNA, 22 bp, Homo sapiens
gtggactggcagtgaccttggt

SEQ ID NO: 7070295 - DNA, 22 bp, Homo sapiens
gtggagagagataagcctggtc

SEQ ID NO: 7070296 - DNA, 22 bp, Homo sapiens
gtggagagagataagcctggtc

SEQ ID NO: 7070297 - DNA, 22 bp, Homo sapiens
gtggagaggaacccagctctgt

SEQ ID NO: 7070298 - DNA, 22 bp, Homo sapiens
gtggaggacaaaagaagccttt

SEQ ID NO: 7070299 - DNA, 22 bp, Homo sapiens
gtggaggacaaaagaagccttt

SEQ ID NO: 7070300 - DNA, 22 bp, Homo sapiens
gtggaggacaaaagaagccttt

SEQ ID NO: 7070301 - DNA, 22 bp, Homo sapiens
gtggagggtttgcaatgtgcag

SEQ ID NO: 7070302 - DNA, 22 bp, Homo sapiens
gtggagggtttgcaatgtgcag

SEQ ID NO: 7070303 - DNA, 22 bp, Homo sapiens
gtggaggtcccgggcaggagca

SEQ ID NO: 7070304 - DNA, 22 bp, Homo sapiens
gtggagtgcaacggttggagtt

SEQ ID NO: 7070305 - DNA, 22 bp, Homo sapiens
gtggagtggcctggccctgaga

SEQ ID NO: 7070306 - DNA, 22 bp, Homo sapiens
gtggagtggcctggccctgaga

SEQ ID NO: 7070307 - DNA, 22 bp, Homo sapiens
gtggatgagataactgtagaag

SEQ ID NO: 7070308 - DNA, 20 bp, Homo sapiens
gtggatgatcagtgtagtgg

SEQ ID NO: 7070309 - DNA, 22 bp, Homo sapiens
gtggatgatgagtgactacaga

SEQ ID NO: 7070310 - DNA, 20 bp, Homo sapiens
gtggatgatcagtgtagtgg

SEQ ID NO: 7070311 - DNA, 22 bp, Homo sapiens
gtggatgattgactctgtagac

SEQ ID NO: 7070312 - DNA, 22 bp, Homo sapiens
gtggagggtgattgccggctgt

SEQ ID NO: 7070313 - DNA, 18 bp, Homo sapiens
gtggagggttctcagaat

SEQ ID NO: 7070314 - DNA, 18 bp, Homo sapiens
gtggagggttctcagaat

SEQ ID NO: 7070315 - DNA, 22 bp, Homo sapiens
gtggagggtttgcaatgtgcag

SEQ ID NO: 7070316 - DNA, 22 bp, Homo sapiens
gtggagggtttgcaatgtgcag

SEQ ID NO: 7070317 - DNA, 22 bp, Homo sapiens
gtggagggaatgaatcttctct

SEQ ID NO: 7070318 - DNA, 22 bp, Homo sapiens
gtggagggtgagctcatgtttg

SEQ ID NO: 7070319 - DNA, 22 bp, Homo sapiens
gtggagggaatgaatcttctct

SEQ ID NO: 7070320 - DNA, 22 bp, Homo sapiens
gtggagggaatgaatcttctct

SEQ ID NO: 7070321 - DNA, 22 bp, Homo sapiens
gtggatggagctggaagccatt

SEQ ID NO: 7070322 - DNA, 22 bp, Homo sapiens
gtggcaaggagcatgaaaagtc

SEQ ID NO: 7070323 - DNA, 22 bp, Homo sapiens
gtggcacagtgggagagcccca

SEQ ID NO: 7070324 - DNA, 22 bp, Homo sapiens
gtggcacattggtagggtctgt

SEQ ID NO: 7070325 - DNA, 22 bp, Homo sapiens
gtggcagagccgtgcaggtagg

SEQ ID NO: 7070326 - DNA, 22 bp, Homo sapiens
gtggcagagggtgagctggact

SEQ ID NO: 7070327 - DNA, 22 bp, Homo sapiens
gtggcagagtgcggttctgacc

SEQ ID NO: 7070328 - DNA, 22 bp, Homo sapiens
gtggcagattgctcaccatggt

SEQ ID NO: 7070329 - DNA, 22 bp, Homo sapiens
gtgcctttgagaagtttctctg

SEQ ID NO: 7070330 - DNA, 22 bp, Homo sapiens
gtgcctttgagaagtttctctg

SEQ ID NO: 7070331 - DNA, 22 bp, Homo sapiens
gtgcctttgtgtctaaaacagc

SEQ ID NO: 7070332 - DNA, 22 bp, Homo sapiens
gtgccttttcttcatagttact

SEQ ID NO: 7070333 - DNA, 22 bp, Homo sapiens
gtgctacagactgagtacactt

SEQ ID NO: 7070334 - DNA, 22 bp, Homo sapiens
gtgcctggcagggtcagctgct

SEQ ID NO: 7070335 - DNA, 22 bp, Homo sapiens
gtgcctgtttcttttgaattca

SEQ ID NO: 7070336 - DNA, 22 bp, Homo sapiens
gtggaaattttaggatcatctt

SEQ ID NO: 7070337 - DNA, 22 bp, Homo sapiens
gtggaaatgcccccaaatagtg

SEQ ID NO: 7070338 - DNA, 22 bp, Homo sapiens
gtggaaatagtttggttataga

SEQ ID NO: 7070339 - DNA, 22 bp, Homo sapiens
gtgctaggattacaggcatggg

SEQ ID NO: 7070340 - DNA, 22 bp, Homo sapiens
gtggaaggtaatgcagcttact

SEQ ID NO: 7070341 - DNA, 22 bp, Homo sapiens
gtggaaggaattaacagactag

SEQ ID NO: 7070342 - DNA, 22 bp, Homo sapiens
gtggaaggaattaacagactag

SEQ ID NO: 7070343 - DNA, 22 bp, Homo sapiens
gtggaaggtgctagaacaagga

SEQ ID NO: 7070344 - DNA, 22 bp, Homo sapiens
gtggaaggtgctagaacaagga

SEQ ID NO: 7070345 - DNA, 22 bp, Homo sapiens
gtggaagtagatttgagaaggt

SEQ ID NO: 7070346 - DNA, 22 bp, Homo sapiens
gtgcctggaatgcgcctcggcg

SEQ ID NO: 7070347 - DNA, 22 bp, Homo sapiens
gtgcctggaccctctttccgga

SEQ ID NO: 7070348 - DNA, 22 bp, Homo sapiens
gtgcctgcagcaatccatggca

SEQ ID NO: 7070349 - DNA, 22 bp, Homo sapiens
gtgcctgctacctgacttgttt

SEQ ID NO: 7070350 - DNA, 22 bp, Homo sapiens
gtgcctgctgcagagtcgctgt

SEQ ID NO: 7070351 - DNA, 22 bp, Homo sapiens
gtgacagtcaaagacatgactt

SEQ ID NO: 7070352 - DNA, 22 bp, Homo sapiens
gtgacagtcaaagacatgactt

SEQ ID NO: 7070353 - DNA, 22 bp, Homo sapiens
gtgacagtggtcacttgtagtt

SEQ ID NO: 7070354 - DNA, 22 bp, Homo sapiens
gtgacatgttatggactggcta

SEQ ID NO: 7070355 - DNA, 20 bp, Homo sapiens
gtgaccagaagacagtgggt

SEQ ID NO: 7070356 - DNA, 22 bp, Homo sapiens
gtgaccagagcgggagattggg

SEQ ID NO: 7070357 - DNA, 22 bp, Homo sapiens
gtgaccagccagtgctgtctgt

SEQ ID NO: 7070358 - DNA, 22 bp, Homo sapiens
gtgaccagcccatagagaggcg

SEQ ID NO: 7070359 - DNA, 22 bp, Homo sapiens
gtgaaggattggagggcatctt

SEQ ID NO: 7070360 - DNA, 22 bp, Homo sapiens
gtgaaggctacaagagatcaag

SEQ ID NO: 7070361 - DNA, 20 bp, Homo sapiens
gtgaagggagtcaggtgtgc

SEQ ID NO: 7070362 - DNA, 22 bp, Homo sapiens
gtgacaggcccagtgggatgca

SEQ ID NO: 7070363 - DNA, 22 bp, Homo sapiens
ggccagaggccatcctcctgct

SEQ ID NO: 7070364 - DNA, 22 bp, Homo sapiens
ggccagagagcagccaggattc

SEQ ID NO: 7070365 - DNA, 22 bp, Homo sapiens
ggccagaggccatcctcctgct

SEQ ID NO: 7070366 - DNA, 18 bp, Homo sapiens
ggccagagggagggtccc

SEQ ID NO: 7070367 - DNA, 18 bp, Homo sapiens
ggccagagggagggtccc

SEQ ID NO: 7070368 - DNA, 22 bp, Homo sapiens
ggccatgggaagaggtggagag

SEQ ID NO: 7070369 - DNA, 22 bp, Homo sapiens
ggcaggtggaagttggcagagc

SEQ ID NO: 7070370 - DNA, 22 bp, Homo sapiens
ggcaggtggaagttggcagagc

SEQ ID NO: 7070371 - DNA, 22 bp, Homo sapiens
ggcaggtggaaggtctccattc

SEQ ID NO: 7070372 - DNA, 22 bp, Homo sapiens
ggcaggtggaaggtctccattc

SEQ ID NO: 7070373 - DNA, 22 bp, Homo sapiens
ggcaggtgcttgtcgaaggcct

SEQ ID NO: 7070374 - DNA, 22 bp, Homo sapiens
ggcaggtgctgggagcatctca

SEQ ID NO: 7070375 - DNA, 22 bp, Homo sapiens
ggccagagaagtcagacccttg

SEQ ID NO: 7070376 - DNA, 22 bp, Homo sapiens
ggccagagaagtcagacccttg

SEQ ID NO: 7070377 - DNA, 22 bp, Homo sapiens
ggcccacttgaaatggagctca

SEQ ID NO: 7070378 - DNA, 22 bp, Homo sapiens
ggcccacactgacagctgagct

SEQ ID NO: 7070379 - DNA, 22 bp, Homo sapiens
ggccatggttggggaagacatg

SEQ ID NO: 7070380 - DNA, 22 bp, Homo sapiens
ggccatggggacagagggtgaa

SEQ ID NO: 7070381 - DNA, 20 bp, Homo sapiens
ggccatgggttgcctgaggt

SEQ ID NO: 7070382 - DNA, 22 bp, Homo sapiens
ggccatggtcatgggtgagctt

SEQ ID NO: 7070383 - DNA, 22 bp, Homo sapiens
ggcccctgcggactgcctagag

SEQ ID NO: 7070384 - DNA, 22 bp, Homo sapiens
ggcccctgcggactgcctagag

SEQ ID NO: 7070385 - DNA, 22 bp, Homo sapiens
ggctcatgtatgaaagggtgtg

SEQ ID NO: 7070386 - DNA, 22 bp, Homo sapiens
ggctcatgtttcagaaagtgga

SEQ ID NO: 7070387 - DNA, 22 bp, Homo sapiens
ggctccaagtctcagagtgaag

SEQ ID NO: 7070388 - DNA, 22 bp, Homo sapiens
ggctcctgcacctgtccctctg

SEQ ID NO: 7070389 - DNA, 22 bp, Homo sapiens
ggctcaggagaggggctaaaag

SEQ ID NO: 7070390 - DNA, 22 bp, Homo sapiens
ggcccctggcaccaggctgatt

SEQ ID NO: 7070391 - DNA, 22 bp, Homo sapiens
ggcccctgtaaaatgtacatgt

SEQ ID NO: 7070392 - DNA, 22 bp, Homo sapiens
ggcccctgtaaaatgtacatgt

SEQ ID NO: 7070393 - DNA, 22 bp, Homo sapiens
ggccctctggcttccgcatggg

SEQ ID NO: 7070394 - DNA, 22 bp, Homo sapiens
ggccctcttttatccatcataa

SEQ ID NO: 7070395 - DNA, 22 bp, Homo sapiens
ggccctgaagtgattgtgagtt

SEQ ID NO: 7070396 - DNA, 22 bp, Homo sapiens
ggccctgagctgaagtactgtg

SEQ ID NO: 7070397 - DNA, 22 bp, Homo sapiens
ggccctgagctgaagtactgtg

SEQ ID NO: 7070398 - DNA, 22 bp, Homo sapiens
ggccctgcgattaggtggcagg

SEQ ID NO: 7070399 - DNA, 22 bp, Homo sapiens
ggccttgagagccagtgcaggc

SEQ ID NO: 7070400 - DNA, 22 bp, Homo sapiens
ggccttgatcctccagagcact

SEQ ID NO: 7070401 - DNA, 22 bp, Homo sapiens
ggctgcaggcagggtatccact

SEQ ID NO: 7070402 - DNA, 22 bp, Homo sapiens
ggctgcaggcagaggctgtctg

SEQ ID NO: 7070403 - DNA, 22 bp, Homo sapiens
ggctgcaggatgcccagccgtg

SEQ ID NO: 7070404 - DNA, 22 bp, Homo sapiens
ggctgcaggaacgacggagggg

SEQ ID NO: 7070405 - DNA, 23 bp, Homo sapiens
ggctggcccggggctgctcctga

SEQ ID NO: 7070406 - DNA, 23 bp, Homo sapiens
ggctggcccggggctgctcctga

SEQ ID NO: 7070407 - DNA, 22 bp, Homo sapiens
ggctggcgggtgggtgaaagac

SEQ ID NO: 7070408 - DNA, 22 bp, Homo sapiens
ggctgatgagcttagctagaga

SEQ ID NO: 7070409 - DNA, 22 bp, Homo sapiens
ggctgatgagcttagctagaga

SEQ ID NO: 7070410 - DNA, 22 bp, Homo sapiens
ggctgatgggcatgagctgtca

SEQ ID NO: 7070411 - DNA, 22 bp, Homo sapiens
ggctgatgggcatgagctgtca

SEQ ID NO: 7070412 - DNA, 22 bp, Homo sapiens
ggctgcacgcctctcagcttgc

SEQ ID NO: 7070413 - DNA, 19 bp, Homo sapiens
ggctctcccttgagagagc

SEQ ID NO: 7070414 - DNA, 22 bp, Homo sapiens
ggctgagttgagaggattactt

SEQ ID NO: 7070415 - DNA, 22 bp, Homo sapiens
ggctgagttgagaggattactt

SEQ ID NO: 7070416 - DNA, 19 bp, Homo sapiens
ggctgcagagccccggcgc

SEQ ID NO: 7070417 - DNA, 19 bp, Homo sapiens
ggctgcagagccccggcgc

SEQ ID NO: 7070418 - DNA, 22 bp, Homo sapiens
ggctgcagagctgggtgggcct

SEQ ID NO: 7070419 - DNA, 22 bp, Homo sapiens
ggctgcagaggcccccagtggg

SEQ ID NO: 7070420 - DNA, 22 bp, Homo sapiens
ggctgcagaggcgatctgaggt

SEQ ID NO: 7070421 - DNA, 22 bp, Homo sapiens
ggctccttcaagcctgtcactg

SEQ ID NO: 7070422 - DNA, 22 bp, Homo sapiens
gggaactgtttaacaggggttt

SEQ ID NO: 7070423 - DNA, 22 bp, Homo sapiens
gggaacacagacttgatgatga

SEQ ID NO: 7070424 - DNA, 22 bp, Homo sapiens
ggcttcctaatactccctacac

SEQ ID NO: 7070425 - DNA, 22 bp, Homo sapiens
ggcttcctaatactccctacac

SEQ ID NO: 7070426 - DNA, 22 bp, Homo sapiens
ggcttcctatcccatctgagtg

SEQ ID NO: 7070427 - DNA, 22 bp, Homo sapiens
ggcttcctccttcctgctgtca

SEQ ID NO: 7070428 - DNA, 22 bp, Homo sapiens
ggcttcctggagaaggtctgag

SEQ ID NO: 7070429 - DNA, 22 bp, Homo sapiens
ggcttcctgggcatgtgttcta

SEQ ID NO: 7070430 - DNA, 22 bp, Homo sapiens
ggcttcctggggcctcctgcaa

SEQ ID NO: 7070431 - DNA, 22 bp, Homo sapiens
ggcttcctttcactaccctcag

SEQ ID NO: 7070432 - DNA, 22 bp, Homo sapiens
ggcttcctttcactaccctcag

SEQ ID NO: 7070433 - DNA, 19 bp, Homo sapiens
ggcttcgaggctggggaag

SEQ ID NO: 7070434 - DNA, 22 bp, Homo sapiens
ggcttctccaggtactgagcat

SEQ ID NO: 7070435 - DNA, 22 bp, Homo sapiens
ggctttgggattcagcatgaga

SEQ ID NO: 7070436 - DNA, 22 bp, Homo sapiens
ggctttggggtgtgcagagatg

SEQ ID NO: 7070437 - DNA, 22 bp, Homo sapiens
ggctggcttgccaagctcaggg

SEQ ID NO: 7070438 - DNA, 22 bp, Homo sapiens
ggctggctatctgtggttgcct

SEQ ID NO: 7070439 - DNA, 22 bp, Homo sapiens
ggctggctcagggcttgagaga

SEQ ID NO: 7070440 - DNA, 22 bp, Homo sapiens
ggctggctcatgcaaagggtga

SEQ ID NO: 7070441 - DNA, 19 bp, Homo sapiens
ggcttcagtttagcaggct

SEQ ID NO: 7070442 - DNA, 23 bp, Homo sapiens
ggcttcagtgagagtccctgctg

SEQ ID NO: 7070443 - DNA, 22 bp, Homo sapiens
ggcttcagtgagctgagctcac

SEQ ID NO: 7070444 - DNA, 22 bp, Homo sapiens
ggcttcaggggcccagtcagca

SEQ ID NO: 7070445 - DNA, 22 bp, Homo sapiens
ggcttccagctgggccttggag

SEQ ID NO: 7070446 - DNA, 22 bp, Homo sapiens
gggacgggcagtccaaggggtc

SEQ ID NO: 7070447 - DNA, 22 bp, Homo sapiens
gggacgtgagtgaagaaggtct

SEQ ID NO: 7070448 - DNA, 22 bp, Homo sapiens
gggagaagaatgtgtcaattgt

SEQ ID NO: 7070449 - DNA, 22 bp, Homo sapiens
gggagaaggagctagttcttga

SEQ ID NO: 7070450 - DNA, 22 bp, Homo sapiens
gggaccctcaacatctgcttct

SEQ ID NO: 7070451 - DNA, 22 bp, Homo sapiens
gggacctgcgccactcactgtc

SEQ ID NO: 7070452 - DNA, 22 bp, Homo sapiens
gggaggctggctctggccacag

SEQ ID NO: 7070453 - DNA, 22 bp, Homo sapiens
gggaggctgccatccttcagga

SEQ ID NO: 7070454 - DNA, 22 bp, Homo sapiens
gggaggctctgctcagcccccg

SEQ ID NO: 7070455 - DNA, 22 bp, Homo sapiens
gggaggctcagtggtgtcctct

SEQ ID NO: 7070456 - DNA, 22 bp, Homo sapiens
gggaggctcagtggtgtcctct

SEQ ID NO: 7070457 - DNA, 22 bp, Homo sapiens
gggaggcgccgagggtagctaa

SEQ ID NO: 7070458 - DNA, 20 bp, Homo sapiens
gggaggcgagggctgagcag

SEQ ID NO: 7070459 - DNA, 22 bp, Homo sapiens
gggaggagggtgctggctaaac

SEQ ID NO: 7070460 - DNA, 22 bp, Homo sapiens
gggagaagtggaaatctcatta

SEQ ID NO: 7070461 - DNA, 22 bp, Homo sapiens
gggagaaggagctagttcttga

SEQ ID NO: 7070462 - DNA, 22 bp, Homo sapiens
gggagaaggaggactgtgctgt

SEQ ID NO: 7070463 - DNA, 20 bp, Homo sapiens
gggagaagggctgatgagag

SEQ ID NO: 7070464 - DNA, 22 bp, Homo sapiens
gggatgaggatcaatcagggag

SEQ ID NO: 7070465 - DNA, 22 bp, Homo sapiens
gggatgatggaaaagtctgtta

SEQ ID NO: 7070466 - DNA, 22 bp, Homo sapiens
gggagggaaggtacctgtgtga

SEQ ID NO: 7070467 - DNA, 22 bp, Homo sapiens
gggagggaaggaggcgccgtgt

SEQ ID NO: 7070468 - DNA, 22 bp, Homo sapiens
gggagggaaagcttgatctgtc

SEQ ID NO: 7070469 - DNA, 22 bp, Homo sapiens
gggatggctgcctgcatcagga

SEQ ID NO: 7070470 - DNA, 22 bp, Homo sapiens
gggatggctcaaaggagtcagg

SEQ ID NO: 7070471 - DNA, 22 bp, Homo sapiens
gggatggggagctggaaagggg

SEQ ID NO: 7070472 - DNA, 22 bp, Homo sapiens
gggatggggagctggaaagggg

SEQ ID NO: 7070473 - DNA, 19 bp, Homo sapiens
gggatgggccctcaccctc

SEQ ID NO: 7070474 - DNA, 22 bp, Homo sapiens
gggatggggagctggaaagggg

SEQ ID NO: 7070475 - DNA, 22 bp, Homo sapiens
gggcagaggggcgcttccctct

SEQ ID NO: 7070476 - DNA, 22 bp, Homo sapiens
gggcagaggggcgcttccctct

SEQ ID NO: 7070477 - DNA, 18 bp, Homo sapiens
gggcagcacagcagcctc

SEQ ID NO: 7070478 - DNA, 22 bp, Homo sapiens
gggcagaggttcaacttcaaca

SEQ ID NO: 7070479 - DNA, 22 bp, Homo sapiens
gggcagaggttcaacttcaaca

SEQ ID NO: 7070480 - DNA, 20 bp, Homo sapiens
gggcagcctcgggagtgggt

SEQ ID NO: 7070481 - DNA, 22 bp, Homo sapiens
gggcagcctgctttctgatcca

SEQ ID NO: 7070482 - DNA, 22 bp, Homo sapiens
gggcgtggatggtcagtgcagg

SEQ ID NO: 7070483 - DNA, 22 bp, Homo sapiens
gggctaagtggatcagtcagga

SEQ ID NO: 7070484 - DNA, 22 bp, Homo sapiens
gggctgagagctggaatctgag

SEQ ID NO: 7070485 - DNA, 22 bp, Homo sapiens
gggctgagagctggaatctgag

SEQ ID NO: 7070486 - DNA, 22 bp, Homo sapiens
gggctgagacgatggggtcttc

SEQ ID NO: 7070487 - DNA, 22 bp, Homo sapiens
gggctgagacgatggggtcttc

SEQ ID NO: 7070488 - DNA, 22 bp, Homo sapiens
gggctgagaattcagctttcct

SEQ ID NO: 7070489 - DNA, 22 bp, Homo sapiens
gggctgagaattcagctttcct

SEQ ID NO: 7070490 - DNA, 22 bp, Homo sapiens
gggctgagacgatggggtcttc

SEQ ID NO: 7070491 - DNA, 22 bp, Homo sapiens
gggctgagaattcagctttcct

SEQ ID NO: 7070492 - DNA, 22 bp, Homo sapiens
gggctgagaattcagctttcct

SEQ ID NO: 7070493 - DNA, 22 bp, Homo sapiens
gggctgagaagttgatcccaag

SEQ ID NO: 7070494 - DNA, 22 bp, Homo sapiens
gggctagcctcttccctgctcc

SEQ ID NO: 7070495 - DNA, 22 bp, Homo sapiens
gggctagcctcttccctgctcc

SEQ ID NO: 7070496 - DNA, 22 bp, Homo sapiens
gggctctgggtcgtgtctccat

SEQ ID NO: 7070497 - DNA, 22 bp, Homo sapiens
gggctctgtggatgtgagagct

SEQ ID NO: 7070498 - DNA, 22 bp, Homo sapiens
ggggaagggagtccaagtgtta

SEQ ID NO: 7070499 - DNA, 23 bp, Homo sapiens
ggggaagtggcagtgagtgaggc

SEQ ID NO: 7070500 - DNA, 22 bp, Homo sapiens
ggggacagttaaagaccaagac

SEQ ID NO: 7070501 - DNA, 22 bp, Homo sapiens
ggggacagttaaagaccaagac

SEQ ID NO: 7070502 - DNA, 22 bp, Homo sapiens
ggggacagttaaagaccaagac

SEQ ID NO: 7070503 - DNA, 22 bp, Homo sapiens
gggctggagacaagtgagccgc

SEQ ID NO: 7070504 - DNA, 22 bp, Homo sapiens
gggctggagccagctgtggctg

SEQ ID NO: 7070505 - DNA, 22 bp, Homo sapiens
gggctggagcctggcggtggtt

SEQ ID NO: 7070506 - DNA, 17 bp, Homo sapiens
gggctggatggccatgg

SEQ ID NO: 7070507 - DNA, 22 bp, Homo sapiens
gggctggatgtttgatgacgaa

SEQ ID NO: 7070508 - DNA, 22 bp, Homo sapiens
gggctggcaggacctgggctga

SEQ ID NO: 7070509 - DNA, 22 bp, Homo sapiens
gggggctgtcctgtgcattgta

SEQ ID NO: 7070510 - DNA, 22 bp, Homo sapiens
ggggactgaggcactgaaggtg

SEQ ID NO: 7070511 - DNA, 22 bp, Homo sapiens
ggggactgccttccacagacac

SEQ ID NO: 7070512 - DNA, 22 bp, Homo sapiens
ggggaccctcaggactgcgtct

SEQ ID NO: 7070513 - DNA, 22 bp, Homo sapiens
ggggtaggcaggtgatctgatc

SEQ ID NO: 7070514 - DNA, 22 bp, Homo sapiens
gggggtgaggacaggagcactg

SEQ ID NO: 7070515 - DNA, 16 bp, Homo sapiens
gggggtgagagagagt

SEQ ID NO: 7070516 - DNA, 22 bp, Homo sapiens
gggggtgacgatggcagctggt

SEQ ID NO: 7070517 - DNA, 22 bp, Homo sapiens
ggggggtgacaagtagaggttg

SEQ ID NO: 7070518 - DNA, 20 bp, Homo sapiens
gggtgagatgtaggagaggg

SEQ ID NO: 7070519 - DNA, 22 bp, Homo sapiens
gggtgaagctcctgcaggggcc

SEQ ID NO: 7070520 - DNA, 22 bp, Homo sapiens
gggtctggcatgctgagatgga

SEQ ID NO: 7070521 - DNA, 22 bp, Homo sapiens
gggtgggatgccgctgtctcca

SEQ ID NO: 7070522 - DNA, 22 bp, Homo sapiens
gggtgggaacaggatgccagga

SEQ ID NO: 7070523 - DNA, 19 bp, Homo sapiens
gggtgaggaagagcgttgc

SEQ ID NO: 7070524 - DNA, 22 bp, Homo sapiens
ggagggctgagactggggtctg

SEQ ID NO: 7070525 - DNA, 22 bp, Homo sapiens
ggagggctgccaggtggagcgg

SEQ ID NO: 7070526 - DNA, 22 bp, Homo sapiens
ggagggctcaattgactcctga

SEQ ID NO: 7070527 - DNA, 22 bp, Homo sapiens
ggagggctccctgggagtggat

SEQ ID NO: 7070528 - DNA, 22 bp, Homo sapiens
ggagggctgccaggtggagcgg

SEQ ID NO: 7070529 - DNA, 22 bp, Homo sapiens
ggagggctgccaggtggagcgg

SEQ ID NO: 7070530 - DNA, 22 bp, Homo sapiens
ggaggggaactaatcccgtgac

SEQ ID NO: 7070531 - DNA, 22 bp, Homo sapiens
ggagggcccctccagtgggcag

SEQ ID NO: 7070532 - DNA, 22 bp, Homo sapiens
ggagggccatcttgggtgtgat

SEQ ID NO: 7070533 - DNA, 22 bp, Homo sapiens
ggagggcccctccagtgggcag

SEQ ID NO: 7070534 - DNA, 20 bp, Homo sapiens
ggagggcagctgagagttgg

SEQ ID NO: 7070535 - DNA, 22 bp, Homo sapiens
ggagggaatgtctagcattctt

SEQ ID NO: 7070536 - DNA, 22 bp, Homo sapiens
ggagggacccactctagaggtg

SEQ ID NO: 7070537 - DNA, 22 bp, Homo sapiens
ggagggacccactctagaggtg

SEQ ID NO: 7070538 - DNA, 22 bp, Homo sapiens
ggagggacccactgcggtgacc

SEQ ID NO: 7070539 - DNA, 22 bp, Homo sapiens
ggagggagagtgaccctaccaa

SEQ ID NO: 7070540 - DNA, 22 bp, Homo sapiens
ggaggctgagaagtccaagatc

SEQ ID NO: 7070541 - DNA, 22 bp, Homo sapiens
ggaggctgagaagtccaagatc

SEQ ID NO: 7070542 - DNA, 22 bp, Homo sapiens
ggaggctgagaagtccaagatc

SEQ ID NO: 7070543 - DNA, 22 bp, Homo sapiens
ggaggctgagaggtcgcagtgg

SEQ ID NO: 7070544 - DNA, 22 bp, Homo sapiens
ggaggctgaggcccctcacagg

SEQ ID NO: 7070545 - DNA, 22 bp, Homo sapiens
ggaggctgctgcctcacgtggg

SEQ ID NO: 7070546 - DNA, 22 bp, Homo sapiens
ggaggctgctgcctcacgtggg

SEQ ID NO: 7070547 - DNA, 22 bp, Homo sapiens
ggaggctgaggcccctcacagg

SEQ ID NO: 7070548 - DNA, 22 bp, Homo sapiens
ggaggctgaggcccctcacagg

SEQ ID NO: 7070549 - DNA, 22 bp, Homo sapiens
ggaggctgaggcccctcacagg

SEQ ID NO: 7070550 - DNA, 22 bp, Homo sapiens
ggaggctgaggcaggcggatca

SEQ ID NO: 7070551 - DNA, 22 bp, Homo sapiens
ggaggctgaggcaggcggatca

SEQ ID NO: 7070552 - DNA, 22 bp, Homo sapiens
ggaggctgagaggtcgcagtgg

SEQ ID NO: 7070553 - DNA, 22 bp, Homo sapiens
ggaggcggaggttgcagtgagt

SEQ ID NO: 7070554 - DNA, 22 bp, Homo sapiens
ggaggcggaggttgcagtgagc

SEQ ID NO: 7070555 - DNA, 22 bp, Homo sapiens
ggaggcggaggttgcagtgagt

SEQ ID NO: 7070556 - DNA, 22 bp, Homo sapiens
ggagggggaaactttggctgcc

SEQ ID NO: 7070557 - DNA, 22 bp, Homo sapiens
ggaggggagatgtttgggctca

SEQ ID NO: 7070558 - DNA, 22 bp, Homo sapiens
ggaggggtggtcacctggcagg

SEQ ID NO: 7070559 - DNA, 22 bp, Homo sapiens
ggaggggtggtcgcgaagagca

SEQ ID NO: 7070560 - DNA, 22 bp, Homo sapiens
ggagggtccactgtgaggcaga

SEQ ID NO: 7070561 - DNA, 22 bp, Homo sapiens
ggagggtccactgtgaggcaga

SEQ ID NO: 7070562 - DNA, 22 bp, Homo sapiens
ggagggtgcttaagttgtgttt

SEQ ID NO: 7070563 - DNA, 22 bp, Homo sapiens
ggaggggtgagaatggctgcct

SEQ ID NO: 7070564 - DNA, 22 bp, Homo sapiens
ggaggggtgctcagctgtcacg

SEQ ID NO: 7070565 - DNA, 22 bp, Homo sapiens
ggaggggtgctcagctgtcacg

SEQ ID NO: 7070566 - DNA, 22 bp, Homo sapiens
ggaggggtggaaggagtgcctg

SEQ ID NO: 7070567 - DNA, 22 bp, Homo sapiens
ggaggggtctctagcgaggaga

SEQ ID NO: 7070568 - DNA, 22 bp, Homo sapiens
ggaggggtctctagcgaggaga

SEQ ID NO: 7070569 - DNA, 23 bp, Homo sapiens
ggaggtcagtgcctgagggtgag

SEQ ID NO: 7070570 - DNA, 22 bp, Homo sapiens
ggaggtcatagctgtgcaggta

SEQ ID NO: 7070571 - DNA, 22 bp, Homo sapiens
ggaggtcacgactgggatgcct

SEQ ID NO: 7070572 - DNA, 22 bp, Homo sapiens
ggaggtcacgactgggatgcct

SEQ ID NO: 7070573 - DNA, 22 bp, Homo sapiens
ggaggtcatagctgtgcaggta

SEQ ID NO: 7070574 - DNA, 22 bp, Homo sapiens
ggaggtggaggttgcagtgagc

SEQ ID NO: 7070575 - DNA, 22 bp, Homo sapiens
ggaggtggaggttgcagtgagc

SEQ ID NO: 7070576 - DNA, 22 bp, Homo sapiens
ggaggtggcagagggacattct

SEQ ID NO: 7070577 - DNA, 22 bp, Homo sapiens
ggaggtggcagagggacattct

SEQ ID NO: 7070578 - DNA, 22 bp, Homo sapiens
ggaggtggcagagggacattct

SEQ ID NO: 7070579 - DNA, 22 bp, Homo sapiens
ggaggtggcagagggacattct

SEQ ID NO: 7070580 - DNA, 20 bp, Homo sapiens
ggagggtggaagaaagcaag

SEQ ID NO: 7070581 - DNA, 22 bp, Homo sapiens
ggagggtggcagcgtcctgggc

SEQ ID NO: 7070582 - DNA, 22 bp, Homo sapiens
ggagggtggcagcgtcctgggc

SEQ ID NO: 7070583 - DNA, 20 bp, Homo sapiens
ggaggtcaaatgatgagaag

SEQ ID NO: 7070584 - DNA, 22 bp, Homo sapiens
ggaggtcaaatggagggctggg

SEQ ID NO: 7070585 - DNA, 22 bp, Homo sapiens
ggaggtcaaatggagggctggg

SEQ ID NO: 7070586 - DNA, 22 bp, Homo sapiens
ggaggtggcctgaaaatgtggc

SEQ ID NO: 7070587 - DNA, 22 bp, Homo sapiens
ggaggtggcagggaacataatt

SEQ ID NO: 7070588 - DNA, 22 bp, Homo sapiens
ggaggtggcctgaaaatgtggc

SEQ ID NO: 7070589 - DNA, 22 bp, Homo sapiens
ggaggtgggagacataggcggc

SEQ ID NO: 7070590 - DNA, 22 bp, Homo sapiens
ggaggtgggagtttagttcttg

SEQ ID NO: 7070591 - DNA, 22 bp, Homo sapiens
ggaggtgggagtttagttcttg

SEQ ID NO: 7070592 - DNA, 22 bp, Homo sapiens
ggaggtgggattaggacctaaa

SEQ ID NO: 7070593 - DNA, 22 bp, Homo sapiens
ggaggtgggagcctccagtggt

SEQ ID NO: 7070594 - DNA, 22 bp, Homo sapiens
ggagtagctgcattccgagcac

SEQ ID NO: 7070595 - DNA, 22 bp, Homo sapiens
ggaggtggtggcagtgacaatt

SEQ ID NO: 7070596 - DNA, 22 bp, Homo sapiens
ggaggtggtttgatttctatat

SEQ ID NO: 7070597 - DNA, 22 bp, Homo sapiens
ggaggtggtttgatttctatat

SEQ ID NO: 7070598 - DNA, 22 bp, Homo sapiens
ggaggtggtggcagtgacaatt

SEQ ID NO: 7070599 - DNA, 16 bp, Homo sapiens
ggaggtgggtaaggtg

SEQ ID NO: 7070600 - DNA, 22 bp, Homo sapiens
ggaggtgggctaaggactctct

SEQ ID NO: 7070601 - DNA, 22 bp, Homo sapiens
ggaggtgggctaaggactctct

SEQ ID NO: 7070602 - DNA, 22 bp, Homo sapiens
ggaggtgggctaaggactctct

SEQ ID NO: 7070603 - DNA, 22 bp, Homo sapiens
ggcaggcagcctccatccacag

SEQ ID NO: 7070604 - DNA, 22 bp, Homo sapiens
ggcaggcattgcaacatgtaca

SEQ ID NO: 7070605 - DNA, 22 bp, Homo sapiens
ggcaggcctgagaggcagggct

SEQ ID NO: 7070606 - DNA, 22 bp, Homo sapiens
ggcaggcgtggtggcctcagaa

SEQ ID NO: 7070607 - DNA, 22 bp, Homo sapiens
ggcaggctgcttgggtcatgtc

SEQ ID NO: 7070608 - DNA, 22 bp, Homo sapiens
ggcaggctggctttgttccagg

SEQ ID NO: 7070609 - DNA, 17 bp, Homo sapiens
ggcaggtgcggggccgc

SEQ ID NO: 7070610 - DNA, 22 bp, Homo sapiens
ggcaggtgctaagagaggtaaa

SEQ ID NO: 7070611 - DNA, 20 bp, Homo sapiens
ggcaggtgctcgcttggtct

SEQ ID NO: 7070612 - DNA, 22 bp, Homo sapiens
ggcaggtgctctgtgggcctgg

SEQ ID NO: 7070613 - DNA, 22 bp, Homo sapiens
ggcagaggaagctggaagtggg

SEQ ID NO: 7070614 - DNA, 22 bp, Homo sapiens
ggcagaggaagctggaagtggg

SEQ ID NO: 7070615 - DNA, 22 bp, Homo sapiens
ggcagaggaagctggaagtggg

SEQ ID NO: 7070616 - DNA, 22 bp, Homo sapiens
ggcagctgcaaatctgctctgt

SEQ ID NO: 7070617 - DNA, 19 bp, Homo sapiens
ggcagctggacgctgttca

SEQ ID NO: 7070618 - DNA, 22 bp, Homo sapiens
ggcagctggggcagtgccctgt

SEQ ID NO: 7070619 - DNA, 22 bp, Homo sapiens
ggcaggcagatggctgcaccaa

SEQ ID NO: 7070620 - DNA, 22 bp, Homo sapiens
ggcagaggaagctggaagtggg

SEQ ID NO: 7070621 - DNA, 23 bp, Homo sapiens
ggcagagagcatggctggggccc

SEQ ID NO: 7070622 - DNA, 23 bp, Homo sapiens
ggcagagagcatggctggggccc

SEQ ID NO: 7070623 - DNA, 23 bp, Homo sapiens
ggcagagagcatggctggggccc

SEQ ID NO: 7070624 - DNA, 22 bp, Homo sapiens
ggcagagacaccgaatgactct

SEQ ID NO: 7070625 - DNA, 22 bp, Homo sapiens
ggcagagacaccgaatgactct

SEQ ID NO: 7070626 - DNA, 22 bp, Homo sapiens
ggcagagactgggttggcagag

SEQ ID NO: 7070627 - DNA, 22 bp, Homo sapiens
ggcagacacctttatgtctaat

SEQ ID NO: 7070628 - DNA, 22 bp, Homo sapiens
ggcagacctctccagccccaca

SEQ ID NO: 7070629 - DNA, 22 bp, Homo sapiens
ggcagagaatctggctgtttac

SEQ ID NO: 7070630 - DNA, 22 bp, Homo sapiens
ggcacagagctccagccttggc

SEQ ID NO: 7070631 - DNA, 22 bp, Homo sapiens
ggcacagagttggcagagctgc

SEQ ID NO: 7070632 - DNA, 22 bp, Homo sapiens
ggagtggcagcgaggatcagat

SEQ ID NO: 7070633 - DNA, 22 bp, Homo sapiens
ggagtggcagagagggtatact

SEQ ID NO: 7070634 - DNA, 22 bp, Homo sapiens
ggagtggcagcgaggatcagat

SEQ ID NO: 7070635 - DNA, 22 bp, Homo sapiens
ggagtggcactctgaggcgggg

SEQ ID NO: 7070636 - DNA, 22 bp, Homo sapiens
ggagtggcagagagggtatact

SEQ ID NO: 7070637 - DNA, 22 bp, Homo sapiens
ggagtggcagctaggctgtcag

SEQ ID NO: 7070638 - DNA, 22 bp, Homo sapiens
ggagtggccacgactgggagat

SEQ ID NO: 7070639 - DNA, 22 bp, Homo sapiens
ggagtggctatttgtgctggtt

SEQ ID NO: 7070640 - DNA, 22 bp, Homo sapiens
ggagtggcctctcctgtgcagg

SEQ ID NO: 7070641 - DNA, 22 bp, Homo sapiens
ggagtgggaacaatgacatggt

SEQ ID NO: 7070642 - DNA, 22 bp, Homo sapiens
ggagtggctatttgtgctggtt

SEQ ID NO: 7070643 - DNA, 22 bp, Homo sapiens
ggagtgggcagcactgccctgt

SEQ ID NO: 7070644 - DNA, 22 bp, Homo sapiens
ggagtggtggtcaggccatggc

SEQ ID NO: 7070645 - DNA, 22 bp, Homo sapiens
ggagtggtggtcaggccatggc

SEQ ID NO: 7070646 - DNA, 22 bp, Homo sapiens
ggagtggtgtcactgagaggaa

SEQ ID NO: 7070647 - DNA, 22 bp, Homo sapiens
ggagtggtgtcactgagaggaa

SEQ ID NO: 7070648 - DNA, 22 bp, Homo sapiens
ggagtggtgtcactgagaggaa

SEQ ID NO: 7070649 - DNA, 22 bp, Homo sapiens
ggagtgtggagaggacatgggt

SEQ ID NO: 7070650 - DNA, 22 bp, Homo sapiens
ggagttcactgtgcaggctctg

SEQ ID NO: 7070651 - DNA, 22 bp, Homo sapiens
ggcaaggccttgcccagcattc

SEQ ID NO: 7070652 - DNA, 22 bp, Homo sapiens
ggcacacatagatctgcactgg

SEQ ID NO: 7070653 - DNA, 22 bp, Homo sapiens
ggagacagggttgaaccacgca

SEQ ID NO: 7070654 - DNA, 17 bp, Homo sapiens
ggagacagggtctttaa

SEQ ID NO: 7070655 - DNA, 22 bp, Homo sapiens
ggagacagcaggaagaaatatc

SEQ ID NO: 7070656 - DNA, 22 bp, Homo sapiens
ggagaaggtggctcagcaaagg

SEQ ID NO: 7070657 - DNA, 22 bp, Homo sapiens
ggagaatgatatatagctcagt

SEQ ID NO: 7070658 - DNA, 22 bp, Homo sapiens
ggagaatgattctttgctcact

SEQ ID NO: 7070659 - DNA, 22 bp, Homo sapiens
ggagacacccacattgctgggt

SEQ ID NO: 7070660 - DNA, 22 bp, Homo sapiens
ggagaaggaatattggagtagg

SEQ ID NO: 7070661 - DNA, 21 bp, Homo sapiens
ggagaaggacaatgttgagta

SEQ ID NO: 7070662 - DNA, 22 bp, Homo sapiens
ggaataaagaatctggttcccc

SEQ ID NO: 7070663 - DNA, 22 bp, Homo sapiens
ggagaagcaggtgctttgggtc

SEQ ID NO: 7070664 - DNA, 19 bp, Homo sapiens
ggagaagcatctagaaata

SEQ ID NO: 7070665 - DNA, 22 bp, Homo sapiens
ggagaagccacacattgggtgt

SEQ ID NO: 7070666 - DNA, 22 bp, Homo sapiens
ggagaagccaggtgataagcaa

SEQ ID NO: 7070667 - DNA, 19 bp, Homo sapiens
ggagaagcccaggaatcct

SEQ ID NO: 7070668 - DNA, 22 bp, Homo sapiens
ggagaggtgaatggctgctcta

SEQ ID NO: 7070669 - DNA, 22 bp, Homo sapiens
ggagaggtgcaggtcagtggca

SEQ ID NO: 7070670 - DNA, 22 bp, Homo sapiens
ggagaggtgtattcagtgggtc

SEQ ID NO: 7070671 - DNA, 22 bp, Homo sapiens
ggagagggtaggggtcctgccc

SEQ ID NO: 7070672 - DNA, 22 bp, Homo sapiens
ggagagggtaggggtcctgccc

SEQ ID NO: 7070673 - DNA, 23 bp, Homo sapiens
ggagaggggtgtgggcatcttta

SEQ ID NO: 7070674 - DNA, 22 bp, Homo sapiens
ggagagggggctccctgcttgg

SEQ ID NO: 7070675 - DNA, 22 bp, Homo sapiens
ggagaggggaacttgttgcttg

SEQ ID NO: 7070676 - DNA, 22 bp, Homo sapiens
ggagcctggtcaggttggctcc

SEQ ID NO: 7070677 - DNA, 22 bp, Homo sapiens
ggagatgctttccagtggggat

SEQ ID NO: 7070678 - DNA, 22 bp, Homo sapiens
ggagatgcaatgtagaatctgg

SEQ ID NO: 7070679 - DNA, 20 bp, Homo sapiens
ggagatgcagcccaggtgcc

SEQ ID NO: 7070680 - DNA, 22 bp, Homo sapiens
ggagatgccagaattgcaaatt

SEQ ID NO: 7070681 - DNA, 22 bp, Homo sapiens
ggagatgccagaattgcaaatt

SEQ ID NO: 7070682 - DNA, 22 bp, Homo sapiens
ggagatgctatgtagtttggtt

SEQ ID NO: 7070683 - DNA, 22 bp, Homo sapiens
ggaggcagaatagagtgtgggt

SEQ ID NO: 7070684 - DNA, 22 bp, Homo sapiens
ggaggcagaatagagtgtgggt

SEQ ID NO: 7070685 - DNA, 22 bp, Homo sapiens
ggaggaggcaagtaccagatgc

SEQ ID NO: 7070686 - DNA, 22 bp, Homo sapiens
ggaggaggcaagtaccagatgc

SEQ ID NO: 7070687 - DNA, 22 bp, Homo sapiens
ggaggccacctgacctgctgtt

SEQ ID NO: 7070688 - DNA, 22 bp, Homo sapiens
ggaggccaggaagagccgccct

SEQ ID NO: 7070689 - DNA, 22 bp, Homo sapiens
ggaggccagcctgaggctgagg

SEQ ID NO: 7070690 - DNA, 22 bp, Homo sapiens
ggaggccatcagggagggcatt

SEQ ID NO: 7070691 - DNA, 22 bp, Homo sapiens
ggaggccatgaggctctaggtg

SEQ ID NO: 7070692 - DNA, 22 bp, Homo sapiens
ggagctcagtggggggactgtg

SEQ ID NO: 7070693 - DNA, 22 bp, Homo sapiens
ggaggaagaggttgttctctca

SEQ ID NO: 7070694 - DNA, 22 bp, Homo sapiens
ggaggaagcacacggcttgtat

SEQ ID NO: 7070695 - DNA, 22 bp, Homo sapiens
ggaggaagtgcagttctactac

SEQ ID NO: 7070696 - DNA, 22 bp, Homo sapiens
ggaggacactggctctgccttc

SEQ ID NO: 7070697 - DNA, 22 bp, Homo sapiens
ggaggacaggggctgcagcaca

SEQ ID NO: 7070698 - DNA, 22 bp, Homo sapiens
ggaggacaggggctgcagcaca

SEQ ID NO: 7070699 - DNA, 22 bp, Homo sapiens
ggaggagcatgagagggtagtg

SEQ ID NO: 7070700 - DNA, 22 bp, Homo sapiens
ggaggactcaggtctggccatg

SEQ ID NO: 7070701 - DNA, 22 bp, Homo sapiens
ggaggagcccactcaaagggga

SEQ ID NO: 7070702 - DNA, 22 bp, Homo sapiens
ggaggagctgctgtgggggccc

SEQ ID NO: 7070703 - DNA, 22 bp, Homo sapiens
ggaaaactgaggctctcagcag

SEQ ID NO: 7070704 - DNA, 22 bp, Homo sapiens
ggaaagagctaaaagggtgaga

SEQ ID NO: 7070705 - DNA, 22 bp, Homo sapiens
ggaaagagggacccagcttggt

SEQ ID NO: 7070706 - DNA, 22 bp, Homo sapiens
ggaaagccaggtgctctggtgt

SEQ ID NO: 7070707 - DNA, 22 bp, Homo sapiens
ggaactcctgctccaagcagct

SEQ ID NO: 7070708 - DNA, 22 bp, Homo sapiens
ggaagaaaatgggcaacaggtg

SEQ ID NO: 7070709 - DNA, 22 bp, Homo sapiens
ggaagaaagacatttattttga

SEQ ID NO: 7070710 - DNA, 22 bp, Homo sapiens
ggaagaaagcacacaaacttga

SEQ ID NO: 7070711 - DNA, 22 bp, Homo sapiens
ggaagaaaggtggacaacaggt

SEQ ID NO: 7070712 - DNA, 22 bp, Homo sapiens
ggaagaaatctggttaagagat

SEQ ID NO: 7070713 - DNA, 22 bp, Homo sapiens
ggaagaaatgctcttctatgcg

SEQ ID NO: 7070714 - DNA, 22 bp, Homo sapiens
ggaagggcaataaaatctcagg

SEQ ID NO: 7070715 - DNA, 21 bp, Homo sapiens
ggaaggggtcctcccaacagt

SEQ ID NO: 7070716 - DNA, 22 bp, Homo sapiens
gctgggctgcgtcggggaagcc

SEQ ID NO: 7070717 - DNA, 22 bp, Homo sapiens
gcttaattctggctcagtttcc

SEQ ID NO: 7070718 - DNA, 22 bp, Homo sapiens
gctgggctgagctagacttggc

SEQ ID NO: 7070719 - DNA, 22 bp, Homo sapiens
gctgggctgcccaacctctgac

SEQ ID NO: 7070720 - DNA, 22 bp, Homo sapiens
gcttacaggtgaggcagcaaga

SEQ ID NO: 7070721 - DNA, 22 bp, Homo sapiens
gcttagaagtacacatgccttt

SEQ ID NO: 7070722 - DNA, 22 bp, Homo sapiens
gctgggctccaggccagggtga

SEQ ID NO: 7070723 - DNA, 22 bp, Homo sapiens
gctgggccagagcagcagcact

SEQ ID NO: 7070724 - DNA, 22 bp, Homo sapiens
gctgggctcagacctagtgaac

SEQ ID NO: 7070725 - DNA, 22 bp, Homo sapiens
gctgggctcagacctagtgaac

SEQ ID NO: 7070726 - DNA, 22 bp, Homo sapiens
gctgggctctgtcatgccttcc

SEQ ID NO: 7070727 - DNA, 22 bp, Homo sapiens
gctgggctcttatcacctgtac

SEQ ID NO: 7070728 - DNA, 22 bp, Homo sapiens
gctgggctcttatcacctgtac

SEQ ID NO: 7070729 - DNA, 22 bp, Homo sapiens
gcttcatttgagaacctctgtg

SEQ ID NO: 7070730 - DNA, 22 bp, Homo sapiens
gcttcattactgacagtctgtg

SEQ ID NO: 7070731 - DNA, 22 bp, Homo sapiens
gcttccttccttacattggtgg

SEQ ID NO: 7070732 - DNA, 22 bp, Homo sapiens
gcttccttattgttgccatagt

SEQ ID NO: 7070733 - DNA, 22 bp, Homo sapiens
gcttcctgtaggcaggtccaag

SEQ ID NO: 7070734 - DNA, 22 bp, Homo sapiens
gcttcctgtatcctcctgtacc

SEQ ID NO: 7070735 - DNA, 22 bp, Homo sapiens
gcttcctgtccaggccccacat

SEQ ID NO: 7070736 - DNA, 17 bp, Homo sapiens
gcttcctgtgctgggga

SEQ ID NO: 7070737 - DNA, 22 bp, Homo sapiens
gcttcgctgctagctagttggt

SEQ ID NO: 7070738 - DNA, 22 bp, Homo sapiens
gcttcggggtccaagcgcgtgt

SEQ ID NO: 7070739 - DNA, 22 bp, Homo sapiens
gcttcggggtccaagcgcgtgt

SEQ ID NO: 7070740 - DNA, 22 bp, Homo sapiens
gcttctgctgttgaagccacca

SEQ ID NO: 7070741 - DNA, 22 bp, Homo sapiens
gctcagaaatggcagatggaga

SEQ ID NO: 7070742 - DNA, 22 bp, Homo sapiens
gctcagaagatatttgatgctg

SEQ ID NO: 7070743 - DNA, 22 bp, Homo sapiens
gctcagagatgttcagtagctt

SEQ ID NO: 7070744 - DNA, 22 bp, Homo sapiens
gctcagagcatcccagtgaatg

SEQ ID NO: 7070745 - DNA, 19 bp, Homo sapiens
gctcagagccatgggggct

SEQ ID NO: 7070746 - DNA, 22 bp, Homo sapiens
gctcatgactgtaatcccagca

SEQ ID NO: 7070747 - DNA, 22 bp, Homo sapiens
gctcatgggcccagagcagccc

SEQ ID NO: 7070748 - DNA, 22 bp, Homo sapiens
gctcactgcaacctccgccttc

SEQ ID NO: 7070749 - DNA, 22 bp, Homo sapiens
gctcactgcaacctctgcctcc

SEQ ID NO: 7070750 - DNA, 22 bp, Homo sapiens
gctcactgcaacctctgcctcc

SEQ ID NO: 7070751 - DNA, 22 bp, Homo sapiens
gctcactgcaacctctgcctcc

SEQ ID NO: 7070752 - DNA, 22 bp, Homo sapiens
gctcactgcaacctctgcctcc

SEQ ID NO: 7070753 - DNA, 22 bp, Homo sapiens
gctcactgcaacctctgcttcc

SEQ ID NO: 7070754 - DNA, 22 bp, Homo sapiens
gctcactgcaacctctgcttcc

SEQ ID NO: 7070755 - DNA, 22 bp, Homo sapiens
gctcactgcaacctctgcttcc

SEQ ID NO: 7070756 - DNA, 22 bp, Homo sapiens
gctcactgcaacctctgcttcc

SEQ ID NO: 7070757 - DNA, 22 bp, Homo sapiens
gctcactgcaagctccgcctcc

SEQ ID NO: 7070758 - DNA, 22 bp, Homo sapiens
gctcactgcaagctccgcctcc

SEQ ID NO: 7070759 - DNA, 22 bp, Homo sapiens
gctcactgcaagctctgcctcc

SEQ ID NO: 7070760 - DNA, 22 bp, Homo sapiens
gctcactgcaagctctgcctcc

SEQ ID NO: 7070761 - DNA, 22 bp, Homo sapiens
gctcactgcaagctctgcctcc

SEQ ID NO: 7070762 - DNA, 22 bp, Homo sapiens
gctcactgcaagctctgcctcc

SEQ ID NO: 7070763 - DNA, 22 bp, Homo sapiens
gctcactgccattctctagatg

SEQ ID NO: 7070764 - DNA, 22 bp, Homo sapiens
gctcactgccattctctagatg

SEQ ID NO: 7070765 - DNA, 22 bp, Homo sapiens
gctcactgcctgggcaacaaga

SEQ ID NO: 7070766 - DNA, 22 bp, Homo sapiens
gctcactggcctgaagaggacg

SEQ ID NO: 7070767 - DNA, 22 bp, Homo sapiens
gctcactggcctgaagaggacg

SEQ ID NO: 7070768 - DNA, 22 bp, Homo sapiens
gctcctggctccaggcagccaa

SEQ ID NO: 7070769 - DNA, 22 bp, Homo sapiens
gctcctctgtcaaatgagagtg

SEQ ID NO: 7070770 - DNA, 21 bp, Homo sapiens
gctcatggtggagaaaagcag

SEQ ID NO: 7070771 - DNA, 22 bp, Homo sapiens
gctgagagtgggtgcagtgctt

SEQ ID NO: 7070772 - DNA, 22 bp, Homo sapiens
gctgagagtgggtgcagtgctt

SEQ ID NO: 7070773 - DNA, 18 bp, Homo sapiens
gctgagcaaattcctccc

SEQ ID NO: 7070774 - DNA, 22 bp, Homo sapiens
gctgagattacgggcatgagcc

SEQ ID NO: 7070775 - DNA, 22 bp, Homo sapiens
gctgagcacacctagggtagag

SEQ ID NO: 7070776 - DNA, 22 bp, Homo sapiens
gctgagcagggtggggaaaggc

SEQ ID NO: 7070777 - DNA, 22 bp, Homo sapiens
gctcttccatttctcttgaact

SEQ ID NO: 7070778 - DNA, 22 bp, Homo sapiens
gctctgtgttccctccaggctc

SEQ ID NO: 7070779 - DNA, 22 bp, Homo sapiens
gctcctggcttcactgacatca

SEQ ID NO: 7070780 - DNA, 19 bp, Homo sapiens
gctcctgggcctcactcat

SEQ ID NO: 7070781 - DNA, 19 bp, Homo sapiens
gctcctgggcctcactcat

SEQ ID NO: 7070782 - DNA, 22 bp, Homo sapiens
gctctctttaaactgcatggct

SEQ ID NO: 7070783 - DNA, 21 bp, Homo sapiens
gctggagagccaggcaggggc

SEQ ID NO: 7070784 - DNA, 21 bp, Homo sapiens
gctggagagccaggcaggggc

SEQ ID NO: 7070785 - DNA, 22 bp, Homo sapiens
gctgctgcctgtagccagggtg

SEQ ID NO: 7070786 - DNA, 22 bp, Homo sapiens
gctgctctgggtctgcccagct

SEQ ID NO: 7070787 - DNA, 22 bp, Homo sapiens
gctgctctgtgacagcctccgg

SEQ ID NO: 7070788 - DNA, 22 bp, Homo sapiens
gctgctctgtgacagcctccgg

SEQ ID NO: 7070789 - DNA, 22 bp, Homo sapiens
gctgctgagaattgcaggcaag

SEQ ID NO: 7070790 - DNA, 22 bp, Homo sapiens
gctgctgcaagagccagctctt

SEQ ID NO: 7070791 - DNA, 22 bp, Homo sapiens
gctgcctggtttctcagctgca

SEQ ID NO: 7070792 - DNA, 20 bp, Homo sapiens
gctgctcgctgcagtcactc

SEQ ID NO: 7070793 - DNA, 22 bp, Homo sapiens
gctgctctcagagctcatgctg

SEQ ID NO: 7070794 - DNA, 22 bp, Homo sapiens
gctgctctccaagcctccttga

SEQ ID NO: 7070795 - DNA, 22 bp, Homo sapiens
gctgctctccaagcctccttga

SEQ ID NO: 7070796 - DNA, 22 bp, Homo sapiens
gctgctctccatggccgtgagt

SEQ ID NO: 7070797 - DNA, 22 bp, Homo sapiens
gctgctctctccctaagttggg

SEQ ID NO: 7070798 - DNA, 22 bp, Homo sapiens
gctgctctgaaaatgactgttg

SEQ ID NO: 7070799 - DNA, 22 bp, Homo sapiens
gctgctctggctctgcagtgtc

SEQ ID NO: 7070800 - DNA, 19 bp, Homo sapiens
gctgctctgggtctcatct

SEQ ID NO: 7070801 - DNA, 19 bp, Homo sapiens
gctgctctgggtctcatct

SEQ ID NO: 7070802 - DNA, 22 bp, Homo sapiens
gctgagccacaggcagtgcact

SEQ ID NO: 7070803 - DNA, 22 bp, Homo sapiens
gctgagcaggtgtaaggaaggc

SEQ ID NO: 7070804 - DNA, 22 bp, Homo sapiens
gctgagcaggtttgatgctttt

SEQ ID NO: 7070805 - DNA, 22 bp, Homo sapiens
gctgagctagaaaaggaccaca

SEQ ID NO: 7070806 - DNA, 22 bp, Homo sapiens
gctgagctagaaaaggaccaca

SEQ ID NO: 7070807 - DNA, 22 bp, Homo sapiens
gctgaggaggtgtggttaggtg

SEQ ID NO: 7070808 - DNA, 22 bp, Homo sapiens
gctgaggatatagcaggaacaa

SEQ ID NO: 7070809 - DNA, 22 bp, Homo sapiens
gctgaggatatagcaggaacaa

SEQ ID NO: 7070810 - DNA, 22 bp, Homo sapiens
gctgaggatatagcaggaacaa

SEQ ID NO: 7070811 - DNA, 22 bp, Homo sapiens
gctgaggattacttgaagtcag

SEQ ID NO: 7070812 - DNA, 22 bp, Homo sapiens
gctgaggattacttgaagtcag

SEQ ID NO: 7070813 - DNA, 20 bp, Homo sapiens
gctgaggattcctggcccct

SEQ ID NO: 7070814 - DNA, 20 bp, Homo sapiens
gctgaggattcctggcccct

SEQ ID NO: 7070815 - DNA, 22 bp, Homo sapiens
gctgaggattgaagagttgcca

SEQ ID NO: 7070816 - DNA, 22 bp, Homo sapiens
gctgaggattgaagagttgcca

SEQ ID NO: 7070817 - DNA, 22 bp, Homo sapiens
gctgaggcaaaccaagaatgta

SEQ ID NO: 7070818 - DNA, 22 bp, Homo sapiens
gctgcctgatcatacaccaggg

SEQ ID NO: 7070819 - DNA, 22 bp, Homo sapiens
gctgcctgctcacccggcctgg

SEQ ID NO: 7070820 - DNA, 22 bp, Homo sapiens
gctgcctgctcggctcctggga

SEQ ID NO: 7070821 - DNA, 22 bp, Homo sapiens
gctgcctggaataacggctggc

SEQ ID NO: 7070822 - DNA, 22 bp, Homo sapiens
gctgcctggagctcagcctgcc

SEQ ID NO: 7070823 - DNA, 22 bp, Homo sapiens
gctgcctggagctcagcctgcc

SEQ ID NO: 7070824 - DNA, 22 bp, Homo sapiens
gctgggcaacggaagagagaaa

SEQ ID NO: 7070825 - DNA, 22 bp, Homo sapiens
gctgggatgcgtcttcccaggc

SEQ ID NO: 7070826 - DNA, 22 bp, Homo sapiens
gctgggagttactgtctccttt

SEQ ID NO: 7070827 - DNA, 22 bp, Homo sapiens
gctgggagtttgatttgactgg

SEQ ID NO: 7070828 - DNA, 22 bp, Homo sapiens
gctgggagtgggcaagatgaga

SEQ ID NO: 7070829 - DNA, 22 bp, Homo sapiens
gctgggagttactgtctccttt

SEQ ID NO: 7070830 - DNA, 22 bp, Homo sapiens
gctgggcagcaggctctccggg

SEQ ID NO: 7070831 - DNA, 22 bp, Homo sapiens
gctgggcactgtcccataggct

SEQ ID NO: 7070832 - DNA, 22 bp, Homo sapiens
gctgggcaccggagagacccca

SEQ ID NO: 7070833 - DNA, 22 bp, Homo sapiens
gctgggcaccggagagacccca

SEQ ID NO: 7070834 - DNA, 22 bp, Homo sapiens
gctgggcaatgccagagaggag

SEQ ID NO: 7070835 - DNA, 22 bp, Homo sapiens
gctgggcaatgccagagaggag

SEQ ID NO: 7070836 - DNA, 22 bp, Homo sapiens
gctgggcaagtgccttgggttt

SEQ ID NO: 7070837 - DNA, 22 bp, Homo sapiens
gctgggcaaggctgaagctacc

SEQ ID NO: 7070838 - DNA, 22 bp, Homo sapiens
gctgggcaacgggcagaaagat

SEQ ID NO: 7070839 - DNA, 22 bp, Homo sapiens
gctgggcagctgaggcctctca

SEQ ID NO: 7070840 - DNA, 22 bp, Homo sapiens
gctgggcagcctggccgctgcc

SEQ ID NO: 7070841 - DNA, 22 bp, Homo sapiens
gctgggcagcccctacagagag

SEQ ID NO: 7070842 - DNA, 22 bp, Homo sapiens
gctgggcagcccctacagagag

SEQ ID NO: 7070843 - DNA, 22 bp, Homo sapiens
gctgggcagtgagtgagtcctt

SEQ ID NO: 7070844 - DNA, 22 bp, Homo sapiens
gctgggcagtgagtgagtcctt

SEQ ID NO: 7070845 - DNA, 22 bp, Homo sapiens
gctgggcaggcctcgtgagggc

SEQ ID NO: 7070846 - DNA, 22 bp, Homo sapiens
gctgggcagctgaggcctctca

SEQ ID NO: 7070847 - DNA, 22 bp, Homo sapiens
gctgggcagctgaggcctctca

SEQ ID NO: 7070848 - DNA, 22 bp, Homo sapiens
gctggagagtgaggggagcaag

SEQ ID NO: 7070849 - DNA, 22 bp, Homo sapiens
gctggagagtgaggggagcaag

SEQ ID NO: 7070850 - DNA, 22 bp, Homo sapiens
gctggagatactgctcagtatc

SEQ ID NO: 7070851 - DNA, 22 bp, Homo sapiens
gctggagatactgctcagtatc

SEQ ID NO: 7070852 - DNA, 22 bp, Homo sapiens
gctggagatactgctcagtatc

SEQ ID NO: 7070853 - DNA, 22 bp, Homo sapiens
gctggagatagaatggccactg

SEQ ID NO: 7070854 - DNA, 22 bp, Homo sapiens
gctggagatgctatgcagaggg

SEQ ID NO: 7070855 - DNA, 22 bp, Homo sapiens
gctggagatgctatgcagaggg

SEQ ID NO: 7070856 - DNA, 22 bp, Homo sapiens
gctggagccattggcttggcct

SEQ ID NO: 7070857 - DNA, 22 bp, Homo sapiens
gctggagccttctgctctgttg

SEQ ID NO: 7070858 - DNA, 22 bp, Homo sapiens
gctggagctgagttccctgggc

SEQ ID NO: 7070859 - DNA, 22 bp, Homo sapiens
gctggcccagtgacccacagtg

SEQ ID NO: 7070860 - DNA, 22 bp, Homo sapiens
gcctgcctttgtgaggaagcgg

SEQ ID NO: 7070861 - DNA, 22 bp, Homo sapiens
gcctgccttttggaggcacatt

SEQ ID NO: 7070862 - DNA, 22 bp, Homo sapiens
gcctgccttttggaggcacatt

SEQ ID NO: 7070863 - DNA, 22 bp, Homo sapiens
gcctgctcagacctagcaggcc

SEQ ID NO: 7070864 - DNA, 22 bp, Homo sapiens
gcctgctctccggatccctgat

SEQ ID NO: 7070865 - DNA, 22 bp, Homo sapiens
gcctgctctgacatccatccca

SEQ ID NO: 7070866 - DNA, 22 bp, Homo sapiens
gcctgcttctcagtcagcttgg

SEQ ID NO: 7070867 - DNA, 22 bp, Homo sapiens
gcctgctttaagtctgttgcct

SEQ ID NO: 7070868 - DNA, 22 bp, Homo sapiens
gcctgctttgtgcctgatcttt

SEQ ID NO: 7070869 - DNA, 17 bp, Homo sapiens
gcctctgcttgtgtcat

SEQ ID NO: 7070870 - DNA, 18 bp, Homo sapiens
gcctgcctagagcttgcc

SEQ ID NO: 7070871 - DNA, 22 bp, Homo sapiens
gcctgcctcaaaatcccagttc

SEQ ID NO: 7070872 - DNA, 22 bp, Homo sapiens
gcctgcctcaaaatcccagttc

SEQ ID NO: 7070873 - DNA, 20 bp, Homo sapiens
gcctgcctcagctagctgag

SEQ ID NO: 7070874 - DNA, 20 bp, Homo sapiens
gcctgcctcagctagctgag

SEQ ID NO: 7070875 - DNA, 20 bp, Homo sapiens
gcctgcctcagctagctgag

SEQ ID NO: 7070876 - DNA, 22 bp, Homo sapiens
gcctgcctgaaggctgtaccag

SEQ ID NO: 7070877 - DNA, 23 bp, Homo sapiens
gcctgcctgacctgtgcaaagtc

SEQ ID NO: 7070878 - DNA, 21 bp, Homo sapiens
gcctgcctgcgtgaccctctt

SEQ ID NO: 7070879 - DNA, 22 bp, Homo sapiens
gcctgcctgctgtcatctgcct

SEQ ID NO: 7070880 - DNA, 22 bp, Homo sapiens
gcctgcctgctgtcatctgcct

SEQ ID NO: 7070881 - DNA, 22 bp, Homo sapiens
gcctgcctgctgtcatctgcct

SEQ ID NO: 7070882 - DNA, 22 bp, Homo sapiens
gcctgcctgctgtcatctgcct

SEQ ID NO: 7070883 - DNA, 22 bp, Homo sapiens
gcctgcctgctgtgtgcaagtt

SEQ ID NO: 7070884 - DNA, 22 bp, Homo sapiens
gcctgcctggagcttgaggtga

SEQ ID NO: 7070885 - DNA, 22 bp, Homo sapiens
gcctgcctggagcttgaggtga

SEQ ID NO: 7070886 - DNA, 22 bp, Homo sapiens
gcctgcctggagcttgaggtga

SEQ ID NO: 7070887 - DNA, 19 bp, Homo sapiens
gcctgcctgggtttctgag

SEQ ID NO: 7070888 - DNA, 19 bp, Homo sapiens
gcctgcctgggtttctgag

SEQ ID NO: 7070889 - DNA, 19 bp, Homo sapiens
gcctgcctgggtttctgag

SEQ ID NO: 7070890 - DNA, 22 bp, Homo sapiens
gcctgcctgttggctgaggtgc

SEQ ID NO: 7070891 - DNA, 22 bp, Homo sapiens
gcctgcctgttggctgaggtgc

SEQ ID NO: 7070892 - DNA, 22 bp, Homo sapiens
gcctgcctgttggctgaggtgc

SEQ ID NO: 7070893 - DNA, 22 bp, Homo sapiens
gcctgccttcggtgcgcagcgg

SEQ ID NO: 7070894 - DNA, 22 bp, Homo sapiens
gcctgccttcggtgcgcagcgg

SEQ ID NO: 7070895 - DNA, 22 bp, Homo sapiens
gcctgcctttgtatgaccctga

SEQ ID NO: 7070896 - DNA, 22 bp, Homo sapiens
gcctgcctttgtatgaccctga

SEQ ID NO: 7070897 - DNA, 22 bp, Homo sapiens
gcctgcctttgtgaggaagcgg

SEQ ID NO: 7070898 - DNA, 19 bp, Homo sapiens
gcctgggatgggcagaact

SEQ ID NO: 7070899 - DNA, 23 bp, Homo sapiens
gcctgggactcaggaggagctca

SEQ ID NO: 7070900 - DNA, 22 bp, Homo sapiens
gcctggtgtctccccaaggaag

SEQ ID NO: 7070901 - DNA, 21 bp, Homo sapiens
gcctggcaggtggaagggctc

SEQ ID NO: 7070902 - DNA, 22 bp, Homo sapiens
gcctggcagtgatgtcttttgg

SEQ ID NO: 7070903 - DNA, 22 bp, Homo sapiens
gcctggcagggcccggacggca

SEQ ID NO: 7070904 - DNA, 17 bp, Homo sapiens
gcctggcccagcctggc

SEQ ID NO: 7070905 - DNA, 22 bp, Homo sapiens
gcctggccgctccgagctccgc

SEQ ID NO: 7070906 - DNA, 22 bp, Homo sapiens
gccatgggtctgctggctcagc

SEQ ID NO: 7070907 - DNA, 19 bp, Homo sapiens
gccatgggctggcagcaga

SEQ ID NO: 7070908 - DNA, 22 bp, Homo sapiens
gccatgggcaaatgcagagctg

SEQ ID NO: 7070909 - DNA, 22 bp, Homo sapiens
gccatgggcaaatgcagagctg

SEQ ID NO: 7070910 - DNA, 23 bp, Homo sapiens
gccatggctgccccacaggcctc

SEQ ID NO: 7070911 - DNA, 22 bp, Homo sapiens
gccagtggtcactgaggaagaa

SEQ ID NO: 7070912 - DNA, 22 bp, Homo sapiens
gccagtggtcactgaggaagaa

SEQ ID NO: 7070913 - DNA, 22 bp, Homo sapiens
gccagtggtcactgaggaagaa

SEQ ID NO: 7070914 - DNA, 22 bp, Homo sapiens
gccagtggtcagtgggagggtg

SEQ ID NO: 7070915 - DNA, 22 bp, Homo sapiens
gccaggctgtttttattactgt

SEQ ID NO: 7070916 - DNA, 22 bp, Homo sapiens
gccaggctgtttttattactgt

SEQ ID NO: 7070917 - DNA, 22 bp, Homo sapiens
gccaggctgtttttattactgt

SEQ ID NO: 7070918 - DNA, 22 bp, Homo sapiens
gccagtggtgagattccctggg

SEQ ID NO: 7070919 - DNA, 22 bp, Homo sapiens
gccataaattgctggtcaaaat

SEQ ID NO: 7070920 - DNA, 22 bp, Homo sapiens
gccatcacatccaggctacctc

SEQ ID NO: 7070921 - DNA, 22 bp, Homo sapiens
gccaggctctcagtgactgccc

SEQ ID NO: 7070922 - DNA, 19 bp, Homo sapiens
gccaggctcttattctgtg

SEQ ID NO: 7070923 - DNA, 19 bp, Homo sapiens
gccaggctcttattctgtg

SEQ ID NO: 7070924 - DNA, 22 bp, Homo sapiens
gccaggctcttccatttgggtc

SEQ ID NO: 7070925 - DNA, 22 bp, Homo sapiens
gccaggctgactcccccggcct

SEQ ID NO: 7070926 - DNA, 22 bp, Homo sapiens
gccaggctgactcccccggcct

SEQ ID NO: 7070927 - DNA, 22 bp, Homo sapiens
gccaggctgaggctctggaaga

SEQ ID NO: 7070928 - DNA, 22 bp, Homo sapiens
gccaggctgccttatctctagc

SEQ ID NO: 7070929 - DNA, 22 bp, Homo sapiens
gccaggctgccttatctctagc

SEQ ID NO: 7070930 - DNA, 22 bp, Homo sapiens
gccaggctgctccagggaggcc

SEQ ID NO: 7070931 - DNA, 22 bp, Homo sapiens
gccaggctgctggctgctgtcc

SEQ ID NO: 7070932 - DNA, 22 bp, Homo sapiens
gccaggctggtgtcacaactct

SEQ ID NO: 7070933 - DNA, 22 bp, Homo sapiens
gccaggctggtgtcacaactct

SEQ ID NO: 7070934 - DNA, 22 bp, Homo sapiens
gccaggctggtgtcacaactct

SEQ ID NO: 7070935 - DNA, 22 bp, Homo sapiens
gccaggctggtgtcacaactct

SEQ ID NO: 7070936 - DNA, 22 bp, Homo sapiens
gccaggctgtggggaacttgaa

SEQ ID NO: 7070937 - DNA, 22 bp, Homo sapiens
gccgtgggtgtcatggcccata

SEQ ID NO: 7070938 - DNA, 22 bp, Homo sapiens
gcctaacttggctttgttcacc

SEQ ID NO: 7070939 - DNA, 22 bp, Homo sapiens
gccggggctggggagagacatg

SEQ ID NO: 7070940 - DNA, 22 bp, Homo sapiens
gccgggttcaagccattctcct

SEQ ID NO: 7070941 - DNA, 22 bp, Homo sapiens
gccgagcacagtgcagctgcct

SEQ ID NO: 7070942 - DNA, 22 bp, Homo sapiens
gccgggaccaaggccacggagc

SEQ ID NO: 7070943 - DNA, 22 bp, Homo sapiens
gcctcctgttatgccatgtgcc

SEQ ID NO: 7070944 - DNA, 22 bp, Homo sapiens
gcctctgcaattacattgtgcc

SEQ ID NO: 7070945 - DNA, 22 bp, Homo sapiens
gcctctgcatcatcactccagc

SEQ ID NO: 7070946 - DNA, 22 bp, Homo sapiens
gcctctgcatgctcagcaccca

SEQ ID NO: 7070947 - DNA, 22 bp, Homo sapiens
gcctctgccctcctgggactgc

SEQ ID NO: 7070948 - DNA, 22 bp, Homo sapiens
gcctctgctctcaggtagcctc

SEQ ID NO: 7070949 - DNA, 19 bp, Homo sapiens
gcctctgctggggacaggc

SEQ ID NO: 7070950 - DNA, 22 bp, Homo sapiens
gccctcagagttccccacagtg

SEQ ID NO: 7070951 - DNA, 22 bp, Homo sapiens
gccctcagctcctggacacatg

SEQ ID NO: 7070952 - DNA, 21 bp, Homo sapiens
gccctcaggggaggatggcct

SEQ ID NO: 7070953 - DNA, 21 bp, Homo sapiens
gccctcaggggaggatggcct

SEQ ID NO: 7070954 - DNA, 22 bp, Homo sapiens
gccctcctttgcttctcctagt

SEQ ID NO: 7070955 - DNA, 22 bp, Homo sapiens
gccctcctttgcttctcctagt

SEQ ID NO: 7070956 - DNA, 22 bp, Homo sapiens
gccctctcggcatagcaggggc

SEQ ID NO: 7070957 - DNA, 22 bp, Homo sapiens
gccctctcttctgcagcctcca

SEQ ID NO: 7070958 - DNA, 22 bp, Homo sapiens
gccctctcttctgcagcctcca

SEQ ID NO: 7070959 - DNA, 22 bp, Homo sapiens
gcccttcagttactccttgatg

SEQ ID NO: 7070960 - DNA, 22 bp, Homo sapiens
gccctctgcacagctctgagca

SEQ ID NO: 7070961 - DNA, 20 bp, Homo sapiens
gccctctgcctccctcagcg

SEQ ID NO: 7070962 - DNA, 20 bp, Homo sapiens
gccctctgcctccctcagcg

SEQ ID NO: 7070963 - DNA, 22 bp, Homo sapiens
gccctctgctcagctcctcagc

SEQ ID NO: 7070964 - DNA, 22 bp, Homo sapiens
gccctctgctcagctcctcagc

SEQ ID NO: 7070965 - DNA, 22 bp, Homo sapiens
gccctctggcacagagatgcag

SEQ ID NO: 7070966 - DNA, 22 bp, Homo sapiens
gcccttacagggtggtcagcca

SEQ ID NO: 7070967 - DNA, 23 bp, Homo sapiens
gcaggtggttcgaacagaagttt

SEQ ID NO: 7070968 - DNA, 22 bp, Homo sapiens
gcaggtggttaaggtcccatgt

SEQ ID NO: 7070969 - DNA, 22 bp, Homo sapiens
gcaggtggtgggggagccgttc

SEQ ID NO: 7070970 - DNA, 22 bp, Homo sapiens
gcaggtggtccccgtggagtgg

SEQ ID NO: 7070971 - DNA, 22 bp, Homo sapiens
gcaggtgggggtcggtgcatct

SEQ ID NO: 7070972 - DNA, 22 bp, Homo sapiens
gcaggtgggagccgctgcctga

SEQ ID NO: 7070973 - DNA, 22 bp, Homo sapiens
gcaggtgggagccgctgcctga

SEQ ID NO: 7070974 - DNA, 22 bp, Homo sapiens
gcaggtggggctgctaccagaa

SEQ ID NO: 7070975 - DNA, 19 bp, Homo sapiens
gcagggtggcagagctctt

SEQ ID NO: 7070976 - DNA, 22 bp, Homo sapiens
gcagggtgccgacttcagggat

SEQ ID NO: 7070977 - DNA, 22 bp, Homo sapiens
gcaggtggcagaggtgggatct

SEQ ID NO: 7070978 - DNA, 22 bp, Homo sapiens
gcaggtgggagccgctgcctga

SEQ ID NO: 7070979 - DNA, 22 bp, Homo sapiens
gcaggtggcagaggtgggatct

SEQ ID NO: 7070980 - DNA, 22 bp, Homo sapiens
gcaggtggagcagtagtctggt

SEQ ID NO: 7070981 - DNA, 22 bp, Homo sapiens
gcaggtggagcagtagtctggt

SEQ ID NO: 7070982 - DNA, 22 bp, Homo sapiens
gcaggtggattatcagaagtgc

SEQ ID NO: 7070983 - DNA, 22 bp, Homo sapiens
gcagtaggagaagaggatgctt

SEQ ID NO: 7070984 - DNA, 18 bp, Homo sapiens
gcagtaggcgcgcaggac

SEQ ID NO: 7070985 - DNA, 18 bp, Homo sapiens
gcagtaggcgcgcaggac

SEQ ID NO: 7070986 - DNA, 22 bp, Homo sapiens
gcagtaggggctggagggctgt

SEQ ID NO: 7070987 - DNA, 22 bp, Homo sapiens
gcagtaggggctggagggctgt

SEQ ID NO: 7070988 - DNA, 22 bp, Homo sapiens
gcagtaagttaatagtgctggt

SEQ ID NO: 7070989 - DNA, 22 bp, Homo sapiens
gcagtggggaatgctggggaga

SEQ ID NO: 7070990 - DNA, 22 bp, Homo sapiens
gcagtgggcctgaggaagggtg

SEQ ID NO: 7070991 - DNA, 22 bp, Homo sapiens
gcagtgggcctgaggaagggtg

SEQ ID NO: 7070992 - DNA, 22 bp, Homo sapiens
gccagcaaagcaagttgtcagc

SEQ ID NO: 7070993 - DNA, 22 bp, Homo sapiens
gccagatttacagatttgccct

SEQ ID NO: 7070994 - DNA, 22 bp, Homo sapiens
gccagatttacagatttgccct

SEQ ID NO: 7070995 - DNA, 18 bp, Homo sapiens
gccagagggaagcaggtg

SEQ ID NO: 7070996 - DNA, 22 bp, Homo sapiens
gccacaggcacttaagggctgg

SEQ ID NO: 7070997 - DNA, 20 bp, Homo sapiens
gccagaggccggcaggggct

SEQ ID NO: 7070998 - DNA, 22 bp, Homo sapiens
gccacagctcacgttccccatt

SEQ ID NO: 7070999 - DNA, 22 bp, Homo sapiens
gccacagcttagatcacagcct

SEQ ID NO: 7071000 - DNA, 22 bp, Homo sapiens
gccagcagccacagaagtcact

SEQ ID NO: 7071001 - DNA, 22 bp, Homo sapiens
gccagcagcccagaaggacttt

SEQ ID NO: 7071002 - DNA, 22 bp, Homo sapiens
gccagcagctcttgggcgggca

SEQ ID NO: 7071003 - DNA, 22 bp, Homo sapiens
gccagcagctgtggggtggcca

SEQ ID NO: 7071004 - DNA, 22 bp, Homo sapiens
gcatgggaggacagtctgggct

SEQ ID NO: 7071005 - DNA, 22 bp, Homo sapiens
gcatggtggagtctgagcaggg

SEQ ID NO: 7071006 - DNA, 22 bp, Homo sapiens
gcatgtggaatctctccatggt

SEQ ID NO: 7071007 - DNA, 22 bp, Homo sapiens
gcagggggtcattcacgctggc

SEQ ID NO: 7071008 - DNA, 22 bp, Homo sapiens
gcagggggtcattcacgctggc

SEQ ID NO: 7071009 - DNA, 22 bp, Homo sapiens
gcaggggctgctgggaactcgg

SEQ ID NO: 7071010 - DNA, 22 bp, Homo sapiens
gcaggggctactctgagcttcc

SEQ ID NO: 7071011 - DNA, 22 bp, Homo sapiens
gcaggggcggctgggtttccag

SEQ ID NO: 7071012 - DNA, 22 bp, Homo sapiens
gcaggggctaaggacacagaga

SEQ ID NO: 7071013 - DNA, 21 bp, Homo sapiens
gcaggggatagaaatggtctg

SEQ ID NO: 7071014 - DNA, 22 bp, Homo sapiens
gcagggcacacaagaatgataa

SEQ ID NO: 7071015 - DNA, 22 bp, Homo sapiens
gcagggcagaaggtgctgagga

SEQ ID NO: 7071016 - DNA, 22 bp, Homo sapiens
gcagggcagaaggtgctgagga

SEQ ID NO: 7071017 - DNA, 22 bp, Homo sapiens
gcagggaagacccggagcagcg

SEQ ID NO: 7071018 - DNA, 22 bp, Homo sapiens
gcagggaagacccggagcagcg

SEQ ID NO: 7071019 - DNA, 22 bp, Homo sapiens
gcagggacgcagcactctccgt

SEQ ID NO: 7071020 - DNA, 22 bp, Homo sapiens
gcaggctggggtagccccactt

SEQ ID NO: 7071021 - DNA, 22 bp, Homo sapiens
gcaggctggggtagccccactt

SEQ ID NO: 7071022 - DNA, 21 bp, Homo sapiens
gcaggctggtcaaacctcagt

SEQ ID NO: 7071023 - DNA, 21 bp, Homo sapiens
gcaggctggtcaaacctcagt

SEQ ID NO: 7071024 - DNA, 21 bp, Homo sapiens
gcaggctggtcaaacctcagt

SEQ ID NO: 7071025 - DNA, 22 bp, Homo sapiens
gcaggctggtctgaccatccct

SEQ ID NO: 7071026 - DNA, 21 bp, Homo sapiens
gcaggcactctagaggagctg

SEQ ID NO: 7071027 - DNA, 17 bp, Homo sapiens
gcaggcactgctgcctg

SEQ ID NO: 7071028 - DNA, 22 bp, Homo sapiens
gcaggcagaggtggaggagaca

SEQ ID NO: 7071029 - DNA, 22 bp, Homo sapiens
gcaggcagaggtggaggagaca

SEQ ID NO: 7071030 - DNA, 22 bp, Homo sapiens
gcaggcagaggtggaggagaca

SEQ ID NO: 7071031 - DNA, 22 bp, Homo sapiens
gcaggctgccaccttctgagtt

SEQ ID NO: 7071032 - DNA, 22 bp, Homo sapiens
gcaggctgccctcttgtgttga

SEQ ID NO: 7071033 - DNA, 22 bp, Homo sapiens
gcaggctgctgagatccttagg

SEQ ID NO: 7071034 - DNA, 22 bp, Homo sapiens
gcaggctggaggctgttctggg

SEQ ID NO: 7071035 - DNA, 22 bp, Homo sapiens
gcaggctggaggctgttctggg

SEQ ID NO: 7071036 - DNA, 22 bp, Homo sapiens
gcaggagactggctgtggtagt

SEQ ID NO: 7071037 - DNA, 22 bp, Homo sapiens
gcaggagactggctgtggtagt

SEQ ID NO: 7071038 - DNA, 22 bp, Homo sapiens
gcaggagaaatgaagattgggt

SEQ ID NO: 7071039 - DNA, 22 bp, Homo sapiens
gcaggagaaatgaagattgggt

SEQ ID NO: 7071040 - DNA, 22 bp, Homo sapiens
gcagctgacatctggctgggcc

SEQ ID NO: 7071041 - DNA, 22 bp, Homo sapiens
gcagctgagagaagaacagggc

SEQ ID NO: 7071042 - DNA, 22 bp, Homo sapiens
gcagctgagagaagaacagggc

SEQ ID NO: 7071043 - DNA, 22 bp, Homo sapiens
gcagctgagcgtgaggaagagt

SEQ ID NO: 7071044 - DNA, 22 bp, Homo sapiens
gcagctgatggaagtcctattg

SEQ ID NO: 7071045 - DNA, 22 bp, Homo sapiens
gcaggacaggcgttggtccagt

SEQ ID NO: 7071046 - DNA, 22 bp, Homo sapiens
gcaggacattcagtgaatgggc

SEQ ID NO: 7071047 - DNA, 22 bp, Homo sapiens
gcaggagccacttcagggatgc

SEQ ID NO: 7071048 - DNA, 22 bp, Homo sapiens
gcaggagccaggccgagctggt

SEQ ID NO: 7071049 - DNA, 23 bp, Homo sapiens
gcaggagttcctggactccagga

SEQ ID NO: 7071050 - DNA, 23 bp, Homo sapiens
gcaggagttcctggactccagga

SEQ ID NO: 7071051 - DNA, 19 bp, Homo sapiens
gcaggcacagccctgggtg

SEQ ID NO: 7071052 - DNA, 22 bp, Homo sapiens
gcaggcacatgggcgggtctgg

SEQ ID NO: 7071053 - DNA, 22 bp, Homo sapiens
gcaggcaccacggctcaggtct

SEQ ID NO: 7071054 - DNA, 22 bp, Homo sapiens
gcaggcaccgcggcggcaggtt

SEQ ID NO: 7071055 - DNA, 22 bp, Homo sapiens
gcaggcaccgcggcggcaggtt

SEQ ID NO: 7071056 - DNA, 22 bp, Homo sapiens
gcaggcaccgggttgctcccct

SEQ ID NO: 7071057 - DNA, 22 bp, Homo sapiens
gcaggcacctcgtggagtggaa

SEQ ID NO: 7071058 - DNA, 22 bp, Homo sapiens
gcaggcacctcgtggagtggaa

SEQ ID NO: 7071059 - DNA, 22 bp, Homo sapiens
gcaggcactcctaggaccatca

SEQ ID NO: 7071060 - DNA, 22 bp, Homo sapiens
gcagcctctgcagttcaggagg

SEQ ID NO: 7071061 - DNA, 17 bp, Homo sapiens
gcagcctcttggtagtg

SEQ ID NO: 7071062 - DNA, 22 bp, Homo sapiens
gcagagctcatgcctgcacctc

SEQ ID NO: 7071063 - DNA, 21 bp, Homo sapiens
gcagagccggggcgagaaggc

SEQ ID NO: 7071064 - DNA, 22 bp, Homo sapiens
gcagagccttgcgtcatgtgcc

SEQ ID NO: 7071065 - DNA, 22 bp, Homo sapiens
gcagctattgtctcctgggccc

SEQ ID NO: 7071066 - DNA, 22 bp, Homo sapiens
gcagctcctcctgggctggaga

SEQ ID NO: 7071067 - DNA, 22 bp, Homo sapiens
gcagctgaaagggatctctaca

SEQ ID NO: 7071068 - DNA, 22 bp, Homo sapiens
gcagctgaaagggatctctaca

SEQ ID NO: 7071069 - DNA, 20 bp, Homo sapiens
gcagctgaaagtatgacacc

SEQ ID NO: 7071070 - DNA, 22 bp, Homo sapiens
gcagctgaagctgcagttccag

SEQ ID NO: 7071071 - DNA, 22 bp, Homo sapiens
gcagctgaatgtccattgctgc

SEQ ID NO: 7071072 - DNA, 22 bp, Homo sapiens
gcagctgaatgtccattgctgc

SEQ ID NO: 7071073 - DNA, 18 bp, Homo sapiens
gcagctgacactggagtt

SEQ ID NO: 7071074 - DNA, 18 bp, Homo sapiens
gcagctgacactggagtt

SEQ ID NO: 7071075 - DNA, 22 bp, Homo sapiens
gcaatgaggagtggtagggata

SEQ ID NO: 7071076 - DNA, 22 bp, Homo sapiens
gcaatagtatttattaaagtag

SEQ ID NO: 7071077 - DNA, 22 bp, Homo sapiens
gcaatagtgcctattctcttga

SEQ ID NO: 7071078 - DNA, 22 bp, Homo sapiens
gcaaacatgttgtgagatacca

SEQ ID NO: 7071079 - DNA, 22 bp, Homo sapiens
gatttttatataaagtgagaaa

SEQ ID NO: 7071080 - DNA, 22 bp, Homo sapiens
gattttctgagccttcaaattt

SEQ ID NO: 7071081 - DNA, 22 bp, Homo sapiens
gattttcttgggaaacaatgag

SEQ ID NO: 7071082 - DNA, 22 bp, Homo sapiens
gattttatagtcaggaaaaaga

SEQ ID NO: 7071083 - DNA, 22 bp, Homo sapiens
gattttaattataggaggtcct

SEQ ID NO: 7071084 - DNA, 22 bp, Homo sapiens
gattttaattataggaggtcct

SEQ ID NO: 7071085 - DNA, 21 bp, Homo sapiens
gattttaaagagactgccaca

SEQ ID NO: 7071086 - DNA, 21 bp, Homo sapiens
gattttaaagagactgccaca

SEQ ID NO: 7071087 - DNA, 22 bp, Homo sapiens
gattttatctttgtgtgcagta

SEQ ID NO: 7071088 - DNA, 22 bp, Homo sapiens
gattttattagcccaaactttg

SEQ ID NO: 7071089 - DNA, 22 bp, Homo sapiens
gattttatcgtcatccttctgg

SEQ ID NO: 7071090 - DNA, 22 bp, Homo sapiens
gattttatatggcatactgtgg

SEQ ID NO: 7071091 - DNA, 22 bp, Homo sapiens
gattttcattatagctagtttc

SEQ ID NO: 7071092 - DNA, 22 bp, Homo sapiens
gattttcattatagctagtttc

SEQ ID NO: 7071093 - DNA, 22 bp, Homo sapiens
gattttcatttgcactctagaa

SEQ ID NO: 7071094 - DNA, 22 bp, Homo sapiens
gattttcatttgcactctagaa

SEQ ID NO: 7071095 - DNA, 22 bp, Homo sapiens
gattttcatgataaacttgtga

SEQ ID NO: 7071096 - DNA, 22 bp, Homo sapiens
gattttcatgataaacttgtga

SEQ ID NO: 7071097 - DNA, 22 bp, Homo sapiens
gattttcatgataaacttgtga

SEQ ID NO: 7071098 - DNA, 22 bp, Homo sapiens
gattttcattatagctagtttc

SEQ ID NO: 7071099 - DNA, 22 bp, Homo sapiens
gattttcattatagctagtttc

SEQ ID NO: 7071100 - DNA, 22 bp, Homo sapiens
gatttcttcattcattagatgg

SEQ ID NO: 7071101 - DNA, 22 bp, Homo sapiens
gatttcttcatttgtggtgaat

SEQ ID NO: 7071102 - DNA, 22 bp, Homo sapiens
gatttcttgacccctgtctcag

SEQ ID NO: 7071103 - DNA, 22 bp, Homo sapiens
gatttcttgataagtagtgtga

SEQ ID NO: 7071104 - DNA, 22 bp, Homo sapiens
gatttcttgataattcaaatcc

SEQ ID NO: 7071105 - DNA, 22 bp, Homo sapiens
gatttctttaggtgtaatagtg

SEQ ID NO: 7071106 - DNA, 22 bp, Homo sapiens
gatttctttatgaagtacagaa

SEQ ID NO: 7071107 - DNA, 22 bp, Homo sapiens
gatttctttgcaagctgtgttc

SEQ ID NO: 7071108 - DNA, 21 bp, Homo sapiens
gatttgcagaaactagacagg

SEQ ID NO: 7071109 - DNA, 22 bp, Homo sapiens
gcagaaagctccttgcgatctg

SEQ ID NO: 7071110 - DNA, 22 bp, Homo sapiens
gcagaaagcttagagggtttgc

SEQ ID NO: 7071111 - DNA, 21 bp, Homo sapiens
gcagaaaggaatcttaggtcc

SEQ ID NO: 7071112 - DNA, 22 bp, Homo sapiens
gcagaagaccatggtggaaaga

SEQ ID NO: 7071113 - DNA, 22 bp, Homo sapiens
gcagaagcccggtcagcgcacg

SEQ ID NO: 7071114 - DNA, 22 bp, Homo sapiens
gcagaagctgggcagcgaggtg

SEQ ID NO: 7071115 - DNA, 22 bp, Homo sapiens
gcagaagctgttcgaaggccgc

SEQ ID NO: 7071116 - DNA, 22 bp, Homo sapiens
gcagaaggatccgcaggtgcaa

SEQ ID NO: 7071117 - DNA, 18 bp, Homo sapiens
gcagagcatcaagggtta

SEQ ID NO: 7071118 - DNA, 22 bp, Homo sapiens
gcagagcatgtcctcaggacag

SEQ ID NO: 7071119 - DNA, 22 bp, Homo sapiens
gcagagcattggagggaccctg

SEQ ID NO: 7071120 - DNA, 22 bp, Homo sapiens
gcagagccagaatggccaggac

SEQ ID NO: 7071121 - DNA, 22 bp, Homo sapiens
gcagagccaggagcccaggatc

SEQ ID NO: 7071122 - DNA, 22 bp, Homo sapiens
gcagagccaggctggggcaggt

SEQ ID NO: 7071123 - DNA, 22 bp, Homo sapiens
gcagagccaggctggggcaggt

SEQ ID NO: 7071124 - DNA, 22 bp, Homo sapiens
gcagagccccattgctggcggg

SEQ ID NO: 7071125 - DNA, 22 bp, Homo sapiens
gcagagcccctcaagccagcct

SEQ ID NO: 7071126 - DNA, 22 bp, Homo sapiens
gcagagcccctcaagccagcct

SEQ ID NO: 7071127 - DNA, 22 bp, Homo sapiens
gcacccagggacttggctggcc

SEQ ID NO: 7071128 - DNA, 16 bp, Homo sapiens
gcacacacatcaatga

SEQ ID NO: 7071129 - DNA, 22 bp, Homo sapiens
gcacacacatgtgagtacatgc

SEQ ID NO: 7071130 - DNA, 22 bp, Homo sapiens
gcacacactgttttcctcacat

SEQ ID NO: 7071131 - DNA, 22 bp, Homo sapiens
gcaccctgtttatcctgagttc

SEQ ID NO: 7071132 - DNA, 17 bp, Homo sapiens
gcaccgtgggcacactc

SEQ ID NO: 7071133 - DNA, 22 bp, Homo sapiens
gcacctgattgatttcactgct

SEQ ID NO: 7071134 - DNA, 22 bp, Homo sapiens
gcacctggacagtgaccctagc

SEQ ID NO: 7071135 - DNA, 22 bp, Homo sapiens
gatttacagatctaagggtcac

SEQ ID NO: 7071136 - DNA, 22 bp, Homo sapiens
gatttacagctatacccaatgg

SEQ ID NO: 7071137 - DNA, 22 bp, Homo sapiens
gatttacaggttaggtcctgta

SEQ ID NO: 7071138 - DNA, 22 bp, Homo sapiens
gatttattggtctttcattggt

SEQ ID NO: 7071139 - DNA, 22 bp, Homo sapiens
gatttattggtctttcattggt

SEQ ID NO: 7071140 - DNA, 22 bp, Homo sapiens
gatttattgtccctgtcctgct

SEQ ID NO: 7071141 - DNA, 22 bp, Homo sapiens
gatttatttttaatcagcaggg

SEQ ID NO: 7071142 - DNA, 22 bp, Homo sapiens
gatttatttttaatcagcaggg

SEQ ID NO: 7071143 - DNA, 22 bp, Homo sapiens
gatttcaacctaacagtatgac

SEQ ID NO: 7071144 - DNA, 22 bp, Homo sapiens
gattgagtctgaggatgctgca

SEQ ID NO: 7071145 - DNA, 22 bp, Homo sapiens
gattgtaaaacagatcattatc

SEQ ID NO: 7071146 - DNA, 19 bp, Homo sapiens
gatttaaacgtggctctat

SEQ ID NO: 7071147 - DNA, 22 bp, Homo sapiens
gatttaaagtagacctttgttt

SEQ ID NO: 7071148 - DNA, 22 bp, Homo sapiens
gatttacaaagctctctagtgt

SEQ ID NO: 7071149 - DNA, 22 bp, Homo sapiens
gattatataatggaagctcttg

SEQ ID NO: 7071150 - DNA, 22 bp, Homo sapiens
gattctttggcctttattgaca

SEQ ID NO: 7071151 - DNA, 22 bp, Homo sapiens
gatgtgtttccaggatttgttt

SEQ ID NO: 7071152 - DNA, 22 bp, Homo sapiens
gatgtgtttccaggatttgttt

SEQ ID NO: 7071153 - DNA, 22 bp, Homo sapiens
gatgtgtttgtttctggaggag

SEQ ID NO: 7071154 - DNA, 22 bp, Homo sapiens
gattaagagaagtttcttatcg

SEQ ID NO: 7071155 - DNA, 22 bp, Homo sapiens
gattaagagaagtttcttatcg

SEQ ID NO: 7071156 - DNA, 22 bp, Homo sapiens
gattaagattacatatttaagt

SEQ ID NO: 7071157 - DNA, 22 bp, Homo sapiens
gattaagattacatatttaagt

SEQ ID NO: 7071158 - DNA, 22 bp, Homo sapiens
gatggggttttgccaggctggt

SEQ ID NO: 7071159 - DNA, 22 bp, Homo sapiens
gatgggtgggttctgtgagagg

SEQ ID NO: 7071160 - DNA, 22 bp, Homo sapiens
gatggtctttgtctctgataag

SEQ ID NO: 7071161 - DNA, 22 bp, Homo sapiens
gatggtgcaattatcgtgcatg

SEQ ID NO: 7071162 - DNA, 22 bp, Homo sapiens
gatggtggcaagagccaagtct

SEQ ID NO: 7071163 - DNA, 22 bp, Homo sapiens
gatgtagagggaagattttaaa

SEQ ID NO: 7071164 - DNA, 22 bp, Homo sapiens
gatgcgggcccgctccactgcc

SEQ ID NO: 7071165 - DNA, 22 bp, Homo sapiens
gatgcattacaaaagtgattat

SEQ ID NO: 7071166 - DNA, 22 bp, Homo sapiens
gatgctgggaccacagagtgtt

SEQ ID NO: 7071167 - DNA, 22 bp, Homo sapiens
gatgctgggaccacagagtgtt

SEQ ID NO: 7071168 - DNA, 18 bp, Homo sapiens
gatggaaagtgtatgagt

SEQ ID NO: 7071169 - DNA, 22 bp, Homo sapiens
gatggacacctcctgaggttct

SEQ ID NO: 7071170 - DNA, 22 bp, Homo sapiens
gatggaggaaaagttggaatgc

SEQ ID NO: 7071171 - DNA, 22 bp, Homo sapiens
gatggaggagatggcagggtgc

SEQ ID NO: 7071172 - DNA, 22 bp, Homo sapiens
gatgggaggaacctgggtccct

SEQ ID NO: 7071173 - DNA, 22 bp, Homo sapiens
gatgggaggaacctgggtccct

SEQ ID NO: 7071174 - DNA, 22 bp, Homo sapiens
gatgggctgtctgagcgctgtg

SEQ ID NO: 7071175 - DNA, 21 bp, Homo sapiens
gagtgggacatgggagtggtt

SEQ ID NO: 7071176 - DNA, 21 bp, Homo sapiens
gagtgggacatgggagtggtt

SEQ ID NO: 7071177 - DNA, 22 bp, Homo sapiens
gagtgggcaccgtgggcacact

SEQ ID NO: 7071178 - DNA, 21 bp, Homo sapiens
gagtggaacgctcttcacacc

SEQ ID NO: 7071179 - DNA, 21 bp, Homo sapiens
gagtggaacgctcttcacacc

SEQ ID NO: 7071180 - DNA, 22 bp, Homo sapiens
gagtggagatcgtgccactgca

SEQ ID NO: 7071181 - DNA, 22 bp, Homo sapiens
gagtggagcaaaagaggtagat

SEQ ID NO: 7071182 - DNA, 22 bp, Homo sapiens
gagtggagcaaaagaggtagat

SEQ ID NO: 7071183 - DNA, 22 bp, Homo sapiens
gagtggagcaaaagaggtagat

SEQ ID NO: 7071184 - DNA, 22 bp, Homo sapiens
gagtggagcaaaagaggtagat

SEQ ID NO: 7071185 - DNA, 22 bp, Homo sapiens
gagtggcatatgtgcctgtgaa

SEQ ID NO: 7071186 - DNA, 23 bp, Homo sapiens
gagtgcagaatagacatgcagtg

SEQ ID NO: 7071187 - DNA, 22 bp, Homo sapiens
gagtgcagtatgagaggctgct

SEQ ID NO: 7071188 - DNA, 22 bp, Homo sapiens
gagtgcagttggggtgagggga

SEQ ID NO: 7071189 - DNA, 22 bp, Homo sapiens
gagtgcagttggggtgagggga

SEQ ID NO: 7071190 - DNA, 17 bp, Homo sapiens
gagtgctggtggagctc

SEQ ID NO: 7071191 - DNA, 17 bp, Homo sapiens
gagtgctggtggagctc

SEQ ID NO: 7071192 - DNA, 22 bp, Homo sapiens
gagtgctgtaggactgagccct

SEQ ID NO: 7071193 - DNA, 22 bp, Homo sapiens
gagtccttctggctggcaggat

SEQ ID NO: 7071194 - DNA, 18 bp, Homo sapiens
gagtctttgttactgctg

SEQ ID NO: 7071195 - DNA, 22 bp, Homo sapiens
gagtctttggtaaagtctgctg

SEQ ID NO: 7071196 - DNA, 22 bp, Homo sapiens
gagtctgaggggagagctgggt

SEQ ID NO: 7071197 - DNA, 22 bp, Homo sapiens
gagtgagggcagcaggggctgc

SEQ ID NO: 7071198 - DNA, 22 bp, Homo sapiens
gagtgagtggccaggaggcaga

SEQ ID NO: 7071199 - DNA, 22 bp, Homo sapiens
gataaagtagatttgttctaga

SEQ ID NO: 7071200 - DNA, 22 bp, Homo sapiens
gataaacttgtggagttttggt

SEQ ID NO: 7071201 - DNA, 22 bp, Homo sapiens
gataaagcaaggatgactgaag

SEQ ID NO: 7071202 - DNA, 21 bp, Homo sapiens
gataaagcagcttgcctaagg

SEQ ID NO: 7071203 - DNA, 20 bp, Homo sapiens
gataaattgtctcttaagtg

SEQ ID NO: 7071204 - DNA, 22 bp, Homo sapiens
gataaacacaaggtgatttcat

SEQ ID NO: 7071205 - DNA, 22 bp, Homo sapiens
gataaaagaggaaatttgttca

SEQ ID NO: 7071206 - DNA, 22 bp, Homo sapiens
gataaaagaggaaatttgttca

SEQ ID NO: 7071207 - DNA, 22 bp, Homo sapiens
gagtttagatggcattaaggta

SEQ ID NO: 7071208 - DNA, 22 bp, Homo sapiens
gagtttagccaatttggtcccc

SEQ ID NO: 7071209 - DNA, 22 bp, Homo sapiens
gagtttaggttcatgaacgagt

SEQ ID NO: 7071210 - DNA, 18 bp, Homo sapiens
gagtttaggttgtagaat

SEQ ID NO: 7071211 - DNA, 22 bp, Homo sapiens
gagtttagtggaatttccttct

SEQ ID NO: 7071212 - DNA, 22 bp, Homo sapiens
gagtttagtttggcttaaactg

SEQ ID NO: 7071213 - DNA, 22 bp, Homo sapiens
gagtgtggtgaacaggagcacc

SEQ ID NO: 7071214 - DNA, 22 bp, Homo sapiens
gagtgtggatcccagaagcaga

SEQ ID NO: 7071215 - DNA, 22 bp, Homo sapiens
gagttaaaggaaaataacttta

SEQ ID NO: 7071216 - DNA, 22 bp, Homo sapiens
gagttctgaactgtgaaatgca

SEQ ID NO: 7071217 - DNA, 22 bp, Homo sapiens
gagtggggggtccgtctcagtg

SEQ ID NO: 7071218 - DNA, 22 bp, Homo sapiens
gagtggggtctgggcatcagtc

SEQ ID NO: 7071219 - DNA, 22 bp, Homo sapiens
gagtggggtctgggcatcagtc

SEQ ID NO: 7071220 - DNA, 22 bp, Homo sapiens
gagtgtagttcattccgtccta

SEQ ID NO: 7071221 - DNA, 22 bp, Homo sapiens
gagtgtccgtgcagccccagac

SEQ ID NO: 7071222 - DNA, 21 bp, Homo sapiens
gagtgtctaatccaggctgtc

SEQ ID NO: 7071223 - DNA, 22 bp, Homo sapiens
gatcattagcttttcaaaggag

SEQ ID NO: 7071224 - DNA, 22 bp, Homo sapiens
gatcatttacttgttctggact

SEQ ID NO: 7071225 - DNA, 22 bp, Homo sapiens
gatcatttacttgttctggact

SEQ ID NO: 7071226 - DNA, 22 bp, Homo sapiens
gatcatttcagtccagtaaata

SEQ ID NO: 7071227 - DNA, 22 bp, Homo sapiens
gatcaaaagctgggttctaaaa

SEQ ID NO: 7071228 - DNA, 22 bp, Homo sapiens
gatatttttgcagacacctggg

SEQ ID NO: 7071229 - DNA, 22 bp, Homo sapiens
gatatttttagtatttctgcct

SEQ ID NO: 7071230 - DNA, 22 bp, Homo sapiens
gatcaatggtgtaacttgtcct

SEQ ID NO: 7071231 - DNA, 22 bp, Homo sapiens
gatcacataatttggaaacagc

SEQ ID NO: 7071232 - DNA, 22 bp, Homo sapiens
gatcacatgaatggaatagaag

SEQ ID NO: 7071233 - DNA, 22 bp, Homo sapiens
gatcacatgaatggaatagaag

SEQ ID NO: 7071234 - DNA, 22 bp, Homo sapiens
gatcacatgagttatctaactt

SEQ ID NO: 7071235 - DNA, 22 bp, Homo sapiens
gatatttttaggtgatgcaggc

SEQ ID NO: 7071236 - DNA, 22 bp, Homo sapiens
gatattttgagaaatcctatga

SEQ ID NO: 7071237 - DNA, 22 bp, Homo sapiens
gatattttgagaaatcctatga

SEQ ID NO: 7071238 - DNA, 22 bp, Homo sapiens
gatattttcgcagggagaattc

SEQ ID NO: 7071239 - DNA, 22 bp, Homo sapiens
gatattttcattcggatgctca

SEQ ID NO: 7071240 - DNA, 22 bp, Homo sapiens
gatattttcagtctcctttcaa

SEQ ID NO: 7071241 - DNA, 22 bp, Homo sapiens
gatataggttcatagtgttaca

SEQ ID NO: 7071242 - DNA, 18 bp, Homo sapiens
gatatataggaggaaagt

SEQ ID NO: 7071243 - DNA, 18 bp, Homo sapiens
gatatataggaggaaagt

SEQ ID NO: 7071244 - DNA, 22 bp, Homo sapiens
gatatttacattaagcacattg

SEQ ID NO: 7071245 - DNA, 21 bp, Homo sapiens
gatatttatgactcattcctt

SEQ ID NO: 7071246 - DNA, 22 bp, Homo sapiens
gatatttattaagtggttggta

SEQ ID NO: 7071247 - DNA, 22 bp, Homo sapiens
gatatttattaagtggttggta

SEQ ID NO: 7071248 - DNA, 22 bp, Homo sapiens
gatataaattaatcaagtgcaa

SEQ ID NO: 7071249 - DNA, 22 bp, Homo sapiens
gatataaattaatcaagtgcaa

SEQ ID NO: 7071250 - DNA, 22 bp, Homo sapiens
gatagtcacctcccttaacttt

SEQ ID NO: 7071251 - DNA, 19 bp, Homo sapiens
gatataaagagatggtgaa

SEQ ID NO: 7071252 - DNA, 22 bp, Homo sapiens
gatacagacaccactcttttcc

SEQ ID NO: 7071253 - DNA, 22 bp, Homo sapiens
gatacagtatttaaagagcaac

SEQ ID NO: 7071254 - DNA, 22 bp, Homo sapiens
gatacatttcaaggaggactgg

SEQ ID NO: 7071255 - DNA, 22 bp, Homo sapiens
gataacattttgaagtgctagt

SEQ ID NO: 7071256 - DNA, 22 bp, Homo sapiens
gatgaaatccagatcacaggtg

SEQ ID NO: 7071257 - DNA, 22 bp, Homo sapiens
gatgaaattgttttgatacttt

SEQ ID NO: 7071258 - DNA, 22 bp, Homo sapiens
gatcttttcagaatttatcagt

SEQ ID NO: 7071259 - DNA, 22 bp, Homo sapiens
gatcttttcaggtttctctagt

SEQ ID NO: 7071260 - DNA, 22 bp, Homo sapiens
gatgaaaaattgctgtgtcata

SEQ ID NO: 7071261 - DNA, 22 bp, Homo sapiens
gatcatttgactttataaggct

SEQ ID NO: 7071262 - DNA, 22 bp, Homo sapiens
gatcatttgcaggaaacattaa

SEQ ID NO: 7071263 - DNA, 22 bp, Homo sapiens
gatcatttgcaggaaacattaa

SEQ ID NO: 7071264 - DNA, 22 bp, Homo sapiens
gatcattttgatgcccttttag

SEQ ID NO: 7071265 - DNA, 22 bp, Homo sapiens
gatcattttgatgcccttttag

SEQ ID NO: 7071266 - DNA, 22 bp, Homo sapiens
gatctgttataatctcttttat

SEQ ID NO: 7071267 - DNA, 22 bp, Homo sapiens
gatctgtttcattcacagtctg

SEQ ID NO: 7071268 - DNA, 22 bp, Homo sapiens
gatgatgggttgatgtgaaggg

SEQ ID NO: 7071269 - DNA, 22 bp, Homo sapiens
gatgagacagaatagcccaagg

SEQ ID NO: 7071270 - DNA, 20 bp, Homo sapiens
gatgagacccatgcatgaga

SEQ ID NO: 7071271 - DNA, 22 bp, Homo sapiens
gatgcagggaacttagtgggct

SEQ ID NO: 7071272 - DNA, 22 bp, Homo sapiens
gatgcagggctggcaggagctt

SEQ ID NO: 7071273 - DNA, 22 bp, Homo sapiens
gatgcatgtatggagtgagggt

SEQ ID NO: 7071274 - DNA, 22 bp, Homo sapiens
gatgcaaagataaaacagacgc

SEQ ID NO: 7071275 - DNA, 22 bp, Homo sapiens
gatgattttgatgcagtaaaga

SEQ ID NO: 7071276 - DNA, 22 bp, Homo sapiens
gatgcaaactgtgacatagagt

SEQ ID NO: 7071277 - DNA, 22 bp, Homo sapiens
gaggctggaatattagaaatgt

SEQ ID NO: 7071278 - DNA, 22 bp, Homo sapiens
gaggctggaatattagaaatgt

SEQ ID NO: 7071279 - DNA, 22 bp, Homo sapiens
gaggctggacgtgcatttctac

SEQ ID NO: 7071280 - DNA, 22 bp, Homo sapiens
gaggcctgcagcgtggtccctg

SEQ ID NO: 7071281 - DNA, 22 bp, Homo sapiens
gaggctggacgtgcatttctac

SEQ ID NO: 7071282 - DNA, 22 bp, Homo sapiens
gaggctggagatattccaatct

SEQ ID NO: 7071283 - DNA, 22 bp, Homo sapiens
gaggctggagatattccaatct

SEQ ID NO: 7071284 - DNA, 22 bp, Homo sapiens
gaggctggaggtcaaagatgaa

SEQ ID NO: 7071285 - DNA, 22 bp, Homo sapiens
gaggctggaggtcaaagatgaa

SEQ ID NO: 7071286 - DNA, 22 bp, Homo sapiens
gaggctggaggtcaaagatgaa

SEQ ID NO: 7071287 - DNA, 22 bp, Homo sapiens
gaggctggcagaaaagcacagg

SEQ ID NO: 7071288 - DNA, 22 bp, Homo sapiens
gaggctggcagaaaagcacagg

SEQ ID NO: 7071289 - DNA, 22 bp, Homo sapiens
gaggctggcagaaaagcacagg

SEQ ID NO: 7071290 - DNA, 22 bp, Homo sapiens
gaggctggcagaaaagcacagg

SEQ ID NO: 7071291 - DNA, 16 bp, Homo sapiens
gaggctggcagatgtc

SEQ ID NO: 7071292 - DNA, 16 bp, Homo sapiens
gaggctggcagatgtc

SEQ ID NO: 7071293 - DNA, 16 bp, Homo sapiens
gaggctggcagatgtc

SEQ ID NO: 7071294 - DNA, 16 bp, Homo sapiens
gaggctggcagatgtc

SEQ ID NO: 7071295 - DNA, 22 bp, Homo sapiens
gaggctgggaagtccaagacca

SEQ ID NO: 7071296 - DNA, 22 bp, Homo sapiens
gaggctgggaagtccaagacca

SEQ ID NO: 7071297 - DNA, 22 bp, Homo sapiens
gaggctgggaagtccaagacca

SEQ ID NO: 7071298 - DNA, 22 bp, Homo sapiens
gaggctgggaagtccaagatca

SEQ ID NO: 7071299 - DNA, 22 bp, Homo sapiens
gaggctgggaagtccaagatca

SEQ ID NO: 7071300 - DNA, 22 bp, Homo sapiens
gaggctgggaagtccaagatca

SEQ ID NO: 7071301 - DNA, 22 bp, Homo sapiens
gaggctgggaagtccaatatca

SEQ ID NO: 7071302 - DNA, 22 bp, Homo sapiens
gaggctgggaagtccaatatca

SEQ ID NO: 7071303 - DNA, 22 bp, Homo sapiens
gaggctgggggctgccttcctc

SEQ ID NO: 7071304 - DNA, 22 bp, Homo sapiens
gaggctgggggctgccttcctc

SEQ ID NO: 7071305 - DNA, 22 bp, Homo sapiens
gaggctggggtctgcctttctg

SEQ ID NO: 7071306 - DNA, 22 bp, Homo sapiens
gagggatgcagaaacagaggcc

SEQ ID NO: 7071307 - DNA, 16 bp, Homo sapiens
gagggcagaggcggaa

SEQ ID NO: 7071308 - DNA, 16 bp, Homo sapiens
gagggcagaggcggaa

SEQ ID NO: 7071309 - DNA, 22 bp, Homo sapiens
gaggggaaagtgtgaggctgcg

SEQ ID NO: 7071310 - DNA, 22 bp, Homo sapiens
gaggggaagacttctggacagt

SEQ ID NO: 7071311 - DNA, 22 bp, Homo sapiens
gagggccaaagagcaagagcct

SEQ ID NO: 7071312 - DNA, 20 bp, Homo sapiens
gagggcaggcacccatttca

SEQ ID NO: 7071313 - DNA, 22 bp, Homo sapiens
gagggcagtagcctcgtaccct

SEQ ID NO: 7071314 - DNA, 22 bp, Homo sapiens
gagggcagtagcctcgtaccct

SEQ ID NO: 7071315 - DNA, 22 bp, Homo sapiens
gaggggatgcagagaggcttat

SEQ ID NO: 7071316 - DNA, 22 bp, Homo sapiens
gaggggagtgtcctccgggccc

SEQ ID NO: 7071317 - DNA, 22 bp, Homo sapiens
gaggggagtaaagtcatgttac

SEQ ID NO: 7071318 - DNA, 22 bp, Homo sapiens
gaggggagtgtcctccgggccc

SEQ ID NO: 7071319 - DNA, 22 bp, Homo sapiens
gaggggcagaggtagagaacaa

SEQ ID NO: 7071320 - DNA, 22 bp, Homo sapiens
gaggtcaggcttgcagcagggt

SEQ ID NO: 7071321 - DNA, 22 bp, Homo sapiens
gaggtcaggctcaagctgggcc

SEQ ID NO: 7071322 - DNA, 22 bp, Homo sapiens
gaggtcaggggagaggctgatg

SEQ ID NO: 7071323 - DNA, 22 bp, Homo sapiens
gaggtccactgaggcaacaggg

SEQ ID NO: 7071324 - DNA, 22 bp, Homo sapiens
gaggtgggatgtgtgtgctact

SEQ ID NO: 7071325 - DNA, 22 bp, Homo sapiens
gaggtggggttttgttcttgaa

SEQ ID NO: 7071326 - DNA, 22 bp, Homo sapiens
gaggtccagagcaggttcagtg

SEQ ID NO: 7071327 - DNA, 22 bp, Homo sapiens
gaggtccagggtggggcctgag

SEQ ID NO: 7071328 - DNA, 22 bp, Homo sapiens
gaggtcccccatggctgtgact

SEQ ID NO: 7071329 - DNA, 22 bp, Homo sapiens
gaggggcctggcgaggacatgt

SEQ ID NO: 7071330 - DNA, 22 bp, Homo sapiens
gaggtaacaactgaaatgagaa

SEQ ID NO: 7071331 - DNA, 22 bp, Homo sapiens
gaggtaggtgtaggaggcctgc

SEQ ID NO: 7071332 - DNA, 22 bp, Homo sapiens
gaggtatcttagagagtgtaga

SEQ ID NO: 7071333 - DNA, 23 bp, Homo sapiens
gaggtcaaggctgcagtgattgc

SEQ ID NO: 7071334 - DNA, 22 bp, Homo sapiens
gagtccagacaccatacctgat

SEQ ID NO: 7071335 - DNA, 22 bp, Homo sapiens
gagtcagattgcagacagggct

SEQ ID NO: 7071336 - DNA, 22 bp, Homo sapiens
gagtcaggagtcctgtgtgaga

SEQ ID NO: 7071337 - DNA, 22 bp, Homo sapiens
gagtcaggcatgaaggtaatta

SEQ ID NO: 7071338 - DNA, 22 bp, Homo sapiens
gagtcaggctagggtgacaggc

SEQ ID NO: 7071339 - DNA, 22 bp, Homo sapiens
gaggtggtggtggaggcatagc

SEQ ID NO: 7071340 - DNA, 22 bp, Homo sapiens
gaggtggtcgaggaggggtacc

SEQ ID NO: 7071341 - DNA, 22 bp, Homo sapiens
gaggtggttcaggtagagccca

SEQ ID NO: 7071342 - DNA, 19 bp, Homo sapiens
gaggtgggtccccgcagcc

SEQ ID NO: 7071343 - DNA, 22 bp, Homo sapiens
gaggtgggtgtatcacaggtca

SEQ ID NO: 7071344 - DNA, 22 bp, Homo sapiens
gaggtgtcatgagggcctgctc

SEQ ID NO: 7071345 - DNA, 18 bp, Homo sapiens
gaggcctgagaaccaggt

SEQ ID NO: 7071346 - DNA, 22 bp, Homo sapiens
gaggcctctgtcccaccaggga

SEQ ID NO: 7071347 - DNA, 22 bp, Homo sapiens
gaggcagcaggctgaggaggat

SEQ ID NO: 7071348 - DNA, 22 bp, Homo sapiens
gaggcagcaggctgaggaggat

SEQ ID NO: 7071349 - DNA, 23 bp, Homo sapiens
gaggcagctcctgcagtgccctg

SEQ ID NO: 7071350 - DNA, 18 bp, Homo sapiens
gaggcagctagcaatttt

SEQ ID NO: 7071351 - DNA, 23 bp, Homo sapiens
gaggcagctcctgcagtgccctg

SEQ ID NO: 7071352 - DNA, 22 bp, Homo sapiens
gaggcagctcttctgaatgggg

SEQ ID NO: 7071353 - DNA, 22 bp, Homo sapiens
gaggcagctgaagcttcaaaga

SEQ ID NO: 7071354 - DNA, 22 bp, Homo sapiens
gaggcagctgggatacaaggga

SEQ ID NO: 7071355 - DNA, 22 bp, Homo sapiens
gaggcccagggtacaggccgct

SEQ ID NO: 7071356 - DNA, 22 bp, Homo sapiens
gaggaggcttccgggaggcacg

SEQ ID NO: 7071357 - DNA, 22 bp, Homo sapiens
gaggaggcttccgggaggcacg

SEQ ID NO: 7071358 - DNA, 22 bp, Homo sapiens
gaggagggagctggaagctctt

SEQ ID NO: 7071359 - DNA, 22 bp, Homo sapiens
gaggagggagctggaagctctt

SEQ ID NO: 7071360 - DNA, 23 bp, Homo sapiens
gaggagggtctgacaagtgtagc

SEQ ID NO: 7071361 - DNA, 23 bp, Homo sapiens
gaggagggtctgacaagtgtagc

SEQ ID NO: 7071362 - DNA, 22 bp, Homo sapiens
gaggagggttggccttaggtag

SEQ ID NO: 7071363 - DNA, 22 bp, Homo sapiens
gaggaggtggaattccaggaat

SEQ ID NO: 7071364 - DNA, 22 bp, Homo sapiens
gaggaggtctcctccgcagggg

SEQ ID NO: 7071365 - DNA, 22 bp, Homo sapiens
gaggcagaggttgcagtgagct

SEQ ID NO: 7071366 - DNA, 22 bp, Homo sapiens
gaggagggttggccttaggtag

SEQ ID NO: 7071367 - DNA, 22 bp, Homo sapiens
gaggaggtcgctgctgagcccc

SEQ ID NO: 7071368 - DNA, 22 bp, Homo sapiens
gaggcagaggttgttgcagtga

SEQ ID NO: 7071369 - DNA, 22 bp, Homo sapiens
gaggcagagtcacaaagagtct

SEQ ID NO: 7071370 - DNA, 22 bp, Homo sapiens
gaggcagagtgcaccccaggag

SEQ ID NO: 7071371 - DNA, 22 bp, Homo sapiens
gaggcagcagaacatggaagag

SEQ ID NO: 7071372 - DNA, 22 bp, Homo sapiens
gaggacagcttagggcttcctg

SEQ ID NO: 7071373 - DNA, 22 bp, Homo sapiens
gaggacagcttagggcttcctg

SEQ ID NO: 7071374 - DNA, 22 bp, Homo sapiens
gaggacacatgactccagcagg

SEQ ID NO: 7071375 - DNA, 22 bp, Homo sapiens
gaggacagagccgcctggcaag

SEQ ID NO: 7071376 - DNA, 22 bp, Homo sapiens
gaggacagagccgcctggcaag

SEQ ID NO: 7071377 - DNA, 22 bp, Homo sapiens
gaggacagagccgcctggcaag

SEQ ID NO: 7071378 - DNA, 22 bp, Homo sapiens
gaggacaaagcccaggtgctgg

SEQ ID NO: 7071379 - DNA, 22 bp, Homo sapiens
gaggacacaaagtggctgagat

SEQ ID NO: 7071380 - DNA, 22 bp, Homo sapiens
gaggaaggtcccatcagaattt

SEQ ID NO: 7071381 - DNA, 22 bp, Homo sapiens
gaggaatgggtgtctcgtgatt

SEQ ID NO: 7071382 - DNA, 21 bp, Homo sapiens
gaggaatggtttgcaaagcac

SEQ ID NO: 7071383 - DNA, 22 bp, Homo sapiens
gaggaagatggttgagtggtcc

SEQ ID NO: 7071384 - DNA, 22 bp, Homo sapiens
gaggaagggactttattatctg

SEQ ID NO: 7071385 - DNA, 22 bp, Homo sapiens
gaggaagggctgcctgccgggc

SEQ ID NO: 7071386 - DNA, 22 bp, Homo sapiens
gaggaagggctgcctgccgggc

SEQ ID NO: 7071387 - DNA, 22 bp, Homo sapiens
gaggaagggctgcctgccgggc

SEQ ID NO: 7071388 - DNA, 18 bp, Homo sapiens
gagctgggagaaggaagg

SEQ ID NO: 7071389 - DNA, 22 bp, Homo sapiens
gagctgggagctgggatttgga

SEQ ID NO: 7071390 - DNA, 22 bp, Homo sapiens
gagctgggaggactgggaactt

SEQ ID NO: 7071391 - DNA, 22 bp, Homo sapiens
gagataaagctaccatgttgat

SEQ ID NO: 7071392 - DNA, 22 bp, Homo sapiens
gagagttcttgcctgggtatta

SEQ ID NO: 7071393 - DNA, 22 bp, Homo sapiens
gagagtgtctggaggaagctaa

SEQ ID NO: 7071394 - DNA, 22 bp, Homo sapiens
gagagtctagtgcacctagttt

SEQ ID NO: 7071395 - DNA, 22 bp, Homo sapiens
gagagtctagtgcacctagttt

SEQ ID NO: 7071396 - DNA, 22 bp, Homo sapiens
gagagtctggtagagcagcaag

SEQ ID NO: 7071397 - DNA, 22 bp, Homo sapiens
gagagtgagatcctcctgggga

SEQ ID NO: 7071398 - DNA, 22 bp, Homo sapiens
gagagtgaggcatcaggggcag

SEQ ID NO: 7071399 - DNA, 22 bp, Homo sapiens
gagagtgaggcctgggaatcta

SEQ ID NO: 7071400 - DNA, 22 bp, Homo sapiens
gagctgggacatgggtcctctc

SEQ ID NO: 7071401 - DNA, 22 bp, Homo sapiens
gagctggccgcagagagggcag

SEQ ID NO: 7071402 - DNA, 22 bp, Homo sapiens
gagctggctaatactgacttat

SEQ ID NO: 7071403 - DNA, 22 bp, Homo sapiens
gagctggcaggaggctccccga

SEQ ID NO: 7071404 - DNA, 22 bp, Homo sapiens
gagctggccgcagagagggcag

SEQ ID NO: 7071405 - DNA, 22 bp, Homo sapiens
cttgaaagaagggtcttttaat

SEQ ID NO: 7071406 - DNA, 22 bp, Homo sapiens
cttgaagacaatggcagattcc

SEQ ID NO: 7071407 - DNA, 22 bp, Homo sapiens
cttctttcttttgatcacaggt

SEQ ID NO: 7071408 - DNA, 22 bp, Homo sapiens
cttctttcccaggcatgtttta

SEQ ID NO: 7071409 - DNA, 22 bp, Homo sapiens
cttcttcttttaataaatgtct

SEQ ID NO: 7071410 - DNA, 22 bp, Homo sapiens
cttcttgagcatgggtagtact

SEQ ID NO: 7071411 - DNA, 22 bp, Homo sapiens
cttctcttcctttgtcaactga

SEQ ID NO: 7071412 - DNA, 22 bp, Homo sapiens
cttctcttgggtgtggtgtctt

SEQ ID NO: 7071413 - DNA, 22 bp, Homo sapiens
cttctcttcccagggacacagg

SEQ ID NO: 7071414 - DNA, 22 bp, Homo sapiens
cttctcttcccagggacacagg

SEQ ID NO: 7071415 - DNA, 22 bp, Homo sapiens
cttctctggctcctcagcgccc

SEQ ID NO: 7071416 - DNA, 22 bp, Homo sapiens
cttctctctgcataggcatggg

SEQ ID NO: 7071417 - DNA, 22 bp, Homo sapiens
cttctctgacagtctgtttcac

SEQ ID NO: 7071418 - DNA, 22 bp, Homo sapiens
cttctctggctcctcagcgccc

SEQ ID NO: 7071419 - DNA, 22 bp, Homo sapiens
cttctccagccacgcccactcc

SEQ ID NO: 7071420 - DNA, 22 bp, Homo sapiens
cttctccagccacgcccactcc

SEQ ID NO: 7071421 - DNA, 22 bp, Homo sapiens
cttctcagtcacctgtgagtct

SEQ ID NO: 7071422 - DNA, 22 bp, Homo sapiens
cttctcagttgcaagtgtcaga

SEQ ID NO: 7071423 - DNA, 22 bp, Homo sapiens
cttctctccctggcactcagac

SEQ ID NO: 7071424 - DNA, 22 bp, Homo sapiens
cttctctccctggcactcagac

SEQ ID NO: 7071425 - DNA, 22 bp, Homo sapiens
cttctctcggtgcatccctcac

SEQ ID NO: 7071426 - DNA, 22 bp, Homo sapiens
ctggctggttactatttctggt

SEQ ID NO: 7071427 - DNA, 22 bp, Homo sapiens
ctggctgtattagtttgatcct

SEQ ID NO: 7071428 - DNA, 22 bp, Homo sapiens
ctggctgtcttctgggagctgt

SEQ ID NO: 7071429 - DNA, 22 bp, Homo sapiens
ctttatgaaaaccagattgggg

SEQ ID NO: 7071430 - DNA, 22 bp, Homo sapiens
ctttatgaaaacctgaattatg

SEQ ID NO: 7071431 - DNA, 22 bp, Homo sapiens
ctttatgaacctgttcagcttg

SEQ ID NO: 7071432 - DNA, 22 bp, Homo sapiens
ctttatgaaggaacaatgctcc

SEQ ID NO: 7071433 - DNA, 22 bp, Homo sapiens
ctttatgactgagttgtcaatt

SEQ ID NO: 7071434 - DNA, 22 bp, Homo sapiens
ctttatgagccttgtgaaggag

SEQ ID NO: 7071435 - DNA, 22 bp, Homo sapiens
ctttggcagcctcagctgcagg

SEQ ID NO: 7071436 - DNA, 22 bp, Homo sapiens
ctttggcagcctcagctgcagg

SEQ ID NO: 7071437 - DNA, 22 bp, Homo sapiens
ctttatatattcccaggctgcc

SEQ ID NO: 7071438 - DNA, 22 bp, Homo sapiens
ctttatatccagatgtttggtg

SEQ ID NO: 7071439 - DNA, 22 bp, Homo sapiens
ctttggcagcctctgctattga

SEQ ID NO: 7071440 - DNA, 22 bp, Homo sapiens
ctttgtagctgcttctgattta

SEQ ID NO: 7071441 - DNA, 17 bp, Homo sapiens
ctttgtcaccaatgcca

SEQ ID NO: 7071442 - DNA, 19 bp, Homo sapiens
ctttgtcagaacatgcttc

SEQ ID NO: 7071443 - DNA, 19 bp, Homo sapiens
ctttgtcagaacatgcttc

SEQ ID NO: 7071444 - DNA, 19 bp, Homo sapiens
ctttgtcagaacatgcttc

SEQ ID NO: 7071445 - DNA, 22 bp, Homo sapiens
ctttgtcattttgtctctcagt

SEQ ID NO: 7071446 - DNA, 22 bp, Homo sapiens
ctttagacatctcattgtgtaa

SEQ ID NO: 7071447 - DNA, 19 bp, Homo sapiens
ctttagacacacctggaca

SEQ ID NO: 7071448 - DNA, 22 bp, Homo sapiens
ctttagacatacagaatttcca

SEQ ID NO: 7071449 - DNA, 22 bp, Homo sapiens
ctttagaatttcatgtttggtc

SEQ ID NO: 7071450 - DNA, 22 bp, Homo sapiens
ctttagaatttgatataatcaa

SEQ ID NO: 7071451 - DNA, 22 bp, Homo sapiens
ctttacaattcaagggaactct

SEQ ID NO: 7071452 - DNA, 22 bp, Homo sapiens
ctttacaacctaagttgaagct

SEQ ID NO: 7071453 - DNA, 20 bp, Homo sapiens
ctttagaagaacccaagcat

SEQ ID NO: 7071454 - DNA, 22 bp, Homo sapiens
ctttagaagggtaacggaatta

SEQ ID NO: 7071455 - DNA, 22 bp, Homo sapiens
ctttaggttttgcctgagatct

SEQ ID NO: 7071456 - DNA, 22 bp, Homo sapiens
cttggggacacagagcccaggg

SEQ ID NO: 7071457 - DNA, 22 bp, Homo sapiens
cttggggatgcaaagccagtgt

SEQ ID NO: 7071458 - DNA, 22 bp, Homo sapiens
cttggggattttaaagacctct

SEQ ID NO: 7071459 - DNA, 23 bp, Homo sapiens
cttgggctagagacttagcagtg

SEQ ID NO: 7071460 - DNA, 22 bp, Homo sapiens
cttgggagacacaagaagacat

SEQ ID NO: 7071461 - DNA, 22 bp, Homo sapiens
cttgggaggggagcattggcct

SEQ ID NO: 7071462 - DNA, 22 bp, Homo sapiens
cttgggagtagaggcaggagca

SEQ ID NO: 7071463 - DNA, 22 bp, Homo sapiens
cttgggagtagaggcaggagca

SEQ ID NO: 7071464 - DNA, 22 bp, Homo sapiens
cttggctgtaaaatcagaggct

SEQ ID NO: 7071465 - DNA, 21 bp, Homo sapiens
cttggcacagggaagatgcac

SEQ ID NO: 7071466 - DNA, 22 bp, Homo sapiens
cttggcacttgggcagtgagca

SEQ ID NO: 7071467 - DNA, 22 bp, Homo sapiens
gaaagtttctcacacatgcaga

SEQ ID NO: 7071468 - DNA, 22 bp, Homo sapiens
gaaagggagtggacaacaggca

SEQ ID NO: 7071469 - DNA, 22 bp, Homo sapiens
gaaagggtctttgatttccctc

SEQ ID NO: 7071470 - DNA, 22 bp, Homo sapiens
gaaaggttcttgggagttcaca

SEQ ID NO: 7071471 - DNA, 22 bp, Homo sapiens
gaaaggttgggtgaatggtgga

SEQ ID NO: 7071472 - DNA, 22 bp, Homo sapiens
gaaaggttgggtgaatggtgga

SEQ ID NO: 7071473 - DNA, 22 bp, Homo sapiens
gaaaagttcatcatatattcag

SEQ ID NO: 7071474 - DNA, 17 bp, Homo sapiens
cttttaatttacttccc

SEQ ID NO: 7071475 - DNA, 22 bp, Homo sapiens
cttttacactcatctgggaggg

SEQ ID NO: 7071476 - DNA, 22 bp, Homo sapiens
cttttaagggataataagatgt

SEQ ID NO: 7071477 - DNA, 22 bp, Homo sapiens
ctttgttttactcagaggcatg

SEQ ID NO: 7071478 - DNA, 23 bp, Homo sapiens
cttttaactagagtatcagctgc

SEQ ID NO: 7071479 - DNA, 23 bp, Homo sapiens
cttttaacttgatctgagaccag

SEQ ID NO: 7071480 - DNA, 22 bp, Homo sapiens
ctttgtttatatttctcctcga

SEQ ID NO: 7071481 - DNA, 22 bp, Homo sapiens
gaaaagctaggccagttcagct

SEQ ID NO: 7071482 - DNA, 22 bp, Homo sapiens
gaaaaggaaatttatagagatc

SEQ ID NO: 7071483 - DNA, 22 bp, Homo sapiens
gaaaaggaaatttatagagatc

SEQ ID NO: 7071484 - DNA, 22 bp, Homo sapiens
gaaaaggattggtaaaatatct

SEQ ID NO: 7071485 - DNA, 22 bp, Homo sapiens
gaaaaggattggtaaaatatct

SEQ ID NO: 7071486 - DNA, 22 bp, Homo sapiens
gaacacatcacattttacagtg

SEQ ID NO: 7071487 - DNA, 22 bp, Homo sapiens
gaacacatgattataaatgcta

SEQ ID NO: 7071488 - DNA, 22 bp, Homo sapiens
gaacacatgtcctccttggatt

SEQ ID NO: 7071489 - DNA, 22 bp, Homo sapiens
gaacacattagtctgagttggc

SEQ ID NO: 7071490 - DNA, 22 bp, Homo sapiens
gaacacatttctctgactgtag

SEQ ID NO: 7071491 - DNA, 22 bp, Homo sapiens
gaacactgagaaagtcagcttt

SEQ ID NO: 7071492 - DNA, 22 bp, Homo sapiens
gaaataattctgtgtctgaaca

SEQ ID NO: 7071493 - DNA, 22 bp, Homo sapiens
gaaagttttcatatataccaaa

SEQ ID NO: 7071494 - DNA, 22 bp, Homo sapiens
gaaagttttctcacacagtaat

SEQ ID NO: 7071495 - DNA, 22 bp, Homo sapiens
gaaataacagctctggaagagt

SEQ ID NO: 7071496 - DNA, 22 bp, Homo sapiens
gaaataacctcatgcaccatga

SEQ ID NO: 7071497 - DNA, 22 bp, Homo sapiens
gaaataacctcatgcaccatga

SEQ ID NO: 7071498 - DNA, 22 bp, Homo sapiens
gaaataagagtccatgccaggt

SEQ ID NO: 7071499 - DNA, 17 bp, Homo sapiens
gaacagcagaggggaca

SEQ ID NO: 7071500 - DNA, 23 bp, Homo sapiens
gaacccagctctgccacttgcca

SEQ ID NO: 7071501 - DNA, 23 bp, Homo sapiens
gaacccagctctgccacttgcca

SEQ ID NO: 7071502 - DNA, 22 bp, Homo sapiens
gaacactgaggacactgagaat

SEQ ID NO: 7071503 - DNA, 22 bp, Homo sapiens
gaactatatcttcaagaaaatg

SEQ ID NO: 7071504 - DNA, 22 bp, Homo sapiens
gaactacaggtgcagcaagtga

SEQ ID NO: 7071505 - DNA, 22 bp, Homo sapiens
gaactacagtaagaattgatgt

SEQ ID NO: 7071506 - DNA, 22 bp, Homo sapiens
gaactacagtgcattttcttaa

SEQ ID NO: 7071507 - DNA, 22 bp, Homo sapiens
gaattctagggtaaatatccta

SEQ ID NO: 7071508 - DNA, 22 bp, Homo sapiens
gaattctagtcacacacattca

SEQ ID NO: 7071509 - DNA, 22 bp, Homo sapiens
gaatttaagaggatgaatctgt

SEQ ID NO: 7071510 - DNA, 22 bp, Homo sapiens
gacacagagataggcctgtgtt

SEQ ID NO: 7071511 - DNA, 22 bp, Homo sapiens
gaattacatgaccctgagtaga

SEQ ID NO: 7071512 - DNA, 22 bp, Homo sapiens
gaattataaactagtgacttca

SEQ ID NO: 7071513 - DNA, 22 bp, Homo sapiens
gaagttatagctatgatcttaa

SEQ ID NO: 7071514 - DNA, 22 bp, Homo sapiens
gaagttatcaaagatgtattct

SEQ ID NO: 7071515 - DNA, 22 bp, Homo sapiens
gaagttatcaggattaaagttg

SEQ ID NO: 7071516 - DNA, 22 bp, Homo sapiens
gaagttattgcctgtgatgaaa

SEQ ID NO: 7071517 - DNA, 22 bp, Homo sapiens
gaagttatttcctggtgttgga

SEQ ID NO: 7071518 - DNA, 22 bp, Homo sapiens
gaagttatttgctatctactga

SEQ ID NO: 7071519 - DNA, 22 bp, Homo sapiens
gaagttatttgctatctactga

SEQ ID NO: 7071520 - DNA, 23 bp, Homo sapiens
gacacaggagcacccagctgagc

SEQ ID NO: 7071521 - DNA, 22 bp, Homo sapiens
gacacaggattcctggctctgc

SEQ ID NO: 7071522 - DNA, 20 bp, Homo sapiens
gacacaggcagtcctcagag

SEQ ID NO: 7071523 - DNA, 22 bp, Homo sapiens
gacacagggacgtgctctgcct

SEQ ID NO: 7071524 - DNA, 22 bp, Homo sapiens
gacacagggggatgtgtggacg

SEQ ID NO: 7071525 - DNA, 22 bp, Homo sapiens
gacagctgtgcaggagaagggg

SEQ ID NO: 7071526 - DNA, 22 bp, Homo sapiens
gacagctgtggagaggcatgtg

SEQ ID NO: 7071527 - DNA, 22 bp, Homo sapiens
gacagcttaggaagtttctatt

SEQ ID NO: 7071528 - DNA, 22 bp, Homo sapiens
gacaggaagtctgaaggaggga

SEQ ID NO: 7071529 - DNA, 22 bp, Homo sapiens
gacaggaatgtgtggatgcgga

SEQ ID NO: 7071530 - DNA, 20 bp, Homo sapiens
gacaggagagttaggtaggt

SEQ ID NO: 7071531 - DNA, 22 bp, Homo sapiens
gaaggctgctgggaagtgtggt

SEQ ID NO: 7071532 - DNA, 22 bp, Homo sapiens
gaaggctaaaggggcagaggtt

SEQ ID NO: 7071533 - DNA, 19 bp, Homo sapiens
gaaggctgaaatgaagcac

SEQ ID NO: 7071534 - DNA, 22 bp, Homo sapiens
gaaggctgagcagacaggccaa

SEQ ID NO: 7071535 - DNA, 22 bp, Homo sapiens
gaaggctgagcagacaggccaa

SEQ ID NO: 7071536 - DNA, 22 bp, Homo sapiens
gaaggctgagtgggtacggagg

SEQ ID NO: 7071537 - DNA, 22 bp, Homo sapiens
gaaggctgagtgggtacggagg

SEQ ID NO: 7071538 - DNA, 22 bp, Homo sapiens
gaaggctgcgaggggagtgccg

SEQ ID NO: 7071539 - DNA, 22 bp, Homo sapiens
gaaggttttgattccactgaat

SEQ ID NO: 7071540 - DNA, 22 bp, Homo sapiens
gaaggttttgtttgcaaatcat

SEQ ID NO: 7071541 - DNA, 22 bp, Homo sapiens
gaagtacaaaggacatggaaac

SEQ ID NO: 7071542 - DNA, 22 bp, Homo sapiens
gaagtggaagccatcggcagtc

SEQ ID NO: 7071543 - DNA, 22 bp, Homo sapiens
gaagtggaattactgggtcata

SEQ ID NO: 7071544 - DNA, 22 bp, Homo sapiens
gaagtgggctttgtggtcagct

SEQ ID NO: 7071545 - DNA, 22 bp, Homo sapiens
gaagtgttgtatctttttaata

SEQ ID NO: 7071546 - DNA, 22 bp, Homo sapiens
gaagttactctcgttaaatatg

SEQ ID NO: 7071547 - DNA, 22 bp, Homo sapiens
gaaggcctaggaaggaagcctt

SEQ ID NO: 7071548 - DNA, 22 bp, Homo sapiens
gaaggagagggtcaaggataat

SEQ ID NO: 7071549 - DNA, 22 bp, Homo sapiens
gaaggagagggtcaaggataat

SEQ ID NO: 7071550 - DNA, 19 bp, Homo sapiens
gaaggagagctgagttagg

SEQ ID NO: 7071551 - DNA, 22 bp, Homo sapiens
gaaggagaggattgtgaggctg

SEQ ID NO: 7071552 - DNA, 22 bp, Homo sapiens
gaaggagaggattgtgaggctg

SEQ ID NO: 7071553 - DNA, 22 bp, Homo sapiens
gaaggagaggattgtgaggctg

SEQ ID NO: 7071554 - DNA, 22 bp, Homo sapiens
gaactgtgggtaatatattaga

SEQ ID NO: 7071555 - DNA, 22 bp, Homo sapiens
gaactgtgtacattgtagataa

SEQ ID NO: 7071556 - DNA, 20 bp, Homo sapiens
gaaggaagggggcaaggtga

SEQ ID NO: 7071557 - DNA, 20 bp, Homo sapiens
gaaggaagggggcaaggtga

SEQ ID NO: 7071558 - DNA, 22 bp, Homo sapiens
gaaggaagtcattagtgcagac

SEQ ID NO: 7071559 - DNA, 22 bp, Homo sapiens
gaaggaagtttattttagaaga

SEQ ID NO: 7071560 - DNA, 21 bp, Homo sapiens
gaaggagaaagcaagtgctgc

SEQ ID NO: 7071561 - DNA, 21 bp, Homo sapiens
gaaggagaaagcaagtgctgc

SEQ ID NO: 7071562 - DNA, 22 bp, Homo sapiens
gacttttgaataaggtaggata

SEQ ID NO: 7071563 - DNA, 22 bp, Homo sapiens
gagaaaagcgaaggacctggag

SEQ ID NO: 7071564 - DNA, 22 bp, Homo sapiens
gagaaaatcttgggtcaagaat

SEQ ID NO: 7071565 - DNA, 22 bp, Homo sapiens
gagaaacaacacttgatgcctt

SEQ ID NO: 7071566 - DNA, 22 bp, Homo sapiens
gactttattatagtggcaatag

SEQ ID NO: 7071567 - DNA, 22 bp, Homo sapiens
gagacacaagaagacatgcaca

SEQ ID NO: 7071568 - DNA, 18 bp, Homo sapiens
gagacacaagggcctgga

SEQ ID NO: 7071569 - DNA, 22 bp, Homo sapiens
gagacacaatctcatttacatt

SEQ ID NO: 7071570 - DNA, 22 bp, Homo sapiens
gagacacacacaggaggtggca

SEQ ID NO: 7071571 - DNA, 22 bp, Homo sapiens
gagacacagagaggctgtgtga

SEQ ID NO: 7071572 - DNA, 22 bp, Homo sapiens
gagacactcaacaaagatatga

SEQ ID NO: 7071573 - DNA, 22 bp, Homo sapiens
gagacagagaggtactcaacat

SEQ ID NO: 7071574 - DNA, 22 bp, Homo sapiens
gagacagagatcttgctgagtc

SEQ ID NO: 7071575 - DNA, 22 bp, Homo sapiens
gagacagatctcggctccatgc

SEQ ID NO: 7071576 - DNA, 22 bp, Homo sapiens
gagagccctgctcctatcccag

SEQ ID NO: 7071577 - DNA, 22 bp, Homo sapiens
gagacagagatcttgctgagtc

SEQ ID NO: 7071578 - DNA, 22 bp, Homo sapiens
gagacagagtttcactcttgtt

SEQ ID NO: 7071579 - DNA, 22 bp, Homo sapiens
gagagctgcattctcagacaca

SEQ ID NO: 7071580 - DNA, 17 bp, Homo sapiens
gagagctgctgcttccg

SEQ ID NO: 7071581 - DNA, 22 bp, Homo sapiens
gagagctgatagatgagctact

SEQ ID NO: 7071582 - DNA, 22 bp, Homo sapiens
gagagctggattctggataggt

SEQ ID NO: 7071583 - DNA, 22 bp, Homo sapiens
gagagctgggaaagccgtggag

SEQ ID NO: 7071584 - DNA, 22 bp, Homo sapiens
gagagctgggctttgggtgaag

SEQ ID NO: 7071585 - DNA, 22 bp, Homo sapiens
gagagctgggttcaagtagctg

SEQ ID NO: 7071586 - DNA, 22 bp, Homo sapiens
gagagctgggttcaagtagctg

SEQ ID NO: 7071587 - DNA, 22 bp, Homo sapiens
gagagctgtaatagtcatgtct

SEQ ID NO: 7071588 - DNA, 22 bp, Homo sapiens
gagaggtacaccctttaaactt

SEQ ID NO: 7071589 - DNA, 22 bp, Homo sapiens
gagaggtacggaaagagcgtgg

SEQ ID NO: 7071590 - DNA, 22 bp, Homo sapiens
gagaggtagaggctctgcttaa

SEQ ID NO: 7071591 - DNA, 22 bp, Homo sapiens
gagagtccttagtttgcaggta

SEQ ID NO: 7071592 - DNA, 22 bp, Homo sapiens
gagagtctaggaacctcatata

SEQ ID NO: 7071593 - DNA, 22 bp, Homo sapiens
gagagtctaggaacctcatata

SEQ ID NO: 7071594 - DNA, 22 bp, Homo sapiens
gacttcaaaagctgacattcat

SEQ ID NO: 7071595 - DNA, 22 bp, Homo sapiens
gacttcaaagcgtgataaagat

SEQ ID NO: 7071596 - DNA, 22 bp, Homo sapiens
gacttcaaaggtcaaacatcgc

SEQ ID NO: 7071597 - DNA, 22 bp, Homo sapiens
gacttaaaggctgaatgtagga

SEQ ID NO: 7071598 - DNA, 22 bp, Homo sapiens
gacttcaaatcatgctaaacct

SEQ ID NO: 7071599 - DNA, 17 bp, Homo sapiens
gacttcaacttctgctg

SEQ ID NO: 7071600 - DNA, 22 bp, Homo sapiens
gacttcaacttctggggagcaa

SEQ ID NO: 7071601 - DNA, 20 bp, Homo sapiens
gacttcaatttctatctttt

SEQ ID NO: 7071602 - DNA, 22 bp, Homo sapiens
gacttcataatattgagcatgt

SEQ ID NO: 7071603 - DNA, 22 bp, Homo sapiens
gacttcatgacattcaggtcag

SEQ ID NO: 7071604 - DNA, 21 bp, Homo sapiens
gacttcatgggtcaaccaatt

SEQ ID NO: 7071605 - DNA, 22 bp, Homo sapiens
gacttggggatttatctcacag

SEQ ID NO: 7071606 - DNA, 22 bp, Homo sapiens
gacttgggggctttggataggc

SEQ ID NO: 7071607 - DNA, 22 bp, Homo sapiens
gacttgggtggattgtgactct

SEQ ID NO: 7071608 - DNA, 22 bp, Homo sapiens
gacttgggagtcttctgagatg

SEQ ID NO: 7071609 - DNA, 22 bp, Homo sapiens
gactggggtaaggtgaggaggt

SEQ ID NO: 7071610 - DNA, 22 bp, Homo sapiens
gactgggtcctctgcttatggt

SEQ ID NO: 7071611 - DNA, 22 bp, Homo sapiens
gacccagggtttctgcacaggg

SEQ ID NO: 7071612 - DNA, 22 bp, Homo sapiens
gacccaggaagctacttctggt

SEQ ID NO: 7071613 - DNA, 22 bp, Homo sapiens
gaccatttctaggaatcagact

SEQ ID NO: 7071614 - DNA, 22 bp, Homo sapiens
gaccatttgctagtaaattgca

SEQ ID NO: 7071615 - DNA, 22 bp, Homo sapiens
gaccatttgttgaaaagattat

SEQ ID NO: 7071616 - DNA, 22 bp, Homo sapiens
gaccatttttacagagcattca

SEQ ID NO: 7071617 - DNA, 22 bp, Homo sapiens
gacccagggtatccagagctgc

SEQ ID NO: 7071618 - DNA, 22 bp, Homo sapiens
gacaggaggcagagctcaggtg

SEQ ID NO: 7071619 - DNA, 22 bp, Homo sapiens
gacaggaggcagagctcaggtg

SEQ ID NO: 7071620 - DNA, 22 bp, Homo sapiens
gacaggaggcagagctcaggtg

SEQ ID NO: 7071621 - DNA, 21 bp, Homo sapiens
gacaggcaaggagtcacttag

SEQ ID NO: 7071622 - DNA, 22 bp, Homo sapiens
gacaggcaattaccagcgccca

SEQ ID NO: 7071623 - DNA, 22 bp, Homo sapiens
gacaggcaattaccagcgccca

SEQ ID NO: 7071624 - DNA, 22 bp, Homo sapiens
gacaggcaccttgtctgtcttg

SEQ ID NO: 7071625 - DNA, 22 bp, Homo sapiens
gacaggcacgaaattgggctgg

SEQ ID NO: 7071626 - DNA, 22 bp, Homo sapiens
gacaggcagacctgtgccctgg

SEQ ID NO: 7071627 - DNA, 22 bp, Homo sapiens
gacaggcagacctgtgccctgg

SEQ ID NO: 7071628 - DNA, 22 bp, Homo sapiens
gacaggcaggccagggctgtgg

SEQ ID NO: 7071629 - DNA, 22 bp, Homo sapiens
gaccagggtcactcacagggct

SEQ ID NO: 7071630 - DNA, 22 bp, Homo sapiens
gaccatcctggccaacgtggta

SEQ ID NO: 7071631 - DNA, 22 bp, Homo sapiens
gacaggcatgctttcaggacta

SEQ ID NO: 7071632 - DNA, 22 bp, Homo sapiens
gaccaggctgttccagtctaac

SEQ ID NO: 7071633 - DNA, 22 bp, Homo sapiens
gacaggcaggccagggctgtgg

SEQ ID NO: 7071634 - DNA, 22 bp, Homo sapiens
gacaggcagttttccagatcag

SEQ ID NO: 7071635 - DNA, 22 bp, Homo sapiens
gacaggcagttttccagatcag

SEQ ID NO: 7071636 - DNA, 21 bp, Homo sapiens
ttcctggggaaggagctgcct

SEQ ID NO: 7071637 - DNA, 22 bp, Homo sapiens
ctacaaaagtaattgtggtttt

SEQ ID NO: 7071638 - DNA, 22 bp, Homo sapiens
ttccttccctcagtggctgaag

SEQ ID NO: 7071639 - DNA, 22 bp, Homo sapiens
ttccttcctgtcttccttactg

SEQ ID NO: 7071640 - DNA, 22 bp, Homo sapiens
ttccttctaatattctgcctgt

SEQ ID NO: 7071641 - DNA, 22 bp, Homo sapiens
ctaatgtatcatggctctcagc

SEQ ID NO: 7071642 - DNA, 22 bp, Homo sapiens
ctaattgtaagctccttgaggg

SEQ ID NO: 7071643 - DNA, 22 bp, Homo sapiens
ctaatttaatgaatgagtctta

SEQ ID NO: 7071644 - DNA, 22 bp, Homo sapiens
ctaaggcaccgaggcaggagcg

SEQ ID NO: 7071645 - DNA, 22 bp, Homo sapiens
ctaatcatctttctcttaaagc

SEQ ID NO: 7071646 - DNA, 22 bp, Homo sapiens
ttccatttggcacttcactgag

SEQ ID NO: 7071647 - DNA, 22 bp, Homo sapiens
ttccatttttctaactctcaga

SEQ ID NO: 7071648 - DNA, 22 bp, Homo sapiens
ttcccacaatctgcgtgtgtat

SEQ ID NO: 7071649 - DNA, 22 bp, Homo sapiens
ttccaaagctgctttatttagt

SEQ ID NO: 7071650 - DNA, 22 bp, Homo sapiens
ttccaaagtcatgttgctgata

SEQ ID NO: 7071651 - DNA, 22 bp, Homo sapiens
ttcccacacccatattgtgatt

SEQ ID NO: 7071652 - DNA, 22 bp, Homo sapiens
ttcccacagagattacattgaa

SEQ ID NO: 7071653 - DNA, 22 bp, Homo sapiens
ttcccacagagattacattgaa

SEQ ID NO: 7071654 - DNA, 22 bp, Homo sapiens
ttcccacattctttacattcat

SEQ ID NO: 7071655 - DNA, 22 bp, Homo sapiens
ttccctggttaaccattttctg

SEQ ID NO: 7071656 - DNA, 22 bp, Homo sapiens
ttcccttctagttttgagagac

SEQ ID NO: 7071657 - DNA, 21 bp, Homo sapiens
ttcccttctggttttgagaga

SEQ ID NO: 7071658 - DNA, 22 bp, Homo sapiens
ttccctttgttaaattggaaga

SEQ ID NO: 7071659 - DNA, 22 bp, Homo sapiens
ttcattcttgtctttgtatagt

SEQ ID NO: 7071660 - DNA, 22 bp, Homo sapiens
ttcagaaaggtaaatggatttc

SEQ ID NO: 7071661 - DNA, 22 bp, Homo sapiens
ttcagaaaggttaatctggatt

SEQ ID NO: 7071662 - DNA, 22 bp, Homo sapiens
ttcatgagcagaagggaggggt

SEQ ID NO: 7071663 - DNA, 22 bp, Homo sapiens
cggctgagacggccatagacac

SEQ ID NO: 7071664 - DNA, 22 bp, Homo sapiens
cggctgagacggccatagacac

SEQ ID NO: 7071665 - DNA, 22 bp, Homo sapiens
cggctgagcagtgctgatggaa

SEQ ID NO: 7071666 - DNA, 22 bp, Homo sapiens
cggctgagcagtgctgatggaa

SEQ ID NO: 7071667 - DNA, 22 bp, Homo sapiens
cggctgaggatctccaggcctg

SEQ ID NO: 7071668 - DNA, 22 bp, Homo sapiens
cggctgaggatctccaggcctg

SEQ ID NO: 7071669 - DNA, 22 bp, Homo sapiens
cggctggggctgtccccatgac

SEQ ID NO: 7071670 - DNA, 22 bp, Homo sapiens
ttcacttaacatcatatcatga

SEQ ID NO: 7071671 - DNA, 22 bp, Homo sapiens
ttcacttaacatttaccaagga

SEQ ID NO: 7071672 - DNA, 22 bp, Homo sapiens
ttcagaaaaaacttcaataagt

SEQ ID NO: 7071673 - DNA, 22 bp, Homo sapiens
ttcagaaacagagtgagtgagt

SEQ ID NO: 7071674 - DNA, 22 bp, Homo sapiens
ttcagaaacatcagtggatgga

SEQ ID NO: 7071675 - DNA, 22 bp, Homo sapiens
ttcagaaaggataattggaagg

SEQ ID NO: 7071676 - DNA, 22 bp, Homo sapiens
cggcatccccacttcctcctgc

SEQ ID NO: 7071677 - DNA, 22 bp, Homo sapiens
cggaagcgttctcagcaggggc

SEQ ID NO: 7071678 - DNA, 22 bp, Homo sapiens
cgctgggggaacttcagccaat

SEQ ID NO: 7071679 - DNA, 22 bp, Homo sapiens
cgctgggcgccgacctgctggc

SEQ ID NO: 7071680 - DNA, 22 bp, Homo sapiens
cgctggggctttttgcttgaga

SEQ ID NO: 7071681 - DNA, 22 bp, Homo sapiens
cgctgggggaacagcgagggtg

SEQ ID NO: 7071682 - DNA, 22 bp, Homo sapiens
cgctgggggaacagcgagggtg

SEQ ID NO: 7071683 - DNA, 22 bp, Homo sapiens
cctgggtggttccggcaaggag

SEQ ID NO: 7071684 - DNA, 22 bp, Homo sapiens
ttcacagactttccatagattg

SEQ ID NO: 7071685 - DNA, 22 bp, Homo sapiens
ctagccatgggcattaaaggta

SEQ ID NO: 7071686 - DNA, 22 bp, Homo sapiens
ctaggcagatggagaagtggct

SEQ ID NO: 7071687 - DNA, 22 bp, Homo sapiens
ctaggcagatggagaagtggct

SEQ ID NO: 7071688 - DNA, 22 bp, Homo sapiens
ttccttctaatattctgcctgt

SEQ ID NO: 7071689 - DNA, 22 bp, Homo sapiens
ttccttctaattttacacctga

SEQ ID NO: 7071690 - DNA, 22 bp, Homo sapiens
ttccttctaattttacacctga

SEQ ID NO: 7071691 - DNA, 22 bp, Homo sapiens
ttcctttctctggactgcagcc

SEQ ID NO: 7071692 - DNA, 22 bp, Homo sapiens
ctaggctgtgcattgcatgaca

SEQ ID NO: 7071693 - DNA, 22 bp, Homo sapiens
ctaggctggagtgcattggcgt

SEQ ID NO: 7071694 - DNA, 17 bp, Homo sapiens
ctaggcttggcagctcg

SEQ ID NO: 7071695 - DNA, 22 bp, Homo sapiens
ctagggaaataaactgagtggt

SEQ ID NO: 7071696 - DNA, 22 bp, Homo sapiens
ctagggaaataaactgagtggt

SEQ ID NO: 7071697 - DNA, 22 bp, Homo sapiens
ctagggaacaagatgcccaggg

SEQ ID NO: 7071698 - DNA, 22 bp, Homo sapiens
ctaggctgagctgggctgagct

SEQ ID NO: 7071699 - DNA, 23 bp, Homo sapiens
ctaggcaggattgtaggcgggta

SEQ ID NO: 7071700 - DNA, 22 bp, Homo sapiens
ctaggcagggtgctgtgccatg

SEQ ID NO: 7071701 - DNA, 22 bp, Homo sapiens
ctaggcagtcctgacggtacta

SEQ ID NO: 7071702 - DNA, 22 bp, Homo sapiens
ttctgtcacagtgctggtatca

SEQ ID NO: 7071703 - DNA, 22 bp, Homo sapiens
ttctgtcacttaggaggtcata

SEQ ID NO: 7071704 - DNA, 22 bp, Homo sapiens
ttctgtcatgctcatgtaattg

SEQ ID NO: 7071705 - DNA, 22 bp, Homo sapiens
ctattttaacttgattacctct

SEQ ID NO: 7071706 - DNA, 22 bp, Homo sapiens
ctattttaacttgattacctct

SEQ ID NO: 7071707 - DNA, 22 bp, Homo sapiens
ctattttaacttgattacctct

SEQ ID NO: 7071708 - DNA, 23 bp, Homo sapiens
ctagggcagtatttcacagacac

SEQ ID NO: 7071709 - DNA, 22 bp, Homo sapiens
ctagggctcgcaagggctggag

SEQ ID NO: 7071710 - DNA, 22 bp, Homo sapiens
ctatttatgtgctattttgtat

SEQ ID NO: 7071711 - DNA, 22 bp, Homo sapiens
ctatttattgtgggtatccagg

SEQ ID NO: 7071712 - DNA, 22 bp, Homo sapiens
ctattttgcctgcctagaaatc

SEQ ID NO: 7071713 - DNA, 22 bp, Homo sapiens
ctattttgcctgcctagaaatc

SEQ ID NO: 7071714 - DNA, 22 bp, Homo sapiens
ctcagagggaggactgggctgg

SEQ ID NO: 7071715 - DNA, 22 bp, Homo sapiens
ctcagaggggatgcttggagaa

SEQ ID NO: 7071716 - DNA, 22 bp, Homo sapiens
ctattttctgtctctatagagt

SEQ ID NO: 7071717 - DNA, 22 bp, Homo sapiens
ctattttaagaggccattaggt

SEQ ID NO: 7071718 - DNA, 22 bp, Homo sapiens
ctattttcattcttacattgtc

SEQ ID NO: 7071719 - DNA, 22 bp, Homo sapiens
ctattttcattcttacattgtc

SEQ ID NO: 7071720 - DNA, 22 bp, Homo sapiens
ctattttcccatatggttgaca

SEQ ID NO: 7071721 - DNA, 22 bp, Homo sapiens
ctattttccgcagcaggaagta

SEQ ID NO: 7071722 - DNA, 22 bp, Homo sapiens
ctattttaagaggccattaggt

SEQ ID NO: 7071723 - DNA, 22 bp, Homo sapiens
ctattttaagaggccattaggt

SEQ ID NO: 7071724 - DNA, 22 bp, Homo sapiens
ctattttaacttgattacctct

SEQ ID NO: 7071725 - DNA, 22 bp, Homo sapiens
ttctttaaaatagtgagaaaga

SEQ ID NO: 7071726 - DNA, 22 bp, Homo sapiens
ttcttgtttattaagatataaa

SEQ ID NO: 7071727 - DNA, 22 bp, Homo sapiens
ttcttgggtgtgaccagtctga

SEQ ID NO: 7071728 - DNA, 22 bp, Homo sapiens
ttgacttttcttggtcacatga

SEQ ID NO: 7071729 - DNA, 22 bp, Homo sapiens
ttgagctgtaaggtgggatgtg

SEQ ID NO: 7071730 - DNA, 22 bp, Homo sapiens
ttgacttcccagacttgtgttt

SEQ ID NO: 7071731 - DNA, 17 bp, Homo sapiens
ttgactgttaatgggtt

SEQ ID NO: 7071732 - DNA, 22 bp, Homo sapiens
ttgacttcagcctgtacttgta

SEQ ID NO: 7071733 - DNA, 22 bp, Homo sapiens
ttgactgtacaaccttttgtag

SEQ ID NO: 7071734 - DNA, 22 bp, Homo sapiens
ttgactatactctggcggaaaa

SEQ ID NO: 7071735 - DNA, 22 bp, Homo sapiens
ttgacctatgtttcttcatctg

SEQ ID NO: 7071736 - DNA, 22 bp, Homo sapiens
ttgaggagcaggatgggaggct

SEQ ID NO: 7071737 - DNA, 22 bp, Homo sapiens
ttgaggaggcctttcagggctt

SEQ ID NO: 7071738 - DNA, 22 bp, Homo sapiens
ttgataaaatgatatcttcttt

SEQ ID NO: 7071739 - DNA, 22 bp, Homo sapiens
ttgataaaatgatgaaatcact

SEQ ID NO: 7071740 - DNA, 22 bp, Homo sapiens
ttgatacacaatggaacaatgt

SEQ ID NO: 7071741 - DNA, 22 bp, Homo sapiens
ttgctttgccaccagaagtcta

SEQ ID NO: 7071742 - DNA, 22 bp, Homo sapiens
ctcagtttttgctgtctggttc

SEQ ID NO: 7071743 - DNA, 22 bp, Homo sapiens
ctcagttttgctagctggagtt

SEQ ID NO: 7071744 - DNA, 22 bp, Homo sapiens
ctcagtttcttactctgtataa

SEQ ID NO: 7071745 - DNA, 22 bp, Homo sapiens
ctcagtttgaatgctgacactg

SEQ ID NO: 7071746 - DNA, 22 bp, Homo sapiens
ctcagtttgaggggtaggtgtt

SEQ ID NO: 7071747 - DNA, 22 bp, Homo sapiens
ctcagtttctgacattaaaatc

SEQ ID NO: 7071748 - DNA, 22 bp, Homo sapiens
ctcagtttcctcttctgttgaa

SEQ ID NO: 7071749 - DNA, 22 bp, Homo sapiens
ctcagtttcctcaactgcaaaa

SEQ ID NO: 7071750 - DNA, 22 bp, Homo sapiens
ctcagtttccccggcctgggcg

SEQ ID NO: 7071751 - DNA, 22 bp, Homo sapiens
ttgctttgttactgcagtttcc

SEQ ID NO: 7071752 - DNA, 18 bp, Homo sapiens
ttgctttgtaagcttgca

SEQ ID NO: 7071753 - DNA, 22 bp, Homo sapiens
ttgctttgtggtggttcttcca

SEQ ID NO: 7071754 - DNA, 22 bp, Homo sapiens
ttgcttttaattaatcattgct

SEQ ID NO: 7071755 - DNA, 22 bp, Homo sapiens
ttgcttttaattaatcattgct

SEQ ID NO: 7071756 - DNA, 22 bp, Homo sapiens
ttggcattgaagtttcattggt

SEQ ID NO: 7071757 - DNA, 22 bp, Homo sapiens
ttggatgaagtctagctttagt

SEQ ID NO: 7071758 - DNA, 22 bp, Homo sapiens
ttggatgagagggtgtggtaca

SEQ ID NO: 7071759 - DNA, 22 bp, Homo sapiens
ttggcatttttcctcagctgga

SEQ ID NO: 7071760 - DNA, 22 bp, Homo sapiens
ttggaaaaacacgatagtggtt

SEQ ID NO: 7071761 - DNA, 22 bp, Homo sapiens
ctcataatgtgactgtatttga

SEQ ID NO: 7071762 - DNA, 22 bp, Homo sapiens
ttgggcagaggctgtgcagagg

SEQ ID NO: 7071763 - DNA, 22 bp, Homo sapiens
ttgggcagaggccaggaggatg

SEQ ID NO: 7071764 - DNA, 22 bp, Homo sapiens
ttgggcagaggccaggaggatg

SEQ ID NO: 7071765 - DNA, 22 bp, Homo sapiens
ttgggcacggacaggtggggat

SEQ ID NO: 7071766 - DNA, 20 bp, Homo sapiens
ctcatctctgagcctcctgg

SEQ ID NO: 7071767 - DNA, 22 bp, Homo sapiens
ctcatctgataaatcactctta

SEQ ID NO: 7071768 - DNA, 22 bp, Homo sapiens
ttgggaggtaatggagccaagt

SEQ ID NO: 7071769 - DNA, 22 bp, Homo sapiens
ttgggaggtcataaatctgttc

SEQ ID NO: 7071770 - DNA, 22 bp, Homo sapiens
ctccagtgcgcaggacagcccc

SEQ ID NO: 7071771 - DNA, 22 bp, Homo sapiens
ctccaggtgcagaaggactcag

SEQ ID NO: 7071772 - DNA, 22 bp, Homo sapiens
ttgttacagcagcaatagaaaa

SEQ ID NO: 7071773 - DNA, 22 bp, Homo sapiens
ttgttacagcagcaatagaaaa

SEQ ID NO: 7071774 - DNA, 22 bp, Homo sapiens
ttgttaaaggcaaaacaagcac

SEQ ID NO: 7071775 - DNA, 22 bp, Homo sapiens
ttgttaaatggatgcagaataa

SEQ ID NO: 7071776 - DNA, 21 bp, Homo sapiens
ttgttacaatgcaagagtatg

SEQ ID NO: 7071777 - DNA, 22 bp, Homo sapiens
ttgtattttgttatgctactgc

SEQ ID NO: 7071778 - DNA, 22 bp, Homo sapiens
ttgttaaaaatagatttccagg

SEQ ID NO: 7071779 - DNA, 22 bp, Homo sapiens
ttgttaaaactccattggtttg

SEQ ID NO: 7071780 - DNA, 22 bp, Homo sapiens
ttgttaaaatgcatattctggt

SEQ ID NO: 7071781 - DNA, 22 bp, Homo sapiens
ttgtatttgggtagtatagaga

SEQ ID NO: 7071782 - DNA, 22 bp, Homo sapiens
ttgtattttgttatgctactgc

SEQ ID NO: 7071783 - DNA, 22 bp, Homo sapiens
ttgtatttctccactttctgtt

SEQ ID NO: 7071784 - DNA, 22 bp, Homo sapiens
ttgtatttgattgtcatatcgt

SEQ ID NO: 7071785 - DNA, 22 bp, Homo sapiens
ctccagggaggtctgcaggact

SEQ ID NO: 7071786 - DNA, 22 bp, Homo sapiens
ctccagggagcttggaaagacc

SEQ ID NO: 7071787 - DNA, 22 bp, Homo sapiens
tttaaatttagaagaaacactg

SEQ ID NO: 7071788 - DNA, 22 bp, Homo sapiens
tttaaatttagaagaaacactg

SEQ ID NO: 7071789 - DNA, 22 bp, Homo sapiens
tttaaaagttatcatctgtcca

SEQ ID NO: 7071790 - DNA, 22 bp, Homo sapiens
tttaaaaggggtattaagtcca

SEQ ID NO: 7071791 - DNA, 22 bp, Homo sapiens
tttaaaaaactagtctgagtct

SEQ ID NO: 7071792 - DNA, 22 bp, Homo sapiens
tttaaaaaactagtctgagtct

SEQ ID NO: 7071793 - DNA, 17 bp, Homo sapiens
tttagaatacaatgttt

SEQ ID NO: 7071794 - DNA, 22 bp, Homo sapiens
tttacacatacctctttaaagt

SEQ ID NO: 7071795 - DNA, 22 bp, Homo sapiens
tttacatagtgctttcccacta

SEQ ID NO: 7071796 - DNA, 22 bp, Homo sapiens
ctcctcccacggtctcaggaag

SEQ ID NO: 7071797 - DNA, 16 bp, Homo sapiens
ctcctctccttcagga

SEQ ID NO: 7071798 - DNA, 17 bp, Homo sapiens
ctcctctctgggttact

SEQ ID NO: 7071799 - DNA, 22 bp, Homo sapiens
ctcctctggaaattcctctgcc

SEQ ID NO: 7071800 - DNA, 22 bp, Homo sapiens
ctcctctggcttcctggaggca

SEQ ID NO: 7071801 - DNA, 22 bp, Homo sapiens
tttagacaggggcaaaataagg

SEQ ID NO: 7071802 - DNA, 22 bp, Homo sapiens
tttagacatagctgaaatcatt

SEQ ID NO: 7071803 - DNA, 22 bp, Homo sapiens
tttagacatctataattgctaa

SEQ ID NO: 7071804 - DNA, 22 bp, Homo sapiens
tttagacactagggatgcagtg

SEQ ID NO: 7071805 - DNA, 22 bp, Homo sapiens
tttagacagcatctggtgactt

SEQ ID NO: 7071806 - DNA, 22 bp, Homo sapiens
tttagacagcggctctgaacca

SEQ ID NO: 7071807 - DNA, 22 bp, Homo sapiens
tttagacagcatctggtgactt

SEQ ID NO: 7071808 - DNA, 22 bp, Homo sapiens
tttagacagatgtgaggtgggt

SEQ ID NO: 7071809 - DNA, 17 bp, Homo sapiens
tttagaatacaatgttt

SEQ ID NO: 7071810 - DNA, 22 bp, Homo sapiens
tttagaatgttagcgttaaagg

SEQ ID NO: 7071811 - DNA, 22 bp, Homo sapiens
tttagacaagatccttctgaat

SEQ ID NO: 7071812 - DNA, 22 bp, Homo sapiens
tttagacacactttgtatattt

SEQ ID NO: 7071813 - DNA, 22 bp, Homo sapiens
ctcctctggcttcctggaggca

SEQ ID NO: 7071814 - DNA, 22 bp, Homo sapiens
ctcctctgtattgattgggact

SEQ ID NO: 7071815 - DNA, 22 bp, Homo sapiens
ctcctctgtctaccacgagggt

SEQ ID NO: 7071816 - DNA, 22 bp, Homo sapiens
ctcctctgtctggccctgagcc

SEQ ID NO: 7071817 - DNA, 22 bp, Homo sapiens
ctcctctgtctaccacgagggt

SEQ ID NO: 7071818 - DNA, 22 bp, Homo sapiens
ctcctcttctgagtaccaggga

SEQ ID NO: 7071819 - DNA, 22 bp, Homo sapiens
ctcctctttagccccagctgga

SEQ ID NO: 7071820 - DNA, 22 bp, Homo sapiens
ctcctctttagccccagctgga

SEQ ID NO: 7071821 - DNA, 22 bp, Homo sapiens
ctcctctttagccccagctgga

SEQ ID NO: 7071822 - DNA, 22 bp, Homo sapiens
ctcctctttggggatttacaca

SEQ ID NO: 7071823 - DNA, 22 bp, Homo sapiens
ctcctgacttgtgagcccctcc

SEQ ID NO: 7071824 - DNA, 22 bp, Homo sapiens
ctcctgagaaataagcaagtaa

SEQ ID NO: 7071825 - DNA, 21 bp, Homo sapiens
ctctccagtggttcctgattc

SEQ ID NO: 7071826 - DNA, 22 bp, Homo sapiens
tttcagttcagtttattatatc

SEQ ID NO: 7071827 - DNA, 22 bp, Homo sapiens
ctctccaggactttggcccaat

SEQ ID NO: 7071828 - DNA, 22 bp, Homo sapiens
ctctccaggactttggcccaat

SEQ ID NO: 7071829 - DNA, 22 bp, Homo sapiens
ctctcccccacagcagccttct

SEQ ID NO: 7071830 - DNA, 22 bp, Homo sapiens
ctctccctaggttagcggtcag

SEQ ID NO: 7071831 - DNA, 22 bp, Homo sapiens
ctctccctatgcctcccaggag

SEQ ID NO: 7071832 - DNA, 22 bp, Homo sapiens
ctctccctggccagctgtgcag

SEQ ID NO: 7071833 - DNA, 22 bp, Homo sapiens
ctctcccttgggtgggctttgg

SEQ ID NO: 7071834 - DNA, 22 bp, Homo sapiens
ctctccctggccagctgtgcag

SEQ ID NO: 7071835 - DNA, 22 bp, Homo sapiens
ctctcctacatttcattcacaa

SEQ ID NO: 7071836 - DNA, 20 bp, Homo sapiens
ctctcctcacccgtgtcagg

SEQ ID NO: 7071837 - DNA, 22 bp, Homo sapiens
ctctcctcagaacaggccctct

SEQ ID NO: 7071838 - DNA, 22 bp, Homo sapiens
ctctcctcagaacaggccctct

SEQ ID NO: 7071839 - DNA, 22 bp, Homo sapiens
ctctcctccaggaactcacagt

SEQ ID NO: 7071840 - DNA, 22 bp, Homo sapiens
ctcctgggagctgtggcagagc

SEQ ID NO: 7071841 - DNA, 22 bp, Homo sapiens
ctcctgggagtcttcctggatg

SEQ ID NO: 7071842 - DNA, 22 bp, Homo sapiens
ctcctgggagtcttcctggatg

SEQ ID NO: 7071843 - DNA, 22 bp, Homo sapiens
ctcctgggatgactctttcttt

SEQ ID NO: 7071844 - DNA, 21 bp, Homo sapiens
ctcctgggctaagatatagtg

SEQ ID NO: 7071845 - DNA, 22 bp, Homo sapiens
ctcctgggctatgtctgcttgg

SEQ ID NO: 7071846 - DNA, 22 bp, Homo sapiens
ctcctgggctcaagtgatcctc

SEQ ID NO: 7071847 - DNA, 22 bp, Homo sapiens
ctcctgggctcaagtgatcctc

SEQ ID NO: 7071848 - DNA, 22 bp, Homo sapiens
ctcctgggctcatatcattcag

SEQ ID NO: 7071849 - DNA, 18 bp, Homo sapiens
ctcctgggctgcagatgc

SEQ ID NO: 7071850 - DNA, 18 bp, Homo sapiens
ctcctgggctgcagatgc

SEQ ID NO: 7071851 - DNA, 22 bp, Homo sapiens
ctcctgggctgtcggcgctctg

SEQ ID NO: 7071852 - DNA, 19 bp, Homo sapiens
ctctcactcgccacatcct

SEQ ID NO: 7071853 - DNA, 22 bp, Homo sapiens
ctctccagatctgctgagccag

SEQ ID NO: 7071854 - DNA, 22 bp, Homo sapiens
ctctccagatctgctgagccag

SEQ ID NO: 7071855 - DNA, 22 bp, Homo sapiens
ctctccagcctttagcccacgc

SEQ ID NO: 7071856 - DNA, 22 bp, Homo sapiens
ctggaggcacccttagagaggc

SEQ ID NO: 7071857 - DNA, 21 bp, Homo sapiens
ctggaggcaggtggtgccagg

SEQ ID NO: 7071858 - DNA, 21 bp, Homo sapiens
ctggaggcaggtggtgccagg

SEQ ID NO: 7071859 - DNA, 22 bp, Homo sapiens
ctggaggctgagttgggtctcc

SEQ ID NO: 7071860 - DNA, 22 bp, Homo sapiens
ctggagggacaaggtatgcatt

SEQ ID NO: 7071861 - DNA, 22 bp, Homo sapiens
ctggaggcaaagcagaggcatg

SEQ ID NO: 7071862 - DNA, 22 bp, Homo sapiens
ctggaggagcatggactggagt

SEQ ID NO: 7071863 - DNA, 22 bp, Homo sapiens
ctggaggagaacttgaggaagg

SEQ ID NO: 7071864 - DNA, 22 bp, Homo sapiens
ctggaggagagtctgaatgaca

SEQ ID NO: 7071865 - DNA, 22 bp, Homo sapiens
ctggactttggcccatctgcca

SEQ ID NO: 7071866 - DNA, 22 bp, Homo sapiens
ctggagctctccagagccccgt

SEQ ID NO: 7071867 - DNA, 22 bp, Homo sapiens
ctggagctcttctgagtgtgct

SEQ ID NO: 7071868 - DNA, 22 bp, Homo sapiens
ctggagctgccagacgggcaca

SEQ ID NO: 7071869 - DNA, 22 bp, Homo sapiens
ctggaggaccacagaagctggt

SEQ ID NO: 7071870 - DNA, 22 bp, Homo sapiens
ctggagggactttctcacggat

SEQ ID NO: 7071871 - DNA, 22 bp, Homo sapiens
ctggagggactttctcacggat

SEQ ID NO: 7071872 - DNA, 22 bp, Homo sapiens
ctggagggcttctgcaggttac

SEQ ID NO: 7071873 - DNA, 22 bp, Homo sapiens
ctggaggggccatccacagtct

SEQ ID NO: 7071874 - DNA, 22 bp, Homo sapiens
ctggagggtgagcctcatctct

SEQ ID NO: 7071875 - DNA, 21 bp, Homo sapiens
ctggagggtagagttgggctg

SEQ ID NO: 7071876 - DNA, 22 bp, Homo sapiens
ctggagggtgagcctcatctct

SEQ ID NO: 7071877 - DNA, 22 bp, Homo sapiens
ctggagtcactcatgtagctgc

SEQ ID NO: 7071878 - DNA, 22 bp, Homo sapiens
ctggagtctccccaggagcgtg

SEQ ID NO: 7071879 - DNA, 22 bp, Homo sapiens
ctggagtctcttctgtagctac

SEQ ID NO: 7071880 - DNA, 22 bp, Homo sapiens
ctggagtgtaaagagcatagaa

SEQ ID NO: 7071881 - DNA, 20 bp, Homo sapiens
ctggagtgtagcagtggctg

SEQ ID NO: 7071882 - DNA, 22 bp, Homo sapiens
ctggagttctatgtgcttgtga

SEQ ID NO: 7071883 - DNA, 22 bp, Homo sapiens
ctggagtttgtggcttgctcaa

SEQ ID NO: 7071884 - DNA, 22 bp, Homo sapiens
ctgcctggctaaactcaagtcg

SEQ ID NO: 7071885 - DNA, 22 bp, Homo sapiens
ctgcctggctaaactcaagtcg

SEQ ID NO: 7071886 - DNA, 22 bp, Homo sapiens
ctgcctggcccagggatgggcc

SEQ ID NO: 7071887 - DNA, 22 bp, Homo sapiens
ctgcctggcctgatctccacgc

SEQ ID NO: 7071888 - DNA, 22 bp, Homo sapiens
ctgcctgggccggccaccctct

SEQ ID NO: 7071889 - DNA, 19 bp, Homo sapiens
ctgcttccttccctcactg

SEQ ID NO: 7071890 - DNA, 23 bp, Homo sapiens
ctgcttccttgcttcattgctgg

SEQ ID NO: 7071891 - DNA, 22 bp, Homo sapiens
ctgcttctaagaacctgcagct

SEQ ID NO: 7071892 - DNA, 22 bp, Homo sapiens
ctgcttctaagaacctgcagct

SEQ ID NO: 7071893 - DNA, 22 bp, Homo sapiens
ctgcttctaagaacctgcagct

SEQ ID NO: 7071894 - DNA, 21 bp, Homo sapiens
ctgctttacttcagaggatct

SEQ ID NO: 7071895 - DNA, 23 bp, Homo sapiens
ctgctttcccactccatgctctt

SEQ ID NO: 7071896 - DNA, 22 bp, Homo sapiens
ctgcctggcatggagaagagaa

SEQ ID NO: 7071897 - DNA, 22 bp, Homo sapiens
ctgcctggcatggagaagagaa

SEQ ID NO: 7071898 - DNA, 22 bp, Homo sapiens
ctgcctggcatggagaagagaa

SEQ ID NO: 7071899 - DNA, 22 bp, Homo sapiens
ctgcctggccacaacccagggt

SEQ ID NO: 7071900 - DNA, 20 bp, Homo sapiens
ctgcctggaggcctctacct

SEQ ID NO: 7071901 - DNA, 22 bp, Homo sapiens
ctgcctggatgaatggcgcctt

SEQ ID NO: 7071902 - DNA, 22 bp, Homo sapiens
ctgcctggatgaatggcgcctt

SEQ ID NO: 7071903 - DNA, 22 bp, Homo sapiens
ctgcctggaccggcagccctcc

SEQ ID NO: 7071904 - DNA, 22 bp, Homo sapiens
ctgcctggagcattctgaaggt

SEQ ID NO: 7071905 - DNA, 22 bp, Homo sapiens
ctgcctgctctatccaggcctg

SEQ ID NO: 7071906 - DNA, 22 bp, Homo sapiens
ctgcctggaatgccagcttctc

SEQ ID NO: 7071907 - DNA, 22 bp, Homo sapiens
ctgcctgcgttgcctcgtgcct

SEQ ID NO: 7071908 - DNA, 22 bp, Homo sapiens
ctgcctgctacctgaaatgcca

SEQ ID NO: 7071909 - DNA, 22 bp, Homo sapiens
ctgcctgctcaccagggctctg

SEQ ID NO: 7071910 - DNA, 22 bp, Homo sapiens
ctgctttgattagaagagtaca

SEQ ID NO: 7071911 - DNA, 22 bp, Homo sapiens
ctgctttgactgttaagaacca

SEQ ID NO: 7071912 - DNA, 22 bp, Homo sapiens
ctgctttctgcaccccaggtcg

SEQ ID NO: 7071913 - DNA, 22 bp, Homo sapiens
ctgctttgcatagctgccagag

SEQ ID NO: 7071914 - DNA, 22 bp, Homo sapiens
ctgctttggacaactattcttg

SEQ ID NO: 7071915 - DNA, 22 bp, Homo sapiens
ctgctttgggcagctttgtggc

SEQ ID NO: 7071916 - DNA, 22 bp, Homo sapiens
ctgctttgtaaaatagacataa

SEQ ID NO: 7071917 - DNA, 22 bp, Homo sapiens
ctggaaagacagagggcatggg

SEQ ID NO: 7071918 - DNA, 22 bp, Homo sapiens
ctggaaagatttctttggagtc

SEQ ID NO: 7071919 - DNA, 22 bp, Homo sapiens
ctggacagtgctgcttgagatg

SEQ ID NO: 7071920 - DNA, 22 bp, Homo sapiens
ctggacaggctggggactgcaa

SEQ ID NO: 7071921 - DNA, 22 bp, Homo sapiens
ctggacagaagtggctgggcag

SEQ ID NO: 7071922 - DNA, 22 bp, Homo sapiens
ctggacagaaaccagtcctggg

SEQ ID NO: 7071923 - DNA, 22 bp, Homo sapiens
ctggacagaaagggctgctgtg

SEQ ID NO: 7071924 - DNA, 22 bp, Homo sapiens
ctggaagtataggggagatgat

SEQ ID NO: 7071925 - DNA, 23 bp, Homo sapiens
ctggaagtgcttttatagctttg

SEQ ID NO: 7071926 - DNA, 22 bp, Homo sapiens
ctggacaaccactcagcctcag

SEQ ID NO: 7071927 - DNA, 22 bp, Homo sapiens
ctggcaagaaatatatatctta

SEQ ID NO: 7071928 - DNA, 22 bp, Homo sapiens
ctggcaagaaatatatatctta

SEQ ID NO: 7071929 - DNA, 22 bp, Homo sapiens
ctggatgataacagcaatattt

SEQ ID NO: 7071930 - DNA, 22 bp, Homo sapiens
ctggatggtcccatgagcagct

SEQ ID NO: 7071931 - DNA, 22 bp, Homo sapiens
ctggcagatagtaagtgatcaa

SEQ ID NO: 7071932 - DNA, 22 bp, Homo sapiens
ctggcagatatttgcagacatg

SEQ ID NO: 7071933 - DNA, 22 bp, Homo sapiens
ctggcacctccagctcatggcc

SEQ ID NO: 7071934 - DNA, 22 bp, Homo sapiens
ctggcagtttgccaggagctcg

SEQ ID NO: 7071935 - DNA, 22 bp, Homo sapiens
ctggcagtgtccagctcgtgat

SEQ ID NO: 7071936 - DNA, 22 bp, Homo sapiens
ctggcagtctgcctcttcactg

SEQ ID NO: 7071937 - DNA, 22 bp, Homo sapiens
ctggcagtctggtggaaggcct

SEQ ID NO: 7071938 - DNA, 22 bp, Homo sapiens
ctggcagtctggtggaaggcct

SEQ ID NO: 7071939 - DNA, 22 bp, Homo sapiens
ctggcagtgacattgcaggtgc

SEQ ID NO: 7071940 - DNA, 22 bp, Homo sapiens
ctggcagcatggagcctgtgct

SEQ ID NO: 7071941 - DNA, 22 bp, Homo sapiens
ctggcagcattaacagagagca

SEQ ID NO: 7071942 - DNA, 22 bp, Homo sapiens
ctggcctgcagatcccagggtc

SEQ ID NO: 7071943 - DNA, 22 bp, Homo sapiens
ctggcctgctgggtgaggtcct

SEQ ID NO: 7071944 - DNA, 22 bp, Homo sapiens
ctggcctgaggccgccttcaga

SEQ ID NO: 7071945 - DNA, 22 bp, Homo sapiens
ctggccagttgtcctggcttgg

SEQ ID NO: 7071946 - DNA, 22 bp, Homo sapiens
ctggccatgttgcctctgagac

SEQ ID NO: 7071947 - DNA, 22 bp, Homo sapiens
ctggcccaggagagcaggcatt

SEQ ID NO: 7071948 - DNA, 22 bp, Homo sapiens
ctggcctggcaggggacctcta

SEQ ID NO: 7071949 - DNA, 22 bp, Homo sapiens
ctggcctggggcctcagctgct

SEQ ID NO: 7071950 - DNA, 22 bp, Homo sapiens
ctggctccaggtcatgcactca

SEQ ID NO: 7071951 - DNA, 23 bp, Homo sapiens
ctggctccgaagactccaggatc

SEQ ID NO: 7071952 - DNA, 22 bp, Homo sapiens
ctggctcctgaggcttggcccc

SEQ ID NO: 7071953 - DNA, 22 bp, Homo sapiens
ctggctctatctccaaggctgg

SEQ ID NO: 7071954 - DNA, 22 bp, Homo sapiens
ctggctctatctccaaggctgg

SEQ ID NO: 7071955 - DNA, 22 bp, Homo sapiens
ctggctctgagtggctctaatt

SEQ ID NO: 7071956 - DNA, 22 bp, Homo sapiens
ctggctctgagtggtatcttga

SEQ ID NO: 7071957 - DNA, 22 bp, Homo sapiens
ctgagaataaagccagcaggag

SEQ ID NO: 7071958 - DNA, 22 bp, Homo sapiens
ctgagaatggacagcagggcag

SEQ ID NO: 7071959 - DNA, 22 bp, Homo sapiens
ctgactgttgctgttgatgagg

SEQ ID NO: 7071960 - DNA, 22 bp, Homo sapiens
ctgactgtttgctgaaaggtct

SEQ ID NO: 7071961 - DNA, 22 bp, Homo sapiens
ctgacttcagggataaaaagta

SEQ ID NO: 7071962 - DNA, 22 bp, Homo sapiens
ctgaagatgtctgagatgctca

SEQ ID NO: 7071963 - DNA, 22 bp, Homo sapiens
ctgactgtgagagcaggaatgg

SEQ ID NO: 7071964 - DNA, 17 bp, Homo sapiens
ctgaagataatggcaac

SEQ ID NO: 7071965 - DNA, 22 bp, Homo sapiens
ctgaagaggacgcagcagcaag

SEQ ID NO: 7071966 - DNA, 22 bp, Homo sapiens
ctgaagaggacgcagcagcaag

SEQ ID NO: 7071967 - DNA, 22 bp, Homo sapiens
ctgaagaggactgggttggagg

SEQ ID NO: 7071968 - DNA, 22 bp, Homo sapiens
ctgaaagcattaactccacttc

SEQ ID NO: 7071969 - DNA, 22 bp, Homo sapiens
ctgaaaggaataaggctctttg

SEQ ID NO: 7071970 - DNA, 22 bp, Homo sapiens
ctgaaaggagagctgcaaggat

SEQ ID NO: 7071971 - DNA, 20 bp, Homo sapiens
ctgaaaggagtcgggatgtc

SEQ ID NO: 7071972 - DNA, 22 bp, Homo sapiens
ctgaaaggcagtgggtagtgtg

SEQ ID NO: 7071973 - DNA, 22 bp, Homo sapiens
ctgaaccactaatattttgatt

SEQ ID NO: 7071974 - DNA, 22 bp, Homo sapiens
ctgaaccatctctgttctgtat

SEQ ID NO: 7071975 - DNA, 22 bp, Homo sapiens
ctgaagagaaagggagctcttc

SEQ ID NO: 7071976 - DNA, 22 bp, Homo sapiens
ctgaagagaaagggagctcttc

SEQ ID NO: 7071977 - DNA, 22 bp, Homo sapiens
ctgaagagcaaaccaactggac

SEQ ID NO: 7071978 - DNA, 22 bp, Homo sapiens
tttttaagctcctttgatgtca

SEQ ID NO: 7071979 - DNA, 22 bp, Homo sapiens
tttttaagctcctttgatgtca

SEQ ID NO: 7071980 - DNA, 22 bp, Homo sapiens
tttttaagctcctttgatgtca

SEQ ID NO: 7071981 - DNA, 22 bp, Homo sapiens
tttttaagagtctggaaatagt

SEQ ID NO: 7071982 - DNA, 22 bp, Homo sapiens
tttttaagagtctggaaatagt

SEQ ID NO: 7071983 - DNA, 22 bp, Homo sapiens
tttttaagagattctccagtct

SEQ ID NO: 7071984 - DNA, 22 bp, Homo sapiens
tttttaagagattctccagtct

SEQ ID NO: 7071985 - DNA, 22 bp, Homo sapiens
tttttaagagattctccagtct

SEQ ID NO: 7071986 - DNA, 22 bp, Homo sapiens
ttttgttttcttagaaacctgg

SEQ ID NO: 7071987 - DNA, 22 bp, Homo sapiens
ttttgttttcttagaaacctgg

SEQ ID NO: 7071988 - DNA, 22 bp, Homo sapiens
ctctttttcacctctgtcagcg

SEQ ID NO: 7071989 - DNA, 22 bp, Homo sapiens
ctctttttcagccttaccaaag

SEQ ID NO: 7071990 - DNA, 19 bp, Homo sapiens
ctgaaaaacattctcagga

SEQ ID NO: 7071991 - DNA, 22 bp, Homo sapiens
ctcttttaattgtcataacaac

SEQ ID NO: 7071992 - DNA, 22 bp, Homo sapiens
ctctttgtcactcatacagtca

SEQ ID NO: 7071993 - DNA, 22 bp, Homo sapiens
ctctttgtgctattatgatcct

SEQ ID NO: 7071994 - DNA, 22 bp, Homo sapiens
ctctggttcagggctccctggc

SEQ ID NO: 7071995 - DNA, 22 bp, Homo sapiens
ctctgggttcactgaggctctg

SEQ ID NO: 7071996 - DNA, 22 bp, Homo sapiens
ctctgggcaggaccagtggacc

SEQ ID NO: 7071997 - DNA, 22 bp, Homo sapiens
ctctgggcaggaccagtggacc

SEQ ID NO: 7071998 - DNA, 22 bp, Homo sapiens
ctctgggcaggaccagtggacc

SEQ ID NO: 7071999 - DNA, 22 bp, Homo sapiens
ctctgggcaaagatgcctcatc

SEQ ID NO: 7072000 - DNA, 22 bp, Homo sapiens
ctctgggatgaggcctaggcac

SEQ ID NO: 7072001 - DNA, 22 bp, Homo sapiens
ctctgggcaaagatgcctcatc

SEQ ID NO: 7072002 - DNA, 22 bp, Homo sapiens
ctctgggatagagcctcggtct

SEQ ID NO: 7072003 - DNA, 22 bp, Homo sapiens
ctctgggatgaggcctaggcac

SEQ ID NO: 7072004 - DNA, 22 bp, Homo sapiens
ctctggcttctaccttgcagtt

SEQ ID NO: 7072005 - DNA, 19 bp, Homo sapiens
ctctgggcaagtcacttaa

SEQ ID NO: 7072006 - DNA, 22 bp, Homo sapiens
ctctgggccatgctactgctct

SEQ ID NO: 7072007 - DNA, 21 bp, Homo sapiens
ctctgggccattttcttccac

SEQ ID NO: 7072008 - DNA, 21 bp, Homo sapiens
ctctgggccattttcttccac

SEQ ID NO: 7072009 - DNA, 22 bp, Homo sapiens
ctctgggctccttcagcccttt

SEQ ID NO: 7072010 - DNA, 22 bp, Homo sapiens
ttttagttactgcagtagcaaa

SEQ ID NO: 7072011 - DNA, 22 bp, Homo sapiens
ttttattatctttgaatgggac

SEQ ID NO: 7072012 - DNA, 22 bp, Homo sapiens
ttttattcaaatagttcacact

SEQ ID NO: 7072013 - DNA, 22 bp, Homo sapiens
ttttattcatagggatggagag

SEQ ID NO: 7072014 - DNA, 22 bp, Homo sapiens
ttttattctcagctccagagag

SEQ ID NO: 7072015 - DNA, 22 bp, Homo sapiens
tttgtgaatggaatccacagac

SEQ ID NO: 7072016 - DNA, 22 bp, Homo sapiens
tttgtgaataggttggcttcca

SEQ ID NO: 7072017 - DNA, 22 bp, Homo sapiens
tttgtgaataggttggcttcca

SEQ ID NO: 7072018 - DNA, 22 bp, Homo sapiens
ctctggctggcacctgatctga

SEQ ID NO: 7072019 - DNA, 22 bp, Homo sapiens
ctctggctgtcccgatgagcag

SEQ ID NO: 7072020 - DNA, 22 bp, Homo sapiens
tttgtgaacttaggcaattagg

SEQ ID NO: 7072021 - DNA, 22 bp, Homo sapiens
tttgtcttggcctcagttttct

SEQ ID NO: 7072022 - DNA, 22 bp, Homo sapiens
tttgtacatcctaattctgagt

SEQ ID NO: 7072023 - DNA, 22 bp, Homo sapiens
ctctcctctgaagtggtgaccc

SEQ ID NO: 7072024 - DNA, 23 bp, Homo sapiens
ctctcctgaaggacaagctgccg

SEQ ID NO: 7072025 - DNA, 22 bp, Homo sapiens
ctctcctgggctgaccgtccga

SEQ ID NO: 7072026 - DNA, 22 bp, Homo sapiens
ctctcctgggctgaccgtccga

SEQ ID NO: 7072027 - DNA, 22 bp, Homo sapiens
ctgagaattactctgatgagta

SEQ ID NO: 7072028 - DNA, 22 bp, Homo sapiens
ctgagactttcatgtgctttta

SEQ ID NO: 7072029 - DNA, 22 bp, Homo sapiens
ctgagacccagacacctgagga

SEQ ID NO: 7072030 - DNA, 22 bp, Homo sapiens
ctgagagaaacatgactcagga

SEQ ID NO: 7072031 - DNA, 22 bp, Homo sapiens
ctgaggaggctaatttgaggat

SEQ ID NO: 7072032 - DNA, 22 bp, Homo sapiens
ctgaggaggctaatttgaggat

SEQ ID NO: 7072033 - DNA, 22 bp, Homo sapiens
ctgaggagggaagtccccaaag

SEQ ID NO: 7072034 - DNA, 22 bp, Homo sapiens
ctgaggaggggcctgagtgaga

SEQ ID NO: 7072035 - DNA, 22 bp, Homo sapiens
ctgagagaatcatgctgcaggt

SEQ ID NO: 7072036 - DNA, 22 bp, Homo sapiens
ctgaggaccccacaggaggccc

SEQ ID NO: 7072037 - DNA, 22 bp, Homo sapiens
ctgaggagtgggtgggcagtga

SEQ ID NO: 7072038 - DNA, 19 bp, Homo sapiens
ctgaggcaagtggtggtca

SEQ ID NO: 7072039 - DNA, 22 bp, Homo sapiens
ctgaggcacagtgaacttctcc

SEQ ID NO: 7072040 - DNA, 22 bp, Homo sapiens
ctgaggcacccatcttctcctg

SEQ ID NO: 7072041 - DNA, 22 bp, Homo sapiens
ctgaggcaccggcaatgttctg

SEQ ID NO: 7072042 - DNA, 22 bp, Homo sapiens
ctgaggcacctacagtctcggg

SEQ ID NO: 7072043 - DNA, 22 bp, Homo sapiens
ctgaggcactaacaaggacaag

SEQ ID NO: 7072044 - DNA, 22 bp, Homo sapiens
ctgaggcactggtaatgggcat

SEQ ID NO: 7072045 - DNA, 22 bp, Homo sapiens
ctgaggcactgtcagctgaggc

SEQ ID NO: 7072046 - DNA, 22 bp, Homo sapiens
ctgaggcagaaaaagcaagggt

SEQ ID NO: 7072047 - DNA, 22 bp, Homo sapiens
ctgcagaaagctgagatgatta

SEQ ID NO: 7072048 - DNA, 22 bp, Homo sapiens
ctgaggcagagaatgagtttgt

SEQ ID NO: 7072049 - DNA, 22 bp, Homo sapiens
ctgagtccagggacagaggcgt

SEQ ID NO: 7072050 - DNA, 22 bp, Homo sapiens
ctgagtccttgggcttagagtg

SEQ ID NO: 7072051 - DNA, 22 bp, Homo sapiens
ctgatctgtcctcctcagagcc

SEQ ID NO: 7072052 - DNA, 22 bp, Homo sapiens
ctgatgcctctcttcttggctt

SEQ ID NO: 7072053 - DNA, 22 bp, Homo sapiens
ctgatgctctggatgtagtcaa

SEQ ID NO: 7072054 - DNA, 22 bp, Homo sapiens
ctgatggagactccactgtgat

SEQ ID NO: 7072055 - DNA, 22 bp, Homo sapiens
ctgatggagagtgtgatttggg

SEQ ID NO: 7072056 - DNA, 22 bp, Homo sapiens
ctgatggagtgatggagaaatt

SEQ ID NO: 7072057 - DNA, 22 bp, Homo sapiens
ctgatggatgctacgtaagagg

SEQ ID NO: 7072058 - DNA, 22 bp, Homo sapiens
ctgatggatggacaggggtagt

SEQ ID NO: 7072059 - DNA, 17 bp, Homo sapiens
ctgatggattttttcca

SEQ ID NO: 7072060 - DNA, 22 bp, Homo sapiens
ctgcagaggggttgaagggtcc

SEQ ID NO: 7072061 - DNA, 22 bp, Homo sapiens
ctgcagagctaggctgagtgaa

SEQ ID NO: 7072062 - DNA, 22 bp, Homo sapiens
ctgcagagcttgtctggatgtg

SEQ ID NO: 7072063 - DNA, 22 bp, Homo sapiens
ctgcagatttggtgtctggtga

SEQ ID NO: 7072064 - DNA, 22 bp, Homo sapiens
ctgcagaggtcttgctgatggt

SEQ ID NO: 7072065 - DNA, 22 bp, Homo sapiens
ctgcagatcttgtgtacttgtc

SEQ ID NO: 7072066 - DNA, 22 bp, Homo sapiens
ctgcagatggtattgttctggt

SEQ ID NO: 7072067 - DNA, 22 bp, Homo sapiens
ctgccaggactgacgtcttcag

SEQ ID NO: 7072068 - DNA, 22 bp, Homo sapiens
ctgccaggcctccgctgtcccc

SEQ ID NO: 7072069 - DNA, 22 bp, Homo sapiens
ctgccagggcatcctgtggtgg

SEQ ID NO: 7072070 - DNA, 22 bp, Homo sapiens
ctgccaggggcctcacaggcca

SEQ ID NO: 7072071 - DNA, 22 bp, Homo sapiens
ctgccctggggggcctccttgc

SEQ ID NO: 7072072 - DNA, 22 bp, Homo sapiens
ctgccaggttggcgctcgctct

SEQ ID NO: 7072073 - DNA, 22 bp, Homo sapiens
ctgccaggttggcgctcgctct

SEQ ID NO: 7072074 - DNA, 22 bp, Homo sapiens
ctgccagtctatgctgctcggc

SEQ ID NO: 7072075 - DNA, 22 bp, Homo sapiens
ctgccatctgagccaaaagtgc

SEQ ID NO: 7072076 - DNA, 22 bp, Homo sapiens
ctgcctagatttgaatcctggc

SEQ ID NO: 7072077 - DNA, 22 bp, Homo sapiens
ctgcctcacattggctgtgtga

SEQ ID NO: 7072078 - DNA, 22 bp, Homo sapiens
ctgcctagggtctggtaccaca

SEQ ID NO: 7072079 - DNA, 22 bp, Homo sapiens
ctgcctcagccttctgggtgac

SEQ ID NO: 7072080 - DNA, 22 bp, Homo sapiens
ctgcctcagcgttgtggcccta

SEQ ID NO: 7072081 - DNA, 22 bp, Homo sapiens
ctgcctcagcgttgtggcccta

SEQ ID NO: 7072082 - DNA, 22 bp, Homo sapiens
ctgcctcatgctgcctgcagcc

SEQ ID NO: 7072083 - DNA, 22 bp, Homo sapiens
ctgcctcagcgttgtggcccta

SEQ ID NO: 7072084 - DNA, 22 bp, Homo sapiens
ctgcctcatgctgcctgcagcc

SEQ ID NO: 7072085 - DNA, 22 bp, Homo sapiens
ctgcctcatgctgcctgcagcc

SEQ ID NO: 7072086 - DNA, 22 bp, Homo sapiens
ctgcctccaggctcaccttgac

SEQ ID NO: 7072087 - DNA, 22 bp, Homo sapiens
ctgcctcctcacgtccacagtg

SEQ ID NO: 7072088 - DNA, 22 bp, Homo sapiens
ctgcctcctgccgtgcagcttc

SEQ ID NO: 7072089 - DNA, 22 bp, Homo sapiens
ctgcctcctgccgtgcagcttc

SEQ ID NO: 7072090 - DNA, 22 bp, Homo sapiens
ctgcctcctgccgtgcagcttc

SEQ ID NO: 7072091 - DNA, 22 bp, Homo sapiens
ctgcctcctggctgatgggtag

SEQ ID NO: 7072092 - DNA, 22 bp, Homo sapiens
ctgcctgcgttgcctcgtgcct

SEQ ID NO: 7072093 - DNA, 22 bp, Homo sapiens
tgccaggcgtggtggtgcgcac

SEQ ID NO: 7072094 - DNA, 22 bp, Homo sapiens
tgccaggctaagtggaggactt

SEQ ID NO: 7072095 - DNA, 21 bp, Homo sapiens
tgccaggcctgagctggggtc

SEQ ID NO: 7072096 - DNA, 21 bp, Homo sapiens
tgccaggcctgagctggggtc

SEQ ID NO: 7072097 - DNA, 22 bp, Homo sapiens
tgccaggcgattgctatcagca

SEQ ID NO: 7072098 - DNA, 22 bp, Homo sapiens
tgccaggcgattgctatcagca

SEQ ID NO: 7072099 - DNA, 22 bp, Homo sapiens
tgccaggcgtggtggtgcgcac

SEQ ID NO: 7072100 - DNA, 22 bp, Homo sapiens
cccaggaggtgtgcccaactcg

SEQ ID NO: 7072101 - DNA, 22 bp, Homo sapiens
cccaggaggttgaggctgcagt

SEQ ID NO: 7072102 - DNA, 22 bp, Homo sapiens
tgccaggcctcaggagtctcca

SEQ ID NO: 7072103 - DNA, 22 bp, Homo sapiens
tgccaggcctcaggagtctcca

SEQ ID NO: 7072104 - DNA, 22 bp, Homo sapiens
tgccaggcctcaggagtctcca

SEQ ID NO: 7072105 - DNA, 22 bp, Homo sapiens
cccaggaggtggagttcacagt

SEQ ID NO: 7072106 - DNA, 22 bp, Homo sapiens
cccaggaggtggaggttgcagt

SEQ ID NO: 7072107 - DNA, 22 bp, Homo sapiens
cccaggaggtggaggttgcagc

SEQ ID NO: 7072108 - DNA, 22 bp, Homo sapiens
tgccacagagcaattctgctga

SEQ ID NO: 7072109 - DNA, 22 bp, Homo sapiens
tgccaagtgcttacttggccct

SEQ ID NO: 7072110 - DNA, 22 bp, Homo sapiens
tgccacacaattactgctgcta

SEQ ID NO: 7072111 - DNA, 22 bp, Homo sapiens
tgccacactcccctgctgcagt

SEQ ID NO: 7072112 - DNA, 17 bp, Homo sapiens
cccagctggcagtgccg

SEQ ID NO: 7072113 - DNA, 18 bp, Homo sapiens
cccagctggtgggtcagt

SEQ ID NO: 7072114 - DNA, 22 bp, Homo sapiens
cccagctgtaacgggtctgcac

SEQ ID NO: 7072115 - DNA, 23 bp, Homo sapiens
cccagctgcagacaagggagggt

SEQ ID NO: 7072116 - DNA, 23 bp, Homo sapiens
cccagctgcagacaagggagggt

SEQ ID NO: 7072117 - DNA, 23 bp, Homo sapiens
cccagctggaagttagaggacca

SEQ ID NO: 7072118 - DNA, 17 bp, Homo sapiens
cccagctggcagtgccg

SEQ ID NO: 7072119 - DNA, 22 bp, Homo sapiens
cccagctgatttttgcagagat

SEQ ID NO: 7072120 - DNA, 22 bp, Homo sapiens
cccagctgatttttgcagagat

SEQ ID NO: 7072121 - DNA, 22 bp, Homo sapiens
cccagctgtggcagaggccggg

SEQ ID NO: 7072122 - DNA, 22 bp, Homo sapiens
cccagcgagtttgccggtgaac

SEQ ID NO: 7072123 - DNA, 22 bp, Homo sapiens
cccagcgagtttgccggtgaac

SEQ ID NO: 7072124 - DNA, 22 bp, Homo sapiens
tgcagggaatgcttgcagcatg

SEQ ID NO: 7072125 - DNA, 22 bp, Homo sapiens
tgcagggaatgcttgcagcatg

SEQ ID NO: 7072126 - DNA, 22 bp, Homo sapiens
tgcagggacacgaagacaaata

SEQ ID NO: 7072127 - DNA, 22 bp, Homo sapiens
tgcagggacacgaagacaaata

SEQ ID NO: 7072128 - DNA, 22 bp, Homo sapiens
tgcagggagggcccagcaatct

SEQ ID NO: 7072129 - DNA, 22 bp, Homo sapiens
tgcagggatcctagctgaagag

SEQ ID NO: 7072130 - DNA, 22 bp, Homo sapiens
cccagcctggtgcactgtgggg

SEQ ID NO: 7072131 - DNA, 22 bp, Homo sapiens
tgctgcagaaattctgtgagga

SEQ ID NO: 7072132 - DNA, 22 bp, Homo sapiens
tgctgactcctggctgtgacac

SEQ ID NO: 7072133 - DNA, 19 bp, Homo sapiens
tgctgactgagctgcaaaa

SEQ ID NO: 7072134 - DNA, 19 bp, Homo sapiens
tgctgactgggcctcaccg

SEQ ID NO: 7072135 - DNA, 19 bp, Homo sapiens
tgctgaagttgtcagtctg

SEQ ID NO: 7072136 - DNA, 22 bp, Homo sapiens
cccagggaggcccaggctctgc

SEQ ID NO: 7072137 - DNA, 22 bp, Homo sapiens
cccagggactcgggattctagg

SEQ ID NO: 7072138 - DNA, 22 bp, Homo sapiens
cccagggagagcgcggaggcgg

SEQ ID NO: 7072139 - DNA, 22 bp, Homo sapiens
tgctcccacactactcggaggc

SEQ ID NO: 7072140 - DNA, 22 bp, Homo sapiens
tgctcccagctcctgcagcaac

SEQ ID NO: 7072141 - DNA, 22 bp, Homo sapiens
cccagggaggtagcaggagaaa

SEQ ID NO: 7072142 - DNA, 22 bp, Homo sapiens
cccagggaggtagcaggagaaa

SEQ ID NO: 7072143 - DNA, 22 bp, Homo sapiens
cccagggaggtagcaggagaaa

SEQ ID NO: 7072144 - DNA, 22 bp, Homo sapiens
cccagggaggtagcaggagaaa

SEQ ID NO: 7072145 - DNA, 22 bp, Homo sapiens
cccagggatgtggcagatgtta

SEQ ID NO: 7072146 - DNA, 22 bp, Homo sapiens
cccagggatgtggcagatgtta

SEQ ID NO: 7072147 - DNA, 22 bp, Homo sapiens
cccagggatgtggcagatgtta

SEQ ID NO: 7072148 - DNA, 22 bp, Homo sapiens
cccagggattataaaggtgaaa

SEQ ID NO: 7072149 - DNA, 22 bp, Homo sapiens
tgctctggagtggcttgtgcac

SEQ ID NO: 7072150 - DNA, 22 bp, Homo sapiens
tgctgaagtccatctgtttgac

SEQ ID NO: 7072151 - DNA, 23 bp, Homo sapiens
tgctgaagtgttggccctgccca

SEQ ID NO: 7072152 - DNA, 22 bp, Homo sapiens
cccaggctcttatgtgacttgc

SEQ ID NO: 7072153 - DNA, 22 bp, Homo sapiens
cccaggctcctgactcattcta

SEQ ID NO: 7072154 - DNA, 22 bp, Homo sapiens
tgcctgggacatgctgtggact

SEQ ID NO: 7072155 - DNA, 22 bp, Homo sapiens
tgcctgctcttaccactctccc

SEQ ID NO: 7072156 - DNA, 22 bp, Homo sapiens
tgcctgctcttgagacttacaa

SEQ ID NO: 7072157 - DNA, 22 bp, Homo sapiens
tgcctgggagtgaccaagactc

SEQ ID NO: 7072158 - DNA, 22 bp, Homo sapiens
tgcctgggccttcccacctctg

SEQ ID NO: 7072159 - DNA, 22 bp, Homo sapiens
tgcctgggctcaccgcctcttt

SEQ ID NO: 7072160 - DNA, 22 bp, Homo sapiens
tgctgcagctttgtcacatgca

SEQ ID NO: 7072161 - DNA, 22 bp, Homo sapiens
tgctgcagctaaggtgaggtgc

SEQ ID NO: 7072162 - DNA, 22 bp, Homo sapiens
tgctgcagcagtgcgggcagct

SEQ ID NO: 7072163 - DNA, 22 bp, Homo sapiens
tgctggagacatagcaggcagc

SEQ ID NO: 7072164 - DNA, 22 bp, Homo sapiens
tgctggagatcattaatgttca

SEQ ID NO: 7072165 - DNA, 22 bp, Homo sapiens
cccccagtctgaacagcagctg

SEQ ID NO: 7072166 - DNA, 22 bp, Homo sapiens
cccccaggctctgacacaggag

SEQ ID NO: 7072167 - DNA, 22 bp, Homo sapiens
cccccaggctctgacacaggag

SEQ ID NO: 7072168 - DNA, 22 bp, Homo sapiens
ccccctgcgcccggcacgtcat

SEQ ID NO: 7072169 - DNA, 22 bp, Homo sapiens
cccctcaggtacccgtgcagca

SEQ ID NO: 7072170 - DNA, 22 bp, Homo sapiens
ccccagggaagctttgcttact

SEQ ID NO: 7072171 - DNA, 22 bp, Homo sapiens
cccccaccgtgttcctgctcgg

SEQ ID NO: 7072172 - DNA, 22 bp, Homo sapiens
cccccaccgtgttcctgctcgg

SEQ ID NO: 7072173 - DNA, 22 bp, Homo sapiens
cccctccctgacctggttgggc

SEQ ID NO: 7072174 - DNA, 22 bp, Homo sapiens
cccctcctggccacactgtcag

SEQ ID NO: 7072175 - DNA, 22 bp, Homo sapiens
cccctcctggccacactgtcag

SEQ ID NO: 7072176 - DNA, 22 bp, Homo sapiens
cccctctccctcacttatcaat

SEQ ID NO: 7072177 - DNA, 22 bp, Homo sapiens
ccctcagggaccactgacttca

SEQ ID NO: 7072178 - DNA, 23 bp, Homo sapiens
ccctggccttggggcacaggctg

SEQ ID NO: 7072179 - DNA, 22 bp, Homo sapiens
ccctggctcttcaccacctgcc

SEQ ID NO: 7072180 - DNA, 22 bp, Homo sapiens
ccctggctgccagtcaccagac

SEQ ID NO: 7072181 - DNA, 22 bp, Homo sapiens
ccctggcctccaggcagtcctg

SEQ ID NO: 7072182 - DNA, 22 bp, Homo sapiens
tggagctgagcacctccagggc

SEQ ID NO: 7072183 - DNA, 18 bp, Homo sapiens
tggagctgagggcaatgc

SEQ ID NO: 7072184 - DNA, 22 bp, Homo sapiens
ccctggcaaaatccctggtaca

SEQ ID NO: 7072185 - DNA, 17 bp, Homo sapiens
tggcaagaatggaaatg

SEQ ID NO: 7072186 - DNA, 22 bp, Homo sapiens
tggcaagagggatgcaaggttt

SEQ ID NO: 7072187 - DNA, 22 bp, Homo sapiens
tggatgagggctgagcactggg

SEQ ID NO: 7072188 - DNA, 22 bp, Homo sapiens
tggatgagtctgagattgggca

SEQ ID NO: 7072189 - DNA, 22 bp, Homo sapiens
tggatgagttcaatgaggcaga

SEQ ID NO: 7072190 - DNA, 22 bp, Homo sapiens
tggatgagttcaatgaggcaga

SEQ ID NO: 7072191 - DNA, 22 bp, Homo sapiens
tggatgagttcaatgaggcaga

SEQ ID NO: 7072192 - DNA, 22 bp, Homo sapiens
tggatcatcttaagaagtgatt

SEQ ID NO: 7072193 - DNA, 22 bp, Homo sapiens
tggatcatgtgatgtcaggagt

SEQ ID NO: 7072194 - DNA, 22 bp, Homo sapiens
tggatctcggcaatgcgggact

SEQ ID NO: 7072195 - DNA, 22 bp, Homo sapiens
tggatgagaaactctggtgact

SEQ ID NO: 7072196 - DNA, 22 bp, Homo sapiens
tggatgagattaaagtgaggtt

SEQ ID NO: 7072197 - DNA, 22 bp, Homo sapiens
tggatgagattaaagtgaggtt

SEQ ID NO: 7072198 - DNA, 22 bp, Homo sapiens
tggatgagattaaagtgaggtt

SEQ ID NO: 7072199 - DNA, 22 bp, Homo sapiens
tggatgaggctgggttaggcag

SEQ ID NO: 7072200 - DNA, 22 bp, Homo sapiens
tggatgagggctgagcactggg

SEQ ID NO: 7072201 - DNA, 22 bp, Homo sapiens
tggatgagggctgagcactggg

SEQ ID NO: 7072202 - DNA, 23 bp, Homo sapiens
tggagctgacagtcagagggagg

SEQ ID NO: 7072203 - DNA, 22 bp, Homo sapiens
tggagctgagaagtggagctct

SEQ ID NO: 7072204 - DNA, 22 bp, Homo sapiens
tggagctgagaagtggagctct

SEQ ID NO: 7072205 - DNA, 22 bp, Homo sapiens
tggagctgagagccaggctggc

SEQ ID NO: 7072206 - DNA, 20 bp, Homo sapiens
ccctggagagaagctccacg

SEQ ID NO: 7072207 - DNA, 22 bp, Homo sapiens
ccctggagatcgggagaggaag

SEQ ID NO: 7072208 - DNA, 22 bp, Homo sapiens
ccctggagatcgggagaggaag

SEQ ID NO: 7072209 - DNA, 22 bp, Homo sapiens
ccctccagagcctggacattct

SEQ ID NO: 7072210 - DNA, 22 bp, Homo sapiens
ccctccagagcttgacctgctg

SEQ ID NO: 7072211 - DNA, 20 bp, Homo sapiens
ccctccagcaaccaggactt

SEQ ID NO: 7072212 - DNA, 20 bp, Homo sapiens
ccctccagcaaccaggactt

SEQ ID NO: 7072213 - DNA, 22 bp, Homo sapiens
ccctccagccatggacccaggt

SEQ ID NO: 7072214 - DNA, 22 bp, Homo sapiens
ccctccagctcaaagcaaccgg

SEQ ID NO: 7072215 - DNA, 22 bp, Homo sapiens
ccctccaggcactgccctcttc

SEQ ID NO: 7072216 - DNA, 22 bp, Homo sapiens
ccctccaggcctgtcatgttcc

SEQ ID NO: 7072217 - DNA, 22 bp, Homo sapiens
ccctccagggagccatgctggg

SEQ ID NO: 7072218 - DNA, 22 bp, Homo sapiens
cctagggagcctgagagcagtg

SEQ ID NO: 7072219 - DNA, 22 bp, Homo sapiens
cctagggagcctgagagcagtg

SEQ ID NO: 7072220 - DNA, 20 bp, Homo sapiens
cctagggcaagtgggtgggc

SEQ ID NO: 7072221 - DNA, 22 bp, Homo sapiens
cctaggctaattcagtccagta

SEQ ID NO: 7072222 - DNA, 23 bp, Homo sapiens
tggccaggcataaaggtgggtgg

SEQ ID NO: 7072223 - DNA, 22 bp, Homo sapiens
tggccaggcattcagataagac

SEQ ID NO: 7072224 - DNA, 22 bp, Homo sapiens
tggccaggaggctgcttctgac

SEQ ID NO: 7072225 - DNA, 22 bp, Homo sapiens
tggccaggaggctgcttctgac

SEQ ID NO: 7072226 - DNA, 22 bp, Homo sapiens
tggccaggaggctgcttctgac

SEQ ID NO: 7072227 - DNA, 22 bp, Homo sapiens
tggccaggcaggtagaacggcc

SEQ ID NO: 7072228 - DNA, 22 bp, Homo sapiens
tggcagcttgaatgcagtcttt

SEQ ID NO: 7072229 - DNA, 22 bp, Homo sapiens
tggcagctgtgtccaggtagaa

SEQ ID NO: 7072230 - DNA, 22 bp, Homo sapiens
tggcacaggaatttagatgcag

SEQ ID NO: 7072231 - DNA, 22 bp, Homo sapiens
tggcagaggtatattgggagga

SEQ ID NO: 7072232 - DNA, 22 bp, Homo sapiens
tggcagcaaaaccagaatcaga

SEQ ID NO: 7072233 - DNA, 22 bp, Homo sapiens
tggcagcaatttgtgatgttga

SEQ ID NO: 7072234 - DNA, 22 bp, Homo sapiens
tggcagctggagggcaatggcc

SEQ ID NO: 7072235 - DNA, 22 bp, Homo sapiens
cctcctctgggaagattcagag

SEQ ID NO: 7072236 - DNA, 22 bp, Homo sapiens
cctcctggtccagcatctcttt

SEQ ID NO: 7072237 - DNA, 22 bp, Homo sapiens
cctcccttttggtgtctgcata

SEQ ID NO: 7072238 - DNA, 23 bp, Homo sapiens
tggctgaggtccaggtagtttca

SEQ ID NO: 7072239 - DNA, 23 bp, Homo sapiens
tggctgaggtccaggtagtttca

SEQ ID NO: 7072240 - DNA, 22 bp, Homo sapiens
tggctgaggtaactatgaataa

SEQ ID NO: 7072241 - DNA, 23 bp, Homo sapiens
tggctgaggtccaggtagtttca

SEQ ID NO: 7072242 - DNA, 22 bp, Homo sapiens
tggctgaggtctggggcttctg

SEQ ID NO: 7072243 - DNA, 22 bp, Homo sapiens
tggctgaggtaactatgaataa

SEQ ID NO: 7072244 - DNA, 22 bp, Homo sapiens
tggctgaggtaactatgaataa

SEQ ID NO: 7072245 - DNA, 22 bp, Homo sapiens
tggctgagggggctctgctcag

SEQ ID NO: 7072246 - DNA, 22 bp, Homo sapiens
tggctgagggggctctgctcag

SEQ ID NO: 7072247 - DNA, 22 bp, Homo sapiens
tggctgagggggcagttcagga

SEQ ID NO: 7072248 - DNA, 22 bp, Homo sapiens
tggctgagggggctctgctcag

SEQ ID NO: 7072249 - DNA, 22 bp, Homo sapiens
cctccagccttcctgaagagcc

SEQ ID NO: 7072250 - DNA, 22 bp, Homo sapiens
cctccagcgcgatccactccgg

SEQ ID NO: 7072251 - DNA, 22 bp, Homo sapiens
tggctgagagcaattgactctg

SEQ ID NO: 7072252 - DNA, 22 bp, Homo sapiens
tggctgagggggcagttcagga

SEQ ID NO: 7072253 - DNA, 22 bp, Homo sapiens
tggctgagggggcagttcagga

SEQ ID NO: 7072254 - DNA, 22 bp, Homo sapiens
cctccaagtttgactcaggaca

SEQ ID NO: 7072255 - DNA, 22 bp, Homo sapiens
cctccaagtttgactcaggaca

SEQ ID NO: 7072256 - DNA, 22 bp, Homo sapiens
cctccacaggagctgcagtgct

SEQ ID NO: 7072257 - DNA, 22 bp, Homo sapiens
cctccagcattactggcccatg

SEQ ID NO: 7072258 - DNA, 22 bp, Homo sapiens
cctccagcattactggcccatg

SEQ ID NO: 7072259 - DNA, 18 bp, Homo sapiens
tggccccttatcagtcct

SEQ ID NO: 7072260 - DNA, 22 bp, Homo sapiens
tggccctgctggacacgcctgc

SEQ ID NO: 7072261 - DNA, 22 bp, Homo sapiens
tggccctgctggccaaaggcta

SEQ ID NO: 7072262 - DNA, 22 bp, Homo sapiens
tggccctgctgggtcagagctg

SEQ ID NO: 7072263 - DNA, 22 bp, Homo sapiens
tggctcagtttcagtcctggtt

SEQ ID NO: 7072264 - DNA, 22 bp, Homo sapiens
tggctcatctatcagaaagtcc

SEQ ID NO: 7072265 - DNA, 22 bp, Homo sapiens
cctctggtcccagctctgctgc

SEQ ID NO: 7072266 - DNA, 22 bp, Homo sapiens
cctctgggggtcctcagagtct

SEQ ID NO: 7072267 - DNA, 22 bp, Homo sapiens
cctctgggtgacagactcttgg

SEQ ID NO: 7072268 - DNA, 22 bp, Homo sapiens
cctctcttggccgcagtcttct

SEQ ID NO: 7072269 - DNA, 22 bp, Homo sapiens
cctctctttcctacaccttgga

SEQ ID NO: 7072270 - DNA, 23 bp, Homo sapiens
cctctctttttaggtggtgtttg

SEQ ID NO: 7072271 - DNA, 22 bp, Homo sapiens
cctctgagaacacctggcgtcc

SEQ ID NO: 7072272 - DNA, 22 bp, Homo sapiens
cctctgaggtgagcccagctgg

SEQ ID NO: 7072273 - DNA, 22 bp, Homo sapiens
cctctggctgtaccactggcac

SEQ ID NO: 7072274 - DNA, 22 bp, Homo sapiens
cctctgggggcttccttaccct

SEQ ID NO: 7072275 - DNA, 22 bp, Homo sapiens
cctctctgtaagggtccctccc

SEQ ID NO: 7072276 - DNA, 22 bp, Homo sapiens
cctctctgtagcagcccccagt

SEQ ID NO: 7072277 - DNA, 22 bp, Homo sapiens
cctctctgtagcagcccccagt

SEQ ID NO: 7072278 - DNA, 22 bp, Homo sapiens
cctctctgtaagggtccctccc

SEQ ID NO: 7072279 - DNA, 20 bp, Homo sapiens
cctctctgccctgcaaggcc

SEQ ID NO: 7072280 - DNA, 22 bp, Homo sapiens
cctctctgtcacaccagtggcc

SEQ ID NO: 7072281 - DNA, 22 bp, Homo sapiens
cctctctgtgtggcctctccat

SEQ ID NO: 7072282 - DNA, 22 bp, Homo sapiens
cctctctgtgtggcctctccat

SEQ ID NO: 7072283 - DNA, 22 bp, Homo sapiens
cctctctgtgtggcctctccat

SEQ ID NO: 7072284 - DNA, 20 bp, Homo sapiens
cctctctgaagaggtcatct

SEQ ID NO: 7072285 - DNA, 20 bp, Homo sapiens
cctctctgcatgctccctga

SEQ ID NO: 7072286 - DNA, 20 bp, Homo sapiens
cctctctgcatgctccctga

SEQ ID NO: 7072287 - DNA, 20 bp, Homo sapiens
cctctctgcatgctccctga

SEQ ID NO: 7072288 - DNA, 22 bp, Homo sapiens
cctctctcttgtagtccctgcc

SEQ ID NO: 7072289 - DNA, 22 bp, Homo sapiens
cctctctcttgtagtccctgcc

SEQ ID NO: 7072290 - DNA, 22 bp, Homo sapiens
tggctgccgactggctcttggc

SEQ ID NO: 7072291 - DNA, 21 bp, Homo sapiens
tggctgcctacatgctgcagg

SEQ ID NO: 7072292 - DNA, 22 bp, Homo sapiens
cctctatagatgtgtgcatcta

SEQ ID NO: 7072293 - DNA, 22 bp, Homo sapiens
cctctatgtacacatttccagc

SEQ ID NO: 7072294 - DNA, 22 bp, Homo sapiens
cctctcagcgattcctcttgga

SEQ ID NO: 7072295 - DNA, 22 bp, Homo sapiens
cctctcagccggactgtcaggc

SEQ ID NO: 7072296 - DNA, 22 bp, Homo sapiens
cctctcagcgattcctcttgga

SEQ ID NO: 7072297 - DNA, 22 bp, Homo sapiens
cctctcatagtctgtatccttt

SEQ ID NO: 7072298 - DNA, 22 bp, Homo sapiens
cctctcatcattatcgctttgt

SEQ ID NO: 7072299 - DNA, 19 bp, Homo sapiens
tgtgttcattcatcagagg

SEQ ID NO: 7072300 - DNA, 22 bp, Homo sapiens
cctggggctccagagcagcgga

SEQ ID NO: 7072301 - DNA, 19 bp, Homo sapiens
cctgggtccactcagacta

SEQ ID NO: 7072302 - DNA, 22 bp, Homo sapiens
cctggggagaagagcttccccc

SEQ ID NO: 7072303 - DNA, 22 bp, Homo sapiens
cctggggacctgcctcagccct

SEQ ID NO: 7072304 - DNA, 22 bp, Homo sapiens
cctgggtctatagacttcaaga

SEQ ID NO: 7072305 - DNA, 22 bp, Homo sapiens
cctgggtgaaatagtcctcaag

SEQ ID NO: 7072306 - DNA, 22 bp, Homo sapiens
cctgggtgaaatagtcctcaag

SEQ ID NO: 7072307 - DNA, 22 bp, Homo sapiens
cctgggtgaaatctctcctgca

SEQ ID NO: 7072308 - DNA, 22 bp, Homo sapiens
cctgggtgacagagtgagacct

SEQ ID NO: 7072309 - DNA, 22 bp, Homo sapiens
cctgggtgacagagtgagacct

SEQ ID NO: 7072310 - DNA, 22 bp, Homo sapiens
cctgggtgacccgtgagcgtcc

SEQ ID NO: 7072311 - DNA, 22 bp, Homo sapiens
cctggggaagtcacttctcttt

SEQ ID NO: 7072312 - DNA, 22 bp, Homo sapiens
cctggggaagtcacttctcttt

SEQ ID NO: 7072313 - DNA, 22 bp, Homo sapiens
cctggggaatagagtcaagggg

SEQ ID NO: 7072314 - DNA, 22 bp, Homo sapiens
cctgggctttgctggcaaggcc

SEQ ID NO: 7072315 - DNA, 22 bp, Homo sapiens
cctgggcttccacgagcagagg

SEQ ID NO: 7072316 - DNA, 22 bp, Homo sapiens
cctgggcctctcaaagtgctgg

SEQ ID NO: 7072317 - DNA, 22 bp, Homo sapiens
tgtgtgtataataatgtctgca

SEQ ID NO: 7072318 - DNA, 22 bp, Homo sapiens
tgtggggcttacaaaggcagat

SEQ ID NO: 7072319 - DNA, 22 bp, Homo sapiens
tgtgtctgtcctcggttgatgc

SEQ ID NO: 7072320 - DNA, 22 bp, Homo sapiens
tgtgtctgtgtatacacggcat

SEQ ID NO: 7072321 - DNA, 22 bp, Homo sapiens
tgtgtgggcgaagacagccttt

SEQ ID NO: 7072322 - DNA, 22 bp, Homo sapiens
cctgggcctcacccagctcttg

SEQ ID NO: 7072323 - DNA, 22 bp, Homo sapiens
cctgggcctcacccagctcttg

SEQ ID NO: 7072324 - DNA, 22 bp, Homo sapiens
tgtggggctccctggcagcctg

SEQ ID NO: 7072325 - DNA, 22 bp, Homo sapiens
cctgggcctatcctagaaccaa

SEQ ID NO: 7072326 - DNA, 22 bp, Homo sapiens
cctgggcattctttgagttctc

SEQ ID NO: 7072327 - DNA, 22 bp, Homo sapiens
cctgggcatcaacaagcagaga

SEQ ID NO: 7072328 - DNA, 22 bp, Homo sapiens
cctgggcagcctgctcaaggac

SEQ ID NO: 7072329 - DNA, 22 bp, Homo sapiens
cctgggcaatatagtgaggccc

SEQ ID NO: 7072330 - DNA, 22 bp, Homo sapiens
tgtggcagctggaggtggagaa

SEQ ID NO: 7072331 - DNA, 22 bp, Homo sapiens
tgtggcaggaagagcttctgag

SEQ ID NO: 7072332 - DNA, 20 bp, Homo sapiens
tgtggcaggatgagggcgga

SEQ ID NO: 7072333 - DNA, 22 bp, Homo sapiens
tgtggcaggcaagatgtacaga

SEQ ID NO: 7072334 - DNA, 22 bp, Homo sapiens
tgtggcaggcattctgaggctg

SEQ ID NO: 7072335 - DNA, 22 bp, Homo sapiens
tgtggcagggatactgaggcag

SEQ ID NO: 7072336 - DNA, 18 bp, Homo sapiens
tgtggcaggggtgggaga

SEQ ID NO: 7072337 - DNA, 22 bp, Homo sapiens
tgtgggaaatgggagtggaaga

SEQ ID NO: 7072338 - DNA, 22 bp, Homo sapiens
tgtgcccatctcccagcttgac

SEQ ID NO: 7072339 - DNA, 22 bp, Homo sapiens
tgtgcttcttgcagctcctgta

SEQ ID NO: 7072340 - DNA, 20 bp, Homo sapiens
cctgggaaggcagccccagc

SEQ ID NO: 7072341 - DNA, 22 bp, Homo sapiens
cctgggagagccatctgtggcc

SEQ ID NO: 7072342 - DNA, 22 bp, Homo sapiens
cctgggagagtctgtggtctcc

SEQ ID NO: 7072343 - DNA, 21 bp, Homo sapiens
cctgggagatcagctgccttc

SEQ ID NO: 7072344 - DNA, 21 bp, Homo sapiens
cctgggagatcagctgccttc

SEQ ID NO: 7072345 - DNA, 22 bp, Homo sapiens
cctgggagccaagcctctgtgt

SEQ ID NO: 7072346 - DNA, 22 bp, Homo sapiens
cctgggagccaagcctctgtgt

SEQ ID NO: 7072347 - DNA, 22 bp, Homo sapiens
cctgggagccgactgactgtgc

SEQ ID NO: 7072348 - DNA, 22 bp, Homo sapiens
cctgggagctgtggaaaggctg

SEQ ID NO: 7072349 - DNA, 22 bp, Homo sapiens
tgtgccagcctctggctgtgtc

SEQ ID NO: 7072350 - DNA, 22 bp, Homo sapiens
cctggctgcattttgctggatg

SEQ ID NO: 7072351 - DNA, 22 bp, Homo sapiens
cctggctgcccatggaccctct

SEQ ID NO: 7072352 - DNA, 22 bp, Homo sapiens
cctggctgccgagtgtgcagcg

SEQ ID NO: 7072353 - DNA, 22 bp, Homo sapiens
cctggctgctgtcactgaccat

SEQ ID NO: 7072354 - DNA, 22 bp, Homo sapiens
cctggctggttgtctgattcta

SEQ ID NO: 7072355 - DNA, 19 bp, Homo sapiens
cctggctgtgaagcctgca

SEQ ID NO: 7072356 - DNA, 23 bp, Homo sapiens
cctggctgtggatttgggcctgc

SEQ ID NO: 7072357 - DNA, 22 bp, Homo sapiens
cctggctgtggcggtgctctca

SEQ ID NO: 7072358 - DNA, 22 bp, Homo sapiens
cctggctgtgtgaccttggcaa

SEQ ID NO: 7072359 - DNA, 22 bp, Homo sapiens
cctggcttagaggttgcctttc

SEQ ID NO: 7072360 - DNA, 22 bp, Homo sapiens
cctggcttcagcattgccctct

SEQ ID NO: 7072361 - DNA, 22 bp, Homo sapiens
cctggcttccatatggcacata

SEQ ID NO: 7072362 - DNA, 18 bp, Homo sapiens
cctggcttccatcttggt

SEQ ID NO: 7072363 - DNA, 22 bp, Homo sapiens
cctggcttccttcatgacctgg

SEQ ID NO: 7072364 - DNA, 22 bp, Homo sapiens
cctggcttctataccaccaggt

SEQ ID NO: 7072365 - DNA, 22 bp, Homo sapiens
cctggcttctctgcattgttct

SEQ ID NO: 7072366 - DNA, 22 bp, Homo sapiens
cctggctttagctgccttccct

SEQ ID NO: 7072367 - DNA, 20 bp, Homo sapiens
cctggctttgcagcatgaga

SEQ ID NO: 7072368 - DNA, 20 bp, Homo sapiens
cctggctttgcatctgtgat

SEQ ID NO: 7072369 - DNA, 18 bp, Homo sapiens
cctggcttttctacttgc

SEQ ID NO: 7072370 - DNA, 22 bp, Homo sapiens
cctgggaaagtgaggtcattat

SEQ ID NO: 7072371 - DNA, 22 bp, Homo sapiens
cctgggaacagtgggttggctc

SEQ ID NO: 7072372 - DNA, 22 bp, Homo sapiens
cctgggaagaccggcagtgggg

SEQ ID NO: 7072373 - DNA, 22 bp, Homo sapiens
tgtctggtgggttgacaggcag

SEQ ID NO: 7072374 - DNA, 19 bp, Homo sapiens
cctggctctgagcccagcc

SEQ ID NO: 7072375 - DNA, 19 bp, Homo sapiens
cctggctctgagcccagcc

SEQ ID NO: 7072376 - DNA, 22 bp, Homo sapiens
cctggctgaacaaagtccctcc

SEQ ID NO: 7072377 - DNA, 22 bp, Homo sapiens
cctggctgagggacctcgggta

SEQ ID NO: 7072378 - DNA, 21 bp, Homo sapiens
cctggctgcacagttgctggt

SEQ ID NO: 7072379 - DNA, 22 bp, Homo sapiens
tgtctggtgggttgacaggcag

SEQ ID NO: 7072380 - DNA, 22 bp, Homo sapiens
tgtgaggctggcaggggccagg

SEQ ID NO: 7072381 - DNA, 22 bp, Homo sapiens
tgtgaggctacctgccagggtc

SEQ ID NO: 7072382 - DNA, 22 bp, Homo sapiens
tgtgaggctacctgccagggtc

SEQ ID NO: 7072383 - DNA, 22 bp, Homo sapiens
tgtgagggttttaagggaatga

SEQ ID NO: 7072384 - DNA, 22 bp, Homo sapiens
tgtgaggataaaaaggaaggag

SEQ ID NO: 7072385 - DNA, 22 bp, Homo sapiens
tgtgaggatggagttctacagg

SEQ ID NO: 7072386 - DNA, 22 bp, Homo sapiens
tgtgaggatgtaaccagaagtc

SEQ ID NO: 7072387 - DNA, 22 bp, Homo sapiens
tgtgaggatgtgagcgtgaacc

SEQ ID NO: 7072388 - DNA, 22 bp, Homo sapiens
tgtgaggatgttaaggggatga

SEQ ID NO: 7072389 - DNA, 22 bp, Homo sapiens
tgtgaggattaaatgcatagtg

SEQ ID NO: 7072390 - DNA, 22 bp, Homo sapiens
tgtgaggcctagacagcctggg

SEQ ID NO: 7072391 - DNA, 22 bp, Homo sapiens
tgtgaggcctctgcaggagcag

SEQ ID NO: 7072392 - DNA, 22 bp, Homo sapiens
tgtgaggcgaggccagtgagct

SEQ ID NO: 7072393 - DNA, 22 bp, Homo sapiens
tgtgaggcctctgcaggagcag

SEQ ID NO: 7072394 - DNA, 23 bp, Homo sapiens
tgtgaaggtgggtccaagggctg

SEQ ID NO: 7072395 - DNA, 22 bp, Homo sapiens
tgtgagcttaggacagggctat

SEQ ID NO: 7072396 - DNA, 22 bp, Homo sapiens
tgtgaggaacaggactagagca

SEQ ID NO: 7072397 - DNA, 22 bp, Homo sapiens
tgtgaggaacccggaatgtggg

SEQ ID NO: 7072398 - DNA, 22 bp, Homo sapiens
tgtgaggacattggaggactca

SEQ ID NO: 7072399 - DNA, 22 bp, Homo sapiens
tgtgaggacctcagcagagtct

SEQ ID NO: 7072400 - DNA, 22 bp, Homo sapiens
tgtgaggagaggcccagctccc

SEQ ID NO: 7072401 - DNA, 20 bp, Homo sapiens
tgtgaggagcatggccgctg

SEQ ID NO: 7072402 - DNA, 22 bp, Homo sapiens
tgtgaggaggcggccagaagag

SEQ ID NO: 7072403 - DNA, 22 bp, Homo sapiens
tgtgaggagggtcaaactgagt

SEQ ID NO: 7072404 - DNA, 22 bp, Homo sapiens
tgtgaggagtaggctgagggtg

SEQ ID NO: 7072405 - DNA, 22 bp, Homo sapiens
tgtctttggaatatttagctga

SEQ ID NO: 7072406 - DNA, 22 bp, Homo sapiens
tgtgaagatttggcatgcagaa

SEQ ID NO: 7072407 - DNA, 22 bp, Homo sapiens
tgtgaagcatagattctgtaga

SEQ ID NO: 7072408 - DNA, 22 bp, Homo sapiens
tgtgaagctggatcctggagct

SEQ ID NO: 7072409 - DNA, 22 bp, Homo sapiens
tgtgaaggagatgaagggagtg

SEQ ID NO: 7072410 - DNA, 22 bp, Homo sapiens
tgtgaaggagatgaagggagtg

SEQ ID NO: 7072411 - DNA, 22 bp, Homo sapiens
tgtgaaggagatgaagggagtg

SEQ ID NO: 7072412 - DNA, 22 bp, Homo sapiens
tgtgaaggagcatgcagagggg

SEQ ID NO: 7072413 - DNA, 22 bp, Homo sapiens
tgtgaaggagcatgcagagggg

SEQ ID NO: 7072414 - DNA, 22 bp, Homo sapiens
tgtgaaggcagagccagtgaaa

SEQ ID NO: 7072415 - DNA, 22 bp, Homo sapiens
tgtgaaggcagagccagtgaaa

SEQ ID NO: 7072416 - DNA, 22 bp, Homo sapiens
tgtgaaggtaaggaggggcaag

SEQ ID NO: 7072417 - DNA, 23 bp, Homo sapiens
tgtgaaggtgggtccaagggctg

SEQ ID NO: 7072418 - DNA, 22 bp, Homo sapiens
tgtcctggatcatgcctctgaa

SEQ ID NO: 7072419 - DNA, 22 bp, Homo sapiens
tgtctcagttcccttctctgga

SEQ ID NO: 7072420 - DNA, 22 bp, Homo sapiens
tgtctcagtacactccgatgtt

SEQ ID NO: 7072421 - DNA, 22 bp, Homo sapiens
tgtctcatctcttaaccccact

SEQ ID NO: 7072422 - DNA, 22 bp, Homo sapiens
tgtctctggctgcagcctgttc

SEQ ID NO: 7072423 - DNA, 22 bp, Homo sapiens
tgtctctgggtgattcagtcct

SEQ ID NO: 7072424 - DNA, 22 bp, Homo sapiens
tgtctctgtctcccaggttgtg

SEQ ID NO: 7072425 - DNA, 22 bp, Homo sapiens
tgtctctgtcttccagggctgt

SEQ ID NO: 7072426 - DNA, 22 bp, Homo sapiens
tgtctctgtgactccttccgcc

SEQ ID NO: 7072427 - DNA, 19 bp, Homo sapiens
cctggccctgctgcgcggg

SEQ ID NO: 7072428 - DNA, 22 bp, Homo sapiens
cctggccctggaatagggcagg

SEQ ID NO: 7072429 - DNA, 22 bp, Homo sapiens
cctggcctggcactccctctgc

SEQ ID NO: 7072430 - DNA, 22 bp, Homo sapiens
cctggcctgtgaatctgagagc

SEQ ID NO: 7072431 - DNA, 22 bp, Homo sapiens
cctggctccagctgcctgtcct

SEQ ID NO: 7072432 - DNA, 22 bp, Homo sapiens
cctggctcgctgacctcagggg

SEQ ID NO: 7072433 - DNA, 22 bp, Homo sapiens
cctggctctagaggccactcct

SEQ ID NO: 7072434 - DNA, 23 bp, Homo sapiens
cctggcagcaaacgaggaggtta

SEQ ID NO: 7072435 - DNA, 23 bp, Homo sapiens
cctggcagcaaacgaggaggtta

SEQ ID NO: 7072436 - DNA, 23 bp, Homo sapiens
cctggcagcaaacgaggaggtta

SEQ ID NO: 7072437 - DNA, 22 bp, Homo sapiens
cctggcagactgtgagggcagg

SEQ ID NO: 7072438 - DNA, 22 bp, Homo sapiens
cctggcagtcaggggagtcctt

SEQ ID NO: 7072439 - DNA, 22 bp, Homo sapiens
cctggcaggctggggacagtgc

SEQ ID NO: 7072440 - DNA, 22 bp, Homo sapiens
cctggcaggcaagaggaaggga

SEQ ID NO: 7072441 - DNA, 22 bp, Homo sapiens
cctggcaggcaagaggaaggga

SEQ ID NO: 7072442 - DNA, 22 bp, Homo sapiens
cctggcagttttgcccaggatt

SEQ ID NO: 7072443 - DNA, 22 bp, Homo sapiens
cctggccagtttccaggccctg

SEQ ID NO: 7072444 - DNA, 17 bp, Homo sapiens
tgtccatttgcctggag

SEQ ID NO: 7072445 - DNA, 22 bp, Homo sapiens
tgtcctcatcctccagtctgtc

SEQ ID NO: 7072446 - DNA, 22 bp, Homo sapiens
tggtgggacatctgaggagagg

SEQ ID NO: 7072447 - DNA, 23 bp, Homo sapiens
tggtggcttgtggtggccaccag

SEQ ID NO: 7072448 - DNA, 22 bp, Homo sapiens
tggtgctgcctcagatgcctta

SEQ ID NO: 7072449 - DNA, 22 bp, Homo sapiens
tggtggccgaagccctctctca

SEQ ID NO: 7072450 - DNA, 22 bp, Homo sapiens
cctctgtgcctcagtttcatgt

SEQ ID NO: 7072451 - DNA, 22 bp, Homo sapiens
cctctgtgctttgtccagcctc

SEQ ID NO: 7072452 - DNA, 22 bp, Homo sapiens
tggtagggacactatgcagaaa

SEQ ID NO: 7072453 - DNA, 22 bp, Homo sapiens
tggtccatgtcctccatctctc

SEQ ID NO: 7072454 - DNA, 22 bp, Homo sapiens
tggtccctgcctgccaagtgct

SEQ ID NO: 7072455 - DNA, 22 bp, Homo sapiens
cctgccagtgcctcccactggt

SEQ ID NO: 7072456 - DNA, 22 bp, Homo sapiens
cctgcccacagagagggtgcat

SEQ ID NO: 7072457 - DNA, 22 bp, Homo sapiens
cctgcccacagagagggtgcat

SEQ ID NO: 7072458 - DNA, 22 bp, Homo sapiens
cctgcccactccaggagcaact

SEQ ID NO: 7072459 - DNA, 17 bp, Homo sapiens
cctgcccagagacagat

SEQ ID NO: 7072460 - DNA, 17 bp, Homo sapiens
cctgcccagagacagat

SEQ ID NO: 7072461 - DNA, 22 bp, Homo sapiens
cctgcccagagcccctttcact

SEQ ID NO: 7072462 - DNA, 22 bp, Homo sapiens
tggtcttagctggaaggaggga

SEQ ID NO: 7072463 - DNA, 22 bp, Homo sapiens
tggtctttaaggtagctgtcat

SEQ ID NO: 7072464 - DNA, 18 bp, Homo sapiens
tggtgaagggtggaggag

SEQ ID NO: 7072465 - DNA, 22 bp, Homo sapiens
tgtcaggagccaccagcactcc

SEQ ID NO: 7072466 - DNA, 22 bp, Homo sapiens
tgtcatgtggcaattaaagcag

SEQ ID NO: 7072467 - DNA, 22 bp, Homo sapiens
tgtcagctggagatggcatggg

SEQ ID NO: 7072468 - DNA, 22 bp, Homo sapiens
cctggcagacagcactgaagct

SEQ ID NO: 7072469 - DNA, 22 bp, Homo sapiens
cctggcaccttcacagactact

SEQ ID NO: 7072470 - DNA, 22 bp, Homo sapiens
cctggcaccttcacagactact

SEQ ID NO: 7072471 - DNA, 22 bp, Homo sapiens
cctggcacgaagggctgaggtt

SEQ ID NO: 7072472 - DNA, 23 bp, Homo sapiens
tgtaggctaagtcccataaatca

SEQ ID NO: 7072473 - DNA, 22 bp, Homo sapiens
tgtaggtctcagtgtctgagct

SEQ ID NO: 7072474 - DNA, 22 bp, Homo sapiens
tgtaaactgtagaaaatacttt

SEQ ID NO: 7072475 - DNA, 22 bp, Homo sapiens
tgtaaactgcttctcaccaagg

SEQ ID NO: 7072476 - DNA, 22 bp, Homo sapiens
tgtaaacatatgtatgtatgta

SEQ ID NO: 7072477 - DNA, 22 bp, Homo sapiens
cctggagcacatggcaggaggc

SEQ ID NO: 7072478 - DNA, 22 bp, Homo sapiens
cctggaggtggaggttgcagtg

SEQ ID NO: 7072479 - DNA, 22 bp, Homo sapiens
tgtagtaagtgcgcaataaata

SEQ ID NO: 7072480 - DNA, 22 bp, Homo sapiens
tgtagtagcattcacgaagtgt

SEQ ID NO: 7072481 - DNA, 22 bp, Homo sapiens
gtgtctgcacataggatctcaa

SEQ ID NO: 7072482 - DNA, 20 bp, Homo sapiens
gtgtctgcatatagcaggtg

SEQ ID NO: 7072483 - DNA, 22 bp, Homo sapiens
gtgtctgcatattcaaacttgt

SEQ ID NO: 7072484 - DNA, 22 bp, Homo sapiens
gtgtctgcctttggactaactg

SEQ ID NO: 7072485 - DNA, 19 bp, Homo sapiens
gtgtctgcctttgtgccac

SEQ ID NO: 7072486 - DNA, 22 bp, Homo sapiens
gtgtctgctcagcttgctagaa

SEQ ID NO: 7072487 - DNA, 22 bp, Homo sapiens
gtgtctgctgcaccctcacacc

SEQ ID NO: 7072488 - DNA, 22 bp, Homo sapiens
gtgtctgcttgctgagcattta

SEQ ID NO: 7072489 - DNA, 22 bp, Homo sapiens
gtgtctgcttggtcatctttca

SEQ ID NO: 7072490 - DNA, 22 bp, Homo sapiens
gtgtctgctttcagctagtagg

SEQ ID NO: 7072491 - DNA, 22 bp, Homo sapiens
gtgggtggggagctctctggag

SEQ ID NO: 7072492 - DNA, 22 bp, Homo sapiens
gtgggtggattccagcaacgct

SEQ ID NO: 7072493 - DNA, 22 bp, Homo sapiens
gtggtaatagagctccaaacta

SEQ ID NO: 7072494 - DNA, 22 bp, Homo sapiens
gtggtaatcggattcttaccgg

SEQ ID NO: 7072495 - DNA, 22 bp, Homo sapiens
gtggtaatttaatcctacactg

SEQ ID NO: 7072496 - DNA, 22 bp, Homo sapiens
gtgtacatagaattgtgctttg

SEQ ID NO: 7072497 - DNA, 22 bp, Homo sapiens
gtgtacatattgagtctgctga

SEQ ID NO: 7072498 - DNA, 22 bp, Homo sapiens
gtgtgcgccgacacagccaggt

SEQ ID NO: 7072499 - DNA, 22 bp, Homo sapiens
gtgtggcaaggtgagaagtggg

SEQ ID NO: 7072500 - DNA, 19 bp, Homo sapiens
gtgtggcagagagtgacca

SEQ ID NO: 7072501 - DNA, 22 bp, Homo sapiens
cagctggctggtcagtgcacaa

SEQ ID NO: 7072502 - DNA, 22 bp, Homo sapiens
cagctggcttgtttgttcttga

SEQ ID NO: 7072503 - DNA, 22 bp, Homo sapiens
gtgggtggatcatgaggtcagg

SEQ ID NO: 7072504 - DNA, 22 bp, Homo sapiens
gtgggtggatcacctgaggtca

SEQ ID NO: 7072505 - DNA, 22 bp, Homo sapiens
cagctggctgcatgatgccaaa

SEQ ID NO: 7072506 - DNA, 22 bp, Homo sapiens
cagctggccccacagtagaggc

SEQ ID NO: 7072507 - DNA, 22 bp, Homo sapiens
cagctggcgtggagtgattgca

SEQ ID NO: 7072508 - DNA, 22 bp, Homo sapiens
cagctggcgtggagtgattgca

SEQ ID NO: 7072509 - DNA, 22 bp, Homo sapiens
cagctgctgatggcctgacaga

SEQ ID NO: 7072510 - DNA, 22 bp, Homo sapiens
cagctgctgcccttggctgcag

SEQ ID NO: 7072511 - DNA, 22 bp, Homo sapiens
cagctgctgttactgcttatta

SEQ ID NO: 7072512 - DNA, 22 bp, Homo sapiens
cagctgctgttcagttttgttt

SEQ ID NO: 7072513 - DNA, 22 bp, Homo sapiens
cagctgcttactagctgtgtga

SEQ ID NO: 7072514 - DNA, 22 bp, Homo sapiens
gtggggcatgcacgctgctcct

SEQ ID NO: 7072515 - DNA, 22 bp, Homo sapiens
gtggggcagtggcctgggagca

SEQ ID NO: 7072516 - DNA, 22 bp, Homo sapiens
cagctgcctatgacctagcctc

SEQ ID NO: 7072517 - DNA, 22 bp, Homo sapiens
gtggccatttggaaggcaagta

SEQ ID NO: 7072518 - DNA, 22 bp, Homo sapiens
gtggcaggttccgtagacagca

SEQ ID NO: 7072519 - DNA, 22 bp, Homo sapiens
gtggcaggtggagcctcctgca

SEQ ID NO: 7072520 - DNA, 22 bp, Homo sapiens
gtggcaggttataagcatctca

SEQ ID NO: 7072521 - DNA, 22 bp, Homo sapiens
gtggcagagccaaggctggagc

SEQ ID NO: 7072522 - DNA, 22 bp, Homo sapiens
gtggcaggtcccattggagcag

SEQ ID NO: 7072523 - DNA, 22 bp, Homo sapiens
gtggcagaaatattcttgctct

SEQ ID NO: 7072524 - DNA, 22 bp, Homo sapiens
gtggcagaaatattcttgctct

SEQ ID NO: 7072525 - DNA, 22 bp, Homo sapiens
gtggcagaccttcccttctcct

SEQ ID NO: 7072526 - DNA, 22 bp, Homo sapiens
gtggcagagagcaagtgtctga

SEQ ID NO: 7072527 - DNA, 22 bp, Homo sapiens
gtggcagagcaggagacaggac

SEQ ID NO: 7072528 - DNA, 22 bp, Homo sapiens
cagcccagccgagggcctggct

SEQ ID NO: 7072529 - DNA, 22 bp, Homo sapiens
cagcccagccgagggcctggct

SEQ ID NO: 7072530 - DNA, 22 bp, Homo sapiens
gtgggcaggccctaggcgattt

SEQ ID NO: 7072531 - DNA, 22 bp, Homo sapiens
gtgggcagggttgctttctccg

SEQ ID NO: 7072532 - DNA, 22 bp, Homo sapiens
gtgggcagtgcctgacggatga

SEQ ID NO: 7072533 - DNA, 22 bp, Homo sapiens
gtgggcagtggggtcttctgcc

SEQ ID NO: 7072534 - DNA, 22 bp, Homo sapiens
gtgggcagtggtttgcgcggtc

SEQ ID NO: 7072535 - DNA, 22 bp, Homo sapiens
gtggggagggagatgctgaagt

SEQ ID NO: 7072536 - DNA, 22 bp, Homo sapiens
gtggcgcagagggtggcagaga

SEQ ID NO: 7072537 - DNA, 22 bp, Homo sapiens
gtggctatatttgaggatacgt

SEQ ID NO: 7072538 - DNA, 22 bp, Homo sapiens
gtgggaagaacttcaagtggct

SEQ ID NO: 7072539 - DNA, 22 bp, Homo sapiens
cagctgaacatgtagagcatct

SEQ ID NO: 7072540 - DNA, 22 bp, Homo sapiens
cagctgaagaaagagtggttag

SEQ ID NO: 7072541 - DNA, 22 bp, Homo sapiens
cagctgagtggaccctagaggc

SEQ ID NO: 7072542 - DNA, 22 bp, Homo sapiens
cagctgagtggaccctagaggc

SEQ ID NO: 7072543 - DNA, 22 bp, Homo sapiens
cagctgagtgttggcatgttca

SEQ ID NO: 7072544 - DNA, 22 bp, Homo sapiens
cagctgagttactctgaggtct

SEQ ID NO: 7072545 - DNA, 22 bp, Homo sapiens
cagctgagttactctgaggtct

SEQ ID NO: 7072546 - DNA, 22 bp, Homo sapiens
cagctgagtttccaagtctgcc

SEQ ID NO: 7072547 - DNA, 22 bp, Homo sapiens
cagctgagctgccagactactg

SEQ ID NO: 7072548 - DNA, 22 bp, Homo sapiens
cagctgagctgccagactactg

SEQ ID NO: 7072549 - DNA, 22 bp, Homo sapiens
cagctgagctgccagactactg

SEQ ID NO: 7072550 - DNA, 22 bp, Homo sapiens
cagctgaggaatactagatgta

SEQ ID NO: 7072551 - DNA, 22 bp, Homo sapiens
cagctgaggtcaaagaagcagg

SEQ ID NO: 7072552 - DNA, 22 bp, Homo sapiens
cagctgaggtcaaagaagcagg

SEQ ID NO: 7072553 - DNA, 22 bp, Homo sapiens
cagctgagtatgcattcaagca

SEQ ID NO: 7072554 - DNA, 22 bp, Homo sapiens
cagctgagtctgaggttctttg

SEQ ID NO: 7072555 - DNA, 22 bp, Homo sapiens
cagctgaagagaggtgctgagt

SEQ ID NO: 7072556 - DNA, 23 bp, Homo sapiens
cagctgaagcagcctgggctgga

SEQ ID NO: 7072557 - DNA, 23 bp, Homo sapiens
cagctgaagcagcctgggctgga

SEQ ID NO: 7072558 - DNA, 22 bp, Homo sapiens
cagctgagctcccaggccatca

SEQ ID NO: 7072559 - DNA, 22 bp, Homo sapiens
cagctgagctcccaggccatca

SEQ ID NO: 7072560 - DNA, 22 bp, Homo sapiens
cagcttctgagcaagccagggg

SEQ ID NO: 7072561 - DNA, 22 bp, Homo sapiens
cagcttctatttatctttgtgt

SEQ ID NO: 7072562 - DNA, 22 bp, Homo sapiens
cagcttctcagaaagctgaggt

SEQ ID NO: 7072563 - DNA, 22 bp, Homo sapiens
cagcttggaggaggatctaaga

SEQ ID NO: 7072564 - DNA, 20 bp, Homo sapiens
cagcttggatgagaggctga

SEQ ID NO: 7072565 - DNA, 22 bp, Homo sapiens
cagcttggcttccgctttactg

SEQ ID NO: 7072566 - DNA, 22 bp, Homo sapiens
cagcttgggagtttggttttat

SEQ ID NO: 7072567 - DNA, 22 bp, Homo sapiens
cagcttgggtcaggtgcctgct

SEQ ID NO: 7072568 - DNA, 22 bp, Homo sapiens
cagctttagagaaaacatattt

SEQ ID NO: 7072569 - DNA, 20 bp, Homo sapiens
cagctttagatctttgatta

SEQ ID NO: 7072570 - DNA, 22 bp, Homo sapiens
cagctttaggactcataataaa

SEQ ID NO: 7072571 - DNA, 22 bp, Homo sapiens
cagctttagtaacccactgctc

SEQ ID NO: 7072572 - DNA, 17 bp, Homo sapiens
cagctttatgctactgt

SEQ ID NO: 7072573 - DNA, 16 bp, Homo sapiens
cagctttatgtcagtg

SEQ ID NO: 7072574 - DNA, 22 bp, Homo sapiens
cagctttatttcacgtgtttgt

SEQ ID NO: 7072575 - DNA, 22 bp, Homo sapiens
cagctttcatcagtgacactca

SEQ ID NO: 7072576 - DNA, 22 bp, Homo sapiens
cagctttcatcagtgacactca

SEQ ID NO: 7072577 - DNA, 22 bp, Homo sapiens
cagctttccccgtgcctcagcc

SEQ ID NO: 7072578 - DNA, 22 bp, Homo sapiens
cagctttctgtctcatgactga

SEQ ID NO: 7072579 - DNA, 22 bp, Homo sapiens
cagctttcttccttctgtctgt

SEQ ID NO: 7072580 - DNA, 22 bp, Homo sapiens
cagctttctttccataaggttt

SEQ ID NO: 7072581 - DNA, 22 bp, Homo sapiens
cagctttgagagttgcatttta

SEQ ID NO: 7072582 - DNA, 21 bp, Homo sapiens
caggaaactgaggccatgggg

SEQ ID NO: 7072583 - DNA, 22 bp, Homo sapiens
gttcacagaaattgtgtacctc

SEQ ID NO: 7072584 - DNA, 22 bp, Homo sapiens
cagcttcattgcctgatgtctt

SEQ ID NO: 7072585 - DNA, 22 bp, Homo sapiens
cagcttccacagacttggctcg

SEQ ID NO: 7072586 - DNA, 22 bp, Homo sapiens
cagcttccataagagatggaga

SEQ ID NO: 7072587 - DNA, 22 bp, Homo sapiens
cagcttccataagagatggaga

SEQ ID NO: 7072588 - DNA, 22 bp, Homo sapiens
cagcttccatctccactgccct

SEQ ID NO: 7072589 - DNA, 22 bp, Homo sapiens
cagcttcccagctcactcataa

SEQ ID NO: 7072590 - DNA, 22 bp, Homo sapiens
cagcttccccccgggcttgaga

SEQ ID NO: 7072591 - DNA, 22 bp, Homo sapiens
cagcttcccttggctgagcaga

SEQ ID NO: 7072592 - DNA, 22 bp, Homo sapiens
cagcttccgaccgggggctgca

SEQ ID NO: 7072593 - DNA, 22 bp, Homo sapiens
cagcttccgaccgggggctgca

SEQ ID NO: 7072594 - DNA, 22 bp, Homo sapiens
cagcttcatgacaaacagtttt

SEQ ID NO: 7072595 - DNA, 22 bp, Homo sapiens
cagcttcagaccctgggctgca

SEQ ID NO: 7072596 - DNA, 22 bp, Homo sapiens
cagctgtgatatgcctgcctga

SEQ ID NO: 7072597 - DNA, 18 bp, Homo sapiens
cagctgtgccctgtttgg

SEQ ID NO: 7072598 - DNA, 22 bp, Homo sapiens
cagctgtgctgattgctcagta

SEQ ID NO: 7072599 - DNA, 22 bp, Homo sapiens
cagctgtggctgccactgctcc

SEQ ID NO: 7072600 - DNA, 22 bp, Homo sapiens
gtgtgtgtactctgtatataaa

SEQ ID NO: 7072601 - DNA, 22 bp, Homo sapiens
gtgtgtgtatatatacacacac

SEQ ID NO: 7072602 - DNA, 22 bp, Homo sapiens
gtgttttaagaaagaagctcag

SEQ ID NO: 7072603 - DNA, 22 bp, Homo sapiens
gtgttttatggagtcataacgt

SEQ ID NO: 7072604 - DNA, 22 bp, Homo sapiens
gttaaacaataactggcacaca

SEQ ID NO: 7072605 - DNA, 22 bp, Homo sapiens
gttaaagtgagctactttaggt

SEQ ID NO: 7072606 - DNA, 22 bp, Homo sapiens
gttaaagtgatcttgtcaggtt

SEQ ID NO: 7072607 - DNA, 22 bp, Homo sapiens
gttacaaatgccaaagctgaga

SEQ ID NO: 7072608 - DNA, 22 bp, Homo sapiens
gttacaactccctgaacctcgg

SEQ ID NO: 7072609 - DNA, 22 bp, Homo sapiens
gttacaatgtccttacatgaaa

SEQ ID NO: 7072610 - DNA, 22 bp, Homo sapiens
gtttgcatttattagtcttctg

SEQ ID NO: 7072611 - DNA, 22 bp, Homo sapiens
gtttcctataactcaggcacca

SEQ ID NO: 7072612 - DNA, 22 bp, Homo sapiens
gtttcctatggctgctgcagga

SEQ ID NO: 7072613 - DNA, 22 bp, Homo sapiens
gtttcctatgtccattgaggga

SEQ ID NO: 7072614 - DNA, 20 bp, Homo sapiens
gtttcctatttacctcctca

SEQ ID NO: 7072615 - DNA, 22 bp, Homo sapiens
gtttcctctgctggttttcatt

SEQ ID NO: 7072616 - DNA, 22 bp, Homo sapiens
caggaagaggacaggcttcccc

SEQ ID NO: 7072617 - DNA, 22 bp, Homo sapiens
caggaagaggtatcaccgagca

SEQ ID NO: 7072618 - DNA, 22 bp, Homo sapiens
caggaagagaacatggaggctg

SEQ ID NO: 7072619 - DNA, 22 bp, Homo sapiens
caggaacagagtggcattgtct

SEQ ID NO: 7072620 - DNA, 22 bp, Homo sapiens
caggaacagcaccaggagctag

SEQ ID NO: 7072621 - DNA, 22 bp, Homo sapiens
caggaacagcaccaggagctag

SEQ ID NO: 7072622 - DNA, 22 bp, Homo sapiens
caggaagaggtggggctaaagt

SEQ ID NO: 7072623 - DNA, 22 bp, Homo sapiens
caggaagattagaccaagagct

SEQ ID NO: 7072624 - DNA, 22 bp, Homo sapiens
caggaagattagaccaagagct

SEQ ID NO: 7072625 - DNA, 22 bp, Homo sapiens
caggaagattgtggaggtggtt

SEQ ID NO: 7072626 - DNA, 22 bp, Homo sapiens
caggaagattgtggaggtggtt

SEQ ID NO: 7072627 - DNA, 22 bp, Homo sapiens
gtttacaacatcttgtccttca

SEQ ID NO: 7072628 - DNA, 22 bp, Homo sapiens
gtttacaacatgccaactgggc

SEQ ID NO: 7072629 - DNA, 21 bp, Homo sapiens
gtttacaaggctttgctcctg

SEQ ID NO: 7072630 - DNA, 22 bp, Homo sapiens
gtttacatgcagaaaatcaatg

SEQ ID NO: 7072631 - DNA, 22 bp, Homo sapiens
gtttacatgcatgcaagaatga

SEQ ID NO: 7072632 - DNA, 22 bp, Homo sapiens
gttcttcagaggggaaagaacc

SEQ ID NO: 7072633 - DNA, 20 bp, Homo sapiens
gttcacaggcttcctttcag

SEQ ID NO: 7072634 - DNA, 22 bp, Homo sapiens
gttcacaggttctctttctaag

SEQ ID NO: 7072635 - DNA, 22 bp, Homo sapiens
gttcacagtgttttctttgcat

SEQ ID NO: 7072636 - DNA, 22 bp, Homo sapiens
gttcctaaatctggaggacctc

SEQ ID NO: 7072637 - DNA, 22 bp, Homo sapiens
gttcctaaatttgaaggacttt

SEQ ID NO: 7072638 - DNA, 22 bp, Homo sapiens
gttcctaaccagcagagaaaca

SEQ ID NO: 7072639 - DNA, 22 bp, Homo sapiens
gttcctaagcactgtgcattct

SEQ ID NO: 7072640 - DNA, 22 bp, Homo sapiens
gttcctaagctgtggccctgga

SEQ ID NO: 7072641 - DNA, 22 bp, Homo sapiens
gttcctcaaaaaggagagcccc

SEQ ID NO: 7072642 - DNA, 22 bp, Homo sapiens
gttcctcacgtggacagatgat

SEQ ID NO: 7072643 - DNA, 22 bp, Homo sapiens
gttcctcagcccttacttagcc

SEQ ID NO: 7072644 - DNA, 22 bp, Homo sapiens
gttcctcagttgtaaaaaatgt

SEQ ID NO: 7072645 - DNA, 22 bp, Homo sapiens
gttcctcatccagtcatgacta

SEQ ID NO: 7072646 - DNA, 22 bp, Homo sapiens
gttcctcatgagtaccccttaa

SEQ ID NO: 7072647 - DNA, 22 bp, Homo sapiens
gttggaatttgctcatccattt

SEQ ID NO: 7072648 - DNA, 22 bp, Homo sapiens
caggaaaggtgtgtcatgatgg

SEQ ID NO: 7072649 - DNA, 22 bp, Homo sapiens
caggagactatggcccaaggcc

SEQ ID NO: 7072650 - DNA, 22 bp, Homo sapiens
caggagacctggtaagccaagt

SEQ ID NO: 7072651 - DNA, 22 bp, Homo sapiens
caggagacaagttagcagctga

SEQ ID NO: 7072652 - DNA, 22 bp, Homo sapiens
caggagaagtctctagggggtg

SEQ ID NO: 7072653 - DNA, 22 bp, Homo sapiens
caggagaagtctctagggggtg

SEQ ID NO: 7072654 - DNA, 22 bp, Homo sapiens
caggagaaggtttggagtgcag

SEQ ID NO: 7072655 - DNA, 19 bp, Homo sapiens
caggacagtttgccaagaa

SEQ ID NO: 7072656 - DNA, 19 bp, Homo sapiens
caggacagtttgccaagaa

SEQ ID NO: 7072657 - DNA, 19 bp, Homo sapiens
caggacagtttgccaagaa

SEQ ID NO: 7072658 - DNA, 22 bp, Homo sapiens
caggacagtttgctttgccctg

SEQ ID NO: 7072659 - DNA, 22 bp, Homo sapiens
caggaccaggcgttctgggctg

SEQ ID NO: 7072660 - DNA, 22 bp, Homo sapiens
caggacagtgcaggtccatcct

SEQ ID NO: 7072661 - DNA, 22 bp, Homo sapiens
taaaccttggtagcatcttgct

SEQ ID NO: 7072662 - DNA, 22 bp, Homo sapiens
taaactatctgtgtttgaagtt

SEQ ID NO: 7072663 - DNA, 22 bp, Homo sapiens
taaactatctgtgtttgaagtt

SEQ ID NO: 7072664 - DNA, 22 bp, Homo sapiens
taaactcttctgtagaatcaga

SEQ ID NO: 7072665 - DNA, 22 bp, Homo sapiens
taaacatttgttattcttgttt

SEQ ID NO: 7072666 - DNA, 18 bp, Homo sapiens
taaaccagatgacagttg

SEQ ID NO: 7072667 - DNA, 22 bp, Homo sapiens
taaaatcagccgaccatggtgg

SEQ ID NO: 7072668 - DNA, 22 bp, Homo sapiens
taaaatcattctggtgtcagta

SEQ ID NO: 7072669 - DNA, 22 bp, Homo sapiens
taaaatcattctggtgtcagta

SEQ ID NO: 7072670 - DNA, 22 bp, Homo sapiens
taaaatcattctggtgtcagta

SEQ ID NO: 7072671 - DNA, 22 bp, Homo sapiens
taaaatgacttcctccaacatc

SEQ ID NO: 7072672 - DNA, 22 bp, Homo sapiens
taaaatgacttcctccaacatc

SEQ ID NO: 7072673 - DNA, 19 bp, Homo sapiens
taaaaactgaaggaagcag

SEQ ID NO: 7072674 - DNA, 22 bp, Homo sapiens
taaaaagcagctgagattttct

SEQ ID NO: 7072675 - DNA, 22 bp, Homo sapiens
gttttcctgaaactgatggtgt

SEQ ID NO: 7072676 - DNA, 22 bp, Homo sapiens
gttttccttctcagccattgcc

SEQ ID NO: 7072677 - DNA, 22 bp, Homo sapiens
gttttctaccagggaagagagt

SEQ ID NO: 7072678 - DNA, 22 bp, Homo sapiens
gttttctcatctcctcaatggt

SEQ ID NO: 7072679 - DNA, 22 bp, Homo sapiens
caggaatgtccttgtcatttca

SEQ ID NO: 7072680 - DNA, 22 bp, Homo sapiens
caggaatgtttgtgctccttta

SEQ ID NO: 7072681 - DNA, 22 bp, Homo sapiens
caggacacagggtgtggctgat

SEQ ID NO: 7072682 - DNA, 22 bp, Homo sapiens
caggaatgatctgctgagtgat

SEQ ID NO: 7072683 - DNA, 22 bp, Homo sapiens
caggaatgccaaccagtgcatg

SEQ ID NO: 7072684 - DNA, 18 bp, Homo sapiens
caggaatggatgggattt

SEQ ID NO: 7072685 - DNA, 22 bp, Homo sapiens
caggaatgtagcagcgatggaa

SEQ ID NO: 7072686 - DNA, 22 bp, Homo sapiens
caggacacttgttcttctctgc

SEQ ID NO: 7072687 - DNA, 22 bp, Homo sapiens
caggacagctcaacacctcctc

SEQ ID NO: 7072688 - DNA, 22 bp, Homo sapiens
caggacagctcaacacctcctc

SEQ ID NO: 7072689 - DNA, 22 bp, Homo sapiens
caggacagctgggccaccacca

SEQ ID NO: 7072690 - DNA, 22 bp, Homo sapiens
caggacaggagtggggtcaaag

SEQ ID NO: 7072691 - DNA, 22 bp, Homo sapiens
caggacaggagtggggtcaaag

SEQ ID NO: 7072692 - DNA, 22 bp, Homo sapiens
caggacaggccctgtggggtct

SEQ ID NO: 7072693 - DNA, 22 bp, Homo sapiens
caggacaggccctgtggggtct

SEQ ID NO: 7072694 - DNA, 22 bp, Homo sapiens
caggacaggccctgtggggtct

SEQ ID NO: 7072695 - DNA, 22 bp, Homo sapiens
caggacaggtgttctagatcag

SEQ ID NO: 7072696 - DNA, 22 bp, Homo sapiens
caggacagtataggctttagga

SEQ ID NO: 7072697 - DNA, 22 bp, Homo sapiens
caggacagtataggctttagga

SEQ ID NO: 7072698 - DNA, 22 bp, Homo sapiens
gttttccactggattgtttgga

SEQ ID NO: 7072699 - DNA, 22 bp, Homo sapiens
gttttccatggaggtctgacct

SEQ ID NO: 7072700 - DNA, 22 bp, Homo sapiens
gtttgtatgaatgttttatgct

SEQ ID NO: 7072701 - DNA, 22 bp, Homo sapiens
gtttgtatgaatgttttatgct

SEQ ID NO: 7072702 - DNA, 23 bp, Homo sapiens
caggaagcagatggggtagaaga

SEQ ID NO: 7072703 - DNA, 22 bp, Homo sapiens
caggaagcatctggctagctaa

SEQ ID NO: 7072704 - DNA, 22 bp, Homo sapiens
caggaagccacaggacaggtag

SEQ ID NO: 7072705 - DNA, 22 bp, Homo sapiens
caggaagctcttagcagtcacc

SEQ ID NO: 7072706 - DNA, 22 bp, Homo sapiens
caggaagctgagctgcactgca

SEQ ID NO: 7072707 - DNA, 22 bp, Homo sapiens
caggaagctgagctgcactgca

SEQ ID NO: 7072708 - DNA, 22 bp, Homo sapiens
caggaagctgagctgcactgca

SEQ ID NO: 7072709 - DNA, 22 bp, Homo sapiens
caggaaggaaagggtgtggaga

SEQ ID NO: 7072710 - DNA, 22 bp, Homo sapiens
caggaaggaccgtccagatcag

SEQ ID NO: 7072711 - DNA, 22 bp, Homo sapiens
caggaagggggatccttggaag

SEQ ID NO: 7072712 - DNA, 22 bp, Homo sapiens
taaatgcttagattcatagaaa

SEQ ID NO: 7072713 - DNA, 22 bp, Homo sapiens
taaatgctttctatgaaagagg

SEQ ID NO: 7072714 - DNA, 22 bp, Homo sapiens
taaatatgcatgtatccttatc

SEQ ID NO: 7072715 - DNA, 22 bp, Homo sapiens
taaatatcagtccagctcttcc

SEQ ID NO: 7072716 - DNA, 22 bp, Homo sapiens
taaatatcacctggaattgtta

SEQ ID NO: 7072717 - DNA, 22 bp, Homo sapiens
taaatagagaatcagcttggag

SEQ ID NO: 7072718 - DNA, 22 bp, Homo sapiens
taaatagagaatcagcttggag

SEQ ID NO: 7072719 - DNA, 18 bp, Homo sapiens
taaatatatttccccctt

SEQ ID NO: 7072720 - DNA, 18 bp, Homo sapiens
taaatatatttccccctt

SEQ ID NO: 7072721 - DNA, 18 bp, Homo sapiens
taaatatatttccccctt

SEQ ID NO: 7072722 - DNA, 22 bp, Homo sapiens
taaagccacgctggaaatcagg

SEQ ID NO: 7072723 - DNA, 22 bp, Homo sapiens
taaagccacttcattctagtct

SEQ ID NO: 7072724 - DNA, 22 bp, Homo sapiens
taaagccatactgaaagccact

SEQ ID NO: 7072725 - DNA, 23 bp, Homo sapiens
taaagtcacatattagagtgagc

SEQ ID NO: 7072726 - DNA, 22 bp, Homo sapiens
taaagtcagatatctgggttga

SEQ ID NO: 7072727 - DNA, 22 bp, Homo sapiens
taaagtcagggagattgaggct

SEQ ID NO: 7072728 - DNA, 22 bp, Homo sapiens
taaagtcatctttacatctttg

SEQ ID NO: 7072729 - DNA, 22 bp, Homo sapiens
taaagtcatctttacatctttg

SEQ ID NO: 7072730 - DNA, 22 bp, Homo sapiens
caggagagcccgggtccgggct

SEQ ID NO: 7072731 - DNA, 22 bp, Homo sapiens
caggagagcccgggtccgggct

SEQ ID NO: 7072732 - DNA, 22 bp, Homo sapiens
caggagagatatgagtccccac

SEQ ID NO: 7072733 - DNA, 22 bp, Homo sapiens
caggagactcagcatccaggat

SEQ ID NO: 7072734 - DNA, 22 bp, Homo sapiens
caggagataaaagagatgcttt

SEQ ID NO: 7072735 - DNA, 22 bp, Homo sapiens
caggagatgacagggaagaacc

SEQ ID NO: 7072736 - DNA, 23 bp, Homo sapiens
caggagatggctgctgtgtcagc

SEQ ID NO: 7072737 - DNA, 23 bp, Homo sapiens
caggagatggctgctgtgtcagc

SEQ ID NO: 7072738 - DNA, 22 bp, Homo sapiens
caggagatgtaagacttctgtt

SEQ ID NO: 7072739 - DNA, 22 bp, Homo sapiens
caggagcccgttgctccggcgg

SEQ ID NO: 7072740 - DNA, 22 bp, Homo sapiens
caggagccctggtgggtggaca

SEQ ID NO: 7072741 - DNA, 22 bp, Homo sapiens
caggagctctcatcgtcagggc

SEQ ID NO: 7072742 - DNA, 22 bp, Homo sapiens
caggaggcagaggatgcccagt

SEQ ID NO: 7072743 - DNA, 22 bp, Homo sapiens
caggaggaagaactctgcaaca

SEQ ID NO: 7072744 - DNA, 22 bp, Homo sapiens
caggaggacatactggctcaca

SEQ ID NO: 7072745 - DNA, 22 bp, Homo sapiens
caggaggacatactggctcaca

SEQ ID NO: 7072746 - DNA, 22 bp, Homo sapiens
caggaggaaatgtgaccctgct

SEQ ID NO: 7072747 - DNA, 22 bp, Homo sapiens
caggaggaaatgtgaccctgct

SEQ ID NO: 7072748 - DNA, 22 bp, Homo sapiens
caggaggaaagttccactcaac

SEQ ID NO: 7072749 - DNA, 22 bp, Homo sapiens
caggaggaaatgtgaccctgct

SEQ ID NO: 7072750 - DNA, 22 bp, Homo sapiens
caggaggaacaagaggttctgg

SEQ ID NO: 7072751 - DNA, 22 bp, Homo sapiens
caggaggaacaagaggttctgg

SEQ ID NO: 7072752 - DNA, 22 bp, Homo sapiens
caggaggaaactggattcactt

SEQ ID NO: 7072753 - DNA, 22 bp, Homo sapiens
taaatgtctttgtcacgttggg

SEQ ID NO: 7072754 - DNA, 22 bp, Homo sapiens
taaatgtataggcactaaacct

SEQ ID NO: 7072755 - DNA, 22 bp, Homo sapiens
taaatgtagtcaaaggagcctc

SEQ ID NO: 7072756 - DNA, 22 bp, Homo sapiens
taaatgtataggcactaaacct

SEQ ID NO: 7072757 - DNA, 22 bp, Homo sapiens
taaatgtataggcactaaacct

SEQ ID NO: 7072758 - DNA, 22 bp, Homo sapiens
taaatgtcaatgtgatttataa

SEQ ID NO: 7072759 - DNA, 22 bp, Homo sapiens
taaatgtaaatggcgtcttgcg

SEQ ID NO: 7072760 - DNA, 22 bp, Homo sapiens
taaatgtaccttctgccttact

SEQ ID NO: 7072761 - DNA, 22 bp, Homo sapiens
taaatgtactgaggcaacagga

SEQ ID NO: 7072762 - DNA, 22 bp, Homo sapiens
caggagtgcaggtggtgaggca

SEQ ID NO: 7072763 - DNA, 22 bp, Homo sapiens
caggagtggtgtgagggactcc

SEQ ID NO: 7072764 - DNA, 22 bp, Homo sapiens
caggagtgtcgggtcactaggt

SEQ ID NO: 7072765 - DNA, 22 bp, Homo sapiens
caggataacagaaaatagctga

SEQ ID NO: 7072766 - DNA, 22 bp, Homo sapiens
caggagggggtggagtttcgcc

SEQ ID NO: 7072767 - DNA, 22 bp, Homo sapiens
taagattacagtgagaaataaa

SEQ ID NO: 7072768 - DNA, 22 bp, Homo sapiens
taagattatacttaaagagaaa

SEQ ID NO: 7072769 - DNA, 22 bp, Homo sapiens
taagatttttaaaatgtcctca

SEQ ID NO: 7072770 - DNA, 22 bp, Homo sapiens
taagatttttaaaatgtcctca

SEQ ID NO: 7072771 - DNA, 22 bp, Homo sapiens
taagcaaaggattttgatcttt

SEQ ID NO: 7072772 - DNA, 22 bp, Homo sapiens
taaggcagaaatatgagcaggg

SEQ ID NO: 7072773 - DNA, 19 bp, Homo sapiens
taaggcagcagtgacaggc

SEQ ID NO: 7072774 - DNA, 22 bp, Homo sapiens
caggcactagcagaatgaggct

SEQ ID NO: 7072775 - DNA, 22 bp, Homo sapiens
caggcactcagtctggatccct

SEQ ID NO: 7072776 - DNA, 22 bp, Homo sapiens
caggcaccaacttcctggggag

SEQ ID NO: 7072777 - DNA, 22 bp, Homo sapiens
caggcacaagatcggctagata

SEQ ID NO: 7072778 - DNA, 22 bp, Homo sapiens
caggatggtggcatgatcagaa

SEQ ID NO: 7072779 - DNA, 22 bp, Homo sapiens
caggatggtggcatgatcagaa

SEQ ID NO: 7072780 - DNA, 22 bp, Homo sapiens
caggatggtgtgagtgtgagga

SEQ ID NO: 7072781 - DNA, 22 bp, Homo sapiens
caggatggtgtgagtgtgagga

SEQ ID NO: 7072782 - DNA, 22 bp, Homo sapiens
caggattaaggtgaggggagta

SEQ ID NO: 7072783 - DNA, 22 bp, Homo sapiens
caggcaagatccagaggctgct

SEQ ID NO: 7072784 - DNA, 22 bp, Homo sapiens
caggcaaggaggcactgaggga

SEQ ID NO: 7072785 - DNA, 21 bp, Homo sapiens
caggatgatgggaaggtggtg

SEQ ID NO: 7072786 - DNA, 20 bp, Homo sapiens
caggatgattggacacgatg

SEQ ID NO: 7072787 - DNA, 22 bp, Homo sapiens
caggatggagagtgaggggtca

SEQ ID NO: 7072788 - DNA, 22 bp, Homo sapiens
caggatggtctcgatctcctga

SEQ ID NO: 7072789 - DNA, 22 bp, Homo sapiens
caggatggtcttcatttggctc

SEQ ID NO: 7072790 - DNA, 22 bp, Homo sapiens
caggatggtggcatgatcagaa

SEQ ID NO: 7072791 - DNA, 18 bp, Homo sapiens
caggatgagtgatgggga

SEQ ID NO: 7072792 - DNA, 22 bp, Homo sapiens
caggatgaggtagaggcagata

SEQ ID NO: 7072793 - DNA, 22 bp, Homo sapiens
caggatgagaggcccagggaag

SEQ ID NO: 7072794 - DNA, 22 bp, Homo sapiens
taacttctttggtttaaagaga

SEQ ID NO: 7072795 - DNA, 19 bp, Homo sapiens
taacttgtagatatgaagt

SEQ ID NO: 7072796 - DNA, 22 bp, Homo sapiens
taacattgtcagttcaactgct

SEQ ID NO: 7072797 - DNA, 22 bp, Homo sapiens
taacattaggtagacataagcc

SEQ ID NO: 7072798 - DNA, 22 bp, Homo sapiens
taacattaggtagacataagcc

SEQ ID NO: 7072799 - DNA, 22 bp, Homo sapiens
taacaatacccattctaattac

SEQ ID NO: 7072800 - DNA, 22 bp, Homo sapiens
taatttaatttcatgccagcct

SEQ ID NO: 7072801 - DNA, 22 bp, Homo sapiens
taatttaatccaagtgttacat

SEQ ID NO: 7072802 - DNA, 22 bp, Homo sapiens
taatttaattccatggattcta

SEQ ID NO: 7072803 - DNA, 22 bp, Homo sapiens
caggcagagcaactggtccaga

SEQ ID NO: 7072804 - DNA, 22 bp, Homo sapiens
caggcagaaggaagtaccaggc

SEQ ID NO: 7072805 - DNA, 22 bp, Homo sapiens
caggcagaaattttgtttcatt

SEQ ID NO: 7072806 - DNA, 22 bp, Homo sapiens
caggcagaagaagtggaaggac

SEQ ID NO: 7072807 - DNA, 17 bp, Homo sapiens
caggcagacatgtaagc

SEQ ID NO: 7072808 - DNA, 22 bp, Homo sapiens
caggcagacatttttgacatag

SEQ ID NO: 7072809 - DNA, 22 bp, Homo sapiens
caggcagagaactcatccgtga

SEQ ID NO: 7072810 - DNA, 22 bp, Homo sapiens
caggcagagacgtcagtgtagg

SEQ ID NO: 7072811 - DNA, 22 bp, Homo sapiens
caggcagagaggagcatttaat

SEQ ID NO: 7072812 - DNA, 22 bp, Homo sapiens
caggcagcagccactctggtat

SEQ ID NO: 7072813 - DNA, 22 bp, Homo sapiens
caggcagcatttactctgatga

SEQ ID NO: 7072814 - DNA, 22 bp, Homo sapiens
caggcagccaggggacctgtcc

SEQ ID NO: 7072815 - DNA, 22 bp, Homo sapiens
caggcagcctgagggatctggg

SEQ ID NO: 7072816 - DNA, 22 bp, Homo sapiens
caggcagccctgcaccaagtgt

SEQ ID NO: 7072817 - DNA, 22 bp, Homo sapiens
caggcagcctgagggatctggg

SEQ ID NO: 7072818 - DNA, 22 bp, Homo sapiens
caggcagcctgagggatctggg

SEQ ID NO: 7072819 - DNA, 22 bp, Homo sapiens
caggcagcctgcggtctgcaca

SEQ ID NO: 7072820 - DNA, 22 bp, Homo sapiens
caggcagctcgatgccttgttg

SEQ ID NO: 7072821 - DNA, 22 bp, Homo sapiens
caggcagctctgcttttcctaa

SEQ ID NO: 7072822 - DNA, 22 bp, Homo sapiens
caggcagctgactgtcagatat

SEQ ID NO: 7072823 - DNA, 22 bp, Homo sapiens
caggcagctgaggactttgcta

SEQ ID NO: 7072824 - DNA, 22 bp, Homo sapiens
caggcagctgaggactttgcta

SEQ ID NO: 7072825 - DNA, 22 bp, Homo sapiens
caggcagctgaggactttgcta

SEQ ID NO: 7072826 - DNA, 22 bp, Homo sapiens
caggcagctgcgacaagagagc

SEQ ID NO: 7072827 - DNA, 22 bp, Homo sapiens
caggcagctgcgacaagagagc

SEQ ID NO: 7072828 - DNA, 22 bp, Homo sapiens
caggcagctgctgggttcagcc

SEQ ID NO: 7072829 - DNA, 22 bp, Homo sapiens
caggcagctgctgggttcagcc

SEQ ID NO: 7072830 - DNA, 22 bp, Homo sapiens
caggcagctgggtcaccgtccc

SEQ ID NO: 7072831 - DNA, 22 bp, Homo sapiens
caggcaggagccagggattcca

SEQ ID NO: 7072832 - DNA, 23 bp, Homo sapiens
caggcaggatgaggactacactc

SEQ ID NO: 7072833 - DNA, 22 bp, Homo sapiens
caggcagggagccactgtataa

SEQ ID NO: 7072834 - DNA, 22 bp, Homo sapiens
tacagtttgttacattgttagt

SEQ ID NO: 7072835 - DNA, 22 bp, Homo sapiens
tacatatgaactttataacttg

SEQ ID NO: 7072836 - DNA, 22 bp, Homo sapiens
tacatatgtaaacatgtataaa

SEQ ID NO: 7072837 - DNA, 22 bp, Homo sapiens
tacatatttgtctttgtactgt

SEQ ID NO: 7072838 - DNA, 22 bp, Homo sapiens
tacatatttgtctttgtactgt

SEQ ID NO: 7072839 - DNA, 22 bp, Homo sapiens
tacatcatgaaagcatacatca

SEQ ID NO: 7072840 - DNA, 22 bp, Homo sapiens
tacatgtggagataactgaagc

SEQ ID NO: 7072841 - DNA, 22 bp, Homo sapiens
caggccctggcagggctgagtc

SEQ ID NO: 7072842 - DNA, 22 bp, Homo sapiens
tacaggtggtaaaaatattgtt

SEQ ID NO: 7072843 - DNA, 22 bp, Homo sapiens
tacaggttacacttttaaaagt

SEQ ID NO: 7072844 - DNA, 22 bp, Homo sapiens
tacagtaaagctgctatgaatt

SEQ ID NO: 7072845 - DNA, 22 bp, Homo sapiens
caggccctggcagggctgagtc

SEQ ID NO: 7072846 - DNA, 22 bp, Homo sapiens
tacaaatgagttgtatgaacca

SEQ ID NO: 7072847 - DNA, 22 bp, Homo sapiens
tacaaactccgaagtttgtacc

SEQ ID NO: 7072848 - DNA, 20 bp, Homo sapiens
tacaatacacatgcatatga

SEQ ID NO: 7072849 - DNA, 22 bp, Homo sapiens
tacaatacttaacctattttgc

SEQ ID NO: 7072850 - DNA, 22 bp, Homo sapiens
tacagcttaaaaaagccaactt

SEQ ID NO: 7072851 - DNA, 22 bp, Homo sapiens
tacagggtattcaagggtagtt

SEQ ID NO: 7072852 - DNA, 22 bp, Homo sapiens
tacagggtataggtacagatga

SEQ ID NO: 7072853 - DNA, 22 bp, Homo sapiens
tacaagtgctagcagatattgt

SEQ ID NO: 7072854 - DNA, 22 bp, Homo sapiens
tacaagtgtaagcttgtgagac

SEQ ID NO: 7072855 - DNA, 22 bp, Homo sapiens
tacaagtgtgcaccaccatgtc

SEQ ID NO: 7072856 - DNA, 22 bp, Homo sapiens
cagtgctggctgttaggacagt

SEQ ID NO: 7072857 - DNA, 22 bp, Homo sapiens
cagtgctgggcagaggagagcg

SEQ ID NO: 7072858 - DNA, 22 bp, Homo sapiens
cagtgcagaggccagggaggat

SEQ ID NO: 7072859 - DNA, 19 bp, Homo sapiens
cagtgcccgacgcaggtct

SEQ ID NO: 7072860 - DNA, 22 bp, Homo sapiens
cagtgctgagagcctggccagg

SEQ ID NO: 7072861 - DNA, 22 bp, Homo sapiens
cagtgctgcaggcgcctgcggt

SEQ ID NO: 7072862 - DNA, 23 bp, Homo sapiens
cagtgctggttctgcctgtgggg

SEQ ID NO: 7072863 - DNA, 22 bp, Homo sapiens
cagtgctgtgctggaagctgtt

SEQ ID NO: 7072864 - DNA, 22 bp, Homo sapiens
cagtgctgtgctggaagctgtt

SEQ ID NO: 7072865 - DNA, 22 bp, Homo sapiens
cagtgctgttgggcccagagag

SEQ ID NO: 7072866 - DNA, 22 bp, Homo sapiens
tcacattgaatggaagaataga

SEQ ID NO: 7072867 - DNA, 22 bp, Homo sapiens
tcaccaggctcctgttaagatg

SEQ ID NO: 7072868 - DNA, 22 bp, Homo sapiens
tcaccaggctggaatgcagtgg

SEQ ID NO: 7072869 - DNA, 22 bp, Homo sapiens
tcaccaggctggagtgcagtgg

SEQ ID NO: 7072870 - DNA, 22 bp, Homo sapiens
tcaccagggagcttgtcctctg

SEQ ID NO: 7072871 - DNA, 22 bp, Homo sapiens
tcacccaagaccatcggaagtg

SEQ ID NO: 7072872 - DNA, 22 bp, Homo sapiens
tcacccagacagcttgcactga

SEQ ID NO: 7072873 - DNA, 22 bp, Homo sapiens
tcactatgttcggagaactctg

SEQ ID NO: 7072874 - DNA, 22 bp, Homo sapiens
tcactcaatatcccagtggggc

SEQ ID NO: 7072875 - DNA, 22 bp, Homo sapiens
tcactcaggttcatgtctttgt

SEQ ID NO: 7072876 - DNA, 22 bp, Homo sapiens
tcactccatagcttaactcttt

SEQ ID NO: 7072877 - DNA, 22 bp, Homo sapiens
tcactccatctttgctactggt

SEQ ID NO: 7072878 - DNA, 22 bp, Homo sapiens
tcacttcccagacggggtggca

SEQ ID NO: 7072879 - DNA, 22 bp, Homo sapiens
tcacttccctcttcagctccca

SEQ ID NO: 7072880 - DNA, 22 bp, Homo sapiens
tcagaaagtgaactgttgacat

SEQ ID NO: 7072881 - DNA, 22 bp, Homo sapiens
tcagaaataatgaatgatgggg

SEQ ID NO: 7072882 - DNA, 22 bp, Homo sapiens
tcagaaatgatcgttattcatt

SEQ ID NO: 7072883 - DNA, 22 bp, Homo sapiens
tcagaaatttaggctggacttg

SEQ ID NO: 7072884 - DNA, 22 bp, Homo sapiens
tcagaagctggtgtcctttgaa

SEQ ID NO: 7072885 - DNA, 22 bp, Homo sapiens
cagtctccgccagctcctcaca

SEQ ID NO: 7072886 - DNA, 22 bp, Homo sapiens
cagtctctaaatcaatctgaat

SEQ ID NO: 7072887 - DNA, 22 bp, Homo sapiens
cagtctcagaggtgggagtggg

SEQ ID NO: 7072888 - DNA, 22 bp, Homo sapiens
cagtgaggtggatggatggcct

SEQ ID NO: 7072889 - DNA, 22 bp, Homo sapiens
cagtgagttgtgctgaggacca

SEQ ID NO: 7072890 - DNA, 22 bp, Homo sapiens
cagtgcaaactccctgaggtgg

SEQ ID NO: 7072891 - DNA, 22 bp, Homo sapiens
cagtgcagacgtggagggggca

SEQ ID NO: 7072892 - DNA, 22 bp, Homo sapiens
cagtgcagacgtggagggggca

SEQ ID NO: 7072893 - DNA, 22 bp, Homo sapiens
cagtgcagaggccagggaggat

SEQ ID NO: 7072894 - DNA, 20 bp, Homo sapiens
tatttacaacttagagcctc

SEQ ID NO: 7072895 - DNA, 20 bp, Homo sapiens
tatttacaacttagagcctc

SEQ ID NO: 7072896 - DNA, 22 bp, Homo sapiens
tattggagtatggggctggagt

SEQ ID NO: 7072897 - DNA, 22 bp, Homo sapiens
tatttagaacagacaatagaaa

SEQ ID NO: 7072898 - DNA, 22 bp, Homo sapiens
tatttagttatctttcataaaa

SEQ ID NO: 7072899 - DNA, 21 bp, Homo sapiens
tatttagttttacaaatgtgg

SEQ ID NO: 7072900 - DNA, 22 bp, Homo sapiens
tatacagtcttttgctatattc

SEQ ID NO: 7072901 - DNA, 22 bp, Homo sapiens
tatacagtatcttttgaaggca

SEQ ID NO: 7072902 - DNA, 22 bp, Homo sapiens
cagggtggaatggaatgctggc

SEQ ID NO: 7072903 - DNA, 17 bp, Homo sapiens
caggtctgaggccaggc

SEQ ID NO: 7072904 - DNA, 22 bp, Homo sapiens
caggtctgcagacagggccatg

SEQ ID NO: 7072905 - DNA, 22 bp, Homo sapiens
caggtctgggttgatggcctgg

SEQ ID NO: 7072906 - DNA, 22 bp, Homo sapiens
cagggtggaagctgtagagtgg

SEQ ID NO: 7072907 - DNA, 22 bp, Homo sapiens
caggggcaggtgtgagatcatc

SEQ ID NO: 7072908 - DNA, 22 bp, Homo sapiens
caggggccggctgtccgtgccc

SEQ ID NO: 7072909 - DNA, 22 bp, Homo sapiens
tataattagtaaatggcagatt

SEQ ID NO: 7072910 - DNA, 22 bp, Homo sapiens
tataatccattcattgatttct

SEQ ID NO: 7072911 - DNA, 22 bp, Homo sapiens
tataatatgaggcaggagtgat

SEQ ID NO: 7072912 - DNA, 22 bp, Homo sapiens
tataagtagttgttgaagactt

SEQ ID NO: 7072913 - DNA, 22 bp, Homo sapiens
tagttttagtcccattttacag

SEQ ID NO: 7072914 - DNA, 22 bp, Homo sapiens
tacatgtggtagggagggcagt

SEQ ID NO: 7072915 - DNA, 17 bp, Homo sapiens
tacatgtgtatctgatt

SEQ ID NO: 7072916 - DNA, 22 bp, Homo sapiens
tattgctttcagttgctttgag

SEQ ID NO: 7072917 - DNA, 22 bp, Homo sapiens
tattgcctgagtgtttcataat

SEQ ID NO: 7072918 - DNA, 22 bp, Homo sapiens
tatgtttttcaagtgcacacta

SEQ ID NO: 7072919 - DNA, 22 bp, Homo sapiens
tatgtttttcagacgtcctaca

SEQ ID NO: 7072920 - DNA, 22 bp, Homo sapiens
tattaaatatatctgttagttg

SEQ ID NO: 7072921 - DNA, 22 bp, Homo sapiens
tattaaatatatctgttagttg

SEQ ID NO: 7072922 - DNA, 22 bp, Homo sapiens
tattcctggtgttggctgggtc

SEQ ID NO: 7072923 - DNA, 22 bp, Homo sapiens
tatgttttaggaattaattgtt

SEQ ID NO: 7072924 - DNA, 22 bp, Homo sapiens
tatgtttttaagagaatgcatt

SEQ ID NO: 7072925 - DNA, 22 bp, Homo sapiens
caggtctgtattaacagagggt

SEQ ID NO: 7072926 - DNA, 22 bp, Homo sapiens
caggtctgtttccatcagtgct

SEQ ID NO: 7072927 - DNA, 22 bp, Homo sapiens
caggtgaaaaagcaaccatatt

SEQ ID NO: 7072928 - DNA, 22 bp, Homo sapiens
caggtgaagaggataaaaagtt

SEQ ID NO: 7072929 - DNA, 22 bp, Homo sapiens
tatctctagcgcacagaagaaa

SEQ ID NO: 7072930 - DNA, 22 bp, Homo sapiens
tatctctgtaaaagaaatcaca

SEQ ID NO: 7072931 - DNA, 22 bp, Homo sapiens
tatctcttgcatgctttttaga

SEQ ID NO: 7072932 - DNA, 22 bp, Homo sapiens
catatgaaatatgagttgaaca

SEQ ID NO: 7072933 - DNA, 22 bp, Homo sapiens
catatcttatggttttctaagt

SEQ ID NO: 7072934 - DNA, 22 bp, Homo sapiens
catatcttctgacatgatcagg

SEQ ID NO: 7072935 - DNA, 22 bp, Homo sapiens
catatcttctgacatgatcagg

SEQ ID NO: 7072936 - DNA, 15 bp, Homo sapiens
catatcactgggaat

SEQ ID NO: 7072937 - DNA, 22 bp, Homo sapiens
catatcataggtcttggataat

SEQ ID NO: 7072938 - DNA, 22 bp, Homo sapiens
catatcatttgcttataaatct

SEQ ID NO: 7072939 - DNA, 22 bp, Homo sapiens
catatattatggactgcagaat

SEQ ID NO: 7072940 - DNA, 22 bp, Homo sapiens
catatattctggttttcactgg

SEQ ID NO: 7072941 - DNA, 22 bp, Homo sapiens
catatacacttccacctctgtg

SEQ ID NO: 7072942 - DNA, 20 bp, Homo sapiens
catatatacctagaagtgga

SEQ ID NO: 7072943 - DNA, 20 bp, Homo sapiens
catatatacctagaagtgga

SEQ ID NO: 7072944 - DNA, 20 bp, Homo sapiens
catatatacctagaagtgga

SEQ ID NO: 7072945 - DNA, 22 bp, Homo sapiens
catatacacttccacctctgtg

SEQ ID NO: 7072946 - DNA, 22 bp, Homo sapiens
catagaatgtaataaagagtag

SEQ ID NO: 7072947 - DNA, 22 bp, Homo sapiens
tcaggaagtgcctaggctggcc

SEQ ID NO: 7072948 - DNA, 22 bp, Homo sapiens
tcaggaagtgctgaggctgctt

SEQ ID NO: 7072949 - DNA, 22 bp, Homo sapiens
tcaggaagtggtaaaggatgtt

SEQ ID NO: 7072950 - DNA, 22 bp, Homo sapiens
tcaggaagtggtaaaggatgtt

SEQ ID NO: 7072951 - DNA, 22 bp, Homo sapiens
tcaggaagttgaggcgtagaga

SEQ ID NO: 7072952 - DNA, 22 bp, Homo sapiens
tcagggccatcttttgcctcaa

SEQ ID NO: 7072953 - DNA, 22 bp, Homo sapiens
catcacatcagtgtgaacagtt

SEQ ID NO: 7072954 - DNA, 22 bp, Homo sapiens
catccactagaatgacagagtt

SEQ ID NO: 7072955 - DNA, 22 bp, Homo sapiens
catccagagtccaaggctgggc

SEQ ID NO: 7072956 - DNA, 22 bp, Homo sapiens
catccaggctgaagtgcagtgg

SEQ ID NO: 7072957 - DNA, 22 bp, Homo sapiens
cagtttcttagtgacacaaatc

SEQ ID NO: 7072958 - DNA, 22 bp, Homo sapiens
cagtttcttggatgccaatttc

SEQ ID NO: 7072959 - DNA, 19 bp, Homo sapiens
cagtttgtccagaggggac

SEQ ID NO: 7072960 - DNA, 22 bp, Homo sapiens
cagtttctgtggtctcttttca

SEQ ID NO: 7072961 - DNA, 22 bp, Homo sapiens
cagtttatatgtcagagctgta

SEQ ID NO: 7072962 - DNA, 22 bp, Homo sapiens
tcagaagggaaacacaagtgac

SEQ ID NO: 7072963 - DNA, 22 bp, Homo sapiens
catacttactgtgtaccaggtg

SEQ ID NO: 7072964 - DNA, 22 bp, Homo sapiens
cataatttttttaagtcagaac

SEQ ID NO: 7072965 - DNA, 22 bp, Homo sapiens
catacattgaatttgcacgtgt

SEQ ID NO: 7072966 - DNA, 22 bp, Homo sapiens
catacattgctcattcagtatc

SEQ ID NO: 7072967 - DNA, 22 bp, Homo sapiens
catacattgctcattcagtatc

SEQ ID NO: 7072968 - DNA, 22 bp, Homo sapiens
catacatttatacacatctatg

SEQ ID NO: 7072969 - DNA, 22 bp, Homo sapiens
tcagctcttaaccctctggcct

SEQ ID NO: 7072970 - DNA, 22 bp, Homo sapiens
tcagctgaagtggagaagcaga

SEQ ID NO: 7072971 - DNA, 22 bp, Homo sapiens
tcagctgagctccagctcatag

SEQ ID NO: 7072972 - DNA, 22 bp, Homo sapiens
tcagctgagttctagagcactc

SEQ ID NO: 7072973 - DNA, 22 bp, Homo sapiens
tcagccctgggcttcctcatgg

SEQ ID NO: 7072974 - DNA, 22 bp, Homo sapiens
tcagccccacggggtcagccaa

SEQ ID NO: 7072975 - DNA, 22 bp, Homo sapiens
tcatggggtttggctggatgtc

SEQ ID NO: 7072976 - DNA, 22 bp, Homo sapiens
tcatggggctcttcaagtggag

SEQ ID NO: 7072977 - DNA, 22 bp, Homo sapiens
tcatggggtgaattagtatgct

SEQ ID NO: 7072978 - DNA, 22 bp, Homo sapiens
tcatggggtgacagaagggagg

SEQ ID NO: 7072979 - DNA, 19 bp, Homo sapiens
tcatgtctctcatctgtga

SEQ ID NO: 7072980 - DNA, 22 bp, Homo sapiens
tcatttcaagttctgacagcta

SEQ ID NO: 7072981 - DNA, 22 bp, Homo sapiens
tcatttgttctcattctctact

SEQ ID NO: 7072982 - DNA, 17 bp, Homo sapiens
tcatttgttgtgactag

SEQ ID NO: 7072983 - DNA, 22 bp, Homo sapiens
catgatctggtcctactgtggg

SEQ ID NO: 7072984 - DNA, 22 bp, Homo sapiens
catgagttcaaaatgcctgcct

SEQ ID NO: 7072985 - DNA, 22 bp, Homo sapiens
catgagttcatctgcttctctt

SEQ ID NO: 7072986 - DNA, 22 bp, Homo sapiens
catgagttttttagttcatgca

SEQ ID NO: 7072987 - DNA, 22 bp, Homo sapiens
catctttgcaccctcaaaacct

SEQ ID NO: 7072988 - DNA, 21 bp, Homo sapiens
tcagttctctgcctgtgcttg

SEQ ID NO: 7072989 - DNA, 22 bp, Homo sapiens
catctttagttattgaatatag

SEQ ID NO: 7072990 - DNA, 22 bp, Homo sapiens
catctttagttattgaatatag

SEQ ID NO: 7072991 - DNA, 22 bp, Homo sapiens
catctttaacagaatggatttg

SEQ ID NO: 7072992 - DNA, 22 bp, Homo sapiens
catctttagggaccattattct

SEQ ID NO: 7072993 - DNA, 22 bp, Homo sapiens
catctttatttatatagacagg

SEQ ID NO: 7072994 - DNA, 22 bp, Homo sapiens
catctttgaactctgtataaac

SEQ ID NO: 7072995 - DNA, 22 bp, Homo sapiens
tcaggtgggcgttccggtgcgg

SEQ ID NO: 7072996 - DNA, 22 bp, Homo sapiens
catctttaacaatttacaatgt

SEQ ID NO: 7072997 - DNA, 22 bp, Homo sapiens
catctttaacaatttacaatgt

SEQ ID NO: 7072998 - DNA, 22 bp, Homo sapiens
catgattttgtcttgtgttaat

SEQ ID NO: 7072999 - DNA, 22 bp, Homo sapiens
tcattttggggtttgtcatctt

SEQ ID NO: 7073000 - DNA, 22 bp, Homo sapiens
tcattttcaagtttgaacagga

SEQ ID NO: 7073001 - DNA, 22 bp, Homo sapiens
tcattttcaagtttgaacagga

SEQ ID NO: 7073002 - DNA, 22 bp, Homo sapiens
tcattttcacacataaatagca

SEQ ID NO: 7073003 - DNA, 22 bp, Homo sapiens
tcattttcacacataaatagca

SEQ ID NO: 7073004 - DNA, 23 bp, Homo sapiens
catggctgatttcaagctaccac

SEQ ID NO: 7073005 - DNA, 22 bp, Homo sapiens
catggctgcgagaagagtgggt

SEQ ID NO: 7073006 - DNA, 19 bp, Homo sapiens
catggctgctgcttgggag

SEQ ID NO: 7073007 - DNA, 22 bp, Homo sapiens
catggcttcgcgcgtccccgct

SEQ ID NO: 7073008 - DNA, 22 bp, Homo sapiens
catggctttccagtcctccact

SEQ ID NO: 7073009 - DNA, 22 bp, Homo sapiens
catgggaggcctgctgctggtg

SEQ ID NO: 7073010 - DNA, 22 bp, Homo sapiens
tccagccaggatggcccaggga

SEQ ID NO: 7073011 - DNA, 22 bp, Homo sapiens
tccagcccagctcctctcagaa

SEQ ID NO: 7073012 - DNA, 18 bp, Homo sapiens
catgtctgcgccacaagg

SEQ ID NO: 7073013 - DNA, 22 bp, Homo sapiens
catgtctgtgtacacatgcaca

SEQ ID NO: 7073014 - DNA, 22 bp, Homo sapiens
catgtcttccttgcacacacac

SEQ ID NO: 7073015 - DNA, 22 bp, Homo sapiens
catgtctttctcatcacatcta

SEQ ID NO: 7073016 - DNA, 19 bp, Homo sapiens
tctctctgtacattagata

SEQ ID NO: 7073017 - DNA, 22 bp, Homo sapiens
ccagatgggccaggggtttgtt

SEQ ID NO: 7073018 - DNA, 22 bp, Homo sapiens
ccagatattcacttttacatgc

SEQ ID NO: 7073019 - DNA, 22 bp, Homo sapiens
ccagaggtgctgggagaggtct

SEQ ID NO: 7073020 - DNA, 22 bp, Homo sapiens
ccagaggtgctctttggaagtg

SEQ ID NO: 7073021 - DNA, 22 bp, Homo sapiens
ccagaggtgccacagaaagagc

SEQ ID NO: 7073022 - DNA, 22 bp, Homo sapiens
ccagatatcactgccgtgttgt

SEQ ID NO: 7073023 - DNA, 22 bp, Homo sapiens
ccagaggagttgaggctttggg

SEQ ID NO: 7073024 - DNA, 22 bp, Homo sapiens
ccagaggagttgaggctttggg

SEQ ID NO: 7073025 - DNA, 22 bp, Homo sapiens
ccagaggagggctctgatgagg

SEQ ID NO: 7073026 - DNA, 22 bp, Homo sapiens
ccagaggagcaggctggctcca

SEQ ID NO: 7073027 - DNA, 22 bp, Homo sapiens
ccagaggagggctctgatgagg

SEQ ID NO: 7073028 - DNA, 22 bp, Homo sapiens
ccagaggagatgcctcctctgt

SEQ ID NO: 7073029 - DNA, 22 bp, Homo sapiens
ccagaggagcaggctggctcca

SEQ ID NO: 7073030 - DNA, 22 bp, Homo sapiens
ccagaggagatgcctcctctgt

SEQ ID NO: 7073031 - DNA, 22 bp, Homo sapiens
ccagaggacttgggggctgaat

SEQ ID NO: 7073032 - DNA, 22 bp, Homo sapiens
ccagaggacttgggggctgaat

SEQ ID NO: 7073033 - DNA, 21 bp, Homo sapiens
tctctacactttcactaggct

SEQ ID NO: 7073034 - DNA, 22 bp, Homo sapiens
tctctagacatggggaatgtca

SEQ ID NO: 7073035 - DNA, 19 bp, Homo sapiens
ccagaggactgttaatgaa

SEQ ID NO: 7073036 - DNA, 22 bp, Homo sapiens
ccagaggacttgggggctgaat

SEQ ID NO: 7073037 - DNA, 22 bp, Homo sapiens
tctcccaacatgtggaggtcag

SEQ ID NO: 7073038 - DNA, 21 bp, Homo sapiens
tctcccaaggaggtcctgagg

SEQ ID NO: 7073039 - DNA, 22 bp, Homo sapiens
tctcccaaggcacagaaagagt

SEQ ID NO: 7073040 - DNA, 21 bp, Homo sapiens
tctccagttgacagtgtctcc

SEQ ID NO: 7073041 - DNA, 19 bp, Homo sapiens
tctccagttgctttcaggg

SEQ ID NO: 7073042 - DNA, 19 bp, Homo sapiens
tctccagttgctttcaggg

SEQ ID NO: 7073043 - DNA, 22 bp, Homo sapiens
tctccatctgtcattcttgtcc

SEQ ID NO: 7073044 - DNA, 22 bp, Homo sapiens
ccagaggaaaaatatctcccta

SEQ ID NO: 7073045 - DNA, 22 bp, Homo sapiens
ccagaggaattgggaaacatgt

SEQ ID NO: 7073046 - DNA, 23 bp, Homo sapiens
tctccagtgtctcttcattgagt

SEQ ID NO: 7073047 - DNA, 22 bp, Homo sapiens
tctcccaagtgaccaggaaaga

SEQ ID NO: 7073048 - DNA, 22 bp, Homo sapiens
tctcccacagccgtgcttcaag

SEQ ID NO: 7073049 - DNA, 22 bp, Homo sapiens
tctcccacagccgtgcttcaag

SEQ ID NO: 7073050 - DNA, 22 bp, Homo sapiens
tctcccacagtctcccatggct

SEQ ID NO: 7073051 - DNA, 22 bp, Homo sapiens
tctctaaatacagatgtcatgg

SEQ ID NO: 7073052 - DNA, 22 bp, Homo sapiens
tctctaaatctggttcacttgc

SEQ ID NO: 7073053 - DNA, 22 bp, Homo sapiens
tctctaaatgattgtgtactcc

SEQ ID NO: 7073054 - DNA, 22 bp, Homo sapiens
ccagacagcagttaaaggacat

SEQ ID NO: 7073055 - DNA, 20 bp, Homo sapiens
ccagagctgatggctgcccg

SEQ ID NO: 7073056 - DNA, 22 bp, Homo sapiens
ccagagctgatgggcccagggt

SEQ ID NO: 7073057 - DNA, 22 bp, Homo sapiens
ccagagctgattcctgggactt

SEQ ID NO: 7073058 - DNA, 22 bp, Homo sapiens
ccagagctgcatccagcaggtt

SEQ ID NO: 7073059 - DNA, 22 bp, Homo sapiens
ccagagctgcatccagcaggtt

SEQ ID NO: 7073060 - DNA, 18 bp, Homo sapiens
ccagagctggctcctcgc

SEQ ID NO: 7073061 - DNA, 18 bp, Homo sapiens
ccagagctggctcctcgc

SEQ ID NO: 7073062 - DNA, 22 bp, Homo sapiens
ccagagcttcggggcggctgta

SEQ ID NO: 7073063 - DNA, 22 bp, Homo sapiens
ccagagcttgacgtgcaacgga

SEQ ID NO: 7073064 - DNA, 22 bp, Homo sapiens
ccagaagtgtctatcaagatgt

SEQ ID NO: 7073065 - DNA, 22 bp, Homo sapiens
ccagaagtcaagtaagatgaag

SEQ ID NO: 7073066 - DNA, 22 bp, Homo sapiens
ccactgccagctttgtcctccc

SEQ ID NO: 7073067 - DNA, 22 bp, Homo sapiens
ccactgcccaccccgacgtcta

SEQ ID NO: 7073068 - DNA, 22 bp, Homo sapiens
ccactgccccctgaagaccagg

SEQ ID NO: 7073069 - DNA, 22 bp, Homo sapiens
ccacagtgagttctgtactctg

SEQ ID NO: 7073070 - DNA, 22 bp, Homo sapiens
ccacagtccgggctggcaggac

SEQ ID NO: 7073071 - DNA, 23 bp, Homo sapiens
ccactgaagaatccagggagttt

SEQ ID NO: 7073072 - DNA, 22 bp, Homo sapiens
ccactctgattttggctccact

SEQ ID NO: 7073073 - DNA, 22 bp, Homo sapiens
tcctggtgaggctagaagtgtc

SEQ ID NO: 7073074 - DNA, 22 bp, Homo sapiens
tcctggtgaggctagaagtgtc

SEQ ID NO: 7073075 - DNA, 18 bp, Homo sapiens
tcctggtggagaagtggt

SEQ ID NO: 7073076 - DNA, 18 bp, Homo sapiens
tcctggtggagaagtggt

SEQ ID NO: 7073077 - DNA, 20 bp, Homo sapiens
tcctgcagttcctaggaggg

SEQ ID NO: 7073078 - DNA, 20 bp, Homo sapiens
ccacagaggacagggctgtg

SEQ ID NO: 7073079 - DNA, 22 bp, Homo sapiens
ccacagagtccgcatttgaggc

SEQ ID NO: 7073080 - DNA, 22 bp, Homo sapiens
ccacagagtccgcatttgaggc

SEQ ID NO: 7073081 - DNA, 22 bp, Homo sapiens
ccacagagttgatgcaataaga

SEQ ID NO: 7073082 - DNA, 22 bp, Homo sapiens
ccacagctgacaatggatagac

SEQ ID NO: 7073083 - DNA, 22 bp, Homo sapiens
tcctccccaaagcccagcctgg

SEQ ID NO: 7073084 - DNA, 22 bp, Homo sapiens
tcctcccaacttttccatctca

SEQ ID NO: 7073085 - DNA, 22 bp, Homo sapiens
tcctcccaacttttccatctca

SEQ ID NO: 7073086 - DNA, 22 bp, Homo sapiens
tcctcccacataggacaatggg

SEQ ID NO: 7073087 - DNA, 22 bp, Homo sapiens
tcctcccacataggacaatggg

SEQ ID NO: 7073088 - DNA, 22 bp, Homo sapiens
tcctcccacataggacaatggg

SEQ ID NO: 7073089 - DNA, 22 bp, Homo sapiens
tcctcccacataggacaatggg

SEQ ID NO: 7073090 - DNA, 22 bp, Homo sapiens
ccaaagtgctggggttacaggc

SEQ ID NO: 7073091 - DNA, 23 bp, Homo sapiens
tcctcccaaatttcagcctcatt

SEQ ID NO: 7073092 - DNA, 23 bp, Homo sapiens
tcctcccaaatttcagcctcatt

SEQ ID NO: 7073093 - DNA, 23 bp, Homo sapiens
tcctcccaaatttcagcctcatt

SEQ ID NO: 7073094 - DNA, 23 bp, Homo sapiens
tcctcccaaatttcagcctcatt

SEQ ID NO: 7073095 - DNA, 22 bp, Homo sapiens
ccacaagtgaagtacacctgcc

SEQ ID NO: 7073096 - DNA, 22 bp, Homo sapiens
tccctgcctgacagcacccacc

SEQ ID NO: 7073097 - DNA, 22 bp, Homo sapiens
catttgcaaaccaacaagatga

SEQ ID NO: 7073098 - DNA, 22 bp, Homo sapiens
catttgcatatgaagaagtaag

SEQ ID NO: 7073099 - DNA, 20 bp, Homo sapiens
tccctgccttttactgctgg

SEQ ID NO: 7073100 - DNA, 22 bp, Homo sapiens
tccctgctgcactcacacctac

SEQ ID NO: 7073101 - DNA, 22 bp, Homo sapiens
tccctgctgcactcacacctac

SEQ ID NO: 7073102 - DNA, 22 bp, Homo sapiens
tccctgcttgctctcagccctt

SEQ ID NO: 7073103 - DNA, 22 bp, Homo sapiens
ccaaagtgctaggattacaggc

SEQ ID NO: 7073104 - DNA, 22 bp, Homo sapiens
ccaaagtgctaggattacaggt

SEQ ID NO: 7073105 - DNA, 22 bp, Homo sapiens
ccaaagtgctgagattacaggt

SEQ ID NO: 7073106 - DNA, 22 bp, Homo sapiens
ccaaagtgctgggattacaggc

SEQ ID NO: 7073107 - DNA, 22 bp, Homo sapiens
ccaaagtgctgggattacaggt

SEQ ID NO: 7073108 - DNA, 21 bp, Homo sapiens
tcccagggccaggtgccatca

SEQ ID NO: 7073109 - DNA, 22 bp, Homo sapiens
tcccagggccgcaaacgagttt

SEQ ID NO: 7073110 - DNA, 22 bp, Homo sapiens
tcccagggcactcaccctccct

SEQ ID NO: 7073111 - DNA, 22 bp, Homo sapiens
tcccagggcagctgtccagaag

SEQ ID NO: 7073112 - DNA, 22 bp, Homo sapiens
catttattagttagttcgatgt

SEQ ID NO: 7073113 - DNA, 22 bp, Homo sapiens
catttattagttagttcgatgt

SEQ ID NO: 7073114 - DNA, 22 bp, Homo sapiens
tcccagggcactcaccctccct

SEQ ID NO: 7073115 - DNA, 22 bp, Homo sapiens
tcccagggccgcaaacgagttt

SEQ ID NO: 7073116 - DNA, 22 bp, Homo sapiens
tcccagggctctagagtgctgg

SEQ ID NO: 7073117 - DNA, 22 bp, Homo sapiens
tcccagggctctagagtgctgg

SEQ ID NO: 7073118 - DNA, 22 bp, Homo sapiens
tcccagggcttttctcatgctt

SEQ ID NO: 7073119 - DNA, 22 bp, Homo sapiens
tcccagggcttttctcatgctt

SEQ ID NO: 7073120 - DNA, 22 bp, Homo sapiens
tcccagggcttttctcatgctt

SEQ ID NO: 7073121 - DNA, 22 bp, Homo sapiens
tcccagggggatgaacactgcc

SEQ ID NO: 7073122 - DNA, 22 bp, Homo sapiens
tcccagggggatgaacactgcc

SEQ ID NO: 7073123 - DNA, 22 bp, Homo sapiens
tcccagggtatcctgtagtaaa

SEQ ID NO: 7073124 - DNA, 22 bp, Homo sapiens
tcccagggtcagtggtgaggcc

SEQ ID NO: 7073125 - DNA, 22 bp, Homo sapiens
catttacacttctaaccacaag

SEQ ID NO: 7073126 - DNA, 22 bp, Homo sapiens
catttacttaaatctttacaag

SEQ ID NO: 7073127 - DNA, 19 bp, Homo sapiens
catttagaagtacatatta

SEQ ID NO: 7073128 - DNA, 22 bp, Homo sapiens
catttagagaagattacaagga

SEQ ID NO: 7073129 - DNA, 22 bp, Homo sapiens
catttagttatactaaaacatt

SEQ ID NO: 7073130 - DNA, 18 bp, Homo sapiens
tctgtctgtgttgtcttt

SEQ ID NO: 7073131 - DNA, 22 bp, Homo sapiens
ccaggaggcagaagttgcagtg

SEQ ID NO: 7073132 - DNA, 22 bp, Homo sapiens
ccaggaggcagaggttgtagtg

SEQ ID NO: 7073133 - DNA, 22 bp, Homo sapiens
ccaggaggcagaggttgtagtg

SEQ ID NO: 7073134 - DNA, 22 bp, Homo sapiens
ccaggaggcggaaggtacagtg

SEQ ID NO: 7073135 - DNA, 22 bp, Homo sapiens
ccaggaggcggaaggtacagtg

SEQ ID NO: 7073136 - DNA, 22 bp, Homo sapiens
ccaggaggcggaaggtacagtg

SEQ ID NO: 7073137 - DNA, 22 bp, Homo sapiens
ccaggaggcggaggttgcagcg

SEQ ID NO: 7073138 - DNA, 22 bp, Homo sapiens
tctgtcacccctgtttctggct

SEQ ID NO: 7073139 - DNA, 22 bp, Homo sapiens
tctgtcactattggccagaaca

SEQ ID NO: 7073140 - DNA, 23 bp, Homo sapiens
ccaggaagaggccatccacagtc

SEQ ID NO: 7073141 - DNA, 22 bp, Homo sapiens
ccaggagcgcgtgaacaggctg

SEQ ID NO: 7073142 - DNA, 22 bp, Homo sapiens
ccaggaggatggttgttaggtg

SEQ ID NO: 7073143 - DNA, 22 bp, Homo sapiens
ccaggaggcaatatcaagtcca

SEQ ID NO: 7073144 - DNA, 22 bp, Homo sapiens
ccaggaggcaatatcaagtcca

SEQ ID NO: 7073145 - DNA, 22 bp, Homo sapiens
ccaggaggcagaagttgcagtg

SEQ ID NO: 7073146 - DNA, 22 bp, Homo sapiens
ccaggaggcagaagttgcagtg

SEQ ID NO: 7073147 - DNA, 22 bp, Homo sapiens
ccagctggtaagtgatggagcc

SEQ ID NO: 7073148 - DNA, 22 bp, Homo sapiens
ccagctggtgacatccccaacc

SEQ ID NO: 7073149 - DNA, 22 bp, Homo sapiens
ccagctggtgggtctttctctg

SEQ ID NO: 7073150 - DNA, 22 bp, Homo sapiens
ccagctggtgttccttaggacc

SEQ ID NO: 7073151 - DNA, 22 bp, Homo sapiens
ccagctggttaaaatagagaaa

SEQ ID NO: 7073152 - DNA, 22 bp, Homo sapiens
tctgcctctttcaggcctggca

SEQ ID NO: 7073153 - DNA, 19 bp, Homo sapiens
tctgcctctggtcaggctc

SEQ ID NO: 7073154 - DNA, 19 bp, Homo sapiens
tctgcctctggtcaggctc

SEQ ID NO: 7073155 - DNA, 22 bp, Homo sapiens
tctgcctctttcaggcctggca

SEQ ID NO: 7073156 - DNA, 22 bp, Homo sapiens
tctgcctgagaagtggggtgcc

SEQ ID NO: 7073157 - DNA, 22 bp, Homo sapiens
tctgccttggcaaccacagctt

SEQ ID NO: 7073158 - DNA, 22 bp, Homo sapiens
tctggcttcaagtcccagctct

SEQ ID NO: 7073159 - DNA, 22 bp, Homo sapiens
tctggcttcagtagggttcact

SEQ ID NO: 7073160 - DNA, 23 bp, Homo sapiens
tctggcttccagtgggttcaacc

SEQ ID NO: 7073161 - DNA, 22 bp, Homo sapiens
tctggcttccctctgttctggg

SEQ ID NO: 7073162 - DNA, 22 bp, Homo sapiens
tctggcttgagcttcgaccagt

SEQ ID NO: 7073163 - DNA, 22 bp, Homo sapiens
tctggcttgctggcttggtccc

SEQ ID NO: 7073164 - DNA, 22 bp, Homo sapiens
tctggcttggcgctgccctctg

SEQ ID NO: 7073165 - DNA, 22 bp, Homo sapiens
tctggcttggctggcatctctg

SEQ ID NO: 7073166 - DNA, 22 bp, Homo sapiens
tctggctttattccttcactga

SEQ ID NO: 7073167 - DNA, 22 bp, Homo sapiens
ccagctgtgccgtgtggatagc

SEQ ID NO: 7073168 - DNA, 22 bp, Homo sapiens
ccagctctaaacggctctgtgg

SEQ ID NO: 7073169 - DNA, 22 bp, Homo sapiens
ccagctctcaaggctccctggg

SEQ ID NO: 7073170 - DNA, 22 bp, Homo sapiens
ccagctcctcttgtctctagca

SEQ ID NO: 7073171 - DNA, 22 bp, Homo sapiens
ccagctcctcttgtctctagca

SEQ ID NO: 7073172 - DNA, 22 bp, Homo sapiens
ccagctcctgggtcttagtcag

SEQ ID NO: 7073173 - DNA, 20 bp, Homo sapiens
tctgccactgcactctgccc

SEQ ID NO: 7073174 - DNA, 22 bp, Homo sapiens
tctgccactgtgatgcatgata

SEQ ID NO: 7073175 - DNA, 22 bp, Homo sapiens
tctgccagaagttctgagagta

SEQ ID NO: 7073176 - DNA, 22 bp, Homo sapiens
tctgcctatgctgtacctttgt

SEQ ID NO: 7073177 - DNA, 22 bp, Homo sapiens
tctgcctcctgcttgtcccgac

SEQ ID NO: 7073178 - DNA, 22 bp, Homo sapiens
tctgcctcctgcttgtcccgac

SEQ ID NO: 7073179 - DNA, 22 bp, Homo sapiens
tctgcctcgctaacagcagcca

SEQ ID NO: 7073180 - DNA, 22 bp, Homo sapiens
tctgcctcgctaacagcagcca

SEQ ID NO: 7073181 - DNA, 22 bp, Homo sapiens
tctgcctcgctaacagcagcca

SEQ ID NO: 7073182 - DNA, 22 bp, Homo sapiens
tctgcctcgctaacagcagcca

SEQ ID NO: 7073183 - DNA, 19 bp, Homo sapiens
tctgcctctggtcaggctc

SEQ ID NO: 7073184 - DNA, 21 bp, Homo sapiens
ccagctccaggaccttggatc

SEQ ID NO: 7073185 - DNA, 22 bp, Homo sapiens
ccagccttctgagctgcctgga

SEQ ID NO: 7073186 - DNA, 22 bp, Homo sapiens
ccagcctggagggcagtggtgg

SEQ ID NO: 7073187 - DNA, 22 bp, Homo sapiens
tctgaaataggagccatgtaga

SEQ ID NO: 7073188 - DNA, 22 bp, Homo sapiens
tctgaaataggcttcttttggt

SEQ ID NO: 7073189 - DNA, 22 bp, Homo sapiens
tctgaaatatattttgagtgtt

SEQ ID NO: 7073190 - DNA, 22 bp, Homo sapiens
tctgaaatattggtaatacttt

SEQ ID NO: 7073191 - DNA, 22 bp, Homo sapiens
tctgaaatcctttatcttggct

SEQ ID NO: 7073192 - DNA, 22 bp, Homo sapiens
tctgaaatctaatgctctgtgg

SEQ ID NO: 7073193 - DNA, 22 bp, Homo sapiens
tctgaaatctgtaagcactagc

SEQ ID NO: 7073194 - DNA, 22 bp, Homo sapiens
tctgaaatgaactcttgaactt

SEQ ID NO: 7073195 - DNA, 22 bp, Homo sapiens
tctcttggaggttcttcctgtt

SEQ ID NO: 7073196 - DNA, 18 bp, Homo sapiens
tctcttgcatcttctgta

SEQ ID NO: 7073197 - DNA, 22 bp, Homo sapiens
tctcttaatccggtgctttctg

SEQ ID NO: 7073198 - DNA, 22 bp, Homo sapiens
tctctcttgtcaccccatctgc

SEQ ID NO: 7073199 - DNA, 22 bp, Homo sapiens
tctctcttgaagtattagctag

SEQ ID NO: 7073200 - DNA, 22 bp, Homo sapiens
tctctcttgaagtattagctag

SEQ ID NO: 7073201 - DNA, 22 bp, Homo sapiens
tctctcttcaacccttaactag

SEQ ID NO: 7073202 - DNA, 22 bp, Homo sapiens
tctctcttcaacccttaactag

SEQ ID NO: 7073203 - DNA, 23 bp, Homo sapiens
tctctcttagctatgcttatggc

SEQ ID NO: 7073204 - DNA, 23 bp, Homo sapiens
tctctcttagctatgcttatggc

SEQ ID NO: 7073205 - DNA, 22 bp, Homo sapiens
ccagccccgggccttaccgtgc

SEQ ID NO: 7073206 - DNA, 22 bp, Homo sapiens
ccagcccctatcctcgctccac

SEQ ID NO: 7073207 - DNA, 22 bp, Homo sapiens
ccagccccgggaacctggccgt

SEQ ID NO: 7073208 - DNA, 21 bp, Homo sapiens
ccagcccagctgtgtcccagc

SEQ ID NO: 7073209 - DNA, 22 bp, Homo sapiens
tctgaggagttgggccagtgct

SEQ ID NO: 7073210 - DNA, 22 bp, Homo sapiens
tctgaggcataacctgttctgc

SEQ ID NO: 7073211 - DNA, 22 bp, Homo sapiens
tctgaggcatacccaggccccc

SEQ ID NO: 7073212 - DNA, 22 bp, Homo sapiens
tctgaggttctgttttcaactg

SEQ ID NO: 7073213 - DNA, 22 bp, Homo sapiens
tctgaggttgaactttgcaaag

SEQ ID NO: 7073214 - DNA, 22 bp, Homo sapiens
tctgaggttttcatgttttctg

SEQ ID NO: 7073215 - DNA, 22 bp, Homo sapiens
tgtcttttggagcatctttctt

SEQ ID NO: 7073216 - DNA, 22 bp, Homo sapiens
tgtgaaaagcgtgtgttctagg

SEQ ID NO: 7073217 - DNA, 22 bp, Homo sapiens
tgtgaaaagggctttgtacaaa

SEQ ID NO: 7073218 - DNA, 22 bp, Homo sapiens
tgtcttttgccaaagatcagtt

SEQ ID NO: 7073219 - DNA, 22 bp, Homo sapiens
tgtcttttataactgacatata

SEQ ID NO: 7073220 - DNA, 22 bp, Homo sapiens
tgtcttgtctgtgagggcattg

SEQ ID NO: 7073221 - DNA, 22 bp, Homo sapiens
tgtcttctgtattcaagtctat

SEQ ID NO: 7073222 - DNA, 22 bp, Homo sapiens
tgtcttcagtaaaatacactat

SEQ ID NO: 7073223 - DNA, 22 bp, Homo sapiens
tgtcttcagtaaaatacactat

SEQ ID NO: 7073224 - DNA, 22 bp, Homo sapiens
tgtcttcatctccatgcacaga

SEQ ID NO: 7073225 - DNA, 22 bp, Homo sapiens
tgtcttcatctccatgcacaga

SEQ ID NO: 7073226 - DNA, 22 bp, Homo sapiens
tgtcttaaacttgtgggacttc

SEQ ID NO: 7073227 - DNA, 22 bp, Homo sapiens
tgtctgttattggtgtataaga

SEQ ID NO: 7073228 - DNA, 19 bp, Homo sapiens
tgtcttaattaactcagag

SEQ ID NO: 7073229 - DNA, 22 bp, Homo sapiens
tgtcttaatttggatgatgttt

SEQ ID NO: 7073230 - DNA, 22 bp, Homo sapiens
tgtctgggatgtaattcctgcc

SEQ ID NO: 7073231 - DNA, 22 bp, Homo sapiens
tgtctgtgacctcttaggcaag

SEQ ID NO: 7073232 - DNA, 22 bp, Homo sapiens
tgtctgtgacctctttggagcc

SEQ ID NO: 7073233 - DNA, 21 bp, Homo sapiens
tgtctgcctgcttcttcactc

SEQ ID NO: 7073234 - DNA, 21 bp, Homo sapiens
tgtctgcctgcttcttcactc

SEQ ID NO: 7073235 - DNA, 22 bp, Homo sapiens
tgtctgcctgtctctgtgcaaa

SEQ ID NO: 7073236 - DNA, 22 bp, Homo sapiens
tgtctgccattagcccagtcca

SEQ ID NO: 7073237 - DNA, 22 bp, Homo sapiens
tgtctgcccattcatgggcaca

SEQ ID NO: 7073238 - DNA, 21 bp, Homo sapiens
tgtctgcccctgtttaccaga

SEQ ID NO: 7073239 - DNA, 22 bp, Homo sapiens
tgtctgccctcaacccagaggc

SEQ ID NO: 7073240 - DNA, 22 bp, Homo sapiens
tgtctgcctgcgggccggcaca

SEQ ID NO: 7073241 - DNA, 22 bp, Homo sapiens
tgtctgcctgcgggccggcaca

SEQ ID NO: 7073242 - DNA, 22 bp, Homo sapiens
tgtctgatgatagtgtctctcc

SEQ ID NO: 7073243 - DNA, 22 bp, Homo sapiens
tgtctgccaaagcttcctcctg

SEQ ID NO: 7073244 - DNA, 22 bp, Homo sapiens
tgtctgccaccccatcaagctc

SEQ ID NO: 7073245 - DNA, 22 bp, Homo sapiens
tgtctgaatcgcttcctagagg

SEQ ID NO: 7073246 - DNA, 22 bp, Homo sapiens
tgtctctgaaatatgtggctcc

SEQ ID NO: 7073247 - DNA, 22 bp, Homo sapiens
tgtctctgaacagcttactaaa

SEQ ID NO: 7073248 - DNA, 22 bp, Homo sapiens
tgtctctgaagccccctccttt

SEQ ID NO: 7073249 - DNA, 18 bp, Homo sapiens
tgtctctgaattccagtg

SEQ ID NO: 7073250 - DNA, 22 bp, Homo sapiens
tgtctctgagatgactcccacc

SEQ ID NO: 7073251 - DNA, 22 bp, Homo sapiens
tgtctctgaggtgagggtcagc

SEQ ID NO: 7073252 - DNA, 22 bp, Homo sapiens
tgtctctgataagtagttcagt

SEQ ID NO: 7073253 - DNA, 22 bp, Homo sapiens
tgtctctgataagtagttcagt

SEQ ID NO: 7073254 - DNA, 22 bp, Homo sapiens
tgtctctgctgcaccttctggg

SEQ ID NO: 7073255 - DNA, 22 bp, Homo sapiens
tgtctctgctttccttgcaggg

SEQ ID NO: 7073256 - DNA, 22 bp, Homo sapiens
tgtctctgctttccttgcaggg

SEQ ID NO: 7073257 - DNA, 22 bp, Homo sapiens
tgtctaaacttgttttatctca

SEQ ID NO: 7073258 - DNA, 22 bp, Homo sapiens
tgtctaaatgcaatggatttcc

SEQ ID NO: 7073259 - DNA, 22 bp, Homo sapiens
tgtctaatggcaatttcatgtg

SEQ ID NO: 7073260 - DNA, 22 bp, Homo sapiens
tgtctccaactcactgtatact

SEQ ID NO: 7073261 - DNA, 22 bp, Homo sapiens
tgtctcctactgcctgtggatc

SEQ ID NO: 7073262 - DNA, 22 bp, Homo sapiens
tgtctcctcaactcatgctcga

SEQ ID NO: 7073263 - DNA, 22 bp, Homo sapiens
tgtctcctcatactgtcatatt

SEQ ID NO: 7073264 - DNA, 22 bp, Homo sapiens
tgtctctccacacagccagtgc

SEQ ID NO: 7073265 - DNA, 18 bp, Homo sapiens
tgtctctcctttctgtgt

SEQ ID NO: 7073266 - DNA, 22 bp, Homo sapiens
tgtgaaatgtgtgtataattaa

SEQ ID NO: 7073267 - DNA, 22 bp, Homo sapiens
tgtgaaatgtggatgttaatag

SEQ ID NO: 7073268 - DNA, 22 bp, Homo sapiens
tgtgaaatgctatttccatgag

SEQ ID NO: 7073269 - DNA, 22 bp, Homo sapiens
tgtgaaatgagtatatttgaat

SEQ ID NO: 7073270 - DNA, 22 bp, Homo sapiens
tgtgaaatgaagataattcttg

SEQ ID NO: 7073271 - DNA, 22 bp, Homo sapiens
tgtgaaatgagtatatttgaat

SEQ ID NO: 7073272 - DNA, 22 bp, Homo sapiens
tgtgaaatgctattgtgacaaa

SEQ ID NO: 7073273 - DNA, 22 bp, Homo sapiens
tgtgaaatgtgtgtataattaa

SEQ ID NO: 7073274 - DNA, 22 bp, Homo sapiens
tgtgaaattacttaaaggaaat

SEQ ID NO: 7073275 - DNA, 22 bp, Homo sapiens
tgtgaaattcttgaaatgcaca

SEQ ID NO: 7073276 - DNA, 22 bp, Homo sapiens
tgtgaaattgaatgcccattgc

SEQ ID NO: 7073277 - DNA, 22 bp, Homo sapiens
tgtgaaattgagaaactttcac

SEQ ID NO: 7073278 - DNA, 23 bp, Homo sapiens
tgtgaaatttgaggtcagtgctt

SEQ ID NO: 7073279 - DNA, 18 bp, Homo sapiens
tgtgaacacatttttctg

SEQ ID NO: 7073280 - DNA, 22 bp, Homo sapiens
tgtgaaacggagtcagggaagg

SEQ ID NO: 7073281 - DNA, 21 bp, Homo sapiens
tgtgaaatagctatgctacat

SEQ ID NO: 7073282 - DNA, 22 bp, Homo sapiens
tgtgaaatattggcaatttcat

SEQ ID NO: 7073283 - DNA, 22 bp, Homo sapiens
tgtgaaatatttatatactcaa

SEQ ID NO: 7073284 - DNA, 22 bp, Homo sapiens
tgtgaaatcaattagctgcaga

SEQ ID NO: 7073285 - DNA, 22 bp, Homo sapiens
tgtgaaatcacaggctatttag

SEQ ID NO: 7073286 - DNA, 22 bp, Homo sapiens
tgtgaaatctgaactcaaagat

SEQ ID NO: 7073287 - DNA, 22 bp, Homo sapiens
tgtgaaatctgatgaattgacc

SEQ ID NO: 7073288 - DNA, 22 bp, Homo sapiens
tgtgaaatctgatgaattgacc

SEQ ID NO: 7073289 - DNA, 22 bp, Homo sapiens
tgtgaacatttctggttatttg

SEQ ID NO: 7073290 - DNA, 22 bp, Homo sapiens
tgtgaaggtttttatgggatat

SEQ ID NO: 7073291 - DNA, 22 bp, Homo sapiens
tgtgaataccttgaattcatca

SEQ ID NO: 7073292 - DNA, 22 bp, Homo sapiens
tgtgaataccttgaattcatca

SEQ ID NO: 7073293 - DNA, 22 bp, Homo sapiens
tgtgaatagattgaagctttgg

SEQ ID NO: 7073294 - DNA, 22 bp, Homo sapiens
tgtgacagtcgttaggagctca

SEQ ID NO: 7073295 - DNA, 19 bp, Homo sapiens
tgtgacatcactgggcagc

SEQ ID NO: 7073296 - DNA, 22 bp, Homo sapiens
tgtgagagtataatctctctgt

SEQ ID NO: 7073297 - DNA, 22 bp, Homo sapiens
tgtgagcactggctgggaaagt

SEQ ID NO: 7073298 - DNA, 22 bp, Homo sapiens
tgtgactggttgtcccgctttc

SEQ ID NO: 7073299 - DNA, 22 bp, Homo sapiens
tgtgacgttcctgctggcgacc

SEQ ID NO: 7073300 - DNA, 22 bp, Homo sapiens
tgtgacttaatccttgggtggg

SEQ ID NO: 7073301 - DNA, 22 bp, Homo sapiens
tgtgacttagggcaggtgagat

SEQ ID NO: 7073302 - DNA, 22 bp, Homo sapiens
tgtgacttctttttgagttcaa

SEQ ID NO: 7073303 - DNA, 22 bp, Homo sapiens
tgtgagaagggtgaggctttta

SEQ ID NO: 7073304 - DNA, 22 bp, Homo sapiens
tgtgagaattcctgatcacagg

SEQ ID NO: 7073305 - DNA, 22 bp, Homo sapiens
tgtgctctggagttgccttcac

SEQ ID NO: 7073306 - DNA, 22 bp, Homo sapiens
tgtgctcttgtctgtgactaac

SEQ ID NO: 7073307 - DNA, 22 bp, Homo sapiens
tgtgctctacctcagtgtcatt

SEQ ID NO: 7073308 - DNA, 22 bp, Homo sapiens
tgtgctctgactttctcctggt

SEQ ID NO: 7073309 - DNA, 22 bp, Homo sapiens
tgtgcctttcatcatgcttttg

SEQ ID NO: 7073310 - DNA, 22 bp, Homo sapiens
tgtgcctttaaggggagctgag

SEQ ID NO: 7073311 - DNA, 22 bp, Homo sapiens
tgtgccttatgaattctttctg

SEQ ID NO: 7073312 - DNA, 22 bp, Homo sapiens
tgtgcctgttggtgtagacata

SEQ ID NO: 7073313 - DNA, 22 bp, Homo sapiens
tgtgcctggatctctgtgacaa

SEQ ID NO: 7073314 - DNA, 22 bp, Homo sapiens
tgtgcctgatggtcacgtggcc

SEQ ID NO: 7073315 - DNA, 22 bp, Homo sapiens
tgtgcaatcatattttaaaatg

SEQ ID NO: 7073316 - DNA, 23 bp, Homo sapiens
tgtgcacatctgacgggtgaagg

SEQ ID NO: 7073317 - DNA, 22 bp, Homo sapiens
tgtgcacaatgtgcaggtttgt

SEQ ID NO: 7073318 - DNA, 22 bp, Homo sapiens
tgtgcacattctaggactagta

SEQ ID NO: 7073319 - DNA, 22 bp, Homo sapiens
tgtgcagctctagagccaagcc

SEQ ID NO: 7073320 - DNA, 19 bp, Homo sapiens
tgtgcctctatagcatgtg

SEQ ID NO: 7073321 - DNA, 18 bp, Homo sapiens
tgtgcctctgcaggacgt

SEQ ID NO: 7073322 - DNA, 22 bp, Homo sapiens
tgtgcctgactaggtgaatcaa

SEQ ID NO: 7073323 - DNA, 22 bp, Homo sapiens
tgtgggaggtctggaaggctcc

SEQ ID NO: 7073324 - DNA, 22 bp, Homo sapiens
tgtgggaggaattagaatggga

SEQ ID NO: 7073325 - DNA, 22 bp, Homo sapiens
tgtgggcactaatgacatgcag

SEQ ID NO: 7073326 - DNA, 22 bp, Homo sapiens
tgtggggaagagtatgacttgg

SEQ ID NO: 7073327 - DNA, 22 bp, Homo sapiens
tgtggggactgagtggaggctt

SEQ ID NO: 7073328 - DNA, 22 bp, Homo sapiens
tgtgggacagggacagcaagag

SEQ ID NO: 7073329 - DNA, 22 bp, Homo sapiens
tgtgggaagatgttgcaggaga

SEQ ID NO: 7073330 - DNA, 22 bp, Homo sapiens
tgtggaatgggagtgagaagac

SEQ ID NO: 7073331 - DNA, 22 bp, Homo sapiens
tgtggaatgtcctcagcatcct

SEQ ID NO: 7073332 - DNA, 22 bp, Homo sapiens
tgtgtgccagcctacgaggagc

SEQ ID NO: 7073333 - DNA, 22 bp, Homo sapiens
tgtgtgtgaaccattgagggct

SEQ ID NO: 7073334 - DNA, 22 bp, Homo sapiens
tgtgtgtgactcatactagaac

SEQ ID NO: 7073335 - DNA, 22 bp, Homo sapiens
tgtgtgtgcacatgcatataca

SEQ ID NO: 7073336 - DNA, 22 bp, Homo sapiens
tgtgtgtgcacgtgcgcgcgag

SEQ ID NO: 7073337 - DNA, 22 bp, Homo sapiens
tgtgtgtgcaggagagcaggtg

SEQ ID NO: 7073338 - DNA, 22 bp, Homo sapiens
tgtgtgtggggaggcagcagat

SEQ ID NO: 7073339 - DNA, 22 bp, Homo sapiens
tgtgtgtgtaaaagcatttata

SEQ ID NO: 7073340 - DNA, 20 bp, Homo sapiens
tgtgtgtgtacttctaaata

SEQ ID NO: 7073341 - DNA, 23 bp, Homo sapiens
tgtgtgtgtattctacgcaaggt

SEQ ID NO: 7073342 - DNA, 22 bp, Homo sapiens
tgtgtgtgtcctcatttgcaga

SEQ ID NO: 7073343 - DNA, 22 bp, Homo sapiens
tgtgtgtgtgcgcgcacgcata

SEQ ID NO: 7073344 - DNA, 22 bp, Homo sapiens
tgtgtgtgtttacagtttctca

SEQ ID NO: 7073345 - DNA, 22 bp, Homo sapiens
tgtgtgtgtttataaatctaaa

SEQ ID NO: 7073346 - DNA, 22 bp, Homo sapiens
tgtgtgtgtttctgctcataca

SEQ ID NO: 7073347 - DNA, 19 bp, Homo sapiens
tgtgtgtttatatatgtat

SEQ ID NO: 7073348 - DNA, 22 bp, Homo sapiens
tgtgttaagtatttgatacact

SEQ ID NO: 7073349 - DNA, 22 bp, Homo sapiens
tgtgttaattccacaaacattc

SEQ ID NO: 7073350 - DNA, 22 bp, Homo sapiens
tgttaaacctagtacaggtcct

SEQ ID NO: 7073351 - DNA, 18 bp, Homo sapiens
tgttaaatgaagatttgc

SEQ ID NO: 7073352 - DNA, 22 bp, Homo sapiens
tgtttattgagtgcctactata

SEQ ID NO: 7073353 - DNA, 18 bp, Homo sapiens
tgtttattctcctgacag

SEQ ID NO: 7073354 - DNA, 22 bp, Homo sapiens
tgtttatgtgtgtgcatatata

SEQ ID NO: 7073355 - DNA, 22 bp, Homo sapiens
tgtttattacagttcttggaat

SEQ ID NO: 7073356 - DNA, 22 bp, Homo sapiens
tgtttatgcatcgttaatacca

SEQ ID NO: 7073357 - DNA, 22 bp, Homo sapiens
tgttcttttctctaaactgata

SEQ ID NO: 7073358 - DNA, 22 bp, Homo sapiens
tgttgagtatatacctacaagt

SEQ ID NO: 7073359 - DNA, 22 bp, Homo sapiens
tgttgggatcgaatggtggaac

SEQ ID NO: 7073360 - DNA, 22 bp, Homo sapiens
tgttgtaaaatttgagatgtca

SEQ ID NO: 7073361 - DNA, 22 bp, Homo sapiens
tgttgttttctcatggagaata

SEQ ID NO: 7073362 - DNA, 22 bp, Homo sapiens
tgtttaaatagaacatactgca

SEQ ID NO: 7073363 - DNA, 22 bp, Homo sapiens
tgtttaagctgatgaggtatcg

SEQ ID NO: 7073364 - DNA, 22 bp, Homo sapiens
tgtttactcctgatatattttt

SEQ ID NO: 7073365 - DNA, 22 bp, Homo sapiens
tgttctttggcttcacagctct

SEQ ID NO: 7073366 - DNA, 22 bp, Homo sapiens
tgttctttggcttcacagctct

SEQ ID NO: 7073367 - DNA, 22 bp, Homo sapiens
tgttcttaacttttgtgtatat

SEQ ID NO: 7073368 - DNA, 22 bp, Homo sapiens
tgttcttaggtatttgacagtc

SEQ ID NO: 7073369 - DNA, 22 bp, Homo sapiens
tgttagaagttaatcactaatt

SEQ ID NO: 7073370 - DNA, 22 bp, Homo sapiens
tgttagaatattgtaatattcg

SEQ ID NO: 7073371 - DNA, 22 bp, Homo sapiens
tgttaggactccccagaagctg

SEQ ID NO: 7073372 - DNA, 22 bp, Homo sapiens
tgttaaatgagattggaatttg

SEQ ID NO: 7073373 - DNA, 22 bp, Homo sapiens
tgttaaatgttcctttactgga

SEQ ID NO: 7073374 - DNA, 22 bp, Homo sapiens
tgttaaatgttttgctagtgtc

SEQ ID NO: 7073375 - DNA, 22 bp, Homo sapiens
tgttaaattgattcacctttct

SEQ ID NO: 7073376 - DNA, 22 bp, Homo sapiens
tgttaaggagacacatgaaaaa

SEQ ID NO: 7073377 - DNA, 22 bp, Homo sapiens
tgttacagtggctttttaaaca

SEQ ID NO: 7073378 - DNA, 22 bp, Homo sapiens
tgttactgatttgatatacagt

SEQ ID NO: 7073379 - DNA, 22 bp, Homo sapiens
tgttagaaattattagtaatat

SEQ ID NO: 7073380 - DNA, 22 bp, Homo sapiens
tgttttatgagccatataacct

SEQ ID NO: 7073381 - DNA, 22 bp, Homo sapiens
tgttttatttctccaagaggga

SEQ ID NO: 7073382 - DNA, 22 bp, Homo sapiens
tgttttatttctccaagaggga

SEQ ID NO: 7073383 - DNA, 22 bp, Homo sapiens
tgttttatttctccaagaggga

SEQ ID NO: 7073384 - DNA, 22 bp, Homo sapiens
tgttttatcaagatggcatgtc

SEQ ID NO: 7073385 - DNA, 22 bp, Homo sapiens
tgttttatgagccatataacct

SEQ ID NO: 7073386 - DNA, 22 bp, Homo sapiens
tgttttatgagccatataacct

SEQ ID NO: 7073387 - DNA, 22 bp, Homo sapiens
tgttttatataagcagagcggt

SEQ ID NO: 7073388 - DNA, 22 bp, Homo sapiens
tgttttatataagcagagcggt

SEQ ID NO: 7073389 - DNA, 22 bp, Homo sapiens
tgttttatcaagatggcatgtc

SEQ ID NO: 7073390 - DNA, 22 bp, Homo sapiens
tgttttaatctcccattgctct

SEQ ID NO: 7073391 - DNA, 22 bp, Homo sapiens
tgttttaatctcccattgctct

SEQ ID NO: 7073392 - DNA, 23 bp, Homo sapiens
tgtttgtttctatgagagatagc

SEQ ID NO: 7073393 - DNA, 22 bp, Homo sapiens
tgttttaagagcgcactttata

SEQ ID NO: 7073394 - DNA, 18 bp, Homo sapiens
tgtttatttttctcttac

SEQ ID NO: 7073395 - DNA, 22 bp, Homo sapiens
tgtttgcattaattagaaggta

SEQ ID NO: 7073396 - DNA, 22 bp, Homo sapiens
tgtttgcattgttaattcagtc

SEQ ID NO: 7073397 - DNA, 22 bp, Homo sapiens
tgtttgctctgactatcttgcg

SEQ ID NO: 7073398 - DNA, 22 bp, Homo sapiens
ttaaacagagtctgaaatgtaa

SEQ ID NO: 7073399 - DNA, 22 bp, Homo sapiens
ttaaacagacagtaaatgaaac

SEQ ID NO: 7073400 - DNA, 22 bp, Homo sapiens
ttaaacatttatggaggcagca

SEQ ID NO: 7073401 - DNA, 22 bp, Homo sapiens
ttaaacatttttgatgatcgat

SEQ ID NO: 7073402 - DNA, 17 bp, Homo sapiens
ttaaaccataaagaagg

SEQ ID NO: 7073403 - DNA, 22 bp, Homo sapiens
ttaaaccatagtttaacataag

SEQ ID NO: 7073404 - DNA, 22 bp, Homo sapiens
ttaaaccatagtttaacataag

SEQ ID NO: 7073405 - DNA, 22 bp, Homo sapiens
ttaaaaccatcagctgtaagat

SEQ ID NO: 7073406 - DNA, 22 bp, Homo sapiens
ttattcttggatctgagtctct

SEQ ID NO: 7073407 - DNA, 22 bp, Homo sapiens
ttatttatggccctcacctgat

SEQ ID NO: 7073408 - DNA, 22 bp, Homo sapiens
ttatttatgttaacagtcgaga

SEQ ID NO: 7073409 - DNA, 22 bp, Homo sapiens
ttatttcattgatttctaagac

SEQ ID NO: 7073410 - DNA, 22 bp, Homo sapiens
ttatttccaaactggatatacc

SEQ ID NO: 7073411 - DNA, 22 bp, Homo sapiens
ttatttccacaatgtggtaggg

SEQ ID NO: 7073412 - DNA, 22 bp, Homo sapiens
ttatttccagtccagaaattta

SEQ ID NO: 7073413 - DNA, 20 bp, Homo sapiens
ttatttccagtccaggtcct

SEQ ID NO: 7073414 - DNA, 22 bp, Homo sapiens
ttatttccctgagggttgcagg

SEQ ID NO: 7073415 - DNA, 22 bp, Homo sapiens
ttatttcctaaatctctttgtt

SEQ ID NO: 7073416 - DNA, 22 bp, Homo sapiens
ttattcatcagtgcattaattt

SEQ ID NO: 7073417 - DNA, 22 bp, Homo sapiens
ttattattccccaagtcattat

SEQ ID NO: 7073418 - DNA, 22 bp, Homo sapiens
ttatgatttgccacagattggt

SEQ ID NO: 7073419 - DNA, 22 bp, Homo sapiens
ttatgagactgttttacacact

SEQ ID NO: 7073420 - DNA, 22 bp, Homo sapiens
ttatgaaaacaatcagtaggca

SEQ ID NO: 7073421 - DNA, 22 bp, Homo sapiens
ttatcttggtgttttagtaatt

SEQ ID NO: 7073422 - DNA, 22 bp, Homo sapiens
ttatgaaagacatttctgttgg

SEQ ID NO: 7073423 - DNA, 19 bp, Homo sapiens
ttatgaatagcttcatcca

SEQ ID NO: 7073424 - DNA, 22 bp, Homo sapiens
ttatattagttagacttgctgt

SEQ ID NO: 7073425 - DNA, 22 bp, Homo sapiens
ttagtgctcacgtgttagaaag

SEQ ID NO: 7073426 - DNA, 22 bp, Homo sapiens
ttatatgtatgcttataaacca

SEQ ID NO: 7073427 - DNA, 22 bp, Homo sapiens
ttatatgtatgcttataaacca

SEQ ID NO: 7073428 - DNA, 20 bp, Homo sapiens
ttatctgtcaatctgtctca

SEQ ID NO: 7073429 - DNA, 22 bp, Homo sapiens
ttatctgtctatcaagactagc

SEQ ID NO: 7073430 - DNA, 22 bp, Homo sapiens
ttatctgtgatcctaaatgtct

SEQ ID NO: 7073431 - DNA, 19 bp, Homo sapiens
ttatctgtgttgcagtggt

SEQ ID NO: 7073432 - DNA, 22 bp, Homo sapiens
ttatctgttgttttagtacaat

SEQ ID NO: 7073433 - DNA, 22 bp, Homo sapiens
ttatctgtttaacaaagtatct

SEQ ID NO: 7073434 - DNA, 22 bp, Homo sapiens
ttatcttagaggtgattgtatt

SEQ ID NO: 7073435 - DNA, 22 bp, Homo sapiens
ttagtcacttcttccttcatca

SEQ ID NO: 7073436 - DNA, 22 bp, Homo sapiens
ttagcattctctgtgtgcataa

SEQ ID NO: 7073437 - DNA, 22 bp, Homo sapiens
ttagatgtggacttatgttatt

SEQ ID NO: 7073438 - DNA, 22 bp, Homo sapiens
ttagcatttcagtacacatgtt

SEQ ID NO: 7073439 - DNA, 22 bp, Homo sapiens
ttagcatttcagtacacatgtt

SEQ ID NO: 7073440 - DNA, 22 bp, Homo sapiens
ttagggaaggacagtgaagaaa

SEQ ID NO: 7073441 - DNA, 22 bp, Homo sapiens
ttagggagctcagtcctcagat

SEQ ID NO: 7073442 - DNA, 19 bp, Homo sapiens
ttaggggtatgaagtggta

SEQ ID NO: 7073443 - DNA, 22 bp, Homo sapiens
ttagggttacaccagcctcctg

SEQ ID NO: 7073444 - DNA, 22 bp, Homo sapiens
ttaggtaaggatggtgacagta

SEQ ID NO: 7073445 - DNA, 22 bp, Homo sapiens
ttaggtaaggatggtgacagta

SEQ ID NO: 7073446 - DNA, 22 bp, Homo sapiens
ttaggtaagtaggatcaaaaaa

SEQ ID NO: 7073447 - DNA, 22 bp, Homo sapiens
ttagtacaagagattaattact

SEQ ID NO: 7073448 - DNA, 22 bp, Homo sapiens
ttagaacttaagaatactgtct

SEQ ID NO: 7073449 - DNA, 22 bp, Homo sapiens
ttagaactgaagaagattaagg

SEQ ID NO: 7073450 - DNA, 22 bp, Homo sapiens
ttagaacttaaacttcagaaag

SEQ ID NO: 7073451 - DNA, 22 bp, Homo sapiens
ttagaaaggttttgctctgaaa

SEQ ID NO: 7073452 - DNA, 22 bp, Homo sapiens
ttagaaatcacctctgaagatc

SEQ ID NO: 7073453 - DNA, 22 bp, Homo sapiens
ttagaaatgtcacagatctgat

SEQ ID NO: 7073454 - DNA, 22 bp, Homo sapiens
ttagaaatgtcacagatctgat

SEQ ID NO: 7073455 - DNA, 22 bp, Homo sapiens
ttacagaatgtgccatttggtc

SEQ ID NO: 7073456 - DNA, 22 bp, Homo sapiens
ttacacaaaaataagatatggc

SEQ ID NO: 7073457 - DNA, 22 bp, Homo sapiens
ttacagatactttgtaggcaag

SEQ ID NO: 7073458 - DNA, 22 bp, Homo sapiens
ttacaatgggtatacttccatt

SEQ ID NO: 7073459 - DNA, 22 bp, Homo sapiens
ttacaaggaggatagcatttcc

SEQ ID NO: 7073460 - DNA, 22 bp, Homo sapiens
ttacaagcagctacatatcaca

SEQ ID NO: 7073461 - DNA, 22 bp, Homo sapiens
ttacagatcatcaaggtataat

SEQ ID NO: 7073462 - DNA, 22 bp, Homo sapiens
ttacagatcatcaaggtataat

SEQ ID NO: 7073463 - DNA, 22 bp, Homo sapiens
ttacatgggccatttagacatg

SEQ ID NO: 7073464 - DNA, 22 bp, Homo sapiens
ttacatgggcttgtgagtcctt

SEQ ID NO: 7073465 - DNA, 21 bp, Homo sapiens
ttacatggtttatcatatgga

SEQ ID NO: 7073466 - DNA, 22 bp, Homo sapiens
ttacatgtacaaacaattctta

SEQ ID NO: 7073467 - DNA, 22 bp, Homo sapiens
ttacatgtactggtttgactta

SEQ ID NO: 7073468 - DNA, 22 bp, Homo sapiens
ttacatgtggagtctgattgca

SEQ ID NO: 7073469 - DNA, 23 bp, Homo sapiens
ttacatgtgtgcacacattctgg

SEQ ID NO: 7073470 - DNA, 22 bp, Homo sapiens
ttacatgtttacggatacactt

SEQ ID NO: 7073471 - DNA, 22 bp, Homo sapiens
ttacatgtttatgtggtacatg

SEQ ID NO: 7073472 - DNA, 22 bp, Homo sapiens
ttacattcttggaatcttgttt

SEQ ID NO: 7073473 - DNA, 22 bp, Homo sapiens
ttacaaagttctgagttcaaac

SEQ ID NO: 7073474 - DNA, 22 bp, Homo sapiens
ttacaaagtgttatgataaaca

SEQ ID NO: 7073475 - DNA, 20 bp, Homo sapiens
ttacaaagaggcatcgcttt

SEQ ID NO: 7073476 - DNA, 22 bp, Homo sapiens
ttaattaattagttaagcatgt

SEQ ID NO: 7073477 - DNA, 22 bp, Homo sapiens
ttaattaaattcatgagcattg

SEQ ID NO: 7073478 - DNA, 22 bp, Homo sapiens
ttaattaaattcatgagcattg

SEQ ID NO: 7073479 - DNA, 22 bp, Homo sapiens
ttaattaactagccaaccacta

SEQ ID NO: 7073480 - DNA, 17 bp, Homo sapiens
ttacaacaattcatgag

SEQ ID NO: 7073481 - DNA, 17 bp, Homo sapiens
ttacaacaattcatgag

SEQ ID NO: 7073482 - DNA, 22 bp, Homo sapiens
ttacaacagacacatattctaa

SEQ ID NO: 7073483 - DNA, 22 bp, Homo sapiens
ttacaacagacacatattctaa

SEQ ID NO: 7073484 - DNA, 22 bp, Homo sapiens
ttacaacagcgatttacctgtc

SEQ ID NO: 7073485 - DNA, 23 bp, Homo sapiens
ttacaacagtgtccatatttgta

SEQ ID NO: 7073486 - DNA, 22 bp, Homo sapiens
ttacaacatatgataggagtct

SEQ ID NO: 7073487 - DNA, 17 bp, Homo sapiens
ttacaacgtcatctctg

SEQ ID NO: 7073488 - DNA, 23 bp, Homo sapiens
ttacaactatttgccatgttgtt

SEQ ID NO: 7073489 - DNA, 22 bp, Homo sapiens
ttacaactgaagctaatgtgct

SEQ ID NO: 7073490 - DNA, 22 bp, Homo sapiens
ttaatacagaagcaagacactg

SEQ ID NO: 7073491 - DNA, 22 bp, Homo sapiens
ttaatacaagcatatgcacaca

SEQ ID NO: 7073492 - DNA, 22 bp, Homo sapiens
ttaatacaagcatatgcacaca

SEQ ID NO: 7073493 - DNA, 22 bp, Homo sapiens
ttaataaagtatgaattggaaa

SEQ ID NO: 7073494 - DNA, 22 bp, Homo sapiens
ttaaagagtctactgcacatcc

SEQ ID NO: 7073495 - DNA, 22 bp, Homo sapiens
ttaaagaggcatgggaatgtat

SEQ ID NO: 7073496 - DNA, 22 bp, Homo sapiens
ttaaagagaactcaatgaatga

SEQ ID NO: 7073497 - DNA, 22 bp, Homo sapiens
ttaaagatgcagctttagagaa

SEQ ID NO: 7073498 - DNA, 22 bp, Homo sapiens
ttaataaagtatgaattggaaa

SEQ ID NO: 7073499 - DNA, 22 bp, Homo sapiens
ttaataaagtatgaattggaaa

SEQ ID NO: 7073500 - DNA, 22 bp, Homo sapiens
ttaataaagtatgaattggaaa

SEQ ID NO: 7073501 - DNA, 22 bp, Homo sapiens
ttatttctactattttgcctga

SEQ ID NO: 7073502 - DNA, 22 bp, Homo sapiens
ttatttcctagggaatttgcct

SEQ ID NO: 7073503 - DNA, 22 bp, Homo sapiens
ttatttcctctctaatagggta

SEQ ID NO: 7073504 - DNA, 22 bp, Homo sapiens
ttatttcctgacacagctgatt

SEQ ID NO: 7073505 - DNA, 22 bp, Homo sapiens
ttatttggatttagcttatcaa

SEQ ID NO: 7073506 - DNA, 22 bp, Homo sapiens
ttatttgtgaatcatttatcta

SEQ ID NO: 7073507 - DNA, 22 bp, Homo sapiens
ttcacattggtgatatgtttct

SEQ ID NO: 7073508 - DNA, 22 bp, Homo sapiens
ttcacattggtgatatgtttct

SEQ ID NO: 7073509 - DNA, 22 bp, Homo sapiens
ttcacattgtgcagattatggt

SEQ ID NO: 7073510 - DNA, 22 bp, Homo sapiens
ttcacattgtgcagattatggt

SEQ ID NO: 7073511 - DNA, 22 bp, Homo sapiens
ttcacattgttttaatgtgaat

SEQ ID NO: 7073512 - DNA, 22 bp, Homo sapiens
ttcacatttactggtttgtccg

SEQ ID NO: 7073513 - DNA, 22 bp, Homo sapiens
ttcacatttctctgctgtttga

SEQ ID NO: 7073514 - DNA, 19 bp, Homo sapiens
ttcacattttgctctgagg

SEQ ID NO: 7073515 - DNA, 18 bp, Homo sapiens
ttcaccagtgtgatgggt

SEQ ID NO: 7073516 - DNA, 18 bp, Homo sapiens
ttcaccagtgtgatgggt

SEQ ID NO: 7073517 - DNA, 22 bp, Homo sapiens
ttcacgttgttgaagaaaatac

SEQ ID NO: 7073518 - DNA, 22 bp, Homo sapiens
ttcactgtactgactgtcttat

SEQ ID NO: 7073519 - DNA, 22 bp, Homo sapiens
ttcagcagtcgtccaggaaaag

SEQ ID NO: 7073520 - DNA, 22 bp, Homo sapiens
ttcagcagtgcagacacccagt

SEQ ID NO: 7073521 - DNA, 22 bp, Homo sapiens
ttcattcttttacatgtgaata

SEQ ID NO: 7073522 - DNA, 20 bp, Homo sapiens
ttcattcattccacaacttc

SEQ ID NO: 7073523 - DNA, 22 bp, Homo sapiens
ttccagagctttgcgcttggaa

SEQ ID NO: 7073524 - DNA, 23 bp, Homo sapiens
ttccagaggaagaagtcatgact

SEQ ID NO: 7073525 - DNA, 22 bp, Homo sapiens
ttcattagttctgaagatgtct

SEQ ID NO: 7073526 - DNA, 23 bp, Homo sapiens
ttcattcaaaaggaaaagtcatg

SEQ ID NO: 7073527 - DNA, 22 bp, Homo sapiens
ttcattcatctctaaaatgcct

SEQ ID NO: 7073528 - DNA, 22 bp, Homo sapiens
ttccagctaactcacatccctt

SEQ ID NO: 7073529 - DNA, 22 bp, Homo sapiens
ttccagagtgactgtgccactt

SEQ ID NO: 7073530 - DNA, 22 bp, Homo sapiens
ttccagagttgggggagtggtt

SEQ ID NO: 7073531 - DNA, 22 bp, Homo sapiens
ttccagagtattggtagctata

SEQ ID NO: 7073532 - DNA, 22 bp, Homo sapiens
ttccagagtcagccactgggag

SEQ ID NO: 7073533 - DNA, 22 bp, Homo sapiens
ttccagaggctctaggggagaa

SEQ ID NO: 7073534 - DNA, 22 bp, Homo sapiens
ttccagaggcttcagggaagaa

SEQ ID NO: 7073535 - DNA, 22 bp, Homo sapiens
ttccagaggggaggtggcagcc

SEQ ID NO: 7073536 - DNA, 22 bp, Homo sapiens
tgtacacatggtgtacactccc

SEQ ID NO: 7073537 - DNA, 22 bp, Homo sapiens
tgtacagactgtatttacaagt

SEQ ID NO: 7073538 - DNA, 22 bp, Homo sapiens
tgtacagctgccttttttactt

SEQ ID NO: 7073539 - DNA, 22 bp, Homo sapiens
tgtacacaattcttaacataca

SEQ ID NO: 7073540 - DNA, 22 bp, Homo sapiens
tgtacaatctgatgatgtatgg

SEQ ID NO: 7073541 - DNA, 22 bp, Homo sapiens
tgtaaggtgctcatgtatttct

SEQ ID NO: 7073542 - DNA, 22 bp, Homo sapiens
tgtaagatattcagcttattga

SEQ ID NO: 7073543 - DNA, 23 bp, Homo sapiens
tgtaaattttgtagtcacatttt

SEQ ID NO: 7073544 - DNA, 22 bp, Homo sapiens
tgtaacagtaagcctgtgagct

SEQ ID NO: 7073545 - DNA, 22 bp, Homo sapiens
tgtaaatcactgaactaaatga

SEQ ID NO: 7073546 - DNA, 22 bp, Homo sapiens
tgtaaatgaagtatgctttact

SEQ ID NO: 7073547 - DNA, 22 bp, Homo sapiens
tgtaaatggtcagataaaccta

SEQ ID NO: 7073548 - DNA, 22 bp, Homo sapiens
tgtaaataatgcatgtaaatca

SEQ ID NO: 7073549 - DNA, 22 bp, Homo sapiens
tgtaaataatgcatgtaaatca

SEQ ID NO: 7073550 - DNA, 22 bp, Homo sapiens
tgtaaataatgcatgtaaatca

SEQ ID NO: 7073551 - DNA, 22 bp, Homo sapiens
tgtaaataatgcatgtaaatca

SEQ ID NO: 7073552 - DNA, 22 bp, Homo sapiens
tgtaaagtatctgtgagctctc

SEQ ID NO: 7073553 - DNA, 22 bp, Homo sapiens
tgtaaaaccaaatcaatctagt

SEQ ID NO: 7073554 - DNA, 22 bp, Homo sapiens
tggtttctttccactctccacc

SEQ ID NO: 7073555 - DNA, 22 bp, Homo sapiens
tggtttgacaatgaggactggt

SEQ ID NO: 7073556 - DNA, 22 bp, Homo sapiens
tggttttaaaaacatgctgcat

SEQ ID NO: 7073557 - DNA, 22 bp, Homo sapiens
tggttttaaaagatgtttgaga

SEQ ID NO: 7073558 - DNA, 22 bp, Homo sapiens
tggttttagagtatattcaggg

SEQ ID NO: 7073559 - DNA, 22 bp, Homo sapiens
tggttttagatgcctttactgc

SEQ ID NO: 7073560 - DNA, 22 bp, Homo sapiens
tggttttagggaatcaatctat

SEQ ID NO: 7073561 - DNA, 22 bp, Homo sapiens
tggttttatttatgttgagtca

SEQ ID NO: 7073562 - DNA, 22 bp, Homo sapiens
tggttttgctaaaatagaaaga

SEQ ID NO: 7073563 - DNA, 22 bp, Homo sapiens
tggttggatggctcttgtggct

SEQ ID NO: 7073564 - DNA, 22 bp, Homo sapiens
tggtttctcagactctttgcag

SEQ ID NO: 7073565 - DNA, 22 bp, Homo sapiens
tggtttctctgaactctacgac

SEQ ID NO: 7073566 - DNA, 22 bp, Homo sapiens
tggtttctgccctcagagctca

SEQ ID NO: 7073567 - DNA, 22 bp, Homo sapiens
tggtttctgggtttgtctagga

SEQ ID NO: 7073568 - DNA, 18 bp, Homo sapiens
tggtggtgacagggtcat

SEQ ID NO: 7073569 - DNA, 22 bp, Homo sapiens
tggtggttatgcgctttgtggg

SEQ ID NO: 7073570 - DNA, 22 bp, Homo sapiens
tggtgccaagcatgaggactct

SEQ ID NO: 7073571 - DNA, 22 bp, Homo sapiens
tggtgcagtccaaagggagcag

SEQ ID NO: 7073572 - DNA, 22 bp, Homo sapiens
tggtgcaggccaagctgcgagc

SEQ ID NO: 7073573 - DNA, 22 bp, Homo sapiens
tggtgcagtcattggcccaggg

SEQ ID NO: 7073574 - DNA, 21 bp, Homo sapiens
tggtgccttcagctgtctttt

SEQ ID NO: 7073575 - DNA, 22 bp, Homo sapiens
tggtggacaccgcagccatgaa

SEQ ID NO: 7073576 - DNA, 22 bp, Homo sapiens
tggtggacattctggatgtgct

SEQ ID NO: 7073577 - DNA, 21 bp, Homo sapiens
tggtggaccagtgctgggaga

SEQ ID NO: 7073578 - DNA, 21 bp, Homo sapiens
tggtggaccagtgctgggaga

SEQ ID NO: 7073579 - DNA, 22 bp, Homo sapiens
tggtggacctggcattgaacct

SEQ ID NO: 7073580 - DNA, 20 bp, Homo sapiens
tggtggactttggcatggct

SEQ ID NO: 7073581 - DNA, 20 bp, Homo sapiens
tggtggactttggcatggct

SEQ ID NO: 7073582 - DNA, 22 bp, Homo sapiens
tggtggagacctcgctaacccc

SEQ ID NO: 7073583 - DNA, 22 bp, Homo sapiens
tggtggagcctaggctaagtct

SEQ ID NO: 7073584 - DNA, 22 bp, Homo sapiens
tggtggagctgtggccacgacc

SEQ ID NO: 7073585 - DNA, 19 bp, Homo sapiens
tggtggaggccccatgttc

SEQ ID NO: 7073586 - DNA, 22 bp, Homo sapiens
tggtggagggaactatttccag

SEQ ID NO: 7073587 - DNA, 19 bp, Homo sapiens
tggtggaggtgcacctgac

SEQ ID NO: 7073588 - DNA, 21 bp, Homo sapiens
tggtggagtgtgctgagcatg

SEQ ID NO: 7073589 - DNA, 22 bp, Homo sapiens
tggtgggagtgagggcatgcca

SEQ ID NO: 7073590 - DNA, 22 bp, Homo sapiens
tggtgggagtccgctgtgctgc

SEQ ID NO: 7073591 - DNA, 22 bp, Homo sapiens
tggtggcatgatagtgtgaatg

SEQ ID NO: 7073592 - DNA, 22 bp, Homo sapiens
tggtgaggccaaagccatgaca

SEQ ID NO: 7073593 - DNA, 22 bp, Homo sapiens
tggtgaggtcatagagaactgt

SEQ ID NO: 7073594 - DNA, 22 bp, Homo sapiens
tggtgcaaaactaattgcggtt

SEQ ID NO: 7073595 - DNA, 22 bp, Homo sapiens
tggtctctgctgcagcttctca

SEQ ID NO: 7073596 - DNA, 22 bp, Homo sapiens
tggtctctgctgcagcttctca

SEQ ID NO: 7073597 - DNA, 22 bp, Homo sapiens
tggtctctgctgcagcttctca

SEQ ID NO: 7073598 - DNA, 22 bp, Homo sapiens
tggtgacaccccatctctaaag

SEQ ID NO: 7073599 - DNA, 22 bp, Homo sapiens
tggtgacacgaagtttgctatc

SEQ ID NO: 7073600 - DNA, 22 bp, Homo sapiens
tggtcgaccagttggaaagtaa

SEQ ID NO: 7073601 - DNA, 22 bp, Homo sapiens
tggtcgaccagttggaaagtaa

SEQ ID NO: 7073602 - DNA, 22 bp, Homo sapiens
tggtctctgagccttcctgtgg

SEQ ID NO: 7073603 - DNA, 22 bp, Homo sapiens
tggtcagacaaaggagaatgtt

SEQ ID NO: 7073604 - DNA, 22 bp, Homo sapiens
tggtcaggattctcagcccttc

SEQ ID NO: 7073605 - DNA, 22 bp, Homo sapiens
tggtcaggattctcagcccttc

SEQ ID NO: 7073606 - DNA, 22 bp, Homo sapiens
tggtcaggctgctctgcggcgt

SEQ ID NO: 7073607 - DNA, 22 bp, Homo sapiens
tggtcaggggcttctgagctgt

SEQ ID NO: 7073608 - DNA, 22 bp, Homo sapiens
tggtcataacatgattagtagg

SEQ ID NO: 7073609 - DNA, 22 bp, Homo sapiens
tggtcattgctattgtttctca

SEQ ID NO: 7073610 - DNA, 17 bp, Homo sapiens
tggtcattttaatttta

SEQ ID NO: 7073611 - DNA, 22 bp, Homo sapiens
tggtcatttttatttcagttgc

SEQ ID NO: 7073612 - DNA, 22 bp, Homo sapiens
tggtccacagggagtccgtgct

SEQ ID NO: 7073613 - DNA, 22 bp, Homo sapiens
tggtccagacatttctgaggta

SEQ ID NO: 7073614 - DNA, 22 bp, Homo sapiens
tggtcctgagaatcctgtcctc

SEQ ID NO: 7073615 - DNA, 22 bp, Homo sapiens
tggtcctggaaggtcctgaggg

SEQ ID NO: 7073616 - DNA, 22 bp, Homo sapiens
tggtcctggagagtgttccata

SEQ ID NO: 7073617 - DNA, 21 bp, Homo sapiens
tgtccttaatgcaatgtcctt

SEQ ID NO: 7073618 - DNA, 22 bp, Homo sapiens
tgtccttataagaaaaggaaat

SEQ ID NO: 7073619 - DNA, 22 bp, Homo sapiens
tgtccttgtgacattctggctt

SEQ ID NO: 7073620 - DNA, 22 bp, Homo sapiens
tgtcctggtgctccaggtggct

SEQ ID NO: 7073621 - DNA, 22 bp, Homo sapiens
tgtcctggtgctccaggtggct

SEQ ID NO: 7073622 - DNA, 22 bp, Homo sapiens
tgtcctggggacaagaggccct

SEQ ID NO: 7073623 - DNA, 22 bp, Homo sapiens
tgtcctgggaaatcccttaggc

SEQ ID NO: 7073624 - DNA, 22 bp, Homo sapiens
tgtcctgggaatgggatgcagt

SEQ ID NO: 7073625 - DNA, 22 bp, Homo sapiens
tgtcctcagatatgtctactct

SEQ ID NO: 7073626 - DNA, 22 bp, Homo sapiens
tgtcctggccaaggccttgctt

SEQ ID NO: 7073627 - DNA, 22 bp, Homo sapiens
tgtccaggcggccttgcctgtt

SEQ ID NO: 7073628 - DNA, 22 bp, Homo sapiens
tgtccaggtcagcagcagggac

SEQ ID NO: 7073629 - DNA, 22 bp, Homo sapiens
tgtccaggtgtgtctaaagaga

SEQ ID NO: 7073630 - DNA, 22 bp, Homo sapiens
tgtccaggtggcctctgctgct

SEQ ID NO: 7073631 - DNA, 22 bp, Homo sapiens
tgtccccaaggttcagcccaca

SEQ ID NO: 7073632 - DNA, 20 bp, Homo sapiens
tgtccccaccaaaatttcat

SEQ ID NO: 7073633 - DNA, 22 bp, Homo sapiens
tgtccccacccaaatctcatct

SEQ ID NO: 7073634 - DNA, 22 bp, Homo sapiens
tgtccccagagcctgttcctgc

SEQ ID NO: 7073635 - DNA, 22 bp, Homo sapiens
tgtccccaggtcctctgccgtc

SEQ ID NO: 7073636 - DNA, 22 bp, Homo sapiens
tgtccctctgaggcttccctgg

SEQ ID NO: 7073637 - DNA, 18 bp, Homo sapiens
tgtccctgcaaataacat

SEQ ID NO: 7073638 - DNA, 18 bp, Homo sapiens
tgtccctgcaaataacat

SEQ ID NO: 7073639 - DNA, 18 bp, Homo sapiens
tgtccctgcaaataacat

SEQ ID NO: 7073640 - DNA, 18 bp, Homo sapiens
tgtccctgcaaataacat

SEQ ID NO: 7073641 - DNA, 22 bp, Homo sapiens
tgtccctgctgtacttagagca

SEQ ID NO: 7073642 - DNA, 20 bp, Homo sapiens
tgtcctaatagacaagcaga

SEQ ID NO: 7073643 - DNA, 22 bp, Homo sapiens
tgtcattttgtctcactgctat

SEQ ID NO: 7073644 - DNA, 22 bp, Homo sapiens
tgtccacatcactcacttgtca

SEQ ID NO: 7073645 - DNA, 22 bp, Homo sapiens
tgtccagatcaatgcccacatg

SEQ ID NO: 7073646 - DNA, 22 bp, Homo sapiens
tgtccaggaattgaccctgcaa

SEQ ID NO: 7073647 - DNA, 22 bp, Homo sapiens
tgtcatttcctgaatgctgagt

SEQ ID NO: 7073648 - DNA, 22 bp, Homo sapiens
tgtcatttcacaatatcactca

SEQ ID NO: 7073649 - DNA, 22 bp, Homo sapiens
tgtcattttagtgcatcactca

SEQ ID NO: 7073650 - DNA, 22 bp, Homo sapiens
tgtcattttcatcctaaggagc

SEQ ID NO: 7073651 - DNA, 22 bp, Homo sapiens
tgtcattttctaatctgttgtc

SEQ ID NO: 7073652 - DNA, 20 bp, Homo sapiens
tgtcattcttctttcacagg

SEQ ID NO: 7073653 - DNA, 22 bp, Homo sapiens
tgtcatttaaagctttccagat

SEQ ID NO: 7073654 - DNA, 22 bp, Homo sapiens
tgtcatttagtcctctgtgtgt

SEQ ID NO: 7073655 - DNA, 22 bp, Homo sapiens
tgtcatttatgcttcttcagtg

SEQ ID NO: 7073656 - DNA, 22 bp, Homo sapiens
tgtcatttattctcttattcta

SEQ ID NO: 7073657 - DNA, 22 bp, Homo sapiens
tgtcatttattttgctgtctgt

SEQ ID NO: 7073658 - DNA, 22 bp, Homo sapiens
tgtcatgagttatttcatagga

SEQ ID NO: 7073659 - DNA, 22 bp, Homo sapiens
tgtcagtttcctgtgccctgct

SEQ ID NO: 7073660 - DNA, 22 bp, Homo sapiens
tgtcatagtgtggtagcagtgg

SEQ ID NO: 7073661 - DNA, 22 bp, Homo sapiens
tgtcagtgagttgggtcctgag

SEQ ID NO: 7073662 - DNA, 20 bp, Homo sapiens
tgtcagtgcctgaggcacag

SEQ ID NO: 7073663 - DNA, 22 bp, Homo sapiens
tgtcagtggtagacccagaggt

SEQ ID NO: 7073664 - DNA, 18 bp, Homo sapiens
tgtcagtaaagtgacaga

SEQ ID NO: 7073665 - DNA, 22 bp, Homo sapiens
tgtcaatgtgtacaggagctca

SEQ ID NO: 7073666 - DNA, 22 bp, Homo sapiens
tgtcacagagcaactatttctt

SEQ ID NO: 7073667 - DNA, 22 bp, Homo sapiens
tgtatttttagacctttagacc

SEQ ID NO: 7073668 - DNA, 21 bp, Homo sapiens
tgtcacagattctcagcttgc

SEQ ID NO: 7073669 - DNA, 22 bp, Homo sapiens
tgtcacagtctcgtgagcatct

SEQ ID NO: 7073670 - DNA, 22 bp, Homo sapiens
tgtcacagtttgtactttatag

SEQ ID NO: 7073671 - DNA, 22 bp, Homo sapiens
tgtcacataatttatctgtagg

SEQ ID NO: 7073672 - DNA, 22 bp, Homo sapiens
tgtcacataggcaaaatgtttt

SEQ ID NO: 7073673 - DNA, 22 bp, Homo sapiens
tgtcacatatataatgttcaat

SEQ ID NO: 7073674 - DNA, 22 bp, Homo sapiens
tgtcacatcaggggtgttgaca

SEQ ID NO: 7073675 - DNA, 22 bp, Homo sapiens
tgtcacatcaggtggtggctgt

SEQ ID NO: 7073676 - DNA, 22 bp, Homo sapiens
tgtcacatccattttgcaagta

SEQ ID NO: 7073677 - DNA, 22 bp, Homo sapiens
tgtcacatgaaacttgctcatc

SEQ ID NO: 7073678 - DNA, 22 bp, Homo sapiens
tgtcacatgaagccaacatagc

SEQ ID NO: 7073679 - DNA, 22 bp, Homo sapiens
tgtcacatgacacaaatatcta

SEQ ID NO: 7073680 - DNA, 21 bp, Homo sapiens
tgtcacatgtggatggtattt

SEQ ID NO: 7073681 - DNA, 22 bp, Homo sapiens
tgtcacatgtgtggcatttttc

SEQ ID NO: 7073682 - DNA, 22 bp, Homo sapiens
tgtcacatgtttaatgtggact

SEQ ID NO: 7073683 - DNA, 22 bp, Homo sapiens
tgtcacattatatgtgaggata

SEQ ID NO: 7073684 - DNA, 22 bp, Homo sapiens
tgtcacattctgatgtgaggtg

SEQ ID NO: 7073685 - DNA, 22 bp, Homo sapiens
tgtcacattgaatatgatttat

SEQ ID NO: 7073686 - DNA, 22 bp, Homo sapiens
tgtcacattgaatatgatttat

SEQ ID NO: 7073687 - DNA, 21 bp, Homo sapiens
tgtcacattgtccctgctgct

SEQ ID NO: 7073688 - DNA, 23 bp, Homo sapiens
tgtcacatttagttggcattgtt

SEQ ID NO: 7073689 - DNA, 22 bp, Homo sapiens
tgtcaccaagttgatgaatgca

SEQ ID NO: 7073690 - DNA, 22 bp, Homo sapiens
tgtcaccatgccagcttctgcc

SEQ ID NO: 7073691 - DNA, 22 bp, Homo sapiens
tgtcaccatgcgaggctaattt

SEQ ID NO: 7073692 - DNA, 22 bp, Homo sapiens
tgtattttctgaggagcattag

SEQ ID NO: 7073693 - DNA, 22 bp, Homo sapiens
tgtattttctgaagataatcaa

SEQ ID NO: 7073694 - DNA, 22 bp, Homo sapiens
tgtatttattcaggatgtaact

SEQ ID NO: 7073695 - DNA, 22 bp, Homo sapiens
tgtatttattcaggatgtaact

SEQ ID NO: 7073696 - DNA, 22 bp, Homo sapiens
tgtatttcgctaggtactccct

SEQ ID NO: 7073697 - DNA, 22 bp, Homo sapiens
tgtattgaattgtgttatatct

SEQ ID NO: 7073698 - DNA, 22 bp, Homo sapiens
tgtatttaagctttacctaaaa

SEQ ID NO: 7073699 - DNA, 20 bp, Homo sapiens
tgtatttaatgaaggctttt

SEQ ID NO: 7073700 - DNA, 22 bp, Homo sapiens
tgtatttaattgtatcatcaca

SEQ ID NO: 7073701 - DNA, 22 bp, Homo sapiens
tgtaggaagatataaaatatct

SEQ ID NO: 7073702 - DNA, 22 bp, Homo sapiens
tgtaggaatggattctagaagg

SEQ ID NO: 7073703 - DNA, 22 bp, Homo sapiens
tgtaggaaaaacaatgatctgc

SEQ ID NO: 7073704 - DNA, 22 bp, Homo sapiens
tgtagcagtttttcattatcca

SEQ ID NO: 7073705 - DNA, 22 bp, Homo sapiens
tgtagaggaggaaactgaggct

SEQ ID NO: 7073706 - DNA, 22 bp, Homo sapiens
tgtagcagtgtctaccacatta

SEQ ID NO: 7073707 - DNA, 22 bp, Homo sapiens
tgtagaaattagtaagatcaac

SEQ ID NO: 7073708 - DNA, 22 bp, Homo sapiens
tgtagaaagctcttctgaaatc

SEQ ID NO: 7073709 - DNA, 22 bp, Homo sapiens
tgtagaacctgtttattataga

SEQ ID NO: 7073710 - DNA, 18 bp, Homo sapiens
tgtagagccaggtttgcc

SEQ ID NO: 7073711 - DNA, 22 bp, Homo sapiens
tgtatattgcctgagtctttcc

SEQ ID NO: 7073712 - DNA, 22 bp, Homo sapiens
tgtatcaaaccaaattaattct

SEQ ID NO: 7073713 - DNA, 22 bp, Homo sapiens
tgtatcaaaccaaattaattct

SEQ ID NO: 7073714 - DNA, 22 bp, Homo sapiens
tgtatcaagggtttatgtaagc

SEQ ID NO: 7073715 - DNA, 22 bp, Homo sapiens
tgtatcaagggtttatgtaagc

SEQ ID NO: 7073716 - DNA, 22 bp, Homo sapiens
tgtatgaggcatacatcaggca

SEQ ID NO: 7073717 - DNA, 22 bp, Homo sapiens
tgtatacaagtcgtgtaaactt

SEQ ID NO: 7073718 - DNA, 22 bp, Homo sapiens
tgtatagagttggaagatgact

SEQ ID NO: 7073719 - DNA, 22 bp, Homo sapiens
tgggcttcctggagcctgtgct

SEQ ID NO: 7073720 - DNA, 22 bp, Homo sapiens
tgggcttaggtcggaggcggcc

SEQ ID NO: 7073721 - DNA, 22 bp, Homo sapiens
tgggctggctgaggcattcact

SEQ ID NO: 7073722 - DNA, 22 bp, Homo sapiens
tgggctggtgagggatcattta

SEQ ID NO: 7073723 - DNA, 22 bp, Homo sapiens
tgggctggcgtggagagtttag

SEQ ID NO: 7073724 - DNA, 22 bp, Homo sapiens
tgggctggctgaacttcaacct

SEQ ID NO: 7073725 - DNA, 17 bp, Homo sapiens
tggggaagctcagattt

SEQ ID NO: 7073726 - DNA, 22 bp, Homo sapiens
tggggacacagaggttcgttgg

SEQ ID NO: 7073727 - DNA, 22 bp, Homo sapiens
tggggaggatatgtgagttatt

SEQ ID NO: 7073728 - DNA, 22 bp, Homo sapiens
tggggaggatatgtgagttatt

SEQ ID NO: 7073729 - DNA, 22 bp, Homo sapiens
tggggaggatatgtgagttatt

SEQ ID NO: 7073730 - DNA, 22 bp, Homo sapiens
tggggaggacgggcgccttcct

SEQ ID NO: 7073731 - DNA, 22 bp, Homo sapiens
tggggaggacgggcgccttcct

SEQ ID NO: 7073732 - DNA, 23 bp, Homo sapiens
tggggagggaagtcatttctgta

SEQ ID NO: 7073733 - DNA, 23 bp, Homo sapiens
tggggagggaagtcatttctgta

SEQ ID NO: 7073734 - DNA, 22 bp, Homo sapiens
tggggacagggctcagcaattt

SEQ ID NO: 7073735 - DNA, 22 bp, Homo sapiens
tggggacatagccagtctggct

SEQ ID NO: 7073736 - DNA, 22 bp, Homo sapiens
tggggaggaagtcagatttcag

SEQ ID NO: 7073737 - DNA, 22 bp, Homo sapiens
tggggatgtaaatgaggtgata

SEQ ID NO: 7073738 - DNA, 17 bp, Homo sapiens
tggggatggttcatgag

SEQ ID NO: 7073739 - DNA, 22 bp, Homo sapiens
tggggatgaaacccaggcatct

SEQ ID NO: 7073740 - DNA, 22 bp, Homo sapiens
tggggatggatgaatctttgct

SEQ ID NO: 7073741 - DNA, 22 bp, Homo sapiens
tggggaggttcgggaatcttgt

SEQ ID NO: 7073742 - DNA, 22 bp, Homo sapiens
tggggaggttcgggaatcttgt

SEQ ID NO: 7073743 - DNA, 22 bp, Homo sapiens
tggggagtgatgcctcggataa

SEQ ID NO: 7073744 - DNA, 22 bp, Homo sapiens
tggggaggtaacaatttcaggc

SEQ ID NO: 7073745 - DNA, 21 bp, Homo sapiens
tggggaggggacctgattatg

SEQ ID NO: 7073746 - DNA, 21 bp, Homo sapiens
tggggaggggacctgattatg

SEQ ID NO: 7073747 - DNA, 22 bp, Homo sapiens
tggggaggtaacaatttcaggc

SEQ ID NO: 7073748 - DNA, 22 bp, Homo sapiens
tggggaggtaacaatttcaggc

SEQ ID NO: 7073749 - DNA, 22 bp, Homo sapiens
tggggaggtaacaatttcaggc

SEQ ID NO: 7073750 - DNA, 22 bp, Homo sapiens
tggggcagcagacctttcttgg

SEQ ID NO: 7073751 - DNA, 23 bp, Homo sapiens
tggggctgatggagacggaccag

SEQ ID NO: 7073752 - DNA, 22 bp, Homo sapiens
tggggctcctcctggcaggagg

SEQ ID NO: 7073753 - DNA, 22 bp, Homo sapiens
tggggctcacctaggctggaag

SEQ ID NO: 7073754 - DNA, 22 bp, Homo sapiens
tggggctgtccttagtctgaga

SEQ ID NO: 7073755 - DNA, 22 bp, Homo sapiens
tggggctggctattgtctccct

SEQ ID NO: 7073756 - DNA, 22 bp, Homo sapiens
tgggggagattgtgcatctcta

SEQ ID NO: 7073757 - DNA, 22 bp, Homo sapiens
tgggggagattagagcttctta

SEQ ID NO: 7073758 - DNA, 22 bp, Homo sapiens
tgggggctccaggctccaggga

SEQ ID NO: 7073759 - DNA, 22 bp, Homo sapiens
tgggggcatggaccagcctggc

SEQ ID NO: 7073760 - DNA, 22 bp, Homo sapiens
tgggggcatggaccagcctggc

SEQ ID NO: 7073761 - DNA, 22 bp, Homo sapiens
tgggggagtatagtctggcctc

SEQ ID NO: 7073762 - DNA, 22 bp, Homo sapiens
tgggggattgttttaatgaata

SEQ ID NO: 7073763 - DNA, 22 bp, Homo sapiens
tgggggagctcagtccagccca

SEQ ID NO: 7073764 - DNA, 22 bp, Homo sapiens
tggggtggtaatacaccgttct

SEQ ID NO: 7073765 - DNA, 22 bp, Homo sapiens
tggggtggaacccttctgctgg

SEQ ID NO: 7073766 - DNA, 22 bp, Homo sapiens
tggggtgccgacagggagggca

SEQ ID NO: 7073767 - DNA, 22 bp, Homo sapiens
tggggtgacagtgcagtggtca

SEQ ID NO: 7073768 - DNA, 22 bp, Homo sapiens
tggggtgccgacagggagggca

SEQ ID NO: 7073769 - DNA, 22 bp, Homo sapiens
tggggtggatagaaagtgatgt

SEQ ID NO: 7073770 - DNA, 22 bp, Homo sapiens
tggggtgggcatgcgctgtcct

SEQ ID NO: 7073771 - DNA, 22 bp, Homo sapiens
tgggggctgtgcacaggctcac

SEQ ID NO: 7073772 - DNA, 22 bp, Homo sapiens
tgggggtgaaagtctggacagt

SEQ ID NO: 7073773 - DNA, 22 bp, Homo sapiens
tgggggtgactatctcgggaat

SEQ ID NO: 7073774 - DNA, 22 bp, Homo sapiens
tggggtgaatctttgttgtccg

SEQ ID NO: 7073775 - DNA, 21 bp, Homo sapiens
tgggggtgaggcctaggaatc

SEQ ID NO: 7073776 - DNA, 22 bp, Homo sapiens
tgggtaggaatcgagtgtatgg

SEQ ID NO: 7073777 - DNA, 23 bp, Homo sapiens
tggggttgaattgtagctgtgcc

SEQ ID NO: 7073778 - DNA, 23 bp, Homo sapiens
tggggttgaattgtagctgtgcc

SEQ ID NO: 7073779 - DNA, 22 bp, Homo sapiens
tgggtaggccaggaagcagtgt

SEQ ID NO: 7073780 - DNA, 22 bp, Homo sapiens
tgggtaggccaggaagcagtgt

SEQ ID NO: 7073781 - DNA, 22 bp, Homo sapiens
tgggtagggacttagctggctg

SEQ ID NO: 7073782 - DNA, 22 bp, Homo sapiens
tgggtagggacttagctggctg

SEQ ID NO: 7073783 - DNA, 22 bp, Homo sapiens
tgggtaggggacgtggaagaaa

SEQ ID NO: 7073784 - DNA, 22 bp, Homo sapiens
tgggtaggggacgtggaagaaa

SEQ ID NO: 7073785 - DNA, 22 bp, Homo sapiens
tgggtccacggaagacttaggg

SEQ ID NO: 7073786 - DNA, 22 bp, Homo sapiens
tgggtccacttctgcactgtgg

SEQ ID NO: 7073787 - DNA, 22 bp, Homo sapiens
tgggtccagtgcagctgcgcgt

SEQ ID NO: 7073788 - DNA, 22 bp, Homo sapiens
tgggtccatggaacagaggtgc

SEQ ID NO: 7073789 - DNA, 21 bp, Homo sapiens
tgggtgggcagagtctcttca

SEQ ID NO: 7073790 - DNA, 21 bp, Homo sapiens
tgggtgggcagagtctcttca

SEQ ID NO: 7073791 - DNA, 17 bp, Homo sapiens
tgggtggtagggagagg

SEQ ID NO: 7073792 - DNA, 16 bp, Homo sapiens
tgggtgggaggagcgg

SEQ ID NO: 7073793 - DNA, 22 bp, Homo sapiens
tgggtggttgctgaggctcctt

SEQ ID NO: 7073794 - DNA, 22 bp, Homo sapiens
tgggtgtgcccagatggtgtcc

SEQ ID NO: 7073795 - DNA, 22 bp, Homo sapiens
tgggtgagccacaggagttgtc

SEQ ID NO: 7073796 - DNA, 22 bp, Homo sapiens
tgggtgagccacaggagttgtc

SEQ ID NO: 7073797 - DNA, 22 bp, Homo sapiens
tgggtgagcggctgcacacccg

SEQ ID NO: 7073798 - DNA, 22 bp, Homo sapiens
tgggtgaggagaggctgtctaa

SEQ ID NO: 7073799 - DNA, 22 bp, Homo sapiens
tgggtgaggatgatgaggcagc

SEQ ID NO: 7073800 - DNA, 21 bp, Homo sapiens
tgggtggaagcgggaggccgc

SEQ ID NO: 7073801 - DNA, 21 bp, Homo sapiens
tgggtggaagcgggaggccgc

SEQ ID NO: 7073802 - DNA, 22 bp, Homo sapiens
tggtatttaagacttcactcct

SEQ ID NO: 7073803 - DNA, 22 bp, Homo sapiens
tgggttctttcacttctcagtt

SEQ ID NO: 7073804 - DNA, 22 bp, Homo sapiens
tgggttctttcacttctcagtt

SEQ ID NO: 7073805 - DNA, 22 bp, Homo sapiens
tggtaaatatgtccattctctt

SEQ ID NO: 7073806 - DNA, 22 bp, Homo sapiens
tggtaaggattgtagaaacgaa

SEQ ID NO: 7073807 - DNA, 22 bp, Homo sapiens
tggtaaggggtggaaccagagc

SEQ ID NO: 7073808 - DNA, 22 bp, Homo sapiens
tggtaaggtcttcactcagatt

SEQ ID NO: 7073809 - DNA, 22 bp, Homo sapiens
tgggcctgggctcctgtcctct

SEQ ID NO: 7073810 - DNA, 22 bp, Homo sapiens
tgggcctgctggggcattttca

SEQ ID NO: 7073811 - DNA, 22 bp, Homo sapiens
tgggcctggggcagcccaaatc

SEQ ID NO: 7073812 - DNA, 22 bp, Homo sapiens
tgggcctgactcacctgcctcc

SEQ ID NO: 7073813 - DNA, 22 bp, Homo sapiens
tgggcctgactcacctgcctcc

SEQ ID NO: 7073814 - DNA, 22 bp, Homo sapiens
tgggcctctgtttcctcatctg

SEQ ID NO: 7073815 - DNA, 20 bp, Homo sapiens
tgggcctctggtgcctctgg

SEQ ID NO: 7073816 - DNA, 22 bp, Homo sapiens
tgggcctcggagcacaggagac

SEQ ID NO: 7073817 - DNA, 22 bp, Homo sapiens
tgggcctccgcatggcccagcg

SEQ ID NO: 7073818 - DNA, 22 bp, Homo sapiens
tgggcctcctgccctggcctag

SEQ ID NO: 7073819 - DNA, 22 bp, Homo sapiens
tgggcctcctgccctggcctag

SEQ ID NO: 7073820 - DNA, 22 bp, Homo sapiens
tgggcctcatgcccagccaccc

SEQ ID NO: 7073821 - DNA, 22 bp, Homo sapiens
tgggcctcatcttcaatgagtc

SEQ ID NO: 7073822 - DNA, 22 bp, Homo sapiens
tgggccaggcatgtgatcagca

SEQ ID NO: 7073823 - DNA, 22 bp, Homo sapiens
tgggccaggcatgtgatcagca

SEQ ID NO: 7073824 - DNA, 23 bp, Homo sapiens
tgggccagggagtccggtttctt

SEQ ID NO: 7073825 - DNA, 22 bp, Homo sapiens
tgggccagtccagccccaggga

SEQ ID NO: 7073826 - DNA, 22 bp, Homo sapiens
tgggctagcagggaagagagac

SEQ ID NO: 7073827 - DNA, 22 bp, Homo sapiens
tgggcgacagagcaagactccg

SEQ ID NO: 7073828 - DNA, 22 bp, Homo sapiens
tgggcctgtggcttggctctag

SEQ ID NO: 7073829 - DNA, 22 bp, Homo sapiens
tgggcctgtggcttggctctag

SEQ ID NO: 7073830 - DNA, 22 bp, Homo sapiens
tgggcctgtgatgctgggctat

SEQ ID NO: 7073831 - DNA, 22 bp, Homo sapiens
tgggcctgtgatgctgggctat

SEQ ID NO: 7073832 - DNA, 22 bp, Homo sapiens
tgggcctgggttcctcctgggc

SEQ ID NO: 7073833 - DNA, 22 bp, Homo sapiens
tgggctgcaccctcagcctctg

SEQ ID NO: 7073834 - DNA, 22 bp, Homo sapiens
tgggctgagcactgaggaagga

SEQ ID NO: 7073835 - DNA, 22 bp, Homo sapiens
tgggctgagcactgaggaagga

SEQ ID NO: 7073836 - DNA, 20 bp, Homo sapiens
tgggctgaggatcaggtgcc

SEQ ID NO: 7073837 - DNA, 20 bp, Homo sapiens
tgggctgaggatcaggtgcc

SEQ ID NO: 7073838 - DNA, 22 bp, Homo sapiens
tgggctgagtggcagccagagt

SEQ ID NO: 7073839 - DNA, 22 bp, Homo sapiens
tgggctgagtgtggaactagtt

SEQ ID NO: 7073840 - DNA, 22 bp, Homo sapiens
tgggctcttcctatagtttata

SEQ ID NO: 7073841 - DNA, 22 bp, Homo sapiens
tgggctgaaatgctgtggacta

SEQ ID NO: 7073842 - DNA, 22 bp, Homo sapiens
tgggctctggtttcctggctgg

SEQ ID NO: 7073843 - DNA, 22 bp, Homo sapiens
tgggctctgaagtcagtctgct

SEQ ID NO: 7073844 - DNA, 20 bp, Homo sapiens
tgggctctgcttcctggagt

SEQ ID NO: 7073845 - DNA, 22 bp, Homo sapiens
tgggctctctggcaggaaggct

SEQ ID NO: 7073846 - DNA, 22 bp, Homo sapiens
tgggcagttgctcctcagaccc

SEQ ID NO: 7073847 - DNA, 19 bp, Homo sapiens
tgggcagtgccagggctta

SEQ ID NO: 7073848 - DNA, 22 bp, Homo sapiens
tgggcagggtctctgttatcag

SEQ ID NO: 7073849 - DNA, 19 bp, Homo sapiens
tgggcaggttcagtaatgg

SEQ ID NO: 7073850 - DNA, 19 bp, Homo sapiens
tgggcaggttcagtaatgg

SEQ ID NO: 7073851 - DNA, 22 bp, Homo sapiens
tgggccacgtgacccttaccct

SEQ ID NO: 7073852 - DNA, 22 bp, Homo sapiens
tgggccacacacagaagaatca

SEQ ID NO: 7073853 - DNA, 22 bp, Homo sapiens
tgggccagctgaagtgccgccc

SEQ ID NO: 7073854 - DNA, 22 bp, Homo sapiens
tgggcagatctttggtggctag

SEQ ID NO: 7073855 - DNA, 22 bp, Homo sapiens
tgggcagatgtcctctgaagtg

SEQ ID NO: 7073856 - DNA, 22 bp, Homo sapiens
tgggcagattaatgcagtggct

SEQ ID NO: 7073857 - DNA, 22 bp, Homo sapiens
tgggcagcagcaaagccagact

SEQ ID NO: 7073858 - DNA, 22 bp, Homo sapiens
tgggcagcatcctccacagtca

SEQ ID NO: 7073859 - DNA, 22 bp, Homo sapiens
tgggcagccatcccagcctctc

SEQ ID NO: 7073860 - DNA, 19 bp, Homo sapiens
tgggcagctccctctgtcc

SEQ ID NO: 7073861 - DNA, 23 bp, Homo sapiens
tgggcagcttctgcatgcccacc

SEQ ID NO: 7073862 - DNA, 22 bp, Homo sapiens
tgggcaggagagaagctaaaga

SEQ ID NO: 7073863 - DNA, 22 bp, Homo sapiens
tgggcaggagagaagctaaaga

SEQ ID NO: 7073864 - DNA, 22 bp, Homo sapiens
tgggcagggagctggaaccaca

SEQ ID NO: 7073865 - DNA, 22 bp, Homo sapiens
tgggcagggatctcttttgcaa

SEQ ID NO: 7073866 - DNA, 22 bp, Homo sapiens
tgggcaggggccctgcttccgt

SEQ ID NO: 7073867 - DNA, 22 bp, Homo sapiens
tgggaggtctcttgcggcctag

SEQ ID NO: 7073868 - DNA, 22 bp, Homo sapiens
tgggaggtctcttgcggcctag

SEQ ID NO: 7073869 - DNA, 22 bp, Homo sapiens
tgggaggtgattaaattatggg

SEQ ID NO: 7073870 - DNA, 23 bp, Homo sapiens
tgggatggattcaccagtgtgct

SEQ ID NO: 7073871 - DNA, 23 bp, Homo sapiens
tgggatggattcaccagtgtgct

SEQ ID NO: 7073872 - DNA, 23 bp, Homo sapiens
tgggatggattcaccagtgtgct

SEQ ID NO: 7073873 - DNA, 22 bp, Homo sapiens
tgggatggcatcctgggccttg

SEQ ID NO: 7073874 - DNA, 22 bp, Homo sapiens
tgggatggcatcctgggccttg

SEQ ID NO: 7073875 - DNA, 22 bp, Homo sapiens
tgggatgagggtgagccacatg

SEQ ID NO: 7073876 - DNA, 22 bp, Homo sapiens
tgggatgataggtaagtaatta

SEQ ID NO: 7073877 - DNA, 22 bp, Homo sapiens
tgggatgagttgttaggactga

SEQ ID NO: 7073878 - DNA, 19 bp, Homo sapiens
tgggatgatgcagaaggta

SEQ ID NO: 7073879 - DNA, 19 bp, Homo sapiens
tgggatgatgcagaaggta

SEQ ID NO: 7073880 - DNA, 18 bp, Homo sapiens
tgggatggagagtaactg

SEQ ID NO: 7073881 - DNA, 22 bp, Homo sapiens
tgggatagattgatggatagag

SEQ ID NO: 7073882 - DNA, 22 bp, Homo sapiens
tgggagtgcacctgggacacga

SEQ ID NO: 7073883 - DNA, 22 bp, Homo sapiens
tgggatgagaagtgcgagggtt

SEQ ID NO: 7073884 - DNA, 22 bp, Homo sapiens
tgggatgagctatatagaaagt

SEQ ID NO: 7073885 - DNA, 22 bp, Homo sapiens
tgggatgaggcctctgttgtga

SEQ ID NO: 7073886 - DNA, 22 bp, Homo sapiens
tgggatagggctattgctcaca

SEQ ID NO: 7073887 - DNA, 22 bp, Homo sapiens
tgggatatacctatcctagaag

SEQ ID NO: 7073888 - DNA, 22 bp, Homo sapiens
tgggatatctgtcagcagcttc

SEQ ID NO: 7073889 - DNA, 22 bp, Homo sapiens
tgggatattttgagctttcctc

SEQ ID NO: 7073890 - DNA, 22 bp, Homo sapiens
tgggcaagtatcggactctgag

SEQ ID NO: 7073891 - DNA, 22 bp, Homo sapiens
tgggcaagggacaggcctggct

SEQ ID NO: 7073892 - DNA, 21 bp, Homo sapiens
tgggatgggtctgggaccagc

SEQ ID NO: 7073893 - DNA, 21 bp, Homo sapiens
tgggatgggtctgggaccagc

SEQ ID NO: 7073894 - DNA, 22 bp, Homo sapiens
tgggcagaggctctgaagtcca

SEQ ID NO: 7073895 - DNA, 20 bp, Homo sapiens
tggcggggatgagggagtta

SEQ ID NO: 7073896 - DNA, 20 bp, Homo sapiens
tggcggggatgagggagtta

SEQ ID NO: 7073897 - DNA, 22 bp, Homo sapiens
tggctatgaggagcgcaggtgt

SEQ ID NO: 7073898 - DNA, 22 bp, Homo sapiens
tggctcagaaggctgccttcac

SEQ ID NO: 7073899 - DNA, 22 bp, Homo sapiens
tggctcagagccttgagagctg

SEQ ID NO: 7073900 - DNA, 22 bp, Homo sapiens
tggctcagataattcaaggggc

SEQ ID NO: 7073901 - DNA, 22 bp, Homo sapiens
tggcctggtgtctgcgaggcct

SEQ ID NO: 7073902 - DNA, 22 bp, Homo sapiens
tggcctggtgtctgcgaggcct

SEQ ID NO: 7073903 - DNA, 22 bp, Homo sapiens
tggcctggtgctcaggcagtag

SEQ ID NO: 7073904 - DNA, 22 bp, Homo sapiens
tggcctggttgttgctgccgtt

SEQ ID NO: 7073905 - DNA, 22 bp, Homo sapiens
tggcctggtccttgtcaaggca

SEQ ID NO: 7073906 - DNA, 22 bp, Homo sapiens
tggcctgggtgctgctgacatc

SEQ ID NO: 7073907 - DNA, 22 bp, Homo sapiens
tggcctggtaccacatagattt

SEQ ID NO: 7073908 - DNA, 22 bp, Homo sapiens
tggcctggccctgaggccctgt

SEQ ID NO: 7073909 - DNA, 22 bp, Homo sapiens
tggcctggctcacagtgagatt

SEQ ID NO: 7073910 - DNA, 22 bp, Homo sapiens
tggcgaggccaggccagggcct

SEQ ID NO: 7073911 - DNA, 22 bp, Homo sapiens
tggcgaggtttcagagagcggc

SEQ ID NO: 7073912 - DNA, 22 bp, Homo sapiens
tggccttcctggtgactcatga

SEQ ID NO: 7073913 - DNA, 22 bp, Homo sapiens
tggctcagatttttgtaggctt

SEQ ID NO: 7073914 - DNA, 22 bp, Homo sapiens
tggctcaggggtctggctctgt

SEQ ID NO: 7073915 - DNA, 22 bp, Homo sapiens
tggctcagtctgggttgactga

SEQ ID NO: 7073916 - DNA, 22 bp, Homo sapiens
tggctcattctggggaagtcag

SEQ ID NO: 7073917 - DNA, 22 bp, Homo sapiens
tggctcatttctaaacccagct

SEQ ID NO: 7073918 - DNA, 22 bp, Homo sapiens
tggctcctcatcacagttggtg

SEQ ID NO: 7073919 - DNA, 22 bp, Homo sapiens
tggctcctgcatttgtgctaac

SEQ ID NO: 7073920 - DNA, 22 bp, Homo sapiens
tggctgcagttcacaggagcaa

SEQ ID NO: 7073921 - DNA, 22 bp, Homo sapiens
tggctgctgcagacagacagga

SEQ ID NO: 7073922 - DNA, 22 bp, Homo sapiens
tggctgctgctcactcagcctc

SEQ ID NO: 7073923 - DNA, 22 bp, Homo sapiens
tggctgctgcttggtcttcttc

SEQ ID NO: 7073924 - DNA, 21 bp, Homo sapiens
tggctgctggccctctctcca

SEQ ID NO: 7073925 - DNA, 22 bp, Homo sapiens
tggctgcttaaaattgctgcaa

SEQ ID NO: 7073926 - DNA, 22 bp, Homo sapiens
tggctgagtgaacatgtccatt

SEQ ID NO: 7073927 - DNA, 22 bp, Homo sapiens
tggctgagtgatatttgcaaag

SEQ ID NO: 7073928 - DNA, 22 bp, Homo sapiens
tggctgagtgatatttgcaaag

SEQ ID NO: 7073929 - DNA, 21 bp, Homo sapiens
tggctgagtggatgcatgaat

SEQ ID NO: 7073930 - DNA, 21 bp, Homo sapiens
tggctgagtggatgcatgaat

SEQ ID NO: 7073931 - DNA, 22 bp, Homo sapiens
tggctgagtgttccaaggagca

SEQ ID NO: 7073932 - DNA, 22 bp, Homo sapiens
tggctgagtgttccaaggagca

SEQ ID NO: 7073933 - DNA, 22 bp, Homo sapiens
tggctgagtgttccaaggagca

SEQ ID NO: 7073934 - DNA, 22 bp, Homo sapiens
tggctgagttacgaacagagca

SEQ ID NO: 7073935 - DNA, 22 bp, Homo sapiens
tggctgagttacgaacagagca

SEQ ID NO: 7073936 - DNA, 22 bp, Homo sapiens
tggctgagttacgaacagagca

SEQ ID NO: 7073937 - DNA, 22 bp, Homo sapiens
tggctgagttcctggcacacgg

SEQ ID NO: 7073938 - DNA, 22 bp, Homo sapiens
tggctgagttcctggcacacgg

SEQ ID NO: 7073939 - DNA, 22 bp, Homo sapiens
tggctgagttctccaggagtag

SEQ ID NO: 7073940 - DNA, 22 bp, Homo sapiens
tggctgagttctccaggagtag

SEQ ID NO: 7073941 - DNA, 22 bp, Homo sapiens
tggctgagttctccaggagtag

SEQ ID NO: 7073942 - DNA, 22 bp, Homo sapiens
tggctgagtttcatgcatcatg

SEQ ID NO: 7073943 - DNA, 22 bp, Homo sapiens
tggctgagtttcatgcatcatg

SEQ ID NO: 7073944 - DNA, 21 bp, Homo sapiens
tggctgcactgtggctttcat

SEQ ID NO: 7073945 - DNA, 22 bp, Homo sapiens
tggctgcagacacctatggcag

SEQ ID NO: 7073946 - DNA, 22 bp, Homo sapiens
tggctgcagatcaagggcaggc

SEQ ID NO: 7073947 - DNA, 22 bp, Homo sapiens
tggctgcagatcaagggcaggc

SEQ ID NO: 7073948 - DNA, 22 bp, Homo sapiens
tggctgagaagttctggtggga

SEQ ID NO: 7073949 - DNA, 22 bp, Homo sapiens
tggctgagaaaatggttttagg

SEQ ID NO: 7073950 - DNA, 22 bp, Homo sapiens
tggctgagaagttctggtggga

SEQ ID NO: 7073951 - DNA, 22 bp, Homo sapiens
tggctgagaagttctggtggga

SEQ ID NO: 7073952 - DNA, 22 bp, Homo sapiens
tggctgagaaaaaagagctata

SEQ ID NO: 7073953 - DNA, 22 bp, Homo sapiens
tggctgagaaaaaagagctata

SEQ ID NO: 7073954 - DNA, 22 bp, Homo sapiens
tggctgagaaaaaagagctata

SEQ ID NO: 7073955 - DNA, 22 bp, Homo sapiens
tggctgagaaaatggttttagg

SEQ ID NO: 7073956 - DNA, 22 bp, Homo sapiens
tggctgagccacttgttcagat

SEQ ID NO: 7073957 - DNA, 22 bp, Homo sapiens
tggctgagccacttgttcagat

SEQ ID NO: 7073958 - DNA, 23 bp, Homo sapiens
tggctgagatcctactgtttgct

SEQ ID NO: 7073959 - DNA, 23 bp, Homo sapiens
tggctgagatcctactgtttgct

SEQ ID NO: 7073960 - DNA, 22 bp, Homo sapiens
tggctgagagtcatcctgtgtg

SEQ ID NO: 7073961 - DNA, 22 bp, Homo sapiens
tggctgagagtcatcctgtgtg

SEQ ID NO: 7073962 - DNA, 22 bp, Homo sapiens
tggctgagagtcatcctgtgtg

SEQ ID NO: 7073963 - DNA, 22 bp, Homo sapiens
tggctgagagcaattgactctg

SEQ ID NO: 7073964 - DNA, 22 bp, Homo sapiens
tggctgagaagttctggtggga

SEQ ID NO: 7073965 - DNA, 23 bp, Homo sapiens
tggctgagcccactatcttggcc

SEQ ID NO: 7073966 - DNA, 23 bp, Homo sapiens
tggctgagcccactatcttggcc

SEQ ID NO: 7073967 - DNA, 23 bp, Homo sapiens
tggctgagcccactatcttggcc

SEQ ID NO: 7073968 - DNA, 22 bp, Homo sapiens
tggctgagcctttggggctttc

SEQ ID NO: 7073969 - DNA, 22 bp, Homo sapiens
tggctgagccacttgttcagat

SEQ ID NO: 7073970 - DNA, 21 bp, Homo sapiens
tggctgagccaggtgtgtgga

SEQ ID NO: 7073971 - DNA, 21 bp, Homo sapiens
tggctgagccaggtgtgtgga

SEQ ID NO: 7073972 - DNA, 22 bp, Homo sapiens
tggctgaggttatgctggttgt

SEQ ID NO: 7073973 - DNA, 22 bp, Homo sapiens
tggctgaggtctggggcttctg

SEQ ID NO: 7073974 - DNA, 22 bp, Homo sapiens
tggctgaggttatgctggttgt

SEQ ID NO: 7073975 - DNA, 22 bp, Homo sapiens
tggctgagggggcagttcagga

SEQ ID NO: 7073976 - DNA, 22 bp, Homo sapiens
tggctgagggcactatgaagcc

SEQ ID NO: 7073977 - DNA, 22 bp, Homo sapiens
tggctgaggttatgctggttgt

SEQ ID NO: 7073978 - DNA, 22 bp, Homo sapiens
tggctgagtaagttgtgatatg

SEQ ID NO: 7073979 - DNA, 22 bp, Homo sapiens
tggctgagtaagttgtgatatg

SEQ ID NO: 7073980 - DNA, 22 bp, Homo sapiens
tggctgagtgaacatgtccatt

SEQ ID NO: 7073981 - DNA, 22 bp, Homo sapiens
tggctgagggcactatgaagcc

SEQ ID NO: 7073982 - DNA, 22 bp, Homo sapiens
tggctgagggcactatgaagcc

SEQ ID NO: 7073983 - DNA, 22 bp, Homo sapiens
tggctgaggcttttcttaaaga

SEQ ID NO: 7073984 - DNA, 22 bp, Homo sapiens
tggctgaggcttttcttaaaga

SEQ ID NO: 7073985 - DNA, 22 bp, Homo sapiens
tggctgaggctggagtgcagtg

SEQ ID NO: 7073986 - DNA, 22 bp, Homo sapiens
tggctgaggctggagtgcagtg

SEQ ID NO: 7073987 - DNA, 22 bp, Homo sapiens
tggctgaggctggagtgcagtg

SEQ ID NO: 7073988 - DNA, 22 bp, Homo sapiens
tggctgagctgcagcgtggctt

SEQ ID NO: 7073989 - DNA, 22 bp, Homo sapiens
tggctgagctgcagcgtggctt

SEQ ID NO: 7073990 - DNA, 22 bp, Homo sapiens
tggctgagctccctgtgtgttg

SEQ ID NO: 7073991 - DNA, 22 bp, Homo sapiens
tggctgagcctttggggctttc

SEQ ID NO: 7073992 - DNA, 22 bp, Homo sapiens
tggctgagctccctgtgtgttg

SEQ ID NO: 7073993 - DNA, 22 bp, Homo sapiens
tggctgagctgcagcgtggctt

SEQ ID NO: 7073994 - DNA, 22 bp, Homo sapiens
tggctgagctgcagcgtggctt

SEQ ID NO: 7073995 - DNA, 19 bp, Homo sapiens
tggctgagctggactgagg

SEQ ID NO: 7073996 - DNA, 19 bp, Homo sapiens
tggctgagctggactgagg

SEQ ID NO: 7073997 - DNA, 22 bp, Homo sapiens
tggctgaggcacagctgccgcc

SEQ ID NO: 7073998 - DNA, 22 bp, Homo sapiens
tggctgaggcacagctgccgcc

SEQ ID NO: 7073999 - DNA, 22 bp, Homo sapiens
tggctgaggcacagctgccgcc

SEQ ID NO: 7074000 - DNA, 22 bp, Homo sapiens
tggctgaggagggtcttctggt

SEQ ID NO: 7074001 - DNA, 22 bp, Homo sapiens
tggctgaggagggtcttctggt

SEQ ID NO: 7074002 - DNA, 22 bp, Homo sapiens
tggctgaggagggtcttctggt

SEQ ID NO: 7074003 - DNA, 22 bp, Homo sapiens
tggctgaggagagggcggaagt

SEQ ID NO: 7074004 - DNA, 19 bp, Homo sapiens
tggctgagctggactgagg

SEQ ID NO: 7074005 - DNA, 22 bp, Homo sapiens
tggctgaggagagggcggaagt

SEQ ID NO: 7074006 - DNA, 23 bp, Homo sapiens
tggctctgtggatccctcaggag

SEQ ID NO: 7074007 - DNA, 22 bp, Homo sapiens
tggctctgggcaccgtgtccac

SEQ ID NO: 7074008 - DNA, 22 bp, Homo sapiens
tggctctgttgtgctgagccag

SEQ ID NO: 7074009 - DNA, 22 bp, Homo sapiens
tggctctgctgaacctagtgca

SEQ ID NO: 7074010 - DNA, 22 bp, Homo sapiens
tggctctggagctcctgggccc

SEQ ID NO: 7074011 - DNA, 22 bp, Homo sapiens
tggctccttccgcagcatgcct

SEQ ID NO: 7074012 - DNA, 22 bp, Homo sapiens
tggctctcaatggctgtactat

SEQ ID NO: 7074013 - DNA, 22 bp, Homo sapiens
tggctggggagccccgactccc

SEQ ID NO: 7074014 - DNA, 22 bp, Homo sapiens
tggctggggccacagttttcct

SEQ ID NO: 7074015 - DNA, 22 bp, Homo sapiens
tggctggggcctgaatcctgca

SEQ ID NO: 7074016 - DNA, 22 bp, Homo sapiens
tggctgggccgggccttgtgcc

SEQ ID NO: 7074017 - DNA, 19 bp, Homo sapiens
tggctgggcgtgcctccgt

SEQ ID NO: 7074018 - DNA, 19 bp, Homo sapiens
tggctgggtgccaatggcc

SEQ ID NO: 7074019 - DNA, 22 bp, Homo sapiens
tggctgggggtgctatagctgc

SEQ ID NO: 7074020 - DNA, 19 bp, Homo sapiens
tggctgggtgccaatggcc

SEQ ID NO: 7074021 - DNA, 22 bp, Homo sapiens
tggctgggtgctatccagtact

SEQ ID NO: 7074022 - DNA, 22 bp, Homo sapiens
tggctgtggactcagatggctc

SEQ ID NO: 7074023 - DNA, 22 bp, Homo sapiens
tggctgtgggatatgtgactga

SEQ ID NO: 7074024 - DNA, 22 bp, Homo sapiens
tggctgtgttaccacttcatgt

SEQ ID NO: 7074025 - DNA, 22 bp, Homo sapiens
tggctgggcccccacctgcctc

SEQ ID NO: 7074026 - DNA, 22 bp, Homo sapiens
tggctgggagctggaactgggc

SEQ ID NO: 7074027 - DNA, 22 bp, Homo sapiens
tggctgggagctggaactgggc

SEQ ID NO: 7074028 - DNA, 22 bp, Homo sapiens
tggctggccctgggagtgcaga

SEQ ID NO: 7074029 - DNA, 22 bp, Homo sapiens
tggctggaatggagctgagcct

SEQ ID NO: 7074030 - DNA, 22 bp, Homo sapiens
tggctggacagtgggcagtgga

SEQ ID NO: 7074031 - DNA, 22 bp, Homo sapiens
tggctggagtctggtgctagcc

SEQ ID NO: 7074032 - DNA, 22 bp, Homo sapiens
tggctggattattggctagtac

SEQ ID NO: 7074033 - DNA, 22 bp, Homo sapiens
tggctggcaaggctggagtcag

SEQ ID NO: 7074034 - DNA, 22 bp, Homo sapiens
tggcttcactgctcaagtgatt

SEQ ID NO: 7074035 - DNA, 22 bp, Homo sapiens
tggcttcagagacagaatctat

SEQ ID NO: 7074036 - DNA, 17 bp, Homo sapiens
tggcttccctgggccac

SEQ ID NO: 7074037 - DNA, 22 bp, Homo sapiens
tggcttccgccgcgggcctcgg

SEQ ID NO: 7074038 - DNA, 22 bp, Homo sapiens
tggcttcctaggagcccgtgct

SEQ ID NO: 7074039 - DNA, 19 bp, Homo sapiens
tggcttcctgactctcatc

SEQ ID NO: 7074040 - DNA, 22 bp, Homo sapiens
tggcttcctgcatggatcctct

SEQ ID NO: 7074041 - DNA, 22 bp, Homo sapiens
tggcttcctggacagatgcggt

SEQ ID NO: 7074042 - DNA, 22 bp, Homo sapiens
tggcttcctgtgtaatgaggtg

SEQ ID NO: 7074043 - DNA, 22 bp, Homo sapiens
tggcttctctgtgtgagggaga

SEQ ID NO: 7074044 - DNA, 22 bp, Homo sapiens
tggcttctgagcattgaaacgt

SEQ ID NO: 7074045 - DNA, 22 bp, Homo sapiens
tggcttcttagaccagtggcct

SEQ ID NO: 7074046 - DNA, 22 bp, Homo sapiens
tggcttcttgggatgggtcatt

SEQ ID NO: 7074047 - DNA, 22 bp, Homo sapiens
tggctttcccccagcccagttg

SEQ ID NO: 7074048 - DNA, 22 bp, Homo sapiens
tggctttcgctatagagcacgg

SEQ ID NO: 7074049 - DNA, 21 bp, Homo sapiens
tggctttgccctgcttgcccc

SEQ ID NO: 7074050 - DNA, 22 bp, Homo sapiens
tgggaaagtgtagcctgcaggc

SEQ ID NO: 7074051 - DNA, 22 bp, Homo sapiens
tgggaaattgtatttctatttc

SEQ ID NO: 7074052 - DNA, 22 bp, Homo sapiens
tgggaacaacatgcactgccac

SEQ ID NO: 7074053 - DNA, 22 bp, Homo sapiens
tgggaacacctgctgcccagtg

SEQ ID NO: 7074054 - DNA, 22 bp, Homo sapiens
tgggaacattttgagctgagag

SEQ ID NO: 7074055 - DNA, 22 bp, Homo sapiens
tgggaagaagcagagaactgga

SEQ ID NO: 7074056 - DNA, 22 bp, Homo sapiens
tgggaagaagcagagaactgga

SEQ ID NO: 7074057 - DNA, 22 bp, Homo sapiens
tgggagaatcttgctctgctac

SEQ ID NO: 7074058 - DNA, 22 bp, Homo sapiens
tgggagacactggtgggagctt

SEQ ID NO: 7074059 - DNA, 23 bp, Homo sapiens
tgggagacttttcattttgttct

SEQ ID NO: 7074060 - DNA, 22 bp, Homo sapiens
tgggacttaatatgcccttgat

SEQ ID NO: 7074061 - DNA, 19 bp, Homo sapiens
tgggagaggcaacagagta

SEQ ID NO: 7074062 - DNA, 21 bp, Homo sapiens
tgggagagggctcagctaccc

SEQ ID NO: 7074063 - DNA, 22 bp, Homo sapiens
tgggagatggttctgagacttt

SEQ ID NO: 7074064 - DNA, 22 bp, Homo sapiens
tgggaggacttgtgggcttcat

SEQ ID NO: 7074065 - DNA, 22 bp, Homo sapiens
tgggaggcaggtaggtgatgat

SEQ ID NO: 7074066 - DNA, 22 bp, Homo sapiens
tgggaggatctcttgaggccag

SEQ ID NO: 7074067 - DNA, 22 bp, Homo sapiens
tgggagcaagctggtgctggag

SEQ ID NO: 7074068 - DNA, 22 bp, Homo sapiens
tgggagcaagctggtgctggag

SEQ ID NO: 7074069 - DNA, 22 bp, Homo sapiens
tgggagcaccctgaggagcttc

SEQ ID NO: 7074070 - DNA, 22 bp, Homo sapiens
tgggagcaccctgaggagcttc

SEQ ID NO: 7074071 - DNA, 22 bp, Homo sapiens
tgggagcaccttgagggcagaa

SEQ ID NO: 7074072 - DNA, 22 bp, Homo sapiens
tgggagcagccaacatggcctt

SEQ ID NO: 7074073 - DNA, 22 bp, Homo sapiens
tgggactcactcttttggccag

SEQ ID NO: 7074074 - DNA, 21 bp, Homo sapiens
tgggacagtgatggctcctcc

SEQ ID NO: 7074075 - DNA, 22 bp, Homo sapiens
tgggacagttgtcctccactct

SEQ ID NO: 7074076 - DNA, 22 bp, Homo sapiens
tgggacagttgtcctccactct

SEQ ID NO: 7074077 - DNA, 22 bp, Homo sapiens
tgggaattgaggtgattgtgag

SEQ ID NO: 7074078 - DNA, 23 bp, Homo sapiens
tgggaattgcagggggttctgcc

SEQ ID NO: 7074079 - DNA, 22 bp, Homo sapiens
tgggacacacaaggtcagctct

SEQ ID NO: 7074080 - DNA, 22 bp, Homo sapiens
tgggacaggttggagagaagca

SEQ ID NO: 7074081 - DNA, 22 bp, Homo sapiens
tgggacaggttggagagaagca

SEQ ID NO: 7074082 - DNA, 22 bp, Homo sapiens
tgggaaggtacacgggaaagag

SEQ ID NO: 7074083 - DNA, 22 bp, Homo sapiens
tgggaagggtcagtttcttcat

SEQ ID NO: 7074084 - DNA, 22 bp, Homo sapiens
tgggaagggtcaacagctggaa

SEQ ID NO: 7074085 - DNA, 22 bp, Homo sapiens
tgggaagggtcaacagctggaa

SEQ ID NO: 7074086 - DNA, 22 bp, Homo sapiens
tgggaagggtcaacagctggaa

SEQ ID NO: 7074087 - DNA, 22 bp, Homo sapiens
tgggaagggcctgcccttcctc

SEQ ID NO: 7074088 - DNA, 22 bp, Homo sapiens
tgggaaggggagctggaaagga

SEQ ID NO: 7074089 - DNA, 22 bp, Homo sapiens
tgggaaggggagctggaaagga

SEQ ID NO: 7074090 - DNA, 22 bp, Homo sapiens
tgggaagatggagtgacaggca

SEQ ID NO: 7074091 - DNA, 22 bp, Homo sapiens
tgggaagggagagtgtcctgga

SEQ ID NO: 7074092 - DNA, 22 bp, Homo sapiens
tgggaagggccgatggagcctc

SEQ ID NO: 7074093 - DNA, 22 bp, Homo sapiens
tggcagggtcttgctgtgttgc

SEQ ID NO: 7074094 - DNA, 22 bp, Homo sapiens
tggcagggtgccagttgcgagt

SEQ ID NO: 7074095 - DNA, 22 bp, Homo sapiens
tggcagggtcttgctgtgttgc

SEQ ID NO: 7074096 - DNA, 22 bp, Homo sapiens
tggcagggtgccagttgcgagt

SEQ ID NO: 7074097 - DNA, 23 bp, Homo sapiens
tggcagtgcccagggagatgatc

SEQ ID NO: 7074098 - DNA, 22 bp, Homo sapiens
tggcagtgccccttgaccagtg

SEQ ID NO: 7074099 - DNA, 22 bp, Homo sapiens
tggcagtgatgcggcaggacat

SEQ ID NO: 7074100 - DNA, 22 bp, Homo sapiens
tggcagtgatgcggcaggacat

SEQ ID NO: 7074101 - DNA, 18 bp, Homo sapiens
tggcagtgaggtaggcat

SEQ ID NO: 7074102 - DNA, 21 bp, Homo sapiens
tggcaggttcaaaggcctatc

SEQ ID NO: 7074103 - DNA, 22 bp, Homo sapiens
tggcagtcccctgtgcctggaa

SEQ ID NO: 7074104 - DNA, 22 bp, Homo sapiens
tggcagtctgggttggcagtta

SEQ ID NO: 7074105 - DNA, 22 bp, Homo sapiens
tggcatggaccttggaagaatt

SEQ ID NO: 7074106 - DNA, 17 bp, Homo sapiens
tggcatgagggtgtggg

SEQ ID NO: 7074107 - DNA, 22 bp, Homo sapiens
tggcatgagtataggcttctca

SEQ ID NO: 7074108 - DNA, 22 bp, Homo sapiens
tggcatgataggaggtgcagaa

SEQ ID NO: 7074109 - DNA, 22 bp, Homo sapiens
tggcatctccgacagtcttgat

SEQ ID NO: 7074110 - DNA, 22 bp, Homo sapiens
tggcatctttgtcccagaagct

SEQ ID NO: 7074111 - DNA, 22 bp, Homo sapiens
tggcatgaagtcagcagctggg

SEQ ID NO: 7074112 - DNA, 22 bp, Homo sapiens
tggcatggcatttagagaatta

SEQ ID NO: 7074113 - DNA, 22 bp, Homo sapiens
tggcatggctactggaatggcg

SEQ ID NO: 7074114 - DNA, 22 bp, Homo sapiens
tggcatgggccagggagagctg

SEQ ID NO: 7074115 - DNA, 22 bp, Homo sapiens
tggcagtggataggggagcggt

SEQ ID NO: 7074116 - DNA, 22 bp, Homo sapiens
tggcagtggataggggagcggt

SEQ ID NO: 7074117 - DNA, 22 bp, Homo sapiens
tggcagtgccccttgaccagtg

SEQ ID NO: 7074118 - DNA, 22 bp, Homo sapiens
tggcagtggctcagagtgcaga

SEQ ID NO: 7074119 - DNA, 22 bp, Homo sapiens
tggcagtggctcagagtgcaga

SEQ ID NO: 7074120 - DNA, 22 bp, Homo sapiens
tggcagtggctcagagtgcaga

SEQ ID NO: 7074121 - DNA, 22 bp, Homo sapiens
tggcagtgtttctaaggggctc

SEQ ID NO: 7074122 - DNA, 22 bp, Homo sapiens
tggcagtgtttctaaggggctc

SEQ ID NO: 7074123 - DNA, 23 bp, Homo sapiens
tggcatagtgaggggcacagaga

SEQ ID NO: 7074124 - DNA, 22 bp, Homo sapiens
tggccaggccggggacagaact

SEQ ID NO: 7074125 - DNA, 22 bp, Homo sapiens
tggccaggcattcagataagac

SEQ ID NO: 7074126 - DNA, 22 bp, Homo sapiens
tggccagcccttcagccatgcc

SEQ ID NO: 7074127 - DNA, 22 bp, Homo sapiens
tggccaggttgggctttgcagc

SEQ ID NO: 7074128 - DNA, 22 bp, Homo sapiens
tggccaggtgtgggttctcaga

SEQ ID NO: 7074129 - DNA, 19 bp, Homo sapiens
tggccaggtactgtctgct

SEQ ID NO: 7074130 - DNA, 23 bp, Homo sapiens
tggccaggtagaggaggtagtga

SEQ ID NO: 7074131 - DNA, 23 bp, Homo sapiens
tggccaggtagaggaggtagtga

SEQ ID NO: 7074132 - DNA, 22 bp, Homo sapiens
tggcatgggtggagagagcaca

SEQ ID NO: 7074133 - DNA, 22 bp, Homo sapiens
tggcattgcttctgaagtggag

SEQ ID NO: 7074134 - DNA, 22 bp, Homo sapiens
tggccacagtgtccagcagcag

SEQ ID NO: 7074135 - DNA, 22 bp, Homo sapiens
tggccaccaccaatacttgcct

SEQ ID NO: 7074136 - DNA, 22 bp, Homo sapiens
tggccaccaccaatacttgcct

SEQ ID NO: 7074137 - DNA, 22 bp, Homo sapiens
tggccacccctttctctgcact

SEQ ID NO: 7074138 - DNA, 22 bp, Homo sapiens
tggccagaacctgcagtaggcc

SEQ ID NO: 7074139 - DNA, 22 bp, Homo sapiens
tggccagacagagaggctttgt

SEQ ID NO: 7074140 - DNA, 22 bp, Homo sapiens
tggccatgaaggaggcagcaga

SEQ ID NO: 7074141 - DNA, 22 bp, Homo sapiens
tggcccagggagttcatggtgt

SEQ ID NO: 7074142 - DNA, 22 bp, Homo sapiens
tggccctgacacgtggtactgg

SEQ ID NO: 7074143 - DNA, 22 bp, Homo sapiens
tggccctgacaggtcctgggca

SEQ ID NO: 7074144 - DNA, 22 bp, Homo sapiens
tggccctgactgatgtggaggg

SEQ ID NO: 7074145 - DNA, 22 bp, Homo sapiens
tggccctgagggctcggagcca

SEQ ID NO: 7074146 - DNA, 22 bp, Homo sapiens
tggccctgaggggctgtgcccc

SEQ ID NO: 7074147 - DNA, 22 bp, Homo sapiens
tggccctgcacccagagcagtt

SEQ ID NO: 7074148 - DNA, 22 bp, Homo sapiens
tggccctgcagaactagcctgg

SEQ ID NO: 7074149 - DNA, 22 bp, Homo sapiens
tggccctgcagaactagcctgg

SEQ ID NO: 7074150 - DNA, 22 bp, Homo sapiens
tggcctggaagagaggtcgagg

SEQ ID NO: 7074151 - DNA, 22 bp, Homo sapiens
tggcctggaaaaatgcagatgg

SEQ ID NO: 7074152 - DNA, 22 bp, Homo sapiens
tggcctggaacctggcagggac

SEQ ID NO: 7074153 - DNA, 22 bp, Homo sapiens
tggcctggaacctggcagggac

SEQ ID NO: 7074154 - DNA, 22 bp, Homo sapiens
tggcctggaaaaatgcagatgg

SEQ ID NO: 7074155 - DNA, 22 bp, Homo sapiens
tggcctggaaaaatgcagatgg

SEQ ID NO: 7074156 - DNA, 22 bp, Homo sapiens
tggcctggaaaaatgcagatgg

SEQ ID NO: 7074157 - DNA, 22 bp, Homo sapiens
tggcctggaagagaggtcgagg

SEQ ID NO: 7074158 - DNA, 18 bp, Homo sapiens
tggcctggagacaactct

SEQ ID NO: 7074159 - DNA, 23 bp, Homo sapiens
tggcctggagagaaaagatgagt

SEQ ID NO: 7074160 - DNA, 22 bp, Homo sapiens
tggcctggcagagcaaggcctg

SEQ ID NO: 7074161 - DNA, 22 bp, Homo sapiens
tggcctggccacatccagcagg

SEQ ID NO: 7074162 - DNA, 22 bp, Homo sapiens
tggcctggccacatccagcagg

SEQ ID NO: 7074163 - DNA, 22 bp, Homo sapiens
tggcctcaaccgtcctaagcac

SEQ ID NO: 7074164 - DNA, 22 bp, Homo sapiens
tggccctgtgtgcaggctgcac

SEQ ID NO: 7074165 - DNA, 22 bp, Homo sapiens
tggccctgtgtcctgctgccag

SEQ ID NO: 7074166 - DNA, 22 bp, Homo sapiens
tggccctgtggaggtcagtgag

SEQ ID NO: 7074167 - DNA, 22 bp, Homo sapiens
tggccctgtggcttcagaacag

SEQ ID NO: 7074168 - DNA, 22 bp, Homo sapiens
tggccctgtgtcctgctgccag

SEQ ID NO: 7074169 - DNA, 22 bp, Homo sapiens
tggccctgttctgtacctcata

SEQ ID NO: 7074170 - DNA, 20 bp, Homo sapiens
tggccctgttttctccaggc

SEQ ID NO: 7074171 - DNA, 22 bp, Homo sapiens
tggcccttgtcctgggagagtt

SEQ ID NO: 7074172 - DNA, 22 bp, Homo sapiens
tggccctgccactcactgctga

SEQ ID NO: 7074173 - DNA, 22 bp, Homo sapiens
tggccctgccctcttcatcttt

SEQ ID NO: 7074174 - DNA, 22 bp, Homo sapiens
tggccctgggtggaatgtccca

SEQ ID NO: 7074175 - DNA, 22 bp, Homo sapiens
tggccctggtggcacagcctgc

SEQ ID NO: 7074176 - DNA, 22 bp, Homo sapiens
tggccctgtcctcatttcatct

SEQ ID NO: 7074177 - DNA, 22 bp, Homo sapiens
tggccctgtcctcatttcatct

SEQ ID NO: 7074178 - DNA, 22 bp, Homo sapiens
tggccctgtgactgagttctag

SEQ ID NO: 7074179 - DNA, 22 bp, Homo sapiens
tggcaggatctttgagagtgaa

SEQ ID NO: 7074180 - DNA, 22 bp, Homo sapiens
tggcaggatctttgagagtgaa

SEQ ID NO: 7074181 - DNA, 22 bp, Homo sapiens
tggcaggaggttttctccagga

SEQ ID NO: 7074182 - DNA, 20 bp, Homo sapiens
tggcaggaggcagcagtgga

SEQ ID NO: 7074183 - DNA, 20 bp, Homo sapiens
tggcaggaggcagcagtgga

SEQ ID NO: 7074184 - DNA, 22 bp, Homo sapiens
tggcaggaggatgaggcggcta

SEQ ID NO: 7074185 - DNA, 22 bp, Homo sapiens
tggcaggaggatgaggcggcta

SEQ ID NO: 7074186 - DNA, 22 bp, Homo sapiens
tggcaggaggatgaggcggcta

SEQ ID NO: 7074187 - DNA, 20 bp, Homo sapiens
tggcaggaatagggccagag

SEQ ID NO: 7074188 - DNA, 22 bp, Homo sapiens
tggcaggaaggagactcagccc

SEQ ID NO: 7074189 - DNA, 20 bp, Homo sapiens
tggcaggaatagggccagag

SEQ ID NO: 7074190 - DNA, 20 bp, Homo sapiens
tggcaggactggctccaccc

SEQ ID NO: 7074191 - DNA, 22 bp, Homo sapiens
tggcaggagacacatggcatag

SEQ ID NO: 7074192 - DNA, 22 bp, Homo sapiens
tggcaggagacacatggcatag

SEQ ID NO: 7074193 - DNA, 18 bp, Homo sapiens
tggcaggaaatgcacttt

SEQ ID NO: 7074194 - DNA, 22 bp, Homo sapiens
tggcaggaaataccctgcctag

SEQ ID NO: 7074195 - DNA, 22 bp, Homo sapiens
tggcaggaaagtaacagagcac

SEQ ID NO: 7074196 - DNA, 22 bp, Homo sapiens
tggcaggaaagtaacagagcac

SEQ ID NO: 7074197 - DNA, 22 bp, Homo sapiens
tggcaggaaataccctgcctag

SEQ ID NO: 7074198 - DNA, 22 bp, Homo sapiens
tggcaggaaccaggaggctctc

SEQ ID NO: 7074199 - DNA, 22 bp, Homo sapiens
tggcaggaaccttaaccacaaa

SEQ ID NO: 7074200 - DNA, 22 bp, Homo sapiens
tggcaggaagacgtggggcacc

SEQ ID NO: 7074201 - DNA, 22 bp, Homo sapiens
tggcagctgaggggaggctttg

SEQ ID NO: 7074202 - DNA, 22 bp, Homo sapiens
tggcagctgattagatggtgcc

SEQ ID NO: 7074203 - DNA, 22 bp, Homo sapiens
tggcaggaaagtaacagagcac

SEQ ID NO: 7074204 - DNA, 22 bp, Homo sapiens
tggcagggagccaccggtcatg

SEQ ID NO: 7074205 - DNA, 22 bp, Homo sapiens
tggcagggagccaccggtcatg

SEQ ID NO: 7074206 - DNA, 18 bp, Homo sapiens
tggcagggaggaaatata

SEQ ID NO: 7074207 - DNA, 19 bp, Homo sapiens
tggcagggagtgatattag

SEQ ID NO: 7074208 - DNA, 22 bp, Homo sapiens
tggcagggagttcgttcacaac

SEQ ID NO: 7074209 - DNA, 22 bp, Homo sapiens
tggcagggagttcgttcacaac

SEQ ID NO: 7074210 - DNA, 22 bp, Homo sapiens
tggcagggagttgcaggatttc

SEQ ID NO: 7074211 - DNA, 22 bp, Homo sapiens
tggcaggggaggtgcttgctta

SEQ ID NO: 7074212 - DNA, 22 bp, Homo sapiens
tggcaggggaggtgcttgctta

SEQ ID NO: 7074213 - DNA, 18 bp, Homo sapiens
tggcaggggcagtacgcc

SEQ ID NO: 7074214 - DNA, 21 bp, Homo sapiens
tggcaggggtagtagtacagc

SEQ ID NO: 7074215 - DNA, 22 bp, Homo sapiens
tggcagggtacaccttaacacc

SEQ ID NO: 7074216 - DNA, 21 bp, Homo sapiens
tggcaggggtagtagtacagc

SEQ ID NO: 7074217 - DNA, 22 bp, Homo sapiens
tggcagctacagacagaggtga

SEQ ID NO: 7074218 - DNA, 22 bp, Homo sapiens
tggcagcattttttccagaaca

SEQ ID NO: 7074219 - DNA, 22 bp, Homo sapiens
tggcagcagacatctgaggtct

SEQ ID NO: 7074220 - DNA, 22 bp, Homo sapiens
tggcagcagccatggaaggccc

SEQ ID NO: 7074221 - DNA, 18 bp, Homo sapiens
tggcagcaggaagccatt

SEQ ID NO: 7074222 - DNA, 22 bp, Homo sapiens
tggcagcagtagccaccccagc

SEQ ID NO: 7074223 - DNA, 22 bp, Homo sapiens
tggcagcagtggaggtagaaag

SEQ ID NO: 7074224 - DNA, 22 bp, Homo sapiens
tggcagcatgttatgtaaggaa

SEQ ID NO: 7074225 - DNA, 22 bp, Homo sapiens
tggcagagtaggatggccctgt

SEQ ID NO: 7074226 - DNA, 22 bp, Homo sapiens
tggcagagtaggatggccctgt

SEQ ID NO: 7074227 - DNA, 22 bp, Homo sapiens
tggcagagtaggatggccctgt

SEQ ID NO: 7074228 - DNA, 22 bp, Homo sapiens
tggcagagtcatcacatctgga

SEQ ID NO: 7074229 - DNA, 22 bp, Homo sapiens
tggcagagtcatcacatctgga

SEQ ID NO: 7074230 - DNA, 22 bp, Homo sapiens
tggcagagtctctcctttccag

SEQ ID NO: 7074231 - DNA, 22 bp, Homo sapiens
tggcagagtctctcctttccag

SEQ ID NO: 7074232 - DNA, 22 bp, Homo sapiens
tggcagagtctgggcttgggca

SEQ ID NO: 7074233 - DNA, 22 bp, Homo sapiens
tggcagagtctgggcttgggca

SEQ ID NO: 7074234 - DNA, 22 bp, Homo sapiens
tggcagagtgcagaagaggcat

SEQ ID NO: 7074235 - DNA, 22 bp, Homo sapiens
tggcagagtgcagaagaggcat

SEQ ID NO: 7074236 - DNA, 22 bp, Homo sapiens
tggcagagtgcagaagaggcat

SEQ ID NO: 7074237 - DNA, 22 bp, Homo sapiens
tggcagagtgcagaagaggcat

SEQ ID NO: 7074238 - DNA, 21 bp, Homo sapiens
tggcagagtgcagtctataca

SEQ ID NO: 7074239 - DNA, 21 bp, Homo sapiens
tggcagagtgcagtctataca

SEQ ID NO: 7074240 - DNA, 21 bp, Homo sapiens
tggcagagtgcagtctataca

SEQ ID NO: 7074241 - DNA, 22 bp, Homo sapiens
tggcagagtgcggcatcccctg

SEQ ID NO: 7074242 - DNA, 22 bp, Homo sapiens
tggcagagtgcggcatcccctg

SEQ ID NO: 7074243 - DNA, 22 bp, Homo sapiens
tggcagagtggaccatactcaa

SEQ ID NO: 7074244 - DNA, 22 bp, Homo sapiens
tggcagagtggaccatactcaa

SEQ ID NO: 7074245 - DNA, 22 bp, Homo sapiens
tggcagagtggaccatactcaa

SEQ ID NO: 7074246 - DNA, 22 bp, Homo sapiens
tggcagagtggaccatactcaa

SEQ ID NO: 7074247 - DNA, 18 bp, Homo sapiens
tggcagagtgtctgttct

SEQ ID NO: 7074248 - DNA, 18 bp, Homo sapiens
tggcagagtgtctgttct

SEQ ID NO: 7074249 - DNA, 22 bp, Homo sapiens
tggcagagttatgggtatttat

SEQ ID NO: 7074250 - DNA, 22 bp, Homo sapiens
tggcagagttcgctcctattca

SEQ ID NO: 7074251 - DNA, 22 bp, Homo sapiens
tggcagagttcgctgtgccttt

SEQ ID NO: 7074252 - DNA, 22 bp, Homo sapiens
tggcagagttcgctgtgccttt

SEQ ID NO: 7074253 - DNA, 22 bp, Homo sapiens
tggcagagttcgctgtgccttt

SEQ ID NO: 7074254 - DNA, 21 bp, Homo sapiens
tggcagagttgagtagttatg

SEQ ID NO: 7074255 - DNA, 22 bp, Homo sapiens
tggcagagttggaggtggaaga

SEQ ID NO: 7074256 - DNA, 20 bp, Homo sapiens
tggcagagttgtcccaccca

SEQ ID NO: 7074257 - DNA, 20 bp, Homo sapiens
tggcagagttgtcccaccca

SEQ ID NO: 7074258 - DNA, 20 bp, Homo sapiens
tggcagagttgtcccaccca

SEQ ID NO: 7074259 - DNA, 22 bp, Homo sapiens
tggcagagcccagaactgagca

SEQ ID NO: 7074260 - DNA, 22 bp, Homo sapiens
tggcagagcaaaaagatagaat

SEQ ID NO: 7074261 - DNA, 22 bp, Homo sapiens
tggcagagatgaagagttgttt

SEQ ID NO: 7074262 - DNA, 22 bp, Homo sapiens
tggcagagcccagaactgagca

SEQ ID NO: 7074263 - DNA, 22 bp, Homo sapiens
tggcagagcccagactccagtc

SEQ ID NO: 7074264 - DNA, 22 bp, Homo sapiens
tggcagagcccagactccagtc

SEQ ID NO: 7074265 - DNA, 22 bp, Homo sapiens
tggcagagcccagactccagtc

SEQ ID NO: 7074266 - DNA, 22 bp, Homo sapiens
tggcagagccttgccaaactcc

SEQ ID NO: 7074267 - DNA, 22 bp, Homo sapiens
tggcagagctggctgcggatga

SEQ ID NO: 7074268 - DNA, 22 bp, Homo sapiens
tggcagaggaaaaagtcactgg

SEQ ID NO: 7074269 - DNA, 22 bp, Homo sapiens
tggcagaggaaaaagtcactgg

SEQ ID NO: 7074270 - DNA, 16 bp, Homo sapiens
tggcagaggttcagcc

SEQ ID NO: 7074271 - DNA, 22 bp, Homo sapiens
tggcagagaacacggctgatct

SEQ ID NO: 7074272 - DNA, 22 bp, Homo sapiens
tggcagagaacacggctgatct

SEQ ID NO: 7074273 - DNA, 22 bp, Homo sapiens
tggcagagaacctgggctttgt

SEQ ID NO: 7074274 - DNA, 22 bp, Homo sapiens
tggcagagaacctgggctttgt

SEQ ID NO: 7074275 - DNA, 22 bp, Homo sapiens
tggcagagaataaatcttgact

SEQ ID NO: 7074276 - DNA, 22 bp, Homo sapiens
tggcagagaataaatcttgact

SEQ ID NO: 7074277 - DNA, 22 bp, Homo sapiens
tggcagagacaaggccgggcct

SEQ ID NO: 7074278 - DNA, 22 bp, Homo sapiens
tggcagagacaaggccgggcct

SEQ ID NO: 7074279 - DNA, 22 bp, Homo sapiens
tggcagagacaaggccgggcct

SEQ ID NO: 7074280 - DNA, 23 bp, Homo sapiens
tggcagagacccagaatctacat

SEQ ID NO: 7074281 - DNA, 23 bp, Homo sapiens
tggcagagacccagaatctacat

SEQ ID NO: 7074282 - DNA, 22 bp, Homo sapiens
tggcagagactcctcctgggag

SEQ ID NO: 7074283 - DNA, 22 bp, Homo sapiens
tggcagagactcctcctgggag

SEQ ID NO: 7074284 - DNA, 22 bp, Homo sapiens
tggcagagactcctcctgggag

SEQ ID NO: 7074285 - DNA, 22 bp, Homo sapiens
tggcagagagactctccttgat

SEQ ID NO: 7074286 - DNA, 22 bp, Homo sapiens
tggcagagagactctccttgat

SEQ ID NO: 7074287 - DNA, 22 bp, Homo sapiens
tggcagagagactctccttgat

SEQ ID NO: 7074288 - DNA, 22 bp, Homo sapiens
tggcagagagagtgcagtcgac

SEQ ID NO: 7074289 - DNA, 22 bp, Homo sapiens
tggcagagagagtgcagtcgac

SEQ ID NO: 7074290 - DNA, 22 bp, Homo sapiens
tggcactatggatgagactgat

SEQ ID NO: 7074291 - DNA, 22 bp, Homo sapiens
tggcactgaaaaaggagaggtt

SEQ ID NO: 7074292 - DNA, 22 bp, Homo sapiens
tggcactgaagctggaaagcct

SEQ ID NO: 7074293 - DNA, 22 bp, Homo sapiens
tggcactgaagctggaaagcct

SEQ ID NO: 7074294 - DNA, 22 bp, Homo sapiens
tggcactgacagggtgctcaag

SEQ ID NO: 7074295 - DNA, 22 bp, Homo sapiens
tggcactgaccccaggcctgtg

SEQ ID NO: 7074296 - DNA, 22 bp, Homo sapiens
tggcactgaccccaggcctgtg

SEQ ID NO: 7074297 - DNA, 22 bp, Homo sapiens
tggcactgccaacctgctaggt

SEQ ID NO: 7074298 - DNA, 22 bp, Homo sapiens
tggcactgccaacctgctaggt

SEQ ID NO: 7074299 - DNA, 22 bp, Homo sapiens
tggcactggaatcgtagccttg

SEQ ID NO: 7074300 - DNA, 22 bp, Homo sapiens
tggcactgggacagatgctctc

SEQ ID NO: 7074301 - DNA, 22 bp, Homo sapiens
tggcactgtagccactactgcc

SEQ ID NO: 7074302 - DNA, 22 bp, Homo sapiens
tggcactgtcaccaatgctgtc

SEQ ID NO: 7074303 - DNA, 22 bp, Homo sapiens
tggcactgtcaccaatgctgtc

SEQ ID NO: 7074304 - DNA, 22 bp, Homo sapiens
tggcagagaacacggctgatct

SEQ ID NO: 7074305 - DNA, 22 bp, Homo sapiens
tggcaaagtatctgtcccagct

SEQ ID NO: 7074306 - DNA, 22 bp, Homo sapiens
tggcaaaggaaatgatttaaga

SEQ ID NO: 7074307 - DNA, 22 bp, Homo sapiens
tggcaaaggcgctcacatgcct

SEQ ID NO: 7074308 - DNA, 22 bp, Homo sapiens
tggatgtgagaaggatcaggct

SEQ ID NO: 7074309 - DNA, 22 bp, Homo sapiens
tggattcacaccattctcctgc

SEQ ID NO: 7074310 - DNA, 22 bp, Homo sapiens
tggattcacaccattctcctgc

SEQ ID NO: 7074311 - DNA, 20 bp, Homo sapiens
tggattctggagctgccctc

SEQ ID NO: 7074312 - DNA, 22 bp, Homo sapiens
tggattgataaaatgggatgtt

SEQ ID NO: 7074313 - DNA, 22 bp, Homo sapiens
tggattgataagagacaagtga

SEQ ID NO: 7074314 - DNA, 17 bp, Homo sapiens
tggcacagaggtgctat

SEQ ID NO: 7074315 - DNA, 21 bp, Homo sapiens
tggcacagcaagtgggctcat

SEQ ID NO: 7074316 - DNA, 17 bp, Homo sapiens
tggcacagaggtgctat

SEQ ID NO: 7074317 - DNA, 22 bp, Homo sapiens
tggcaattgtccactgtctgcc

SEQ ID NO: 7074318 - DNA, 22 bp, Homo sapiens
tggcacacagagaagacacttg

SEQ ID NO: 7074319 - DNA, 22 bp, Homo sapiens
tggcacagaaaaatgctccatt

SEQ ID NO: 7074320 - DNA, 22 bp, Homo sapiens
tggcacagacagatcaggagtc

SEQ ID NO: 7074321 - DNA, 22 bp, Homo sapiens
tggcacagacagatcaggagtc

SEQ ID NO: 7074322 - DNA, 22 bp, Homo sapiens
tggcacagacagcacagcaatg

SEQ ID NO: 7074323 - DNA, 22 bp, Homo sapiens
tggcacagacatttaatagcct

SEQ ID NO: 7074324 - DNA, 22 bp, Homo sapiens
tgctttaaaatggactgttttg

SEQ ID NO: 7074325 - DNA, 22 bp, Homo sapiens
tgcttgtgagagttttttcaga

SEQ ID NO: 7074326 - DNA, 22 bp, Homo sapiens
tgctttaaccatcttgtttgga

SEQ ID NO: 7074327 - DNA, 22 bp, Homo sapiens
tgctttaacgctgagggtctca

SEQ ID NO: 7074328 - DNA, 22 bp, Homo sapiens
tgcttgaaaggggtttcccagt

SEQ ID NO: 7074329 - DNA, 17 bp, Homo sapiens
tgcttgactctcttgtt

SEQ ID NO: 7074330 - DNA, 22 bp, Homo sapiens
tgcttgacttagtttctcattt

SEQ ID NO: 7074331 - DNA, 19 bp, Homo sapiens
tgcttgcctgcctttccca

SEQ ID NO: 7074332 - DNA, 22 bp, Homo sapiens
tgcttctggaaacagtggctgt

SEQ ID NO: 7074333 - DNA, 19 bp, Homo sapiens
tgcttctggaatgcaaggc

SEQ ID NO: 7074334 - DNA, 22 bp, Homo sapiens
tgcttctggcttatctcgtgcc

SEQ ID NO: 7074335 - DNA, 22 bp, Homo sapiens
tgcttctgggcaaatgtgtgtg

SEQ ID NO: 7074336 - DNA, 19 bp, Homo sapiens
tgcttctggggcttctcca

SEQ ID NO: 7074337 - DNA, 22 bp, Homo sapiens
tgcttctgggtaggcctcagga

SEQ ID NO: 7074338 - DNA, 22 bp, Homo sapiens
tgcttctgggtaggcctcagga

SEQ ID NO: 7074339 - DNA, 22 bp, Homo sapiens
tgcttctgggtcccagcctggc

SEQ ID NO: 7074340 - DNA, 17 bp, Homo sapiens
tgcttctgtattgctgg

SEQ ID NO: 7074341 - DNA, 22 bp, Homo sapiens
tgcttctgtctcttatgccttg

SEQ ID NO: 7074342 - DNA, 22 bp, Homo sapiens
tgcttctgttctttcacctacg

SEQ ID NO: 7074343 - DNA, 22 bp, Homo sapiens
tgcttctgtttcattgatctta

SEQ ID NO: 7074344 - DNA, 22 bp, Homo sapiens
tgcttctgtttgtttctgtcat

SEQ ID NO: 7074345 - DNA, 22 bp, Homo sapiens
tgcttctttactataggcaatt

SEQ ID NO: 7074346 - DNA, 18 bp, Homo sapiens
tgctttatgcttatataa

SEQ ID NO: 7074347 - DNA, 22 bp, Homo sapiens
tgctttctctctaccccacttt

SEQ ID NO: 7074348 - DNA, 17 bp, Homo sapiens
tgctttcttcctgccct

SEQ ID NO: 7074349 - DNA, 22 bp, Homo sapiens
tgctttctttagctcctgagtc

SEQ ID NO: 7074350 - DNA, 22 bp, Homo sapiens
tgctttttagtactgtcttatt

SEQ ID NO: 7074351 - DNA, 19 bp, Homo sapiens
tgctttgctcttggactca

SEQ ID NO: 7074352 - DNA, 22 bp, Homo sapiens
tgctttggatctatttgctgag

SEQ ID NO: 7074353 - DNA, 22 bp, Homo sapiens
tgctttggccactagaattcag

SEQ ID NO: 7074354 - DNA, 22 bp, Homo sapiens
tgctttgggtctctctagtttc

SEQ ID NO: 7074355 - DNA, 22 bp, Homo sapiens
tgctttgtgacagattagtttt

SEQ ID NO: 7074356 - DNA, 22 bp, Homo sapiens
tggaaagagaaactcttgctaa

SEQ ID NO: 7074357 - DNA, 22 bp, Homo sapiens
tggaaagaggtagaggatctgg

SEQ ID NO: 7074358 - DNA, 22 bp, Homo sapiens
tggaaagaggtagaggatctgg

SEQ ID NO: 7074359 - DNA, 22 bp, Homo sapiens
tggaaacactcaagcttatatt

SEQ ID NO: 7074360 - DNA, 22 bp, Homo sapiens
tggaaaatcaggggacattgat

SEQ ID NO: 7074361 - DNA, 21 bp, Homo sapiens
tggaaaacatttaaatagcaa

SEQ ID NO: 7074362 - DNA, 22 bp, Homo sapiens
tggaaatgtttcttgagctcag

SEQ ID NO: 7074363 - DNA, 22 bp, Homo sapiens
tggaacctggcctgagctacca

SEQ ID NO: 7074364 - DNA, 22 bp, Homo sapiens
tggaaatggatctgatgagtct

SEQ ID NO: 7074365 - DNA, 22 bp, Homo sapiens
tggaaatacttgccataaaact

SEQ ID NO: 7074366 - DNA, 22 bp, Homo sapiens
tggaaatatacaatgtgtctct

SEQ ID NO: 7074367 - DNA, 22 bp, Homo sapiens
tggaaaggaggcttgtggaata

SEQ ID NO: 7074368 - DNA, 22 bp, Homo sapiens
tggaaaggacagttgctgatag

SEQ ID NO: 7074369 - DNA, 22 bp, Homo sapiens
tggaagcagtgattcttgtctg

SEQ ID NO: 7074370 - DNA, 22 bp, Homo sapiens
tggaagcatcacttcttgcctg

SEQ ID NO: 7074371 - DNA, 22 bp, Homo sapiens
tggaagcacttgggttttgttg

SEQ ID NO: 7074372 - DNA, 22 bp, Homo sapiens
tggaagcgagacagagatctcc

SEQ ID NO: 7074373 - DNA, 22 bp, Homo sapiens
tggaagcggacgttgtggggtg

SEQ ID NO: 7074374 - DNA, 22 bp, Homo sapiens
tggaagcggtgctggcccatgg

SEQ ID NO: 7074375 - DNA, 18 bp, Homo sapiens
tggaagctggtgagcaga

SEQ ID NO: 7074376 - DNA, 17 bp, Homo sapiens
tggaagcttcatgttgg

SEQ ID NO: 7074377 - DNA, 22 bp, Homo sapiens
tggaaggaaaggtagcagagaa

SEQ ID NO: 7074378 - DNA, 22 bp, Homo sapiens
tggaaggaagccaaggaaggtt

SEQ ID NO: 7074379 - DNA, 22 bp, Homo sapiens
tggaagagaaaatccaccctta

SEQ ID NO: 7074380 - DNA, 22 bp, Homo sapiens
tggaagagaaaggagtggatct

SEQ ID NO: 7074381 - DNA, 22 bp, Homo sapiens
tggaagagacacttacattcag

SEQ ID NO: 7074382 - DNA, 22 bp, Homo sapiens
tggaagagcaggcagacaatgc

SEQ ID NO: 7074383 - DNA, 19 bp, Homo sapiens
tggaagaggaagggaaata

SEQ ID NO: 7074384 - DNA, 19 bp, Homo sapiens
tggaagaggaagggaaata

SEQ ID NO: 7074385 - DNA, 22 bp, Homo sapiens
tggaagaggccagaaagtggga

SEQ ID NO: 7074386 - DNA, 22 bp, Homo sapiens
tggaagagggagctgggtggcc

SEQ ID NO: 7074387 - DNA, 22 bp, Homo sapiens
tggaagagggagctgggtggcc

SEQ ID NO: 7074388 - DNA, 22 bp, Homo sapiens
tggaagaggtggaagtggcttc

SEQ ID NO: 7074389 - DNA, 23 bp, Homo sapiens
tggaataataaggtacattaaca

SEQ ID NO: 7074390 - DNA, 20 bp, Homo sapiens
tggaataagttaagttgttt

SEQ ID NO: 7074391 - DNA, 23 bp, Homo sapiens
tggaataataaggtacattaaca

SEQ ID NO: 7074392 - DNA, 22 bp, Homo sapiens
tggaatagaggtgctgatatta

SEQ ID NO: 7074393 - DNA, 22 bp, Homo sapiens
tggaatctgtatgtatgtataa

SEQ ID NO: 7074394 - DNA, 22 bp, Homo sapiens
tggaagtgctcttctgaccaac

SEQ ID NO: 7074395 - DNA, 22 bp, Homo sapiens
tggaagtggcagaaaatgaaca

SEQ ID NO: 7074396 - DNA, 22 bp, Homo sapiens
tggaagtggcagaaaatgaaca

SEQ ID NO: 7074397 - DNA, 20 bp, Homo sapiens
tggaagttctgttgcattgg

SEQ ID NO: 7074398 - DNA, 22 bp, Homo sapiens
tggaataactcaccaaggtcat

SEQ ID NO: 7074399 - DNA, 22 bp, Homo sapiens
tggaataactcaccaaggtcat

SEQ ID NO: 7074400 - DNA, 22 bp, Homo sapiens
tggaagggggaagacagctctg

SEQ ID NO: 7074401 - DNA, 22 bp, Homo sapiens
tggaaggggttacgcagcagga

SEQ ID NO: 7074402 - DNA, 22 bp, Homo sapiens
tggaagggagtgacagtcagag

SEQ ID NO: 7074403 - DNA, 22 bp, Homo sapiens
tggaagggagtgacagtcagag

SEQ ID NO: 7074404 - DNA, 22 bp, Homo sapiens
tggaaggaagccaaggaaggtt

SEQ ID NO: 7074405 - DNA, 22 bp, Homo sapiens
tggaaggagactgggaagtgtg

SEQ ID NO: 7074406 - DNA, 22 bp, Homo sapiens
tggaaggagactgggaagtgtg

SEQ ID NO: 7074407 - DNA, 22 bp, Homo sapiens
tggaaggagctaaggacctggg

SEQ ID NO: 7074408 - DNA, 22 bp, Homo sapiens
tggaaggagctaaggacctggg

SEQ ID NO: 7074409 - DNA, 22 bp, Homo sapiens
tggaaggagctaaggacctggg

SEQ ID NO: 7074410 - DNA, 22 bp, Homo sapiens
tggacaacatagtgagacctca

SEQ ID NO: 7074411 - DNA, 22 bp, Homo sapiens
tggaatggaaacaaactgagga

SEQ ID NO: 7074412 - DNA, 22 bp, Homo sapiens
tggaatggaaacaaactgagga

SEQ ID NO: 7074413 - DNA, 22 bp, Homo sapiens
tggaatgccgggccaggctccg

SEQ ID NO: 7074414 - DNA, 22 bp, Homo sapiens
tggaatggaaacaaactgagga

SEQ ID NO: 7074415 - DNA, 22 bp, Homo sapiens
tggaatgcatggctctgtgacg

SEQ ID NO: 7074416 - DNA, 21 bp, Homo sapiens
tggaatgaggctgagcagtgc

SEQ ID NO: 7074417 - DNA, 22 bp, Homo sapiens
tggaatgaatatgttttaagga

SEQ ID NO: 7074418 - DNA, 22 bp, Homo sapiens
tggaatgacaagttgttcagag

SEQ ID NO: 7074419 - DNA, 22 bp, Homo sapiens
tggaatgacagagagtctgaat

SEQ ID NO: 7074420 - DNA, 22 bp, Homo sapiens
tggaatgacagagagtctgaat

SEQ ID NO: 7074421 - DNA, 22 bp, Homo sapiens
tggaatgacagagagtctgaat

SEQ ID NO: 7074422 - DNA, 18 bp, Homo sapiens
tggacacatggcctgggt

SEQ ID NO: 7074423 - DNA, 22 bp, Homo sapiens
tggacacaatgttgccttaggg

SEQ ID NO: 7074424 - DNA, 22 bp, Homo sapiens
tggacacacatgtatgtcagag

SEQ ID NO: 7074425 - DNA, 22 bp, Homo sapiens
tggacaggatagtgcagtacgc

SEQ ID NO: 7074426 - DNA, 22 bp, Homo sapiens
tggacagcttgcagagccaccc

SEQ ID NO: 7074427 - DNA, 22 bp, Homo sapiens
tggacaggatctgagactgaga

SEQ ID NO: 7074428 - DNA, 22 bp, Homo sapiens
tggacaggcaagcaagacatac

SEQ ID NO: 7074429 - DNA, 20 bp, Homo sapiens
tggaccataaacaccaggta

SEQ ID NO: 7074430 - DNA, 22 bp, Homo sapiens
tggaccatgagctgcaggtgtt

SEQ ID NO: 7074431 - DNA, 22 bp, Homo sapiens
tggacaggtgagtgactcaggg

SEQ ID NO: 7074432 - DNA, 18 bp, Homo sapiens
tggacagggtggagaaaa

SEQ ID NO: 7074433 - DNA, 22 bp, Homo sapiens
tggacagggcagagaccgagtc

SEQ ID NO: 7074434 - DNA, 22 bp, Homo sapiens
tggacagggcagagaccgagtc

SEQ ID NO: 7074435 - DNA, 22 bp, Homo sapiens
tggacaggctcctaggggttcc

SEQ ID NO: 7074436 - DNA, 22 bp, Homo sapiens
tggactctatgatgcgccagca

SEQ ID NO: 7074437 - DNA, 18 bp, Homo sapiens
tggagccattgccaccat

SEQ ID NO: 7074438 - DNA, 22 bp, Homo sapiens
tggagcccaggagaggataaac

SEQ ID NO: 7074439 - DNA, 22 bp, Homo sapiens
tggagcccagggtgagaaggag

SEQ ID NO: 7074440 - DNA, 18 bp, Homo sapiens
tggagctgagtgctgtgc

SEQ ID NO: 7074441 - DNA, 18 bp, Homo sapiens
tggagctgagtgctgtgc

SEQ ID NO: 7074442 - DNA, 22 bp, Homo sapiens
tggagctgatacagctggcttt

SEQ ID NO: 7074443 - DNA, 22 bp, Homo sapiens
tggagctgatacagctggcttt

SEQ ID NO: 7074444 - DNA, 17 bp, Homo sapiens
tggagctgcgtgtgttc

SEQ ID NO: 7074445 - DNA, 22 bp, Homo sapiens
tggagctggaatttctgggcct

SEQ ID NO: 7074446 - DNA, 22 bp, Homo sapiens
tggagctggaatttgagctgga

SEQ ID NO: 7074447 - DNA, 22 bp, Homo sapiens
tggagctggaatttgagctgga

SEQ ID NO: 7074448 - DNA, 22 bp, Homo sapiens
tggagctggcttgtggaagttg

SEQ ID NO: 7074449 - DNA, 22 bp, Homo sapiens
tggagctgggagtcctgggctg

SEQ ID NO: 7074450 - DNA, 22 bp, Homo sapiens
tggagccagcggcctgctgagg

SEQ ID NO: 7074451 - DNA, 22 bp, Homo sapiens
tggagccagcccaggcccctct

SEQ ID NO: 7074452 - DNA, 22 bp, Homo sapiens
tggagccaatgaacatttgctg

SEQ ID NO: 7074453 - DNA, 18 bp, Homo sapiens
tggagcaggaagcctggc

SEQ ID NO: 7074454 - DNA, 22 bp, Homo sapiens
tggagcaggaagtctatggctg

SEQ ID NO: 7074455 - DNA, 22 bp, Homo sapiens
tggagcaggaagtctatggctg

SEQ ID NO: 7074456 - DNA, 22 bp, Homo sapiens
tggagcaggacggggagtggta

SEQ ID NO: 7074457 - DNA, 22 bp, Homo sapiens
tggagcaggacggggagtggta

SEQ ID NO: 7074458 - DNA, 22 bp, Homo sapiens
tggagcaggtgccaggtgtgtg

SEQ ID NO: 7074459 - DNA, 22 bp, Homo sapiens
tggagaagattggtcaccattc

SEQ ID NO: 7074460 - DNA, 22 bp, Homo sapiens
tggagaagctgtaggtggactc

SEQ ID NO: 7074461 - DNA, 22 bp, Homo sapiens
tggagaagctgtaggtggactc

SEQ ID NO: 7074462 - DNA, 22 bp, Homo sapiens
tggagaaggacagcctgagaaa

SEQ ID NO: 7074463 - DNA, 22 bp, Homo sapiens
tggagaaggacagcctgagaaa

SEQ ID NO: 7074464 - DNA, 22 bp, Homo sapiens
tggagaaggccggccaggagtg

SEQ ID NO: 7074465 - DNA, 22 bp, Homo sapiens
tggagaaggggcagggtctcca

SEQ ID NO: 7074466 - DNA, 22 bp, Homo sapiens
tggagaagtcaaagtgaacagg

SEQ ID NO: 7074467 - DNA, 22 bp, Homo sapiens
tggagaagtcaaagtgaacagg

SEQ ID NO: 7074468 - DNA, 22 bp, Homo sapiens
tggagagaaagttgaatggagg

SEQ ID NO: 7074469 - DNA, 22 bp, Homo sapiens
tggagagaacagtgtctgaaag

SEQ ID NO: 7074470 - DNA, 22 bp, Homo sapiens
tggagagaagaggcagtgtgct

SEQ ID NO: 7074471 - DNA, 19 bp, Homo sapiens
tggagaggaaatgctgctc

SEQ ID NO: 7074472 - DNA, 22 bp, Homo sapiens
tggagaggaaagtgcagttttg

SEQ ID NO: 7074473 - DNA, 22 bp, Homo sapiens
tggagagcgtgcttagcactct

SEQ ID NO: 7074474 - DNA, 22 bp, Homo sapiens
tggagagctggttcaaagcaga

SEQ ID NO: 7074475 - DNA, 22 bp, Homo sapiens
tggagagcaagtcgcagacatg

SEQ ID NO: 7074476 - DNA, 22 bp, Homo sapiens
tggagagcaagtcgcagacatg

SEQ ID NO: 7074477 - DNA, 22 bp, Homo sapiens
tggagagcaatgaggggcaggc

SEQ ID NO: 7074478 - DNA, 18 bp, Homo sapiens
tggagagcagcagtgggg

SEQ ID NO: 7074479 - DNA, 22 bp, Homo sapiens
tggagagcagggctggagttca

SEQ ID NO: 7074480 - DNA, 20 bp, Homo sapiens
tggagagcctctggactgtg

SEQ ID NO: 7074481 - DNA, 22 bp, Homo sapiens
tggagcagaggaagaaggcttt

SEQ ID NO: 7074482 - DNA, 22 bp, Homo sapiens
tggagcagaggctgaggttggg

SEQ ID NO: 7074483 - DNA, 22 bp, Homo sapiens
tggagcagcacaagaaagggga

SEQ ID NO: 7074484 - DNA, 22 bp, Homo sapiens
tggagcagcacaagaaagggga

SEQ ID NO: 7074485 - DNA, 22 bp, Homo sapiens
tggagcagagatggtggccttc

SEQ ID NO: 7074486 - DNA, 22 bp, Homo sapiens
tggaggcagtaactgagcaaca

SEQ ID NO: 7074487 - DNA, 22 bp, Homo sapiens
tggaggcagtaactgagcaaca

SEQ ID NO: 7074488 - DNA, 22 bp, Homo sapiens
tggaggcagtcacctgaagtca

SEQ ID NO: 7074489 - DNA, 22 bp, Homo sapiens
tggaggcccacactgggtagat

SEQ ID NO: 7074490 - DNA, 22 bp, Homo sapiens
tggaggccgcgtagtctgagca

SEQ ID NO: 7074491 - DNA, 22 bp, Homo sapiens
tggaggcctaggttgatgtgtg

SEQ ID NO: 7074492 - DNA, 22 bp, Homo sapiens
tggaggcaggggatacaggtca

SEQ ID NO: 7074493 - DNA, 18 bp, Homo sapiens
tggaggcagagttctggc

SEQ ID NO: 7074494 - DNA, 22 bp, Homo sapiens
tggaggcaggagacagggcaaa

SEQ ID NO: 7074495 - DNA, 22 bp, Homo sapiens
tggaggcaactgaagatgtagt

SEQ ID NO: 7074496 - DNA, 20 bp, Homo sapiens
tggaggcagagccagaggga

SEQ ID NO: 7074497 - DNA, 22 bp, Homo sapiens
tggagctggtaaacagtgacat

SEQ ID NO: 7074498 - DNA, 22 bp, Homo sapiens
tggaggaaaaaaccaggcagag

SEQ ID NO: 7074499 - DNA, 22 bp, Homo sapiens
tggagcttgggactcttggtag

SEQ ID NO: 7074500 - DNA, 23 bp, Homo sapiens
tggagctgggctcagaccctggg

SEQ ID NO: 7074501 - DNA, 22 bp, Homo sapiens
tggagctggggtttgaatctgg

SEQ ID NO: 7074502 - DNA, 22 bp, Homo sapiens
tggagctggggtttgaatctgg

SEQ ID NO: 7074503 - DNA, 22 bp, Homo sapiens
tggagctggtaaacagtgacat

SEQ ID NO: 7074504 - DNA, 22 bp, Homo sapiens
tggaggagaactccctggctac

SEQ ID NO: 7074505 - DNA, 22 bp, Homo sapiens
tggaggagaatttatggtcgaa

SEQ ID NO: 7074506 - DNA, 22 bp, Homo sapiens
tggaggagaccattccactcag

SEQ ID NO: 7074507 - DNA, 22 bp, Homo sapiens
tggaggagaccattccactcag

SEQ ID NO: 7074508 - DNA, 22 bp, Homo sapiens
tggaggaggaacttcttatctc

SEQ ID NO: 7074509 - DNA, 22 bp, Homo sapiens
tggaggagggctggtgtctgta

SEQ ID NO: 7074510 - DNA, 22 bp, Homo sapiens
tggaggagggctggtgtctgta

SEQ ID NO: 7074511 - DNA, 22 bp, Homo sapiens
tggaggagggctggtgtctgta

SEQ ID NO: 7074512 - DNA, 22 bp, Homo sapiens
tggaggagggctggtgtctgta

SEQ ID NO: 7074513 - DNA, 22 bp, Homo sapiens
tggaggagtgtgattgtctgcc

SEQ ID NO: 7074514 - DNA, 22 bp, Homo sapiens
tggaggcaactgaagatgtagt

SEQ ID NO: 7074515 - DNA, 22 bp, Homo sapiens
tggatggagactgatatgggta

SEQ ID NO: 7074516 - DNA, 22 bp, Homo sapiens
tggatggattgacgaaggcagc

SEQ ID NO: 7074517 - DNA, 22 bp, Homo sapiens
tggagtgggcaatgtaggcaag

SEQ ID NO: 7074518 - DNA, 22 bp, Homo sapiens
tggagtggacttcatgaggcca

SEQ ID NO: 7074519 - DNA, 22 bp, Homo sapiens
tggataaactcactgtaagttg

SEQ ID NO: 7074520 - DNA, 22 bp, Homo sapiens
tggataaactcactgtaagttg

SEQ ID NO: 7074521 - DNA, 23 bp, Homo sapiens
tggataaagctgtgctgcatagg

SEQ ID NO: 7074522 - DNA, 22 bp, Homo sapiens
tggaggtgtccaactcgtgggt

SEQ ID NO: 7074523 - DNA, 22 bp, Homo sapiens
tggaggtgtccaactcgtgggt

SEQ ID NO: 7074524 - DNA, 22 bp, Homo sapiens
tggaggtgtccaactcgtgggt

SEQ ID NO: 7074525 - DNA, 16 bp, Homo sapiens
tggaggtgtttctagt

SEQ ID NO: 7074526 - DNA, 22 bp, Homo sapiens
tggagtcacttccatatgggaa

SEQ ID NO: 7074527 - DNA, 22 bp, Homo sapiens
tggagtcagaatgcgacaggcc

SEQ ID NO: 7074528 - DNA, 22 bp, Homo sapiens
tggagtcctagtattggaaaca

SEQ ID NO: 7074529 - DNA, 22 bp, Homo sapiens
tggagtccttgttggaagtgaa

SEQ ID NO: 7074530 - DNA, 22 bp, Homo sapiens
tggagtctgtgatgctctgggt

SEQ ID NO: 7074531 - DNA, 22 bp, Homo sapiens
tggagtgaagtaaagaggacaa

SEQ ID NO: 7074532 - DNA, 22 bp, Homo sapiens
tggagtggacttcatgaggcca

SEQ ID NO: 7074533 - DNA, 22 bp, Homo sapiens
tggagggctaagctgagggata

SEQ ID NO: 7074534 - DNA, 22 bp, Homo sapiens
tggagggctctttcacctggta

SEQ ID NO: 7074535 - DNA, 22 bp, Homo sapiens
tggaggtggcatctgacagctg

SEQ ID NO: 7074536 - DNA, 22 bp, Homo sapiens
tggaggtggcatctgacagctg

SEQ ID NO: 7074537 - DNA, 22 bp, Homo sapiens
tggaggtgggagggactgtcct

SEQ ID NO: 7074538 - DNA, 22 bp, Homo sapiens
tggaggtgggagggactgtcct

SEQ ID NO: 7074539 - DNA, 22 bp, Homo sapiens
tggaggtgggagggactgtcct

SEQ ID NO: 7074540 - DNA, 22 bp, Homo sapiens
tggaggtggggctcaggaatct

SEQ ID NO: 7074541 - DNA, 20 bp, Homo sapiens
tggaggtggtctgctgtcct

SEQ ID NO: 7074542 - DNA, 20 bp, Homo sapiens
tggaggtggtctgctgtcct

SEQ ID NO: 7074543 - DNA, 22 bp, Homo sapiens
tggaggtgtataaggtagcttc

SEQ ID NO: 7074544 - DNA, 22 bp, Homo sapiens
tggaggtgtataaggtagcttc

SEQ ID NO: 7074545 - DNA, 22 bp, Homo sapiens
tggagggcatctgtggtcaggc

SEQ ID NO: 7074546 - DNA, 22 bp, Homo sapiens
tggagggcgcttagatggaggg

SEQ ID NO: 7074547 - DNA, 22 bp, Homo sapiens
tggagggatacaaagatgaaaa

SEQ ID NO: 7074548 - DNA, 22 bp, Homo sapiens
tggagggcatctgtggtcaggc

SEQ ID NO: 7074549 - DNA, 22 bp, Homo sapiens
tggaggctgtgtgcatgagacc

SEQ ID NO: 7074550 - DNA, 22 bp, Homo sapiens
tggaggctggtttctgctgagg

SEQ ID NO: 7074551 - DNA, 22 bp, Homo sapiens
tggagggaacaaaggagtccca

SEQ ID NO: 7074552 - DNA, 22 bp, Homo sapiens
tggagggaacaaaggagtccca

SEQ ID NO: 7074553 - DNA, 22 bp, Homo sapiens
tggagggaacccaggctgctct

SEQ ID NO: 7074554 - DNA, 22 bp, Homo sapiens
tggagggaacccaggctgctct

SEQ ID NO: 7074555 - DNA, 22 bp, Homo sapiens
tgcttctgactgggtcagttga

SEQ ID NO: 7074556 - DNA, 22 bp, Homo sapiens
tgcttctgagttgcaggacttg

SEQ ID NO: 7074557 - DNA, 22 bp, Homo sapiens
tgcttctgaactcagcatgtgg

SEQ ID NO: 7074558 - DNA, 22 bp, Homo sapiens
tgcttctgacatgttcttggtt

SEQ ID NO: 7074559 - DNA, 22 bp, Homo sapiens
tgcttctgcaacttgaatgtac

SEQ ID NO: 7074560 - DNA, 22 bp, Homo sapiens
tgcttctcccaaccagggcctg

SEQ ID NO: 7074561 - DNA, 21 bp, Homo sapiens
tgcttctctagatcaactact

SEQ ID NO: 7074562 - DNA, 23 bp, Homo sapiens
tgcttctctgcttgacagttctg

SEQ ID NO: 7074563 - DNA, 22 bp, Homo sapiens
tgcttctgaaatgcaggtcttc

SEQ ID NO: 7074564 - DNA, 22 bp, Homo sapiens
tgcttctgaaatgcaggtcttc

SEQ ID NO: 7074565 - DNA, 22 bp, Homo sapiens
tgcttattaaacatgcatattc

SEQ ID NO: 7074566 - DNA, 22 bp, Homo sapiens
tgcttcagaggaaaggcaaaag

SEQ ID NO: 7074567 - DNA, 22 bp, Homo sapiens
tgcttcagcactttgagagcct

SEQ ID NO: 7074568 - DNA, 22 bp, Homo sapiens
tgcttcagtgctctgagcctgt

SEQ ID NO: 7074569 - DNA, 22 bp, Homo sapiens
tgcttaatattgtgatgtaata

SEQ ID NO: 7074570 - DNA, 22 bp, Homo sapiens
tgcttaaaattttccaaggatt

SEQ ID NO: 7074571 - DNA, 22 bp, Homo sapiens
tgcttaaacacatacatacata

SEQ ID NO: 7074572 - DNA, 22 bp, Homo sapiens
tgcttaaacacatacatacata

SEQ ID NO: 7074573 - DNA, 22 bp, Homo sapiens
tgcttaaacatactatttatat

SEQ ID NO: 7074574 - DNA, 22 bp, Homo sapiens
tgcttaaacatccagacagtat

SEQ ID NO: 7074575 - DNA, 22 bp, Homo sapiens
tgcttaaacatccagacagtat

SEQ ID NO: 7074576 - DNA, 22 bp, Homo sapiens
tgcttaaaccctgatcatgtgt

SEQ ID NO: 7074577 - DNA, 22 bp, Homo sapiens
tgcttaaaggatagtttaaact

SEQ ID NO: 7074578 - DNA, 22 bp, Homo sapiens
tgcttaaagtagtggattgtta

SEQ ID NO: 7074579 - DNA, 20 bp, Homo sapiens
tgctgtcgtgttttctgctt

SEQ ID NO: 7074580 - DNA, 17 bp, Homo sapiens
tgctgtctgcttcccta

SEQ ID NO: 7074581 - DNA, 22 bp, Homo sapiens
tgctgtcttctctgaggtccct

SEQ ID NO: 7074582 - DNA, 22 bp, Homo sapiens
tgctgtcttttcccaatcctgg

SEQ ID NO: 7074583 - DNA, 22 bp, Homo sapiens
tgctgtctttttcccttcctaa

SEQ ID NO: 7074584 - DNA, 22 bp, Homo sapiens
tgctgtgaggttgagaaggaag

SEQ ID NO: 7074585 - DNA, 22 bp, Homo sapiens
tgctgtgaggttgagaaggaag

SEQ ID NO: 7074586 - DNA, 22 bp, Homo sapiens
tgctgtgaggttgagaaggaag

SEQ ID NO: 7074587 - DNA, 23 bp, Homo sapiens
tgctggggtagtttgtggcacag

SEQ ID NO: 7074588 - DNA, 22 bp, Homo sapiens
tgctggggtcatggggcgcccg

SEQ ID NO: 7074589 - DNA, 22 bp, Homo sapiens
tgctggggtctctccggtgccc

SEQ ID NO: 7074590 - DNA, 18 bp, Homo sapiens
tgctgggtaactgtatgg

SEQ ID NO: 7074591 - DNA, 22 bp, Homo sapiens
tgctgggtagaagtattagtct

SEQ ID NO: 7074592 - DNA, 22 bp, Homo sapiens
tgctggggagtgattgaccatc

SEQ ID NO: 7074593 - DNA, 20 bp, Homo sapiens
tgctggggacatacagggtg

SEQ ID NO: 7074594 - DNA, 16 bp, Homo sapiens
tgctggggcgccgtcc

SEQ ID NO: 7074595 - DNA, 22 bp, Homo sapiens
tgctggggcagaagagccaaga

SEQ ID NO: 7074596 - DNA, 22 bp, Homo sapiens
tgctggggatccgtaccaaccc

SEQ ID NO: 7074597 - DNA, 22 bp, Homo sapiens
tgctgggttacctaagcctaaa

SEQ ID NO: 7074598 - DNA, 22 bp, Homo sapiens
tgctggtcccctgcagcctgtg

SEQ ID NO: 7074599 - DNA, 22 bp, Homo sapiens
tgctgggtgttccgcacttgac

SEQ ID NO: 7074600 - DNA, 22 bp, Homo sapiens
tgctggtcctggagctgggttc

SEQ ID NO: 7074601 - DNA, 22 bp, Homo sapiens
tgctgtatatattttgaagtga

SEQ ID NO: 7074602 - DNA, 22 bp, Homo sapiens
tgctgggctagaagctgaggcc

SEQ ID NO: 7074603 - DNA, 23 bp, Homo sapiens
tgctgggcagagctggtgctgag

SEQ ID NO: 7074604 - DNA, 22 bp, Homo sapiens
tgctgggcatcgtaggaggtac

SEQ ID NO: 7074605 - DNA, 23 bp, Homo sapiens
tgctggctgtgttattgccaaca

SEQ ID NO: 7074606 - DNA, 22 bp, Homo sapiens
tgctggctgtgtaccatctcaa

SEQ ID NO: 7074607 - DNA, 22 bp, Homo sapiens
tgctggctgttctagggaggcc

SEQ ID NO: 7074608 - DNA, 22 bp, Homo sapiens
tgctggcttatttagtaaatgt

SEQ ID NO: 7074609 - DNA, 22 bp, Homo sapiens
tgctggcttcctgtgcacagca

SEQ ID NO: 7074610 - DNA, 22 bp, Homo sapiens
tgctggctgcagtgctgtcaaa

SEQ ID NO: 7074611 - DNA, 22 bp, Homo sapiens
tgctggctggcctggcctggac

SEQ ID NO: 7074612 - DNA, 22 bp, Homo sapiens
tgctggctgtatatgtgagagt

SEQ ID NO: 7074613 - DNA, 22 bp, Homo sapiens
tgctggctactgatggcaggcc

SEQ ID NO: 7074614 - DNA, 22 bp, Homo sapiens
tgctggctcctcgaggcttcgt

SEQ ID NO: 7074615 - DNA, 23 bp, Homo sapiens
tgctggctgaaacagccaaagga

SEQ ID NO: 7074616 - DNA, 21 bp, Homo sapiens
tgctggctgaaaggcacagag

SEQ ID NO: 7074617 - DNA, 21 bp, Homo sapiens
tgctggctgaaaggcacagag

SEQ ID NO: 7074618 - DNA, 22 bp, Homo sapiens
tgctggaggagtttactgtggc

SEQ ID NO: 7074619 - DNA, 22 bp, Homo sapiens
tgctggaggcagtggaggtgcc

SEQ ID NO: 7074620 - DNA, 22 bp, Homo sapiens
tgctggaggcctgactgtgttt

SEQ ID NO: 7074621 - DNA, 22 bp, Homo sapiens
tgctgcttttgtatatcagaga

SEQ ID NO: 7074622 - DNA, 22 bp, Homo sapiens
tgctgctttgatgtgtaaatca

SEQ ID NO: 7074623 - DNA, 22 bp, Homo sapiens
tgctgctgtttcctacatctca

SEQ ID NO: 7074624 - DNA, 22 bp, Homo sapiens
tgctgcttcacctgttgtacag

SEQ ID NO: 7074625 - DNA, 22 bp, Homo sapiens
tgctgcttcctggtagatagga

SEQ ID NO: 7074626 - DNA, 20 bp, Homo sapiens
tgctgctgtgagcgtccctg

SEQ ID NO: 7074627 - DNA, 22 bp, Homo sapiens
tgctgctgttgacggctgtcca

SEQ ID NO: 7074628 - DNA, 22 bp, Homo sapiens
tgctgctgtatcatgccttcat

SEQ ID NO: 7074629 - DNA, 22 bp, Homo sapiens
tgctgctgggtttgacagtcac

SEQ ID NO: 7074630 - DNA, 22 bp, Homo sapiens
tgctgctgtatccttagtgtca

SEQ ID NO: 7074631 - DNA, 22 bp, Homo sapiens
tgctgctgtatccttagtgtca

SEQ ID NO: 7074632 - DNA, 19 bp, Homo sapiens
tgctgctgtccttgcaggg

SEQ ID NO: 7074633 - DNA, 19 bp, Homo sapiens
tgctgctgtccttgcaggg

SEQ ID NO: 7074634 - DNA, 22 bp, Homo sapiens
tgctgctggatcttactcatct

SEQ ID NO: 7074635 - DNA, 22 bp, Homo sapiens
tgctgctgcttctgtacagcct

SEQ ID NO: 7074636 - DNA, 20 bp, Homo sapiens
tgctgctgcttcacccccat

SEQ ID NO: 7074637 - DNA, 22 bp, Homo sapiens
tgctgctgatggcacctaggca

SEQ ID NO: 7074638 - DNA, 22 bp, Homo sapiens
tgctgctgatggcacctaggca

SEQ ID NO: 7074639 - DNA, 20 bp, Homo sapiens
tgctgctgcctccgcctctg

SEQ ID NO: 7074640 - DNA, 20 bp, Homo sapiens
tgctggaaattgttctagga

SEQ ID NO: 7074641 - DNA, 22 bp, Homo sapiens
tgctgctgatgcatagtctgct

SEQ ID NO: 7074642 - DNA, 21 bp, Homo sapiens
tgctgctgatcggggttggct

SEQ ID NO: 7074643 - DNA, 22 bp, Homo sapiens
tgctgctgatcatttatagtct

SEQ ID NO: 7074644 - DNA, 22 bp, Homo sapiens
tgctgctgacatttggggcttg

SEQ ID NO: 7074645 - DNA, 22 bp, Homo sapiens
tgctgctgatcatttatagtct

SEQ ID NO: 7074646 - DNA, 22 bp, Homo sapiens
tgctgctcgccacggcccaggg

SEQ ID NO: 7074647 - DNA, 22 bp, Homo sapiens
tgctgcctccttcctgccagga

SEQ ID NO: 7074648 - DNA, 22 bp, Homo sapiens
tgctgccagccaggccatggag

SEQ ID NO: 7074649 - DNA, 22 bp, Homo sapiens
tgctgcatagcagctcctgaaa

SEQ ID NO: 7074650 - DNA, 22 bp, Homo sapiens
tgctatttttatcttgatcaaa

SEQ ID NO: 7074651 - DNA, 22 bp, Homo sapiens
tgctataagaattatattactc

SEQ ID NO: 7074652 - DNA, 22 bp, Homo sapiens
tgctataagctccacgctgtag

SEQ ID NO: 7074653 - DNA, 22 bp, Homo sapiens
tgctataagtagacattcaaca

SEQ ID NO: 7074654 - DNA, 20 bp, Homo sapiens
tgcgtgtgtatttattttct

SEQ ID NO: 7074655 - DNA, 22 bp, Homo sapiens
tgcgttgcgctcctgcagcagg

SEQ ID NO: 7074656 - DNA, 22 bp, Homo sapiens
tgcgggtcccagggtcacaggc

SEQ ID NO: 7074657 - DNA, 22 bp, Homo sapiens
tgcgggttggtggcatatgcag

SEQ ID NO: 7074658 - DNA, 22 bp, Homo sapiens
tgcgcaggagctctgccaggag

SEQ ID NO: 7074659 - DNA, 22 bp, Homo sapiens
tgcgcgctggcgtcacttagca

SEQ ID NO: 7074660 - DNA, 22 bp, Homo sapiens
tgcggagggagcagtcggctgt

SEQ ID NO: 7074661 - DNA, 22 bp, Homo sapiens
tgcggaggtcggtgctgcgggc

SEQ ID NO: 7074662 - DNA, 22 bp, Homo sapiens
tgcggcagccaccgcgtggccc

SEQ ID NO: 7074663 - DNA, 22 bp, Homo sapiens
tgcggcaggagaaggtgttatg

SEQ ID NO: 7074664 - DNA, 17 bp, Homo sapiens
tgctcaaatacttttga

SEQ ID NO: 7074665 - DNA, 19 bp, Homo sapiens
tgctcactctcagtccctc

SEQ ID NO: 7074666 - DNA, 22 bp, Homo sapiens
tgctcactgaactcttgctgtc

SEQ ID NO: 7074667 - DNA, 22 bp, Homo sapiens
tgctcagacttaagaagatcag

SEQ ID NO: 7074668 - DNA, 22 bp, Homo sapiens
tgctcagtagcagtgtgctgct

SEQ ID NO: 7074669 - DNA, 22 bp, Homo sapiens
tgctcagtcctaccttggctcc

SEQ ID NO: 7074670 - DNA, 22 bp, Homo sapiens
tgctcagtcctcctgcagtgcc

SEQ ID NO: 7074671 - DNA, 22 bp, Homo sapiens
tgctcagttaagcagaggaaat

SEQ ID NO: 7074672 - DNA, 22 bp, Homo sapiens
tgctcagttccatgagtggagt

SEQ ID NO: 7074673 - DNA, 22 bp, Homo sapiens
tgctcatcaacatgatgatcat

SEQ ID NO: 7074674 - DNA, 22 bp, Homo sapiens
tgctcattgctgatttacatgt

SEQ ID NO: 7074675 - DNA, 22 bp, Homo sapiens
tgccttttgaagcctcacaggt

SEQ ID NO: 7074676 - DNA, 22 bp, Homo sapiens
tgccttttctgtagctctggaa

SEQ ID NO: 7074677 - DNA, 22 bp, Homo sapiens
tgccttttccagtttctagggg

SEQ ID NO: 7074678 - DNA, 22 bp, Homo sapiens
tgccttttccagcttccaggag

SEQ ID NO: 7074679 - DNA, 22 bp, Homo sapiens
tgccttttatggctagcctcag

SEQ ID NO: 7074680 - DNA, 22 bp, Homo sapiens
tgccttggattgcagggaacct

SEQ ID NO: 7074681 - DNA, 22 bp, Homo sapiens
tgccttcttctccctggctcag

SEQ ID NO: 7074682 - DNA, 22 bp, Homo sapiens
tgccttgcgggcgtttctgttg

SEQ ID NO: 7074683 - DNA, 22 bp, Homo sapiens
tgcctgtgtcacagtgatgttt

SEQ ID NO: 7074684 - DNA, 22 bp, Homo sapiens
tgcctgtgtccccttcttggca

SEQ ID NO: 7074685 - DNA, 22 bp, Homo sapiens
tgccttcttctccctggctcag

SEQ ID NO: 7074686 - DNA, 22 bp, Homo sapiens
tgcctgtggttccagttttttc

SEQ ID NO: 7074687 - DNA, 22 bp, Homo sapiens
tgcctgtcttggagtcctggcc

SEQ ID NO: 7074688 - DNA, 22 bp, Homo sapiens
tgcctgtctttcctccctcgta

SEQ ID NO: 7074689 - DNA, 22 bp, Homo sapiens
tgcctgggtgccctctgctcct

SEQ ID NO: 7074690 - DNA, 22 bp, Homo sapiens
tgcctgggtgtaaagggccaac

SEQ ID NO: 7074691 - DNA, 22 bp, Homo sapiens
tgcctggccctgacagccctgg

SEQ ID NO: 7074692 - DNA, 19 bp, Homo sapiens
tgctctctggtgcttcatg

SEQ ID NO: 7074693 - DNA, 22 bp, Homo sapiens
tgctctccggcttccgtggcct

SEQ ID NO: 7074694 - DNA, 22 bp, Homo sapiens
tgctctcctgctcctcagccca

SEQ ID NO: 7074695 - DNA, 22 bp, Homo sapiens
tgctctggctgggatgagtgca

SEQ ID NO: 7074696 - DNA, 23 bp, Homo sapiens
tgctctgggaggccctggagagc

SEQ ID NO: 7074697 - DNA, 22 bp, Homo sapiens
tgctctgggcaacagcctccct

SEQ ID NO: 7074698 - DNA, 22 bp, Homo sapiens
tgctctgggctatctgagaaag

SEQ ID NO: 7074699 - DNA, 22 bp, Homo sapiens
tgctctgggctatctgagaaag

SEQ ID NO: 7074700 - DNA, 22 bp, Homo sapiens
tgctctgggctcaatggcagct

SEQ ID NO: 7074701 - DNA, 22 bp, Homo sapiens
tgctctggggagctcctctgcg

SEQ ID NO: 7074702 - DNA, 22 bp, Homo sapiens
tgctcctggcatctctgcgtcc

SEQ ID NO: 7074703 - DNA, 22 bp, Homo sapiens
tgctcctgtttcatcagctata

SEQ ID NO: 7074704 - DNA, 22 bp, Homo sapiens
tgctcctgtttcatcagctata

SEQ ID NO: 7074705 - DNA, 22 bp, Homo sapiens
tgctcgaggtccccaccggctc

SEQ ID NO: 7074706 - DNA, 22 bp, Homo sapiens
tgctcgccccacatgccctcat

SEQ ID NO: 7074707 - DNA, 22 bp, Homo sapiens
tgctcgcgctgttccagcagct

SEQ ID NO: 7074708 - DNA, 22 bp, Homo sapiens
tgctctaagaactctaggaatt

SEQ ID NO: 7074709 - DNA, 22 bp, Homo sapiens
tgctctagctcataggactcat

SEQ ID NO: 7074710 - DNA, 22 bp, Homo sapiens
tgctccagggcctccagtgggg

SEQ ID NO: 7074711 - DNA, 22 bp, Homo sapiens
tgctccgggaaagagcagccgc

SEQ ID NO: 7074712 - DNA, 22 bp, Homo sapiens
tgctccagcgctgccaccagtt

SEQ ID NO: 7074713 - DNA, 20 bp, Homo sapiens
tgctccaggaacactggccg

SEQ ID NO: 7074714 - DNA, 22 bp, Homo sapiens
tgctgaaagaccgtatttatct

SEQ ID NO: 7074715 - DNA, 22 bp, Homo sapiens
tgctgaaggcaggggaggtggc

SEQ ID NO: 7074716 - DNA, 22 bp, Homo sapiens
tgctgaagggaaggtcttgaat

SEQ ID NO: 7074717 - DNA, 22 bp, Homo sapiens
tgctgaggaaaaatgtgactct

SEQ ID NO: 7074718 - DNA, 22 bp, Homo sapiens
tgctgaggaaagaggataaaag

SEQ ID NO: 7074719 - DNA, 22 bp, Homo sapiens
tgctgaggaataattgttcctg

SEQ ID NO: 7074720 - DNA, 22 bp, Homo sapiens
tgctgaggaatttggtttatgt

SEQ ID NO: 7074721 - DNA, 22 bp, Homo sapiens
tgctgaggacacctagccttct

SEQ ID NO: 7074722 - DNA, 22 bp, Homo sapiens
tgctgaggactaaaggagatga

SEQ ID NO: 7074723 - DNA, 22 bp, Homo sapiens
tgctgaggactaaaggagatga

SEQ ID NO: 7074724 - DNA, 22 bp, Homo sapiens
tgctgaggagggcacccggggg

SEQ ID NO: 7074725 - DNA, 22 bp, Homo sapiens
tgctgaggaggtggctgtgctt

SEQ ID NO: 7074726 - DNA, 22 bp, Homo sapiens
tgctgaggaggtggctgtgctt

SEQ ID NO: 7074727 - DNA, 19 bp, Homo sapiens
tgctgaggatgcaagatcc

SEQ ID NO: 7074728 - DNA, 22 bp, Homo sapiens
tgctctgggtcctgggcctcct

SEQ ID NO: 7074729 - DNA, 20 bp, Homo sapiens
tgctctgggggtggagagac

SEQ ID NO: 7074730 - DNA, 20 bp, Homo sapiens
tgctctgggggtggagagac

SEQ ID NO: 7074731 - DNA, 22 bp, Homo sapiens
tgctctggtaactcacttccat

SEQ ID NO: 7074732 - DNA, 22 bp, Homo sapiens
tgctctggtcctccctcggcgc

SEQ ID NO: 7074733 - DNA, 22 bp, Homo sapiens
tgctctgtaacaaattgacatg

SEQ ID NO: 7074734 - DNA, 22 bp, Homo sapiens
tgctctgtcaagaaaagatgcc

SEQ ID NO: 7074735 - DNA, 22 bp, Homo sapiens
tgctctgtccagtgcaccatca

SEQ ID NO: 7074736 - DNA, 22 bp, Homo sapiens
tgctgcaggtgtgttcagtgag

SEQ ID NO: 7074737 - DNA, 22 bp, Homo sapiens
tgctgcaggcagcccctctact

SEQ ID NO: 7074738 - DNA, 22 bp, Homo sapiens
tgctgagtatttgtttgaataa

SEQ ID NO: 7074739 - DNA, 22 bp, Homo sapiens
tgctgatgagtccttctatcgc

SEQ ID NO: 7074740 - DNA, 22 bp, Homo sapiens
tgctgatgctgttctgttagga

SEQ ID NO: 7074741 - DNA, 21 bp, Homo sapiens
tgctgatgtcagagaagcaag

SEQ ID NO: 7074742 - DNA, 22 bp, Homo sapiens
tgctgaggttgtggagtgcatt

SEQ ID NO: 7074743 - DNA, 22 bp, Homo sapiens
tgctgaggtttcgtctgcttgc

SEQ ID NO: 7074744 - DNA, 22 bp, Homo sapiens
tgctgaggtttctgactatgga

SEQ ID NO: 7074745 - DNA, 22 bp, Homo sapiens
tgctgaggtttctgactatgga

SEQ ID NO: 7074746 - DNA, 22 bp, Homo sapiens
tgctgaggcccaggagcacttt

SEQ ID NO: 7074747 - DNA, 22 bp, Homo sapiens
tgctgaggcccaggagcacttt

SEQ ID NO: 7074748 - DNA, 20 bp, Homo sapiens
tgctgaggcctgaggcctgg

SEQ ID NO: 7074749 - DNA, 20 bp, Homo sapiens
tgctgaggcctgaggcctgg

SEQ ID NO: 7074750 - DNA, 22 bp, Homo sapiens
tgctgaggcagatgtctgtgac

SEQ ID NO: 7074751 - DNA, 22 bp, Homo sapiens
tgctgaggcagtcctaacagga

SEQ ID NO: 7074752 - DNA, 22 bp, Homo sapiens
tgctgaggcatttggacagagt

SEQ ID NO: 7074753 - DNA, 22 bp, Homo sapiens
tgctgaggcatttggacagagt

SEQ ID NO: 7074754 - DNA, 22 bp, Homo sapiens
tgctgaggcatttggacagagt

SEQ ID NO: 7074755 - DNA, 22 bp, Homo sapiens
tgctgaggctagacctggaagt

SEQ ID NO: 7074756 - DNA, 22 bp, Homo sapiens
tgctgagggagcatcaaagaaa

SEQ ID NO: 7074757 - DNA, 22 bp, Homo sapiens
tgctgagggaggggttttccag

SEQ ID NO: 7074758 - DNA, 22 bp, Homo sapiens
tgctgagggcagatgaattaga

SEQ ID NO: 7074759 - DNA, 22 bp, Homo sapiens
tgctgagggctgttaaggaagc

SEQ ID NO: 7074760 - DNA, 22 bp, Homo sapiens
tgctgaggtaaccatatcctgc

SEQ ID NO: 7074761 - DNA, 22 bp, Homo sapiens
tgctgaggtcaccttgctgcta

SEQ ID NO: 7074762 - DNA, 22 bp, Homo sapiens
tgctgaggtcaccttgctgcta

SEQ ID NO: 7074763 - DNA, 22 bp, Homo sapiens
tgctgaggtcacggcggccaga

SEQ ID NO: 7074764 - DNA, 22 bp, Homo sapiens
tgctgaggtcacggcggccaga

SEQ ID NO: 7074765 - DNA, 22 bp, Homo sapiens
tgctgaggtcatttccaagtga

SEQ ID NO: 7074766 - DNA, 20 bp, Homo sapiens
tgctgaggttgacatgccca

SEQ ID NO: 7074767 - DNA, 22 bp, Homo sapiens
tgaaataggaaacagatgtttc

SEQ ID NO: 7074768 - DNA, 22 bp, Homo sapiens
tgaaataatatctggatcaatc

SEQ ID NO: 7074769 - DNA, 22 bp, Homo sapiens
tgaaatactgagtgaaagaatt

SEQ ID NO: 7074770 - DNA, 23 bp, Homo sapiens
tgaaatattcttttgcatgagct

SEQ ID NO: 7074771 - DNA, 22 bp, Homo sapiens
tgaaatcaatgtcttctgtctc

SEQ ID NO: 7074772 - DNA, 17 bp, Homo sapiens
tgaaatcagcacccagg

SEQ ID NO: 7074773 - DNA, 22 bp, Homo sapiens
tgaaatcagtatgtctttctca

SEQ ID NO: 7074774 - DNA, 22 bp, Homo sapiens
tgaaagttgcacataagagaat

SEQ ID NO: 7074775 - DNA, 21 bp, Homo sapiens
tgaaagttggagtcaaatgta

SEQ ID NO: 7074776 - DNA, 22 bp, Homo sapiens
tgaaagttattactgatgatgt

SEQ ID NO: 7074777 - DNA, 22 bp, Homo sapiens
tgaaaggtgacatttcttggat

SEQ ID NO: 7074778 - DNA, 20 bp, Homo sapiens
tgaaaggtgggaattgtggg

SEQ ID NO: 7074779 - DNA, 22 bp, Homo sapiens
tgaaaggtgtccaatatttctc

SEQ ID NO: 7074780 - DNA, 22 bp, Homo sapiens
tgaaaggttaaaagtagtattg

SEQ ID NO: 7074781 - DNA, 22 bp, Homo sapiens
tgaaaggttatttaggtctgct

SEQ ID NO: 7074782 - DNA, 22 bp, Homo sapiens
tgaaagtctctgttatagagaa

SEQ ID NO: 7074783 - DNA, 23 bp, Homo sapiens
tgaaagcaatgggtctatagtat

SEQ ID NO: 7074784 - DNA, 22 bp, Homo sapiens
tgaaagcacaagttctaacagg

SEQ ID NO: 7074785 - DNA, 22 bp, Homo sapiens
tgaaagcactcacttctgctct

SEQ ID NO: 7074786 - DNA, 22 bp, Homo sapiens
tgaaaggtagctggcctcatag

SEQ ID NO: 7074787 - DNA, 22 bp, Homo sapiens
tgaaatcatgaacaaggtaggt

SEQ ID NO: 7074788 - DNA, 22 bp, Homo sapiens
tgaaatcatgagatagtgtcac

SEQ ID NO: 7074789 - DNA, 22 bp, Homo sapiens
tgaaatcatgagatagtgtcac

SEQ ID NO: 7074790 - DNA, 22 bp, Homo sapiens
tgaaatcatgtagttattgcaa

SEQ ID NO: 7074791 - DNA, 22 bp, Homo sapiens
tgaaatcattggggttgaataa

SEQ ID NO: 7074792 - DNA, 21 bp, Homo sapiens
tgaaatctgatgggacaaatg

SEQ ID NO: 7074793 - DNA, 22 bp, Homo sapiens
tgaaatctgcatgcaaagtcct

SEQ ID NO: 7074794 - DNA, 22 bp, Homo sapiens
tgaaatgctgtagagactgtat

SEQ ID NO: 7074795 - DNA, 22 bp, Homo sapiens
tgaaatgtcagtgttttataag

SEQ ID NO: 7074796 - DNA, 22 bp, Homo sapiens
tgaaatgtgtccatgttatttc

SEQ ID NO: 7074797 - DNA, 22 bp, Homo sapiens
tgaaatgtgttctagtgttttg

SEQ ID NO: 7074798 - DNA, 22 bp, Homo sapiens
tgaaatgttggtaattttatat

SEQ ID NO: 7074799 - DNA, 22 bp, Homo sapiens
tgaaattagtgaagttacagtt

SEQ ID NO: 7074800 - DNA, 22 bp, Homo sapiens
tgaaattatgcattgttgtacc

SEQ ID NO: 7074801 - DNA, 22 bp, Homo sapiens
tgaaattatgcattgttgtacc

SEQ ID NO: 7074802 - DNA, 22 bp, Homo sapiens
tgaaattcattgttttatgtgt

SEQ ID NO: 7074803 - DNA, 22 bp, Homo sapiens
tgaacaaactgcattcttcact

SEQ ID NO: 7074804 - DNA, 22 bp, Homo sapiens
tgaacaaactgcattcttcact

SEQ ID NO: 7074805 - DNA, 21 bp, Homo sapiens
tgaacaaagttcttatcgtga

SEQ ID NO: 7074806 - DNA, 22 bp, Homo sapiens
tgaacaacagatgtccattgtt

SEQ ID NO: 7074807 - DNA, 22 bp, Homo sapiens
tgaacagtttcaagaaaacttt

SEQ ID NO: 7074808 - DNA, 22 bp, Homo sapiens
tgaactctctcaagtgacagaa

SEQ ID NO: 7074809 - DNA, 22 bp, Homo sapiens
tgaagaagccaattggtaggct

SEQ ID NO: 7074810 - DNA, 22 bp, Homo sapiens
tgaagaatgttgcagtgagcat

SEQ ID NO: 7074811 - DNA, 22 bp, Homo sapiens
tgaagacaagtgtgctggtgtt

SEQ ID NO: 7074812 - DNA, 22 bp, Homo sapiens
tgaagactcagaagctaagata

SEQ ID NO: 7074813 - DNA, 22 bp, Homo sapiens
tgaagactcagaagctaagata

SEQ ID NO: 7074814 - DNA, 22 bp, Homo sapiens
tgaaacttttgaggttcttcca

SEQ ID NO: 7074815 - DNA, 22 bp, Homo sapiens
tgaaacttataagaatatgaat

SEQ ID NO: 7074816 - DNA, 22 bp, Homo sapiens
tgaaacttataagaatatgaat

SEQ ID NO: 7074817 - DNA, 22 bp, Homo sapiens
tgaaacctcaaccaaaggttac

SEQ ID NO: 7074818 - DNA, 22 bp, Homo sapiens
tgaaacggaatgttctttatcg

SEQ ID NO: 7074819 - DNA, 22 bp, Homo sapiens
tgaaagaactagcatcttcaag

SEQ ID NO: 7074820 - DNA, 17 bp, Homo sapiens
tgaaagaatcagggaga

SEQ ID NO: 7074821 - DNA, 21 bp, Homo sapiens
tgaaagaggatgtggtcattc

SEQ ID NO: 7074822 - DNA, 19 bp, Homo sapiens
tgaaacaaacttaaaagga

SEQ ID NO: 7074823 - DNA, 22 bp, Homo sapiens
tgaaacaggcaaaactgcagat

SEQ ID NO: 7074824 - DNA, 22 bp, Homo sapiens
tgaaacagtctccagacttgga

SEQ ID NO: 7074825 - DNA, 23 bp, Homo sapiens
tgaaacatttagggtagaatttc

SEQ ID NO: 7074826 - DNA, 21 bp, Homo sapiens
tgaaacatttgatcaaagcac

SEQ ID NO: 7074827 - DNA, 22 bp, Homo sapiens
tgaaaagggtagatccctaagt

SEQ ID NO: 7074828 - DNA, 22 bp, Homo sapiens
tgaaaactccaagtttcatcag

SEQ ID NO: 7074829 - DNA, 22 bp, Homo sapiens
tgaaaacttgacaagtgaggta

SEQ ID NO: 7074830 - DNA, 22 bp, Homo sapiens
tgaaaagactgcaagagagcat

SEQ ID NO: 7074831 - DNA, 22 bp, Homo sapiens
tgaaaatatagttttccagact

SEQ ID NO: 7074832 - DNA, 22 bp, Homo sapiens
tgaaaatatagttttccagact

SEQ ID NO: 7074833 - DNA, 22 bp, Homo sapiens
tgaaaattgttgtacttgataa

SEQ ID NO: 7074834 - DNA, 23 bp, Homo sapiens
tctttttaagagatctagtgacg

SEQ ID NO: 7074835 - DNA, 22 bp, Homo sapiens
tgaaaaaacaagttggcccatt

SEQ ID NO: 7074836 - DNA, 22 bp, Homo sapiens
tcttttattaggctgaaatggg

SEQ ID NO: 7074837 - DNA, 22 bp, Homo sapiens
tcttttcatcatttaataggta

SEQ ID NO: 7074838 - DNA, 22 bp, Homo sapiens
tcttttcattgagaacacactg

SEQ ID NO: 7074839 - DNA, 21 bp, Homo sapiens
tcttttctctgcaggattcct

SEQ ID NO: 7074840 - DNA, 21 bp, Homo sapiens
tcttttctctgcaggattcct

SEQ ID NO: 7074841 - DNA, 22 bp, Homo sapiens
tcttttaacctaactagcttgg

SEQ ID NO: 7074842 - DNA, 22 bp, Homo sapiens
tcttttaaaagccctgctgtct

SEQ ID NO: 7074843 - DNA, 22 bp, Homo sapiens
tctttgtaagacatgtaagtcc

SEQ ID NO: 7074844 - DNA, 22 bp, Homo sapiens
tctttgtaaatgcctagcataa

SEQ ID NO: 7074845 - DNA, 22 bp, Homo sapiens
tctttgtaactgtctattgaga

SEQ ID NO: 7074846 - DNA, 22 bp, Homo sapiens
tctttgtaactgtctattgaga

SEQ ID NO: 7074847 - DNA, 18 bp, Homo sapiens
tctttggacaactactgg

SEQ ID NO: 7074848 - DNA, 22 bp, Homo sapiens
tctttggatcccaactggctgg

SEQ ID NO: 7074849 - DNA, 22 bp, Homo sapiens
tctttgcaaaatacaacaatgg

SEQ ID NO: 7074850 - DNA, 22 bp, Homo sapiens
tctttgcaaatgttattatctt

SEQ ID NO: 7074851 - DNA, 22 bp, Homo sapiens
tctttgcactgtgcaagcagaa

SEQ ID NO: 7074852 - DNA, 22 bp, Homo sapiens
tctttgcagaatttaactttgc

SEQ ID NO: 7074853 - DNA, 22 bp, Homo sapiens
tctttgcaggccaaattgttaa

SEQ ID NO: 7074854 - DNA, 22 bp, Homo sapiens
tctttgctccacactctagaga

SEQ ID NO: 7074855 - DNA, 22 bp, Homo sapiens
tctttgctccacactctagaga

SEQ ID NO: 7074856 - DNA, 22 bp, Homo sapiens
tctttggaatgctagcattcta

SEQ ID NO: 7074857 - DNA, 22 bp, Homo sapiens
tgaaggtgaatgtctatgggga

SEQ ID NO: 7074858 - DNA, 22 bp, Homo sapiens
tgaagttgttaaggttgccatt

SEQ ID NO: 7074859 - DNA, 22 bp, Homo sapiens
tgaataaactatgaggaggaat

SEQ ID NO: 7074860 - DNA, 22 bp, Homo sapiens
tgaataaactatgaggaggaat

SEQ ID NO: 7074861 - DNA, 22 bp, Homo sapiens
tgaataaattgagagcgaatgt

SEQ ID NO: 7074862 - DNA, 22 bp, Homo sapiens
tgaataagaattattataatga

SEQ ID NO: 7074863 - DNA, 22 bp, Homo sapiens
tgaataatcttgggtattaata

SEQ ID NO: 7074864 - DNA, 22 bp, Homo sapiens
tgaaggcagcatgcacactagt

SEQ ID NO: 7074865 - DNA, 22 bp, Homo sapiens
tgaaggcataaatcttgggaac

SEQ ID NO: 7074866 - DNA, 22 bp, Homo sapiens
tgaaggcattgatgaaggaatc

SEQ ID NO: 7074867 - DNA, 22 bp, Homo sapiens
tgaaggcatttgagttggtgag

SEQ ID NO: 7074868 - DNA, 22 bp, Homo sapiens
tgaaggctgggctcagccagct

SEQ ID NO: 7074869 - DNA, 22 bp, Homo sapiens
tgaaggcttgactgaggcagga

SEQ ID NO: 7074870 - DNA, 22 bp, Homo sapiens
tgaagggcaaccccaggcccag

SEQ ID NO: 7074871 - DNA, 21 bp, Homo sapiens
tgaagggcagcctcaggctcc

SEQ ID NO: 7074872 - DNA, 22 bp, Homo sapiens
tgaaggaggaatgtggcctcca

SEQ ID NO: 7074873 - DNA, 22 bp, Homo sapiens
tgaaggagggaagaaggctctg

SEQ ID NO: 7074874 - DNA, 19 bp, Homo sapiens
tgaaggagggggatggcca

SEQ ID NO: 7074875 - DNA, 19 bp, Homo sapiens
tgaaggagggggatggcca

SEQ ID NO: 7074876 - DNA, 22 bp, Homo sapiens
tgaaggcaacctctgtggtcct

SEQ ID NO: 7074877 - DNA, 22 bp, Homo sapiens
tgaaggcacgtgggtggatact

SEQ ID NO: 7074878 - DNA, 22 bp, Homo sapiens
tgaaggcacttgcctaggggca

SEQ ID NO: 7074879 - DNA, 22 bp, Homo sapiens
tgaaggcacttgcctaggggca

SEQ ID NO: 7074880 - DNA, 22 bp, Homo sapiens
tgaaggagctcaggagatagtc

SEQ ID NO: 7074881 - DNA, 22 bp, Homo sapiens
tgaaggagctcaggagatagtc

SEQ ID NO: 7074882 - DNA, 22 bp, Homo sapiens
tgaaggagctgatgtaaggggt

SEQ ID NO: 7074883 - DNA, 21 bp, Homo sapiens
tgaagcctgaggcatagcccc

SEQ ID NO: 7074884 - DNA, 22 bp, Homo sapiens
tgaagccatcaggaagccagca

SEQ ID NO: 7074885 - DNA, 22 bp, Homo sapiens
tgaagccatccctcagatggcc

SEQ ID NO: 7074886 - DNA, 22 bp, Homo sapiens
tgaagccattactgtgttaggg

SEQ ID NO: 7074887 - DNA, 22 bp, Homo sapiens
tgaagccaaggatgcctttctc

SEQ ID NO: 7074888 - DNA, 22 bp, Homo sapiens
tgaagccaatctgccaggcaga

SEQ ID NO: 7074889 - DNA, 22 bp, Homo sapiens
tgaagccacactagcttgtcct

SEQ ID NO: 7074890 - DNA, 22 bp, Homo sapiens
tgaagccacagagcatctgcct

SEQ ID NO: 7074891 - DNA, 22 bp, Homo sapiens
tgaagccaccgaaccagaagag

SEQ ID NO: 7074892 - DNA, 22 bp, Homo sapiens
tgaagccactttccagaatcac

SEQ ID NO: 7074893 - DNA, 22 bp, Homo sapiens
tgaagccagtcaatgttaagtt

SEQ ID NO: 7074894 - DNA, 22 bp, Homo sapiens
tgaagccataggacagaggata

SEQ ID NO: 7074895 - DNA, 22 bp, Homo sapiens
tgaatacaggaaaatatactga

SEQ ID NO: 7074896 - DNA, 22 bp, Homo sapiens
tgaatacactaaaaatcacttt

SEQ ID NO: 7074897 - DNA, 22 bp, Homo sapiens
tgaatacactaaaaatcacttt

SEQ ID NO: 7074898 - DNA, 22 bp, Homo sapiens
tgaatacaggaaaatatactga

SEQ ID NO: 7074899 - DNA, 22 bp, Homo sapiens
tgaatactatttcataatgtgg

SEQ ID NO: 7074900 - DNA, 22 bp, Homo sapiens
tgaatagtccttggaataactg

SEQ ID NO: 7074901 - DNA, 22 bp, Homo sapiens
tgaatatgctttgcaatcctaa

SEQ ID NO: 7074902 - DNA, 22 bp, Homo sapiens
tgaatcagtataaattctcaaa

SEQ ID NO: 7074903 - DNA, 22 bp, Homo sapiens
tgaatcctaattctatcactta

SEQ ID NO: 7074904 - DNA, 22 bp, Homo sapiens
tgaatgtgatgctaaacatatg

SEQ ID NO: 7074905 - DNA, 22 bp, Homo sapiens
tgaatgagtgagttcagacctc

SEQ ID NO: 7074906 - DNA, 21 bp, Homo sapiens
tgaatgagcatctggactttt

SEQ ID NO: 7074907 - DNA, 21 bp, Homo sapiens
tgaatgaggaggatggcattt

SEQ ID NO: 7074908 - DNA, 22 bp, Homo sapiens
tgaatgaggatccttgacctta

SEQ ID NO: 7074909 - DNA, 21 bp, Homo sapiens
tgaatttcggtatggctataa

SEQ ID NO: 7074910 - DNA, 22 bp, Homo sapiens
tgaattcttaatgaaatctact

SEQ ID NO: 7074911 - DNA, 22 bp, Homo sapiens
tgaattctggccctctcactta

SEQ ID NO: 7074912 - DNA, 17 bp, Homo sapiens
tgaattcaatctgcact

SEQ ID NO: 7074913 - DNA, 22 bp, Homo sapiens
tgacaaaccagtagcaataaag

SEQ ID NO: 7074914 - DNA, 22 bp, Homo sapiens
tgacaaaccctgcaaatagctc

SEQ ID NO: 7074915 - DNA, 22 bp, Homo sapiens
tgacacaaacaagatatttgcc

SEQ ID NO: 7074916 - DNA, 22 bp, Homo sapiens
tgacagacagcttctcatttta

SEQ ID NO: 7074917 - DNA, 22 bp, Homo sapiens
tgacagaccactgcaactctgt

SEQ ID NO: 7074918 - DNA, 22 bp, Homo sapiens
tgacacagattagagacatacc

SEQ ID NO: 7074919 - DNA, 22 bp, Homo sapiens
tgacacagggaaagcggatcca

SEQ ID NO: 7074920 - DNA, 22 bp, Homo sapiens
tgacacagggaaagcggatcca

SEQ ID NO: 7074921 - DNA, 23 bp, Homo sapiens
tgacacaggtcaaaaataagatg

SEQ ID NO: 7074922 - DNA, 22 bp, Homo sapiens
tgacacagtagaaagatgatga

SEQ ID NO: 7074923 - DNA, 22 bp, Homo sapiens
tgacacagtagaaagatgatga

SEQ ID NO: 7074924 - DNA, 22 bp, Homo sapiens
tgacacagtatcaaacatgatt

SEQ ID NO: 7074925 - DNA, 22 bp, Homo sapiens
tgacacatgcaccagtctttaa

SEQ ID NO: 7074926 - DNA, 22 bp, Homo sapiens
tgacagggacagtggagatgga

SEQ ID NO: 7074927 - DNA, 22 bp, Homo sapiens
tgacaggatgatgagcaggggg

SEQ ID NO: 7074928 - DNA, 22 bp, Homo sapiens
tgacagcagcatagtgagcaat

SEQ ID NO: 7074929 - DNA, 22 bp, Homo sapiens
tgacagcataacactggtcttg

SEQ ID NO: 7074930 - DNA, 22 bp, Homo sapiens
tgacaggtgattgtgaactaag

SEQ ID NO: 7074931 - DNA, 22 bp, Homo sapiens
tgacagtctgcagttttaaaaa

SEQ ID NO: 7074932 - DNA, 22 bp, Homo sapiens
tgacagtgagcttggggtactt

SEQ ID NO: 7074933 - DNA, 22 bp, Homo sapiens
tgacatttcctagtgctttgtg

SEQ ID NO: 7074934 - DNA, 22 bp, Homo sapiens
tgacctttctctgggtgcttgg

SEQ ID NO: 7074935 - DNA, 22 bp, Homo sapiens
tgactattacggccacgaattt

SEQ ID NO: 7074936 - DNA, 22 bp, Homo sapiens
tgactattttttatagattcca

SEQ ID NO: 7074937 - DNA, 22 bp, Homo sapiens
tgacttgtctctttgggagaca

SEQ ID NO: 7074938 - DNA, 22 bp, Homo sapiens
tgacttcctgcactcaggtgat

SEQ ID NO: 7074939 - DNA, 22 bp, Homo sapiens
tgacttcctgcactcaggtgat

SEQ ID NO: 7074940 - DNA, 22 bp, Homo sapiens
tgactggagacctcagtagggt

SEQ ID NO: 7074941 - DNA, 19 bp, Homo sapiens
tgactgcctcaggggtgga

SEQ ID NO: 7074942 - DNA, 22 bp, Homo sapiens
tgactgccccttccattcctgc

SEQ ID NO: 7074943 - DNA, 21 bp, Homo sapiens
tgactgaggcttcttcacaca

SEQ ID NO: 7074944 - DNA, 21 bp, Homo sapiens
tgactgaggcttcttcacaca

SEQ ID NO: 7074945 - DNA, 22 bp, Homo sapiens
tgactgccatgagggtgagggc

SEQ ID NO: 7074946 - DNA, 19 bp, Homo sapiens
tgagatttcttaggtgatt

SEQ ID NO: 7074947 - DNA, 22 bp, Homo sapiens
tgagatgggtggggagctcagg

SEQ ID NO: 7074948 - DNA, 22 bp, Homo sapiens
tgagaggtcaaagggcatggag

SEQ ID NO: 7074949 - DNA, 22 bp, Homo sapiens
tgagatcatttatttacctttc

SEQ ID NO: 7074950 - DNA, 22 bp, Homo sapiens
tgagatgatgggataagagggc

SEQ ID NO: 7074951 - DNA, 22 bp, Homo sapiens
tgagatgctaaagggctgctca

SEQ ID NO: 7074952 - DNA, 22 bp, Homo sapiens
tgagagccaggatctgctctat

SEQ ID NO: 7074953 - DNA, 22 bp, Homo sapiens
tgagagccagaagggcctgagg

SEQ ID NO: 7074954 - DNA, 18 bp, Homo sapiens
tgagagcctgcttgtccc

SEQ ID NO: 7074955 - DNA, 23 bp, Homo sapiens
tgagagcctggcagcctgggttc

SEQ ID NO: 7074956 - DNA, 21 bp, Homo sapiens
tgagagagtagcaggacatat

SEQ ID NO: 7074957 - DNA, 22 bp, Homo sapiens
tgagagagcctgaatctcttac

SEQ ID NO: 7074958 - DNA, 22 bp, Homo sapiens
tgagagagtaattgagtggtaa

SEQ ID NO: 7074959 - DNA, 22 bp, Homo sapiens
tgagagcctgtgttcaaatgcc

SEQ ID NO: 7074960 - DNA, 22 bp, Homo sapiens
tgagaggagtgattgtaaaatt

SEQ ID NO: 7074961 - DNA, 22 bp, Homo sapiens
tgagaggatattttgggaggat

SEQ ID NO: 7074962 - DNA, 18 bp, Homo sapiens
tgagaggctattttttgc

SEQ ID NO: 7074963 - DNA, 19 bp, Homo sapiens
tgagaggcttaaggcagct

SEQ ID NO: 7074964 - DNA, 22 bp, Homo sapiens
tgagagggcccagagcacacca

SEQ ID NO: 7074965 - DNA, 22 bp, Homo sapiens
tgagaggtaggaaatgaacaag

SEQ ID NO: 7074966 - DNA, 22 bp, Homo sapiens
tgagacagttctgcagctgggt

SEQ ID NO: 7074967 - DNA, 22 bp, Homo sapiens
tgagacagtcccatgatctgca

SEQ ID NO: 7074968 - DNA, 22 bp, Homo sapiens
tgagacagtcaccaggcaggcc

SEQ ID NO: 7074969 - DNA, 22 bp, Homo sapiens
tgagacagtcaccaggcaggcc

SEQ ID NO: 7074970 - DNA, 22 bp, Homo sapiens
tgagacagtaattgtatagttt

SEQ ID NO: 7074971 - DNA, 22 bp, Homo sapiens
tgagacagtatcgccccaaggc

SEQ ID NO: 7074972 - DNA, 22 bp, Homo sapiens
tgagacagggtcttgctctgtt

SEQ ID NO: 7074973 - DNA, 17 bp, Homo sapiens
tgagacagggcaggccc

SEQ ID NO: 7074974 - DNA, 22 bp, Homo sapiens
tgagacagggtcttgctctgtt

SEQ ID NO: 7074975 - DNA, 18 bp, Homo sapiens
tgagacagctaccacttg

SEQ ID NO: 7074976 - DNA, 22 bp, Homo sapiens
tgagacaggagaggcccctcct

SEQ ID NO: 7074977 - DNA, 22 bp, Homo sapiens
tgagacaggcttccttcttggg

SEQ ID NO: 7074978 - DNA, 19 bp, Homo sapiens
tgagacagggattcaggtg

SEQ ID NO: 7074979 - DNA, 19 bp, Homo sapiens
tgagacagggattcaggtg

SEQ ID NO: 7074980 - DNA, 17 bp, Homo sapiens
tgagacagggcaggccc

SEQ ID NO: 7074981 - DNA, 22 bp, Homo sapiens
tgagacagcccttctgcacagg

SEQ ID NO: 7074982 - DNA, 22 bp, Homo sapiens
tgagacagcagtcagggaaata

SEQ ID NO: 7074983 - DNA, 22 bp, Homo sapiens
tgagacagcccttctgcacagg

SEQ ID NO: 7074984 - DNA, 22 bp, Homo sapiens
tgagacagcctctgcactcatg

SEQ ID NO: 7074985 - DNA, 22 bp, Homo sapiens
tgagacagcagtcagggaaata

SEQ ID NO: 7074986 - DNA, 22 bp, Homo sapiens
tgagacagcagattagcaatga

SEQ ID NO: 7074987 - DNA, 19 bp, Homo sapiens
tgagacagagaccagttct

SEQ ID NO: 7074988 - DNA, 19 bp, Homo sapiens
tgagacagaagatgagcct

SEQ ID NO: 7074989 - DNA, 19 bp, Homo sapiens
tgagacagaagatgagcct

SEQ ID NO: 7074990 - DNA, 20 bp, Homo sapiens
tgagaagctcctgtctcctc

SEQ ID NO: 7074991 - DNA, 22 bp, Homo sapiens
tgagaagctgctgacttagcct

SEQ ID NO: 7074992 - DNA, 22 bp, Homo sapiens
tgagaagctgcttgtgctgtat

SEQ ID NO: 7074993 - DNA, 22 bp, Homo sapiens
tgagaattacaaatgagtcaca

SEQ ID NO: 7074994 - DNA, 22 bp, Homo sapiens
tgagaatttgtgaacttttctc

SEQ ID NO: 7074995 - DNA, 22 bp, Homo sapiens
tgagaattttcagtttcacttt

SEQ ID NO: 7074996 - DNA, 22 bp, Homo sapiens
tgagaattttcagtttcacttt

SEQ ID NO: 7074997 - DNA, 22 bp, Homo sapiens
tgagaattttttgtcatgcatt

SEQ ID NO: 7074998 - DNA, 22 bp, Homo sapiens
tgagaaaattactataattgtc

SEQ ID NO: 7074999 - DNA, 22 bp, Homo sapiens
tgagaaagtgggtgcctagcaa

SEQ ID NO: 7075000 - DNA, 22 bp, Homo sapiens
tgagaaccatgaaaagctgtca

SEQ ID NO: 7075001 - DNA, 22 bp, Homo sapiens
tgagaacggatactaagggctg

SEQ ID NO: 7075002 - DNA, 22 bp, Homo sapiens
tgagaactgaggatttgaattc

SEQ ID NO: 7075003 - DNA, 22 bp, Homo sapiens
tgagaacttgtgctattgcaca

SEQ ID NO: 7075004 - DNA, 22 bp, Homo sapiens
tgagaagattgggcagagtgga

SEQ ID NO: 7075005 - DNA, 22 bp, Homo sapiens
tgagaagcagcttacaggtgtc

SEQ ID NO: 7075006 - DNA, 22 bp, Homo sapiens
tgagaagcagcttacaggtgtc

SEQ ID NO: 7075007 - DNA, 22 bp, Homo sapiens
tgagaagcagtttcagtaagaa

SEQ ID NO: 7075008 - DNA, 23 bp, Homo sapiens
tgagaagccaggggagcgtgagg

SEQ ID NO: 7075009 - DNA, 23 bp, Homo sapiens
tgagaagccattagagcaggtgg

SEQ ID NO: 7075010 - DNA, 23 bp, Homo sapiens
tgagaagccgccgggcagcctgg

SEQ ID NO: 7075011 - DNA, 19 bp, Homo sapiens
tgagccagggaggccatgc

SEQ ID NO: 7075012 - DNA, 22 bp, Homo sapiens
tgagccaggcccagtggggtca

SEQ ID NO: 7075013 - DNA, 20 bp, Homo sapiens
tgagccaggctaggaagggc

SEQ ID NO: 7075014 - DNA, 22 bp, Homo sapiens
tgagccaggctcaagtgatcct

SEQ ID NO: 7075015 - DNA, 22 bp, Homo sapiens
tgagccaggagtttgaggctgt

SEQ ID NO: 7075016 - DNA, 22 bp, Homo sapiens
tgagccagataagggctcacgc

SEQ ID NO: 7075017 - DNA, 22 bp, Homo sapiens
tgagccagcaggcctccagtgg

SEQ ID NO: 7075018 - DNA, 22 bp, Homo sapiens
tgagccagcctcagaagtcacg

SEQ ID NO: 7075019 - DNA, 22 bp, Homo sapiens
tgagccagagtggagtgtgcct

SEQ ID NO: 7075020 - DNA, 22 bp, Homo sapiens
tgagcattggatcaaatgactt

SEQ ID NO: 7075021 - DNA, 22 bp, Homo sapiens
tgagccaagatcatgccgttgt

SEQ ID NO: 7075022 - DNA, 22 bp, Homo sapiens
tgagcagggactttggagtctg

SEQ ID NO: 7075023 - DNA, 22 bp, Homo sapiens
tgagcagggagctgggctgagc

SEQ ID NO: 7075024 - DNA, 22 bp, Homo sapiens
tgagcagggagctgggctgagc

SEQ ID NO: 7075025 - DNA, 19 bp, Homo sapiens
tgagcatgcgagctgagaa

SEQ ID NO: 7075026 - DNA, 22 bp, Homo sapiens
tgagcatggtgggtgcagagca

SEQ ID NO: 7075027 - DNA, 22 bp, Homo sapiens
tgagcacagctttcactagaaa

SEQ ID NO: 7075028 - DNA, 22 bp, Homo sapiens
tgagcagagcaataggactctc

SEQ ID NO: 7075029 - DNA, 22 bp, Homo sapiens
tgagcagagcagtaacaggagc

SEQ ID NO: 7075030 - DNA, 22 bp, Homo sapiens
tgagcagatggaggcttctgca

SEQ ID NO: 7075031 - DNA, 22 bp, Homo sapiens
tgagcagatggaggcttctgca

SEQ ID NO: 7075032 - DNA, 22 bp, Homo sapiens
tgagcaggcgcagcaggaggtc

SEQ ID NO: 7075033 - DNA, 22 bp, Homo sapiens
tgagcaggcgcagcaggaggtc

SEQ ID NO: 7075034 - DNA, 22 bp, Homo sapiens
tgagcaggcgcagcaggaggtc

SEQ ID NO: 7075035 - DNA, 22 bp, Homo sapiens
tgagcagggactttgagtgtag

SEQ ID NO: 7075036 - DNA, 22 bp, Homo sapiens
tgagcagggactttgagtgtag

SEQ ID NO: 7075037 - DNA, 21 bp, Homo sapiens
tgagcccttgcctcagagccc

SEQ ID NO: 7075038 - DNA, 22 bp, Homo sapiens
tgagcccttgacatcgcccact

SEQ ID NO: 7075039 - DNA, 22 bp, Homo sapiens
tgagccagtctctcagaaccct

SEQ ID NO: 7075040 - DNA, 22 bp, Homo sapiens
tgagccagtctgtctgggtgaa

SEQ ID NO: 7075041 - DNA, 22 bp, Homo sapiens
tgagcctgtcctgtgcatgtga

SEQ ID NO: 7075042 - DNA, 22 bp, Homo sapiens
tgagctagggctggtgaggagc

SEQ ID NO: 7075043 - DNA, 22 bp, Homo sapiens
tgagcctggttgcagtgtctgg

SEQ ID NO: 7075044 - DNA, 22 bp, Homo sapiens
tgagctgtagcagatgctgttg

SEQ ID NO: 7075045 - DNA, 22 bp, Homo sapiens
tgagctgtgattaactctgaga

SEQ ID NO: 7075046 - DNA, 22 bp, Homo sapiens
tgagcttgctacatagatcaga

SEQ ID NO: 7075047 - DNA, 22 bp, Homo sapiens
tgaggaaactgaggcacagatg

SEQ ID NO: 7075048 - DNA, 22 bp, Homo sapiens
tgaggaaacttacaaggcagaa

SEQ ID NO: 7075049 - DNA, 22 bp, Homo sapiens
tgaggaaacttacaaggcagaa

SEQ ID NO: 7075050 - DNA, 22 bp, Homo sapiens
tgagctggttcttgaggcatga

SEQ ID NO: 7075051 - DNA, 22 bp, Homo sapiens
tgagctggtcttgagtgtagct

SEQ ID NO: 7075052 - DNA, 22 bp, Homo sapiens
tgagctggagtctgtggctcct

SEQ ID NO: 7075053 - DNA, 22 bp, Homo sapiens
tgagctggaggacaggagggta

SEQ ID NO: 7075054 - DNA, 22 bp, Homo sapiens
tgagctggaggacaggagggta

SEQ ID NO: 7075055 - DNA, 22 bp, Homo sapiens
tgagctcctggtcacaattatc

SEQ ID NO: 7075056 - DNA, 22 bp, Homo sapiens
tgagctctgttagggctggaac

SEQ ID NO: 7075057 - DNA, 22 bp, Homo sapiens
tgaggcagggagagtggatatg

SEQ ID NO: 7075058 - DNA, 22 bp, Homo sapiens
tgaggcagggagtttaattgtc

SEQ ID NO: 7075059 - DNA, 21 bp, Homo sapiens
tgaggcaggggtgcttttgtc

SEQ ID NO: 7075060 - DNA, 22 bp, Homo sapiens
tgaggcagttcttacttgtatt

SEQ ID NO: 7075061 - DNA, 22 bp, Homo sapiens
tgaggcagttgagcttcctgag

SEQ ID NO: 7075062 - DNA, 22 bp, Homo sapiens
tgaggcattaaagggaggtcaa

SEQ ID NO: 7075063 - DNA, 22 bp, Homo sapiens
tgaggccaactagggagatgga

SEQ ID NO: 7075064 - DNA, 23 bp, Homo sapiens
tgaggcaggcggatcacgaggtc

SEQ ID NO: 7075065 - DNA, 22 bp, Homo sapiens
tgaggcaggatgcttgcacagg

SEQ ID NO: 7075066 - DNA, 22 bp, Homo sapiens
tgaggcaggagttcaggctgcg

SEQ ID NO: 7075067 - DNA, 22 bp, Homo sapiens
tgaggcaggagttcaggctgcg

SEQ ID NO: 7075068 - DNA, 22 bp, Homo sapiens
tgaggcaggaggattgcaggat

SEQ ID NO: 7075069 - DNA, 22 bp, Homo sapiens
tgaggcaggaggattgcaggat

SEQ ID NO: 7075070 - DNA, 22 bp, Homo sapiens
tgaggcaggagaatggcgggaa

SEQ ID NO: 7075071 - DNA, 18 bp, Homo sapiens
tgaggccagagtgggcat

SEQ ID NO: 7075072 - DNA, 22 bp, Homo sapiens
tgaggccagcttcagcagtgga

SEQ ID NO: 7075073 - DNA, 22 bp, Homo sapiens
tgaggccccgaagctgaggttt

SEQ ID NO: 7075074 - DNA, 18 bp, Homo sapiens
tgaggcccgcagaggtgg

SEQ ID NO: 7075075 - DNA, 22 bp, Homo sapiens
tgaggcccgggtggaggaatgc

SEQ ID NO: 7075076 - DNA, 22 bp, Homo sapiens
tgaggccctagggcatgggaga

SEQ ID NO: 7075077 - DNA, 22 bp, Homo sapiens
tgaggccctctgggctggtcct

SEQ ID NO: 7075078 - DNA, 22 bp, Homo sapiens
tgaggcctctgaggcctaggct

SEQ ID NO: 7075079 - DNA, 17 bp, Homo sapiens
tgaggcctgcatcagtg

SEQ ID NO: 7075080 - DNA, 17 bp, Homo sapiens
tgaggcctgcatcagtg

SEQ ID NO: 7075081 - DNA, 21 bp, Homo sapiens
tgaggcctgccagtctcagaa

SEQ ID NO: 7075082 - DNA, 22 bp, Homo sapiens
tgaggcaggagaatcacatgaa

SEQ ID NO: 7075083 - DNA, 22 bp, Homo sapiens
tgaggcaggagaatcacatgaa

SEQ ID NO: 7075084 - DNA, 22 bp, Homo sapiens
tgaggcaggagaatcaccggaa

SEQ ID NO: 7075085 - DNA, 20 bp, Homo sapiens
tgaggcaggagaatggcatg

SEQ ID NO: 7075086 - DNA, 22 bp, Homo sapiens
tgaggcaggagaatcacatgaa

SEQ ID NO: 7075087 - DNA, 22 bp, Homo sapiens
tgaggcaggactgagcgggatg

SEQ ID NO: 7075088 - DNA, 22 bp, Homo sapiens
tgaggcaggacatggacaactg

SEQ ID NO: 7075089 - DNA, 22 bp, Homo sapiens
tgaggcactgggagagcacact

SEQ ID NO: 7075090 - DNA, 22 bp, Homo sapiens
tgaggcagctttttctgtgtgt

SEQ ID NO: 7075091 - DNA, 22 bp, Homo sapiens
tgaggcagctttttctgtgtgt

SEQ ID NO: 7075092 - DNA, 22 bp, Homo sapiens
tgaggatggtgttggagagggc

SEQ ID NO: 7075093 - DNA, 21 bp, Homo sapiens
tgaggatgtgcagcagcagga

SEQ ID NO: 7075094 - DNA, 21 bp, Homo sapiens
tgaggatgtgcagcagcagga

SEQ ID NO: 7075095 - DNA, 22 bp, Homo sapiens
tgaggcacatccaggccagctc

SEQ ID NO: 7075096 - DNA, 19 bp, Homo sapiens
tgaggcacatgataagaac

SEQ ID NO: 7075097 - DNA, 19 bp, Homo sapiens
tgaggcactagtctggtcc

SEQ ID NO: 7075098 - DNA, 22 bp, Homo sapiens
tgaggatggtcccgaggacact

SEQ ID NO: 7075099 - DNA, 22 bp, Homo sapiens
tgaggatggggagatggtgtct

SEQ ID NO: 7075100 - DNA, 22 bp, Homo sapiens
tgaggatggtcccgaggacact

SEQ ID NO: 7075101 - DNA, 22 bp, Homo sapiens
tgaggatggaatgctgtgcaag

SEQ ID NO: 7075102 - DNA, 22 bp, Homo sapiens
tgaggatggcagtgtgctcagc

SEQ ID NO: 7075103 - DNA, 22 bp, Homo sapiens
tgaggatggcagtgtgctcagc

SEQ ID NO: 7075104 - DNA, 22 bp, Homo sapiens
tgaggatgacgatggcaatggc

SEQ ID NO: 7075105 - DNA, 22 bp, Homo sapiens
tgaggatgagatgagataacac

SEQ ID NO: 7075106 - DNA, 22 bp, Homo sapiens
tgaggatgacgatggcaatggc

SEQ ID NO: 7075107 - DNA, 22 bp, Homo sapiens
tgaggaggtcagagtctggctg

SEQ ID NO: 7075108 - DNA, 22 bp, Homo sapiens
tgaggaggcccaggttggggct

SEQ ID NO: 7075109 - DNA, 22 bp, Homo sapiens
tgaggaggtcagagtctggctg

SEQ ID NO: 7075110 - DNA, 23 bp, Homo sapiens
tgaggagcatagctgactgacag

SEQ ID NO: 7075111 - DNA, 22 bp, Homo sapiens
tgaggagccactctagcagtca

SEQ ID NO: 7075112 - DNA, 22 bp, Homo sapiens
tgaggaagaacaagaatttaga

SEQ ID NO: 7075113 - DNA, 22 bp, Homo sapiens
tgaggaagcaaaggcttgtgtg

SEQ ID NO: 7075114 - DNA, 22 bp, Homo sapiens
tgaggaagcaaaggcttgtgtg

SEQ ID NO: 7075115 - DNA, 22 bp, Homo sapiens
tgaggaagccaaacagctacac

SEQ ID NO: 7075116 - DNA, 22 bp, Homo sapiens
tgaggaaggaattgaggtttta

SEQ ID NO: 7075117 - DNA, 22 bp, Homo sapiens
tgaggaaggaattgaggtttta

SEQ ID NO: 7075118 - DNA, 22 bp, Homo sapiens
tgaggaagggtgtgacggcacc

SEQ ID NO: 7075119 - DNA, 22 bp, Homo sapiens
tgaggaagggtgtgacggcacc

SEQ ID NO: 7075120 - DNA, 22 bp, Homo sapiens
tgaggaagtggttgtatggttt

SEQ ID NO: 7075121 - DNA, 22 bp, Homo sapiens
tgaggaagttgatctcatcagt

SEQ ID NO: 7075122 - DNA, 22 bp, Homo sapiens
tgaggagaaatgctcagagcca

SEQ ID NO: 7075123 - DNA, 22 bp, Homo sapiens
tgaggagaaatgctcagagcca

SEQ ID NO: 7075124 - DNA, 22 bp, Homo sapiens
tgaggctctccaagcagatgag

SEQ ID NO: 7075125 - DNA, 22 bp, Homo sapiens
tgaggctctatgtggtagatta

SEQ ID NO: 7075126 - DNA, 17 bp, Homo sapiens
tgaggctcggtgaggag

SEQ ID NO: 7075127 - DNA, 22 bp, Homo sapiens
tgaggctgccttgggaagaggg

SEQ ID NO: 7075128 - DNA, 22 bp, Homo sapiens
tgaggctgccttgggaagaggg

SEQ ID NO: 7075129 - DNA, 22 bp, Homo sapiens
tgaggctggatgggatgcctcc

SEQ ID NO: 7075130 - DNA, 22 bp, Homo sapiens
tgaggctggatgggatgcctcc

SEQ ID NO: 7075131 - DNA, 22 bp, Homo sapiens
tgaggctggatgggatgcctcc

SEQ ID NO: 7075132 - DNA, 22 bp, Homo sapiens
tgaggctggcaaggctggtatt

SEQ ID NO: 7075133 - DNA, 22 bp, Homo sapiens
tgaggctggcaaggctggtatt

SEQ ID NO: 7075134 - DNA, 22 bp, Homo sapiens
tgaggctggcaaggctggtatt

SEQ ID NO: 7075135 - DNA, 22 bp, Homo sapiens
tgaggctgttctaccagggcca

SEQ ID NO: 7075136 - DNA, 22 bp, Homo sapiens
tgaggctgttctaccagggcca

SEQ ID NO: 7075137 - DNA, 22 bp, Homo sapiens
tgaggctgttctaccagggcca

SEQ ID NO: 7075138 - DNA, 22 bp, Homo sapiens
tgaggctgttctaccagggcca

SEQ ID NO: 7075139 - DNA, 21 bp, Homo sapiens
tgaggctgttgtaccagggag

SEQ ID NO: 7075140 - DNA, 21 bp, Homo sapiens
tgaggctgttgtaccagggag

SEQ ID NO: 7075141 - DNA, 21 bp, Homo sapiens
tgaggctgttgtaccagggag

SEQ ID NO: 7075142 - DNA, 21 bp, Homo sapiens
tgaggctgttgtaccagggag

SEQ ID NO: 7075143 - DNA, 22 bp, Homo sapiens
tgaggcttagatttggtaactc

SEQ ID NO: 7075144 - DNA, 22 bp, Homo sapiens
tgaggcttggagaggtcaggga

SEQ ID NO: 7075145 - DNA, 22 bp, Homo sapiens
tgaggctccttgtagagagtgg

SEQ ID NO: 7075146 - DNA, 22 bp, Homo sapiens
tgaggctcattctgcatgccaa

SEQ ID NO: 7075147 - DNA, 20 bp, Homo sapiens
tgaggctcagagaggttgag

SEQ ID NO: 7075148 - DNA, 22 bp, Homo sapiens
tgaggctcagagcacctgctcc

SEQ ID NO: 7075149 - DNA, 22 bp, Homo sapiens
tgaggctcagagaagtgctgtt

SEQ ID NO: 7075150 - DNA, 22 bp, Homo sapiens
tgaggctcagagaacagtgact

SEQ ID NO: 7075151 - DNA, 22 bp, Homo sapiens
tgaggctcacgaacagaagact

SEQ ID NO: 7075152 - DNA, 22 bp, Homo sapiens
tgaggctcaagaaagatttgtt

SEQ ID NO: 7075153 - DNA, 21 bp, Homo sapiens
tgaggcctgccagtctcagaa

SEQ ID NO: 7075154 - DNA, 22 bp, Homo sapiens
tgagggagtgtggatacagtag

SEQ ID NO: 7075155 - DNA, 22 bp, Homo sapiens
tgagggagttgggtgtatagga

SEQ ID NO: 7075156 - DNA, 22 bp, Homo sapiens
tgagggagcacacactgaagtg

SEQ ID NO: 7075157 - DNA, 22 bp, Homo sapiens
tgagggagcacacactgaagtg

SEQ ID NO: 7075158 - DNA, 22 bp, Homo sapiens
tgagtaataaactgtcttgctc

SEQ ID NO: 7075159 - DNA, 22 bp, Homo sapiens
tgagtatcaattacatagttgt

SEQ ID NO: 7075160 - DNA, 22 bp, Homo sapiens
tgagtcacatccatttttgtgt

SEQ ID NO: 7075161 - DNA, 22 bp, Homo sapiens
tgaggtggctagggaggcactc

SEQ ID NO: 7075162 - DNA, 22 bp, Homo sapiens
tgaggtggccgaggagcaggac

SEQ ID NO: 7075163 - DNA, 22 bp, Homo sapiens
tgaggtgccacccaagagcctt

SEQ ID NO: 7075164 - DNA, 22 bp, Homo sapiens
tgaggtggaaggatcctttgaa

SEQ ID NO: 7075165 - DNA, 22 bp, Homo sapiens
tgaggtggcacacacttcctgc

SEQ ID NO: 7075166 - DNA, 22 bp, Homo sapiens
tgaggtggctagggaggcactc

SEQ ID NO: 7075167 - DNA, 22 bp, Homo sapiens
tgaggtggctagggaggcactc

SEQ ID NO: 7075168 - DNA, 22 bp, Homo sapiens
tgaggtggctagggaggcactc

SEQ ID NO: 7075169 - DNA, 22 bp, Homo sapiens
tgaggtggctggatctcagcct

SEQ ID NO: 7075170 - DNA, 22 bp, Homo sapiens
tgaggtgggcttgtggatttgc

SEQ ID NO: 7075171 - DNA, 22 bp, Homo sapiens
tgaggtgggcttgtggatttgc

SEQ ID NO: 7075172 - DNA, 22 bp, Homo sapiens
tgaggtgggtgtcaggtcagag

SEQ ID NO: 7075173 - DNA, 22 bp, Homo sapiens
tgaggtgggtggcttctgttat

SEQ ID NO: 7075174 - DNA, 22 bp, Homo sapiens
tgaggtggtccaaagactgttt

SEQ ID NO: 7075175 - DNA, 22 bp, Homo sapiens
tgaggtggtccaaagactgttt

SEQ ID NO: 7075176 - DNA, 22 bp, Homo sapiens
tgaggtgggtgtcaggtcagag

SEQ ID NO: 7075177 - DNA, 22 bp, Homo sapiens
tgaggtgggtgtcaggtcagag

SEQ ID NO: 7075178 - DNA, 22 bp, Homo sapiens
tgaggtggtgctaatctctgct

SEQ ID NO: 7075179 - DNA, 22 bp, Homo sapiens
tgaggtggtgctaatctctgct

SEQ ID NO: 7075180 - DNA, 22 bp, Homo sapiens
tgaggtggttactgtggtgctc

SEQ ID NO: 7075181 - DNA, 22 bp, Homo sapiens
tgaggtggttactgtggtgctc

SEQ ID NO: 7075182 - DNA, 22 bp, Homo sapiens
tgaggtggttcaagagccttgt

SEQ ID NO: 7075183 - DNA, 22 bp, Homo sapiens
tgaggtggttcaagagccttgt

SEQ ID NO: 7075184 - DNA, 22 bp, Homo sapiens
tgaggtggtttgtatcactggg

SEQ ID NO: 7075185 - DNA, 22 bp, Homo sapiens
tgaggtggtttgtatcactggg

SEQ ID NO: 7075186 - DNA, 22 bp, Homo sapiens
tgaggtgtgtccccagggaggt

SEQ ID NO: 7075187 - DNA, 22 bp, Homo sapiens
tgaggttatttattatgcatga

SEQ ID NO: 7075188 - DNA, 22 bp, Homo sapiens
tgaggggcggcctgcagaggcc

SEQ ID NO: 7075189 - DNA, 19 bp, Homo sapiens
tgaggggctcacagtctca

SEQ ID NO: 7075190 - DNA, 22 bp, Homo sapiens
tgaggggtaagtaaaggaattg

SEQ ID NO: 7075191 - DNA, 21 bp, Homo sapiens
tgaggggttataacagggtgg

SEQ ID NO: 7075192 - DNA, 22 bp, Homo sapiens
tgaggggttgtgagaaatgtag

SEQ ID NO: 7075193 - DNA, 22 bp, Homo sapiens
tgagggtcatttggaagtggaa

SEQ ID NO: 7075194 - DNA, 22 bp, Homo sapiens
tgagggtggccttgtgtggact

SEQ ID NO: 7075195 - DNA, 22 bp, Homo sapiens
tgaggtctgcagggctgtgcat

SEQ ID NO: 7075196 - DNA, 22 bp, Homo sapiens
tgaggtcttttatagtgtgtca

SEQ ID NO: 7075197 - DNA, 22 bp, Homo sapiens
tgaggtgaatggtgtccctgga

SEQ ID NO: 7075198 - DNA, 22 bp, Homo sapiens
tgaggtgagtcatgcattggag

SEQ ID NO: 7075199 - DNA, 22 bp, Homo sapiens
tgcagggtagatgcaggctgtg

SEQ ID NO: 7075200 - DNA, 22 bp, Homo sapiens
tgcaggggcttgtctgggcctg

SEQ ID NO: 7075201 - DNA, 22 bp, Homo sapiens
tgcaggggcttgtctgggcctg

SEQ ID NO: 7075202 - DNA, 19 bp, Homo sapiens
tgcagggctgcgcctgggg

SEQ ID NO: 7075203 - DNA, 19 bp, Homo sapiens
tgcagggctgcgcctgggg

SEQ ID NO: 7075204 - DNA, 22 bp, Homo sapiens
tgcagggcttcctcttggagtt

SEQ ID NO: 7075205 - DNA, 22 bp, Homo sapiens
tgcagggcttcctcttggagtt

SEQ ID NO: 7075206 - DNA, 22 bp, Homo sapiens
tgcaggtgagtgcaggggctca

SEQ ID NO: 7075207 - DNA, 22 bp, Homo sapiens
tgcaggtgagtgcaggggctca

SEQ ID NO: 7075208 - DNA, 22 bp, Homo sapiens
tgcaggtctccattggcagact

SEQ ID NO: 7075209 - DNA, 22 bp, Homo sapiens
tgcaggtgaaaattatgaggat

SEQ ID NO: 7075210 - DNA, 22 bp, Homo sapiens
tgcagggtgtccggaggatcac

SEQ ID NO: 7075211 - DNA, 22 bp, Homo sapiens
tgcaggtgattctgatgcagtt

SEQ ID NO: 7075212 - DNA, 22 bp, Homo sapiens
tgcaggtggattcaatgtggga

SEQ ID NO: 7075213 - DNA, 22 bp, Homo sapiens
tgcaggtggctccagggactgc

SEQ ID NO: 7075214 - DNA, 22 bp, Homo sapiens
tgcaggtggctccagggactgc

SEQ ID NO: 7075215 - DNA, 22 bp, Homo sapiens
tgcagtgtttttcagggcatat

SEQ ID NO: 7075216 - DNA, 22 bp, Homo sapiens
tgcagtgtgacctgtagcgagc

SEQ ID NO: 7075217 - DNA, 22 bp, Homo sapiens
tgcaggttctgaccagccaact

SEQ ID NO: 7075218 - DNA, 21 bp, Homo sapiens
tgcagtatgtatttgtatcca

SEQ ID NO: 7075219 - DNA, 22 bp, Homo sapiens
tgcagtgggccggaggccaggg

SEQ ID NO: 7075220 - DNA, 22 bp, Homo sapiens
tgcagtgggccggaggccaggg

SEQ ID NO: 7075221 - DNA, 22 bp, Homo sapiens
tgcagtggtggtaaagatgctc

SEQ ID NO: 7075222 - DNA, 22 bp, Homo sapiens
tgcaggtgtgggcaggggagca

SEQ ID NO: 7075223 - DNA, 22 bp, Homo sapiens
tgcaggtgtgggcaggggagca

SEQ ID NO: 7075224 - DNA, 22 bp, Homo sapiens
tgcaggtgtctgggggcaacag

SEQ ID NO: 7075225 - DNA, 20 bp, Homo sapiens
tgcaggtgtgtccaagcact

SEQ ID NO: 7075226 - DNA, 22 bp, Homo sapiens
tgcaggtgtgtgcaagggaggg

SEQ ID NO: 7075227 - DNA, 20 bp, Homo sapiens
tgcaggtgggcccttctggg

SEQ ID NO: 7075228 - DNA, 22 bp, Homo sapiens
tgcaggtggtccttcctctgct

SEQ ID NO: 7075229 - DNA, 22 bp, Homo sapiens
tgcaggtgtctccagggcaggt

SEQ ID NO: 7075230 - DNA, 22 bp, Homo sapiens
tgcagggcccttggggttgaac

SEQ ID NO: 7075231 - DNA, 22 bp, Homo sapiens
tgcagggcccctctgcatgagt

SEQ ID NO: 7075232 - DNA, 22 bp, Homo sapiens
tgcagggccgctggaggtcatg

SEQ ID NO: 7075233 - DNA, 22 bp, Homo sapiens
tgcagggctacaggactacaac

SEQ ID NO: 7075234 - DNA, 22 bp, Homo sapiens
tgcagggccatggtggcggctg

SEQ ID NO: 7075235 - DNA, 22 bp, Homo sapiens
tgcagggccagactgggttgga

SEQ ID NO: 7075236 - DNA, 22 bp, Homo sapiens
tgcagggccatggtggcggctg

SEQ ID NO: 7075237 - DNA, 22 bp, Homo sapiens
tgcagggccagactgggttgga

SEQ ID NO: 7075238 - DNA, 22 bp, Homo sapiens
tgcagggcatctttgaagtgtg

SEQ ID NO: 7075239 - DNA, 22 bp, Homo sapiens
tgcagggcagtttgtttcggca

SEQ ID NO: 7075240 - DNA, 22 bp, Homo sapiens
tgcagggcatagggtccagttt

SEQ ID NO: 7075241 - DNA, 22 bp, Homo sapiens
tgcagggcatctttgaagtgtg

SEQ ID NO: 7075242 - DNA, 23 bp, Homo sapiens
tgcagggcaagttagagacccca

SEQ ID NO: 7075243 - DNA, 22 bp, Homo sapiens
tgcagggcacacgcacgggtgt

SEQ ID NO: 7075244 - DNA, 22 bp, Homo sapiens
tgcagggcacggtgcgcgtggg

SEQ ID NO: 7075245 - DNA, 22 bp, Homo sapiens
tgcagggcacggtgcgcgtggg

SEQ ID NO: 7075246 - DNA, 22 bp, Homo sapiens
tgcagggcagatatgactgtag

SEQ ID NO: 7075247 - DNA, 22 bp, Homo sapiens
tgcagggcagctagggagcttt

SEQ ID NO: 7075248 - DNA, 22 bp, Homo sapiens
tgcagggcagctagggagcttt

SEQ ID NO: 7075249 - DNA, 22 bp, Homo sapiens
tgcaggctccatgaggacaggc

SEQ ID NO: 7075250 - DNA, 17 bp, Homo sapiens
tgcaggctcctgtccct

SEQ ID NO: 7075251 - DNA, 22 bp, Homo sapiens
tgcaggctctctgctgccagat

SEQ ID NO: 7075252 - DNA, 22 bp, Homo sapiens
tgcaggctctgtgtgtgcctgg

SEQ ID NO: 7075253 - DNA, 22 bp, Homo sapiens
tgcaggctgccttcacagagcc

SEQ ID NO: 7075254 - DNA, 22 bp, Homo sapiens
tgcaggctgccttcacagagcc

SEQ ID NO: 7075255 - DNA, 22 bp, Homo sapiens
tgcaggctgctggcagtagctt

SEQ ID NO: 7075256 - DNA, 22 bp, Homo sapiens
tgcaggctggggaggcagactt

SEQ ID NO: 7075257 - DNA, 22 bp, Homo sapiens
tgcaggctgtaatctgaggcta

SEQ ID NO: 7075258 - DNA, 21 bp, Homo sapiens
tgcaggctgtgcgctcctgcc

SEQ ID NO: 7075259 - DNA, 22 bp, Homo sapiens
tgcaggctttagccccatggct

SEQ ID NO: 7075260 - DNA, 22 bp, Homo sapiens
tgcagggaaaacccaggatgct

SEQ ID NO: 7075261 - DNA, 22 bp, Homo sapiens
tgcagggaaagtgttggcagca

SEQ ID NO: 7075262 - DNA, 22 bp, Homo sapiens
tgcagggaacttggacagctag

SEQ ID NO: 7075263 - DNA, 22 bp, Homo sapiens
tgcagggaacttggacagctag

SEQ ID NO: 7075264 - DNA, 22 bp, Homo sapiens
tgcagggaagtcccagctcctg

SEQ ID NO: 7075265 - DNA, 22 bp, Homo sapiens
tgcatagttctccttcctcctc

SEQ ID NO: 7075266 - DNA, 22 bp, Homo sapiens
tgcatagaggatccagtgtggt

SEQ ID NO: 7075267 - DNA, 22 bp, Homo sapiens
tgcatacacacataggtatggg

SEQ ID NO: 7075268 - DNA, 22 bp, Homo sapiens
tgcatacataaagtgctatcat

SEQ ID NO: 7075269 - DNA, 18 bp, Homo sapiens
tgcatatactgcctatct

SEQ ID NO: 7075270 - DNA, 22 bp, Homo sapiens
tgcatcatataatgtctatgga

SEQ ID NO: 7075271 - DNA, 22 bp, Homo sapiens
tgcatcatttataatgtctttg

SEQ ID NO: 7075272 - DNA, 22 bp, Homo sapiens
tgcataaaatatgagaaatgta

SEQ ID NO: 7075273 - DNA, 21 bp, Homo sapiens
tgcataaagaaatacaaatac

SEQ ID NO: 7075274 - DNA, 22 bp, Homo sapiens
tgcataaagtgccatagtatta

SEQ ID NO: 7075275 - DNA, 19 bp, Homo sapiens
tgcataaattatatacttt

SEQ ID NO: 7075276 - DNA, 22 bp, Homo sapiens
tgcatgatagagatggtattag

SEQ ID NO: 7075277 - DNA, 22 bp, Homo sapiens
tgcatgtgtgtgtatttataaa

SEQ ID NO: 7075278 - DNA, 22 bp, Homo sapiens
tgcatgtatttaaagttgcaat

SEQ ID NO: 7075279 - DNA, 23 bp, Homo sapiens
tgcatgtgaattcatacttgttt

SEQ ID NO: 7075280 - DNA, 22 bp, Homo sapiens
tgcatttttgataactgtgtac

SEQ ID NO: 7075281 - DNA, 22 bp, Homo sapiens
tgcatttccagatttctggagt

SEQ ID NO: 7075282 - DNA, 22 bp, Homo sapiens
tgcatttgcaatgggtacacaa

SEQ ID NO: 7075283 - DNA, 22 bp, Homo sapiens
tgcattggtcttaatcttcagg

SEQ ID NO: 7075284 - DNA, 23 bp, Homo sapiens
tgccagaggcagtcacagtggtg

SEQ ID NO: 7075285 - DNA, 22 bp, Homo sapiens
tgccagagagtggctgggtgtc

SEQ ID NO: 7075286 - DNA, 22 bp, Homo sapiens
tgccagagagtggctgggtgtc

SEQ ID NO: 7075287 - DNA, 23 bp, Homo sapiens
tgccagaggcagtcacagtggtg

SEQ ID NO: 7075288 - DNA, 22 bp, Homo sapiens
tgccacagttgtttgtgctcta

SEQ ID NO: 7075289 - DNA, 22 bp, Homo sapiens
tgccacagtttcatggattctg

SEQ ID NO: 7075290 - DNA, 22 bp, Homo sapiens
tgccaccatctggctgtgttga

SEQ ID NO: 7075291 - DNA, 22 bp, Homo sapiens
tgccacccctctgcaccctcag

SEQ ID NO: 7075292 - DNA, 22 bp, Homo sapiens
tgccagagaagacccagtcact

SEQ ID NO: 7075293 - DNA, 22 bp, Homo sapiens
tgcctgagtgatgtggcagcca

SEQ ID NO: 7075294 - DNA, 22 bp, Homo sapiens
tgcctctgtgtgcaggtgagca

SEQ ID NO: 7075295 - DNA, 22 bp, Homo sapiens
tgcctctgttgagccttggctg

SEQ ID NO: 7075296 - DNA, 22 bp, Homo sapiens
tgcctcttggagcctttcctct

SEQ ID NO: 7075297 - DNA, 22 bp, Homo sapiens
tgcctcttggagcctttcctct

SEQ ID NO: 7075298 - DNA, 22 bp, Homo sapiens
tgcctctgggtgaccaaggagc

SEQ ID NO: 7075299 - DNA, 22 bp, Homo sapiens
tgcctctggttatctggtacct

SEQ ID NO: 7075300 - DNA, 22 bp, Homo sapiens
tgcctctggttatctggtacct

SEQ ID NO: 7075301 - DNA, 22 bp, Homo sapiens
tgcctctggttatctggtacct

SEQ ID NO: 7075302 - DNA, 22 bp, Homo sapiens
tgcctctgtggaaatggtggtc

SEQ ID NO: 7075303 - DNA, 22 bp, Homo sapiens
tgcctctgtgggcagagctgcc

SEQ ID NO: 7075304 - DNA, 22 bp, Homo sapiens
tgcctctgtgggcagagctgcc

SEQ ID NO: 7075305 - DNA, 22 bp, Homo sapiens
tgcctctgtgggcagagctgcc

SEQ ID NO: 7075306 - DNA, 22 bp, Homo sapiens
tgcctctgtgggccttcctggc

SEQ ID NO: 7075307 - DNA, 22 bp, Homo sapiens
tgcctctgtgggccttcctggc

SEQ ID NO: 7075308 - DNA, 22 bp, Homo sapiens
tgcctcaggcacctggcaggtt

SEQ ID NO: 7075309 - DNA, 22 bp, Homo sapiens
tgcctcagtcagcttccctggg

SEQ ID NO: 7075310 - DNA, 22 bp, Homo sapiens
tgcctcagagtgggcttgctat

SEQ ID NO: 7075311 - DNA, 22 bp, Homo sapiens
tgcctcagctgaggccgctcca

SEQ ID NO: 7075312 - DNA, 22 bp, Homo sapiens
tgcctcagctgaggccgctcca

SEQ ID NO: 7075313 - DNA, 22 bp, Homo sapiens
tgcctccctctctgccactgga

SEQ ID NO: 7075314 - DNA, 22 bp, Homo sapiens
tgcctccctggcaagtctctcc

SEQ ID NO: 7075315 - DNA, 22 bp, Homo sapiens
tgcctcgtgtctgagtctgttc

SEQ ID NO: 7075316 - DNA, 22 bp, Homo sapiens
tgcctctgaggaagattgtgtt

SEQ ID NO: 7075317 - DNA, 22 bp, Homo sapiens
tgcctctgaggaagattgtgtt

SEQ ID NO: 7075318 - DNA, 22 bp, Homo sapiens
tgcctctgcctccattgttagt

SEQ ID NO: 7075319 - DNA, 22 bp, Homo sapiens
tgcctctgcctccattgttagt

SEQ ID NO: 7075320 - DNA, 23 bp, Homo sapiens
tgcctctgcctccctagtctgca

SEQ ID NO: 7075321 - DNA, 23 bp, Homo sapiens
tgcctctgcctccctagtctgca

SEQ ID NO: 7075322 - DNA, 22 bp, Homo sapiens
tgcctctgctgctgtggcatca

SEQ ID NO: 7075323 - DNA, 22 bp, Homo sapiens
tgcctgccaggtgcttcttcat

SEQ ID NO: 7075324 - DNA, 22 bp, Homo sapiens
tgcctgccatgcagaaagctga

SEQ ID NO: 7075325 - DNA, 22 bp, Homo sapiens
tgcctgccccacaaggggttgc

SEQ ID NO: 7075326 - DNA, 22 bp, Homo sapiens
tgcctgctgattggagttgaat

SEQ ID NO: 7075327 - DNA, 22 bp, Homo sapiens
tgcctgctgccactgctgttac

SEQ ID NO: 7075328 - DNA, 22 bp, Homo sapiens
tgcctgctgcctttcatcccaa

SEQ ID NO: 7075329 - DNA, 22 bp, Homo sapiens
tgcctgcttgtgtacctggtga

SEQ ID NO: 7075330 - DNA, 22 bp, Homo sapiens
tgcctgcttgtttacctactcc

SEQ ID NO: 7075331 - DNA, 22 bp, Homo sapiens
tgcctggcaccccagtctgcac

SEQ ID NO: 7075332 - DNA, 22 bp, Homo sapiens
tgccgcagtgcggggagggccc

SEQ ID NO: 7075333 - DNA, 22 bp, Homo sapiens
tgccctgttcctgcctccagct

SEQ ID NO: 7075334 - DNA, 17 bp, Homo sapiens
tgccctgtgcctggtgt

SEQ ID NO: 7075335 - DNA, 20 bp, Homo sapiens
tgccctgtggaggggaaagg

SEQ ID NO: 7075336 - DNA, 22 bp, Homo sapiens
tgccctgttatcttggaagagt

SEQ ID NO: 7075337 - DNA, 22 bp, Homo sapiens
tgccctgtctaagctgtcagta

SEQ ID NO: 7075338 - DNA, 22 bp, Homo sapiens
tgccctggctcttcttgttcca

SEQ ID NO: 7075339 - DNA, 22 bp, Homo sapiens
tgccctggctggagtgcagtgg

SEQ ID NO: 7075340 - DNA, 22 bp, Homo sapiens
tgccctgggaacacagatgcca

SEQ ID NO: 7075341 - DNA, 22 bp, Homo sapiens
tgccctgggaacacagatgcca

SEQ ID NO: 7075342 - DNA, 22 bp, Homo sapiens
tgccgcagtgcggggagggccc

SEQ ID NO: 7075343 - DNA, 22 bp, Homo sapiens
tgccgctgtcgccaccatggct

SEQ ID NO: 7075344 - DNA, 22 bp, Homo sapiens
tgcctaactccaccaggcaggt

SEQ ID NO: 7075345 - DNA, 22 bp, Homo sapiens
tgcctaggaaacctcatgcttc

SEQ ID NO: 7075346 - DNA, 22 bp, Homo sapiens
tgcctcagagacctgacagtac

SEQ ID NO: 7075347 - DNA, 22 bp, Homo sapiens
tgccctggcattgggttggata

SEQ ID NO: 7075348 - DNA, 22 bp, Homo sapiens
tgccctggcacacacacagctg

SEQ ID NO: 7075349 - DNA, 22 bp, Homo sapiens
tgccctggcacacacacagctg

SEQ ID NO: 7075350 - DNA, 22 bp, Homo sapiens
tgccctggcgctgtctctatgg

SEQ ID NO: 7075351 - DNA, 22 bp, Homo sapiens
tgccctggctcctcccacgctg

SEQ ID NO: 7075352 - DNA, 22 bp, Homo sapiens
tgccctggctcctcccacgctg

SEQ ID NO: 7075353 - DNA, 22 bp, Homo sapiens
tgccctggctctccactagttt

SEQ ID NO: 7075354 - DNA, 22 bp, Homo sapiens
tgccctggctctccactagttt

SEQ ID NO: 7075355 - DNA, 22 bp, Homo sapiens
tgccctggagtcagtggctatt

SEQ ID NO: 7075356 - DNA, 22 bp, Homo sapiens
tgccctggaaccatctacagtc

SEQ ID NO: 7075357 - DNA, 22 bp, Homo sapiens
tgccctggaaccatctacagtc

SEQ ID NO: 7075358 - DNA, 22 bp, Homo sapiens
tgccctggaaccatctacagtc

SEQ ID NO: 7075359 - DNA, 22 bp, Homo sapiens
tgccctggaaatgagaggtgtg

SEQ ID NO: 7075360 - DNA, 22 bp, Homo sapiens
tgccctgctgtggctctgccca

SEQ ID NO: 7075361 - DNA, 22 bp, Homo sapiens
tgcccctgacctcaggcgaagg

SEQ ID NO: 7075362 - DNA, 22 bp, Homo sapiens
tgcccctgatgcctagaacaga

SEQ ID NO: 7075363 - DNA, 19 bp, Homo sapiens
tgcccctgcagtctaccca

SEQ ID NO: 7075364 - DNA, 19 bp, Homo sapiens
tgccccttaagagtttctc

SEQ ID NO: 7075365 - DNA, 22 bp, Homo sapiens
tgccccttctacccgtctctgt

SEQ ID NO: 7075366 - DNA, 22 bp, Homo sapiens
tgccctgccaagaccaagtggt

SEQ ID NO: 7075367 - DNA, 22 bp, Homo sapiens
tgccctgccaagactcagtggt

SEQ ID NO: 7075368 - DNA, 20 bp, Homo sapiens
tgccagggccagcagaggct

SEQ ID NO: 7075369 - DNA, 22 bp, Homo sapiens
tgccagggagccctgctgacca

SEQ ID NO: 7075370 - DNA, 22 bp, Homo sapiens
tgccaggcttagagcaggggct

SEQ ID NO: 7075371 - DNA, 22 bp, Homo sapiens
tgccaggcttagagcaggggct

SEQ ID NO: 7075372 - DNA, 22 bp, Homo sapiens
tgccaggctttggtcaaaggct

SEQ ID NO: 7075373 - DNA, 22 bp, Homo sapiens
tgccaggctccggaacgacagt

SEQ ID NO: 7075374 - DNA, 22 bp, Homo sapiens
tgccaggctgaacagggtctta

SEQ ID NO: 7075375 - DNA, 20 bp, Homo sapiens
tgccaggctgcacgcctgcc

SEQ ID NO: 7075376 - DNA, 22 bp, Homo sapiens
tgccaggctgccctccagtctg

SEQ ID NO: 7075377 - DNA, 22 bp, Homo sapiens
tgccaggctgtcaattcaccca

SEQ ID NO: 7075378 - DNA, 22 bp, Homo sapiens
tgccaggctgtcaattcaccca

SEQ ID NO: 7075379 - DNA, 22 bp, Homo sapiens
tgccaggctgtcctgggcctgg

SEQ ID NO: 7075380 - DNA, 22 bp, Homo sapiens
tgccagggtcctgagggccttg

SEQ ID NO: 7075381 - DNA, 22 bp, Homo sapiens
tgccagggtgtcaggagagcta

SEQ ID NO: 7075382 - DNA, 22 bp, Homo sapiens
tgccagggccatagggagtcta

SEQ ID NO: 7075383 - DNA, 23 bp, Homo sapiens
tgccagggccctgtgtgcaatgc

SEQ ID NO: 7075384 - DNA, 22 bp, Homo sapiens
tgccaggggacctagggatgtc

SEQ ID NO: 7075385 - DNA, 22 bp, Homo sapiens
tgccaggggacctagggatgtc

SEQ ID NO: 7075386 - DNA, 22 bp, Homo sapiens
tgccagtctcaccctgggtcct

SEQ ID NO: 7075387 - DNA, 22 bp, Homo sapiens
tgccatcactgaacttctgaaa

SEQ ID NO: 7075388 - DNA, 22 bp, Homo sapiens
tgccatctgcacccacctgccc

SEQ ID NO: 7075389 - DNA, 22 bp, Homo sapiens
tgccatcttccttcctctgcac

SEQ ID NO: 7075390 - DNA, 22 bp, Homo sapiens
tgccatggaagtggccagacct

SEQ ID NO: 7075391 - DNA, 22 bp, Homo sapiens
tgccaggcaactgcccagccat

SEQ ID NO: 7075392 - DNA, 20 bp, Homo sapiens
tgccaggcacggagtgcatg

SEQ ID NO: 7075393 - DNA, 20 bp, Homo sapiens
tgccaggcacggagtgcatg

SEQ ID NO: 7075394 - DNA, 22 bp, Homo sapiens
tgccaggcacgtgagagtggcc

SEQ ID NO: 7075395 - DNA, 22 bp, Homo sapiens
tgccaggcaggaccctagaacc

SEQ ID NO: 7075396 - DNA, 22 bp, Homo sapiens
tgccaggcagtgtcagattgag

SEQ ID NO: 7075397 - DNA, 22 bp, Homo sapiens
tgccaggcatatggcctctttg

SEQ ID NO: 7075398 - DNA, 22 bp, Homo sapiens
tgccaggcatatggcctctttg

SEQ ID NO: 7075399 - DNA, 22 bp, Homo sapiens
tgccaggcatgtagtagacttg

SEQ ID NO: 7075400 - DNA, 22 bp, Homo sapiens
tgccaggcatgtagtagacttg

SEQ ID NO: 7075401 - DNA, 22 bp, Homo sapiens
tgccaggcatttgacagacact

SEQ ID NO: 7075402 - DNA, 22 bp, Homo sapiens
tgccaggcatttgacagacact

SEQ ID NO: 7075403 - DNA, 22 bp, Homo sapiens
tgccaggccaatgaaggcaggg

SEQ ID NO: 7075404 - DNA, 22 bp, Homo sapiens
tgccaggccaatgaaggcaggg

SEQ ID NO: 7075405 - DNA, 22 bp, Homo sapiens
tgccaggccaattctatttgac

SEQ ID NO: 7075406 - DNA, 22 bp, Homo sapiens
tgccaggccacgtagcttcaag

SEQ ID NO: 7075407 - DNA, 22 bp, Homo sapiens
tgccaggccacgtagcttcaag

SEQ ID NO: 7075408 - DNA, 22 bp, Homo sapiens
tgccaggcccagcagggcggcc

SEQ ID NO: 7075409 - DNA, 22 bp, Homo sapiens
tgccaggcccagctccagagct

SEQ ID NO: 7075410 - DNA, 22 bp, Homo sapiens
tgccaggcccagctccagagct

SEQ ID NO: 7075411 - DNA, 22 bp, Homo sapiens
tgccaggcccagctccagagct

SEQ ID NO: 7075412 - DNA, 22 bp, Homo sapiens
tgccaggccctcccacagatta

SEQ ID NO: 7075413 - DNA, 22 bp, Homo sapiens
tgccaggccctgcggggtccca

SEQ ID NO: 7075414 - DNA, 22 bp, Homo sapiens
tgccaggccctgtgctggatgc

SEQ ID NO: 7075415 - DNA, 22 bp, Homo sapiens
tgccaggccctgtgctggatgc

SEQ ID NO: 7075416 - DNA, 22 bp, Homo sapiens
tgccaggcctcaggagtctcca

SEQ ID NO: 7075417 - DNA, 22 bp, Homo sapiens
tgccaggctcagcccctatctt

SEQ ID NO: 7075418 - DNA, 22 bp, Homo sapiens
tgccaggctcaggatgtccctg

SEQ ID NO: 7075419 - DNA, 22 bp, Homo sapiens
tgcccagcacccagcatgatgc

SEQ ID NO: 7075420 - DNA, 22 bp, Homo sapiens
tgcccagcaataaaccagaaga

SEQ ID NO: 7075421 - DNA, 22 bp, Homo sapiens
tgcccaggatctggcgatgctc

SEQ ID NO: 7075422 - DNA, 20 bp, Homo sapiens
tgcccagcaagagtgcagtt

SEQ ID NO: 7075423 - DNA, 22 bp, Homo sapiens
tgcccacattctgaagctccct

SEQ ID NO: 7075424 - DNA, 22 bp, Homo sapiens
tgccccagacctactgaatggg

SEQ ID NO: 7075425 - DNA, 20 bp, Homo sapiens
tgccccaggcctgcacctgc

SEQ ID NO: 7075426 - DNA, 22 bp, Homo sapiens
tgcccagggtggagtgcagtgg

SEQ ID NO: 7075427 - DNA, 22 bp, Homo sapiens
tgcccaggtttgagtgcccaag

SEQ ID NO: 7075428 - DNA, 22 bp, Homo sapiens
tgcccaggtttgagtgcccaag

SEQ ID NO: 7075429 - DNA, 22 bp, Homo sapiens
tgcccagtctccgggccagccc

SEQ ID NO: 7075430 - DNA, 22 bp, Homo sapiens
tgcccatgtttctctgtatccc

SEQ ID NO: 7075431 - DNA, 22 bp, Homo sapiens
tgcccaggattgtgaggtcagg

SEQ ID NO: 7075432 - DNA, 19 bp, Homo sapiens
tgcccaggccaggttgggc

SEQ ID NO: 7075433 - DNA, 22 bp, Homo sapiens
tgcccaggctggagtacagtgg

SEQ ID NO: 7075434 - DNA, 22 bp, Homo sapiens
tgcccaggctggagtgcagagg

SEQ ID NO: 7075435 - DNA, 22 bp, Homo sapiens
tgcccaggctggagtgcagagg

SEQ ID NO: 7075436 - DNA, 22 bp, Homo sapiens
tgcccaggctggagtgcagtgg

SEQ ID NO: 7075437 - DNA, 22 bp, Homo sapiens
tgcccaggcttcaccctcagag

SEQ ID NO: 7075438 - DNA, 22 bp, Homo sapiens
tgcaaggatatttagtctagtg

SEQ ID NO: 7075439 - DNA, 19 bp, Homo sapiens
tgcaagctttttcttgtta

SEQ ID NO: 7075440 - DNA, 22 bp, Homo sapiens
tgcaaggaagggacagctgaga

SEQ ID NO: 7075441 - DNA, 22 bp, Homo sapiens
tgcaagcttggctgatgttgat

SEQ ID NO: 7075442 - DNA, 22 bp, Homo sapiens
tgcaagggcttagggggctgtg

SEQ ID NO: 7075443 - DNA, 22 bp, Homo sapiens
tgcaaggggtttatgcagatga

SEQ ID NO: 7075444 - DNA, 22 bp, Homo sapiens
tgcacacacaggagtctcctcc

SEQ ID NO: 7075445 - DNA, 22 bp, Homo sapiens
tgcacacactctgcatatactt

SEQ ID NO: 7075446 - DNA, 22 bp, Homo sapiens
tgcacacagtggacaagtcttg

SEQ ID NO: 7075447 - DNA, 22 bp, Homo sapiens
tgcaaagaagcctttgccttct

SEQ ID NO: 7075448 - DNA, 22 bp, Homo sapiens
tgattttcatgggtgatctttg

SEQ ID NO: 7075449 - DNA, 22 bp, Homo sapiens
tgatttttagctattctgaaga

SEQ ID NO: 7075450 - DNA, 22 bp, Homo sapiens
tgatttttagctattctgaaga

SEQ ID NO: 7075451 - DNA, 22 bp, Homo sapiens
tgcaaaaaggcagactggtgat

SEQ ID NO: 7075452 - DNA, 22 bp, Homo sapiens
tgcaaaatgacttctgaaaaga

SEQ ID NO: 7075453 - DNA, 22 bp, Homo sapiens
tgatttatgcattatactgttg

SEQ ID NO: 7075454 - DNA, 22 bp, Homo sapiens
tgatttccccagtcttgctgct

SEQ ID NO: 7075455 - DNA, 22 bp, Homo sapiens
tgatttaggaaacagctacagg

SEQ ID NO: 7075456 - DNA, 19 bp, Homo sapiens
tgagtgggcccctgcagac

SEQ ID NO: 7075457 - DNA, 22 bp, Homo sapiens
tgagtgtgctaggtgtctcggt

SEQ ID NO: 7075458 - DNA, 22 bp, Homo sapiens
tgagtgtggggaatgtcatgag

SEQ ID NO: 7075459 - DNA, 23 bp, Homo sapiens
tgagtgtgttccctgtgagattt

SEQ ID NO: 7075460 - DNA, 22 bp, Homo sapiens
tgagttaaatgagaacatgaaa

SEQ ID NO: 7075461 - DNA, 22 bp, Homo sapiens
tgagttataatgaatatttgaa

SEQ ID NO: 7075462 - DNA, 22 bp, Homo sapiens
tgagttatctaaaatagtcaaa

SEQ ID NO: 7075463 - DNA, 22 bp, Homo sapiens
tgagttatctaaaatagtcaaa

SEQ ID NO: 7075464 - DNA, 22 bp, Homo sapiens
tgagttatatatactggctctg

SEQ ID NO: 7075465 - DNA, 22 bp, Homo sapiens
tgagttatggagaataaagtca

SEQ ID NO: 7075466 - DNA, 22 bp, Homo sapiens
tgagttattgagaaataactgc

SEQ ID NO: 7075467 - DNA, 22 bp, Homo sapiens
tgagttattgcagcttcctcct

SEQ ID NO: 7075468 - DNA, 22 bp, Homo sapiens
tgagttcaaattttggctctgc

SEQ ID NO: 7075469 - DNA, 22 bp, Homo sapiens
tgagttcagatcctggctctgc

SEQ ID NO: 7075470 - DNA, 22 bp, Homo sapiens
tgagtgggacctgcgtgtgtca

SEQ ID NO: 7075471 - DNA, 22 bp, Homo sapiens
tgagtggagtagtgaatgcatt

SEQ ID NO: 7075472 - DNA, 19 bp, Homo sapiens
tgagtgggagcccaggtat

SEQ ID NO: 7075473 - DNA, 22 bp, Homo sapiens
tgagtgggattaaatgaggtga

SEQ ID NO: 7075474 - DNA, 22 bp, Homo sapiens
tgagtggagaacagaggctctc

SEQ ID NO: 7075475 - DNA, 22 bp, Homo sapiens
tgagtggagactgtgtgtagag

SEQ ID NO: 7075476 - DNA, 22 bp, Homo sapiens
tgagtgaaattctggtaaagga

SEQ ID NO: 7075477 - DNA, 22 bp, Homo sapiens
tgagtgaattcaagtaaagggc

SEQ ID NO: 7075478 - DNA, 22 bp, Homo sapiens
tgagtgagctggggagccggtg

SEQ ID NO: 7075479 - DNA, 22 bp, Homo sapiens
tgagtgaggaagcggtggagga

SEQ ID NO: 7075480 - DNA, 20 bp, Homo sapiens
tgagtgagtttgtggcagga

SEQ ID NO: 7075481 - DNA, 20 bp, Homo sapiens
tgagtgctccattctgccca

SEQ ID NO: 7075482 - DNA, 22 bp, Homo sapiens
tgagtgctctgtatgtgccaga

SEQ ID NO: 7075483 - DNA, 22 bp, Homo sapiens
tgatatttaagcaaaaatatgg

SEQ ID NO: 7075484 - DNA, 22 bp, Homo sapiens
tgatatttgctgactgcattgt

SEQ ID NO: 7075485 - DNA, 22 bp, Homo sapiens
tgatatgtgaagctattagttc

SEQ ID NO: 7075486 - DNA, 22 bp, Homo sapiens
tgatatgtaactactccttata

SEQ ID NO: 7075487 - DNA, 21 bp, Homo sapiens
tgatcatttgtgtaaaggaga

SEQ ID NO: 7075488 - DNA, 22 bp, Homo sapiens
tgatcacaagtctgaagaatga

SEQ ID NO: 7075489 - DNA, 22 bp, Homo sapiens
tgatcaaaacattactccacca

SEQ ID NO: 7075490 - DNA, 22 bp, Homo sapiens
tgatcccaatctttcctgctcc

SEQ ID NO: 7075491 - DNA, 22 bp, Homo sapiens
tgatctttactgctgtttataa

SEQ ID NO: 7075492 - DNA, 18 bp, Homo sapiens
tgatctttcatgattcca

SEQ ID NO: 7075493 - DNA, 18 bp, Homo sapiens
tgatctttgagtataatg

SEQ ID NO: 7075494 - DNA, 18 bp, Homo sapiens
tgatctttgagtataatg

SEQ ID NO: 7075495 - DNA, 22 bp, Homo sapiens
tgatctttgggccattaataaa

SEQ ID NO: 7075496 - DNA, 22 bp, Homo sapiens
tgatctttggtagtacgataat

SEQ ID NO: 7075497 - DNA, 22 bp, Homo sapiens
tgatgaaagttcagtagtgaat

SEQ ID NO: 7075498 - DNA, 22 bp, Homo sapiens
tgatgaataaacttgagagtca

SEQ ID NO: 7075499 - DNA, 22 bp, Homo sapiens
tgatgaatgtcatacataatga

SEQ ID NO: 7075500 - DNA, 22 bp, Homo sapiens
tgatgaggtggattcaaagcag

SEQ ID NO: 7075501 - DNA, 22 bp, Homo sapiens
tgatggaaaataaatcttattc

SEQ ID NO: 7075502 - DNA, 22 bp, Homo sapiens
tgatggaaacttgggtaagtca

SEQ ID NO: 7075503 - DNA, 21 bp, Homo sapiens
tgatggaaaggattttgggtc

SEQ ID NO: 7075504 - DNA, 22 bp, Homo sapiens
tgatggaaataaaagcatagct

SEQ ID NO: 7075505 - DNA, 22 bp, Homo sapiens
tgatggaaatatgtaatctggt

SEQ ID NO: 7075506 - DNA, 22 bp, Homo sapiens
tgatggaaatattgacaccaca

SEQ ID NO: 7075507 - DNA, 23 bp, Homo sapiens
tgatggaaatgatctgggtctgt

SEQ ID NO: 7075508 - DNA, 22 bp, Homo sapiens
tgatggaaatgttctgtatctg

SEQ ID NO: 7075509 - DNA, 22 bp, Homo sapiens
tgatggaaatttgggaagcttt

SEQ ID NO: 7075510 - DNA, 22 bp, Homo sapiens
tgatggaaatttgggaagcttt

SEQ ID NO: 7075511 - DNA, 22 bp, Homo sapiens
tgatggaacagcctttgccaaa

SEQ ID NO: 7075512 - DNA, 22 bp, Homo sapiens
tgatggaagagctaacaatatc

SEQ ID NO: 7075513 - DNA, 22 bp, Homo sapiens
tgatggaaggtttctcggtgat

SEQ ID NO: 7075514 - DNA, 22 bp, Homo sapiens
tgatggaagtgactgtcagttc

SEQ ID NO: 7075515 - DNA, 22 bp, Homo sapiens
tgatggaatataccttcgggag

SEQ ID NO: 7075516 - DNA, 22 bp, Homo sapiens
tgatggaatggaggacatgtgg

SEQ ID NO: 7075517 - DNA, 19 bp, Homo sapiens
tgatggaatttgacattcc

SEQ ID NO: 7075518 - DNA, 22 bp, Homo sapiens
tgatgggaggtgctgcaggacc

SEQ ID NO: 7075519 - DNA, 22 bp, Homo sapiens
tgatggtcaggatgcatggaga

SEQ ID NO: 7075520 - DNA, 22 bp, Homo sapiens
tgattacacaccacagtgctcc

SEQ ID NO: 7075521 - DNA, 23 bp, Homo sapiens
tgattcagcaagtccacttctgg

SEQ ID NO: 7075522 - DNA, 22 bp, Homo sapiens
tgattcagtctcttcaggagaa

SEQ ID NO: 7075523 - DNA, 23 bp, Homo sapiens
tgattacaagggccaaagaaagg

SEQ ID NO: 7075524 - DNA, 22 bp, Homo sapiens
tgattacaaaagattgtttgaa

SEQ ID NO: 7075525 - DNA, 22 bp, Homo sapiens
tgattaactgtctattaatcat

SEQ ID NO: 7075526 - DNA, 22 bp, Homo sapiens
tgatgtaagagatacacttgat

SEQ ID NO: 7075527 - DNA, 22 bp, Homo sapiens
tgattaaaatttaacttagtta

SEQ ID NO: 7075528 - DNA, 22 bp, Homo sapiens
tgattctgatcatcatcatggt

SEQ ID NO: 7075529 - DNA, 22 bp, Homo sapiens
tgattctgccacgtactggctg

SEQ ID NO: 7075530 - DNA, 23 bp, Homo sapiens
tgattctgctttgagaatcatgg

SEQ ID NO: 7075531 - DNA, 22 bp, Homo sapiens
tgattctgcttatgggtggatt

SEQ ID NO: 7075532 - DNA, 22 bp, Homo sapiens
tgattcctaggcactcttctcc

SEQ ID NO: 7075533 - DNA, 22 bp, Homo sapiens
tgattctgtaagtcatattgtt

SEQ ID NO: 7075534 - DNA, 22 bp, Homo sapiens
tgattctgtgaattagttgggt

SEQ ID NO: 7075535 - DNA, 18 bp, Homo sapiens
tgattctgtgatgtggtc

SEQ ID NO: 7075536 - DNA, 22 bp, Homo sapiens
tgcagccatcgcagagtctgta

SEQ ID NO: 7075537 - DNA, 22 bp, Homo sapiens
tgcagcccttccttcctctggg

SEQ ID NO: 7075538 - DNA, 22 bp, Homo sapiens
tgcagctggtatcccatggatt

SEQ ID NO: 7075539 - DNA, 22 bp, Homo sapiens
tgcagctggtttagaactagat

SEQ ID NO: 7075540 - DNA, 20 bp, Homo sapiens
tgcagctggtttcacaggga

SEQ ID NO: 7075541 - DNA, 22 bp, Homo sapiens
tgcagctgagtcacccagccat

SEQ ID NO: 7075542 - DNA, 22 bp, Homo sapiens
tgcagctgatgatacccccatg

SEQ ID NO: 7075543 - DNA, 17 bp, Homo sapiens
tgcagctgctcccaggc

SEQ ID NO: 7075544 - DNA, 22 bp, Homo sapiens
tgcagctgctggcccaggtgct

SEQ ID NO: 7075545 - DNA, 22 bp, Homo sapiens
tgcagctgcttgattcatcttg

SEQ ID NO: 7075546 - DNA, 22 bp, Homo sapiens
tgcagccttgcctcctcccagc

SEQ ID NO: 7075547 - DNA, 22 bp, Homo sapiens
tgcagctgaacctagagtctgt

SEQ ID NO: 7075548 - DNA, 21 bp, Homo sapiens
tgcagctgacactggtatgcc

SEQ ID NO: 7075549 - DNA, 22 bp, Homo sapiens
tgcagctgacccactccagtcc

SEQ ID NO: 7075550 - DNA, 21 bp, Homo sapiens
tgcaggagtctgtgagtcagg

SEQ ID NO: 7075551 - DNA, 22 bp, Homo sapiens
tgcaggagtccaatcaggagac

SEQ ID NO: 7075552 - DNA, 22 bp, Homo sapiens
tgcaggaggattttgtggagct

SEQ ID NO: 7075553 - DNA, 22 bp, Homo sapiens
tgcaggaggattttgtggagct

SEQ ID NO: 7075554 - DNA, 22 bp, Homo sapiens
tgcaggaggccccatggaaccg

SEQ ID NO: 7075555 - DNA, 22 bp, Homo sapiens
tgcaggaggctttattcaggat

SEQ ID NO: 7075556 - DNA, 22 bp, Homo sapiens
tgcaggagggagggttacagtt

SEQ ID NO: 7075557 - DNA, 22 bp, Homo sapiens
tgcaggagcccttgggctctgg

SEQ ID NO: 7075558 - DNA, 22 bp, Homo sapiens
tgcaggagccttggacttgaaa

SEQ ID NO: 7075559 - DNA, 22 bp, Homo sapiens
tgcaggagctgctgtcctgctc

SEQ ID NO: 7075560 - DNA, 22 bp, Homo sapiens
tgcaggagctgctgtcctgctc

SEQ ID NO: 7075561 - DNA, 22 bp, Homo sapiens
tgcaggagctgtgcggtgaggg

SEQ ID NO: 7075562 - DNA, 22 bp, Homo sapiens
tgcaggagctgtgcggtgaggg

SEQ ID NO: 7075563 - DNA, 22 bp, Homo sapiens
tgcaggagcttggctctgtccc

SEQ ID NO: 7075564 - DNA, 19 bp, Homo sapiens
tgcaggaggactgagcaga

SEQ ID NO: 7075565 - DNA, 18 bp, Homo sapiens
tgcaggagtgaccccggc

SEQ ID NO: 7075566 - DNA, 21 bp, Homo sapiens
tgcaggagtgtaatgtgaccc

SEQ ID NO: 7075567 - DNA, 22 bp, Homo sapiens
tgcaggagttaagtgctctcct

SEQ ID NO: 7075568 - DNA, 22 bp, Homo sapiens
tgcaggagttaagtgctctcct

SEQ ID NO: 7075569 - DNA, 22 bp, Homo sapiens
tgcaggagttcccctctgcctg

SEQ ID NO: 7075570 - DNA, 22 bp, Homo sapiens
tgcaggcagctaaaccatgtaa

SEQ ID NO: 7075571 - DNA, 22 bp, Homo sapiens
tgcaggcagctgaaaggtgcct

SEQ ID NO: 7075572 - DNA, 21 bp, Homo sapiens
tgcaggctacttctgactcta

SEQ ID NO: 7075573 - DNA, 22 bp, Homo sapiens
tgcagctgtaacagaggcctca

SEQ ID NO: 7075574 - DNA, 22 bp, Homo sapiens
tgcaggagcagagatggctgga

SEQ ID NO: 7075575 - DNA, 22 bp, Homo sapiens
tgcaggagcagagatggctgga

SEQ ID NO: 7075576 - DNA, 22 bp, Homo sapiens
tgcaggagcaccagctcaccct

SEQ ID NO: 7075577 - DNA, 22 bp, Homo sapiens
tgcaggagcagagatggctgga

SEQ ID NO: 7075578 - DNA, 22 bp, Homo sapiens
tgcaggagcccttgggctctgg

SEQ ID NO: 7075579 - DNA, 22 bp, Homo sapiens
tgcaggagagctggtctggccc

SEQ ID NO: 7075580 - DNA, 22 bp, Homo sapiens
tgcaggagagtgagtcagtagg

SEQ ID NO: 7075581 - DNA, 22 bp, Homo sapiens
tgcaggagataatggtgcttag

SEQ ID NO: 7075582 - DNA, 21 bp, Homo sapiens
tgcaggaaagtgctgcgaccc

SEQ ID NO: 7075583 - DNA, 22 bp, Homo sapiens
tgcaggaacttggttttactca

SEQ ID NO: 7075584 - DNA, 22 bp, Homo sapiens
tgcaggagacataatagggact

SEQ ID NO: 7075585 - DNA, 22 bp, Homo sapiens
tgcactactgtgatacacagcc

SEQ ID NO: 7075586 - DNA, 22 bp, Homo sapiens
tgcacgtgggctctctgctctt

SEQ ID NO: 7075587 - DNA, 22 bp, Homo sapiens
tgcacgtatggcagtggagccc

SEQ ID NO: 7075588 - DNA, 22 bp, Homo sapiens
tgcacgtgtgagcattcacatg

SEQ ID NO: 7075589 - DNA, 22 bp, Homo sapiens
tgcagaaaccaattcaagtaag

SEQ ID NO: 7075590 - DNA, 19 bp, Homo sapiens
tgcagaagacacagtggtg

SEQ ID NO: 7075591 - DNA, 22 bp, Homo sapiens
tgcagaagtgagtcatgaggaa

SEQ ID NO: 7075592 - DNA, 21 bp, Homo sapiens
tgcacctgtgccccatccttc

SEQ ID NO: 7075593 - DNA, 22 bp, Homo sapiens
tgcacaggtggtccatctgcac

SEQ ID NO: 7075594 - DNA, 22 bp, Homo sapiens
tgcacagtaaacatgactggag

SEQ ID NO: 7075595 - DNA, 22 bp, Homo sapiens
tgcacagtgacccctggtgact

SEQ ID NO: 7075596 - DNA, 22 bp, Homo sapiens
tgcacattagtgtttgagatgc

SEQ ID NO: 7075597 - DNA, 22 bp, Homo sapiens
tgcacattcacttaggtattgt

SEQ ID NO: 7075598 - DNA, 22 bp, Homo sapiens
tgcacaggccttgaagggagag

SEQ ID NO: 7075599 - DNA, 22 bp, Homo sapiens
tgcacagggagggggccagctc

SEQ ID NO: 7075600 - DNA, 21 bp, Homo sapiens
tgcacagggcccaggagagcc

SEQ ID NO: 7075601 - DNA, 20 bp, Homo sapiens
tgcacagggtgggaagcaac

SEQ ID NO: 7075602 - DNA, 20 bp, Homo sapiens
tgcacagggtgggaagcaac

SEQ ID NO: 7075603 - DNA, 20 bp, Homo sapiens
tgcacagggtgggaagcaac

SEQ ID NO: 7075604 - DNA, 22 bp, Homo sapiens
tgcacaggtatgcaaagcatgt

SEQ ID NO: 7075605 - DNA, 22 bp, Homo sapiens
tgcacaggtgagactcaggaag

SEQ ID NO: 7075606 - DNA, 22 bp, Homo sapiens
tgcagatgagggatgaaaatga

SEQ ID NO: 7075607 - DNA, 22 bp, Homo sapiens
tgcagagggagtgacggttcac

SEQ ID NO: 7075608 - DNA, 22 bp, Homo sapiens
tgcagagggaaaaggtgctcct

SEQ ID NO: 7075609 - DNA, 22 bp, Homo sapiens
tgcagagggacagccacagctc

SEQ ID NO: 7075610 - DNA, 19 bp, Homo sapiens
tgcagagggtaggaaggcc

SEQ ID NO: 7075611 - DNA, 19 bp, Homo sapiens
tgcagagggtaggaaggcc

SEQ ID NO: 7075612 - DNA, 22 bp, Homo sapiens
tgcagaggagtcagcctgggca

SEQ ID NO: 7075613 - DNA, 21 bp, Homo sapiens
tgcagaggcacaaacaagccc

SEQ ID NO: 7075614 - DNA, 22 bp, Homo sapiens
tgcagaggagctggaaggctgg

SEQ ID NO: 7075615 - DNA, 22 bp, Homo sapiens
tgcagaggagctggaaggctgg

SEQ ID NO: 7075616 - DNA, 23 bp, Homo sapiens
tgcagaggcatgatcactgctca

SEQ ID NO: 7075617 - DNA, 22 bp, Homo sapiens
tgcagaggcgccgtgggtgggg

SEQ ID NO: 7075618 - DNA, 22 bp, Homo sapiens
tgcagaggctggctcgccgggt

SEQ ID NO: 7075619 - DNA, 22 bp, Homo sapiens
tgcagaggagctggaaggctgg

SEQ ID NO: 7075620 - DNA, 22 bp, Homo sapiens
tgcagagcttcattgcataggc

SEQ ID NO: 7075621 - DNA, 20 bp, Homo sapiens
tgcagagctggctggctcct

SEQ ID NO: 7075622 - DNA, 22 bp, Homo sapiens
tgcagagatctgggcgtcggct

SEQ ID NO: 7075623 - DNA, 22 bp, Homo sapiens
tgcagagatttggctcttaaag

SEQ ID NO: 7075624 - DNA, 22 bp, Homo sapiens
tgcagacaagtcgtgggatctt

SEQ ID NO: 7075625 - DNA, 22 bp, Homo sapiens
tgcagagaaaactcctgggtac

SEQ ID NO: 7075626 - DNA, 22 bp, Homo sapiens
tgcagagaaaccagtggaggac

SEQ ID NO: 7075627 - DNA, 22 bp, Homo sapiens
tgcagagaaaccagtggaggac

SEQ ID NO: 7075628 - DNA, 22 bp, Homo sapiens
tgcagagatcctggactgagcg

SEQ ID NO: 7075629 - DNA, 22 bp, Homo sapiens
tcttcagcagggcctctctgag

SEQ ID NO: 7075630 - DNA, 22 bp, Homo sapiens
tcttcagttgtaaaagtgttgg

SEQ ID NO: 7075631 - DNA, 22 bp, Homo sapiens
tcttcatctcagattaacagga

SEQ ID NO: 7075632 - DNA, 22 bp, Homo sapiens
tcttcatgaatgaatctttgac

SEQ ID NO: 7075633 - DNA, 22 bp, Homo sapiens
tcttcatgccaaatgagttttg

SEQ ID NO: 7075634 - DNA, 22 bp, Homo sapiens
tcttcatgttgctgtagggaga

SEQ ID NO: 7075635 - DNA, 22 bp, Homo sapiens
tcttcatgttgcttattctggg

SEQ ID NO: 7075636 - DNA, 22 bp, Homo sapiens
tcttcattccgtagatatttat

SEQ ID NO: 7075637 - DNA, 22 bp, Homo sapiens
tcttcattttatagcatctgtg

SEQ ID NO: 7075638 - DNA, 22 bp, Homo sapiens
tcttccagaatctcagagggct

SEQ ID NO: 7075639 - DNA, 22 bp, Homo sapiens
tcttccagatacttcctgactt

SEQ ID NO: 7075640 - DNA, 22 bp, Homo sapiens
tcttcaaaaatacaggttttca

SEQ ID NO: 7075641 - DNA, 22 bp, Homo sapiens
tcttcaaatacagtcatattga

SEQ ID NO: 7075642 - DNA, 22 bp, Homo sapiens
tcttcaattagatttaccaatt

SEQ ID NO: 7075643 - DNA, 22 bp, Homo sapiens
tcttcacaccgggcagcaggaa

SEQ ID NO: 7075644 - DNA, 22 bp, Homo sapiens
tcttccttgccttgcttcatca

SEQ ID NO: 7075645 - DNA, 22 bp, Homo sapiens
tcttccttgtaagggctttaga

SEQ ID NO: 7075646 - DNA, 21 bp, Homo sapiens
tcttcctgctccacactcccc

SEQ ID NO: 7075647 - DNA, 22 bp, Homo sapiens
tcttcctgcttggtgtgtctgg

SEQ ID NO: 7075648 - DNA, 22 bp, Homo sapiens
tcttcctgctttggtgaggctt

SEQ ID NO: 7075649 - DNA, 22 bp, Homo sapiens
tcttcctggcattgatgctgca

SEQ ID NO: 7075650 - DNA, 22 bp, Homo sapiens
tcttcctcttctgctgagaagt

SEQ ID NO: 7075651 - DNA, 22 bp, Homo sapiens
tcttcctctagatctgaggccc

SEQ ID NO: 7075652 - DNA, 22 bp, Homo sapiens
tcttcctgaaaccctgttccag

SEQ ID NO: 7075653 - DNA, 22 bp, Homo sapiens
tcttcctgaaaccctgttccag

SEQ ID NO: 7075654 - DNA, 23 bp, Homo sapiens
tcttcctgaactatcaggcacat

SEQ ID NO: 7075655 - DNA, 21 bp, Homo sapiens
tcttcctgctccacactcccc

SEQ ID NO: 7075656 - DNA, 20 bp, Homo sapiens
tcttccagcttctggtagaa

SEQ ID NO: 7075657 - DNA, 22 bp, Homo sapiens
tcttccaggccctgccacagct

SEQ ID NO: 7075658 - DNA, 21 bp, Homo sapiens
tcttcctccacagcgtgccac

SEQ ID NO: 7075659 - DNA, 22 bp, Homo sapiens
tcttcctccctacagagctcag

SEQ ID NO: 7075660 - DNA, 22 bp, Homo sapiens
tcttctgttttagattgcatac

SEQ ID NO: 7075661 - DNA, 22 bp, Homo sapiens
tcttcttatgtgccattatctc

SEQ ID NO: 7075662 - DNA, 20 bp, Homo sapiens
tcttctgttgccttgttctg

SEQ ID NO: 7075663 - DNA, 20 bp, Homo sapiens
tcttctgttgccttgttctg

SEQ ID NO: 7075664 - DNA, 22 bp, Homo sapiens
tcttcttatgtgccattatctc

SEQ ID NO: 7075665 - DNA, 22 bp, Homo sapiens
tcttcttcctcatttatacata

SEQ ID NO: 7075666 - DNA, 22 bp, Homo sapiens
tcttcttcctccacagggccca

SEQ ID NO: 7075667 - DNA, 22 bp, Homo sapiens
tcttctccagtgcttctgcaca

SEQ ID NO: 7075668 - DNA, 22 bp, Homo sapiens
tcttctccagttcatcctacca

SEQ ID NO: 7075669 - DNA, 22 bp, Homo sapiens
tcttctccagttcatcctacca

SEQ ID NO: 7075670 - DNA, 22 bp, Homo sapiens
tcttctccagttcatcctacca

SEQ ID NO: 7075671 - DNA, 22 bp, Homo sapiens
tcttctccataatcaacactct

SEQ ID NO: 7075672 - DNA, 22 bp, Homo sapiens
tcttctcccagggtcgcccaag

SEQ ID NO: 7075673 - DNA, 22 bp, Homo sapiens
tcttctcccatctccaggcagg

SEQ ID NO: 7075674 - DNA, 22 bp, Homo sapiens
tcttctctacaccagcagcccc

SEQ ID NO: 7075675 - DNA, 22 bp, Homo sapiens
tcttctctacaccagcagcccc

SEQ ID NO: 7075676 - DNA, 22 bp, Homo sapiens
tcttctgtattgttaactcagg

SEQ ID NO: 7075677 - DNA, 22 bp, Homo sapiens
tcttctgtgagaattcaagcaa

SEQ ID NO: 7075678 - DNA, 22 bp, Homo sapiens
tcttctgtgatctatgtgtttt

SEQ ID NO: 7075679 - DNA, 22 bp, Homo sapiens
tctttgaatttctgactgtctt

SEQ ID NO: 7075680 - DNA, 22 bp, Homo sapiens
tctttgatgtggttaattatga

SEQ ID NO: 7075681 - DNA, 22 bp, Homo sapiens
tctttgaatcctttacatctga

SEQ ID NO: 7075682 - DNA, 22 bp, Homo sapiens
tctttgaattcaaactgttcaa

SEQ ID NO: 7075683 - DNA, 22 bp, Homo sapiens
tctttgaacttggctgatctct

SEQ ID NO: 7075684 - DNA, 22 bp, Homo sapiens
tctttcctgtaactgctgttca

SEQ ID NO: 7075685 - DNA, 21 bp, Homo sapiens
tctttcctgcccagttgccct

SEQ ID NO: 7075686 - DNA, 22 bp, Homo sapiens
tctttccttagaataattcttt

SEQ ID NO: 7075687 - DNA, 17 bp, Homo sapiens
tctttcctgccatgctc

SEQ ID NO: 7075688 - DNA, 22 bp, Homo sapiens
tctttcctctgagctcctgtag

SEQ ID NO: 7075689 - DNA, 22 bp, Homo sapiens
tctttcctaggtgatatgcaat

SEQ ID NO: 7075690 - DNA, 22 bp, Homo sapiens
tctttcctaggtgatatgcaat

SEQ ID NO: 7075691 - DNA, 22 bp, Homo sapiens
tctttccatggccacacagtct

SEQ ID NO: 7075692 - DNA, 22 bp, Homo sapiens
tctttccagaggaatttttaga

SEQ ID NO: 7075693 - DNA, 21 bp, Homo sapiens
tctttccaatattcatgtctc

SEQ ID NO: 7075694 - DNA, 19 bp, Homo sapiens
tctttcatttctagctctg

SEQ ID NO: 7075695 - DNA, 22 bp, Homo sapiens
tctttcaatgtgaaaccatgta

SEQ ID NO: 7075696 - DNA, 22 bp, Homo sapiens
tctttattgctactggtttgtc

SEQ ID NO: 7075697 - DNA, 22 bp, Homo sapiens
tctttatttaagtctgttgtaa

SEQ ID NO: 7075698 - DNA, 22 bp, Homo sapiens
tctttatctggctcagagacac

SEQ ID NO: 7075699 - DNA, 22 bp, Homo sapiens
tctttatcaagtctgttctttg

SEQ ID NO: 7075700 - DNA, 22 bp, Homo sapiens
tcttgctaaagaccaacacatt

SEQ ID NO: 7075701 - DNA, 22 bp, Homo sapiens
tcttgcttctgctcaaggggag

SEQ ID NO: 7075702 - DNA, 22 bp, Homo sapiens
tcttgaaagtatcttattttgt

SEQ ID NO: 7075703 - DNA, 22 bp, Homo sapiens
tcttgaattgtactcccataag

SEQ ID NO: 7075704 - DNA, 22 bp, Homo sapiens
tcttggattttaatggatcaaa

SEQ ID NO: 7075705 - DNA, 18 bp, Homo sapiens
tcttggcagcatctggca

SEQ ID NO: 7075706 - DNA, 22 bp, Homo sapiens
tcttggccccaaccctctattt

SEQ ID NO: 7075707 - DNA, 22 bp, Homo sapiens
tcttggctagtaccttcctgcc

SEQ ID NO: 7075708 - DNA, 22 bp, Homo sapiens
tcttggctatccaagttatcca

SEQ ID NO: 7075709 - DNA, 22 bp, Homo sapiens
tctttacagtcctctgtcaatc

SEQ ID NO: 7075710 - DNA, 22 bp, Homo sapiens
tctttacatcacaattgtatgg

SEQ ID NO: 7075711 - DNA, 22 bp, Homo sapiens
tctttacatcacaattgtatgg

SEQ ID NO: 7075712 - DNA, 22 bp, Homo sapiens
tctttactggaatggaactttc

SEQ ID NO: 7075713 - DNA, 19 bp, Homo sapiens
tcttggctttgtctactgt

SEQ ID NO: 7075714 - DNA, 22 bp, Homo sapiens
tcttggctgctgccaatttact

SEQ ID NO: 7075715 - DNA, 22 bp, Homo sapiens
tcttggctggtcatttaaaatc

SEQ ID NO: 7075716 - DNA, 22 bp, Homo sapiens
tcttggctgtaccattgactag

SEQ ID NO: 7075717 - DNA, 22 bp, Homo sapiens
tcttggctgtctttgaagttag

SEQ ID NO: 7075718 - DNA, 22 bp, Homo sapiens
tcttggcttctgtatttcctgt

SEQ ID NO: 7075719 - DNA, 20 bp, Homo sapiens
tcttaaatccccagggccat

SEQ ID NO: 7075720 - DNA, 22 bp, Homo sapiens
tcttaaatgactgataagagga

SEQ ID NO: 7075721 - DNA, 22 bp, Homo sapiens
tcttaactgacagtttaatggg

SEQ ID NO: 7075722 - DNA, 22 bp, Homo sapiens
tcttaagcagagaagaagttga

SEQ ID NO: 7075723 - DNA, 22 bp, Homo sapiens
tcttaagtacctcctttatcac

SEQ ID NO: 7075724 - DNA, 22 bp, Homo sapiens
tcttatatgcacatacattggg

SEQ ID NO: 7075725 - DNA, 22 bp, Homo sapiens
tcttatcttatacctaacagcc

SEQ ID NO: 7075726 - DNA, 22 bp, Homo sapiens
tcttatgaaaagcacttagaac

SEQ ID NO: 7075727 - DNA, 22 bp, Homo sapiens
tcttaaaagtatgccaattgga

SEQ ID NO: 7075728 - DNA, 22 bp, Homo sapiens
tctgtttcctcttgtgtaaagt

SEQ ID NO: 7075729 - DNA, 22 bp, Homo sapiens
tctgtttctccaacattgtgag

SEQ ID NO: 7075730 - DNA, 22 bp, Homo sapiens
tctgttatatagataatgtgtg

SEQ ID NO: 7075731 - DNA, 22 bp, Homo sapiens
tctgttatgcataagcatcagt

SEQ ID NO: 7075732 - DNA, 20 bp, Homo sapiens
tctgttattattacattgcc

SEQ ID NO: 7075733 - DNA, 22 bp, Homo sapiens
tctgttattctgtctattgcca

SEQ ID NO: 7075734 - DNA, 22 bp, Homo sapiens
tctgttgcaatgtgcatggtga

SEQ ID NO: 7075735 - DNA, 22 bp, Homo sapiens
tctgttgcatatgctgctgggt

SEQ ID NO: 7075736 - DNA, 22 bp, Homo sapiens
tctgtgtcagaagatatcatgg

SEQ ID NO: 7075737 - DNA, 23 bp, Homo sapiens
tctgtgtcctcctggaccacaga

SEQ ID NO: 7075738 - DNA, 22 bp, Homo sapiens
tctgtggagtgacctgggcttt

SEQ ID NO: 7075739 - DNA, 22 bp, Homo sapiens
tctgtgctttccctgccttctt

SEQ ID NO: 7075740 - DNA, 22 bp, Homo sapiens
tctgtggagttgaggaaggttg

SEQ ID NO: 7075741 - DNA, 22 bp, Homo sapiens
tctgtgctcattcagtcattca

SEQ ID NO: 7075742 - DNA, 22 bp, Homo sapiens
tctgtgctgccatcctgtggcc

SEQ ID NO: 7075743 - DNA, 22 bp, Homo sapiens
tctgtgctggactgatttcata

SEQ ID NO: 7075744 - DNA, 19 bp, Homo sapiens
tctgtgctgggaggcagca

SEQ ID NO: 7075745 - DNA, 22 bp, Homo sapiens
tctgtgccaagcttatatctgt

SEQ ID NO: 7075746 - DNA, 22 bp, Homo sapiens
tctgtgccacctctccagtgtc

SEQ ID NO: 7075747 - DNA, 23 bp, Homo sapiens
tctgtgccagtttccatgtctgt

SEQ ID NO: 7075748 - DNA, 22 bp, Homo sapiens
tctgtgcctttaagaagctcat

SEQ ID NO: 7075749 - DNA, 22 bp, Homo sapiens
tctgtctgagggagtgacattt

SEQ ID NO: 7075750 - DNA, 22 bp, Homo sapiens
tctgtgaacatcacattgacag

SEQ ID NO: 7075751 - DNA, 22 bp, Homo sapiens
tctgtacagtaccagatagtaa

SEQ ID NO: 7075752 - DNA, 22 bp, Homo sapiens
tctgtagagacgaatgtgttat

SEQ ID NO: 7075753 - DNA, 22 bp, Homo sapiens
tctgtattgagaaagccggaca

SEQ ID NO: 7075754 - DNA, 22 bp, Homo sapiens
tctgtattgattctgttaggca

SEQ ID NO: 7075755 - DNA, 22 bp, Homo sapiens
tctgtcacccaggctggagtgc

SEQ ID NO: 7075756 - DNA, 22 bp, Homo sapiens
tctgtccagaacgtacatcttg

SEQ ID NO: 7075757 - DNA, 22 bp, Homo sapiens
tctgtccaggcttactatatat

SEQ ID NO: 7075758 - DNA, 22 bp, Homo sapiens
tctgtcctccggagctcccagt

SEQ ID NO: 7075759 - DNA, 22 bp, Homo sapiens
tctgtcctgtttcctcctgaca

SEQ ID NO: 7075760 - DNA, 22 bp, Homo sapiens
tctgtcctgtttcctcctgaca

SEQ ID NO: 7075761 - DNA, 18 bp, Homo sapiens
tctgtccttccattcttc

SEQ ID NO: 7075762 - DNA, 22 bp, Homo sapiens
tctgtctcaagttcttgcactc

SEQ ID NO: 7075763 - DNA, 22 bp, Homo sapiens
tctgtctcaagttcttgcactc

SEQ ID NO: 7075764 - DNA, 22 bp, Homo sapiens
tctgtctcctcagatgactcca

SEQ ID NO: 7075765 - DNA, 22 bp, Homo sapiens
tctgtctcctctgaggtgccag

SEQ ID NO: 7075766 - DNA, 22 bp, Homo sapiens
tctgtctcctctgaggtgccag

SEQ ID NO: 7075767 - DNA, 22 bp, Homo sapiens
tctgtctcctgccagtgcctct

SEQ ID NO: 7075768 - DNA, 21 bp, Homo sapiens
tctgtctctccactgccctgc

SEQ ID NO: 7075769 - DNA, 22 bp, Homo sapiens
tctgggcttttccatgcctgtg

SEQ ID NO: 7075770 - DNA, 22 bp, Homo sapiens
tctggggatgagtgatgtcgta

SEQ ID NO: 7075771 - DNA, 22 bp, Homo sapiens
tctgggctttaagaactctgtt

SEQ ID NO: 7075772 - DNA, 22 bp, Homo sapiens
tctgggctttacactgtgctta

SEQ ID NO: 7075773 - DNA, 22 bp, Homo sapiens
tctgggctggtgctcatgaatt

SEQ ID NO: 7075774 - DNA, 22 bp, Homo sapiens
tctgggctgtggttccactccg

SEQ ID NO: 7075775 - DNA, 17 bp, Homo sapiens
tctgggcttcagtggtc

SEQ ID NO: 7075776 - DNA, 22 bp, Homo sapiens
tctgtaaaacttctttgtaaat

SEQ ID NO: 7075777 - DNA, 22 bp, Homo sapiens
tctgggttcttgatgctacctt

SEQ ID NO: 7075778 - DNA, 22 bp, Homo sapiens
tctgggtgccactgtctgtaca

SEQ ID NO: 7075779 - DNA, 22 bp, Homo sapiens
tctggggttgagtctgggtcag

SEQ ID NO: 7075780 - DNA, 22 bp, Homo sapiens
tctgggtctggctgctggtgca

SEQ ID NO: 7075781 - DNA, 22 bp, Homo sapiens
tctgggtgaccctgggcaaggc

SEQ ID NO: 7075782 - DNA, 22 bp, Homo sapiens
tctggggtggagccctggagtc

SEQ ID NO: 7075783 - DNA, 22 bp, Homo sapiens
tctgggaagcctgtatgcagaa

SEQ ID NO: 7075784 - DNA, 19 bp, Homo sapiens
tctgggaagccgggctcca

SEQ ID NO: 7075785 - DNA, 22 bp, Homo sapiens
tctgggaaggctctgcagatat

SEQ ID NO: 7075786 - DNA, 22 bp, Homo sapiens
tctgggaaccagtgcggctggg

SEQ ID NO: 7075787 - DNA, 22 bp, Homo sapiens
tctgggaaccattggtggggat

SEQ ID NO: 7075788 - DNA, 22 bp, Homo sapiens
tctgggaactatatctggtggt

SEQ ID NO: 7075789 - DNA, 22 bp, Homo sapiens
tctgggaactctgtcatttccc

SEQ ID NO: 7075790 - DNA, 22 bp, Homo sapiens
tctggcttttattcagttggca

SEQ ID NO: 7075791 - DNA, 22 bp, Homo sapiens
tctgggaaatggctacttgtca

SEQ ID NO: 7075792 - DNA, 22 bp, Homo sapiens
tctgggaaatgggcagcttcgc

SEQ ID NO: 7075793 - DNA, 22 bp, Homo sapiens
tctgggaacacacgtcacttca

SEQ ID NO: 7075794 - DNA, 22 bp, Homo sapiens
tctggctgacatcctgtatgag

SEQ ID NO: 7075795 - DNA, 21 bp, Homo sapiens
tctggctttcattccccttct

SEQ ID NO: 7075796 - DNA, 22 bp, Homo sapiens
tctggctttcatttgtttaaag

SEQ ID NO: 7075797 - DNA, 22 bp, Homo sapiens
tctggctttcatttgtttaaag

SEQ ID NO: 7075798 - DNA, 22 bp, Homo sapiens
tctggctttcctggagcaagaa

SEQ ID NO: 7075799 - DNA, 22 bp, Homo sapiens
tctggcccatgatcctgctaac

SEQ ID NO: 7075800 - DNA, 22 bp, Homo sapiens
tctggccccggtcttcacagct

SEQ ID NO: 7075801 - DNA, 22 bp, Homo sapiens
tctggcccctggcagtcctgga

SEQ ID NO: 7075802 - DNA, 21 bp, Homo sapiens
tctggccctcacagtcacacc

SEQ ID NO: 7075803 - DNA, 22 bp, Homo sapiens
tctggctgaagcttttgcagct

SEQ ID NO: 7075804 - DNA, 22 bp, Homo sapiens
tctgggaggtggcagggtgcat

SEQ ID NO: 7075805 - DNA, 22 bp, Homo sapiens
tctgggaggtgttttgagaact

SEQ ID NO: 7075806 - DNA, 22 bp, Homo sapiens
tctgggaggggctgccattgct

SEQ ID NO: 7075807 - DNA, 22 bp, Homo sapiens
tctgggaggggctgccattgct

SEQ ID NO: 7075808 - DNA, 22 bp, Homo sapiens
tctgggagagtcacaggcattg

SEQ ID NO: 7075809 - DNA, 22 bp, Homo sapiens
tctgggaggtaaccatgctgat

SEQ ID NO: 7075810 - DNA, 22 bp, Homo sapiens
tctgggaggtaaccatgctgat

SEQ ID NO: 7075811 - DNA, 22 bp, Homo sapiens
tctgggaagtcctctgtcatgc

SEQ ID NO: 7075812 - DNA, 22 bp, Homo sapiens
tctgggaagttggcagccagct

SEQ ID NO: 7075813 - DNA, 22 bp, Homo sapiens
tctgggaataaaactagggact

SEQ ID NO: 7075814 - DNA, 22 bp, Homo sapiens
tctgggaatacacactgattta

SEQ ID NO: 7075815 - DNA, 19 bp, Homo sapiens
tctgggaatgatgccagca

SEQ ID NO: 7075816 - DNA, 22 bp, Homo sapiens
tctgggagagcacgtggctgac

SEQ ID NO: 7075817 - DNA, 22 bp, Homo sapiens
tctgggagagcacgtggctgac

SEQ ID NO: 7075818 - DNA, 22 bp, Homo sapiens
tctgggcagagggtcttagtca

SEQ ID NO: 7075819 - DNA, 18 bp, Homo sapiens
tctgggcaatctcagtat

SEQ ID NO: 7075820 - DNA, 22 bp, Homo sapiens
tctgggcaatggatgcactcac

SEQ ID NO: 7075821 - DNA, 22 bp, Homo sapiens
tctgggataagaccacagattt

SEQ ID NO: 7075822 - DNA, 22 bp, Homo sapiens
tctgggctcttagtgtaccctc

SEQ ID NO: 7075823 - DNA, 22 bp, Homo sapiens
tctggcagttccttgttgatat

SEQ ID NO: 7075824 - DNA, 22 bp, Homo sapiens
tctggcagttgccgcttcagtc

SEQ ID NO: 7075825 - DNA, 22 bp, Homo sapiens
tctggcagtgatttctgtgatc

SEQ ID NO: 7075826 - DNA, 22 bp, Homo sapiens
tctggcatctgttttcatattt

SEQ ID NO: 7075827 - DNA, 22 bp, Homo sapiens
tctggccacccgaggcccctgc

SEQ ID NO: 7075828 - DNA, 22 bp, Homo sapiens
tctggccactaataggtctcac

SEQ ID NO: 7075829 - DNA, 22 bp, Homo sapiens
tctggccacttgcttcacactg

SEQ ID NO: 7075830 - DNA, 22 bp, Homo sapiens
tctggccagcatgagacctggt

SEQ ID NO: 7075831 - DNA, 22 bp, Homo sapiens
tctggccaggatggcaagacca

SEQ ID NO: 7075832 - DNA, 22 bp, Homo sapiens
tctggccaggggtccctgaagg

SEQ ID NO: 7075833 - DNA, 22 bp, Homo sapiens
tctggcccagcccctgaggtca

SEQ ID NO: 7075834 - DNA, 22 bp, Homo sapiens
tctggcagggtgtgtatttaca

SEQ ID NO: 7075835 - DNA, 22 bp, Homo sapiens
tctggcaggtcaatcattcttt

SEQ ID NO: 7075836 - DNA, 20 bp, Homo sapiens
tctggcaggtgaacgagctg

SEQ ID NO: 7075837 - DNA, 20 bp, Homo sapiens
tctggcaggtgaacgagctg

SEQ ID NO: 7075838 - DNA, 20 bp, Homo sapiens
tctggcaggtgaacgagctg

SEQ ID NO: 7075839 - DNA, 22 bp, Homo sapiens
tctggcagtgaagtcatgaggt

SEQ ID NO: 7075840 - DNA, 22 bp, Homo sapiens
tctggcagtgagcaacttgaca

SEQ ID NO: 7075841 - DNA, 22 bp, Homo sapiens
tctggcagaagtgctgtcagta

SEQ ID NO: 7075842 - DNA, 22 bp, Homo sapiens
tctggcagaggaaggaggcctg

SEQ ID NO: 7075843 - DNA, 22 bp, Homo sapiens
tctggagccacaaacctcagct

SEQ ID NO: 7075844 - DNA, 22 bp, Homo sapiens
tctggaagttagaggaggaaag

SEQ ID NO: 7075845 - DNA, 22 bp, Homo sapiens
tctggaataaccctgcttccaa

SEQ ID NO: 7075846 - DNA, 22 bp, Homo sapiens
tctggaataggtcctgagtatt

SEQ ID NO: 7075847 - DNA, 22 bp, Homo sapiens
tctggaatcagacctaatccca

SEQ ID NO: 7075848 - DNA, 22 bp, Homo sapiens
tctggaatcagtggcttaccct

SEQ ID NO: 7075849 - DNA, 23 bp, Homo sapiens
tctggaatcctcccccttggttc

SEQ ID NO: 7075850 - DNA, 22 bp, Homo sapiens
tctggaatgaatgaggttctgt

SEQ ID NO: 7075851 - DNA, 22 bp, Homo sapiens
tctggaatgatttccttcccct

SEQ ID NO: 7075852 - DNA, 22 bp, Homo sapiens
tctggaagacagtgagcccgct

SEQ ID NO: 7075853 - DNA, 22 bp, Homo sapiens
tctggaaggaacccttagagga

SEQ ID NO: 7075854 - DNA, 22 bp, Homo sapiens
tctggaattctcaagtcctgga

SEQ ID NO: 7075855 - DNA, 22 bp, Homo sapiens
tctggaattttattgatcaaaa

SEQ ID NO: 7075856 - DNA, 22 bp, Homo sapiens
tctggagaagaaacttgctctg

SEQ ID NO: 7075857 - DNA, 22 bp, Homo sapiens
tctggagaagcccagggagctg

SEQ ID NO: 7075858 - DNA, 22 bp, Homo sapiens
tctggagaagcccagggagctg

SEQ ID NO: 7075859 - DNA, 22 bp, Homo sapiens
tctggaagaacggggcatgctg

SEQ ID NO: 7075860 - DNA, 22 bp, Homo sapiens
tctgctgtgtccctggtctcct

SEQ ID NO: 7075861 - DNA, 22 bp, Homo sapiens
tctgctgttcattcttttagct

SEQ ID NO: 7075862 - DNA, 22 bp, Homo sapiens
tctgctgttcattcttttagct

SEQ ID NO: 7075863 - DNA, 22 bp, Homo sapiens
tctgctgtattaggttgaactg

SEQ ID NO: 7075864 - DNA, 22 bp, Homo sapiens
tctgctgtcactcatttgcttc

SEQ ID NO: 7075865 - DNA, 22 bp, Homo sapiens
tctgctgtgaaaggtgaatatt

SEQ ID NO: 7075866 - DNA, 22 bp, Homo sapiens
tctgctgtgattctactagtgt

SEQ ID NO: 7075867 - DNA, 22 bp, Homo sapiens
tctgctgtgatttgctacctgt

SEQ ID NO: 7075868 - DNA, 22 bp, Homo sapiens
tctgctgtgggtctatatttta

SEQ ID NO: 7075869 - DNA, 22 bp, Homo sapiens
tctgctgctgaccaacactgtg

SEQ ID NO: 7075870 - DNA, 22 bp, Homo sapiens
tctgctgctgcagctacactat

SEQ ID NO: 7075871 - DNA, 22 bp, Homo sapiens
tctgctgctgcagctacactat

SEQ ID NO: 7075872 - DNA, 22 bp, Homo sapiens
tctgctgtaaagaatttctgcc

SEQ ID NO: 7075873 - DNA, 22 bp, Homo sapiens
tctgctgctacagactctctag

SEQ ID NO: 7075874 - DNA, 22 bp, Homo sapiens
tctgctgctacagactctctag

SEQ ID NO: 7075875 - DNA, 22 bp, Homo sapiens
tctgctctgtggcttcagctaa

SEQ ID NO: 7075876 - DNA, 22 bp, Homo sapiens
tctgctgaacttgctgcccaga

SEQ ID NO: 7075877 - DNA, 22 bp, Homo sapiens
tctgctgaatcagatagctaag

SEQ ID NO: 7075878 - DNA, 22 bp, Homo sapiens
tctgctgaatggagccaacctc

SEQ ID NO: 7075879 - DNA, 22 bp, Homo sapiens
tctgctgacatttatgaataga

SEQ ID NO: 7075880 - DNA, 22 bp, Homo sapiens
tctgctgacctttctctgacac

SEQ ID NO: 7075881 - DNA, 22 bp, Homo sapiens
tctgctgagatgcccatggtta

SEQ ID NO: 7075882 - DNA, 22 bp, Homo sapiens
tctgctgaggccttcccactcc

SEQ ID NO: 7075883 - DNA, 22 bp, Homo sapiens
tctgctgaggtggttttagaga

SEQ ID NO: 7075884 - DNA, 22 bp, Homo sapiens
tctgctgagtcagacctctggg

SEQ ID NO: 7075885 - DNA, 22 bp, Homo sapiens
tctgctctagttgcttcctgcc

SEQ ID NO: 7075886 - DNA, 22 bp, Homo sapiens
tctgctctagttgcttcctgcc

SEQ ID NO: 7075887 - DNA, 22 bp, Homo sapiens
tctgctctagttgcttcctgcc

SEQ ID NO: 7075888 - DNA, 22 bp, Homo sapiens
tctgctctccatacttccgcac

SEQ ID NO: 7075889 - DNA, 22 bp, Homo sapiens
tctgctctccatacttccgcac

SEQ ID NO: 7075890 - DNA, 23 bp, Homo sapiens
tctgctctgaagttcggctgagc

SEQ ID NO: 7075891 - DNA, 23 bp, Homo sapiens
tctgctctgaagttcggctgagc

SEQ ID NO: 7075892 - DNA, 22 bp, Homo sapiens
tctgctctgagagggccatcag

SEQ ID NO: 7075893 - DNA, 17 bp, Homo sapiens
tctgctctgccaatcca

SEQ ID NO: 7075894 - DNA, 17 bp, Homo sapiens
tctgctctgccaatcca

SEQ ID NO: 7075895 - DNA, 22 bp, Homo sapiens
tctgctctgggccagctattaa

SEQ ID NO: 7075896 - DNA, 22 bp, Homo sapiens
tctgctctgggccagctattaa

SEQ ID NO: 7075897 - DNA, 22 bp, Homo sapiens
tctgctctgtactgcactggcc

SEQ ID NO: 7075898 - DNA, 22 bp, Homo sapiens
tctgctctgtactgcactggcc

SEQ ID NO: 7075899 - DNA, 22 bp, Homo sapiens
tctgctctgtggcttcagctaa

SEQ ID NO: 7075900 - DNA, 22 bp, Homo sapiens
tctgctctgtggcttcagctaa

SEQ ID NO: 7075901 - DNA, 22 bp, Homo sapiens
tctgctctgtggcttcagctaa

SEQ ID NO: 7075902 - DNA, 22 bp, Homo sapiens
tctgatttctcttgtggatgct

SEQ ID NO: 7075903 - DNA, 22 bp, Homo sapiens
tctgatgtctgaaatgctcttg

SEQ ID NO: 7075904 - DNA, 22 bp, Homo sapiens
tctgatgtggcagctgcatcta

SEQ ID NO: 7075905 - DNA, 22 bp, Homo sapiens
tctgatgtgtttaagaaagaag

SEQ ID NO: 7075906 - DNA, 21 bp, Homo sapiens
tctgatgtgtttaatggtggg

SEQ ID NO: 7075907 - DNA, 23 bp, Homo sapiens
tctgatgttctcttatgctgtag

SEQ ID NO: 7075908 - DNA, 22 bp, Homo sapiens
tctgatgttgcttctgcagaac

SEQ ID NO: 7075909 - DNA, 22 bp, Homo sapiens
tctgatgttgtgacatcacttc

SEQ ID NO: 7075910 - DNA, 22 bp, Homo sapiens
tctgatgttgtgacatcacttc

SEQ ID NO: 7075911 - DNA, 22 bp, Homo sapiens
tctgattagagcattcttgagt

SEQ ID NO: 7075912 - DNA, 22 bp, Homo sapiens
tctgattagagcattcttgagt

SEQ ID NO: 7075913 - DNA, 22 bp, Homo sapiens
tctgattagcagtttagggaaa

SEQ ID NO: 7075914 - DNA, 22 bp, Homo sapiens
tctgattcattcatgtgcacca

SEQ ID NO: 7075915 - DNA, 22 bp, Homo sapiens
tctgattccagtgaccctagga

SEQ ID NO: 7075916 - DNA, 22 bp, Homo sapiens
tctgaggtcagtgctgcagtta

SEQ ID NO: 7075917 - DNA, 22 bp, Homo sapiens
tctgaggtcagtgctgcagtta

SEQ ID NO: 7075918 - DNA, 22 bp, Homo sapiens
tctgaggtcataaagcaacttt

SEQ ID NO: 7075919 - DNA, 22 bp, Homo sapiens
tctgaggtcattccaaggacat

SEQ ID NO: 7075920 - DNA, 22 bp, Homo sapiens
tctgaggtcattccaaggacat

SEQ ID NO: 7075921 - DNA, 23 bp, Homo sapiens
tctgaggtccaccagtttgcaga

SEQ ID NO: 7075922 - DNA, 22 bp, Homo sapiens
tctgaggtcctactataagtgg

SEQ ID NO: 7075923 - DNA, 22 bp, Homo sapiens
tctgaggtcctgtgatttctct

SEQ ID NO: 7075924 - DNA, 22 bp, Homo sapiens
tctgaggtctatgactttgctt

SEQ ID NO: 7075925 - DNA, 22 bp, Homo sapiens
tctgaggtctcatgacttgcat

SEQ ID NO: 7075926 - DNA, 17 bp, Homo sapiens
tctgaggtgaggatgca

SEQ ID NO: 7075927 - DNA, 19 bp, Homo sapiens
tctgaggtggaactggggg

SEQ ID NO: 7075928 - DNA, 19 bp, Homo sapiens
tctgaggtggaactggggg

SEQ ID NO: 7075929 - DNA, 18 bp, Homo sapiens
tctgaggtggacgaggag

SEQ ID NO: 7075930 - DNA, 22 bp, Homo sapiens
tctgaggtggacgatggagcct

SEQ ID NO: 7075931 - DNA, 22 bp, Homo sapiens
tctgaggtggacgatggagcct

SEQ ID NO: 7075932 - DNA, 23 bp, Homo sapiens
tctgaggtggctcttgctttgaa

SEQ ID NO: 7075933 - DNA, 22 bp, Homo sapiens
tctgaggtggggctggagcatt

SEQ ID NO: 7075934 - DNA, 22 bp, Homo sapiens
tctgaggtgtagctgggcttca

SEQ ID NO: 7075935 - DNA, 22 bp, Homo sapiens
tctgaggtgtcacaaggccagg

SEQ ID NO: 7075936 - DNA, 22 bp, Homo sapiens
tctgaggttaatcctgctgcat

SEQ ID NO: 7075937 - DNA, 22 bp, Homo sapiens
tctgaggttactgctttgtaga

SEQ ID NO: 7075938 - DNA, 22 bp, Homo sapiens
tctgaggttattgtctgccatt

SEQ ID NO: 7075939 - DNA, 22 bp, Homo sapiens
tctgaggttccctcaactacct

SEQ ID NO: 7075940 - DNA, 22 bp, Homo sapiens
tctgatgcaatgtaagtcttgg

SEQ ID NO: 7075941 - DNA, 21 bp, Homo sapiens
tctgatggtagatgagatgtg

SEQ ID NO: 7075942 - DNA, 22 bp, Homo sapiens
tctgaggccctaccctgagcct

SEQ ID NO: 7075943 - DNA, 17 bp, Homo sapiens
tctgaggcctctaggag

SEQ ID NO: 7075944 - DNA, 22 bp, Homo sapiens
tctgaggcctgaagcagcagag

SEQ ID NO: 7075945 - DNA, 22 bp, Homo sapiens
tctgaggccttggcagctaagg

SEQ ID NO: 7075946 - DNA, 22 bp, Homo sapiens
tctgaggctaagagacagaggc

SEQ ID NO: 7075947 - DNA, 22 bp, Homo sapiens
tctgaggctaagagacagaggc

SEQ ID NO: 7075948 - DNA, 22 bp, Homo sapiens
tctgaggctgaatggactccgt

SEQ ID NO: 7075949 - DNA, 20 bp, Homo sapiens
tctgaggctgagctctactt

SEQ ID NO: 7075950 - DNA, 19 bp, Homo sapiens
tctgagggagcacgaaggc

SEQ ID NO: 7075951 - DNA, 23 bp, Homo sapiens
tctgagggagtgggcagtggcac

SEQ ID NO: 7075952 - DNA, 22 bp, Homo sapiens
tctgaggggctggaagggctgc

SEQ ID NO: 7075953 - DNA, 22 bp, Homo sapiens
tctgagggtgggagaaggagct

SEQ ID NO: 7075954 - DNA, 22 bp, Homo sapiens
tctgagggttgtagagagggac

SEQ ID NO: 7075955 - DNA, 22 bp, Homo sapiens
tctgaggtaccagctggtttat

SEQ ID NO: 7075956 - DNA, 20 bp, Homo sapiens
tctgaggtatgatagggtct

SEQ ID NO: 7075957 - DNA, 22 bp, Homo sapiens
tctgaggtcacagatttcaaga

SEQ ID NO: 7075958 - DNA, 22 bp, Homo sapiens
tctgagaaatcagtggtgaata

SEQ ID NO: 7075959 - DNA, 22 bp, Homo sapiens
tctgagaaatcagtggtgaata

SEQ ID NO: 7075960 - DNA, 21 bp, Homo sapiens
tctgagaacttctgctgcagc

SEQ ID NO: 7075961 - DNA, 22 bp, Homo sapiens
tctgagaaggaagctctgtgta

SEQ ID NO: 7075962 - DNA, 22 bp, Homo sapiens
tctgagaagggtaggctccatt

SEQ ID NO: 7075963 - DNA, 17 bp, Homo sapiens
tctgagaatgctggagg

SEQ ID NO: 7075964 - DNA, 17 bp, Homo sapiens
tctgagaatgctggagg

SEQ ID NO: 7075965 - DNA, 22 bp, Homo sapiens
tctgacattagattaattggaa

SEQ ID NO: 7075966 - DNA, 22 bp, Homo sapiens
tctgacattttgagaatgacat

SEQ ID NO: 7075967 - DNA, 22 bp, Homo sapiens
tctgacttatttgtccttggtg

SEQ ID NO: 7075968 - DNA, 22 bp, Homo sapiens
tctgacttcctccacatctgtt

SEQ ID NO: 7075969 - DNA, 22 bp, Homo sapiens
tctgacttggcgctcttgtctt

SEQ ID NO: 7075970 - DNA, 22 bp, Homo sapiens
tctgagaatggtggatgtggtg

SEQ ID NO: 7075971 - DNA, 22 bp, Homo sapiens
tctgagcagggcagtgtccatg

SEQ ID NO: 7075972 - DNA, 22 bp, Homo sapiens
tctgagcatatgcagcacctgg

SEQ ID NO: 7075973 - DNA, 22 bp, Homo sapiens
tctgagctaatcctgttgccga

SEQ ID NO: 7075974 - DNA, 22 bp, Homo sapiens
tctgagctccatgcaggaggct

SEQ ID NO: 7075975 - DNA, 22 bp, Homo sapiens
tctgagctctatctgtgggaat

SEQ ID NO: 7075976 - DNA, 21 bp, Homo sapiens
tctgagctgagtcctctaggt

SEQ ID NO: 7075977 - DNA, 22 bp, Homo sapiens
tctgagctgcccctttactttg

SEQ ID NO: 7075978 - DNA, 22 bp, Homo sapiens
tctgagctggagcccatcacct

SEQ ID NO: 7075979 - DNA, 22 bp, Homo sapiens
tctgagctgggcacagaaggcg

SEQ ID NO: 7075980 - DNA, 23 bp, Homo sapiens
tctgagctgtcttttcagcagaa

SEQ ID NO: 7075981 - DNA, 22 bp, Homo sapiens
tctgagctgtggccattcttcc

SEQ ID NO: 7075982 - DNA, 22 bp, Homo sapiens
tctgccttgaggtcctcagctc

SEQ ID NO: 7075983 - DNA, 20 bp, Homo sapiens
tctgctcagccctcagtggc

SEQ ID NO: 7075984 - DNA, 22 bp, Homo sapiens
tctgctcaggttacctagctag

SEQ ID NO: 7075985 - DNA, 22 bp, Homo sapiens
tctgctcagtgcttatctctaa

SEQ ID NO: 7075986 - DNA, 22 bp, Homo sapiens
tctgcctgtgctgtgttttcat

SEQ ID NO: 7075987 - DNA, 22 bp, Homo sapiens
tctgcctgtggtggaggaagtt

SEQ ID NO: 7075988 - DNA, 22 bp, Homo sapiens
tctgcctgttcaagtcttctag

SEQ ID NO: 7075989 - DNA, 22 bp, Homo sapiens
tctgcctgttgagcctaaggcc

SEQ ID NO: 7075990 - DNA, 22 bp, Homo sapiens
tctgcctgttgctagaatgtca

SEQ ID NO: 7075991 - DNA, 22 bp, Homo sapiens
tctgccttccccataatctgat

SEQ ID NO: 7075992 - DNA, 22 bp, Homo sapiens
tctgccttcgctgctccctgaa

SEQ ID NO: 7075993 - DNA, 22 bp, Homo sapiens
tctgcctggcctggagggcaca

SEQ ID NO: 7075994 - DNA, 22 bp, Homo sapiens
tctgcctggattttggaaagct

SEQ ID NO: 7075995 - DNA, 22 bp, Homo sapiens
tctgcctggatgatggcagggc

SEQ ID NO: 7075996 - DNA, 22 bp, Homo sapiens
tctgcctggattccattctcca

SEQ ID NO: 7075997 - DNA, 22 bp, Homo sapiens
tctgcctggattccattctcca

SEQ ID NO: 7075998 - DNA, 22 bp, Homo sapiens
tctgcctggcggactcccggaa

SEQ ID NO: 7075999 - DNA, 22 bp, Homo sapiens
tctgcctggctcatggcagtga

SEQ ID NO: 7076000 - DNA, 22 bp, Homo sapiens
tctgcctggctcatggcagtga

SEQ ID NO: 7076001 - DNA, 22 bp, Homo sapiens
tctgcctgtacctcttttttgc

SEQ ID NO: 7076002 - DNA, 22 bp, Homo sapiens
tctgcctgctaactcctgcacc

SEQ ID NO: 7076003 - DNA, 22 bp, Homo sapiens
tctgcctgctaactcctgcacc

SEQ ID NO: 7076004 - DNA, 22 bp, Homo sapiens
tctgcctgcggctgcaggtggc

SEQ ID NO: 7076005 - DNA, 22 bp, Homo sapiens
tctgcctgcggctgcaggtggc

SEQ ID NO: 7076006 - DNA, 22 bp, Homo sapiens
tctgcctggagagttcttctct

SEQ ID NO: 7076007 - DNA, 22 bp, Homo sapiens
tctgcctgcagtgtggcagggc

SEQ ID NO: 7076008 - DNA, 22 bp, Homo sapiens
tctgcctgccagtctggtcctc

SEQ ID NO: 7076009 - DNA, 22 bp, Homo sapiens
tctgcctgccagtctggtcctc

SEQ ID NO: 7076010 - DNA, 22 bp, Homo sapiens
tctgcctgccagtctggtcctc

SEQ ID NO: 7076011 - DNA, 22 bp, Homo sapiens
tctgcctgagggagctgaggaa

SEQ ID NO: 7076012 - DNA, 22 bp, Homo sapiens
tctgcctgagggagctgaggaa

SEQ ID NO: 7076013 - DNA, 22 bp, Homo sapiens
tctgcctgagcagagggaggcc

SEQ ID NO: 7076014 - DNA, 22 bp, Homo sapiens
tctgcctgagcagagggaggcc

SEQ ID NO: 7076015 - DNA, 21 bp, Homo sapiens
tctgcctgagactttgctggt

SEQ ID NO: 7076016 - DNA, 22 bp, Homo sapiens
tctgcccttggctctcttgttg

SEQ ID NO: 7076017 - DNA, 22 bp, Homo sapiens
tctgccgtgcgaggtcccacca

SEQ ID NO: 7076018 - DNA, 22 bp, Homo sapiens
tctgccctggggtcagcctcca

SEQ ID NO: 7076019 - DNA, 22 bp, Homo sapiens
tctgcccttggctctcttgttg

SEQ ID NO: 7076020 - DNA, 22 bp, Homo sapiens
tctgcccagtttgtgctcaggt

SEQ ID NO: 7076021 - DNA, 19 bp, Homo sapiens
tctgcccagttgtctgccc

SEQ ID NO: 7076022 - DNA, 22 bp, Homo sapiens
tctgccctcattgctgcctgga

SEQ ID NO: 7076023 - DNA, 21 bp, Homo sapiens
tctgccctccaggagctcata

SEQ ID NO: 7076024 - DNA, 22 bp, Homo sapiens
tctgcccacagcctcctgtcca

SEQ ID NO: 7076025 - DNA, 20 bp, Homo sapiens
tctgcccaccccggctccca

SEQ ID NO: 7076026 - DNA, 22 bp, Homo sapiens
tctgcccactgctctgctgccc

SEQ ID NO: 7076027 - DNA, 22 bp, Homo sapiens
tctgcatcatttttcagagccg

SEQ ID NO: 7076028 - DNA, 22 bp, Homo sapiens
tctgccaccaactgtcactaca

SEQ ID NO: 7076029 - DNA, 22 bp, Homo sapiens
tctgccatcttaattctctttt

SEQ ID NO: 7076030 - DNA, 20 bp, Homo sapiens
tctctgggttctcactcagc

SEQ ID NO: 7076031 - DNA, 22 bp, Homo sapiens
tctctgggtaaagttctctcat

SEQ ID NO: 7076032 - DNA, 22 bp, Homo sapiens
tctctgggtattcactgccttc

SEQ ID NO: 7076033 - DNA, 22 bp, Homo sapiens
tctctggggatggacctgggag

SEQ ID NO: 7076034 - DNA, 22 bp, Homo sapiens
tctctggggatgcttattcttg

SEQ ID NO: 7076035 - DNA, 22 bp, Homo sapiens
tctctggggaaaaggctgatac

SEQ ID NO: 7076036 - DNA, 22 bp, Homo sapiens
tctctgggctcaggagcccggc

SEQ ID NO: 7076037 - DNA, 19 bp, Homo sapiens
tctctggggacactttcac

SEQ ID NO: 7076038 - DNA, 22 bp, Homo sapiens
tctctgggcctccctttccaag

SEQ ID NO: 7076039 - DNA, 22 bp, Homo sapiens
tctctgggcctgttttctcatc

SEQ ID NO: 7076040 - DNA, 21 bp, Homo sapiens
tctctgggccctcctgtgggg

SEQ ID NO: 7076041 - DNA, 22 bp, Homo sapiens
tctctgggcctcagttttctca

SEQ ID NO: 7076042 - DNA, 22 bp, Homo sapiens
tctctgggatcgttttgggctc

SEQ ID NO: 7076043 - DNA, 22 bp, Homo sapiens
tctctgggcccagaccttcctt

SEQ ID NO: 7076044 - DNA, 21 bp, Homo sapiens
tctctgggccctcctgtgggg

SEQ ID NO: 7076045 - DNA, 22 bp, Homo sapiens
tctctggctggcaccccaggga

SEQ ID NO: 7076046 - DNA, 22 bp, Homo sapiens
tctctggctggcaccccaggga

SEQ ID NO: 7076047 - DNA, 19 bp, Homo sapiens
tctctggcttgtctgcctg

SEQ ID NO: 7076048 - DNA, 22 bp, Homo sapiens
tctctgggatcaggtggcccag

SEQ ID NO: 7076049 - DNA, 22 bp, Homo sapiens
tctctggcagaggccctatccc

SEQ ID NO: 7076050 - DNA, 22 bp, Homo sapiens
tctctggcagaggccctatccc

SEQ ID NO: 7076051 - DNA, 22 bp, Homo sapiens
tctctggcagggatatctggct

SEQ ID NO: 7076052 - DNA, 22 bp, Homo sapiens
tctctggcagacacctccctga

SEQ ID NO: 7076053 - DNA, 19 bp, Homo sapiens
tctctggcatagactcaat

SEQ ID NO: 7076054 - DNA, 22 bp, Homo sapiens
tctctggccccatggctgagct

SEQ ID NO: 7076055 - DNA, 22 bp, Homo sapiens
tctctggccctgttttctatct

SEQ ID NO: 7076056 - DNA, 22 bp, Homo sapiens
tctctggctcctgccgggtcca

SEQ ID NO: 7076057 - DNA, 22 bp, Homo sapiens
tctctggctgatattcctctgc

SEQ ID NO: 7076058 - DNA, 19 bp, Homo sapiens
tctctgcttctcttggcat

SEQ ID NO: 7076059 - DNA, 19 bp, Homo sapiens
tctctgcttctcttggcat

SEQ ID NO: 7076060 - DNA, 19 bp, Homo sapiens
tctctgcttctcttggcat

SEQ ID NO: 7076061 - DNA, 22 bp, Homo sapiens
tctctgcttggtgtatgtgagt

SEQ ID NO: 7076062 - DNA, 22 bp, Homo sapiens
tctctggagggctccaggcggg

SEQ ID NO: 7076063 - DNA, 19 bp, Homo sapiens
tctctgccgatcagggccc

SEQ ID NO: 7076064 - DNA, 19 bp, Homo sapiens
tctctgccgatcagggccc

SEQ ID NO: 7076065 - DNA, 22 bp, Homo sapiens
tctctgctaagattgtgtctag

SEQ ID NO: 7076066 - DNA, 22 bp, Homo sapiens
tctctgctaagattgtgtctag

SEQ ID NO: 7076067 - DNA, 22 bp, Homo sapiens
tctctgctaagattgtgtctag

SEQ ID NO: 7076068 - DNA, 22 bp, Homo sapiens
tctctgctcaggcaccagccct

SEQ ID NO: 7076069 - DNA, 22 bp, Homo sapiens
tctctgctcaggcaccagccct

SEQ ID NO: 7076070 - DNA, 22 bp, Homo sapiens
tctctgctctgtgcctcagttt

SEQ ID NO: 7076071 - DNA, 22 bp, Homo sapiens
tctctgctctgtgcctcagttt

SEQ ID NO: 7076072 - DNA, 22 bp, Homo sapiens
tctctgctctgtgcctcagttt

SEQ ID NO: 7076073 - DNA, 20 bp, Homo sapiens
tctctgctgtccacatttgc

SEQ ID NO: 7076074 - DNA, 19 bp, Homo sapiens
tctctgcttctcttggcat

SEQ ID NO: 7076075 - DNA, 19 bp, Homo sapiens
tctctgcttctcttggcat

SEQ ID NO: 7076076 - DNA, 22 bp, Homo sapiens
tctctctcctagtttttagtgg

SEQ ID NO: 7076077 - DNA, 18 bp, Homo sapiens
tctctctgaagagttccc

SEQ ID NO: 7076078 - DNA, 18 bp, Homo sapiens
tctctctgaagagttccc

SEQ ID NO: 7076079 - DNA, 22 bp, Homo sapiens
tctctctgagttgagcaggagt

SEQ ID NO: 7076080 - DNA, 22 bp, Homo sapiens
tctctccttatcattgtgttta

SEQ ID NO: 7076081 - DNA, 22 bp, Homo sapiens
tctctccttatcattgtgttta

SEQ ID NO: 7076082 - DNA, 22 bp, Homo sapiens
tctctctcagccattacagaac

SEQ ID NO: 7076083 - DNA, 22 bp, Homo sapiens
tctctcctctagtcagggtggt

SEQ ID NO: 7076084 - DNA, 22 bp, Homo sapiens
tctctcctgtgttctgatgttt

SEQ ID NO: 7076085 - DNA, 22 bp, Homo sapiens
tctctcctgtgttctgatgttt

SEQ ID NO: 7076086 - DNA, 21 bp, Homo sapiens
tctctcctcaagctcgacccc

SEQ ID NO: 7076087 - DNA, 21 bp, Homo sapiens
tctctcctcaagctcgacccc

SEQ ID NO: 7076088 - DNA, 22 bp, Homo sapiens
tctctcctccacaccgggtgct

SEQ ID NO: 7076089 - DNA, 22 bp, Homo sapiens
tctctcctaatttcaggtgctt

SEQ ID NO: 7076090 - DNA, 22 bp, Homo sapiens
tctctcctaatttcaggtgctt

SEQ ID NO: 7076091 - DNA, 19 bp, Homo sapiens
tctctatatttgtttctga

SEQ ID NO: 7076092 - DNA, 22 bp, Homo sapiens
tctctatttgcctaggcttgtg

SEQ ID NO: 7076093 - DNA, 22 bp, Homo sapiens
tctctcactggtgcctctgttg

SEQ ID NO: 7076094 - DNA, 22 bp, Homo sapiens
tctctcagaggaagaggcagtg

SEQ ID NO: 7076095 - DNA, 22 bp, Homo sapiens
tctctcagaggaagaggcagtg

SEQ ID NO: 7076096 - DNA, 22 bp, Homo sapiens
tctctcaggctggagtgcagtg

SEQ ID NO: 7076097 - DNA, 18 bp, Homo sapiens
tctctcagggaaacagaa

SEQ ID NO: 7076098 - DNA, 22 bp, Homo sapiens
tctctcataagatgagtactta

SEQ ID NO: 7076099 - DNA, 22 bp, Homo sapiens
tctctccaacatggtggtgctg

SEQ ID NO: 7076100 - DNA, 22 bp, Homo sapiens
tctctgagcatgccatattgct

SEQ ID NO: 7076101 - DNA, 22 bp, Homo sapiens
tctctgagatcagccactgact

SEQ ID NO: 7076102 - DNA, 22 bp, Homo sapiens
tctctgagacagtagcctctgc

SEQ ID NO: 7076103 - DNA, 22 bp, Homo sapiens
tctctgagcccaatgtagcaat

SEQ ID NO: 7076104 - DNA, 22 bp, Homo sapiens
tctctgagcccagtgtccccct

SEQ ID NO: 7076105 - DNA, 22 bp, Homo sapiens
tctctgagcccctgcctctttc

SEQ ID NO: 7076106 - DNA, 22 bp, Homo sapiens
tctctgagcgcattcctccggc

SEQ ID NO: 7076107 - DNA, 22 bp, Homo sapiens
tctctgagctcaggagctgcag

SEQ ID NO: 7076108 - DNA, 22 bp, Homo sapiens
tctctgagctgcttcttgcata

SEQ ID NO: 7076109 - DNA, 22 bp, Homo sapiens
tctctgagctgcttcttgcata

SEQ ID NO: 7076110 - DNA, 22 bp, Homo sapiens
tctctgagcttaaggtgtttca

SEQ ID NO: 7076111 - DNA, 20 bp, Homo sapiens
tctctgagcttctcttgggg

SEQ ID NO: 7076112 - DNA, 22 bp, Homo sapiens
tctctgagggagatggcctgcc

SEQ ID NO: 7076113 - DNA, 22 bp, Homo sapiens
tctctgaggttgtttccagcac

SEQ ID NO: 7076114 - DNA, 22 bp, Homo sapiens
tctctgagtaagtgacagttca

SEQ ID NO: 7076115 - DNA, 22 bp, Homo sapiens
tctctgagtatcctgaactgcc

SEQ ID NO: 7076116 - DNA, 22 bp, Homo sapiens
tctctgagtatcctgaactgcc

SEQ ID NO: 7076117 - DNA, 22 bp, Homo sapiens
tctctgagttctcctccagccc

SEQ ID NO: 7076118 - DNA, 22 bp, Homo sapiens
tctctgagaagttcctttgtga

SEQ ID NO: 7076119 - DNA, 22 bp, Homo sapiens
tctctgaattgtttaagttatt

SEQ ID NO: 7076120 - DNA, 22 bp, Homo sapiens
tctctctgccaactcacagcca

SEQ ID NO: 7076121 - DNA, 22 bp, Homo sapiens
tctctctgccaactcacagcca

SEQ ID NO: 7076122 - DNA, 22 bp, Homo sapiens
tctctctggagctggggcatga

SEQ ID NO: 7076123 - DNA, 23 bp, Homo sapiens
tctctctggcaaatttcacatat

SEQ ID NO: 7076124 - DNA, 22 bp, Homo sapiens
tctctctttttaatcatgtaat

SEQ ID NO: 7076125 - DNA, 22 bp, Homo sapiens
tctctcttttttgaacccgctc

SEQ ID NO: 7076126 - DNA, 22 bp, Homo sapiens
tctctgggtttttgtcctgtac

SEQ ID NO: 7076127 - DNA, 22 bp, Homo sapiens
tctctgggtttttgtcctgtac

SEQ ID NO: 7076128 - DNA, 22 bp, Homo sapiens
tctctggttattaactaactcc

SEQ ID NO: 7076129 - DNA, 21 bp, Homo sapiens
tctctggttggagttgtgcca

SEQ ID NO: 7076130 - DNA, 22 bp, Homo sapiens
tctctgtccctaggagccttgc

SEQ ID NO: 7076131 - DNA, 22 bp, Homo sapiens
tctctgtccctaggagccttgc

SEQ ID NO: 7076132 - DNA, 22 bp, Homo sapiens
tctctgtctcccgtgtgtccgg

SEQ ID NO: 7076133 - DNA, 22 bp, Homo sapiens
tctctgtctgagcctggcagac

SEQ ID NO: 7076134 - DNA, 22 bp, Homo sapiens
tctctgtctgagcctggcagac

SEQ ID NO: 7076135 - DNA, 22 bp, Homo sapiens
tctctgtctttgttgtcttcac

SEQ ID NO: 7076136 - DNA, 22 bp, Homo sapiens
tctctgtgagtggaaggcaccc

SEQ ID NO: 7076137 - DNA, 22 bp, Homo sapiens
tctctgtgggctttggacttga

SEQ ID NO: 7076138 - DNA, 22 bp, Homo sapiens
tctctgtggtgggaggctgagt

SEQ ID NO: 7076139 - DNA, 22 bp, Homo sapiens
tctcttctaacactagaaattc

SEQ ID NO: 7076140 - DNA, 22 bp, Homo sapiens
tctcttccttgacctattgtaa

SEQ ID NO: 7076141 - DNA, 22 bp, Homo sapiens
tctcttccttgacctattgtaa

SEQ ID NO: 7076142 - DNA, 22 bp, Homo sapiens
tctcttccagtggctttgattt

SEQ ID NO: 7076143 - DNA, 22 bp, Homo sapiens
tctcttccatgtttcagcccca

SEQ ID NO: 7076144 - DNA, 22 bp, Homo sapiens
tctcttccatgtttcagcccca

SEQ ID NO: 7076145 - DNA, 21 bp, Homo sapiens
tctctgtgtctttaagctgga

SEQ ID NO: 7076146 - DNA, 22 bp, Homo sapiens
tctcttaatccggtgctttctg

SEQ ID NO: 7076147 - DNA, 22 bp, Homo sapiens
tctcttaattcagaggcagtta

SEQ ID NO: 7076148 - DNA, 22 bp, Homo sapiens
tctcttattttgcctttgacaa

SEQ ID NO: 7076149 - DNA, 22 bp, Homo sapiens
tctcttccagtaagagtcttta

SEQ ID NO: 7076150 - DNA, 19 bp, Homo sapiens
tctcttctccctggtttta

SEQ ID NO: 7076151 - DNA, 22 bp, Homo sapiens
tctcttctctagtgagcaactg

SEQ ID NO: 7076152 - DNA, 22 bp, Homo sapiens
tctcttctatttgagactattt

SEQ ID NO: 7076153 - DNA, 22 bp, Homo sapiens
tctcttctatttgagactattt

SEQ ID NO: 7076154 - DNA, 22 bp, Homo sapiens
tctcttctagcttcttgtggtt

SEQ ID NO: 7076155 - DNA, 22 bp, Homo sapiens
tctcttctagcttcttgtggtt

SEQ ID NO: 7076156 - DNA, 22 bp, Homo sapiens
tctcttctaattagggtccatg

SEQ ID NO: 7076157 - DNA, 22 bp, Homo sapiens
tctcttctaattagggtccatg

SEQ ID NO: 7076158 - DNA, 22 bp, Homo sapiens
tctcttctaattttcccgagta

SEQ ID NO: 7076159 - DNA, 22 bp, Homo sapiens
tctcttctaattttcccgagta

SEQ ID NO: 7076160 - DNA, 22 bp, Homo sapiens
tctcttctgaaacctgtcttta

SEQ ID NO: 7076161 - DNA, 22 bp, Homo sapiens
tctcttctgaaacctgtcttta

SEQ ID NO: 7076162 - DNA, 20 bp, Homo sapiens
tctcttctggggagataaaa

SEQ ID NO: 7076163 - DNA, 22 bp, Homo sapiens
tctcttcttgattttcactgga

SEQ ID NO: 7076164 - DNA, 22 bp, Homo sapiens
tctcttcttgattttcactgga

SEQ ID NO: 7076165 - DNA, 22 bp, Homo sapiens
tctcttcttgtgttttcctgcc

SEQ ID NO: 7076166 - DNA, 17 bp, Homo sapiens
tctgaagccagtctgct

SEQ ID NO: 7076167 - DNA, 22 bp, Homo sapiens
tctgaagggctgagtggaggag

SEQ ID NO: 7076168 - DNA, 22 bp, Homo sapiens
tctgaaggtctgagaaccagga

SEQ ID NO: 7076169 - DNA, 22 bp, Homo sapiens
tctgaaggtgctagagaaagct

SEQ ID NO: 7076170 - DNA, 22 bp, Homo sapiens
tctgaaggtgctagagaaagct

SEQ ID NO: 7076171 - DNA, 22 bp, Homo sapiens
tctgaagaactgtctagagaac

SEQ ID NO: 7076172 - DNA, 22 bp, Homo sapiens
tctgaagaactgagtaaacatg

SEQ ID NO: 7076173 - DNA, 22 bp, Homo sapiens
tctgaaatagaagtgtctttct

SEQ ID NO: 7076174 - DNA, 22 bp, Homo sapiens
tctgaaataggaaagcaaatgg

SEQ ID NO: 7076175 - DNA, 22 bp, Homo sapiens
tctgaaatgcaaatttgactga

SEQ ID NO: 7076176 - DNA, 22 bp, Homo sapiens
tctgaaatgcaggcaatttgct

SEQ ID NO: 7076177 - DNA, 22 bp, Homo sapiens
tctgaaatggcagcgggaatga

SEQ ID NO: 7076178 - DNA, 22 bp, Homo sapiens
tctgaaatggcgatggccgttg

SEQ ID NO: 7076179 - DNA, 22 bp, Homo sapiens
tctgaaatggggctgaagcact

SEQ ID NO: 7076180 - DNA, 22 bp, Homo sapiens
tctgaaatgttctcttgttttg

SEQ ID NO: 7076181 - DNA, 22 bp, Homo sapiens
tctgaaattcacagttgagtca

SEQ ID NO: 7076182 - DNA, 22 bp, Homo sapiens
tctgaaattccttccagacttt

SEQ ID NO: 7076183 - DNA, 22 bp, Homo sapiens
tctgaaattgttagtaaaaatg

SEQ ID NO: 7076184 - DNA, 22 bp, Homo sapiens
tctgaaattttagttatagaaa

SEQ ID NO: 7076185 - DNA, 22 bp, Homo sapiens
tctgaaataactgatgccagat

SEQ ID NO: 7076186 - DNA, 22 bp, Homo sapiens
tctgaaataagggagaagggaa

SEQ ID NO: 7076187 - DNA, 22 bp, Homo sapiens
tctgaaatactgcaggttctct

SEQ ID NO: 7076188 - DNA, 22 bp, Homo sapiens
tctgaaatactgcaggttctct

SEQ ID NO: 7076189 - DNA, 22 bp, Homo sapiens
tctgaaatagaagtgtctttct

SEQ ID NO: 7076190 - DNA, 22 bp, Homo sapiens
tctgaaagccctagtttgtaat

SEQ ID NO: 7076191 - DNA, 22 bp, Homo sapiens
tctgaaataaatgcactgttag

SEQ ID NO: 7076192 - DNA, 22 bp, Homo sapiens
tctgaaagaaagattttgtttc

SEQ ID NO: 7076193 - DNA, 22 bp, Homo sapiens
tctctttgtctgctcttagttg

SEQ ID NO: 7076194 - DNA, 21 bp, Homo sapiens
tctctttctggaagcttccct

SEQ ID NO: 7076195 - DNA, 22 bp, Homo sapiens
tctctttctttgtatgtctatt

SEQ ID NO: 7076196 - DNA, 17 bp, Homo sapiens
tctctttccctttctgc

SEQ ID NO: 7076197 - DNA, 17 bp, Homo sapiens
tctctttccctttctgc

SEQ ID NO: 7076198 - DNA, 17 bp, Homo sapiens
tctctttccctttctgc

SEQ ID NO: 7076199 - DNA, 17 bp, Homo sapiens
tctctttccctttctgc

SEQ ID NO: 7076200 - DNA, 22 bp, Homo sapiens
tctctttctattgcaccatgct

SEQ ID NO: 7076201 - DNA, 22 bp, Homo sapiens
tctctttctattgcaccatgct

SEQ ID NO: 7076202 - DNA, 22 bp, Homo sapiens
tctcttcttgtgttttcctgcc

SEQ ID NO: 7076203 - DNA, 22 bp, Homo sapiens
tctcctggcatttggttgagta

SEQ ID NO: 7076204 - DNA, 22 bp, Homo sapiens
tctcctggatagatactatcca

SEQ ID NO: 7076205 - DNA, 22 bp, Homo sapiens
tctcctggagcaggaaggtggg

SEQ ID NO: 7076206 - DNA, 22 bp, Homo sapiens
tctcctggagcccagatgctgg

SEQ ID NO: 7076207 - DNA, 22 bp, Homo sapiens
tctcctgccactgcttcccatt

SEQ ID NO: 7076208 - DNA, 22 bp, Homo sapiens
tctcctgccactgcttcccatt

SEQ ID NO: 7076209 - DNA, 22 bp, Homo sapiens
tctcctgccactgcttcccatt

SEQ ID NO: 7076210 - DNA, 22 bp, Homo sapiens
tctcctgctcagaacagcctca

SEQ ID NO: 7076211 - DNA, 22 bp, Homo sapiens
tctcctgctcccaactgctgca

SEQ ID NO: 7076212 - DNA, 22 bp, Homo sapiens
tctcctgcttcaactgatggac

SEQ ID NO: 7076213 - DNA, 22 bp, Homo sapiens
tctcctggaagaataccacact

SEQ ID NO: 7076214 - DNA, 22 bp, Homo sapiens
tctcctccttttttcaacatag

SEQ ID NO: 7076215 - DNA, 23 bp, Homo sapiens
tctcctcctagatacagtcatgg

SEQ ID NO: 7076216 - DNA, 23 bp, Homo sapiens
tctcctcctagatacagtcatgg

SEQ ID NO: 7076217 - DNA, 22 bp, Homo sapiens
tctcctcaccaccagcagcaga

SEQ ID NO: 7076218 - DNA, 22 bp, Homo sapiens
tctcctctatttctgtatgtat

SEQ ID NO: 7076219 - DNA, 22 bp, Homo sapiens
tctcctctcttacctggtacaa

SEQ ID NO: 7076220 - DNA, 22 bp, Homo sapiens
tctcctctgtgccacagcttgg

SEQ ID NO: 7076221 - DNA, 22 bp, Homo sapiens
tctcctgaagaccatgtgcact

SEQ ID NO: 7076222 - DNA, 22 bp, Homo sapiens
tctcctgacatgtctggaggaa

SEQ ID NO: 7076223 - DNA, 22 bp, Homo sapiens
tctccttcgaggcccagctccc

SEQ ID NO: 7076224 - DNA, 18 bp, Homo sapiens
tctccttccaaatcttca

SEQ ID NO: 7076225 - DNA, 20 bp, Homo sapiens
tctcctggtctggtccgtgc

SEQ ID NO: 7076226 - DNA, 22 bp, Homo sapiens
tctcctggtacccttcctagca

SEQ ID NO: 7076227 - DNA, 22 bp, Homo sapiens
tctcctggtacccttcctagca

SEQ ID NO: 7076228 - DNA, 22 bp, Homo sapiens
tctcctggtacccttcctagca

SEQ ID NO: 7076229 - DNA, 18 bp, Homo sapiens
tctcctgggtaggggcct

SEQ ID NO: 7076230 - DNA, 22 bp, Homo sapiens
tctcctgggtaaaagggttgat

SEQ ID NO: 7076231 - DNA, 22 bp, Homo sapiens
tctcctttctggagcctgctca

SEQ ID NO: 7076232 - DNA, 22 bp, Homo sapiens
tctcctttgaaagttaggactg

SEQ ID NO: 7076233 - DNA, 22 bp, Homo sapiens
tctcgctctgtcgcccaggctg

SEQ ID NO: 7076234 - DNA, 22 bp, Homo sapiens
tctccttgctacccagtatgtc

SEQ ID NO: 7076235 - DNA, 22 bp, Homo sapiens
tctccttcgaggcccagctccc

SEQ ID NO: 7076236 - DNA, 22 bp, Homo sapiens
tctccttgacaggcaggcagac

SEQ ID NO: 7076237 - DNA, 21 bp, Homo sapiens
tctcgttgtatggtcttgggg

SEQ ID NO: 7076238 - DNA, 22 bp, Homo sapiens
tctctagtctcctttaacctga

SEQ ID NO: 7076239 - DNA, 22 bp, Homo sapiens
tctcgctctgtcgcccaggctg

SEQ ID NO: 7076240 - DNA, 22 bp, Homo sapiens
tctcgctctgtcgcccaggctg

SEQ ID NO: 7076241 - DNA, 22 bp, Homo sapiens
tctcccacggtacaggataaac

SEQ ID NO: 7076242 - DNA, 22 bp, Homo sapiens
tctcccactgcaagcccaggct

SEQ ID NO: 7076243 - DNA, 22 bp, Homo sapiens
tctcccactgcaagcccaggct

SEQ ID NO: 7076244 - DNA, 22 bp, Homo sapiens
tctcccactggccttgtatgat

SEQ ID NO: 7076245 - DNA, 22 bp, Homo sapiens
tctcccactggccttgtatgat

SEQ ID NO: 7076246 - DNA, 22 bp, Homo sapiens
tctcccagaagtcctcagtaca

SEQ ID NO: 7076247 - DNA, 22 bp, Homo sapiens
tctcccactggccttgtatgat

SEQ ID NO: 7076248 - DNA, 22 bp, Homo sapiens
tctcccagaagtcctcagtaca

SEQ ID NO: 7076249 - DNA, 22 bp, Homo sapiens
tctcccagaggatcccagtgga

SEQ ID NO: 7076250 - DNA, 22 bp, Homo sapiens
tctcccagaggatcccagtgga

SEQ ID NO: 7076251 - DNA, 22 bp, Homo sapiens
tctcccagaggatcccagtgga

SEQ ID NO: 7076252 - DNA, 22 bp, Homo sapiens
tctcccaggcaggagtgcagtg

SEQ ID NO: 7076253 - DNA, 20 bp, Homo sapiens
tctcccaggctcagggaaga

SEQ ID NO: 7076254 - DNA, 22 bp, Homo sapiens
tctcccaggctgccctgtggac

SEQ ID NO: 7076255 - DNA, 22 bp, Homo sapiens
tctcccaggctgccctgtggac

SEQ ID NO: 7076256 - DNA, 22 bp, Homo sapiens
tctcccaggctggagtgcagtg

SEQ ID NO: 7076257 - DNA, 22 bp, Homo sapiens
tctcccaggtcatacacagaga

SEQ ID NO: 7076258 - DNA, 22 bp, Homo sapiens
tctcccaggtgggtgcctggag

SEQ ID NO: 7076259 - DNA, 22 bp, Homo sapiens
tctcccaggtgggtgcctggag

SEQ ID NO: 7076260 - DNA, 22 bp, Homo sapiens
tctcccaggtgggtgcctggag

SEQ ID NO: 7076261 - DNA, 22 bp, Homo sapiens
tctcccagtggtgcagaaagca

SEQ ID NO: 7076262 - DNA, 22 bp, Homo sapiens
tctcccagtggtgcagaaagca

SEQ ID NO: 7076263 - DNA, 22 bp, Homo sapiens
tctcccagtggtgcagaaagca

SEQ ID NO: 7076264 - DNA, 22 bp, Homo sapiens
tctcccagtgtctggcagtcag

SEQ ID NO: 7076265 - DNA, 22 bp, Homo sapiens
tctccccaaccatggcactcac

SEQ ID NO: 7076266 - DNA, 22 bp, Homo sapiens
tctccccaggggtatgggtatt

SEQ ID NO: 7076267 - DNA, 23 bp, Homo sapiens
tctccctcatgcctaggcctggg

SEQ ID NO: 7076268 - DNA, 22 bp, Homo sapiens
tctcctaattaaatgctcttat

SEQ ID NO: 7076269 - DNA, 22 bp, Homo sapiens
tctcatcttcattgtctcccat

SEQ ID NO: 7076270 - DNA, 22 bp, Homo sapiens
tctcatgaaaggtctctcctgg

SEQ ID NO: 7076271 - DNA, 22 bp, Homo sapiens
tctcatctgcgagctctgccag

SEQ ID NO: 7076272 - DNA, 22 bp, Homo sapiens
tctcatctgcgagctctgccag

SEQ ID NO: 7076273 - DNA, 22 bp, Homo sapiens
tctcatcttcatatctgaaaga

SEQ ID NO: 7076274 - DNA, 22 bp, Homo sapiens
tctcataatagcatttctcacc

SEQ ID NO: 7076275 - DNA, 22 bp, Homo sapiens
tctcatctagactctgcccttg

SEQ ID NO: 7076276 - DNA, 22 bp, Homo sapiens
tctcatctagactctgcccttg

SEQ ID NO: 7076277 - DNA, 22 bp, Homo sapiens
tctcatctccattatagcatca

SEQ ID NO: 7076278 - DNA, 22 bp, Homo sapiens
tctcagtcagccttgatgtccc

SEQ ID NO: 7076279 - DNA, 22 bp, Homo sapiens
tctcagtctttgcaaggatgct

SEQ ID NO: 7076280 - DNA, 22 bp, Homo sapiens
tctcattggtatatacatgtgt

SEQ ID NO: 7076281 - DNA, 22 bp, Homo sapiens
tctcattcataccctacatgct

SEQ ID NO: 7076282 - DNA, 19 bp, Homo sapiens
tctccaggcaggtgagcga

SEQ ID NO: 7076283 - DNA, 22 bp, Homo sapiens
tctcagggagttgaggctgcct

SEQ ID NO: 7076284 - DNA, 22 bp, Homo sapiens
tctcagggcagcaaggaagcat

SEQ ID NO: 7076285 - DNA, 22 bp, Homo sapiens
tctcagggcgcagtgaggcagt

SEQ ID NO: 7076286 - DNA, 22 bp, Homo sapiens
tctcagcctcacctctatggag

SEQ ID NO: 7076287 - DNA, 22 bp, Homo sapiens
tctcagctgcctgccctgctcc

SEQ ID NO: 7076288 - DNA, 22 bp, Homo sapiens
tctcaggcccctgagtttctct

SEQ ID NO: 7076289 - DNA, 21 bp, Homo sapiens
tctcaggcgagaattctttta

SEQ ID NO: 7076290 - DNA, 22 bp, Homo sapiens
tctcagagtttagagctgagcc

SEQ ID NO: 7076291 - DNA, 22 bp, Homo sapiens
tctcagagtttagagctgagcc

SEQ ID NO: 7076292 - DNA, 22 bp, Homo sapiens
tctcagagtttagagctgagcc

SEQ ID NO: 7076293 - DNA, 22 bp, Homo sapiens
tctcagagtttagagctgagcc

SEQ ID NO: 7076294 - DNA, 22 bp, Homo sapiens
tctcagagtttgaatctggagt

SEQ ID NO: 7076295 - DNA, 22 bp, Homo sapiens
tctcagagggaaacatgagtga

SEQ ID NO: 7076296 - DNA, 22 bp, Homo sapiens
tctcagagggaggattactgcc

SEQ ID NO: 7076297 - DNA, 22 bp, Homo sapiens
tctcagaggtgccctggcatct

SEQ ID NO: 7076298 - DNA, 22 bp, Homo sapiens
tctcagagtgacaatgagaatt

SEQ ID NO: 7076299 - DNA, 22 bp, Homo sapiens
tctcagagttcctctggagtcc

SEQ ID NO: 7076300 - DNA, 22 bp, Homo sapiens
tctcacagtgagcctgaggtcg

SEQ ID NO: 7076301 - DNA, 22 bp, Homo sapiens
tctcactgatttgagaccaagg

SEQ ID NO: 7076302 - DNA, 22 bp, Homo sapiens
tctcactgcaaatattatgtat

SEQ ID NO: 7076303 - DNA, 22 bp, Homo sapiens
tctcactgcaaatattatgtat

SEQ ID NO: 7076304 - DNA, 22 bp, Homo sapiens
tctcactgggtataaatgagta

SEQ ID NO: 7076305 - DNA, 22 bp, Homo sapiens
tctcactgggtataaatgagta

SEQ ID NO: 7076306 - DNA, 22 bp, Homo sapiens
tctcactgggtcacagcagagg

SEQ ID NO: 7076307 - DNA, 22 bp, Homo sapiens
tctcactgggtcacagcagagg

SEQ ID NO: 7076308 - DNA, 21 bp, Homo sapiens
tctcactgtctgctttgttta

SEQ ID NO: 7076309 - DNA, 22 bp, Homo sapiens
tctcactttccagacttttcaa

SEQ ID NO: 7076310 - DNA, 22 bp, Homo sapiens
tctcagaaaaactttgagggta

SEQ ID NO: 7076311 - DNA, 22 bp, Homo sapiens
tctcagaaaaaggagaaactgg

SEQ ID NO: 7076312 - DNA, 22 bp, Homo sapiens
tctcagaaaagagcttcagaaa

SEQ ID NO: 7076313 - DNA, 23 bp, Homo sapiens
tctcagaaaggagaagtaatttg

SEQ ID NO: 7076314 - DNA, 22 bp, Homo sapiens
tctcagaaatactatgttgtca

SEQ ID NO: 7076315 - DNA, 22 bp, Homo sapiens
tctcagaaatgacaggaggtac

SEQ ID NO: 7076316 - DNA, 22 bp, Homo sapiens
tctcagaacacccttctatggt

SEQ ID NO: 7076317 - DNA, 22 bp, Homo sapiens
tctcagaacctcagtttgctct

SEQ ID NO: 7076318 - DNA, 22 bp, Homo sapiens
tctcagaactttatatgtatca

SEQ ID NO: 7076319 - DNA, 22 bp, Homo sapiens
tctcagaaggcaagggctgggg

SEQ ID NO: 7076320 - DNA, 22 bp, Homo sapiens
tctcagagagatgaaacttcca

SEQ ID NO: 7076321 - DNA, 22 bp, Homo sapiens
tctcagaaggcaagggctgggg

SEQ ID NO: 7076322 - DNA, 22 bp, Homo sapiens
tctcagagagctgtgttttcct

SEQ ID NO: 7076323 - DNA, 22 bp, Homo sapiens
tctcagagaggggccgggcctt

SEQ ID NO: 7076324 - DNA, 22 bp, Homo sapiens
tctcagagatgttagggaagag

SEQ ID NO: 7076325 - DNA, 22 bp, Homo sapiens
tctcagagatgttagggaagag

SEQ ID NO: 7076326 - DNA, 22 bp, Homo sapiens
tctcagagcatcattttcttag

SEQ ID NO: 7076327 - DNA, 19 bp, Homo sapiens
tctcagagccctagaggcc

SEQ ID NO: 7076328 - DNA, 19 bp, Homo sapiens
tctcagagccctagaggcc

SEQ ID NO: 7076329 - DNA, 20 bp, Homo sapiens
tctatttgtaaagggctgtg

SEQ ID NO: 7076330 - DNA, 22 bp, Homo sapiens
tctattttatactcaaatcttc

SEQ ID NO: 7076331 - DNA, 22 bp, Homo sapiens
tctattcattcaatttagctct

SEQ ID NO: 7076332 - DNA, 22 bp, Homo sapiens
tctattcaggcagagtgcagca

SEQ ID NO: 7076333 - DNA, 22 bp, Homo sapiens
tctatttaccaaatgtagttcc

SEQ ID NO: 7076334 - DNA, 22 bp, Homo sapiens
tctatttttatagttgaagtgc

SEQ ID NO: 7076335 - DNA, 22 bp, Homo sapiens
tctatttttatagttgaagtgc

SEQ ID NO: 7076336 - DNA, 22 bp, Homo sapiens
tctcaaactaacaatgattata

SEQ ID NO: 7076337 - DNA, 22 bp, Homo sapiens
tctcaaagtagctcccacagat

SEQ ID NO: 7076338 - DNA, 23 bp, Homo sapiens
tctcaaatatgatctgggtcatc

SEQ ID NO: 7076339 - DNA, 22 bp, Homo sapiens
tctcaaatatttggagagagga

SEQ ID NO: 7076340 - DNA, 22 bp, Homo sapiens
tctcaaatcaaactttgagctt

SEQ ID NO: 7076341 - DNA, 22 bp, Homo sapiens
tctcaaatgtaaagcatgattt

SEQ ID NO: 7076342 - DNA, 21 bp, Homo sapiens
tctcacaatatgatgccagat

SEQ ID NO: 7076343 - DNA, 22 bp, Homo sapiens
tctcacacaacatgttactttg

SEQ ID NO: 7076344 - DNA, 22 bp, Homo sapiens
tctcacaccgtccctaaaccat

SEQ ID NO: 7076345 - DNA, 22 bp, Homo sapiens
tctcacactaatgctctatcag

SEQ ID NO: 7076346 - DNA, 22 bp, Homo sapiens
tctcacactatttattctgctt

SEQ ID NO: 7076347 - DNA, 22 bp, Homo sapiens
tctcacactatttcaggtgact

SEQ ID NO: 7076348 - DNA, 22 bp, Homo sapiens
tctcacacttctgtgttgcaca

SEQ ID NO: 7076349 - DNA, 22 bp, Homo sapiens
tctcacagcaggggccaggtct

SEQ ID NO: 7076350 - DNA, 22 bp, Homo sapiens
tctcacagcatcattgctcatg

SEQ ID NO: 7076351 - DNA, 22 bp, Homo sapiens
tctagtcatattttttcagtat

SEQ ID NO: 7076352 - DNA, 22 bp, Homo sapiens
tctagttctagatccctgagga

SEQ ID NO: 7076353 - DNA, 22 bp, Homo sapiens
tctataaaactcaagagcaatt

SEQ ID NO: 7076354 - DNA, 22 bp, Homo sapiens
tctataaaactcaagagcaatt

SEQ ID NO: 7076355 - DNA, 22 bp, Homo sapiens
tctataaagggccagatagtag

SEQ ID NO: 7076356 - DNA, 22 bp, Homo sapiens
tctataaagggccagatagtag

SEQ ID NO: 7076357 - DNA, 22 bp, Homo sapiens
tctataaagggccagatagtag

SEQ ID NO: 7076358 - DNA, 22 bp, Homo sapiens
tctataaatgcagatatgtgtg

SEQ ID NO: 7076359 - DNA, 22 bp, Homo sapiens
tctattacttaccactaattca

SEQ ID NO: 7076360 - DNA, 22 bp, Homo sapiens
tctacttctccttcatttccca

SEQ ID NO: 7076361 - DNA, 22 bp, Homo sapiens
tctagaattttgccatatagct

SEQ ID NO: 7076362 - DNA, 22 bp, Homo sapiens
tctaccctgcggtcttggggca

SEQ ID NO: 7076363 - DNA, 22 bp, Homo sapiens
tctaccctgcggtcttggggca

SEQ ID NO: 7076364 - DNA, 22 bp, Homo sapiens
tctactatgtttcttaaataga

SEQ ID NO: 7076365 - DNA, 22 bp, Homo sapiens
tctactgcactggtgtctcatc

SEQ ID NO: 7076366 - DNA, 22 bp, Homo sapiens
tctactgtagtgatgctgcagt

SEQ ID NO: 7076367 - DNA, 22 bp, Homo sapiens
tctactgtggtccttgtaacca

SEQ ID NO: 7076368 - DNA, 22 bp, Homo sapiens
tctagacctggcactgccctgt

SEQ ID NO: 7076369 - DNA, 22 bp, Homo sapiens
tctagagactataatgtgtcct

SEQ ID NO: 7076370 - DNA, 22 bp, Homo sapiens
tctagcaagctcgtgctcaagg

SEQ ID NO: 7076371 - DNA, 22 bp, Homo sapiens
tctagctctgcttatcatggct

SEQ ID NO: 7076372 - DNA, 22 bp, Homo sapiens
tctagctctgcttatcatggct

SEQ ID NO: 7076373 - DNA, 20 bp, Homo sapiens
tctagcttagtgcctgcctc

SEQ ID NO: 7076374 - DNA, 22 bp, Homo sapiens
tctagcttggcgtttgccttct

SEQ ID NO: 7076375 - DNA, 22 bp, Homo sapiens
tctacaaagaagaattaatgtc

SEQ ID NO: 7076376 - DNA, 22 bp, Homo sapiens
tctaagaaatcagatgatgagg

SEQ ID NO: 7076377 - DNA, 22 bp, Homo sapiens
tctaacattgtttttcacagat

SEQ ID NO: 7076378 - DNA, 22 bp, Homo sapiens
tctaactaactacagtaagagg

SEQ ID NO: 7076379 - DNA, 22 bp, Homo sapiens
tctaactatacaaagaaaacat

SEQ ID NO: 7076380 - DNA, 22 bp, Homo sapiens
tctacaaataaattactatgta

SEQ ID NO: 7076381 - DNA, 22 bp, Homo sapiens
tctacaagtcaagtctatcaag

SEQ ID NO: 7076382 - DNA, 22 bp, Homo sapiens
tctacagagagtcatagactca

SEQ ID NO: 7076383 - DNA, 22 bp, Homo sapiens
tctacagggtaaggggcttgcc

SEQ ID NO: 7076384 - DNA, 22 bp, Homo sapiens
tctacagggtcagagtttcatg

SEQ ID NO: 7076385 - DNA, 22 bp, Homo sapiens
tctacaggtggggcctggcaat

SEQ ID NO: 7076386 - DNA, 21 bp, Homo sapiens
tccttatatttgaatacttta

SEQ ID NO: 7076387 - DNA, 22 bp, Homo sapiens
tccttagagacaagaccagttt

SEQ ID NO: 7076388 - DNA, 22 bp, Homo sapiens
tccttagagatactgtcttgaa

SEQ ID NO: 7076389 - DNA, 18 bp, Homo sapiens
tccttcacagcaggaagg

SEQ ID NO: 7076390 - DNA, 22 bp, Homo sapiens
tccttcacctcaagcttttgaa

SEQ ID NO: 7076391 - DNA, 22 bp, Homo sapiens
tccttcaccttagccctcctag

SEQ ID NO: 7076392 - DNA, 22 bp, Homo sapiens
tccttcactccctctgcatcca

SEQ ID NO: 7076393 - DNA, 19 bp, Homo sapiens
tccttcacttcttaccagg

SEQ ID NO: 7076394 - DNA, 22 bp, Homo sapiens
tccttctctacaaatccaggca

SEQ ID NO: 7076395 - DNA, 19 bp, Homo sapiens
tccttctccggccaccccg

SEQ ID NO: 7076396 - DNA, 22 bp, Homo sapiens
tccttctgtagtccctgtccct

SEQ ID NO: 7076397 - DNA, 21 bp, Homo sapiens
tccttcagtctagatgattgt

SEQ ID NO: 7076398 - DNA, 22 bp, Homo sapiens
tccttcctggggtctctgctgc

SEQ ID NO: 7076399 - DNA, 22 bp, Homo sapiens
tccttcctggggtctctgctgc

SEQ ID NO: 7076400 - DNA, 22 bp, Homo sapiens
tccttcctggggtctctgctgc

SEQ ID NO: 7076401 - DNA, 22 bp, Homo sapiens
tccttcctggggtctctgctgc

SEQ ID NO: 7076402 - DNA, 23 bp, Homo sapiens
tccttcctttgagaggctccatc

SEQ ID NO: 7076403 - DNA, 22 bp, Homo sapiens
tccttctttcacctcatagtca

SEQ ID NO: 7076404 - DNA, 22 bp, Homo sapiens
tccttctttgacaagtggcaga

SEQ ID NO: 7076405 - DNA, 22 bp, Homo sapiens
tccttgactgtgaggaactagc

SEQ ID NO: 7076406 - DNA, 22 bp, Homo sapiens
tcgccagggatgctgtaaggaa

SEQ ID NO: 7076407 - DNA, 22 bp, Homo sapiens
tcgcccaggctggaagtgcagt

SEQ ID NO: 7076408 - DNA, 22 bp, Homo sapiens
tcgtgaggctctgcatcgcaca

SEQ ID NO: 7076409 - DNA, 21 bp, Homo sapiens
tcgtgcagcagctgaggcttg

SEQ ID NO: 7076410 - DNA, 19 bp, Homo sapiens
tcctttctgttcctgagat

SEQ ID NO: 7076411 - DNA, 23 bp, Homo sapiens
tccttgggcctgcccagagtggt

SEQ ID NO: 7076412 - DNA, 23 bp, Homo sapiens
tccttgggcctgcccagagtggt

SEQ ID NO: 7076413 - DNA, 22 bp, Homo sapiens
tcctttccctttccatcctggc

SEQ ID NO: 7076414 - DNA, 22 bp, Homo sapiens
tcctttggttgtagacaggaat

SEQ ID NO: 7076415 - DNA, 22 bp, Homo sapiens
tcctttgacttcttgcagtcca

SEQ ID NO: 7076416 - DNA, 22 bp, Homo sapiens
tcctttgcttctgtcattctcc

SEQ ID NO: 7076417 - DNA, 22 bp, Homo sapiens
tcctttggaactgactccgtta

SEQ ID NO: 7076418 - DNA, 22 bp, Homo sapiens
tcctttggacacattttttata

SEQ ID NO: 7076419 - DNA, 22 bp, Homo sapiens
tcctttggagcttgactggtag

SEQ ID NO: 7076420 - DNA, 22 bp, Homo sapiens
tcctttggcaagctctgctctt

SEQ ID NO: 7076421 - DNA, 20 bp, Homo sapiens
tcctttggccttagagctgt

SEQ ID NO: 7076422 - DNA, 22 bp, Homo sapiens
tcctttggtagttttcttaaag

SEQ ID NO: 7076423 - DNA, 22 bp, Homo sapiens
tcctttggttctctaagatgct

SEQ ID NO: 7076424 - DNA, 22 bp, Homo sapiens
tcctttggttgtagacaggaat

SEQ ID NO: 7076425 - DNA, 22 bp, Homo sapiens
tcctttttaagtcgttgtggta

SEQ ID NO: 7076426 - DNA, 22 bp, Homo sapiens
tcctttttatagttagagaaac

SEQ ID NO: 7076427 - DNA, 22 bp, Homo sapiens
tcctttttggtccaaggtgacc

SEQ ID NO: 7076428 - DNA, 22 bp, Homo sapiens
tcctggcctccgttctctgcat

SEQ ID NO: 7076429 - DNA, 22 bp, Homo sapiens
tcctggcctccgttctctgcat

SEQ ID NO: 7076430 - DNA, 20 bp, Homo sapiens
tcctggcctccctggggctc

SEQ ID NO: 7076431 - DNA, 22 bp, Homo sapiens
tcctggcctcgctgtccacctt

SEQ ID NO: 7076432 - DNA, 22 bp, Homo sapiens
tcctggctctaagtcctgagtg

SEQ ID NO: 7076433 - DNA, 17 bp, Homo sapiens
tcctggctctgccactg

SEQ ID NO: 7076434 - DNA, 16 bp, Homo sapiens
tcctggcccctatgga

SEQ ID NO: 7076435 - DNA, 22 bp, Homo sapiens
tcctggcccgatccctgtgaag

SEQ ID NO: 7076436 - DNA, 22 bp, Homo sapiens
tcctggcccggccgggcctgct

SEQ ID NO: 7076437 - DNA, 22 bp, Homo sapiens
tcctggccgccgcgtggggccg

SEQ ID NO: 7076438 - DNA, 22 bp, Homo sapiens
tcctggccgctggcccctgaga

SEQ ID NO: 7076439 - DNA, 22 bp, Homo sapiens
tcctggcctagctcaccctgga

SEQ ID NO: 7076440 - DNA, 22 bp, Homo sapiens
tcctggcctagctcaccctgga

SEQ ID NO: 7076441 - DNA, 22 bp, Homo sapiens
tcctggagttgtgcagtgcaca

SEQ ID NO: 7076442 - DNA, 22 bp, Homo sapiens
tcctggagtttgtggtgatatg

SEQ ID NO: 7076443 - DNA, 17 bp, Homo sapiens
tcctggcagtcccctgg

SEQ ID NO: 7076444 - DNA, 22 bp, Homo sapiens
tcctggccaagttactctctgc

SEQ ID NO: 7076445 - DNA, 22 bp, Homo sapiens
tcctggccaagttactctctgc

SEQ ID NO: 7076446 - DNA, 22 bp, Homo sapiens
tcctggcccaatctgcccatga

SEQ ID NO: 7076447 - DNA, 22 bp, Homo sapiens
taagaatattgggaatggatgg

SEQ ID NO: 7076448 - DNA, 19 bp, Homo sapiens
tcctgctgtgtgaagggga

SEQ ID NO: 7076449 - DNA, 22 bp, Homo sapiens
tcctgctgtttacctacaatgg

SEQ ID NO: 7076450 - DNA, 20 bp, Homo sapiens
tcctgcttccaccagagcac

SEQ ID NO: 7076451 - DNA, 22 bp, Homo sapiens
tcctgcttcttcgagcttctgg

SEQ ID NO: 7076452 - DNA, 18 bp, Homo sapiens
taagaaggtggctccagc

SEQ ID NO: 7076453 - DNA, 22 bp, Homo sapiens
tcctggagtatttctgtggtgt

SEQ ID NO: 7076454 - DNA, 22 bp, Homo sapiens
tcctggagggctcacaggcggc

SEQ ID NO: 7076455 - DNA, 22 bp, Homo sapiens
tcctggaggggacagcatgggc

SEQ ID NO: 7076456 - DNA, 22 bp, Homo sapiens
tcctggaggcactcgctggggc

SEQ ID NO: 7076457 - DNA, 22 bp, Homo sapiens
tcctggagggaggcggtgctac

SEQ ID NO: 7076458 - DNA, 22 bp, Homo sapiens
tcctggagataattgcagtgaa

SEQ ID NO: 7076459 - DNA, 22 bp, Homo sapiens
tcctggagagaggcctggaaga

SEQ ID NO: 7076460 - DNA, 22 bp, Homo sapiens
tcctgctttgtgcctcacactt

SEQ ID NO: 7076461 - DNA, 22 bp, Homo sapiens
tcctggacaagcccttcaccct

SEQ ID NO: 7076462 - DNA, 22 bp, Homo sapiens
tcctggacagatccccatcatc

SEQ ID NO: 7076463 - DNA, 22 bp, Homo sapiens
tcctggactggctcagcaccct

SEQ ID NO: 7076464 - DNA, 22 bp, Homo sapiens
tcctggagaaactcagagatct

SEQ ID NO: 7076465 - DNA, 22 bp, Homo sapiens
tcctggagaagaggggcttgga

SEQ ID NO: 7076466 - DNA, 22 bp, Homo sapiens
tcctggagaagaggggcttgga

SEQ ID NO: 7076467 - DNA, 22 bp, Homo sapiens
tcctgggaccctgggtgcagag

SEQ ID NO: 7076468 - DNA, 22 bp, Homo sapiens
tcctggctgtcactcgggttga

SEQ ID NO: 7076469 - DNA, 22 bp, Homo sapiens
tcctggctggaatttctcactc

SEQ ID NO: 7076470 - DNA, 21 bp, Homo sapiens
tcctggctttatgctacctct

SEQ ID NO: 7076471 - DNA, 22 bp, Homo sapiens
tcctggcttttcttggctcatc

SEQ ID NO: 7076472 - DNA, 22 bp, Homo sapiens
tcctgggagtggccatgtaatg

SEQ ID NO: 7076473 - DNA, 22 bp, Homo sapiens
tcctgggagtaattgagtcatg

SEQ ID NO: 7076474 - DNA, 22 bp, Homo sapiens
tcctgggatgacttttgaaatg

SEQ ID NO: 7076475 - DNA, 22 bp, Homo sapiens
tcctgggattaaggtggtgatt

SEQ ID NO: 7076476 - DNA, 22 bp, Homo sapiens
tcctgggcaaagaggggcagtg

SEQ ID NO: 7076477 - DNA, 22 bp, Homo sapiens
tcctgggcagaatgggatggct

SEQ ID NO: 7076478 - DNA, 22 bp, Homo sapiens
tcctgggcagaatgggatggct

SEQ ID NO: 7076479 - DNA, 22 bp, Homo sapiens
tcctgggcagcctctctggaag

SEQ ID NO: 7076480 - DNA, 22 bp, Homo sapiens
tcctgggcagcgggacgctcag

SEQ ID NO: 7076481 - DNA, 22 bp, Homo sapiens
tcctgggcgaggtactggggct

SEQ ID NO: 7076482 - DNA, 22 bp, Homo sapiens
tcctgggcgagtggtggtacac

SEQ ID NO: 7076483 - DNA, 22 bp, Homo sapiens
tcctgggcctgtactccatccg

SEQ ID NO: 7076484 - DNA, 22 bp, Homo sapiens
tcctgggccctccggatcaggt

SEQ ID NO: 7076485 - DNA, 22 bp, Homo sapiens
tcctgggcccaggctgccaggg

SEQ ID NO: 7076486 - DNA, 22 bp, Homo sapiens
tcctgggccaagggctgtgagg

SEQ ID NO: 7076487 - DNA, 22 bp, Homo sapiens
tcctgggccaagggctgtgagg

SEQ ID NO: 7076488 - DNA, 22 bp, Homo sapiens
tcctgggcccaggctgccaggg

SEQ ID NO: 7076489 - DNA, 22 bp, Homo sapiens
tcctgggctgcagggaagagca

SEQ ID NO: 7076490 - DNA, 19 bp, Homo sapiens
tcctgggctgcgtcttgcc

SEQ ID NO: 7076491 - DNA, 22 bp, Homo sapiens
tcctgggcgattttctgaatat

SEQ ID NO: 7076492 - DNA, 19 bp, Homo sapiens
tcctgggctgggccaggtc

SEQ ID NO: 7076493 - DNA, 22 bp, Homo sapiens
tcctgggctgtgtgccactctg

SEQ ID NO: 7076494 - DNA, 22 bp, Homo sapiens
tcctggtgtaatggtaagcatg

SEQ ID NO: 7076495 - DNA, 22 bp, Homo sapiens
tcctggtgtcgcctggtcagtt

SEQ ID NO: 7076496 - DNA, 22 bp, Homo sapiens
tcctgtcctgaggctccaggcc

SEQ ID NO: 7076497 - DNA, 22 bp, Homo sapiens
tcctgtctaaagacctgcaggc

SEQ ID NO: 7076498 - DNA, 22 bp, Homo sapiens
tcctgtctaaagacctgcaggc

SEQ ID NO: 7076499 - DNA, 22 bp, Homo sapiens
tcctgtctaaagacctgcaggc

SEQ ID NO: 7076500 - DNA, 17 bp, Homo sapiens
tcctgtgggtgcagcag

SEQ ID NO: 7076501 - DNA, 22 bp, Homo sapiens
tcctgtggtatgggagtgatgt

SEQ ID NO: 7076502 - DNA, 22 bp, Homo sapiens
tcctgtggagaggactggaggt

SEQ ID NO: 7076503 - DNA, 22 bp, Homo sapiens
tcctgtggaagacagtgttggg

SEQ ID NO: 7076504 - DNA, 22 bp, Homo sapiens
tcctgtctaaagacctgcaggc

SEQ ID NO: 7076505 - DNA, 22 bp, Homo sapiens
tcctgtctgctcacagagctgg

SEQ ID NO: 7076506 - DNA, 22 bp, Homo sapiens
tcctgtctgctcacagagctgg

SEQ ID NO: 7076507 - DNA, 22 bp, Homo sapiens
tcctgtctgtctttggtccctt

SEQ ID NO: 7076508 - DNA, 22 bp, Homo sapiens
tcctgtctgctcacagagctgg

SEQ ID NO: 7076509 - DNA, 22 bp, Homo sapiens
tcctgtctgtctttggtccctt

SEQ ID NO: 7076510 - DNA, 22 bp, Homo sapiens
tcctggggccagcactggtgga

SEQ ID NO: 7076511 - DNA, 22 bp, Homo sapiens
tcctggggctctgagcgagaca

SEQ ID NO: 7076512 - DNA, 22 bp, Homo sapiens
tcctggggctgcaaggcctgtc

SEQ ID NO: 7076513 - DNA, 22 bp, Homo sapiens
tcctggggctgcaaggcctgtc

SEQ ID NO: 7076514 - DNA, 22 bp, Homo sapiens
tcctggggtcctgactgcttcc

SEQ ID NO: 7076515 - DNA, 22 bp, Homo sapiens
tcctgggtaaacactgaccttt

SEQ ID NO: 7076516 - DNA, 22 bp, Homo sapiens
tcctgggtagcctgtccaagat

SEQ ID NO: 7076517 - DNA, 22 bp, Homo sapiens
tcctgggtcccgcacatctgtc

SEQ ID NO: 7076518 - DNA, 22 bp, Homo sapiens
tcctgggtgaaagaacaggcag

SEQ ID NO: 7076519 - DNA, 22 bp, Homo sapiens
tcctgggtggtggtaggagcag

SEQ ID NO: 7076520 - DNA, 22 bp, Homo sapiens
tcctgggtgtgatattcataga

SEQ ID NO: 7076521 - DNA, 23 bp, Homo sapiens
tcctgggtttgaattctagtctt

SEQ ID NO: 7076522 - DNA, 22 bp, Homo sapiens
tcctggtggctctttgggaagg

SEQ ID NO: 7076523 - DNA, 22 bp, Homo sapiens
acctacccttagatcacaaggg

SEQ ID NO: 7076524 - DNA, 22 bp, Homo sapiens
aaggctgcttttaacatgcata

SEQ ID NO: 7076525 - DNA, 22 bp, Homo sapiens
aagccttttccacctaatagag

SEQ ID NO: 7076526 - DNA, 22 bp, Homo sapiens
aattaacagagggcttattact

SEQ ID NO: 7076527 - DNA, 22 bp, Homo sapiens
aattaaaagataacccatgagt

SEQ ID NO: 7076528 - DNA, 22 bp, Homo sapiens
agaccctctcctcatggacatg

SEQ ID NO: 7076529 - DNA, 23 bp, Homo sapiens
aatggtcttcctccacccctctg

SEQ ID NO: 7076530 - DNA, 22 bp, Homo sapiens
agaggctgttacactcccagat

SEQ ID NO: 7076531 - DNA, 22 bp, Homo sapiens
accctcaacaaattcactctat

SEQ ID NO: 7076532 - DNA, 22 bp, Homo sapiens
acccgggaggcaggagtcatag

SEQ ID NO: 7076533 - DNA, 22 bp, Homo sapiens
acatttaacctttgaggaactg

SEQ ID NO: 7076534 - DNA, 22 bp, Homo sapiens
atcacatttatagtggcacgca

SEQ ID NO: 7076535 - DNA, 22 bp, Homo sapiens
acttggtgtattagctctcact

SEQ ID NO: 7076536 - DNA, 22 bp, Homo sapiens
agtttatgtaaaattagtaatg

SEQ ID NO: 7076537 - DNA, 22 bp, Homo sapiens
actgtgtggaccactctgaggc

SEQ ID NO: 7076538 - DNA, 22 bp, Homo sapiens
acctccccattaggtcacccac

SEQ ID NO: 7076539 - DNA, 22 bp, Homo sapiens
acctccccgggagcagcctcct

SEQ ID NO: 7076540 - DNA, 22 bp, Homo sapiens
acctcccctgactcgaaaccca

SEQ ID NO: 7076541 - DNA, 22 bp, Homo sapiens
cagacagcaggcctggatgtgt

SEQ ID NO: 7076542 - DNA, 22 bp, Homo sapiens
cagccagatcaaactcagatgt

SEQ ID NO: 7076543 - DNA, 22 bp, Homo sapiens
cagccagatcagggcaggggtt

SEQ ID NO: 7076544 - DNA, 22 bp, Homo sapiens
cagccagagaaagggcactgcc

SEQ ID NO: 7076545 - DNA, 22 bp, Homo sapiens
cagccagagaggaaggaatgca

SEQ ID NO: 7076546 - DNA, 22 bp, Homo sapiens
agcagctgtttgttgaattggt

SEQ ID NO: 7076547 - DNA, 22 bp, Homo sapiens
agcacagatgtactttgagggg

SEQ ID NO: 7076548 - DNA, 22 bp, Homo sapiens
agcacagagctcggggaatgga

SEQ ID NO: 7076549 - DNA, 19 bp, Homo sapiens
agcacagagagtctatagc

SEQ ID NO: 7076550 - DNA, 22 bp, Homo sapiens
agcacagagattatttacaaga

SEQ ID NO: 7076551 - DNA, 23 bp, Homo sapiens
agcacagactagaaaggtctttc

SEQ ID NO: 7076552 - DNA, 22 bp, Homo sapiens
atgttttaaatatgtgtgtaaa

SEQ ID NO: 7076553 - DNA, 22 bp, Homo sapiens
atttaagaggctgctagagtat

SEQ ID NO: 7076554 - DNA, 22 bp, Homo sapiens
agcaaacagtttctggggatct

SEQ ID NO: 7076555 - DNA, 22 bp, Homo sapiens
atcttggggaatcctctgtgta

SEQ ID NO: 7076556 - DNA, 23 bp, Homo sapiens
agctctgaaatagggaaagagga

SEQ ID NO: 7076557 - DNA, 22 bp, Homo sapiens
agctgtgtgcccatggtggagg

SEQ ID NO: 7076558 - DNA, 22 bp, Homo sapiens
agctgtgtgtgcttgggattat

SEQ ID NO: 7076559 - DNA, 22 bp, Homo sapiens
agctgtgtttccagatggtagc

SEQ ID NO: 7076560 - DNA, 22 bp, Homo sapiens
aggctctgatcaggtggctgtg

SEQ ID NO: 7076561 - DNA, 22 bp, Homo sapiens
aggctctgaggcagattttcgt

SEQ ID NO: 7076562 - DNA, 22 bp, Homo sapiens
aggctctgcatccaggctttat

SEQ ID NO: 7076563 - DNA, 22 bp, Homo sapiens
ctcagcctgtgaagagcagagg

SEQ ID NO: 7076564 - DNA, 19 bp, Homo sapiens
ctctggagaacaatagtgc

SEQ ID NO: 7076565 - DNA, 18 bp, Homo sapiens
ctcctttccctacacctc

SEQ ID NO: 7076566 - DNA, 22 bp, Homo sapiens
ctcgcctgcctgtgtctctccc

SEQ ID NO: 7076567 - DNA, 22 bp, Homo sapiens
ctgcagctaaggaatgtggttg

SEQ ID NO: 7076568 - DNA, 22 bp, Homo sapiens
ctggagagaccgaaagaggctg

SEQ ID NO: 7076569 - DNA, 22 bp, Homo sapiens
atccatttgtttactgatggac

SEQ ID NO: 7076570 - DNA, 22 bp, Homo sapiens
atatgaagtcagacaaactggg

SEQ ID NO: 7076571 - DNA, 22 bp, Homo sapiens
gaggctgctttcctcctatcct

SEQ ID NO: 7076572 - DNA, 22 bp, Homo sapiens
gaggctgctttgatgacaggag

SEQ ID NO: 7076573 - DNA, 23 bp, Homo sapiens
gaggcctggccctgccacatctc

SEQ ID NO: 7076574 - DNA, 20 bp, Homo sapiens
gaggctgcggactgctggac

SEQ ID NO: 7076575 - DNA, 22 bp, Homo sapiens
gaggctgcggggaggagcctgc

SEQ ID NO: 7076576 - DNA, 22 bp, Homo sapiens
atgagttgaagctacaagaggc

SEQ ID NO: 7076577 - DNA, 23 bp, Homo sapiens
atgttttatgtctctagctgcca

SEQ ID NO: 7076578 - DNA, 22 bp, Homo sapiens
atttctcacagtggaatctctg

SEQ ID NO: 7076579 - DNA, 22 bp, Homo sapiens
atttctcaggactccatgggcg

SEQ ID NO: 7076580 - DNA, 22 bp, Homo sapiens
attggagaagaacatgaattag

SEQ ID NO: 7076581 - DNA, 22 bp, Homo sapiens
atttaattaatcatggtgaatt

SEQ ID NO: 7076582 - DNA, 22 bp, Homo sapiens
atttaattttctcaacagtgct

SEQ ID NO: 7076583 - DNA, 22 bp, Homo sapiens
atttctcaaaggaatagagtga

SEQ ID NO: 7076584 - DNA, 22 bp, Homo sapiens
ggcactgggaatgcagtgatga

SEQ ID NO: 7076585 - DNA, 18 bp, Homo sapiens
caccctccgcggctgccc

SEQ ID NO: 7076586 - DNA, 22 bp, Homo sapiens
caccccttccgccactgccttc

SEQ ID NO: 7076587 - DNA, 22 bp, Homo sapiens
caccctcaagcagtggcacgtg

SEQ ID NO: 7076588 - DNA, 22 bp, Homo sapiens
ggcatagatttctttaggttta

SEQ ID NO: 7076589 - DNA, 20 bp, Homo sapiens
gctgtggcaaagctttgtgt

SEQ ID NO: 7076590 - DNA, 22 bp, Homo sapiens
ggttccccaggcggcccttgga

SEQ ID NO: 7076591 - DNA, 22 bp, Homo sapiens
cagcagagtttggcttctaatg

SEQ ID NO: 7076592 - DNA, 22 bp, Homo sapiens
tctgtggcacgattgcactgca

SEQ ID NO: 7076593 - DNA, 22 bp, Homo sapiens
tcctccccaaagcccagcctgg

SEQ ID NO: 7076594 - DNA, 22 bp, Homo sapiens
ccactgacacagacaaggcctg

SEQ ID NO: 7076595 - DNA, 17 bp, Homo sapiens
ccactgactctgacttc

SEQ ID NO: 7076596 - DNA, 22 bp, Homo sapiens
caggagttttaaatctagcatg

SEQ ID NO: 7076597 - DNA, 22 bp, Homo sapiens
cagctctgttcatagatggtgc

SEQ ID NO: 7076598 - DNA, 21 bp, Homo sapiens
cctctgtgctaaagggctccc

SEQ ID NO: 7076599 - DNA, 22 bp, Homo sapiens
tgtctcttctgcctccagctgt

SEQ ID NO: 7076600 - DNA, 22 bp, Homo sapiens
tgtctcttggctctatcactta

SEQ ID NO: 7076601 - DNA, 22 bp, Homo sapiens
tggcacaggaatttagatgcag

SEQ ID NO: 7076602 - DNA, 22 bp, Homo sapiens
tggcacagtatgggattaaaga

SEQ ID NO: 7076603 - DNA, 22 bp, Homo sapiens
cccctcctgcagcacctttctt

SEQ ID NO: 7076604 - DNA, 22 bp, Homo sapiens
cccctcctggccacactgtcag

SEQ ID NO: 7076605 - DNA, 19 bp, Homo sapiens
tctgtggccttccctgatg

SEQ ID NO: 7076606 - DNA, 22 bp, Homo sapiens
tctgtggcatgttgcacttgta

SEQ ID NO: 7076607 - DNA, 22 bp, Homo sapiens
tctgtggcccaagtgatggctg

SEQ ID NO: 7076608 - DNA, 23 bp, Homo sapiens
tctgtggccccttcgccccactc

SEQ ID NO: 7076609 - DNA, 22 bp, Homo sapiens
tctgtggcctccttccacttac

SEQ ID NO: 7076610 - DNA, 22 bp, Homo sapiens
tctgtggcctgcctcctcattt

SEQ ID NO: 7076611 - DNA, 22 bp, Homo sapiens
cccagcctttgcttcctggttc

SEQ ID NO: 7076612 - DNA, 22 bp, Homo sapiens
ctgattgagaaggaaggggatc

SEQ ID NO: 7076613 - DNA, 22 bp, Homo sapiens
ctgaagagcaaaccaactggac

SEQ ID NO: 7076614 - DNA, 22 bp, Homo sapiens
ctggctctaagtgtcagctccc

SEQ ID NO: 7076615 - DNA, 22 bp, Homo sapiens
ctggcaagaaatatatatctta

SEQ ID NO: 7076616 - DNA, 22 bp, Homo sapiens
ctctccactgtcctttgctggt

SEQ ID NO: 7076617 - DNA, 22 bp, Homo sapiens
ctctccctatgcctcccaggag

SEQ ID NO: 7076618 - DNA, 22 bp, Homo sapiens
ttggatgaggttgagaatcatt

SEQ ID NO: 7076619 - DNA, 22 bp, Homo sapiens
gagagctgggggactgtggatg

SEQ ID NO: 7076620 - DNA, 22 bp, Homo sapiens
gagagctggattctggataggt

SEQ ID NO: 7076621 - DNA, 22 bp, Homo sapiens
gacacagggacgtgctctgcct

SEQ ID NO: 7076622 - DNA, 22 bp, Homo sapiens
cttggctgtcataaggtcctgg

SEQ ID NO: 7076623 - DNA, 18 bp, Homo sapiens
ctttagctgtcatctttg

SEQ ID NO: 7076624 - DNA, 22 bp, Homo sapiens
gaggctgcccaactggagtgga

SEQ ID NO: 7076625 - DNA, 22 bp, Homo sapiens
gaggctgcccacacctgcgccg

SEQ ID NO: 7076626 - DNA, 17 bp, Homo sapiens
gatgaaatgatgcacac

SEQ ID NO: 7076627 - DNA, 20 bp, Homo sapiens
gatgaaatcactgggcagcc

SEQ ID NO: 7076628 - DNA, 22 bp, Homo sapiens
gatgtagacacttggaggctta

SEQ ID NO: 7076629 - DNA, 22 bp, Homo sapiens
gatggtctttgtctctgataag

SEQ ID NO: 7076630 - DNA, 21 bp, Homo sapiens
gcaggcactctagaggagctg

SEQ ID NO: 7076631 - DNA, 16 bp, Homo sapiens
gccctttccttggctg

SEQ ID NO: 7076632 - DNA, 22 bp, Homo sapiens
gccctttcttcttctggactgg

SEQ ID NO: 7076633 - DNA, 22 bp, Homo sapiens
gccctcctttgcttctcctagt

SEQ ID NO: 7076634 - DNA, 22 bp, Homo sapiens
gctgctctcatagatggcttca

SEQ ID NO: 7076635 - DNA, 22 bp, Homo sapiens
gctctgaggagccaagaatgtg

SEQ ID NO: 7076636 - DNA, 22 bp, Homo sapiens
gctctgagtgatcagctgggaa

SEQ ID NO: 7076637 - DNA, 22 bp, Homo sapiens
ggaagaaatctggttaagagat

SEQ ID NO: 7076638 - DNA, 22 bp, Homo sapiens
ggcacagacctgctgcgatatc

SEQ ID NO: 7076639 - DNA, 22 bp, Homo sapiens
ggagttgattttggatatatta

SEQ ID NO: 7076640 - DNA, 22 bp, Homo sapiens
ggcacagagttggcagagctgc

SEQ ID NO: 7076641 - DNA, 22 bp, Homo sapiens
ggcacagatagatcaagtgtct

SEQ ID NO: 7076642 - DNA, 23 bp, Homo sapiens
ggcacagatgctgagcatgtgca

SEQ ID NO: 7076643 - DNA, 22 bp, Homo sapiens
ggcacagagctccagccttggc

SEQ ID NO: 7076644 - DNA, 21 bp, Homo sapiens
ggcagagaagctggaagttgg

SEQ ID NO: 7076645 - DNA, 22 bp, Homo sapiens
ggcagaggaagctggaagtggg

SEQ ID NO: 7076646 - DNA, 22 bp, Homo sapiens
gggaacagggcctgagctgggg

SEQ ID NO: 7076647 - DNA, 22 bp, Homo sapiens
ggctgatcaggtgcaaatgcat

SEQ ID NO: 7076648 - DNA, 22 bp, Homo sapiens
ggctccaccctgcttccagaag

SEQ ID NO: 7076649 - DNA, 22 bp, Homo sapiens
gtggctgctgtcctctctggtt

SEQ ID NO: 7076650 - DNA, 22 bp, Homo sapiens
gtggctctggctttccaggcgg

SEQ ID NO: 7076651 - DNA, 22 bp, Homo sapiens
gtggctcttgcatggggtctct

SEQ ID NO: 7076652 - DNA, 22 bp, Homo sapiens
tcctttctatcttgggtatcta

SEQ ID NO: 7076653 - DNA, 22 bp, Homo sapiens
tcctttctcccaggttagttgt

SEQ ID NO: 7076654 - DNA, 18 bp, Homo sapiens
tcctttctccctcatctt

SEQ ID NO: 7076655 - DNA, 22 bp, Homo sapiens
tcctttctgggcctcagtgact

SEQ ID NO: 7076656 - DNA, 19 bp, Homo sapiens
tccttctccggccaccccg

SEQ ID NO: 7076657 - DNA, 23 bp, Homo sapiens
tctagcctgtcatcagcctctcc

SEQ ID NO: 7076658 - DNA, 22 bp, Homo sapiens
tctcccctactctaaatctgca

SEQ ID NO: 7076659 - DNA, 22 bp, Homo sapiens
tctcccctagtgcattaaagtg

SEQ ID NO: 7076660 - DNA, 18 bp, Homo sapiens
tctgaaagcaccggtgaa

SEQ ID NO: 7076661 - DNA, 22 bp, Homo sapiens
tctgaagaactgagtaaacatg

SEQ ID NO: 7076662 - DNA, 22 bp, Homo sapiens
tctgaagaataggatgttgtgt

SEQ ID NO: 7076663 - DNA, 22 bp, Homo sapiens
tctgaagattaccagctaaatg

SEQ ID NO: 7076664 - DNA, 22 bp, Homo sapiens
tctctgaacttcctggaaaggc

SEQ ID NO: 7076665 - DNA, 22 bp, Homo sapiens
tctctgaagagctcagactagt

SEQ ID NO: 7076666 - DNA, 22 bp, Homo sapiens
tctgcccttggctctcttgttg

SEQ ID NO: 7076667 - DNA, 22 bp, Homo sapiens
tctgagacactcttgtgatggg

SEQ ID NO: 7076668 - DNA, 22 bp, Homo sapiens
tctgagacaggaagtggagggt

SEQ ID NO: 7076669 - DNA, 20 bp, Homo sapiens
tctgagacttgtagtgtgga

SEQ ID NO: 7076670 - DNA, 22 bp, Homo sapiens
tctgtggctgtgctgggccaga

SEQ ID NO: 7076671 - DNA, 22 bp, Homo sapiens
tctgtggctgttatctttatat

SEQ ID NO: 7076672 - DNA, 22 bp, Homo sapiens
tctgtggcttcctatttcttgg

SEQ ID NO: 7076673 - DNA, 22 bp, Homo sapiens
tctgtggcttgggcctgcctgt

SEQ ID NO: 7076674 - DNA, 22 bp, Homo sapiens
tctgtggctttcttatgttgta

SEQ ID NO: 7076675 - DNA, 22 bp, Homo sapiens
tctttcccagtagctctcccag

SEQ ID NO: 7076676 - DNA, 21 bp, Homo sapiens
tgcccctttatgggctcccta

SEQ ID NO: 7076677 - DNA, 22 bp, Homo sapiens
tgccctggaaccatctacagtc

SEQ ID NO: 7076678 - DNA, 22 bp, Homo sapiens
tgccctgggaacacagatgcca

SEQ ID NO: 7076679 - DNA, 22 bp, Homo sapiens
tgaggctcaagaatagacagta

SEQ ID NO: 7076680 - DNA, 22 bp, Homo sapiens
tgaggctcagaaatgtaagttt

SEQ ID NO: 7076681 - DNA, 22 bp, Homo sapiens
tgaggctccagccaggccagca

SEQ ID NO: 7076682 - DNA, 22 bp, Homo sapiens
tgaaaccactgatggtaccaag

SEQ ID NO: 7076683 - DNA, 17 bp, Homo sapiens
tgctttcttcctgccct

SEQ ID NO: 7076684 - DNA, 22 bp, Homo sapiens
tgctttctctctaccccacttt

SEQ ID NO: 7076685 - DNA, 22 bp, Homo sapiens
tggcacagacagcacagcaatg

SEQ ID NO: 7076686 - DNA, 22 bp, Homo sapiens
tggcacagttaaagttgtagaa

SEQ ID NO: 7076687 - DNA, 19 bp, Homo sapiens
tggctctgtttctctggag

SEQ ID NO: 7076688 - DNA, 21 bp, Homo sapiens
tggctgactcttcctatcatt

SEQ ID NO: 7076689 - DNA, 22 bp, Homo sapiens
tggctgacaatgtagcagtaac

SEQ ID NO: 7076690 - DNA, 22 bp, Homo sapiens
tggctgctgcagacagacagga

SEQ ID NO: 7076691 - DNA, 22 bp, Homo sapiens
tggctgctgagaaggcagctgt

SEQ ID NO: 7076692 - DNA, 22 bp, Homo sapiens
tgggctctctttacctcataac

SEQ ID NO: 7076693 - DNA, 22 bp, Homo sapiens
tgggctctgaagggtcccggat

SEQ ID NO: 7076694 - DNA, 22 bp, Homo sapiens
tgggctctcaaagtgcggcttg

SEQ ID NO: 7076695 - DNA, 20 bp, Homo sapiens
tgggctctgcttcctggagt

SEQ ID NO: 7076696 - DNA, 22 bp, Homo sapiens
tgggctctgcatcagtgcccat

SEQ ID NO: 7076697 - DNA, 22 bp, Homo sapiens
tgggctctggggaaactgtgat

SEQ ID NO: 7076698 - DNA, 22 bp, Homo sapiens
tgggctctggtttcctggctgg

SEQ ID NO: 7076699 - DNA, 22 bp, Homo sapiens
tgggctctggagggcctaggat

SEQ ID NO: 7076700 - DNA, 21 bp, Homo sapiens
tgggctctttaacccaggcac

SEQ ID NO: 7076701 - DNA, 22 bp, Homo sapiens
tggtagtcggcctcggtggctc

SEQ ID NO: 7076702 - DNA, 22 bp, Homo sapiens
tgtattgaattgtgttatatct

SEQ ID NO: 7076703 - DNA, 18 bp, Homo sapiens
tgtccctgcaaataacat

SEQ ID NO: 7076704 - DNA, 22 bp, Homo sapiens
tggtgaggtcatagagaactgt

SEQ ID NO: 7076705 - DNA, 22 bp, Homo sapiens
tggtgaggccaaagccatgaca

SEQ ID NO: 7076706 - DNA, 22 bp, Homo sapiens
ttcagcctgtctgcagacccct

SEQ ID NO: 7076707 - DNA, 22 bp, Homo sapiens
ttagataacagtagaatatcaa

SEQ ID NO: 7076708 - DNA, 22 bp, Homo sapiens
ttatatgtttctgtttggaggc

SEQ ID NO: 7076709 - DNA, 22 bp, Homo sapiens
ttatgatttagaaagattcact

SEQ ID NO: 7076710 - DNA, 22 bp, Homo sapiens
tgtggctcggccagctgctgaa

SEQ ID NO: 7076711 - DNA, 22 bp, Homo sapiens
tgtggctctcctcctgctgccc

SEQ ID NO: 7076712 - DNA, 22 bp, Homo sapiens
tgtggctgactcctggtcccca

SEQ ID NO: 7076713 - DNA, 22 bp, Homo sapiens
tgtctcttttcaagctaccctt

SEQ ID NO: 7076714 - DNA, 22 bp, Homo sapiens
aagccagatagaagaactcatt

SEQ ID NO: 7076715 - DNA, 22 bp, Homo sapiens
aagccagatcaaagtgtccagg

SEQ ID NO: 7076716 - DNA, 22 bp, Homo sapiens
aagccagatttcactcttaatt

SEQ ID NO: 7076717 - DNA, 22 bp, Homo sapiens
aaattaactatcacttttgtga

SEQ ID NO: 7076718 - DNA, 22 bp, Homo sapiens
aaatttcaagcaaagtagctat

SEQ ID NO: 7076719 - DNA, 22 bp, Homo sapiens
aagaggttgtctgtgatgagtt

SEQ ID NO: 7076720 - DNA, 22 bp, Homo sapiens
aattcaacagtcagttatctca

SEQ ID NO: 7076721 - DNA, 22 bp, Homo sapiens
actgtggctaattcatttggtc

SEQ ID NO: 7076722 - DNA, 22 bp, Homo sapiens
actgtggccttgtgggttcagg

SEQ ID NO: 7076723 - DNA, 22 bp, Homo sapiens
actgtggccggaacagtgggac

SEQ ID NO: 7076724 - DNA, 22 bp, Homo sapiens
actgtggcctgctgtatgggct

SEQ ID NO: 7076725 - DNA, 22 bp, Homo sapiens
actgtggcactaggcaccttac

SEQ ID NO: 7076726 - DNA, 22 bp, Homo sapiens
actgtggccaaagcctctggga

SEQ ID NO: 7076727 - DNA, 22 bp, Homo sapiens
acccacgaagatgagcggcatg

SEQ ID NO: 7076728 - DNA, 22 bp, Homo sapiens
agctgtgtaagtcatgtaggtg

SEQ ID NO: 7076729 - DNA, 22 bp, Homo sapiens
agaagccaatccttgtctctct

SEQ ID NO: 7076730 - DNA, 22 bp, Homo sapiens
atccattttttcagaatgctct

SEQ ID NO: 7076731 - DNA, 22 bp, Homo sapiens
atccattttccttggcagcagg

SEQ ID NO: 7076732 - DNA, 22 bp, Homo sapiens
agtacccttttcactgtcacaa

SEQ ID NO: 7076733 - DNA, 22 bp, Homo sapiens
atgaaggacaacaggggagcag

SEQ ID NO: 7076734 - DNA, 22 bp, Homo sapiens
cactgtgggcctgtcgtgggtg

SEQ ID NO: 7076735 - DNA, 22 bp, Homo sapiens
agcagaggaggatttagttagg

SEQ ID NO: 7076736 - DNA, 21 bp, Homo sapiens
ccctgccctcaaggacagtgc

SEQ ID NO: 7076737 - DNA, 22 bp, Homo sapiens
ccctgcccaccacatgctggga

SEQ ID NO: 7076738 - DNA, 22 bp, Homo sapiens
agggctgcttacctggaatggc

SEQ ID NO: 7076739 - DNA, 22 bp, Homo sapiens
aggctgcttcttgtccttggca

SEQ ID NO: 7076740 - DNA, 20 bp, Homo sapiens
aggcagagcgcacttttaga

SEQ ID NO: 7076741 - DNA, 23 bp, Homo sapiens
catgtgtgacagtatcactgttt

SEQ ID NO: 7076742 - DNA, 22 bp, Homo sapiens
catgtgtgaatcttgtgatcat

SEQ ID NO: 7076743 - DNA, 22 bp, Homo sapiens
aggagtttggggattagtcagg

SEQ ID NO: 7076744 - DNA, 22 bp, Homo sapiens
ctatctcagataacctgcacca

SEQ ID NO: 7076745 - DNA, 22 bp, Homo sapiens
ctgagccagctggcatgtgcta

SEQ ID NO: 7076746 - DNA, 22 bp, Homo sapiens
agtgtttggggtgattgtaacc

SEQ ID NO: 7076747 - DNA, 22 bp, Homo sapiens
agtgtttgggggccttgtaaca

SEQ ID NO: 7076748 - DNA, 22 bp, Homo sapiens
agtgagttgaacattgataatg

SEQ ID NO: 7076749 - DNA, 18 bp, Homo sapiens
agtgagttgttgaaagaa

SEQ ID NO: 7076750 - DNA, 21 bp, Homo sapiens
atctcgggcttctcgcccagc

SEQ ID NO: 7076751 - DNA, 22 bp, Homo sapiens
atctggttcttcttaggcatca

SEQ ID NO: 7076752 - DNA, 22 bp, Homo sapiens
ctggctctttcagccgctggag

SEQ ID NO: 7076753 - DNA, 22 bp, Homo sapiens
gagttataacctagtttaactg

SEQ ID NO: 7076754 - DNA, 22 bp, Homo sapiens
gagttaattcgaatattctagc

SEQ ID NO: 7076755 - DNA, 22 bp, Homo sapiens
cttgagaatcttctctgaagag

SEQ ID NO: 7076756 - DNA, 22 bp, Homo sapiens
gctctgagacagtagagatggc

SEQ ID NO: 7076757 - DNA, 22 bp, Homo sapiens
gccctcctgcaggggcttctgg

SEQ ID NO: 7076758 - DNA, 22 bp, Homo sapiens
gcccctccatccatcaccgggg

SEQ ID NO: 7076759 - DNA, 22 bp, Homo sapiens
attgttgggtagtttgttcagc

SEQ ID NO: 7076760 - DNA, 22 bp, Homo sapiens
gcacagagcttgtttacatttg

SEQ ID NO: 7076761 - DNA, 18 bp, Homo sapiens
gcacagagcaagtttcat

SEQ ID NO: 7076762 - DNA, 22 bp, Homo sapiens
gcagaggctgtagggaaggttg

SEQ ID NO: 7076763 - DNA, 20 bp, Homo sapiens
caagtgttattgtgcattta

SEQ ID NO: 7076764 - DNA, 22 bp, Homo sapiens
cacagcctgctgcactcaagaa

SEQ ID NO: 7076765 - DNA, 22 bp, Homo sapiens
ggcgctcagtgttgccccagag

SEQ ID NO: 7076766 - DNA, 22 bp, Homo sapiens
ggatacagcggcttctgcgcga

SEQ ID NO: 7076767 - DNA, 20 bp, Homo sapiens
cagcctccactcactcagct

SEQ ID NO: 7076768 - DNA, 22 bp, Homo sapiens
gtctttcttcagagcttggact

SEQ ID NO: 7076769 - DNA, 22 bp, Homo sapiens
gtctttctgctgcacggactgc

SEQ ID NO: 7076770 - DNA, 22 bp, Homo sapiens
gtctttctctggaacagtaaaa

SEQ ID NO: 7076771 - DNA, 22 bp, Homo sapiens
gtctttcttaaacaacagaaca

SEQ ID NO: 7076772 - DNA, 22 bp, Homo sapiens
cagcagagctgggctttgaatt

SEQ ID NO: 7076773 - DNA, 19 bp, Homo sapiens
cagaggcactttctcttag

SEQ ID NO: 7076774 - DNA, 22 bp, Homo sapiens
catttcacagtatattcaaaat

SEQ ID NO: 7076775 - DNA, 22 bp, Homo sapiens
catttcaccttagagaattatt

SEQ ID NO: 7076776 - DNA, 22 bp, Homo sapiens
catttccactctgggagtcaga

SEQ ID NO: 7076777 - DNA, 22 bp, Homo sapiens
tctagaaagccaaattaggaat

SEQ ID NO: 7076778 - DNA, 22 bp, Homo sapiens
tcaaattagtggaataataatg

SEQ ID NO: 7076779 - DNA, 22 bp, Homo sapiens
caggctgcagcagcagtggccc

SEQ ID NO: 7076780 - DNA, 22 bp, Homo sapiens
ccctttagcccctgcagagact

SEQ ID NO: 7076781 - DNA, 22 bp, Homo sapiens
ccctttcaacattctgccttgt

SEQ ID NO: 7076782 - DNA, 22 bp, Homo sapiens
ccctcctcaactctggcttcca

SEQ ID NO: 7076783 - DNA, 22 bp, Homo sapiens
ccctccctttgcagcagtgcat

SEQ ID NO: 7076784 - DNA, 23 bp, Homo sapiens
cctcccacctatttcactttctt

SEQ ID NO: 7076785 - DNA, 22 bp, Homo sapiens
cctccatctccagcttctgcct

SEQ ID NO: 7076786 - DNA, 22 bp, Homo sapiens
cctgcagctttgcctcctgaac

SEQ ID NO: 7076787 - DNA, 22 bp, Homo sapiens
tgcacagatgctaggaggtgaa

SEQ ID NO: 7076788 - DNA, 21 bp, Homo sapiens
tgagtctcccttagcccacgc

SEQ ID NO: 7076789 - DNA, 22 bp, Homo sapiens
tgagttttttcaacatatgaag

SEQ ID NO: 7076790 - DNA, 22 bp, Homo sapiens
tgttgcccaggttctctcctgc

SEQ ID NO: 7076791 - DNA, 22 bp, Homo sapiens
cctgtggctgccacttgggtga

SEQ ID NO: 7076792 - DNA, 22 bp, Homo sapiens
ttacccacctttctcatgccaa

SEQ ID NO: 7076793 - DNA, 22 bp, Homo sapiens
ttacccactgagcttcagccct

SEQ ID NO: 7076794 - DNA, 18 bp, Homo sapiens
ctgccccttctctgagat

SEQ ID NO: 7076795 - DNA, 19 bp, Homo sapiens
ctctggagcagacactgga

SEQ ID NO: 7076796 - DNA, 22 bp, Homo sapiens
cttagtgaggaatgaatttgtt

SEQ ID NO: 7076797 - DNA, 22 bp, Homo sapiens
ctttaagactaaattagagttt

SEQ ID NO: 7076798 - DNA, 22 bp, Homo sapiens
gaaagccatctggctgctggga

SEQ ID NO: 7076799 - DNA, 22 bp, Homo sapiens
gaggctgcagctatcagacatt

SEQ ID NO: 7076800 - DNA, 22 bp, Homo sapiens
gaggctgcaggcaatgctgccc

SEQ ID NO: 7076801 - DNA, 22 bp, Homo sapiens
gacagacatttcctgatccaat

SEQ ID NO: 7076802 - DNA, 22 bp, Homo sapiens
gactcccctgggccccatccag

SEQ ID NO: 7076803 - DNA, 22 bp, Homo sapiens
gacagacacaattgatccatga

SEQ ID NO: 7076804 - DNA, 22 bp, Homo sapiens
gacagacaggaggcattcaggg

SEQ ID NO: 7076805 - DNA, 22 bp, Homo sapiens
gcactggagatacagagatgaa

SEQ ID NO: 7076806 - DNA, 22 bp, Homo sapiens
gcactggaaatacctagatgaa

SEQ ID NO: 7076807 - DNA, 22 bp, Homo sapiens
gcccatggacacccaagtgcca

SEQ ID NO: 7076808 - DNA, 22 bp, Homo sapiens
ggagagctggtatatgaagaca

SEQ ID NO: 7076809 - DNA, 22 bp, Homo sapiens
ggactctcaggctgtcggcttc

SEQ ID NO: 7076810 - DNA, 21 bp, Homo sapiens
gctctccagggccagcccagg

SEQ ID NO: 7076811 - DNA, 21 bp, Homo sapiens
ggccctggttacgcctcctct

SEQ ID NO: 7076812 - DNA, 18 bp, Homo sapiens
ggctgcttaaggagatcc

SEQ ID NO: 7076813 - DNA, 22 bp, Homo sapiens
gtgcacagaaattggtaagact

SEQ ID NO: 7076814 - DNA, 22 bp, Homo sapiens
tagtcccggaactccttcaggt

SEQ ID NO: 7076815 - DNA, 22 bp, Homo sapiens
taggtttactgaattagtggaa

SEQ ID NO: 7076816 - DNA, 22 bp, Homo sapiens
taggctgctcaccaggctcaga

SEQ ID NO: 7076817 - DNA, 22 bp, Homo sapiens
taagtgttggtaattacaatga

SEQ ID NO: 7076818 - DNA, 18 bp, Homo sapiens
tcccttctcccttgcctc

SEQ ID NO: 7076819 - DNA, 22 bp, Homo sapiens
tccctttcactactgtgttggt

SEQ ID NO: 7076820 - DNA, 22 bp, Homo sapiens
tccctttcacttaactagccca

SEQ ID NO: 7076821 - DNA, 22 bp, Homo sapiens
tccgggagctgaacgtcttgcg

SEQ ID NO: 7076822 - DNA, 21 bp, Homo sapiens
tcccactgccacagcttcagg

SEQ ID NO: 7076823 - DNA, 22 bp, Homo sapiens
tcccactgctttgctctgctca

SEQ ID NO: 7076824 - DNA, 20 bp, Homo sapiens
tcccactgggcctcagtttc

SEQ ID NO: 7076825 - DNA, 22 bp, Homo sapiens
tcagcctctctgagtccagacc

SEQ ID NO: 7076826 - DNA, 22 bp, Homo sapiens
tttctagtaaaagctaattacc

SEQ ID NO: 7076827 - DNA, 22 bp, Homo sapiens
tttgaagacagatcaatataag

SEQ ID NO: 7076828 - DNA, 22 bp, Homo sapiens
tttacagaatgttgaatttggg

SEQ ID NO: 7076829 - DNA, 22 bp, Homo sapiens
tttagctcagttctagccccat

SEQ ID NO: 7076830 - DNA, 22 bp, Homo sapiens
tttagctcatactgctcttcca

SEQ ID NO: 7076831 - DNA, 22 bp, Homo sapiens
ttgtagaacatgcagcacaatg

SEQ ID NO: 7076832 - DNA, 22 bp, Homo sapiens
ttcccctttttgtgtgcagctg

SEQ ID NO: 7076833 - DNA, 22 bp, Homo sapiens
ttccccttataagtctggcttc

SEQ ID NO: 7076834 - DNA, 22 bp, Homo sapiens
ttctttctctactagcagagct

SEQ ID NO: 7076835 - DNA, 20 bp, Homo sapiens
aatcccttctctggactctt

SEQ ID NO: 7076836 - DNA, 22 bp, Homo sapiens
aaggctgcctctgccagaggag

SEQ ID NO: 7076837 - DNA, 22 bp, Homo sapiens
accatgttggccaagctggtct

SEQ ID NO: 7076838 - DNA, 22 bp, Homo sapiens
aaagtgttttgatttagtggta

SEQ ID NO: 7076839 - DNA, 22 bp, Homo sapiens
aaagtgtttttgagctgtagtt

SEQ ID NO: 7076840 - DNA, 22 bp, Homo sapiens
aaagtgttgggattacaggcat

SEQ ID NO: 7076841 - DNA, 22 bp, Homo sapiens
aaagccacgtggcctggggagc

SEQ ID NO: 7076842 - DNA, 22 bp, Homo sapiens
agtatttgatcagatgatagta

SEQ ID NO: 7076843 - DNA, 22 bp, Homo sapiens
actttcaagcaagaacactttg

SEQ ID NO: 7076844 - DNA, 20 bp, Homo sapiens
actttctcggtttctcacct

SEQ ID NO: 7076845 - DNA, 22 bp, Homo sapiens
acttcttcttcagctgggggat

SEQ ID NO: 7076846 - DNA, 22 bp, Homo sapiens
agggctgcccagtgtgagagct

SEQ ID NO: 7076847 - DNA, 20 bp, Homo sapiens
aggcctgagagatgactggg

SEQ ID NO: 7076848 - DNA, 22 bp, Homo sapiens
aggctctgtttgctgtggtacc

SEQ ID NO: 7076849 - DNA, 22 bp, Homo sapiens
atttcacagctgtcagtgttac

SEQ ID NO: 7076850 - DNA, 22 bp, Homo sapiens
atttcacatctatctcagattt

SEQ ID NO: 7076851 - DNA, 22 bp, Homo sapiens
caactttagaccccaagtagct

SEQ ID NO: 7076852 - DNA, 19 bp, Homo sapiens
agccagaactagtgtttct

SEQ ID NO: 7076853 - DNA, 22 bp, Homo sapiens
caggctgcgtttgtgaaaggta

SEQ ID NO: 7076854 - DNA, 22 bp, Homo sapiens
caggctgctccagggtaggaaa

SEQ ID NO: 7076855 - DNA, 22 bp, Homo sapiens
caggctgcggccgtgtgagcat

SEQ ID NO: 7076856 - DNA, 22 bp, Homo sapiens
ccctttcttccgtgacttctgc

SEQ ID NO: 7076857 - DNA, 22 bp, Homo sapiens
ccctttctgggacccctgtctc

SEQ ID NO: 7076858 - DNA, 22 bp, Homo sapiens
ccctttctccagaactgtctga

SEQ ID NO: 7076859 - DNA, 22 bp, Homo sapiens
ccctccccacaaagcttcacac

SEQ ID NO: 7076860 - DNA, 22 bp, Homo sapiens
aggttatcatcagttgagcact

SEQ ID NO: 7076861 - DNA, 22 bp, Homo sapiens
cctttagaatacagactttcta

SEQ ID NO: 7076862 - DNA, 22 bp, Homo sapiens
cctttagaattctgcccctcct

SEQ ID NO: 7076863 - DNA, 22 bp, Homo sapiens
cctttaggagtgaggaccgagc

SEQ ID NO: 7076864 - DNA, 20 bp, Homo sapiens
aggtctgattccagaatcag

SEQ ID NO: 7076865 - DNA, 22 bp, Homo sapiens
ctctgagaagagttcaagtaaa

SEQ ID NO: 7076866 - DNA, 22 bp, Homo sapiens
ctccagttggccccagttggtt

SEQ ID NO: 7076867 - DNA, 22 bp, Homo sapiens
ctcctcccacggtctcaggaag

SEQ ID NO: 7076868 - DNA, 22 bp, Homo sapiens
ataggtccaaggagaggtcttt

SEQ ID NO: 7076869 - DNA, 22 bp, Homo sapiens
agtttatgtctttacttcagct

SEQ ID NO: 7076870 - DNA, 22 bp, Homo sapiens
agttttattccaatgtgcagca

SEQ ID NO: 7076871 - DNA, 22 bp, Homo sapiens
atggctctgctgggcaaagcaa

SEQ ID NO: 7076872 - DNA, 22 bp, Homo sapiens
atgtattatggttttccttaag

SEQ ID NO: 7076873 - DNA, 22 bp, Homo sapiens
atgtatttctatgtagtgaaga

SEQ ID NO: 7076874 - DNA, 22 bp, Homo sapiens
atgtggctgccacctgcctgaa

SEQ ID NO: 7076875 - DNA, 22 bp, Homo sapiens
atgtggctcagcaggctcccgt

SEQ ID NO: 7076876 - DNA, 22 bp, Homo sapiens
atgtggctagtcctctgcggca

SEQ ID NO: 7076877 - DNA, 23 bp, Homo sapiens
ctttgccacccagagcctgacag

SEQ ID NO: 7076878 - DNA, 22 bp, Homo sapiens
atttcccactcaggccgcggcg

SEQ ID NO: 7076879 - DNA, 22 bp, Homo sapiens
atttcccagataaacagctgga

SEQ ID NO: 7076880 - DNA, 22 bp, Homo sapiens
atttcccagctttgatcagttt

SEQ ID NO: 7076881 - DNA, 22 bp, Homo sapiens
atttcccagggccctcatagtt

SEQ ID NO: 7076882 - DNA, 22 bp, Homo sapiens
atttcccagggcctgggatttg

SEQ ID NO: 7076883 - DNA, 22 bp, Homo sapiens
caatttcagtgctgtggagagg

SEQ ID NO: 7076884 - DNA, 22 bp, Homo sapiens
cagccagaacctaggatgagct

SEQ ID NO: 7076885 - DNA, 22 bp, Homo sapiens
ggggccttggatctgtgccccg

SEQ ID NO: 7076886 - DNA, 22 bp, Homo sapiens
gggtccctggaattacttgaca

SEQ ID NO: 7076887 - DNA, 22 bp, Homo sapiens
ggtagtcggccttgccctgggc

SEQ ID NO: 7076888 - DNA, 22 bp, Homo sapiens
tgccctccctgtactgtcagga

SEQ ID NO: 7076889 - DNA, 22 bp, Homo sapiens
cctcagccttggccccaggcag

SEQ ID NO: 7076890 - DNA, 22 bp, Homo sapiens
cctcactcttgtcctggcaggt

SEQ ID NO: 7076891 - DNA, 22 bp, Homo sapiens
cctcccctcagacagagactgg

SEQ ID NO: 7076892 - DNA, 22 bp, Homo sapiens
cctcccctgctcagaactctgg

SEQ ID NO: 7076893 - DNA, 22 bp, Homo sapiens
cctccctccctgcagaagccac

SEQ ID NO: 7076894 - DNA, 22 bp, Homo sapiens
cctccctctgttagagctgtct

SEQ ID NO: 7076895 - DNA, 23 bp, Homo sapiens
cctccccttcccacagctgggtg

SEQ ID NO: 7076896 - DNA, 19 bp, Homo sapiens
cctccccttggaccagcaa

SEQ ID NO: 7076897 - DNA, 22 bp, Homo sapiens
ccctttccatggctctcctagg

SEQ ID NO: 7076898 - DNA, 22 bp, Homo sapiens
ccctgccttcttggcctttaaa

SEQ ID NO: 7076899 - DNA, 22 bp, Homo sapiens
ccctgccttgtctgggctaggt

SEQ ID NO: 7076900 - DNA, 22 bp, Homo sapiens
ccctgcctacagggttttcttt

SEQ ID NO: 7076901 - DNA, 22 bp, Homo sapiens
tggaaggcaggacctgccttgg

SEQ ID NO: 7076902 - DNA, 22 bp, Homo sapiens
tggaaggcagtgatattgttga

SEQ ID NO: 7076903 - DNA, 20 bp, Homo sapiens
tggaaggcatctgcattatt

SEQ ID NO: 7076904 - DNA, 22 bp, Homo sapiens
tggaaggcttggaatacttcca

SEQ ID NO: 7076905 - DNA, 22 bp, Homo sapiens
tggaaggctttgctgtccttgc

SEQ ID NO: 7076906 - DNA, 22 bp, Homo sapiens
tggaaggcctgttgtgtcctag

SEQ ID NO: 7076907 - DNA, 22 bp, Homo sapiens
tggaaggctgtgattactgtgc

SEQ ID NO: 7076908 - DNA, 22 bp, Homo sapiens
ccctactctgccactttttctg

SEQ ID NO: 7076909 - DNA, 22 bp, Homo sapiens
tgcctcagtttcatctgcagaa

SEQ ID NO: 7076910 - DNA, 23 bp, Homo sapiens
tggctctctcagtgctgcagagg

SEQ ID NO: 7076911 - DNA, 22 bp, Homo sapiens
cctgactcctgggcaaaaccaa

SEQ ID NO: 7076912 - DNA, 23 bp, Homo sapiens
cctgaccctgtctccctcacatg

SEQ ID NO: 7076913 - DNA, 22 bp, Homo sapiens
ccacctcctaggcctggagaag

SEQ ID NO: 7076914 - DNA, 22 bp, Homo sapiens
ccacctccacctattgccagcc

SEQ ID NO: 7076915 - DNA, 22 bp, Homo sapiens
tctcctggctcaccaggctgga

SEQ ID NO: 7076916 - DNA, 22 bp, Homo sapiens
tccctcacctagtctttgactc

SEQ ID NO: 7076917 - DNA, 22 bp, Homo sapiens
catgtgtgtccatgtgactaag

SEQ ID NO: 7076918 - DNA, 22 bp, Homo sapiens
ccttttgctctcccatccagaa

SEQ ID NO: 7076919 - DNA, 22 bp, Homo sapiens
ccttcagccttcatccttcctt

SEQ ID NO: 7076920 - DNA, 18 bp, Homo sapiens
ccttcagctctgccagta

SEQ ID NO: 7076921 - DNA, 22 bp, Homo sapiens
ttagcaattccaggtaagttat

SEQ ID NO: 7076922 - DNA, 22 bp, Homo sapiens
ttggctgatgcaagagcttcct

SEQ ID NO: 7076923 - DNA, 22 bp, Homo sapiens
ttggctgaatgaggtcaccttt

SEQ ID NO: 7076924 - DNA, 22 bp, Homo sapiens
ttggctgagagctgctctgcag

SEQ ID NO: 7076925 - DNA, 22 bp, Homo sapiens
ttctttctctccacaaggcttg

SEQ ID NO: 7076926 - DNA, 22 bp, Homo sapiens
ttctttctgaatacagttgagt

SEQ ID NO: 7076927 - DNA, 22 bp, Homo sapiens
ctctgaaaatgtggtggggaaa

SEQ ID NO: 7076928 - DNA, 22 bp, Homo sapiens
ctctgaagccccaaatagtccg

SEQ ID NO: 7076929 - DNA, 19 bp, Homo sapiens
ctctgggctgcatcttggt

SEQ ID NO: 7076930 - DNA, 22 bp, Homo sapiens
ctgcccctgccaggcagctgtc

SEQ ID NO: 7076931 - DNA, 22 bp, Homo sapiens
ctgggctcagtggctcatggct

SEQ ID NO: 7076932 - DNA, 22 bp, Homo sapiens
ctgggctcaaatcctggccctg

SEQ ID NO: 7076933 - DNA, 22 bp, Homo sapiens
ctgtcccagatgttctcagcac

SEQ ID NO: 7076934 - DNA, 22 bp, Homo sapiens
ctgtcccatccttactctaccc

SEQ ID NO: 7076935 - DNA, 21 bp, Homo sapiens
ctgtggtacagctgggacgga

SEQ ID NO: 7076936 - DNA, 22 bp, Homo sapiens
ctgtggcttctaggtccccgat

SEQ ID NO: 7076937 - DNA, 22 bp, Homo sapiens
ctgtggcttctgcttgggcctc

SEQ ID NO: 7076938 - DNA, 22 bp, Homo sapiens
ctgtggcttctgggtcagttca

SEQ ID NO: 7076939 - DNA, 22 bp, Homo sapiens
ctgtggctttctctgcctcctt

SEQ ID NO: 7076940 - DNA, 22 bp, Homo sapiens
ctgtggctttgcagggcttgtt

SEQ ID NO: 7076941 - DNA, 22 bp, Homo sapiens
gaagaaggaagatcatgcttga

SEQ ID NO: 7076942 - DNA, 22 bp, Homo sapiens
ctttcctagttggtcccagcac

SEQ ID NO: 7076943 - DNA, 22 bp, Homo sapiens
ctttcctccactccctaggctt

SEQ ID NO: 7076944 - DNA, 22 bp, Homo sapiens
ctttctcagtgttaattacttt

SEQ ID NO: 7076945 - DNA, 22 bp, Homo sapiens
gaggcctgtcgctaggcctctg

SEQ ID NO: 7076946 - DNA, 22 bp, Homo sapiens
gacagcagccacagggagaggg

SEQ ID NO: 7076947 - DNA, 19 bp, Homo sapiens
gcctcatttccacctcccc

SEQ ID NO: 7076948 - DNA, 21 bp, Homo sapiens
gccacctcgtctcggagcagc

SEQ ID NO: 7076949 - DNA, 22 bp, Homo sapiens
gcacagcagctgggggccctgg

SEQ ID NO: 7076950 - DNA, 22 bp, Homo sapiens
gcacagagtcactagctaagca

SEQ ID NO: 7076951 - DNA, 22 bp, Homo sapiens
gcacagagacagtcctgagatc

SEQ ID NO: 7076952 - DNA, 22 bp, Homo sapiens
gcacagaaccctatctttcgga

SEQ ID NO: 7076953 - DNA, 22 bp, Homo sapiens
gcacagaacttctcttagtagg

SEQ ID NO: 7076954 - DNA, 22 bp, Homo sapiens
ggaaggcttgagttcccaggtc

SEQ ID NO: 7076955 - DNA, 22 bp, Homo sapiens
ggaaggctctgttccttgactt

SEQ ID NO: 7076956 - DNA, 22 bp, Homo sapiens
gctttggtcaggtgtccagccc

SEQ ID NO: 7076957 - DNA, 22 bp, Homo sapiens
gctaggctcggaagcagcaggg

SEQ ID NO: 7076958 - DNA, 22 bp, Homo sapiens
ggctctgaaggagacagctgct

SEQ ID NO: 7076959 - DNA, 22 bp, Homo sapiens
ggctctgaagggtgacaggttt

SEQ ID NO: 7076960 - DNA, 22 bp, Homo sapiens
ggctctgaattattcctgagtc

SEQ ID NO: 7076961 - DNA, 23 bp, Homo sapiens
ggctctgaggatggagctggtgg

SEQ ID NO: 7076962 - DNA, 22 bp, Homo sapiens
ggctctgcccaggtggacagca

SEQ ID NO: 7076963 - DNA, 22 bp, Homo sapiens
gtagtcccagctaccccggagg

SEQ ID NO: 7076964 - DNA, 22 bp, Homo sapiens
gtagtcccagctaccccggagg

SEQ ID NO: 7076965 - DNA, 22 bp, Homo sapiens
gtctttctatgcatagagcaga

SEQ ID NO: 7076966 - DNA, 22 bp, Homo sapiens
tagtgccctcccctttgggata

SEQ ID NO: 7076967 - DNA, 22 bp, Homo sapiens
tagttttgaggattatatgtga

SEQ ID NO: 7076968 - DNA, 22 bp, Homo sapiens
tagtttttactgcgagttataa

SEQ ID NO: 7076969 - DNA, 22 bp, Homo sapiens
tagctgacagatacaatcagat

SEQ ID NO: 7076970 - DNA, 22 bp, Homo sapiens
tattaagatacgtagttgtaaa

SEQ ID NO: 7076971 - DNA, 22 bp, Homo sapiens
tccctccccacttctgagcttt

SEQ ID NO: 7076972 - DNA, 22 bp, Homo sapiens
tcccctttgtaagatggaaacg

SEQ ID NO: 7076973 - DNA, 22 bp, Homo sapiens
tcccctttgtcttcctgtgggt

SEQ ID NO: 7076974 - DNA, 22 bp, Homo sapiens
tccctggcagctgtcctttcag

SEQ ID NO: 7076975 - DNA, 22 bp, Homo sapiens
tcagtagtcttgggccgacttg

SEQ ID NO: 7076976 - DNA, 22 bp, Homo sapiens
tcaactttgaaaccatagtgaa

SEQ ID NO: 7076977 - DNA, 22 bp, Homo sapiens
tttcacactgcagcatcagaga

SEQ ID NO: 7076978 - DNA, 22 bp, Homo sapiens
tttcacacccactaggactgtt

SEQ ID NO: 7076979 - DNA, 22 bp, Homo sapiens
tttcacacgcatctgtctgccc

SEQ ID NO: 7076980 - DNA, 22 bp, Homo sapiens
ttgtggctgtgcaccgctgcct

SEQ ID NO: 7076981 - DNA, 22 bp, Homo sapiens
ttgtggctcatcttcagctccc

SEQ ID NO: 7076982 - DNA, 22 bp, Homo sapiens
tttgatagggaagtaagaatga

SEQ ID NO: 7076983 - DNA, 22 bp, Homo sapiens
aattaagaaaatgttttatgat

SEQ ID NO: 7076984 - DNA, 22 bp, Homo sapiens
agcacagaaagcacatttgaaa

SEQ ID NO: 7076985 - DNA, 22 bp, Homo sapiens
acagcaggttttaactttgaag

SEQ ID NO: 7076986 - DNA, 22 bp, Homo sapiens
aagtgtttccattgtgcaggct

SEQ ID NO: 7076987 - DNA, 18 bp, Homo sapiens
actctttctgcccacagg

SEQ ID NO: 7076988 - DNA, 22 bp, Homo sapiens
acatcctcccgatctactggct

SEQ ID NO: 7076989 - DNA, 22 bp, Homo sapiens
acagcagggggagctgttggac

SEQ ID NO: 7076990 - DNA, 22 bp, Homo sapiens
aagagtttctgggtcaaggatt

SEQ ID NO: 7076991 - DNA, 22 bp, Homo sapiens
caattcaagttgagtacagctt

SEQ ID NO: 7076992 - DNA, 22 bp, Homo sapiens
cagcctcctgggacactcaccg

SEQ ID NO: 7076993 - DNA, 18 bp, Homo sapiens
cagcctctgattggttgc

SEQ ID NO: 7076994 - DNA, 22 bp, Homo sapiens
atacacgtgccatgttggtgtg

SEQ ID NO: 7076995 - DNA, 18 bp, Homo sapiens
accctttccaaactgcag

SEQ ID NO: 7076996 - DNA, 22 bp, Homo sapiens
accctttcttactcacacgctc

SEQ ID NO: 7076997 - DNA, 22 bp, Homo sapiens
aggctgcttcaatggataagat

SEQ ID NO: 7076998 - DNA, 22 bp, Homo sapiens
aggctgctgccttggagagtgt

SEQ ID NO: 7076999 - DNA, 22 bp, Homo sapiens
aggctgctctgcgaagtcagct

SEQ ID NO: 7077000 - DNA, 22 bp, Homo sapiens
aggctctggcaacagctggtgt

SEQ ID NO: 7077001 - DNA, 22 bp, Homo sapiens
aggctctgacgtcacacgtggc

SEQ ID NO: 7077002 - DNA, 22 bp, Homo sapiens
aggctctggagtgtggtgctgg

SEQ ID NO: 7077003 - DNA, 22 bp, Homo sapiens
acaggcctggtgctgctgacag

SEQ ID NO: 7077004 - DNA, 22 bp, Homo sapiens
aggctctgggctctagattttg

SEQ ID NO: 7077005 - DNA, 22 bp, Homo sapiens
aggctctggttcatcatgatgg

SEQ ID NO: 7077006 - DNA, 22 bp, Homo sapiens
aggctctgtatgaaggtttggg

SEQ ID NO: 7077007 - DNA, 22 bp, Homo sapiens
cccacgtcgaacttgctccaga

SEQ ID NO: 7077008 - DNA, 22 bp, Homo sapiens
cccacactcagttccccttggg

SEQ ID NO: 7077009 - DNA, 22 bp, Homo sapiens
cccctgccagctatccctgaac

SEQ ID NO: 7077010 - DNA, 22 bp, Homo sapiens
cccctgttatagaaccacctca

SEQ ID NO: 7077011 - DNA, 22 bp, Homo sapiens
cctccttctctttttgcagagc

SEQ ID NO: 7077012 - DNA, 23 bp, Homo sapiens
ccactagcacctgttcaacttct

SEQ ID NO: 7077013 - DNA, 22 bp, Homo sapiens
ccacgacgagtcatcagggcga

SEQ ID NO: 7077014 - DNA, 22 bp, Homo sapiens
aggaagagctggaccagaggac

SEQ ID NO: 7077015 - DNA, 22 bp, Homo sapiens
agtcccttgagggagtactgtt

SEQ ID NO: 7077016 - DNA, 22 bp, Homo sapiens
ctgggctcacctgtggctggca

SEQ ID NO: 7077017 - DNA, 22 bp, Homo sapiens
ctgtgtgcatagttgtgctcaa

SEQ ID NO: 7077018 - DNA, 22 bp, Homo sapiens
ctgtgtgctcggatggactcgt

SEQ ID NO: 7077019 - DNA, 22 bp, Homo sapiens
ctgtggctcaattgcctactga

SEQ ID NO: 7077020 - DNA, 22 bp, Homo sapiens
ctgtggctcaaaatcccatgat

SEQ ID NO: 7077021 - DNA, 22 bp, Homo sapiens
ctgtggctaggattattcctga

SEQ ID NO: 7077022 - DNA, 22 bp, Homo sapiens
ctgtggctatggtgtacatact

SEQ ID NO: 7077023 - DNA, 22 bp, Homo sapiens
ctgtggctcagcacggggtcag

SEQ ID NO: 7077024 - DNA, 22 bp, Homo sapiens
ctgtggctcaggcctgtaagcc

SEQ ID NO: 7077025 - DNA, 22 bp, Homo sapiens
ctgtggctttggggcggaggac

SEQ ID NO: 7077026 - DNA, 22 bp, Homo sapiens
ctgtggctttgtgtctattgta

SEQ ID NO: 7077027 - DNA, 22 bp, Homo sapiens
ctgtggcttttccggggagcct

SEQ ID NO: 7077028 - DNA, 22 bp, Homo sapiens
ctgtggctaggaagctgtggga

SEQ ID NO: 7077029 - DNA, 22 bp, Homo sapiens
ctgtggctaataattagtattt

SEQ ID NO: 7077030 - DNA, 15 bp, Homo sapiens
ctgtggctaacctaa

SEQ ID NO: 7077031 - DNA, 22 bp, Homo sapiens
cttcccactagtatcacagagc

SEQ ID NO: 7077032 - DNA, 22 bp, Homo sapiens
cttcccacagaattcaatcagt

SEQ ID NO: 7077033 - DNA, 17 bp, Homo sapiens
cttcccaccatctcctg

SEQ ID NO: 7077034 - DNA, 22 bp, Homo sapiens
agttatttaaaatgattgtcct

SEQ ID NO: 7077035 - DNA, 22 bp, Homo sapiens
atgcacagctgaacactctaaa

SEQ ID NO: 7077036 - DNA, 22 bp, Homo sapiens
atgcacaggaagtgtccccatt

SEQ ID NO: 7077037 - DNA, 22 bp, Homo sapiens
atgcacaggacagcctctactc

SEQ ID NO: 7077038 - DNA, 22 bp, Homo sapiens
atgcacagatcctggcacttag

SEQ ID NO: 7077039 - DNA, 22 bp, Homo sapiens
atgcacagcagtgagttcagtg

SEQ ID NO: 7077040 - DNA, 22 bp, Homo sapiens
atgcacagaacaattttaagag

SEQ ID NO: 7077041 - DNA, 22 bp, Homo sapiens
atgcacagtaatgagctggttg

SEQ ID NO: 7077042 - DNA, 22 bp, Homo sapiens
atgaaattcatctgagaatgct

SEQ ID NO: 7077043 - DNA, 18 bp, Homo sapiens
gctctttctgtctccagc

SEQ ID NO: 7077044 - DNA, 22 bp, Homo sapiens
atttcccaatacgctaagtgga

SEQ ID NO: 7077045 - DNA, 22 bp, Homo sapiens
atttctcagtgtgatcaggcct

SEQ ID NO: 7077046 - DNA, 22 bp, Homo sapiens
gccaacaggccttgctctgctc

SEQ ID NO: 7077047 - DNA, 22 bp, Homo sapiens
attaggtcatggggaggcccta

SEQ ID NO: 7077048 - DNA, 22 bp, Homo sapiens
gctgttctttgcatctctggtg

SEQ ID NO: 7077049 - DNA, 22 bp, Homo sapiens
cacagaggaaatgactttctta

SEQ ID NO: 7077050 - DNA, 22 bp, Homo sapiens
cacagacagtgtccctttgttg

SEQ ID NO: 7077051 - DNA, 22 bp, Homo sapiens
ggctgttgacagacataggttt

SEQ ID NO: 7077052 - DNA, 22 bp, Homo sapiens
cagaggcacagcttcttttaat

SEQ ID NO: 7077053 - DNA, 22 bp, Homo sapiens
caggctgccaaggctggggagg

SEQ ID NO: 7077054 - DNA, 22 bp, Homo sapiens
caggctgcagtgcagtggctat

SEQ ID NO: 7077055 - DNA, 22 bp, Homo sapiens
tccctcctgcatgaggctcggc

SEQ ID NO: 7077056 - DNA, 22 bp, Homo sapiens
tccctcctggtgatgatgcaaa

SEQ ID NO: 7077057 - DNA, 18 bp, Homo sapiens
tccctcctgcctgcttcc

SEQ ID NO: 7077058 - DNA, 22 bp, Homo sapiens
tccctcctggccgtcaccgctg

SEQ ID NO: 7077059 - DNA, 22 bp, Homo sapiens
cccactttggttgcactctgcc

SEQ ID NO: 7077060 - DNA, 22 bp, Homo sapiens
tgcacagaatcattttcagctg

SEQ ID NO: 7077061 - DNA, 22 bp, Homo sapiens
tgcacagacaactctttctaga

SEQ ID NO: 7077062 - DNA, 22 bp, Homo sapiens
cccttcctcccaggcttctgtg

SEQ ID NO: 7077063 - DNA, 22 bp, Homo sapiens
cccttctctttcactcactatt

SEQ ID NO: 7077064 - DNA, 22 bp, Homo sapiens
tgggctctagactttagtgtgg

SEQ ID NO: 7077065 - DNA, 22 bp, Homo sapiens
ccccttctgtgtcctgtcagcc

SEQ ID NO: 7077066 - DNA, 22 bp, Homo sapiens
cccctttctcccgcgactggcc

SEQ ID NO: 7077067 - DNA, 22 bp, Homo sapiens
cccctttctcccgcgtctggcc

SEQ ID NO: 7077068 - DNA, 22 bp, Homo sapiens
ccccttctctgcaagcctgctc

SEQ ID NO: 7077069 - DNA, 22 bp, Homo sapiens
tgcacagatctggtggcaagga

SEQ ID NO: 7077070 - DNA, 22 bp, Homo sapiens
tgcacagacatacacatatatg

SEQ ID NO: 7077071 - DNA, 22 bp, Homo sapiens
tgcacagatagtgatagatagc

SEQ ID NO: 7077072 - DNA, 22 bp, Homo sapiens
ccttccccagtgattctctcag

SEQ ID NO: 7077073 - DNA, 22 bp, Homo sapiens
ccttctcagccccagctcccgc

SEQ ID NO: 7077074 - DNA, 22 bp, Homo sapiens
ctcacagctgcttcaggatcca

SEQ ID NO: 7077075 - DNA, 22 bp, Homo sapiens
cctttctctatcgacccatcgc

SEQ ID NO: 7077076 - DNA, 18 bp, Homo sapiens
cctttcctcccctcagct

SEQ ID NO: 7077077 - DNA, 22 bp, Homo sapiens
cctttctctttgctgatcatgt

SEQ ID NO: 7077078 - DNA, 22 bp, Homo sapiens
cctttctcttggataccgattg

SEQ ID NO: 7077079 - DNA, 22 bp, Homo sapiens
ctcccctgagcatagactctgt

SEQ ID NO: 7077080 - DNA, 22 bp, Homo sapiens
ctcccctttggaagaagggtct

SEQ ID NO: 7077081 - DNA, 19 bp, Homo sapiens
ctccaagttaagagggagg

SEQ ID NO: 7077082 - DNA, 22 bp, Homo sapiens
ctcccactcctggctcaccaca

SEQ ID NO: 7077083 - DNA, 22 bp, Homo sapiens
ctctttctcgccgcccgcagtc

SEQ ID NO: 7077084 - DNA, 22 bp, Homo sapiens
ctctttctgattcgctgggacc

SEQ ID NO: 7077085 - DNA, 22 bp, Homo sapiens
ctgtggccccaccctcttggcc

SEQ ID NO: 7077086 - DNA, 22 bp, Homo sapiens
ctgtggctcatatctgtaatct

SEQ ID NO: 7077087 - DNA, 20 bp, Homo sapiens
ctgtggctcatgcatctgcc

SEQ ID NO: 7077088 - DNA, 22 bp, Homo sapiens
ctgtggctccatagaagttgca

SEQ ID NO: 7077089 - DNA, 16 bp, Homo sapiens
ctgtggctcccaggtt

SEQ ID NO: 7077090 - DNA, 22 bp, Homo sapiens
ctgtggctcattcttggtggca

SEQ ID NO: 7077091 - DNA, 22 bp, Homo sapiens
ctgtggctccagtgaaccaatg

SEQ ID NO: 7077092 - DNA, 22 bp, Homo sapiens
ctgtggctctctgcagggtccc

SEQ ID NO: 7077093 - DNA, 22 bp, Homo sapiens
ctgtggctctccaatggaggga

SEQ ID NO: 7077094 - DNA, 22 bp, Homo sapiens
ctgtggctctcagaggctgctg

SEQ ID NO: 7077095 - DNA, 22 bp, Homo sapiens
ctgtggctgcctcacctacagg

SEQ ID NO: 7077096 - DNA, 22 bp, Homo sapiens
ctgtggctgcagaccttaaaca

SEQ ID NO: 7077097 - DNA, 22 bp, Homo sapiens
ctgtggctgcagccttggtcct

SEQ ID NO: 7077098 - DNA, 22 bp, Homo sapiens
ctgtggctgcgccctgggggag

SEQ ID NO: 7077099 - DNA, 22 bp, Homo sapiens
ctgtggctgcgccatcgaaaac

SEQ ID NO: 7077100 - DNA, 22 bp, Homo sapiens
ctgtggctgcgtaggtctggca

SEQ ID NO: 7077101 - DNA, 22 bp, Homo sapiens
ctgtggctctgcagtcccaaca

SEQ ID NO: 7077102 - DNA, 22 bp, Homo sapiens
ctgtggctctttagttgagcac

SEQ ID NO: 7077103 - DNA, 22 bp, Homo sapiens
ctgtggctgaactctgaagagg

SEQ ID NO: 7077104 - DNA, 19 bp, Homo sapiens
ctgtggctgacctctggcc

SEQ ID NO: 7077105 - DNA, 23 bp, Homo sapiens
ctgtggctgagtcctgttggagt

SEQ ID NO: 7077106 - DNA, 22 bp, Homo sapiens
ctgtggctgagttccttatgtt

SEQ ID NO: 7077107 - DNA, 22 bp, Homo sapiens
ctgtggctgtctctttcccatg

SEQ ID NO: 7077108 - DNA, 22 bp, Homo sapiens
ctgtggctgtgaaacttctcag

SEQ ID NO: 7077109 - DNA, 22 bp, Homo sapiens
ctgtggcttcagcattcagagc

SEQ ID NO: 7077110 - DNA, 22 bp, Homo sapiens
ctgtggctgtatttggccagag

SEQ ID NO: 7077111 - DNA, 22 bp, Homo sapiens
ctgtggctggctcatcataggt

SEQ ID NO: 7077112 - DNA, 22 bp, Homo sapiens
ctgtggctggcctgtctgacat

SEQ ID NO: 7077113 - DNA, 22 bp, Homo sapiens
ctgtggctggaataataaatgt

SEQ ID NO: 7077114 - DNA, 22 bp, Homo sapiens
ctgtggctggccttattgctgc

SEQ ID NO: 7077115 - DNA, 17 bp, Homo sapiens
ctgttccccactactca

SEQ ID NO: 7077116 - DNA, 22 bp, Homo sapiens
ctgttggcctttcatcagtaat

SEQ ID NO: 7077117 - DNA, 22 bp, Homo sapiens
cttcagcccagcctccgcctcc

SEQ ID NO: 7077118 - DNA, 22 bp, Homo sapiens
cttcagcctcaactactatggt

SEQ ID NO: 7077119 - DNA, 22 bp, Homo sapiens
cttcagccctgagtgccagcag

SEQ ID NO: 7077120 - DNA, 22 bp, Homo sapiens
cttcagcctcatctcagcccgt

SEQ ID NO: 7077121 - DNA, 22 bp, Homo sapiens
cttcagcctcgttactcctgcg

SEQ ID NO: 7077122 - DNA, 22 bp, Homo sapiens
ctggctcttcagtgcttggttc

SEQ ID NO: 7077123 - DNA, 22 bp, Homo sapiens
gagccagaaaagctgcctgact

SEQ ID NO: 7077124 - DNA, 22 bp, Homo sapiens
gaagaggcaattgaataagcta

SEQ ID NO: 7077125 - DNA, 22 bp, Homo sapiens
ctttcacataattgaccttgaa

SEQ ID NO: 7077126 - DNA, 22 bp, Homo sapiens
ctttcacagcacaagcctgcct

SEQ ID NO: 7077127 - DNA, 22 bp, Homo sapiens
ctttcacagctactcacctctg

SEQ ID NO: 7077128 - DNA, 22 bp, Homo sapiens
gccctggccttcatctcagaca

SEQ ID NO: 7077129 - DNA, 18 bp, Homo sapiens
gcccatggtaaatgctgt

SEQ ID NO: 7077130 - DNA, 22 bp, Homo sapiens
gcaaagcattctgtggagtcta

SEQ ID NO: 7077131 - DNA, 22 bp, Homo sapiens
gctgctgttcctccagtggatc

SEQ ID NO: 7077132 - DNA, 22 bp, Homo sapiens
gctgtggctttctgtttctgtt

SEQ ID NO: 7077133 - DNA, 17 bp, Homo sapiens
ggacacagctcatggct

SEQ ID NO: 7077134 - DNA, 22 bp, Homo sapiens
gctttggaaatatagactcaag

SEQ ID NO: 7077135 - DNA, 22 bp, Homo sapiens
ggctcttctggttgtcacattt

SEQ ID NO: 7077136 - DNA, 22 bp, Homo sapiens
ggctcttctgtttcacaggcca

SEQ ID NO: 7077137 - DNA, 23 bp, Homo sapiens
gtgcacagtcaagcccagcttag

SEQ ID NO: 7077138 - DNA, 22 bp, Homo sapiens
tatttaatttgctcattgtgat

SEQ ID NO: 7077139 - DNA, 22 bp, Homo sapiens
tatccaattcaccattgatggg

SEQ ID NO: 7077140 - DNA, 21 bp, Homo sapiens
tagcccttctccacctcgccc

SEQ ID NO: 7077141 - DNA, 22 bp, Homo sapiens
tagcccctgcctttgaacctgg

SEQ ID NO: 7077142 - DNA, 22 bp, Homo sapiens
gttggtgagtttctgatcacaa

SEQ ID NO: 7077143 - DNA, 22 bp, Homo sapiens
gttggtgatgccacacatattt

SEQ ID NO: 7077144 - DNA, 22 bp, Homo sapiens
gtgtggctagaagtgtcttgtt

SEQ ID NO: 7077145 - DNA, 22 bp, Homo sapiens
tcccctcctctcctgatatggg

SEQ ID NO: 7077146 - DNA, 22 bp, Homo sapiens
tgtggtggtaatgagccagatg

SEQ ID NO: 7077147 - DNA, 22 bp, Homo sapiens
tgtgtgaggtggttctgagaag

SEQ ID NO: 7077148 - DNA, 22 bp, Homo sapiens
tgtgtgagtaaggctgagagag

SEQ ID NO: 7077149 - DNA, 19 bp, Homo sapiens
ttccacacagctctcgggc

SEQ ID NO: 7077150 - DNA, 22 bp, Homo sapiens
ttgaagattctttttgttagta

SEQ ID NO: 7077151 - DNA, 22 bp, Homo sapiens
ttttctagggtgctaaatgaac

SEQ ID NO: 7077152 - DNA, 21 bp, Homo sapiens
tttctcataaaatactcatta

SEQ ID NO: 7077153 - DNA, 19 bp, Homo sapiens
tttctctgtgcaccttttc

SEQ ID NO: 7077154 - DNA, 21 bp, Homo sapiens
tttcttcactttgccccatgt

SEQ ID NO: 7077155 - DNA, 22 bp, Homo sapiens
tttcttcattcaccttcacccc

SEQ ID NO: 7077156 - DNA, 22 bp, Homo sapiens
tttagttattgttacagtatga

SEQ ID NO: 7077157 - DNA, 22 bp, Homo sapiens
ttgttagtgcaatgtttggtga

SEQ ID NO: 7077158 - DNA, 22 bp, Homo sapiens
cagagggtgtgaaggggatgaa

SEQ ID NO: 7077159 - DNA, 22 bp, Homo sapiens
cagagggttgatgtgaggctta

SEQ ID NO: 7077160 - DNA, 22 bp, Homo sapiens
ggcttagcaactcctgaggctc

SEQ ID NO: 7077161 - DNA, 22 bp, Homo sapiens
gggcagcagcaggaggtctctg

SEQ ID NO: 7077162 - DNA, 22 bp, Homo sapiens
gtccctggggaatcagctggag

SEQ ID NO: 7077163 - DNA, 22 bp, Homo sapiens
ggctgtagtcagtgacatggta

SEQ ID NO: 7077164 - DNA, 22 bp, Homo sapiens
ggcaggtgccttctgtgctagc

SEQ ID NO: 7077165 - DNA, 22 bp, Homo sapiens
ggcaggtgcccagagagcacga

SEQ ID NO: 7077166 - DNA, 22 bp, Homo sapiens
ggaagggcctcgggcgtgggac

SEQ ID NO: 7077167 - DNA, 20 bp, Homo sapiens
ggaaggggcaaagtgtgtga

SEQ ID NO: 7077168 - DNA, 21 bp, Homo sapiens
ggaagggctctgaggacggct

SEQ ID NO: 7077169 - DNA, 22 bp, Homo sapiens
ggagctggaatatattgaaacc

SEQ ID NO: 7077170 - DNA, 21 bp, Homo sapiens
gctggctgtcccagggaagca

SEQ ID NO: 7077171 - DNA, 22 bp, Homo sapiens
ctttccccaagcaccacagtgc

SEQ ID NO: 7077172 - DNA, 22 bp, Homo sapiens
atgtgagctccggcaggtggaa

SEQ ID NO: 7077173 - DNA, 22 bp, Homo sapiens
atggggagagaagggctgagct

SEQ ID NO: 7077174 - DNA, 21 bp, Homo sapiens
atggtgagatactgggtgtgg

SEQ ID NO: 7077175 - DNA, 22 bp, Homo sapiens
ctgagctgggactcagtagcaa

SEQ ID NO: 7077176 - DNA, 22 bp, Homo sapiens
ctgagcagcacagggcgccagg

SEQ ID NO: 7077177 - DNA, 22 bp, Homo sapiens
ctgagcagcaacccagagcctc

SEQ ID NO: 7077178 - DNA, 22 bp, Homo sapiens
ctgagcagatgttgcccagaag

SEQ ID NO: 7077179 - DNA, 22 bp, Homo sapiens
aggtagtaaagttcttgatcct

SEQ ID NO: 7077180 - DNA, 20 bp, Homo sapiens
aggtaggatcggtgtcataa

SEQ ID NO: 7077181 - DNA, 22 bp, Homo sapiens
ctaggtgatccactgctctctt

SEQ ID NO: 7077182 - DNA, 23 bp, Homo sapiens
aggaagaggcaatttctcttaga

SEQ ID NO: 7077183 - DNA, 22 bp, Homo sapiens
aggacagagcctgtgcagaccg

SEQ ID NO: 7077184 - DNA, 20 bp, Homo sapiens
aggaagtgatgttttatctg

SEQ ID NO: 7077185 - DNA, 22 bp, Homo sapiens
caggtggttgagagctgtaggc

SEQ ID NO: 7077186 - DNA, 22 bp, Homo sapiens
caggagtgaaatgaggcccagg

SEQ ID NO: 7077187 - DNA, 22 bp, Homo sapiens
aggagctgtcagagtgccagag

SEQ ID NO: 7077188 - DNA, 22 bp, Homo sapiens
aggatgagagatacatggagca

SEQ ID NO: 7077189 - DNA, 22 bp, Homo sapiens
catgaggatccaggtgacaggc

SEQ ID NO: 7077190 - DNA, 22 bp, Homo sapiens
catgagggttggggtggagctt

SEQ ID NO: 7077191 - DNA, 22 bp, Homo sapiens
aggggctctgagtgggccagga

SEQ ID NO: 7077192 - DNA, 22 bp, Homo sapiens
agggggagacatgtgtgtgttt

SEQ ID NO: 7077193 - DNA, 22 bp, Homo sapiens
agggggagcttggctactcctg

SEQ ID NO: 7077194 - DNA, 22 bp, Homo sapiens
cctctgtgtgtgcatgcatgcg

SEQ ID NO: 7077195 - DNA, 22 bp, Homo sapiens
cccctgctggcctgctggtttc

SEQ ID NO: 7077196 - DNA, 22 bp, Homo sapiens
cccctgctggtcgaaacaattt

SEQ ID NO: 7077197 - DNA, 22 bp, Homo sapiens
cccagtacctctgttccctgct

SEQ ID NO: 7077198 - DNA, 22 bp, Homo sapiens
ccagtgggtaggccatggtgag

SEQ ID NO: 7077199 - DNA, 22 bp, Homo sapiens
ccaggaggtctgagtgtggaca

SEQ ID NO: 7077200 - DNA, 22 bp, Homo sapiens
ccaggagggtggttactcaatc

SEQ ID NO: 7077201 - DNA, 22 bp, Homo sapiens
ccaggaggtggaggttgcggtg

SEQ ID NO: 7077202 - DNA, 22 bp, Homo sapiens
aggcagaagccagccagggtcc

SEQ ID NO: 7077203 - DNA, 21 bp, Homo sapiens
aggcagaaagagcccaggctg

SEQ ID NO: 7077204 - DNA, 20 bp, Homo sapiens
aggaggcatgaggggattta

SEQ ID NO: 7077205 - DNA, 22 bp, Homo sapiens
aggctctccagagagctgcttt

SEQ ID NO: 7077206 - DNA, 20 bp, Homo sapiens
aggggtgatcgggtgacact

SEQ ID NO: 7077207 - DNA, 22 bp, Homo sapiens
agggcctgtcagcggtgtcctg

SEQ ID NO: 7077208 - DNA, 22 bp, Homo sapiens
agtgggggccaacgagggcagc

SEQ ID NO: 7077209 - DNA, 22 bp, Homo sapiens
agtgaggcaaagtgagaggcag

SEQ ID NO: 7077210 - DNA, 20 bp, Homo sapiens
agtgaggcagttcagtgggc

SEQ ID NO: 7077211 - DNA, 22 bp, Homo sapiens
agtgaatgtccccgcgggtcag

SEQ ID NO: 7077212 - DNA, 22 bp, Homo sapiens
agggtgagggtctggccttgag

SEQ ID NO: 7077213 - DNA, 17 bp, Homo sapiens
agctgagctggccaggg

SEQ ID NO: 7077214 - DNA, 22 bp, Homo sapiens
agaggccctgggctggtgtgct

SEQ ID NO: 7077215 - DNA, 21 bp, Homo sapiens
agaggaagaagagtgtattat

SEQ ID NO: 7077216 - DNA, 22 bp, Homo sapiens
attggtggtgaggacatgccag

SEQ ID NO: 7077217 - DNA, 22 bp, Homo sapiens
agatgatgttggagtctgtgct

SEQ ID NO: 7077218 - DNA, 22 bp, Homo sapiens
aaggaagggaaatagtgatgtc

SEQ ID NO: 7077219 - DNA, 22 bp, Homo sapiens
aaggaagttttcttggttccta

SEQ ID NO: 7077220 - DNA, 22 bp, Homo sapiens
agccagaggaacttgatgactg

SEQ ID NO: 7077221 - DNA, 22 bp, Homo sapiens
agccagagattgagatgcaggc

SEQ ID NO: 7077222 - DNA, 19 bp, Homo sapiens
agccagagtggcccagggg

SEQ ID NO: 7077223 - DNA, 22 bp, Homo sapiens
agcacaggaccaaggaagctgt

SEQ ID NO: 7077224 - DNA, 22 bp, Homo sapiens
agcacaggaacatggagatggg

SEQ ID NO: 7077225 - DNA, 22 bp, Homo sapiens
agcacaggctttggtgtgaggg

SEQ ID NO: 7077226 - DNA, 22 bp, Homo sapiens
agcacagggcccagcctaggcc

SEQ ID NO: 7077227 - DNA, 22 bp, Homo sapiens
agagtgggttataggcagactt

SEQ ID NO: 7077228 - DNA, 22 bp, Homo sapiens
agatgccagcttacactgggaa

SEQ ID NO: 7077229 - DNA, 22 bp, Homo sapiens
agatgccaggttgggaagtgat

SEQ ID NO: 7077230 - DNA, 22 bp, Homo sapiens
agagctggaagctgctcttaga

SEQ ID NO: 7077231 - DNA, 21 bp, Homo sapiens
agaggaagtgattggtctggc

SEQ ID NO: 7077232 - DNA, 22 bp, Homo sapiens
gtgtggctacctcagaggagca

SEQ ID NO: 7077233 - DNA, 22 bp, Homo sapiens
gtgtgggaaggctaggatgctg

SEQ ID NO: 7077234 - DNA, 22 bp, Homo sapiens
gtgtggcttgggtgaggcgcct

SEQ ID NO: 7077235 - DNA, 22 bp, Homo sapiens
gttgccctggctctgcccagct

SEQ ID NO: 7077236 - DNA, 22 bp, Homo sapiens
gttgagtgggttaggatgctga

SEQ ID NO: 7077237 - DNA, 21 bp, Homo sapiens
taggatgaaagtgagtgagaa

SEQ ID NO: 7077238 - DNA, 22 bp, Homo sapiens
tccccaggggcatctctctgct

SEQ ID NO: 7077239 - DNA, 22 bp, Homo sapiens
tccccaagcaggcaatctcccg

SEQ ID NO: 7077240 - DNA, 22 bp, Homo sapiens
tccccaagtaaagatcctgaga

SEQ ID NO: 7077241 - DNA, 19 bp, Homo sapiens
tccccaagagttctagctc

SEQ ID NO: 7077242 - DNA, 22 bp, Homo sapiens
tcactctgatagataagctaac

SEQ ID NO: 7077243 - DNA, 22 bp, Homo sapiens
gtgagcagggcaggactgggga

SEQ ID NO: 7077244 - DNA, 22 bp, Homo sapiens
gtgagcagcctcacctgagggt

SEQ ID NO: 7077245 - DNA, 22 bp, Homo sapiens
gtccccaaaattacaagacaca

SEQ ID NO: 7077246 - DNA, 22 bp, Homo sapiens
gtccccagagctggtggtggtt

SEQ ID NO: 7077247 - DNA, 22 bp, Homo sapiens
gtccccagctaatctctttgcc

SEQ ID NO: 7077248 - DNA, 22 bp, Homo sapiens
gtcccctgctggtgttgctgct

SEQ ID NO: 7077249 - DNA, 22 bp, Homo sapiens
gtcccctggcccccagcgtcgg

SEQ ID NO: 7077250 - DNA, 22 bp, Homo sapiens
gtcctgggagatgggaccctga

SEQ ID NO: 7077251 - DNA, 22 bp, Homo sapiens
ggtgtggatcatctgaggtcag

SEQ ID NO: 7077252 - DNA, 22 bp, Homo sapiens
ggtcagaaggcctcggcaggaa

SEQ ID NO: 7077253 - DNA, 22 bp, Homo sapiens
gggtggagcttggacaccagta

SEQ ID NO: 7077254 - DNA, 22 bp, Homo sapiens
gggtggaggagaacaggcccca

SEQ ID NO: 7077255 - DNA, 22 bp, Homo sapiens
ggggaaggattgagttgaccca

SEQ ID NO: 7077256 - DNA, 22 bp, Homo sapiens
ggggctcagttcggacagcctg

SEQ ID NO: 7077257 - DNA, 22 bp, Homo sapiens
gggctgagagctggaatctgag

SEQ ID NO: 7077258 - DNA, 22 bp, Homo sapiens
gggcttggctcataagtggatg

SEQ ID NO: 7077259 - DNA, 22 bp, Homo sapiens
gggctgaggctaccactggtct

SEQ ID NO: 7077260 - DNA, 22 bp, Homo sapiens
ggctgaagaactgggagtctca

SEQ ID NO: 7077261 - DNA, 22 bp, Homo sapiens
ggctgaagtgtagtggctcact

SEQ ID NO: 7077262 - DNA, 22 bp, Homo sapiens
ggcggaggttgcagtaagccga

SEQ ID NO: 7077263 - DNA, 22 bp, Homo sapiens
gggcaaagtggtggaggcagtt

SEQ ID NO: 7077264 - DNA, 22 bp, Homo sapiens
gggaggagctgagtgtgtgtgc

SEQ ID NO: 7077265 - DNA, 22 bp, Homo sapiens
ggcacaggaatctgtgaagtgc

SEQ ID NO: 7077266 - DNA, 22 bp, Homo sapiens
ggcagaggaggggtgaatttgc

SEQ ID NO: 7077267 - DNA, 20 bp, Homo sapiens
ggcagagggcctgggagaag

SEQ ID NO: 7077268 - DNA, 22 bp, Homo sapiens
ggagtgagtactggagtagctg

SEQ ID NO: 7077269 - DNA, 22 bp, Homo sapiens
ggcagtgaatgaaacagaggct

SEQ ID NO: 7077270 - DNA, 21 bp, Homo sapiens
ggcaggtgggtctctgttgct

SEQ ID NO: 7077271 - DNA, 22 bp, Homo sapiens
ggaagaggctgaggccatgctg

SEQ ID NO: 7077272 - DNA, 22 bp, Homo sapiens
ggagcagggcagtgaattctgg

SEQ ID NO: 7077273 - DNA, 22 bp, Homo sapiens
ggagcaggctctgtggtttcca

SEQ ID NO: 7077274 - DNA, 22 bp, Homo sapiens
gctgtgtgaccctagccagtag

SEQ ID NO: 7077275 - DNA, 19 bp, Homo sapiens
gctggctggaggagggaca

SEQ ID NO: 7077276 - DNA, 22 bp, Homo sapiens
gctggctggagtaaggagggag

SEQ ID NO: 7077277 - DNA, 22 bp, Homo sapiens
gctgctcctgagtcccgcgcgc

SEQ ID NO: 7077278 - DNA, 22 bp, Homo sapiens
gctgcgccggatcccacgttcc

SEQ ID NO: 7077279 - DNA, 22 bp, Homo sapiens
gcgtggggcagcccagggcttc

SEQ ID NO: 7077280 - DNA, 22 bp, Homo sapiens
gcacaggtcaggagatgagatt

SEQ ID NO: 7077281 - DNA, 22 bp, Homo sapiens
gcacaggttgtacttgggcacc

SEQ ID NO: 7077282 - DNA, 22 bp, Homo sapiens
gccaggtatagactccagttct

SEQ ID NO: 7077283 - DNA, 22 bp, Homo sapiens
gccctgtggacagtgagaagtg

SEQ ID NO: 7077284 - DNA, 22 bp, Homo sapiens
gccccagacataagtagggggt

SEQ ID NO: 7077285 - DNA, 22 bp, Homo sapiens
gccaccagtagctaacaacagt

SEQ ID NO: 7077286 - DNA, 22 bp, Homo sapiens
gcagtgggagcttaggcagtgc

SEQ ID NO: 7077287 - DNA, 22 bp, Homo sapiens
gaagccagtgtttgaagaattt

SEQ ID NO: 7077288 - DNA, 22 bp, Homo sapiens
gaagccagcagtggagaaagga

SEQ ID NO: 7077289 - DNA, 22 bp, Homo sapiens
gacagggtacgggctaggcaca

SEQ ID NO: 7077290 - DNA, 22 bp, Homo sapiens
gacagggtttgcaaggacttcg

SEQ ID NO: 7077291 - DNA, 22 bp, Homo sapiens
gaaggaagattctgttggaatc

SEQ ID NO: 7077292 - DNA, 22 bp, Homo sapiens
gagaagggggctcgagtgtcct

SEQ ID NO: 7077293 - DNA, 22 bp, Homo sapiens
gaggccagcccctcttgaaggc

SEQ ID NO: 7077294 - DNA, 22 bp, Homo sapiens
gagctaggttttccagtcgcat

SEQ ID NO: 7077295 - DNA, 22 bp, Homo sapiens
ctggctcttcagtgcttggttc

SEQ ID NO: 7077296 - DNA, 22 bp, Homo sapiens
ctggggctgcggtggaggagcc

SEQ ID NO: 7077297 - DNA, 22 bp, Homo sapiens
ctggggctcactttggtcaggc

SEQ ID NO: 7077298 - DNA, 23 bp, Homo sapiens
ctggggctcattgcagtagccat

SEQ ID NO: 7077299 - DNA, 22 bp, Homo sapiens
ctgttggcctggtgatgaagct

SEQ ID NO: 7077300 - DNA, 23 bp, Homo sapiens
ctgttggctgtcagggctggact

SEQ ID NO: 7077301 - DNA, 22 bp, Homo sapiens
ctgttggcttcagtgcagagaa

SEQ ID NO: 7077302 - DNA, 22 bp, Homo sapiens
ctgtgcccagctccctgactgc

SEQ ID NO: 7077303 - DNA, 22 bp, Homo sapiens
ctgtgcccacctggctctgagg

SEQ ID NO: 7077304 - DNA, 22 bp, Homo sapiens
ctgagccctcctgcttgctgag

SEQ ID NO: 7077305 - DNA, 22 bp, Homo sapiens
ctgagcccaggcgggagctgag

SEQ ID NO: 7077306 - DNA, 22 bp, Homo sapiens
ctcccaagataaataaggcagt

SEQ ID NO: 7077307 - DNA, 22 bp, Homo sapiens
ctcccagagaccaagctgagaa

SEQ ID NO: 7077308 - DNA, 22 bp, Homo sapiens
cgggggagttgaggcacatggg

SEQ ID NO: 7077309 - DNA, 22 bp, Homo sapiens
tgggggaaattcagccagatat

SEQ ID NO: 7077310 - DNA, 21 bp, Homo sapiens
tgggggagaattggttgcttt

SEQ ID NO: 7077311 - DNA, 22 bp, Homo sapiens
tgggcccatcattgctgtgggc

SEQ ID NO: 7077312 - DNA, 22 bp, Homo sapiens
tgggcccaagtgcaatgcagtg

SEQ ID NO: 7077313 - DNA, 18 bp, Homo sapiens
tggagcaggtaggcatga

SEQ ID NO: 7077314 - DNA, 22 bp, Homo sapiens
tgaggggaactgatgcccattg

SEQ ID NO: 7077315 - DNA, 20 bp, Homo sapiens
ccagtccctgagcaccaggg

SEQ ID NO: 7077316 - DNA, 22 bp, Homo sapiens
tgagaaggtgaaagtgtggaga

SEQ ID NO: 7077317 - DNA, 22 bp, Homo sapiens
tctttggccttaggagcccttg

SEQ ID NO: 7077318 - DNA, 22 bp, Homo sapiens
tctttggctgcctgaagcccaa

SEQ ID NO: 7077319 - DNA, 22 bp, Homo sapiens
ccaggagggaggagttcctgag

SEQ ID NO: 7077320 - DNA, 22 bp, Homo sapiens
ccaggaggttgaggctgcagtg

SEQ ID NO: 7077321 - DNA, 22 bp, Homo sapiens
ccaggagggaccgcggcatccc

SEQ ID NO: 7077322 - DNA, 22 bp, Homo sapiens
cagggggctcaaaggagagtgc

SEQ ID NO: 7077323 - DNA, 22 bp, Homo sapiens
caggtaggccaatgttttccaa

SEQ ID NO: 7077324 - DNA, 22 bp, Homo sapiens
tttctcttaatgtctctgtgct

SEQ ID NO: 7077325 - DNA, 22 bp, Homo sapiens
tttccttccaaatgcccgggag

SEQ ID NO: 7077326 - DNA, 22 bp, Homo sapiens
tttcctctttgtaccttgacta

SEQ ID NO: 7077327 - DNA, 22 bp, Homo sapiens
tttcctctgtcatgacagctga

SEQ ID NO: 7077328 - DNA, 22 bp, Homo sapiens
tttcctcttccgagggggaggc

SEQ ID NO: 7077329 - DNA, 22 bp, Homo sapiens
tttcctcttcgattaagtttgg

SEQ ID NO: 7077330 - DNA, 19 bp, Homo sapiens
ttttccttctcctcttaat

SEQ ID NO: 7077331 - DNA, 20 bp, Homo sapiens
ttttccttgttgccgctgct

SEQ ID NO: 7077332 - DNA, 22 bp, Homo sapiens
ttttcctttgattcccagatgt

SEQ ID NO: 7077333 - DNA, 22 bp, Homo sapiens
ttttcctttggaagatgcatat

SEQ ID NO: 7077334 - DNA, 22 bp, Homo sapiens
ttgagcccaggaggcctgggtg

SEQ ID NO: 7077335 - DNA, 20 bp, Homo sapiens
ttgagcagcagtgctgtgtc

SEQ ID NO: 7077336 - DNA, 22 bp, Homo sapiens
ttgatcttttcttgctgcccca

SEQ ID NO: 7077337 - DNA, 22 bp, Homo sapiens
ttccttctgaagcctttgtgtt

SEQ ID NO: 7077338 - DNA, 18 bp, Homo sapiens
ttccttctgatgtatatg

SEQ ID NO: 7077339 - DNA, 22 bp, Homo sapiens
ttccttctccagaacttctagg

SEQ ID NO: 7077340 - DNA, 22 bp, Homo sapiens
tgtgtgagtaaggctgagagag

SEQ ID NO: 7077341 - DNA, 22 bp, Homo sapiens
tgtgtgaggattcctggttctt

SEQ ID NO: 7077342 - DNA, 22 bp, Homo sapiens
tgtgtgaggtggttctgagaag

SEQ ID NO: 7077343 - DNA, 22 bp, Homo sapiens
tgtggggaggctgcagtgctgc

SEQ ID NO: 7077344 - DNA, 22 bp, Homo sapiens
tcccccagtctgggcgtggtca

SEQ ID NO: 7077345 - DNA, 17 bp, Homo sapiens
tcccccagggctctctc

SEQ ID NO: 7077346 - DNA, 22 bp, Homo sapiens
tcccccaggctggagtgcagtg

SEQ ID NO: 7077347 - DNA, 22 bp, Homo sapiens
tcccccaactcttagcactgta

SEQ ID NO: 7077348 - DNA, 22 bp, Homo sapiens
tccccatgaggctgaattgggc

SEQ ID NO: 7077349 - DNA, 21 bp, Homo sapiens
tccccagtgccctctctaaga

SEQ ID NO: 7077350 - DNA, 22 bp, Homo sapiens
tgtgttgtgacattcttggatg

SEQ ID NO: 7077351 - DNA, 17 bp, Homo sapiens
ttaaggtggatcagcac

SEQ ID NO: 7077352 - DNA, 22 bp, Homo sapiens
gggtacagccgttggttgccgg

SEQ ID NO: 7077353 - DNA, 22 bp, Homo sapiens
ggggcagatggaacagagcaca

SEQ ID NO: 7077354 - DNA, 22 bp, Homo sapiens
gggctgtaggagctggaatggg

SEQ ID NO: 7077355 - DNA, 22 bp, Homo sapiens
gggatgagagtagggtgtgaaa

SEQ ID NO: 7077356 - DNA, 22 bp, Homo sapiens
gggatgagagctgggacagaag

SEQ ID NO: 7077357 - DNA, 22 bp, Homo sapiens
ggctggcacagagggctggtgt

SEQ ID NO: 7077358 - DNA, 22 bp, Homo sapiens
cagccagaacctaggatgagct

SEQ ID NO: 7077359 - DNA, 23 bp, Homo sapiens
gtgagcagcaccatgaggctaga

SEQ ID NO: 7077360 - DNA, 22 bp, Homo sapiens
ggaagcggccctgagcgcaggg

SEQ ID NO: 7077361 - DNA, 22 bp, Homo sapiens
cacaggtgctcctcggggagct

SEQ ID NO: 7077362 - DNA, 22 bp, Homo sapiens
gcccagtgccctagaatgcact

SEQ ID NO: 7077363 - DNA, 22 bp, Homo sapiens
gcccagtagttcaaggttgcag

SEQ ID NO: 7077364 - DNA, 22 bp, Homo sapiens
gctccccaaaagctccaggaaa

SEQ ID NO: 7077365 - DNA, 22 bp, Homo sapiens
gctcccagggacactggccact

SEQ ID NO: 7077366 - DNA, 22 bp, Homo sapiens
gcaccaggcagctgagcaggcc

SEQ ID NO: 7077367 - DNA, 22 bp, Homo sapiens
gagtggggaaagccaggacaga

SEQ ID NO: 7077368 - DNA, 23 bp, Homo sapiens
gagtggggagaaattggttaaac

SEQ ID NO: 7077369 - DNA, 22 bp, Homo sapiens
gagtggggcccactgctgggtg

SEQ ID NO: 7077370 - DNA, 22 bp, Homo sapiens
gatgtgagtggtagctgggatt

SEQ ID NO: 7077371 - DNA, 22 bp, Homo sapiens
atgatggatgtcacagtctgta

SEQ ID NO: 7077372 - DNA, 22 bp, Homo sapiens
atgccactgcacttcagcctgg

SEQ ID NO: 7077373 - DNA, 22 bp, Homo sapiens
atgcctggactgtatcccagat

SEQ ID NO: 7077374 - DNA, 22 bp, Homo sapiens
gagtgcagtatgagaggctgct

SEQ ID NO: 7077375 - DNA, 22 bp, Homo sapiens
gaggttggagggctggcctgca

SEQ ID NO: 7077376 - DNA, 22 bp, Homo sapiens
gaggttggcgccctgcctggcc

SEQ ID NO: 7077377 - DNA, 22 bp, Homo sapiens
atgtggcacagcacagtaagag

SEQ ID NO: 7077378 - DNA, 22 bp, Homo sapiens
gagcacaggctttggtggacac

SEQ ID NO: 7077379 - DNA, 22 bp, Homo sapiens
atgctgggaagacaaggtggag

SEQ ID NO: 7077380 - DNA, 22 bp, Homo sapiens
atgctgggaagtcctaaccaca

SEQ ID NO: 7077381 - DNA, 22 bp, Homo sapiens
atgctggggcctcagaccagaa

SEQ ID NO: 7077382 - DNA, 22 bp, Homo sapiens
gagaaggggtgatgtgggtaat

SEQ ID NO: 7077383 - DNA, 22 bp, Homo sapiens
ctgagtggaacataggatgata

SEQ ID NO: 7077384 - DNA, 22 bp, Homo sapiens
ctggtggcaatgaggcgtcact

SEQ ID NO: 7077385 - DNA, 22 bp, Homo sapiens
ctggtggcatcttgagacggtt

SEQ ID NO: 7077386 - DNA, 22 bp, Homo sapiens
ctggtggcatcttgagatggtt

SEQ ID NO: 7077387 - DNA, 21 bp, Homo sapiens
agtgggatactggaaggtaga

SEQ ID NO: 7077388 - DNA, 22 bp, Homo sapiens
agtggggacaatgagagcaggt

SEQ ID NO: 7077389 - DNA, 20 bp, Homo sapiens
agtggggagtcaggagtgcc

SEQ ID NO: 7077390 - DNA, 22 bp, Homo sapiens
cctggtgaatgttcatggactg

SEQ ID NO: 7077391 - DNA, 22 bp, Homo sapiens
ccgaggaagggacagggctctg

SEQ ID NO: 7077392 - DNA, 22 bp, Homo sapiens
agggccctctggcaggccaggc

SEQ ID NO: 7077393 - DNA, 23 bp, Homo sapiens
agggctgatgccattgcagctct

SEQ ID NO: 7077394 - DNA, 22 bp, Homo sapiens
ccagggtgctctgtggcgtcgc

SEQ ID NO: 7077395 - DNA, 22 bp, Homo sapiens
ccagggtcttggagaggagtgc

SEQ ID NO: 7077396 - DNA, 22 bp, Homo sapiens
ccaggaggaaattctaaaggta

SEQ ID NO: 7077397 - DNA, 22 bp, Homo sapiens
ccagggaaggctgctggctgtg

SEQ ID NO: 7077398 - DNA, 22 bp, Homo sapiens
ccagggtggaggctggatggag

SEQ ID NO: 7077399 - DNA, 22 bp, Homo sapiens
ccagagagtatcatggagagta

SEQ ID NO: 7077400 - DNA, 22 bp, Homo sapiens
ccagagtgacgtgaagtgtgaa

SEQ ID NO: 7077401 - DNA, 22 bp, Homo sapiens
caggtgagaggcggtcctgcat

SEQ ID NO: 7077402 - DNA, 22 bp, Homo sapiens
caggtgagttttcctccttggt

SEQ ID NO: 7077403 - DNA, 22 bp, Homo sapiens
caggtgagtaacaatgggtgat

SEQ ID NO: 7077404 - DNA, 23 bp, Homo sapiens
cagggtgaccaatgtggccatca

SEQ ID NO: 7077405 - DNA, 22 bp, Homo sapiens
cagggtgactgccctggccact

SEQ ID NO: 7077406 - DNA, 22 bp, Homo sapiens
cagggtgagcctctggagccct

SEQ ID NO: 7077407 - DNA, 22 bp, Homo sapiens
caggaggaggtgaggtagaact

SEQ ID NO: 7077408 - DNA, 22 bp, Homo sapiens
agctgggctgggctgagctgag

SEQ ID NO: 7077409 - DNA, 22 bp, Homo sapiens
caggaagggggatccttggaag

SEQ ID NO: 7077410 - DNA, 22 bp, Homo sapiens
catggaggaggaagggcgttgt

SEQ ID NO: 7077411 - DNA, 22 bp, Homo sapiens
catggaggagttaggtgtgagt

SEQ ID NO: 7077412 - DNA, 22 bp, Homo sapiens
catggaggaccctcagggagct

SEQ ID NO: 7077413 - DNA, 22 bp, Homo sapiens
aggaggggcaatgatagtctgg

SEQ ID NO: 7077414 - DNA, 21 bp, Homo sapiens
aggagggcacaaggccaggaa

SEQ ID NO: 7077415 - DNA, 22 bp, Homo sapiens
aggagggagcttaagccaggca

SEQ ID NO: 7077416 - DNA, 18 bp, Homo sapiens
cagtggtgctgggatgtg

SEQ ID NO: 7077417 - DNA, 22 bp, Homo sapiens
agccagaacgcatcgccaaggc

SEQ ID NO: 7077418 - DNA, 22 bp, Homo sapiens
agccagaaaaacaccaagagga

SEQ ID NO: 7077419 - DNA, 22 bp, Homo sapiens
agccagagactttacctgtgca

SEQ ID NO: 7077420 - DNA, 22 bp, Homo sapiens
cagaaatctccatgtcagacat

SEQ ID NO: 7077421 - DNA, 22 bp, Homo sapiens
cagcagggcccccgggtgcgcc

SEQ ID NO: 7077422 - DNA, 22 bp, Homo sapiens
cagcaggggtgtcattgtagtt

SEQ ID NO: 7077423 - DNA, 23 bp, Homo sapiens
agcaccaggaacagtgtggtcct

SEQ ID NO: 7077424 - DNA, 22 bp, Homo sapiens
agcaccaggatattgttggaga

SEQ ID NO: 7077425 - DNA, 22 bp, Homo sapiens
agcaggggtggaaggtagcttt

SEQ ID NO: 7077426 - DNA, 22 bp, Homo sapiens
agcagctgatcaaagcacttat

SEQ ID NO: 7077427 - DNA, 20 bp, Homo sapiens
agagtgggtgtcacaggctg

SEQ ID NO: 7077428 - DNA, 22 bp, Homo sapiens
agagctgtttattgatgtcaca

SEQ ID NO: 7077429 - DNA, 22 bp, Homo sapiens
agaggaagctgagatgcctctt

SEQ ID NO: 7077430 - DNA, 22 bp, Homo sapiens
agaggaggctctgggatcgtcc

SEQ ID NO: 7077431 - DNA, 22 bp, Homo sapiens
atgtgggccgtgcgggtgtcct

SEQ ID NO: 7077432 - DNA, 22 bp, Homo sapiens
atgggggcctgaacaggcaaaa

SEQ ID NO: 7077433 - DNA, 23 bp, Homo sapiens
agaagtggaatggccgtggggtc

SEQ ID NO: 7077434 - DNA, 22 bp, Homo sapiens
aggctgaggagggatgttgctt

SEQ ID NO: 7077435 - DNA, 22 bp, Homo sapiens
agggctgacagtgaggagtcaa

SEQ ID NO: 7077436 - DNA, 22 bp, Homo sapiens
agggggagtttcagttagaaag

SEQ ID NO: 7077437 - DNA, 22 bp, Homo sapiens
agggggaggctgtgctgcgtct

SEQ ID NO: 7077438 - DNA, 22 bp, Homo sapiens
aggatgagattgctgtgttgta

SEQ ID NO: 7077439 - DNA, 22 bp, Homo sapiens
acaggtgtacaatgcatgacag

SEQ ID NO: 7077440 - DNA, 22 bp, Homo sapiens
acaggtgttgactcacaggccc

SEQ ID NO: 7077441 - DNA, 22 bp, Homo sapiens
acaggagtgaatctggcactta

SEQ ID NO: 7077442 - DNA, 22 bp, Homo sapiens
acaggagtagggctggtggaga

SEQ ID NO: 7077443 - DNA, 22 bp, Homo sapiens
agaaagggttctctgaggtgct

SEQ ID NO: 7077444 - DNA, 22 bp, Homo sapiens
acgctaggcatgagaaaggtct

SEQ ID NO: 7077445 - DNA, 22 bp, Homo sapiens
agtcccagtgagatgagccacg

SEQ ID NO: 7077446 - DNA, 22 bp, Homo sapiens
aaagcgcttccctttggagcgt

SEQ ID NO: 7077447 - DNA, 22 bp, Homo sapiens
aacagcagtggcaggagaaggc

SEQ ID NO: 7077448 - DNA, 22 bp, Homo sapiens
aaggtaggctcagggttgttct

SEQ ID NO: 7077449 - DNA, 22 bp, Homo sapiens
acaggtgttgaatgatgtcaca

SEQ ID NO: 7077450 - DNA, 18 bp, Homo sapiens
agaaggagctatgggcag

SEQ ID NO: 7077451 - DNA, 22 bp, Homo sapiens
agaaggagtgtacaggtcatgc

SEQ ID NO: 7077452 - DNA, 22 bp, Homo sapiens
agagctggggccagagtcaagg

SEQ ID NO: 7077453 - DNA, 22 bp, Homo sapiens
agaagggccagctggacacctg

SEQ ID NO: 7077454 - DNA, 22 bp, Homo sapiens
agaagggctacacgggctctcc

SEQ ID NO: 7077455 - DNA, 22 bp, Homo sapiens
agagctgggtggtggtgactca

SEQ ID NO: 7077456 - DNA, 22 bp, Homo sapiens
agagctgggtggacttgtagtt

SEQ ID NO: 7077457 - DNA, 22 bp, Homo sapiens
agagctggggctctgggtttaa

SEQ ID NO: 7077458 - DNA, 22 bp, Homo sapiens
agcacaggtacggagatgctac

SEQ ID NO: 7077459 - DNA, 20 bp, Homo sapiens
agctctcagcatgctgcctg

SEQ ID NO: 7077460 - DNA, 22 bp, Homo sapiens
agctaggggaccaaggtggccc

SEQ ID NO: 7077461 - DNA, 19 bp, Homo sapiens
acagagtgatgaggataga

SEQ ID NO: 7077462 - DNA, 22 bp, Homo sapiens
agcagggcatgaataagggttt

SEQ ID NO: 7077463 - DNA, 22 bp, Homo sapiens
agcagggcccactaggggagat

SEQ ID NO: 7077464 - DNA, 22 bp, Homo sapiens
agcagggcagttaaagggtcct

SEQ ID NO: 7077465 - DNA, 22 bp, Homo sapiens
tcagcaggcccatcctccaggc

SEQ ID NO: 7077466 - DNA, 22 bp, Homo sapiens
tccctctgctagtgcttgagct

SEQ ID NO: 7077467 - DNA, 22 bp, Homo sapiens
tcccagagcagtactccaggag

SEQ ID NO: 7077468 - DNA, 22 bp, Homo sapiens
tcccaagatgacacagtggacg

SEQ ID NO: 7077469 - DNA, 23 bp, Homo sapiens
tattttccaaatgatgactacat

SEQ ID NO: 7077470 - DNA, 21 bp, Homo sapiens
tagggggcagtgggatgctta

SEQ ID NO: 7077471 - DNA, 22 bp, Homo sapiens
tagggggctttgctgcttgaca

SEQ ID NO: 7077472 - DNA, 22 bp, Homo sapiens
taagcctgcatgaaccatgaga

SEQ ID NO: 7077473 - DNA, 22 bp, Homo sapiens
gttgagcaaggccagagaagcc

SEQ ID NO: 7077474 - DNA, 22 bp, Homo sapiens
gtgagcagtggccagggtccta

SEQ ID NO: 7077475 - DNA, 22 bp, Homo sapiens
gtgagctgttggagtggcagag

SEQ ID NO: 7077476 - DNA, 17 bp, Homo sapiens
gtgagctgagtcaggac

SEQ ID NO: 7077477 - DNA, 22 bp, Homo sapiens
gtgagcatagtaccaggtagta

SEQ ID NO: 7077478 - DNA, 22 bp, Homo sapiens
gtgagccaataccatgctgttc

SEQ ID NO: 7077479 - DNA, 22 bp, Homo sapiens
gtgagcttctgacagatgcacc

SEQ ID NO: 7077480 - DNA, 22 bp, Homo sapiens
gtgaggattgctctggagaatt

SEQ ID NO: 7077481 - DNA, 22 bp, Homo sapiens
gtgctgagtgcagagtgcagag

SEQ ID NO: 7077482 - DNA, 22 bp, Homo sapiens
gtcctgggaactggacagctaa

SEQ ID NO: 7077483 - DNA, 22 bp, Homo sapiens
ggtgagctggtctggggctgct

SEQ ID NO: 7077484 - DNA, 21 bp, Homo sapiens
ggtgctcgctgatgaggagtg

SEQ ID NO: 7077485 - DNA, 22 bp, Homo sapiens
ggtggcacactggggagctcgg

SEQ ID NO: 7077486 - DNA, 22 bp, Homo sapiens
ggtggagagctggatgagaggt

SEQ ID NO: 7077487 - DNA, 22 bp, Homo sapiens
ggtggcagagaggaggtagttt

SEQ ID NO: 7077488 - DNA, 22 bp, Homo sapiens
ggtgtttgcatggggccagttt

SEQ ID NO: 7077489 - DNA, 22 bp, Homo sapiens
gggtgaggccttgctgccatca

SEQ ID NO: 7077490 - DNA, 19 bp, Homo sapiens
ggggcccggggtctgcgag

SEQ ID NO: 7077491 - DNA, 22 bp, Homo sapiens
ggggagtggttgcctgtgatcc

SEQ ID NO: 7077492 - DNA, 22 bp, Homo sapiens
ggaggaggtgggttaagttgta

SEQ ID NO: 7077493 - DNA, 23 bp, Homo sapiens
ggaggagttcccagccctcctgg

SEQ ID NO: 7077494 - DNA, 22 bp, Homo sapiens
ggcactagtgacaaggggacat

SEQ ID NO: 7077495 - DNA, 22 bp, Homo sapiens
ggcactaggagacctgggggtc

SEQ ID NO: 7077496 - DNA, 22 bp, Homo sapiens
ggcagcagaactggccctgtat

SEQ ID NO: 7077497 - DNA, 22 bp, Homo sapiens
ggcaggggtcctggtgttgact

SEQ ID NO: 7077498 - DNA, 22 bp, Homo sapiens
ggcagtgagctggagggaagga

SEQ ID NO: 7077499 - DNA, 22 bp, Homo sapiens
ggcagtgagtcccggagaggcc

SEQ ID NO: 7077500 - DNA, 22 bp, Homo sapiens
ggcagtgactgttcagacgtcc

SEQ ID NO: 7077501 - DNA, 22 bp, Homo sapiens
gggccctgtgatttcttgagga

SEQ ID NO: 7077502 - DNA, 22 bp, Homo sapiens
gggccctgatctgtgagcgcag

SEQ ID NO: 7077503 - DNA, 22 bp, Homo sapiens
gggccctgcgactcgcggcgga

SEQ ID NO: 7077504 - DNA, 22 bp, Homo sapiens
gggccctggggatgtggacgcg

SEQ ID NO: 7077505 - DNA, 22 bp, Homo sapiens
gggccctggggcctgatttgca

SEQ ID NO: 7077506 - DNA, 21 bp, Homo sapiens
gggctcagcgctcggctcctc

SEQ ID NO: 7077507 - DNA, 20 bp, Homo sapiens
gggagtggtggtagcctgtg

SEQ ID NO: 7077508 - DNA, 22 bp, Homo sapiens
gggagtgggtttggcctaggcc

SEQ ID NO: 7077509 - DNA, 22 bp, Homo sapiens
gggatcagcaagccactgcacc

SEQ ID NO: 7077510 - DNA, 22 bp, Homo sapiens
gggagtggattatgtggaccca

SEQ ID NO: 7077511 - DNA, 22 bp, Homo sapiens
gggaagagggagctggaatgat

SEQ ID NO: 7077512 - DNA, 22 bp, Homo sapiens
ggctggcagaggggagtctgtg

SEQ ID NO: 7077513 - DNA, 22 bp, Homo sapiens
gctcagggaatgagaagatgtt

SEQ ID NO: 7077514 - DNA, 22 bp, Homo sapiens
gctcagggagagagggcagccg

SEQ ID NO: 7077515 - DNA, 22 bp, Homo sapiens
gctcagggcgcgagggacgtgg

SEQ ID NO: 7077516 - DNA, 22 bp, Homo sapiens
gctccccattgatctgcaggct

SEQ ID NO: 7077517 - DNA, 22 bp, Homo sapiens
gctggagtgcagttgcacagtc

SEQ ID NO: 7077518 - DNA, 22 bp, Homo sapiens
gctggagtgctgaggtgcagtg

SEQ ID NO: 7077519 - DNA, 22 bp, Homo sapiens
gctgagtgtaatgatggcagag

SEQ ID NO: 7077520 - DNA, 22 bp, Homo sapiens
gctgagtggagcagtcagcgct

SEQ ID NO: 7077521 - DNA, 17 bp, Homo sapiens
gctgagtgcagggagtc

SEQ ID NO: 7077522 - DNA, 22 bp, Homo sapiens
gctgagtgaggtccagagcttg

SEQ ID NO: 7077523 - DNA, 22 bp, Homo sapiens
ggaaggaggggcaaagcagttc

SEQ ID NO: 7077524 - DNA, 22 bp, Homo sapiens
ggaaggaggatgctctggcctt

SEQ ID NO: 7077525 - DNA, 22 bp, Homo sapiens
ggaaggagccatatcatatcca

SEQ ID NO: 7077526 - DNA, 22 bp, Homo sapiens
ggacaggggcgtggggattgtt

SEQ ID NO: 7077527 - DNA, 22 bp, Homo sapiens
ggaggaggggtgactgaatgct

SEQ ID NO: 7077528 - DNA, 22 bp, Homo sapiens
ggagctggctacagagaactcc

SEQ ID NO: 7077529 - DNA, 22 bp, Homo sapiens
ggagctgggaactatgtagtat

SEQ ID NO: 7077530 - DNA, 22 bp, Homo sapiens
ggagctgggaattggatcatct

SEQ ID NO: 7077531 - DNA, 22 bp, Homo sapiens
gcagaagggaataaggagcttt

SEQ ID NO: 7077532 - DNA, 22 bp, Homo sapiens
gcagaaggcctcttggttaata

SEQ ID NO: 7077533 - DNA, 22 bp, Homo sapiens
gcagctggctcagagaggtggg

SEQ ID NO: 7077534 - DNA, 22 bp, Homo sapiens
gccctgcttggtcatggccttc

SEQ ID NO: 7077535 - DNA, 22 bp, Homo sapiens
gccctgctggggcacagcaaga

SEQ ID NO: 7077536 - DNA, 22 bp, Homo sapiens
gccctgctgtcttcagagtata

SEQ ID NO: 7077537 - DNA, 22 bp, Homo sapiens
gccctgctgtttagagagctac

SEQ ID NO: 7077538 - DNA, 22 bp, Homo sapiens
gccctgcttctggcatgcagaa

SEQ ID NO: 7077539 - DNA, 23 bp, Homo sapiens
gccctgctgggacctcctgctac

SEQ ID NO: 7077540 - DNA, 22 bp, Homo sapiens
gccctgctgctggcagaggcgc

SEQ ID NO: 7077541 - DNA, 22 bp, Homo sapiens
gccctgctcttttgcccaccca

SEQ ID NO: 7077542 - DNA, 22 bp, Homo sapiens
gccctgctgagtccggctcaga

SEQ ID NO: 7077543 - DNA, 22 bp, Homo sapiens
gccctgctgcgcagcacgcatg

SEQ ID NO: 7077544 - DNA, 22 bp, Homo sapiens
gccctgctaatttcgtactttt

SEQ ID NO: 7077545 - DNA, 22 bp, Homo sapiens
gccctgctcatttcacgtgttt

SEQ ID NO: 7077546 - DNA, 23 bp, Homo sapiens
gccctgctactcacaagctgtgt

SEQ ID NO: 7077547 - DNA, 23 bp, Homo sapiens
gccctgctcctggctgggaggga

SEQ ID NO: 7077548 - DNA, 22 bp, Homo sapiens
gccctgctccaggagaataccc

SEQ ID NO: 7077549 - DNA, 22 bp, Homo sapiens
gccctgctcctccgtcccacga

SEQ ID NO: 7077550 - DNA, 22 bp, Homo sapiens
gccctgctctggtctctgcccg

SEQ ID NO: 7077551 - DNA, 22 bp, Homo sapiens
gccctgctctgttggtcacctg

SEQ ID NO: 7077552 - DNA, 22 bp, Homo sapiens
gccctcagaggacagctgactt

SEQ ID NO: 7077553 - DNA, 22 bp, Homo sapiens
gccctagccatcctgtgctctg

SEQ ID NO: 7077554 - DNA, 22 bp, Homo sapiens
gccctagcgccagctcagcacc

SEQ ID NO: 7077555 - DNA, 22 bp, Homo sapiens
gagcactgagctggaattggag

SEQ ID NO: 7077556 - DNA, 20 bp, Homo sapiens
gagcacagtaatgactgcta

SEQ ID NO: 7077557 - DNA, 22 bp, Homo sapiens
gagggaagaggcctgacatttt

SEQ ID NO: 7077558 - DNA, 22 bp, Homo sapiens
gagggaagagggtttgaattca

SEQ ID NO: 7077559 - DNA, 22 bp, Homo sapiens
gagggaagattccccatatggg

SEQ ID NO: 7077560 - DNA, 22 bp, Homo sapiens
gagggaaggagagttgtagctg

SEQ ID NO: 7077561 - DNA, 22 bp, Homo sapiens
gaggtgagtggatcacgaggtc

SEQ ID NO: 7077562 - DNA, 20 bp, Homo sapiens
gagctgtgctctcaggagcc

SEQ ID NO: 7077563 - DNA, 22 bp, Homo sapiens
gagctggtgatcagctggagga

SEQ ID NO: 7077564 - DNA, 22 bp, Homo sapiens
gaggccagaagtctgagatcag

SEQ ID NO: 7077565 - DNA, 22 bp, Homo sapiens
gaggaggttccgggtggagaag

SEQ ID NO: 7077566 - DNA, 22 bp, Homo sapiens
gaggagtggagttgctgggttg

SEQ ID NO: 7077567 - DNA, 21 bp, Homo sapiens
cttccccaggctggtctgtat

SEQ ID NO: 7077568 - DNA, 22 bp, Homo sapiens
ctgtgtgaatagtgaggtctat

SEQ ID NO: 7077569 - DNA, 22 bp, Homo sapiens
ctgtgagaaaggtgatggaggt

SEQ ID NO: 7077570 - DNA, 22 bp, Homo sapiens
ctgggtggaaagtgctgagaat

SEQ ID NO: 7077571 - DNA, 17 bp, Homo sapiens
ctgaggggagtgctgtg

SEQ ID NO: 7077572 - DNA, 22 bp, Homo sapiens
ctggagagttggaagatggact

SEQ ID NO: 7077573 - DNA, 22 bp, Homo sapiens
tttgacctctggaccctctgaa

SEQ ID NO: 7077574 - DNA, 22 bp, Homo sapiens
ttggctgaaagccatgagaccg

SEQ ID NO: 7077575 - DNA, 22 bp, Homo sapiens
ttggaaggttctggtcatggtt

SEQ ID NO: 7077576 - DNA, 22 bp, Homo sapiens
ctcagctgtctcatgggtctgt

SEQ ID NO: 7077577 - DNA, 22 bp, Homo sapiens
cgtgagcaaaatggacactccc

SEQ ID NO: 7077578 - DNA, 22 bp, Homo sapiens
tccccagaggtgaggcagcttt

SEQ ID NO: 7077579 - DNA, 22 bp, Homo sapiens
tccccagatggccagctacatg

SEQ ID NO: 7077580 - DNA, 22 bp, Homo sapiens
ccacagtgatccctgcctgcga

SEQ ID NO: 7077581 - DNA, 22 bp, Homo sapiens
ccagagaggccaaggtcgtggt

SEQ ID NO: 7077582 - DNA, 22 bp, Homo sapiens
cagtggggtttctgtgggtgct

SEQ ID NO: 7077583 - DNA, 22 bp, Homo sapiens
cagtgggggtgaggccgaggta

SEQ ID NO: 7077584 - DNA, 22 bp, Homo sapiens
cagtgggggggccatgctgcag

SEQ ID NO: 7077585 - DNA, 22 bp, Homo sapiens
cagtgggaatgaagtggaggcc

SEQ ID NO: 7077586 - DNA, 22 bp, Homo sapiens
caggttgggctgcgaggaggag

SEQ ID NO: 7077587 - DNA, 22 bp, Homo sapiens
caggtgttaattgttggagcaa

SEQ ID NO: 7077588 - DNA, 22 bp, Homo sapiens
caggtgttggaagggcagtggg

SEQ ID NO: 7077589 - DNA, 22 bp, Homo sapiens
cagtaggaggttctgaggttct

SEQ ID NO: 7077590 - DNA, 22 bp, Homo sapiens
cagtagggaatgtgggaggctg

SEQ ID NO: 7077591 - DNA, 22 bp, Homo sapiens
cagtgagctcctgtctgtccct

SEQ ID NO: 7077592 - DNA, 22 bp, Homo sapiens
tagggtggttagaaggagtatg

SEQ ID NO: 7077593 - DNA, 22 bp, Homo sapiens
taggaacaaaaggttttcctga

SEQ ID NO: 7077594 - DNA, 22 bp, Homo sapiens
gtgaggggagtaaagccatgtt

SEQ ID NO: 7077595 - DNA, 22 bp, Homo sapiens
tgggggagagaggcattctttc

SEQ ID NO: 7077596 - DNA, 22 bp, Homo sapiens
cctgcttaacattgccatgaca

SEQ ID NO: 7077597 - DNA, 22 bp, Homo sapiens
tggaagggaacaggtgggtgtt

SEQ ID NO: 7077598 - DNA, 22 bp, Homo sapiens
ccctgctgaatcccatggagtc

SEQ ID NO: 7077599 - DNA, 22 bp, Homo sapiens
cctcagctcttccctgtgcaca

SEQ ID NO: 7077600 - DNA, 22 bp, Homo sapiens
cctcagctgctgcacagctttt

SEQ ID NO: 7077601 - DNA, 22 bp, Homo sapiens
tgccctcctcctgagcccatgt

SEQ ID NO: 7077602 - DNA, 18 bp, Homo sapiens
tgaggcagtcagtgatgg

SEQ ID NO: 7077603 - DNA, 22 bp, Homo sapiens
tgatgagggggaacagagattt

SEQ ID NO: 7077604 - DNA, 22 bp, Homo sapiens
cccagagagcacaggtggtggg

SEQ ID NO: 7077605 - DNA, 22 bp, Homo sapiens
tgagcccaggagttggaggctg

SEQ ID NO: 7077606 - DNA, 22 bp, Homo sapiens
tgagctggcaggggctcaggga

SEQ ID NO: 7077607 - DNA, 22 bp, Homo sapiens
tgagctgggaagagcagccaga

SEQ ID NO: 7077608 - DNA, 22 bp, Homo sapiens
tgagctgggagtggtgatgagg

SEQ ID NO: 7077609 - DNA, 23 bp, Homo sapiens
tgagctgggcctgcaggggtctc

SEQ ID NO: 7077610 - DNA, 22 bp, Homo sapiens
tgagctgggctgggctgagctg

SEQ ID NO: 7077611 - DNA, 23 bp, Homo sapiens
tgagcacctacctggagccaagc

SEQ ID NO: 7077612 - DNA, 22 bp, Homo sapiens
tgagcacctccctgacagtggg

SEQ ID NO: 7077613 - DNA, 22 bp, Homo sapiens
ccagggtggcgtagatgctggg

SEQ ID NO: 7077614 - DNA, 22 bp, Homo sapiens
ccagggaaaggaggttgacttg

SEQ ID NO: 7077615 - DNA, 22 bp, Homo sapiens
tttcctctgatgctgacttgga

SEQ ID NO: 7077616 - DNA, 22 bp, Homo sapiens
tttcctctgagtgagctgggag

SEQ ID NO: 7077617 - DNA, 22 bp, Homo sapiens
tttcctctgactgctcccctgc

SEQ ID NO: 7077618 - DNA, 22 bp, Homo sapiens
tttcctctccggggcctccagg

SEQ ID NO: 7077619 - DNA, 22 bp, Homo sapiens
tttcctctccaccaggaggtct

SEQ ID NO: 7077620 - DNA, 22 bp, Homo sapiens
ttcctgctccatttgctgagct

SEQ ID NO: 7077621 - DNA, 22 bp, Homo sapiens
ttccttcttccagaggctgccc

SEQ ID NO: 7077622 - DNA, 22 bp, Homo sapiens
ttccttcttcctttagtaacca

SEQ ID NO: 7077623 - DNA, 22 bp, Homo sapiens
ttccttctttgtggtagaaagt

SEQ ID NO: 7077624 - DNA, 22 bp, Homo sapiens
gggggatgctcaggaggctgct

SEQ ID NO: 7077625 - DNA, 22 bp, Homo sapiens
cagagcttttagatgttgaaca

SEQ ID NO: 7077626 - DNA, 22 bp, Homo sapiens
cagagctttttacattaatgat

SEQ ID NO: 7077627 - DNA, 22 bp, Homo sapiens
gggctcagggacacatgtgtgt

SEQ ID NO: 7077628 - DNA, 22 bp, Homo sapiens
gggctcaggtcagggcatcagc

SEQ ID NO: 7077629 - DNA, 19 bp, Homo sapiens
gggcggagcctgacctggg

SEQ ID NO: 7077630 - DNA, 22 bp, Homo sapiens
gggccctgcgtccggaagtctg

SEQ ID NO: 7077631 - DNA, 22 bp, Homo sapiens
gggccctggatttaagcatgga

SEQ ID NO: 7077632 - DNA, 22 bp, Homo sapiens
cagagagcttagtgtgctgcat

SEQ ID NO: 7077633 - DNA, 22 bp, Homo sapiens
ggggtgagatcaaggaagccct

SEQ ID NO: 7077634 - DNA, 22 bp, Homo sapiens
ggggtgagctgggcctgtgcct

SEQ ID NO: 7077635 - DNA, 22 bp, Homo sapiens
gtgcagctgtggtggagccagg

SEQ ID NO: 7077636 - DNA, 22 bp, Homo sapiens
gtgcagctgaaggctggccagc

SEQ ID NO: 7077637 - DNA, 22 bp, Homo sapiens
gtgctgagcacaaggcccagag

SEQ ID NO: 7077638 - DNA, 22 bp, Homo sapiens
cagctcccagtggcagctcctt

SEQ ID NO: 7077639 - DNA, 22 bp, Homo sapiens
ggagtgactcacagctgggaca

SEQ ID NO: 7077640 - DNA, 22 bp, Homo sapiens
ggagtgagcaaatagagatttg

SEQ ID NO: 7077641 - DNA, 22 bp, Homo sapiens
ggctgcagcggattggggattg

SEQ ID NO: 7077642 - DNA, 22 bp, Homo sapiens
ggcttgagacccgggagccaga

SEQ ID NO: 7077643 - DNA, 22 bp, Homo sapiens
ggagggcaacttttcagtaggt

SEQ ID NO: 7077644 - DNA, 22 bp, Homo sapiens
ggaggggcatagttcaccatca

SEQ ID NO: 7077645 - DNA, 22 bp, Homo sapiens
ggagcaggcagggccgtgtctg

SEQ ID NO: 7077646 - DNA, 22 bp, Homo sapiens
ggagagtggattccagctgtat

SEQ ID NO: 7077647 - DNA, 22 bp, Homo sapiens
gcaggtggatcacctgaggtca

SEQ ID NO: 7077648 - DNA, 22 bp, Homo sapiens
gcagggaggaagagatgcttcc

SEQ ID NO: 7077649 - DNA, 22 bp, Homo sapiens
gctctgagacagtagagatggc

SEQ ID NO: 7077650 - DNA, 22 bp, Homo sapiens
gctctgagaggatgctgagcag

SEQ ID NO: 7077651 - DNA, 22 bp, Homo sapiens
gcgtggggtaggtagacatgga

SEQ ID NO: 7077652 - DNA, 22 bp, Homo sapiens
atgcccaatgtaggccccagga

SEQ ID NO: 7077653 - DNA, 22 bp, Homo sapiens
gaggttggggctgcagtgagct

SEQ ID NO: 7077654 - DNA, 19 bp, Homo sapiens
gagcgcagagggcagggga

SEQ ID NO: 7077655 - DNA, 22 bp, Homo sapiens
gaggaaggctaaggggcttaga

SEQ ID NO: 7077656 - DNA, 22 bp, Homo sapiens
gaggaaggaatgcagtgtatgc

SEQ ID NO: 7077657 - DNA, 22 bp, Homo sapiens
gaggaaggagggaaagcgcgcg

SEQ ID NO: 7077658 - DNA, 22 bp, Homo sapiens
gaggaaggatttagtttgaggg

SEQ ID NO: 7077659 - DNA, 22 bp, Homo sapiens
gagcttggggcatatggtgcta

SEQ ID NO: 7077660 - DNA, 22 bp, Homo sapiens
cttccttggcttctggggtgtg

SEQ ID NO: 7077661 - DNA, 22 bp, Homo sapiens
ctgggggcaagcagacagctgt

SEQ ID NO: 7077662 - DNA, 22 bp, Homo sapiens
agtgaggggcagctgagtgggc

SEQ ID NO: 7077663 - DNA, 22 bp, Homo sapiens
agtgaggggattcaggcaaggt

SEQ ID NO: 7077664 - DNA, 22 bp, Homo sapiens
agtgagggactagtgctgggga

SEQ ID NO: 7077665 - DNA, 19 bp, Homo sapiens
agtgtgagtaattggagtt

SEQ ID NO: 7077666 - DNA, 22 bp, Homo sapiens
agtgtgagtgctcatgtccatc

SEQ ID NO: 7077667 - DNA, 22 bp, Homo sapiens
agtgtgagttacaaagtgtgaa

SEQ ID NO: 7077668 - DNA, 22 bp, Homo sapiens
agtgtgagtttggttgagactt

SEQ ID NO: 7077669 - DNA, 22 bp, Homo sapiens
ctgagctgaaacttgagaggct

SEQ ID NO: 7077670 - DNA, 22 bp, Homo sapiens
ctgagcagccccaccagccatt

SEQ ID NO: 7077671 - DNA, 22 bp, Homo sapiens
ctgagctgagccaaatctgtct

SEQ ID NO: 7077672 - DNA, 22 bp, Homo sapiens
ctgagctgcggcaggcacctgg

SEQ ID NO: 7077673 - DNA, 22 bp, Homo sapiens
agtgtgaggggttctttgatat

SEQ ID NO: 7077674 - DNA, 22 bp, Homo sapiens
agtgtgagtaattgagtctgtc

SEQ ID NO: 7077675 - DNA, 22 bp, Homo sapiens
agtgtgagattaaaccgaatca

SEQ ID NO: 7077676 - DNA, 22 bp, Homo sapiens
agtgtgagctaatagcagagcc

SEQ ID NO: 7077677 - DNA, 22 bp, Homo sapiens
agtgtgagaacggactaataaa

SEQ ID NO: 7077678 - DNA, 22 bp, Homo sapiens
agtgtgagatgattgaggagca

SEQ ID NO: 7077679 - DNA, 22 bp, Homo sapiens
agtggccatccctcaggtaggc

SEQ ID NO: 7077680 - DNA, 22 bp, Homo sapiens
agtggtagagtcaaggttgtaa

SEQ ID NO: 7077681 - DNA, 22 bp, Homo sapiens
agtcaggaagctggagctgggg

SEQ ID NO: 7077682 - DNA, 22 bp, Homo sapiens
ctaggcacttgtaaggccgctc

SEQ ID NO: 7077683 - DNA, 22 bp, Homo sapiens
agtagcataaatagtggtagta

SEQ ID NO: 7077684 - DNA, 22 bp, Homo sapiens
agtagcatgtgcacagtaattt

SEQ ID NO: 7077685 - DNA, 22 bp, Homo sapiens
aggtaagcatggtggctgctgt

SEQ ID NO: 7077686 - DNA, 20 bp, Homo sapiens
aggcacagttcctagttggg

SEQ ID NO: 7077687 - DNA, 22 bp, Homo sapiens
aggaggtctcactatgttgccc

SEQ ID NO: 7077688 - DNA, 22 bp, Homo sapiens
cagtgagggaagatctcagcac

SEQ ID NO: 7077689 - DNA, 18 bp, Homo sapiens
cagtgaggatgaagggtt

SEQ ID NO: 7077690 - DNA, 22 bp, Homo sapiens
aggaagggttctttgtgaaaga

SEQ ID NO: 7077691 - DNA, 22 bp, Homo sapiens
aggaagggttctttctgtttat

SEQ ID NO: 7077692 - DNA, 22 bp, Homo sapiens
aggaagggtgtcatgagccctt

SEQ ID NO: 7077693 - DNA, 22 bp, Homo sapiens
aggaaggggagaagttaaagct

SEQ ID NO: 7077694 - DNA, 20 bp, Homo sapiens
aggaaggagaatctgagcaa

SEQ ID NO: 7077695 - DNA, 22 bp, Homo sapiens
agcttctgagaatagtaaatgc

SEQ ID NO: 7077696 - DNA, 22 bp, Homo sapiens
agctggtgagggttgaggggta

SEQ ID NO: 7077697 - DNA, 22 bp, Homo sapiens
agctggagccagtgtgaggctt

SEQ ID NO: 7077698 - DNA, 22 bp, Homo sapiens
agctgggcaccccgctgcgtct

SEQ ID NO: 7077699 - DNA, 22 bp, Homo sapiens
agctgggcagactgcagtggtt

SEQ ID NO: 7077700 - DNA, 22 bp, Homo sapiens
ccagagctgaggagatgggctt

SEQ ID NO: 7077701 - DNA, 22 bp, Homo sapiens
agggcgaggagacggaggcaca

SEQ ID NO: 7077702 - DNA, 22 bp, Homo sapiens
agggcctggaactgtgggcagg

SEQ ID NO: 7077703 - DNA, 18 bp, Homo sapiens
aggggcagcttgtgtgga

SEQ ID NO: 7077704 - DNA, 22 bp, Homo sapiens
aggggaggcagcgataaacctg

SEQ ID NO: 7077705 - DNA, 22 bp, Homo sapiens
ccctgctgtgcctgactgccat

SEQ ID NO: 7077706 - DNA, 22 bp, Homo sapiens
cccaggagatggtgcgtggtct

SEQ ID NO: 7077707 - DNA, 18 bp, Homo sapiens
agcagtagcgccaggtgc

SEQ ID NO: 7077708 - DNA, 22 bp, Homo sapiens
agcagtgagccataagtgctag

SEQ ID NO: 7077709 - DNA, 22 bp, Homo sapiens
agcagtggcctggggctctgtg

SEQ ID NO: 7077710 - DNA, 22 bp, Homo sapiens
agcagggctctgtggagggtgg

SEQ ID NO: 7077711 - DNA, 22 bp, Homo sapiens
agcccatgcaacaggcctagcg

SEQ ID NO: 7077712 - DNA, 22 bp, Homo sapiens
agagctggctgtgggtgacttt

SEQ ID NO: 7077713 - DNA, 22 bp, Homo sapiens
agagctggccagggatcactct

SEQ ID NO: 7077714 - DNA, 22 bp, Homo sapiens
agagctggcagcagcttctcct

SEQ ID NO: 7077715 - DNA, 21 bp, Homo sapiens
agagctgggacttgcctgaga

SEQ ID NO: 7077716 - DNA, 22 bp, Homo sapiens
agaggggctcaagcagtggtct

SEQ ID NO: 7077717 - DNA, 18 bp, Homo sapiens
agaggggaggtaagtctg

SEQ ID NO: 7077718 - DNA, 22 bp, Homo sapiens
agaggggagagctaagcaattc

SEQ ID NO: 7077719 - DNA, 23 bp, Homo sapiens
agtgaagctggttagtgatgacc

SEQ ID NO: 7077720 - DNA, 22 bp, Homo sapiens
atccccagaaagaccgatgtac

SEQ ID NO: 7077721 - DNA, 22 bp, Homo sapiens
atccccaagccaaggcctgagg

SEQ ID NO: 7077722 - DNA, 22 bp, Homo sapiens
atccccagaaaataggtgccta

SEQ ID NO: 7077723 - DNA, 23 bp, Homo sapiens
agctgggcaaggatccgggctcc

SEQ ID NO: 7077724 - DNA, 22 bp, Homo sapiens
agctggcctgttagagctgagt

SEQ ID NO: 7077725 - DNA, 22 bp, Homo sapiens
aggagctgctttggtgcggttt

SEQ ID NO: 7077726 - DNA, 22 bp, Homo sapiens
acaggggtgcatggtgcatggt

SEQ ID NO: 7077727 - DNA, 22 bp, Homo sapiens
acagggtgactttgtgacagat

SEQ ID NO: 7077728 - DNA, 22 bp, Homo sapiens
acagggtggggatggtgagctt

SEQ ID NO: 7077729 - DNA, 22 bp, Homo sapiens
aggaaggcacattgttggctaa

SEQ ID NO: 7077730 - DNA, 22 bp, Homo sapiens
aggaagggagcagtttgttgtt

SEQ ID NO: 7077731 - DNA, 22 bp, Homo sapiens
aggaagggatacataggatagt

SEQ ID NO: 7077732 - DNA, 21 bp, Homo sapiens
aggaggggtctttcccactga

SEQ ID NO: 7077733 - DNA, 22 bp, Homo sapiens
aggcaacatgggccaggcagaa

SEQ ID NO: 7077734 - DNA, 21 bp, Homo sapiens
accctgctttatgccgtcctc

SEQ ID NO: 7077735 - DNA, 22 bp, Homo sapiens
accctgctttatgccgtcctct

SEQ ID NO: 7077736 - DNA, 22 bp, Homo sapiens
accctgctgacctgaaagaggg

SEQ ID NO: 7077737 - DNA, 22 bp, Homo sapiens
accctgcttctggattaatcca

SEQ ID NO: 7077738 - DNA, 22 bp, Homo sapiens
accctgcttggccccacttcta

SEQ ID NO: 7077739 - DNA, 22 bp, Homo sapiens
accaggtggccccagcgtggtt

SEQ ID NO: 7077740 - DNA, 22 bp, Homo sapiens
aagtgatgctacgactttgaca

SEQ ID NO: 7077741 - DNA, 22 bp, Homo sapiens
accaggaacaagccatggagga

SEQ ID NO: 7077742 - DNA, 22 bp, Homo sapiens
accaggaaactgtgcccacgac

SEQ ID NO: 7077743 - DNA, 22 bp, Homo sapiens
acaggtagcatttttcctcttt

SEQ ID NO: 7077744 - DNA, 22 bp, Homo sapiens
acaggtgtcctcacagggggtg

SEQ ID NO: 7077745 - DNA, 22 bp, Homo sapiens
acaggtgtgagaacatgccttg

SEQ ID NO: 7077746 - DNA, 22 bp, Homo sapiens
acagtggtggctttgctatgct

SEQ ID NO: 7077747 - DNA, 18 bp, Homo sapiens
acagtggtttgatgtgct

SEQ ID NO: 7077748 - DNA, 22 bp, Homo sapiens
agcagccagttctctgtggtag

SEQ ID NO: 7077749 - DNA, 22 bp, Homo sapiens
agcagctgagccccagctgtga

SEQ ID NO: 7077750 - DNA, 22 bp, Homo sapiens
agcaggagggttttgtagagtc

SEQ ID NO: 7077751 - DNA, 22 bp, Homo sapiens
tcagcttgggaaattgagcaag

SEQ ID NO: 7077752 - DNA, 22 bp, Homo sapiens
tcccagagttcaatgggaaggt

SEQ ID NO: 7077753 - DNA, 22 bp, Homo sapiens
tccactccttatgccagacggt

SEQ ID NO: 7077754 - DNA, 22 bp, Homo sapiens
tcctccagcttctcttttgggg

SEQ ID NO: 7077755 - DNA, 19 bp, Homo sapiens
taagatggcaagtgtctct

SEQ ID NO: 7077756 - DNA, 22 bp, Homo sapiens
tagaggcaccctggaggagact

SEQ ID NO: 7077757 - DNA, 22 bp, Homo sapiens
gtctcctggcttttgtcccagt

SEQ ID NO: 7077758 - DNA, 22 bp, Homo sapiens
gtctcctggaaatatgcccata

SEQ ID NO: 7077759 - DNA, 22 bp, Homo sapiens
gtgaggtgggctgggctctatg

SEQ ID NO: 7077760 - DNA, 22 bp, Homo sapiens
gtgaggtggtacaatattaact

SEQ ID NO: 7077761 - DNA, 22 bp, Homo sapiens
gtgagtgttaacccactgcttc

SEQ ID NO: 7077762 - DNA, 22 bp, Homo sapiens
gtgatgagagaaccaggacctt

SEQ ID NO: 7077763 - DNA, 22 bp, Homo sapiens
gtagagcaggacttgagatgtt

SEQ ID NO: 7077764 - DNA, 20 bp, Homo sapiens
gggggccagcagcagacgcc

SEQ ID NO: 7077765 - DNA, 22 bp, Homo sapiens
gggggcgccccatggaggtgag

SEQ ID NO: 7077766 - DNA, 22 bp, Homo sapiens
ggtaggagtattttgcagcagt

SEQ ID NO: 7077767 - DNA, 23 bp, Homo sapiens
ggtagagccgcgccctgggggaa

SEQ ID NO: 7077768 - DNA, 22 bp, Homo sapiens
ggtaccatggggaggcagaggt

SEQ ID NO: 7077769 - DNA, 17 bp, Homo sapiens
gggaagtggagaaagct

SEQ ID NO: 7077770 - DNA, 22 bp, Homo sapiens
gggagctgagctggaagagaat

SEQ ID NO: 7077771 - DNA, 22 bp, Homo sapiens
gggaagggacttgtttaaggtc

SEQ ID NO: 7077772 - DNA, 22 bp, Homo sapiens
ggcatgagcacgaagtggtacc

SEQ ID NO: 7077773 - DNA, 22 bp, Homo sapiens
ggcatgagtaacgtgagtgagg

SEQ ID NO: 7077774 - DNA, 22 bp, Homo sapiens
ggatggcatgttgggctctgtt

SEQ ID NO: 7077775 - DNA, 22 bp, Homo sapiens
ggatgccaactctgtttctgtg

SEQ ID NO: 7077776 - DNA, 21 bp, Homo sapiens
ggatgccacgaagcaccagga

SEQ ID NO: 7077777 - DNA, 22 bp, Homo sapiens
ggatgccatcagagtgtctgtg

SEQ ID NO: 7077778 - DNA, 22 bp, Homo sapiens
ggatgccatttgggtctggctt

SEQ ID NO: 7077779 - DNA, 22 bp, Homo sapiens
ggatgaggtagatgaacaaggg

SEQ ID NO: 7077780 - DNA, 22 bp, Homo sapiens
ggcagaagaaaggctaagtctc

SEQ ID NO: 7077781 - DNA, 19 bp, Homo sapiens
ggcagaaggtgtaggggga

SEQ ID NO: 7077782 - DNA, 22 bp, Homo sapiens
ggcagcagggtctagattgatg

SEQ ID NO: 7077783 - DNA, 22 bp, Homo sapiens
ggcagcagtaggagctaatctt

SEQ ID NO: 7077784 - DNA, 22 bp, Homo sapiens
ggcagcagtccatggcccaagg

SEQ ID NO: 7077785 - DNA, 22 bp, Homo sapiens
gctgaagtgtggagtgacagtt

SEQ ID NO: 7077786 - DNA, 22 bp, Homo sapiens
gctgatgtcccactgacagcca

SEQ ID NO: 7077787 - DNA, 22 bp, Homo sapiens
gcgctgagcttttcttattgaa

SEQ ID NO: 7077788 - DNA, 22 bp, Homo sapiens
gcggggcccccggccgagctct

SEQ ID NO: 7077789 - DNA, 22 bp, Homo sapiens
gcctggggccagcttgggctga

SEQ ID NO: 7077790 - DNA, 22 bp, Homo sapiens
ggactgaggcccacttgaggga

SEQ ID NO: 7077791 - DNA, 22 bp, Homo sapiens
ggactgaggacatgtgaggcat

SEQ ID NO: 7077792 - DNA, 22 bp, Homo sapiens
ggacagagccctggtggcctaa

SEQ ID NO: 7077793 - DNA, 20 bp, Homo sapiens
gctgggggtgtgctgagtga

SEQ ID NO: 7077794 - DNA, 22 bp, Homo sapiens
gcccagtgtctaggaggtgaac

SEQ ID NO: 7077795 - DNA, 19 bp, Homo sapiens
gcccaggggcccgatgctg

SEQ ID NO: 7077796 - DNA, 22 bp, Homo sapiens
gcccagtggtaaaagcaggcct

SEQ ID NO: 7077797 - DNA, 22 bp, Homo sapiens
gcccagggcgatggtcggggcc

SEQ ID NO: 7077798 - DNA, 22 bp, Homo sapiens
gccaggaggctgctgtgtaggc

SEQ ID NO: 7077799 - DNA, 22 bp, Homo sapiens
gcatgaggggggttaggaagtt

SEQ ID NO: 7077800 - DNA, 22 bp, Homo sapiens
gccagccaagattgagaaggta

SEQ ID NO: 7077801 - DNA, 22 bp, Homo sapiens
gaggggctggggttgactccaa

SEQ ID NO: 7077802 - DNA, 22 bp, Homo sapiens
gaggggctgtggagctctctgg

SEQ ID NO: 7077803 - DNA, 22 bp, Homo sapiens
gcagcaggcacttaccgttgct

SEQ ID NO: 7077804 - DNA, 22 bp, Homo sapiens
gaaggggactggcagctgcaga

SEQ ID NO: 7077805 - DNA, 22 bp, Homo sapiens
gaaggtgtctacgcgccttgag

SEQ ID NO: 7077806 - DNA, 22 bp, Homo sapiens
gaaggcagggaatgtggtgcta

SEQ ID NO: 7077807 - DNA, 22 bp, Homo sapiens
gaccagaaagtcatgagtcagt

SEQ ID NO: 7077808 - DNA, 22 bp, Homo sapiens
gaccagaaatgattctccagct

SEQ ID NO: 7077809 - DNA, 22 bp, Homo sapiens
gagagggctctgtgtgggtact

SEQ ID NO: 7077810 - DNA, 22 bp, Homo sapiens
gagagggctgcctggtgtgagg

SEQ ID NO: 7077811 - DNA, 18 bp, Homo sapiens
gagggagtagctgaggtt

SEQ ID NO: 7077812 - DNA, 22 bp, Homo sapiens
gaggggctgccctggtgtcagg

SEQ ID NO: 7077813 - DNA, 22 bp, Homo sapiens
gaggggctggctgtggtcccat

SEQ ID NO: 7077814 - DNA, 22 bp, Homo sapiens
gaggcagtaattgtgggcaata

SEQ ID NO: 7077815 - DNA, 22 bp, Homo sapiens
gaggcagtccagtgggtaagaa

SEQ ID NO: 7077816 - DNA, 22 bp, Homo sapiens
gagctgaggatacatcagtgaa

SEQ ID NO: 7077817 - DNA, 22 bp, Homo sapiens
gagctgagggtctaggagggtt

SEQ ID NO: 7077818 - DNA, 22 bp, Homo sapiens
gagctgagtagaggctgctccc

SEQ ID NO: 7077819 - DNA, 22 bp, Homo sapiens
gagctgaggtgatgtggtcgtt

SEQ ID NO: 7077820 - DNA, 22 bp, Homo sapiens
gagcatggttccataggttggt

SEQ ID NO: 7077821 - DNA, 22 bp, Homo sapiens
gagaggggcgcgcagctcgcga

SEQ ID NO: 7077822 - DNA, 22 bp, Homo sapiens
cttttcctattgattctgttac

SEQ ID NO: 7077823 - DNA, 22 bp, Homo sapiens
ctttgacctctctgtgcccctc

SEQ ID NO: 7077824 - DNA, 22 bp, Homo sapiens
cttctgggtgtggagtgaggac

SEQ ID NO: 7077825 - DNA, 22 bp, Homo sapiens
cttctcagagcttccagaaaac

SEQ ID NO: 7077826 - DNA, 20 bp, Homo sapiens
ctgtagagcacaagtggagg

SEQ ID NO: 7077827 - DNA, 22 bp, Homo sapiens
ctgtcacctctgccctttgccc

SEQ ID NO: 7077828 - DNA, 22 bp, Homo sapiens
ctcctgctgaatggccaggagc

SEQ ID NO: 7077829 - DNA, 22 bp, Homo sapiens
ctccccaaagataacggcttct

SEQ ID NO: 7077830 - DNA, 22 bp, Homo sapiens
ctccccaaatgggttgagttct

SEQ ID NO: 7077831 - DNA, 22 bp, Homo sapiens
ctccccaactcagccgaggctt

SEQ ID NO: 7077832 - DNA, 22 bp, Homo sapiens
ctccccaagccttggcttctcc

SEQ ID NO: 7077833 - DNA, 22 bp, Homo sapiens
ctccccaagtcatggagccagg

SEQ ID NO: 7077834 - DNA, 22 bp, Homo sapiens
ctccccagctcgcgggtgacgg

SEQ ID NO: 7077835 - DNA, 22 bp, Homo sapiens
ctgcagtgcctgccactgagcc

SEQ ID NO: 7077836 - DNA, 22 bp, Homo sapiens
ctgagctgtcaggaatggaaag

SEQ ID NO: 7077837 - DNA, 22 bp, Homo sapiens
ctgagctgtgctaagtgaaatg

SEQ ID NO: 7077838 - DNA, 21 bp, Homo sapiens
ctgagctggggtgaaggttgc

SEQ ID NO: 7077839 - DNA, 22 bp, Homo sapiens
ctgagctggtggaagcatgcag

SEQ ID NO: 7077840 - DNA, 22 bp, Homo sapiens
ctgagctgggagtggatagtgg

SEQ ID NO: 7077841 - DNA, 22 bp, Homo sapiens
ctgagctgggagcctggcacca

SEQ ID NO: 7077842 - DNA, 22 bp, Homo sapiens
ctgagctgggagtagagactct

SEQ ID NO: 7077843 - DNA, 22 bp, Homo sapiens
ccttctggagggtgtacgagag

SEQ ID NO: 7077844 - DNA, 22 bp, Homo sapiens
cgatgccaatagttttacaggc

SEQ ID NO: 7077845 - DNA, 22 bp, Homo sapiens
cgatgccacggacttgttcctg

SEQ ID NO: 7077846 - DNA, 22 bp, Homo sapiens
cgatgccagtgacaccagaccc

SEQ ID NO: 7077847 - DNA, 22 bp, Homo sapiens
tgttgcccaggttctctcctgc

SEQ ID NO: 7077848 - DNA, 22 bp, Homo sapiens
tgttggcagttggaagggagtg

SEQ ID NO: 7077849 - DNA, 22 bp, Homo sapiens
tgttggcatctctgagagagtt

SEQ ID NO: 7077850 - DNA, 22 bp, Homo sapiens
cctgctccatgctcaccatcag

SEQ ID NO: 7077851 - DNA, 22 bp, Homo sapiens
ttgctgaggacgcagtgcagtg

SEQ ID NO: 7077852 - DNA, 22 bp, Homo sapiens
tgagccagttcttcagatccat

SEQ ID NO: 7077853 - DNA, 22 bp, Homo sapiens
ccagtcccaggcagaaatccag

SEQ ID NO: 7077854 - DNA, 22 bp, Homo sapiens
ccagtcccagctctgccatgct

SEQ ID NO: 7077855 - DNA, 22 bp, Homo sapiens
tgagcccaggagttggagaccg

SEQ ID NO: 7077856 - DNA, 22 bp, Homo sapiens
tgagcccagagcccttgtaggg

SEQ ID NO: 7077857 - DNA, 22 bp, Homo sapiens
tgagcccaggaggcagaggttg

SEQ ID NO: 7077858 - DNA, 22 bp, Homo sapiens
ccagtgcctatctcctctggga

SEQ ID NO: 7077859 - DNA, 22 bp, Homo sapiens
ccagtgcccagtctccctggtc

SEQ ID NO: 7077860 - DNA, 22 bp, Homo sapiens
cccagagatgggaggtgatcgg

SEQ ID NO: 7077861 - DNA, 18 bp, Homo sapiens
cccagaggaatgcctgga

SEQ ID NO: 7077862 - DNA, 22 bp, Homo sapiens
ccaggaggcggaggttgcagtg

SEQ ID NO: 7077863 - DNA, 22 bp, Homo sapiens
ccaggaggctctgcccatccca

SEQ ID NO: 7077864 - DNA, 22 bp, Homo sapiens
ccaggaggctcttgtccctggt

SEQ ID NO: 7077865 - DNA, 22 bp, Homo sapiens
ccaggaggcttcgtccgtggag

SEQ ID NO: 7077866 - DNA, 22 bp, Homo sapiens
cctgagtggcagggtttgggct

SEQ ID NO: 7077867 - DNA, 22 bp, Homo sapiens
cctgagtggccaggcagctgtg

SEQ ID NO: 7077868 - DNA, 17 bp, Homo sapiens
cctgagtgggagaggaa

SEQ ID NO: 7077869 - DNA, 21 bp, Homo sapiens
cctgagtgagacctggcccgt

SEQ ID NO: 7077870 - DNA, 19 bp, Homo sapiens
tggcagtgtggcttccaga

SEQ ID NO: 7077871 - DNA, 19 bp, Homo sapiens
tggcagtgtggggtatgaa

SEQ ID NO: 7077872 - DNA, 22 bp, Homo sapiens
tggcagtgtcctactggttggt

SEQ ID NO: 7077873 - DNA, 22 bp, Homo sapiens
tggcagtgtcttatcaggagtg

SEQ ID NO: 7077874 - DNA, 22 bp, Homo sapiens
tggcacagtgctggatggtgct

SEQ ID NO: 7077875 - DNA, 18 bp, Homo sapiens
cccagtgctcactgcctc

SEQ ID NO: 7077876 - DNA, 22 bp, Homo sapiens
tgctagggatgtagcagtgaag

SEQ ID NO: 7077877 - DNA, 17 bp, Homo sapiens
tgctagggggagagtag

SEQ ID NO: 7077878 - DNA, 22 bp, Homo sapiens
tgctagggatatagtggcgagt

SEQ ID NO: 7077879 - DNA, 22 bp, Homo sapiens
tgctagggatacagtggtgaat

SEQ ID NO: 7077880 - DNA, 23 bp, Homo sapiens
cagggaggagatactgtgtatct

SEQ ID NO: 7077881 - DNA, 22 bp, Homo sapiens
tagcatgtcagtcgccacacgt

SEQ ID NO: 7077882 - DNA, 20 bp, Homo sapiens
catgccagaatgtgaggtag

SEQ ID NO: 7077883 - DNA, 22 bp, Homo sapiens
ttccctgcaacctttccctggg

SEQ ID NO: 7077884 - DNA, 22 bp, Homo sapiens
ttcccccacctggggtacagga

SEQ ID NO: 7077885 - DNA, 21 bp, Homo sapiens
ttccccaaggcctcaggggca

SEQ ID NO: 7077886 - DNA, 22 bp, Homo sapiens
ttccccaggctggagtgcagtg

SEQ ID NO: 7077887 - DNA, 22 bp, Homo sapiens
tcctctccaggtgagccgaaat

SEQ ID NO: 7077888 - DNA, 22 bp, Homo sapiens
ttgtgcccgggcccgggcctct

SEQ ID NO: 7077889 - DNA, 22 bp, Homo sapiens
ttgggctgaagtagagggcaga

SEQ ID NO: 7077890 - DNA, 22 bp, Homo sapiens
ttgccaccgtcatggccattat

SEQ ID NO: 7077891 - DNA, 22 bp, Homo sapiens
tttcctttgtgcaggccttggg

SEQ ID NO: 7077892 - DNA, 22 bp, Homo sapiens
ttttccttcacctcttgagcct

SEQ ID NO: 7077893 - DNA, 18 bp, Homo sapiens
ttttccttccaccttgaa

SEQ ID NO: 7077894 - DNA, 22 bp, Homo sapiens
cagcaaggcattctgtggatta

SEQ ID NO: 7077895 - DNA, 22 bp, Homo sapiens
ggtggggttttaggctgctgca

SEQ ID NO: 7077896 - DNA, 22 bp, Homo sapiens
gggaaggaggtggcttgaagtg

SEQ ID NO: 7077897 - DNA, 22 bp, Homo sapiens
gggaggggttgcatgtttgagt

SEQ ID NO: 7077898 - DNA, 22 bp, Homo sapiens
cagacagggccctgtgatggta

SEQ ID NO: 7077899 - DNA, 22 bp, Homo sapiens
caaggacactgatgttcatcct

SEQ ID NO: 7077900 - DNA, 22 bp, Homo sapiens
gctgcagtgttggacctcaggg

SEQ ID NO: 7077901 - DNA, 22 bp, Homo sapiens
gctgcagtgagccaagatcgtg

SEQ ID NO: 7077902 - DNA, 22 bp, Homo sapiens
ggcataggcactttaatttgga

SEQ ID NO: 7077903 - DNA, 22 bp, Homo sapiens
ggctagggatctagaccaggac

SEQ ID NO: 7077904 - DNA, 22 bp, Homo sapiens
ggcacagggagccgcagttgca

SEQ ID NO: 7077905 - DNA, 22 bp, Homo sapiens
ggcacagggaggccctggtgtg

SEQ ID NO: 7077906 - DNA, 22 bp, Homo sapiens
ggcagcagttacaaatgtgcag

SEQ ID NO: 7077907 - DNA, 22 bp, Homo sapiens
cacagtggattgggtgatgccc

SEQ ID NO: 7077908 - DNA, 22 bp, Homo sapiens
ggagggagtcagctgattagaa

SEQ ID NO: 7077909 - DNA, 22 bp, Homo sapiens
gccaggaggggagagtgtgtca

SEQ ID NO: 7077910 - DNA, 22 bp, Homo sapiens
gcctccagcccacgcaggcctg

SEQ ID NO: 7077911 - DNA, 22 bp, Homo sapiens
gcctctcctggagaaggcaggg

SEQ ID NO: 7077912 - DNA, 22 bp, Homo sapiens
gcagcagggagcaggggtgtca

SEQ ID NO: 7077913 - DNA, 22 bp, Homo sapiens
cttgctggcagtcactgttgcg

SEQ ID NO: 7077914 - DNA, 22 bp, Homo sapiens
gaggccaggggcctggagatga

SEQ ID NO: 7077915 - DNA, 22 bp, Homo sapiens
atgccactgcgctctagcctgg

SEQ ID NO: 7077916 - DNA, 17 bp, Homo sapiens
atccccagcatctagaa

SEQ ID NO: 7077917 - DNA, 22 bp, Homo sapiens
atccctgccctcatggagctta

SEQ ID NO: 7077918 - DNA, 22 bp, Homo sapiens
atccccagggaggcctgacctg

SEQ ID NO: 7077919 - DNA, 22 bp, Homo sapiens
atccccagggagtgagctgtct

SEQ ID NO: 7077920 - DNA, 22 bp, Homo sapiens
agttgttgatgttgcagtcctg

SEQ ID NO: 7077921 - DNA, 22 bp, Homo sapiens
ctctctccttagctgcagacca

SEQ ID NO: 7077922 - DNA, 22 bp, Homo sapiens
ctcttagtaatgccatgaagca

SEQ ID NO: 7077923 - DNA, 22 bp, Homo sapiens
ctcagctgcagcctggctggca

SEQ ID NO: 7077924 - DNA, 20 bp, Homo sapiens
agtgacagagactgtgtggc

SEQ ID NO: 7077925 - DNA, 22 bp, Homo sapiens
aggtgggaacccagcagggccc

SEQ ID NO: 7077926 - DNA, 22 bp, Homo sapiens
cgagcatgatgacggctgtggc

SEQ ID NO: 7077927 - DNA, 22 bp, Homo sapiens
cctctgccacctcccacgaggc

SEQ ID NO: 7077928 - DNA, 20 bp, Homo sapiens
agggtgagacatgagcctcc

SEQ ID NO: 7077929 - DNA, 22 bp, Homo sapiens
aggctgagccacggggctggct

SEQ ID NO: 7077930 - DNA, 22 bp, Homo sapiens
aggctgagcggggtcccagagc

SEQ ID NO: 7077931 - DNA, 23 bp, Homo sapiens
ccagtgagcatggctgtgttcca

SEQ ID NO: 7077932 - DNA, 22 bp, Homo sapiens
ccctgttgggaagagagatggc

SEQ ID NO: 7077933 - DNA, 19 bp, Homo sapiens
ccccagggtaggctagggg

SEQ ID NO: 7077934 - DNA, 19 bp, Homo sapiens
agggaaggattctgtcatt

SEQ ID NO: 7077935 - DNA, 22 bp, Homo sapiens
agggaagaatcactgggatgtt

SEQ ID NO: 7077936 - DNA, 22 bp, Homo sapiens
agggaaggaaaagctgtcgctt

SEQ ID NO: 7077937 - DNA, 22 bp, Homo sapiens
agggaaggaggccatgtgtccc

SEQ ID NO: 7077938 - DNA, 22 bp, Homo sapiens
agggaagggcagggtctatgca

SEQ ID NO: 7077939 - DNA, 22 bp, Homo sapiens
agggaaggtagaggtcaccggc

SEQ ID NO: 7077940 - DNA, 22 bp, Homo sapiens
aggctgttctaggagagtggga

SEQ ID NO: 7077941 - DNA, 22 bp, Homo sapiens
aggctgttgagccccagcaagt

SEQ ID NO: 7077942 - DNA, 22 bp, Homo sapiens
aggctgttgcatgccacagata

SEQ ID NO: 7077943 - DNA, 22 bp, Homo sapiens
agctgttggagtaaagcactta

SEQ ID NO: 7077944 - DNA, 22 bp, Homo sapiens
agctgttgttaattaactcatt

SEQ ID NO: 7077945 - DNA, 22 bp, Homo sapiens
agctggcattacaggagcatgc

SEQ ID NO: 7077946 - DNA, 22 bp, Homo sapiens
catgccagggcttgctgcctgg

SEQ ID NO: 7077947 - DNA, 22 bp, Homo sapiens
catgccaggattaggacccagc

SEQ ID NO: 7077948 - DNA, 23 bp, Homo sapiens
catgccagtttgtgcaggcagat

SEQ ID NO: 7077949 - DNA, 22 bp, Homo sapiens
aggaggaggtaagaaaagcata

SEQ ID NO: 7077950 - DNA, 22 bp, Homo sapiens
aggaaggactgcagcatttggt

SEQ ID NO: 7077951 - DNA, 22 bp, Homo sapiens
agagtggggaaggtgttgagaa

SEQ ID NO: 7077952 - DNA, 22 bp, Homo sapiens
agagtggggacagggcctgtcc

SEQ ID NO: 7077953 - DNA, 22 bp, Homo sapiens
agagtgggcctagctgtaaaag

SEQ ID NO: 7077954 - DNA, 22 bp, Homo sapiens
agagtgggacacgggcgctgtc

SEQ ID NO: 7077955 - DNA, 22 bp, Homo sapiens
agcagaagaggtcttgttgctg

SEQ ID NO: 7077956 - DNA, 22 bp, Homo sapiens
cagccagaggctgcgaggggcc

SEQ ID NO: 7077957 - DNA, 22 bp, Homo sapiens
cagccagatcagggcaggggtt

SEQ ID NO: 7077958 - DNA, 22 bp, Homo sapiens
cagccagagaaagggcactgcc

SEQ ID NO: 7077959 - DNA, 22 bp, Homo sapiens
cagaaggagcgctaaggtccca

SEQ ID NO: 7077960 - DNA, 17 bp, Homo sapiens
cagaaggaagcatggca

SEQ ID NO: 7077961 - DNA, 22 bp, Homo sapiens
agccaggatggtctcgatcggc

SEQ ID NO: 7077962 - DNA, 22 bp, Homo sapiens
agtggctgatgtaggcagtggg

SEQ ID NO: 7077963 - DNA, 22 bp, Homo sapiens
aggctgagggctcctgagggca

SEQ ID NO: 7077964 - DNA, 22 bp, Homo sapiens
aggctgagtgctcccctagatg

SEQ ID NO: 7077965 - DNA, 22 bp, Homo sapiens
aggcaggggagctggaagggta

SEQ ID NO: 7077966 - DNA, 22 bp, Homo sapiens
agggcctggtgacctgggtcct

SEQ ID NO: 7077967 - DNA, 22 bp, Homo sapiens
agctgggggttggataagggta

SEQ ID NO: 7077968 - DNA, 22 bp, Homo sapiens
aggcagcatgggcccagagtcc

SEQ ID NO: 7077969 - DNA, 22 bp, Homo sapiens
aggcagcattcaggggtgatga

SEQ ID NO: 7077970 - DNA, 22 bp, Homo sapiens
acaggtgtaatttgcccgaggt

SEQ ID NO: 7077971 - DNA, 22 bp, Homo sapiens
agaggccctctctgctcagtct

SEQ ID NO: 7077972 - DNA, 22 bp, Homo sapiens
agcagctggttcccgagggcgt

SEQ ID NO: 7077973 - DNA, 22 bp, Homo sapiens
aaggaggaattctgagttcatg

SEQ ID NO: 7077974 - DNA, 20 bp, Homo sapiens
aaggcagagtgggttggagc

SEQ ID NO: 7077975 - DNA, 22 bp, Homo sapiens
actgagtggctggggagtggca

SEQ ID NO: 7077976 - DNA, 22 bp, Homo sapiens
actgagtgtccactatgagcca

SEQ ID NO: 7077977 - DNA, 22 bp, Homo sapiens
gtgggatggtaggtaggtaata

SEQ ID NO: 7077978 - DNA, 22 bp, Homo sapiens
gtggcccaggctggagtgcagt

SEQ ID NO: 7077979 - DNA, 22 bp, Homo sapiens
gtggcccaggcttggcgctggc

SEQ ID NO: 7077980 - DNA, 22 bp, Homo sapiens
gtggcccaggttggagtgcagt

SEQ ID NO: 7077981 - DNA, 22 bp, Homo sapiens
gtgaccagcccatagagaggcg

SEQ ID NO: 7077982 - DNA, 22 bp, Homo sapiens
gtgaccagttggcaggggtggg

SEQ ID NO: 7077983 - DNA, 22 bp, Homo sapiens
gtgaccagagcgggagattggg

SEQ ID NO: 7077984 - DNA, 20 bp, Homo sapiens
gtgaccagaagacagtgggt

SEQ ID NO: 7077985 - DNA, 22 bp, Homo sapiens
gtgcggatgaggaggttgaacc

SEQ ID NO: 7077986 - DNA, 22 bp, Homo sapiens
gtggcagagggtgagctggact

SEQ ID NO: 7077987 - DNA, 22 bp, Homo sapiens
gtggcagaggctctgggaccag

SEQ ID NO: 7077988 - DNA, 22 bp, Homo sapiens
gtggagggtgattgccggctgt

SEQ ID NO: 7077989 - DNA, 18 bp, Homo sapiens
gtggatgcattgggaggg

SEQ ID NO: 7077990 - DNA, 22 bp, Homo sapiens
gtggatgcttaggcagcctggg

SEQ ID NO: 7077991 - DNA, 22 bp, Homo sapiens
gtggagtggtgatggataggtt

SEQ ID NO: 7077992 - DNA, 22 bp, Homo sapiens
gtggagtgcaacggttggagtt

SEQ ID NO: 7077993 - DNA, 22 bp, Homo sapiens
gtctggctccgaggagtggcag

SEQ ID NO: 7077994 - DNA, 22 bp, Homo sapiens
gtctggctctggaaggcaaagg

SEQ ID NO: 7077995 - DNA, 22 bp, Homo sapiens
gttgttcagcctagagtgcagt

SEQ ID NO: 7077996 - DNA, 22 bp, Homo sapiens
gtgtgcaggtgtcagtgcagct

SEQ ID NO: 7077997 - DNA, 22 bp, Homo sapiens
gtgtgcagggggccagcgcagc

SEQ ID NO: 7077998 - DNA, 22 bp, Homo sapiens
gtgtgcagggatgagtgcaggt

SEQ ID NO: 7077999 - DNA, 22 bp, Homo sapiens
gtgtgcagaggcaggaggtgct

SEQ ID NO: 7078000 - DNA, 22 bp, Homo sapiens
gtgtgcagaacagggagtgggt

SEQ ID NO: 7078001 - DNA, 22 bp, Homo sapiens
gtgtgagccatgatgtgtccag

SEQ ID NO: 7078002 - DNA, 22 bp, Homo sapiens
gtgtcagctaatttgggagctc

SEQ ID NO: 7078003 - DNA, 22 bp, Homo sapiens
gtggggaggcctaagcaagttg

SEQ ID NO: 7078004 - DNA, 22 bp, Homo sapiens
gtgggggatgctgagttggaaa

SEQ ID NO: 7078005 - DNA, 22 bp, Homo sapiens
gtgggcttcccttaagccagag

SEQ ID NO: 7078006 - DNA, 18 bp, Homo sapiens
ggctcagcaggctctctc

SEQ ID NO: 7078007 - DNA, 22 bp, Homo sapiens
ggctcagcttatctgggcaggc

SEQ ID NO: 7078008 - DNA, 22 bp, Homo sapiens
ggcctgggcccactgtcaagag

SEQ ID NO: 7078009 - DNA, 22 bp, Homo sapiens
ggctgagttgagaggattactt

SEQ ID NO: 7078010 - DNA, 22 bp, Homo sapiens
gggaagagaccgtaccctggcc

SEQ ID NO: 7078011 - DNA, 22 bp, Homo sapiens
gggtgggaacaggatgccagga

SEQ ID NO: 7078012 - DNA, 22 bp, Homo sapiens
gggggtgacgatggcagctggt

SEQ ID NO: 7078013 - DNA, 22 bp, Homo sapiens
ggggacagtcgatctagtgatt

SEQ ID NO: 7078014 - DNA, 22 bp, Homo sapiens
ggggaagggagtccaagtgtta

SEQ ID NO: 7078015 - DNA, 22 bp, Homo sapiens
gggctgagacgatggggtcttc

SEQ ID NO: 7078016 - DNA, 19 bp, Homo sapiens
gggcccagcatggagggtt

SEQ ID NO: 7078017 - DNA, 22 bp, Homo sapiens
gggcagcacgtttcaggaggat

SEQ ID NO: 7078018 - DNA, 22 bp, Homo sapiens
gggcagcagaattggacagaaa

SEQ ID NO: 7078019 - DNA, 22 bp, Homo sapiens
gggcagcaaatctgagtctggt

SEQ ID NO: 7078020 - DNA, 22 bp, Homo sapiens
gggcagcacagacagtgaaggc

SEQ ID NO: 7078021 - DNA, 22 bp, Homo sapiens
gggagggaaagcttgatctgtc

SEQ ID NO: 7078022 - DNA, 22 bp, Homo sapiens
gggaggaggaatgttttgtgta

SEQ ID NO: 7078023 - DNA, 22 bp, Homo sapiens
gggaggagggtgctggctaaac

SEQ ID NO: 7078024 - DNA, 22 bp, Homo sapiens
ggcagaggaagctggaagtggg

SEQ ID NO: 7078025 - DNA, 19 bp, Homo sapiens
ggagtgggtagttagtggt

SEQ ID NO: 7078026 - DNA, 22 bp, Homo sapiens
ggaggtagcctcaaaagcagct

SEQ ID NO: 7078027 - DNA, 22 bp, Homo sapiens
ggaggggtctctagcgaggaga

SEQ ID NO: 7078028 - DNA, 22 bp, Homo sapiens
ggagggggactgacactgattt

SEQ ID NO: 7078029 - DNA, 22 bp, Homo sapiens
ggaggggtggaaggagtgcctg

SEQ ID NO: 7078030 - DNA, 22 bp, Homo sapiens
ggaggggctcctgttcgccccc

SEQ ID NO: 7078031 - DNA, 22 bp, Homo sapiens
ggagggggaattcagccccagc

SEQ ID NO: 7078032 - DNA, 20 bp, Homo sapiens
ggagggcagctgagagttgg

SEQ ID NO: 7078033 - DNA, 22 bp, Homo sapiens
ggagggccctgggtgcagctct

SEQ ID NO: 7078034 - DNA, 22 bp, Homo sapiens
ggaagggcaaaagagatgaact

SEQ ID NO: 7078035 - DNA, 22 bp, Homo sapiens
ggaggaagcacacggcttgtat

SEQ ID NO: 7078036 - DNA, 22 bp, Homo sapiens
ggaggaagaggttgttctctca

SEQ ID NO: 7078037 - DNA, 22 bp, Homo sapiens
ggagctgaaggggtgggctcag

SEQ ID NO: 7078038 - DNA, 22 bp, Homo sapiens
ggagctgagcagcgatggcgga

SEQ ID NO: 7078039 - DNA, 22 bp, Homo sapiens
ggagctgaggtaacagtgagtg

SEQ ID NO: 7078040 - DNA, 22 bp, Homo sapiens
ggaggaggcggcagaagttcct

SEQ ID NO: 7078041 - DNA, 22 bp, Homo sapiens
ggaggcagaatagagtgtgggt

SEQ ID NO: 7078042 - DNA, 22 bp, Homo sapiens
ggagagggggctccctgcttgg

SEQ ID NO: 7078043 - DNA, 22 bp, Homo sapiens
ggagagggtaggggtcctgccc

SEQ ID NO: 7078044 - DNA, 22 bp, Homo sapiens
gctctgagtaaatgaaagcatt

SEQ ID NO: 7078045 - DNA, 22 bp, Homo sapiens
gctctgagcagggagaaacagg

SEQ ID NO: 7078046 - DNA, 22 bp, Homo sapiens
gctctgagcccccagaagcaga

SEQ ID NO: 7078047 - DNA, 22 bp, Homo sapiens
gctgagcacagcaaagagacaa

SEQ ID NO: 7078048 - DNA, 22 bp, Homo sapiens
gctgagctgaggcagggctggg

SEQ ID NO: 7078049 - DNA, 22 bp, Homo sapiens
gctgagctagaaaaggaccaca

SEQ ID NO: 7078050 - DNA, 22 bp, Homo sapiens
gcagggggatggagttgaaatg

SEQ ID NO: 7078051 - DNA, 18 bp, Homo sapiens
gcagctgacactggagtt

SEQ ID NO: 7078052 - DNA, 22 bp, Homo sapiens
gcagtggggcgctgggagttgg

SEQ ID NO: 7078053 - DNA, 22 bp, Homo sapiens
gatgggtggtctcagacttgcc

SEQ ID NO: 7078054 - DNA, 22 bp, Homo sapiens
gatggggtccttgacctggcca

SEQ ID NO: 7078055 - DNA, 22 bp, Homo sapiens
gatgcctgtggtgagcacacat

SEQ ID NO: 7078056 - DNA, 22 bp, Homo sapiens
gcagaaggatccgcaggtgcaa

SEQ ID NO: 7078057 - DNA, 22 bp, Homo sapiens
gatgaagtcagttagtgggaaa

SEQ ID NO: 7078058 - DNA, 22 bp, Homo sapiens
gagtgggtaccggagcaggtgc

SEQ ID NO: 7078059 - DNA, 22 bp, Homo sapiens
gagtggggtctgggcatcagtc

SEQ ID NO: 7078060 - DNA, 22 bp, Homo sapiens
gagtgagggcagcaggggctgc

SEQ ID NO: 7078061 - DNA, 22 bp, Homo sapiens
gagtgcagttggggtgagggga

SEQ ID NO: 7078062 - DNA, 22 bp, Homo sapiens
gagtggagcaaaagaggtagat

SEQ ID NO: 7078063 - DNA, 22 bp, Homo sapiens
gagtggggctttaaaggctcag

SEQ ID NO: 7078064 - DNA, 22 bp, Homo sapiens
gagtggctgagtaagaggggag

SEQ ID NO: 7078065 - DNA, 22 bp, Homo sapiens
gaggggcaggattattgggatt

SEQ ID NO: 7078066 - DNA, 22 bp, Homo sapiens
gaggggcacagtaaagggtccc

SEQ ID NO: 7078067 - DNA, 22 bp, Homo sapiens
gaggggcacagcagctgttgca

SEQ ID NO: 7078068 - DNA, 22 bp, Homo sapiens
gaggggcaagaagttggcctct

SEQ ID NO: 7078069 - DNA, 22 bp, Homo sapiens
gagctggaggcagtgctgaggt

SEQ ID NO: 7078070 - DNA, 22 bp, Homo sapiens
gagagtggatggagctgcgaag

SEQ ID NO: 7078071 - DNA, 22 bp, Homo sapiens
gagagtggaaagcaagctgagt

SEQ ID NO: 7078072 - DNA, 22 bp, Homo sapiens
gagatatgttggcagctggtat

SEQ ID NO: 7078073 - DNA, 22 bp, Homo sapiens
gaggaagtttacaaagcatctg

SEQ ID NO: 7078074 - DNA, 22 bp, Homo sapiens
gaggacagcttagggcttcctg

SEQ ID NO: 7078075 - DNA, 22 bp, Homo sapiens
gaggaggtctcctccgcagggg

SEQ ID NO: 7078076 - DNA, 22 bp, Homo sapiens
gaggaggtggaattccaggaat

SEQ ID NO: 7078077 - DNA, 22 bp, Homo sapiens
gaggagggagctggaagctctt

SEQ ID NO: 7078078 - DNA, 22 bp, Homo sapiens
cttggctgggaactgtgattca

SEQ ID NO: 7078079 - DNA, 17 bp, Homo sapiens
cttggctgctgtgcgat

SEQ ID NO: 7078080 - DNA, 22 bp, Homo sapiens
gaaggaagtcattagtgcagac

SEQ ID NO: 7078081 - DNA, 20 bp, Homo sapiens
gaaggaagggggcaaggtga

SEQ ID NO: 7078082 - DNA, 22 bp, Homo sapiens
gaaggaagctgtctggatgtgt

SEQ ID NO: 7078083 - DNA, 22 bp, Homo sapiens
gaaggagaggattgtgaggctg

SEQ ID NO: 7078084 - DNA, 22 bp, Homo sapiens
gagagctgatagatgagctact

SEQ ID NO: 7078085 - DNA, 22 bp, Homo sapiens
ttggatgagagggtgtggtaca

SEQ ID NO: 7078086 - DNA, 22 bp, Homo sapiens
ttgacctgggcacagtgagcat

SEQ ID NO: 7078087 - DNA, 22 bp, Homo sapiens
ttccttctaattttacacctga

SEQ ID NO: 7078088 - DNA, 22 bp, Homo sapiens
ctggcccagagagcagagctta

SEQ ID NO: 7078089 - DNA, 22 bp, Homo sapiens
ctggagtgtaaagagcatagaa

SEQ ID NO: 7078090 - DNA, 22 bp, Homo sapiens
ctggaggcacccttagagaggc

SEQ ID NO: 7078091 - DNA, 22 bp, Homo sapiens
cccccagccagcagtgctcagc

SEQ ID NO: 7078092 - DNA, 22 bp, Homo sapiens
cccccagtctgaacagcagctg

SEQ ID NO: 7078093 - DNA, 22 bp, Homo sapiens
ccccagctcagtgcagggacat

SEQ ID NO: 7078094 - DNA, 22 bp, Homo sapiens
tgctgcagatcagctgagtcct

SEQ ID NO: 7078095 - DNA, 22 bp, Homo sapiens
tggcacagtcctgggtgcctgc

SEQ ID NO: 7078096 - DNA, 20 bp, Homo sapiens
ccctccagcaaccaggactt

SEQ ID NO: 7078097 - DNA, 22 bp, Homo sapiens
ccctccagagcttgacctgctg

SEQ ID NO: 7078098 - DNA, 22 bp, Homo sapiens
tggatgaggctgggttaggcag

SEQ ID NO: 7078099 - DNA, 22 bp, Homo sapiens
tggatgagggctgagcactggg

SEQ ID NO: 7078100 - DNA, 22 bp, Homo sapiens
tggatgagattaaagtgaggtt

SEQ ID NO: 7078101 - DNA, 22 bp, Homo sapiens
tggatgagaaactctggtgact

SEQ ID NO: 7078102 - DNA, 22 bp, Homo sapiens
tggatgagttcaatgaggcaga

SEQ ID NO: 7078103 - DNA, 22 bp, Homo sapiens
cctctcagccggactgtcaggc

SEQ ID NO: 7078104 - DNA, 22 bp, Homo sapiens
tgtcctggatcatgcctctgaa

SEQ ID NO: 7078105 - DNA, 22 bp, Homo sapiens
cctggcagactgtgagggcagg

SEQ ID NO: 7078106 - DNA, 22 bp, Homo sapiens
cctggcagacagcactgaagct

SEQ ID NO: 7078107 - DNA, 22 bp, Homo sapiens
tgtgagcttaggacagggctat

SEQ ID NO: 7078108 - DNA, 22 bp, Homo sapiens
tgtgagcagctctgtggactca

SEQ ID NO: 7078109 - DNA, 22 bp, Homo sapiens
tgtgaggcctagacagcctggg

SEQ ID NO: 7078110 - DNA, 22 bp, Homo sapiens
tgtgcccattacacagaggcat

SEQ ID NO: 7078111 - DNA, 20 bp, Homo sapiens
tgtgcccaatgtccaggttc

SEQ ID NO: 7078112 - DNA, 22 bp, Homo sapiens
cctggggctccagagcagcgga

SEQ ID NO: 7078113 - DNA, 22 bp, Homo sapiens
gtggcagaaactggcagaggag

SEQ ID NO: 7078114 - DNA, 22 bp, Homo sapiens
gtggcagagcaggagacaggac

SEQ ID NO: 7078115 - DNA, 22 bp, Homo sapiens
gtggcagagaacaaggagaggt

SEQ ID NO: 7078116 - DNA, 22 bp, Homo sapiens
gtggcagaagagtaggatgggc

SEQ ID NO: 7078117 - DNA, 22 bp, Homo sapiens
gtggggatcactggggacaatc

SEQ ID NO: 7078118 - DNA, 21 bp, Homo sapiens
gtgtggatatgtgacaggtgg

SEQ ID NO: 7078119 - DNA, 22 bp, Homo sapiens
cagctgtgagagtgcattgaag

SEQ ID NO: 7078120 - DNA, 22 bp, Homo sapiens
gtgtagagtgacaaggtgggaa

SEQ ID NO: 7078121 - DNA, 22 bp, Homo sapiens
gtgtgagcacactcgggccagc

SEQ ID NO: 7078122 - DNA, 22 bp, Homo sapiens
caggagtgttgattgctcagga

SEQ ID NO: 7078123 - DNA, 22 bp, Homo sapiens
caggagtggtgtgagggactcc

SEQ ID NO: 7078124 - DNA, 20 bp, Homo sapiens
caggagggacatttcagcat

SEQ ID NO: 7078125 - DNA, 23 bp, Homo sapiens
caggagggaatgaagttagacaa

SEQ ID NO: 7078126 - DNA, 22 bp, Homo sapiens
caggaggcagtgggtgttgtct

SEQ ID NO: 7078127 - DNA, 22 bp, Homo sapiens
caggaaggaaagggtgtggaga

SEQ ID NO: 7078128 - DNA, 22 bp, Homo sapiens
ccacaagtttcagcacccagag

SEQ ID NO: 7078129 - DNA, 22 bp, Homo sapiens
tccctgctttcttgtgagggga

SEQ ID NO: 7078130 - DNA, 15 bp, Homo sapiens
tccctgctggtcaaa

SEQ ID NO: 7078131 - DNA, 22 bp, Homo sapiens
tccctgcttgctctcagccctt

SEQ ID NO: 7078132 - DNA, 22 bp, Homo sapiens
tccctgctgggagatgacctta

SEQ ID NO: 7078133 - DNA, 22 bp, Homo sapiens
tccctgcttggaatgaccctta

SEQ ID NO: 7078134 - DNA, 21 bp, Homo sapiens
tccctgctttctggcccagtc

SEQ ID NO: 7078135 - DNA, 22 bp, Homo sapiens
tccctgctgcactcacacctac

SEQ ID NO: 7078136 - DNA, 22 bp, Homo sapiens
tccctgctaattggaatgtata

SEQ ID NO: 7078137 - DNA, 22 bp, Homo sapiens
tccctgctcagctcacctggca

SEQ ID NO: 7078138 - DNA, 22 bp, Homo sapiens
tccctgctgagagtgctctccc

SEQ ID NO: 7078139 - DNA, 22 bp, Homo sapiens
ccaggaggcggaggttgcagcg

SEQ ID NO: 7078140 - DNA, 22 bp, Homo sapiens
ccaggaggcggaaggtacagtg

SEQ ID NO: 7078141 - DNA, 22 bp, Homo sapiens
ccaggaggcagaggttacagtg

SEQ ID NO: 7078142 - DNA, 22 bp, Homo sapiens
ccaggaggcagaagttgcagtg

SEQ ID NO: 7078143 - DNA, 22 bp, Homo sapiens
ccaggaggcaatatcaagtcca

SEQ ID NO: 7078144 - DNA, 22 bp, Homo sapiens
ccaggaagcggtgagggctgcc

SEQ ID NO: 7078145 - DNA, 22 bp, Homo sapiens
ccaggaagctgtctgatatgaa

SEQ ID NO: 7078146 - DNA, 22 bp, Homo sapiens
ccaggaagcataatgtagtggg

SEQ ID NO: 7078147 - DNA, 22 bp, Homo sapiens
ccaggaagcctcagatgctgag

SEQ ID NO: 7078148 - DNA, 22 bp, Homo sapiens
ccaggaagacacatgctcatcc

SEQ ID NO: 7078149 - DNA, 22 bp, Homo sapiens
tctgagtgagcacatggttaga

SEQ ID NO: 7078150 - DNA, 22 bp, Homo sapiens
tctgagtgagggtgtgagatat

SEQ ID NO: 7078151 - DNA, 19 bp, Homo sapiens
tctgagtgagggttatcct

SEQ ID NO: 7078152 - DNA, 22 bp, Homo sapiens
tctgagtgagtgtaggcctgac

SEQ ID NO: 7078153 - DNA, 22 bp, Homo sapiens
tctgagtgatcagatgcattgc

SEQ ID NO: 7078154 - DNA, 22 bp, Homo sapiens
tctgagtgatgttgagtcagaa

SEQ ID NO: 7078155 - DNA, 22 bp, Homo sapiens
tctgagtgcactaggaggggca

SEQ ID NO: 7078156 - DNA, 22 bp, Homo sapiens
catccccagagcagttccacta

SEQ ID NO: 7078157 - DNA, 22 bp, Homo sapiens
tcagaagggaaacacaagtgac

SEQ ID NO: 7078158 - DNA, 22 bp, Homo sapiens
tcagaaggtacagaagggaggt

SEQ ID NO: 7078159 - DNA, 23 bp, Homo sapiens
tcagaaggtgccactgacgcttt

SEQ ID NO: 7078160 - DNA, 22 bp, Homo sapiens
tcagaaggtggaggttgcagtg

SEQ ID NO: 7078161 - DNA, 22 bp, Homo sapiens
tcagaaggtttttagcaaagga

SEQ ID NO: 7078162 - DNA, 22 bp, Homo sapiens
cagggtggaagctgtagagtgg

SEQ ID NO: 7078163 - DNA, 22 bp, Homo sapiens
cagtgaggtggatggatggcct

SEQ ID NO: 7078164 - DNA, 22 bp, Homo sapiens
cagtgaggtgcccagcctgccc

SEQ ID NO: 7078165 - DNA, 22 bp, Homo sapiens
cagtgaggtagacagctttttc

SEQ ID NO: 7078166 - DNA, 22 bp, Homo sapiens
tcagaaggaagttagagtatgg

SEQ ID NO: 7078167 - DNA, 22 bp, Homo sapiens
tcagaaggatgtgcaggtggca

SEQ ID NO: 7078168 - DNA, 19 bp, Homo sapiens
tcagaaggcaggagaggcc

SEQ ID NO: 7078169 - DNA, 22 bp, Homo sapiens
tcagaaggcccgttgctaagag

SEQ ID NO: 7078170 - DNA, 22 bp, Homo sapiens
tgtgccctcagaagagtacatc

SEQ ID NO: 7078171 - DNA, 22 bp, Homo sapiens
tgtggggacccatgccatgggc

SEQ ID NO: 7078172 - DNA, 22 bp, Homo sapiens
tgtgtggattcatctcaaagag

SEQ ID NO: 7078173 - DNA, 20 bp, Homo sapiens
tgtttgtgtggggccttggc

SEQ ID NO: 7078174 - DNA, 22 bp, Homo sapiens
tggtgagcgatgctgcatgttc

SEQ ID NO: 7078175 - DNA, 22 bp, Homo sapiens
tggtgagctggaaggggctttg

SEQ ID NO: 7078176 - DNA, 22 bp, Homo sapiens
tggtggcagcaggagggcccct

SEQ ID NO: 7078177 - DNA, 22 bp, Homo sapiens
tggtggcagctgggacagaggt

SEQ ID NO: 7078178 - DNA, 22 bp, Homo sapiens
tggtggcaaggtgataagtggg

SEQ ID NO: 7078179 - DNA, 23 bp, Homo sapiens
tggtggcagaagtagcagatgac

SEQ ID NO: 7078180 - DNA, 22 bp, Homo sapiens
tggtggcaaagtacaaagtgac

SEQ ID NO: 7078181 - DNA, 17 bp, Homo sapiens
tgtaagcaggtgagaga

SEQ ID NO: 7078182 - DNA, 19 bp, Homo sapiens
tgtccctggtcaccagact

SEQ ID NO: 7078183 - DNA, 22 bp, Homo sapiens
tgtccctgctgtacttagagca

SEQ ID NO: 7078184 - DNA, 22 bp, Homo sapiens
tgtccccagagcctgttcctgc

SEQ ID NO: 7078185 - DNA, 22 bp, Homo sapiens
tgtccccattctaagaggtggc

SEQ ID NO: 7078186 - DNA, 22 bp, Homo sapiens
tgtcctggtgctccaggtggct

SEQ ID NO: 7078187 - DNA, 22 bp, Homo sapiens
tgtatgaggcatacatcaggca

SEQ ID NO: 7078188 - DNA, 22 bp, Homo sapiens
tgtagatgagtcagggtgcacc

SEQ ID NO: 7078189 - DNA, 22 bp, Homo sapiens
tgtagatgagtcagggtgcatg

SEQ ID NO: 7078190 - DNA, 22 bp, Homo sapiens
tgggggagctcagtccagccca

SEQ ID NO: 7078191 - DNA, 22 bp, Homo sapiens
tgggggagcgacagacataatt

SEQ ID NO: 7078192 - DNA, 22 bp, Homo sapiens
tgggggagccttcacagtagct

SEQ ID NO: 7078193 - DNA, 22 bp, Homo sapiens
tgggggagtatagtctggcctc

SEQ ID NO: 7078194 - DNA, 22 bp, Homo sapiens
tgggggcatggaccagcctggc

SEQ ID NO: 7078195 - DNA, 22 bp, Homo sapiens
tgggggcagccaggctgtcaag

SEQ ID NO: 7078196 - DNA, 17 bp, Homo sapiens
tgggggcgccagggtct

SEQ ID NO: 7078197 - DNA, 22 bp, Homo sapiens
tgggggagattgtgcatctcta

SEQ ID NO: 7078198 - DNA, 22 bp, Homo sapiens
tgggggagattagagcttctta

SEQ ID NO: 7078199 - DNA, 22 bp, Homo sapiens
tgggggagatagagtctgatgg

SEQ ID NO: 7078200 - DNA, 22 bp, Homo sapiens
tgggggagagtttagatgattt

SEQ ID NO: 7078201 - DNA, 22 bp, Homo sapiens
tgggggagagtgcaagcatgaa

SEQ ID NO: 7078202 - DNA, 22 bp, Homo sapiens
tggggctcctcctggcaggagg

SEQ ID NO: 7078203 - DNA, 22 bp, Homo sapiens
tggggctcatgcctgctggaac

SEQ ID NO: 7078204 - DNA, 22 bp, Homo sapiens
tggggatgtaaatgaggtgata

SEQ ID NO: 7078205 - DNA, 22 bp, Homo sapiens
tggggatgtagaaatgaacaac

SEQ ID NO: 7078206 - DNA, 22 bp, Homo sapiens
tgggctgtccagcacctgggct

SEQ ID NO: 7078207 - DNA, 22 bp, Homo sapiens
tgggcttaggtcggaggcggcc

SEQ ID NO: 7078208 - DNA, 22 bp, Homo sapiens
tgggctgaaatgctgtggacta

SEQ ID NO: 7078209 - DNA, 22 bp, Homo sapiens
tgggatgagaagtgcgagggtt

SEQ ID NO: 7078210 - DNA, 22 bp, Homo sapiens
tgggatagattgatggatagag

SEQ ID NO: 7078211 - DNA, 22 bp, Homo sapiens
tggctgagtgttccaaggagca

SEQ ID NO: 7078212 - DNA, 21 bp, Homo sapiens
tggcacagcaagtgggctcat

SEQ ID NO: 7078213 - DNA, 22 bp, Homo sapiens
tggcaaaggggaccatgttgaa

SEQ ID NO: 7078214 - DNA, 22 bp, Homo sapiens
tggcactatggatgagactgat

SEQ ID NO: 7078215 - DNA, 22 bp, Homo sapiens
tggcagcagccatggaaggccc

SEQ ID NO: 7078216 - DNA, 22 bp, Homo sapiens
tggcagcagacatctgaggtct

SEQ ID NO: 7078217 - DNA, 22 bp, Homo sapiens
tggcagccttctctgagaaggt

SEQ ID NO: 7078218 - DNA, 22 bp, Homo sapiens
tggcaggaaaaagggccagagg

SEQ ID NO: 7078219 - DNA, 22 bp, Homo sapiens
tggcccagtgcttatgctctga

SEQ ID NO: 7078220 - DNA, 22 bp, Homo sapiens
tggcccagctgcagatggtgga

SEQ ID NO: 7078221 - DNA, 22 bp, Homo sapiens
tggcccagagcactgctgggca

SEQ ID NO: 7078222 - DNA, 18 bp, Homo sapiens
tggcataaaatcagagtc

SEQ ID NO: 7078223 - DNA, 22 bp, Homo sapiens
tggcagtggctcagagtgcaga

SEQ ID NO: 7078224 - DNA, 17 bp, Homo sapiens
tggcatgagggtgtggg

SEQ ID NO: 7078225 - DNA, 22 bp, Homo sapiens
tggcatgagggaagtttgtggc

SEQ ID NO: 7078226 - DNA, 19 bp, Homo sapiens
tggcatgatgatggatggg

SEQ ID NO: 7078227 - DNA, 22 bp, Homo sapiens
tggcatgataggaggtgcagaa

SEQ ID NO: 7078228 - DNA, 18 bp, Homo sapiens
tggcagtgaggtaggcat

SEQ ID NO: 7078229 - DNA, 22 bp, Homo sapiens
tggcagtgatgcggcaggacat

SEQ ID NO: 7078230 - DNA, 22 bp, Homo sapiens
tggcagtgatgcttatggtttg

SEQ ID NO: 7078231 - DNA, 22 bp, Homo sapiens
tgcttctttttatcttggagta

SEQ ID NO: 7078232 - DNA, 22 bp, Homo sapiens
tggacctgagcctggccctgcc

SEQ ID NO: 7078233 - DNA, 22 bp, Homo sapiens
tggaaggagactgggaagtgtg

SEQ ID NO: 7078234 - DNA, 22 bp, Homo sapiens
tggaagggagtgacagtcagag

SEQ ID NO: 7078235 - DNA, 22 bp, Homo sapiens
tggaaggggttacgcagcagga

SEQ ID NO: 7078236 - DNA, 22 bp, Homo sapiens
tggaaggggccaggcgcggagt

SEQ ID NO: 7078237 - DNA, 22 bp, Homo sapiens
tggaaggaacagagtttgaaac

SEQ ID NO: 7078238 - DNA, 22 bp, Homo sapiens
tggaaggaagccaaggaaggtt

SEQ ID NO: 7078239 - DNA, 22 bp, Homo sapiens
tggaaggaaaggtagcagagaa

SEQ ID NO: 7078240 - DNA, 22 bp, Homo sapiens
tggagtgcaatagtaataaggt

SEQ ID NO: 7078241 - DNA, 22 bp, Homo sapiens
tggagcagccttttctaagcaa

SEQ ID NO: 7078242 - DNA, 20 bp, Homo sapiens
tggagagcctctggactgtg

SEQ ID NO: 7078243 - DNA, 22 bp, Homo sapiens
tggagagcagggctggagttca

SEQ ID NO: 7078244 - DNA, 22 bp, Homo sapiens
tgctgcaggtgtgttcagtgag

SEQ ID NO: 7078245 - DNA, 22 bp, Homo sapiens
tgctgagcgcatccggcggccg

SEQ ID NO: 7078246 - DNA, 20 bp, Homo sapiens
tgctgggtgggcagctgtaa

SEQ ID NO: 7078247 - DNA, 22 bp, Homo sapiens
tctttggcatcagggccagcta

SEQ ID NO: 7078248 - DNA, 19 bp, Homo sapiens
tgaagcaggcagagaagat

SEQ ID NO: 7078249 - DNA, 22 bp, Homo sapiens
tgaagcagttctcagaagtggg

SEQ ID NO: 7078250 - DNA, 22 bp, Homo sapiens
tgacctcttgtcggagctccag

SEQ ID NO: 7078251 - DNA, 22 bp, Homo sapiens
tgaccttttagctgagtcccca

SEQ ID NO: 7078252 - DNA, 22 bp, Homo sapiens
tgaagctttaggatgggttcat

SEQ ID NO: 7078253 - DNA, 22 bp, Homo sapiens
tgaggggagaagcagcagcctg

SEQ ID NO: 7078254 - DNA, 22 bp, Homo sapiens
tgaggggagcccgccctggacg

SEQ ID NO: 7078255 - DNA, 22 bp, Homo sapiens
tgaggggagctagcatgccttg

SEQ ID NO: 7078256 - DNA, 22 bp, Homo sapiens
tgaggagtatggtggggtcatt

SEQ ID NO: 7078257 - DNA, 22 bp, Homo sapiens
tgaggagtcgagaaggggtaat

SEQ ID NO: 7078258 - DNA, 22 bp, Homo sapiens
tgaggcagaaaatagcagttca

SEQ ID NO: 7078259 - DNA, 22 bp, Homo sapiens
tgaggcaggactgagcgggatg

SEQ ID NO: 7078260 - DNA, 22 bp, Homo sapiens
tgagctcgagagctttggtcca

SEQ ID NO: 7078261 - DNA, 23 bp, Homo sapiens
tgagctgagtgagttggcctggg

SEQ ID NO: 7078262 - DNA, 22 bp, Homo sapiens
tgagctgataggctgtgagcct

SEQ ID NO: 7078263 - DNA, 22 bp, Homo sapiens
tgagctggagtcgtgagcaaag

SEQ ID NO: 7078264 - DNA, 22 bp, Homo sapiens
tgagctggaggacaggagggta

SEQ ID NO: 7078265 - DNA, 22 bp, Homo sapiens
tgagctggatccaactccgttt

SEQ ID NO: 7078266 - DNA, 22 bp, Homo sapiens
tgagctggagtctgtggctcct

SEQ ID NO: 7078267 - DNA, 22 bp, Homo sapiens
tgagctggtcttgagtgtagct

SEQ ID NO: 7078268 - DNA, 22 bp, Homo sapiens
tgagctggttcttgaggcatga

SEQ ID NO: 7078269 - DNA, 22 bp, Homo sapiens
tgagcttttaatatacaggtgt

SEQ ID NO: 7078270 - DNA, 22 bp, Homo sapiens
tgagctgtggtggggtagagga

SEQ ID NO: 7078271 - DNA, 22 bp, Homo sapiens
tgagctgtgagggtacagatat

SEQ ID NO: 7078272 - DNA, 22 bp, Homo sapiens
tgagctgtcaaggtacagtgaa

SEQ ID NO: 7078273 - DNA, 22 bp, Homo sapiens
tgagcctggggcctgggcagcg

SEQ ID NO: 7078274 - DNA, 22 bp, Homo sapiens
tgagccttcctcagaagctcct

SEQ ID NO: 7078275 - DNA, 22 bp, Homo sapiens
tgagcctgcaataagcacagcc

SEQ ID NO: 7078276 - DNA, 22 bp, Homo sapiens
tgagccagtggaagatggcagt

SEQ ID NO: 7078277 - DNA, 22 bp, Homo sapiens
tgagccagtctgtctgggtgaa

SEQ ID NO: 7078278 - DNA, 22 bp, Homo sapiens
tgagccaggtctcactcacctt

SEQ ID NO: 7078279 - DNA, 22 bp, Homo sapiens
tgagccaggttaagacaggagc

SEQ ID NO: 7078280 - DNA, 22 bp, Homo sapiens
tgagcaggcgcagcaggaggtc

SEQ ID NO: 7078281 - DNA, 22 bp, Homo sapiens
tgagcacactcctggtgagcga

SEQ ID NO: 7078282 - DNA, 19 bp, Homo sapiens
tgagcatgcgagctgagaa

SEQ ID NO: 7078283 - DNA, 22 bp, Homo sapiens
tgagcagggagctgggctgagc

SEQ ID NO: 7078284 - DNA, 22 bp, Homo sapiens
tgagccagagaggttgaggcta

SEQ ID NO: 7078285 - DNA, 22 bp, Homo sapiens
tgagccagagtggagtgtgcct

SEQ ID NO: 7078286 - DNA, 22 bp, Homo sapiens
tgagccagaggaggctgtgtgg

SEQ ID NO: 7078287 - DNA, 22 bp, Homo sapiens
tgagccagcctcagaagtcacg

SEQ ID NO: 7078288 - DNA, 22 bp, Homo sapiens
tgagccagcaggcctccagtgg

SEQ ID NO: 7078289 - DNA, 22 bp, Homo sapiens
tgagccagctccttgcctgtca

SEQ ID NO: 7078290 - DNA, 22 bp, Homo sapiens
tgagccaggagtttgaggctgt

SEQ ID NO: 7078291 - DNA, 22 bp, Homo sapiens
tgagccaggctccatgccacct

SEQ ID NO: 7078292 - DNA, 22 bp, Homo sapiens
tgagccaggctcaagtgatcct

SEQ ID NO: 7078293 - DNA, 20 bp, Homo sapiens
tgagccaggctaggaagggc

SEQ ID NO: 7078294 - DNA, 22 bp, Homo sapiens
tgagccaggcccagtggggtca

SEQ ID NO: 7078295 - DNA, 19 bp, Homo sapiens
tgagccagggaggccatgc

SEQ ID NO: 7078296 - DNA, 22 bp, Homo sapiens
tgagccagggtttccggctgct

SEQ ID NO: 7078297 - DNA, 21 bp, Homo sapiens
tgagccaggctgacggctgtg

SEQ ID NO: 7078298 - DNA, 22 bp, Homo sapiens
tgagacagggtcttgctctgtt

SEQ ID NO: 7078299 - DNA, 22 bp, Homo sapiens
tgagacagtcaccaggcaggcc

SEQ ID NO: 7078300 - DNA, 22 bp, Homo sapiens
tgagacagtcccatgatctgca

SEQ ID NO: 7078301 - DNA, 22 bp, Homo sapiens
tgagaggatattttgggaggat

SEQ ID NO: 7078302 - DNA, 22 bp, Homo sapiens
tgagacagttctgcagctgggt

SEQ ID NO: 7078303 - DNA, 22 bp, Homo sapiens
tgagatgctgggaacaaggaag

SEQ ID NO: 7078304 - DNA, 22 bp, Homo sapiens
tgagatggcaacaccagctttg

SEQ ID NO: 7078305 - DNA, 22 bp, Homo sapiens
tgagatggctgggccccaggag

SEQ ID NO: 7078306 - DNA, 22 bp, Homo sapiens
tgccgtggggctgaggctggag

SEQ ID NO: 7078307 - DNA, 22 bp, Homo sapiens
tgccacccctctgcaccctcag

SEQ ID NO: 7078308 - DNA, 19 bp, Homo sapiens
tgccagcattaggctgaag

SEQ ID NO: 7078309 - DNA, 22 bp, Homo sapiens
tgcaccagagcagggtgcccaa

SEQ ID NO: 7078310 - DNA, 22 bp, Homo sapiens
tgatcttttcaaagacaagctt

SEQ ID NO: 7078311 - DNA, 18 bp, Homo sapiens
tgatctttgagtataatg

SEQ ID NO: 7078312 - DNA, 23 bp, Homo sapiens
tgatgccaagcatggagatacaa

SEQ ID NO: 7078313 - DNA, 22 bp, Homo sapiens
tgatgccaataaaactctccct

SEQ ID NO: 7078314 - DNA, 22 bp, Homo sapiens
tgatgccagtgcttagaccatt

SEQ ID NO: 7078315 - DNA, 22 bp, Homo sapiens
tgatgccatctttccacctata

SEQ ID NO: 7078316 - DNA, 22 bp, Homo sapiens
tgatcccagatctgagagggtt

SEQ ID NO: 7078317 - DNA, 20 bp, Homo sapiens
tgagtgagtttgtggcagga

SEQ ID NO: 7078318 - DNA, 22 bp, Homo sapiens
tgagtgagttttcacggtcagc

SEQ ID NO: 7078319 - DNA, 22 bp, Homo sapiens
tgagtgaggtgcttagggcaca

SEQ ID NO: 7078320 - DNA, 22 bp, Homo sapiens
tgagtgagctggggagccggtg

SEQ ID NO: 7078321 - DNA, 22 bp, Homo sapiens
tgagtggacgtgaggctgagta

SEQ ID NO: 7078322 - DNA, 17 bp, Homo sapiens
tgagtggccgggggaca

SEQ ID NO: 7078323 - DNA, 22 bp, Homo sapiens
tctgttggagcctaggatgaca

SEQ ID NO: 7078324 - DNA, 22 bp, Homo sapiens
tctgagcttactcagggataca

SEQ ID NO: 7078325 - DNA, 22 bp, Homo sapiens
tctgagcttccctctgaggcag

SEQ ID NO: 7078326 - DNA, 22 bp, Homo sapiens
tctgagctgggcacagaaggcg

SEQ ID NO: 7078327 - DNA, 22 bp, Homo sapiens
tctgagctgctaggtatgcatt

SEQ ID NO: 7078328 - DNA, 19 bp, Homo sapiens
tctgagctgatatgacatt

SEQ ID NO: 7078329 - DNA, 22 bp, Homo sapiens
tctgagctccatgcaggaggct

SEQ ID NO: 7078330 - DNA, 22 bp, Homo sapiens
tctgagctcaagtgacagttag

SEQ ID NO: 7078331 - DNA, 22 bp, Homo sapiens
tctgagctatgtaagacttgga

SEQ ID NO: 7078332 - DNA, 22 bp, Homo sapiens
tctgcccactgctctgctgccc

SEQ ID NO: 7078333 - DNA, 19 bp, Homo sapiens
tctgcccagttgtctgccc

SEQ ID NO: 7078334 - DNA, 22 bp, Homo sapiens
tctgcccagtttgtgctcaggt

SEQ ID NO: 7078335 - DNA, 22 bp, Homo sapiens
tctggcagtggatgagggcagc

SEQ ID NO: 7078336 - DNA, 22 bp, Homo sapiens
tctccccagtatggattctctg

SEQ ID NO: 7078337 - DNA, 21 bp, Homo sapiens
tctccccattcttattcccat

SEQ ID NO: 7078338 - DNA, 22 bp, Homo sapiens
tctccccagctgagctgccctt

SEQ ID NO: 7078339 - DNA, 22 bp, Homo sapiens
tccttctggaggctgtaaagga

SEQ ID NO: 7078340 - DNA, 20 bp, Homo sapiens
tccttctgaggtgaggagga

SEQ ID NO: 7078341 - DNA, 22 bp, Homo sapiens
tccttctggaggctctaagggg

SEQ ID NO: 7078342 - DNA, 22 bp, Homo sapiens
tcctgggccctccggatcaggt

SEQ ID NO: 7078343 - DNA, 22 bp, Homo sapiens
tcctgggcagcctctctggaag

SEQ ID NO: 7078344 - DNA, 22 bp, Homo sapiens
actcagagaatatctagaagga

SEQ ID NO: 7078345 - DNA, 22 bp, Homo sapiens
actcagacagaccaaagttctg

SEQ ID NO: 7078346 - DNA, 22 bp, Homo sapiens
actcagacatgccttttacttc

SEQ ID NO: 7078347 - DNA, 22 bp, Homo sapiens
actcagactataagcttatttt

SEQ ID NO: 7078348 - DNA, 23 bp, Homo sapiens
actttattgaccccaggtcagtt

SEQ ID NO: 7078349 - DNA, 22 bp, Homo sapiens
actttatttcctattgcatcca

SEQ ID NO: 7078350 - DNA, 17 bp, Homo sapiens
aagcggagggccgggcc

SEQ ID NO: 7078351 - DNA, 22 bp, Homo sapiens
aagcggcatgaggagtaagtag

SEQ ID NO: 7078352 - DNA, 22 bp, Homo sapiens
acaaagacgggataaggtttgg

SEQ ID NO: 7078353 - DNA, 22 bp, Homo sapiens
aatggccagacagatggctgct

SEQ ID NO: 7078354 - DNA, 22 bp, Homo sapiens
aatggccagcaacaggagtgaa

SEQ ID NO: 7078355 - DNA, 22 bp, Homo sapiens
aatgggcacacttagagagtaa

SEQ ID NO: 7078356 - DNA, 22 bp, Homo sapiens
aacacagagtatttgaagcatt

SEQ ID NO: 7078357 - DNA, 22 bp, Homo sapiens
aacacagaagtgccaagagcca

SEQ ID NO: 7078358 - DNA, 22 bp, Homo sapiens
aatggccagctgggagagttga

SEQ ID NO: 7078359 - DNA, 22 bp, Homo sapiens
aatggccatatcattgcagagc

SEQ ID NO: 7078360 - DNA, 22 bp, Homo sapiens
aatggccattgggtcatgctag

SEQ ID NO: 7078361 - DNA, 22 bp, Homo sapiens
aagaccgaggtgaggtgttatt

SEQ ID NO: 7078362 - DNA, 22 bp, Homo sapiens
aagacctattttaggatatgaa

SEQ ID NO: 7078363 - DNA, 22 bp, Homo sapiens
aagacgcaccctttgagggcac

SEQ ID NO: 7078364 - DNA, 22 bp, Homo sapiens
aagaggggtggtctgtgaggat

SEQ ID NO: 7078365 - DNA, 22 bp, Homo sapiens
aagagggaaattgttggctgct

SEQ ID NO: 7078366 - DNA, 22 bp, Homo sapiens
aagagggaggtgcgggtgcaga

SEQ ID NO: 7078367 - DNA, 22 bp, Homo sapiens
aagagggctcgatttggcaaaa

SEQ ID NO: 7078368 - DNA, 22 bp, Homo sapiens
aaagaacagatgtgtggtgcat

SEQ ID NO: 7078369 - DNA, 21 bp, Homo sapiens
aaagagcccgctgagaggttc

SEQ ID NO: 7078370 - DNA, 22 bp, Homo sapiens
agctttatgaggagaccttagt

SEQ ID NO: 7078371 - DNA, 22 bp, Homo sapiens
agctttatcccttgcccatcga

SEQ ID NO: 7078372 - DNA, 22 bp, Homo sapiens
agctttatgcttcctacaagct

SEQ ID NO: 7078373 - DNA, 22 bp, Homo sapiens
agggcctggttctgtgtaggga

SEQ ID NO: 7078374 - DNA, 22 bp, Homo sapiens
aggcgcattgaggccctgttgc

SEQ ID NO: 7078375 - DNA, 22 bp, Homo sapiens
agggctggtatgtccatgaaag

SEQ ID NO: 7078376 - DNA, 22 bp, Homo sapiens
aggtacgggtctgagagccatg

SEQ ID NO: 7078377 - DNA, 23 bp, Homo sapiens
acgggagggctgtttgcttggtg

SEQ ID NO: 7078378 - DNA, 22 bp, Homo sapiens
cagaagcattccagcaaatagt

SEQ ID NO: 7078379 - DNA, 22 bp, Homo sapiens
cagaagacgcctgggtgctgta

SEQ ID NO: 7078380 - DNA, 22 bp, Homo sapiens
cagaagactgcagggaagggac

SEQ ID NO: 7078381 - DNA, 22 bp, Homo sapiens
cagaagcagtgagagatgtgca

SEQ ID NO: 7078382 - DNA, 22 bp, Homo sapiens
agcctttaagctgccacagctg

SEQ ID NO: 7078383 - DNA, 22 bp, Homo sapiens
caactcagactggattaaataa

SEQ ID NO: 7078384 - DNA, 22 bp, Homo sapiens
caactcaggcacctcatataag

SEQ ID NO: 7078385 - DNA, 22 bp, Homo sapiens
atttattcctgattcctggctt

SEQ ID NO: 7078386 - DNA, 22 bp, Homo sapiens
atttattcctttatggctggag

SEQ ID NO: 7078387 - DNA, 22 bp, Homo sapiens
atttattctccagatggcgaga

SEQ ID NO: 7078388 - DNA, 22 bp, Homo sapiens
attcaaagcccagtaaacattg

SEQ ID NO: 7078389 - DNA, 22 bp, Homo sapiens
attcaaagagctgccagaactg

SEQ ID NO: 7078390 - DNA, 22 bp, Homo sapiens
attcaaagatcatgatctctac

SEQ ID NO: 7078391 - DNA, 22 bp, Homo sapiens
attcacagggggagaagggtat

SEQ ID NO: 7078392 - DNA, 22 bp, Homo sapiens
attcagagtctgcacaacagca

SEQ ID NO: 7078393 - DNA, 18 bp, Homo sapiens
atggctcaggaatggctt

SEQ ID NO: 7078394 - DNA, 22 bp, Homo sapiens
aggactttagagccagaaagac

SEQ ID NO: 7078395 - DNA, 22 bp, Homo sapiens
aggactttatcttctagacctc

SEQ ID NO: 7078396 - DNA, 22 bp, Homo sapiens
aggactttgattttgtaagatc

SEQ ID NO: 7078397 - DNA, 22 bp, Homo sapiens
catggccaggccaagagagtac

SEQ ID NO: 7078398 - DNA, 22 bp, Homo sapiens
catggccaggcccagggcccag

SEQ ID NO: 7078399 - DNA, 22 bp, Homo sapiens
catggccagggagagagaatgt

SEQ ID NO: 7078400 - DNA, 22 bp, Homo sapiens
catggccagggcagatggcagg

SEQ ID NO: 7078401 - DNA, 22 bp, Homo sapiens
catggccccaaatcccatgcat

SEQ ID NO: 7078402 - DNA, 22 bp, Homo sapiens
catggcctcaaaggactgcaga

SEQ ID NO: 7078403 - DNA, 22 bp, Homo sapiens
catggccttgagtgactgcact

SEQ ID NO: 7078404 - DNA, 22 bp, Homo sapiens
catggctcggggacaggaggta

SEQ ID NO: 7078405 - DNA, 22 bp, Homo sapiens
cattcaaagcaggaaaggcctt

SEQ ID NO: 7078406 - DNA, 22 bp, Homo sapiens
cattcaaacattaatttattca

SEQ ID NO: 7078407 - DNA, 22 bp, Homo sapiens
cattcaaaagctccatgtttgt

SEQ ID NO: 7078408 - DNA, 22 bp, Homo sapiens
cattcaaaatgggctgacctgt

SEQ ID NO: 7078409 - DNA, 22 bp, Homo sapiens
agctttatataaaagagtacat

SEQ ID NO: 7078410 - DNA, 22 bp, Homo sapiens
cagggccagagagggctggctg

SEQ ID NO: 7078411 - DNA, 22 bp, Homo sapiens
cagggccagccgcagcatccac

SEQ ID NO: 7078412 - DNA, 22 bp, Homo sapiens
cagggccagcgcccaggcccag

SEQ ID NO: 7078413 - DNA, 22 bp, Homo sapiens
agggagcatgggtgaagcaggc

SEQ ID NO: 7078414 - DNA, 22 bp, Homo sapiens
agggaggaccaatgtgtggtta

SEQ ID NO: 7078415 - DNA, 22 bp, Homo sapiens
aggccaagctcccagagaagct

SEQ ID NO: 7078416 - DNA, 22 bp, Homo sapiens
aggccaagtgctgggacaggtg

SEQ ID NO: 7078417 - DNA, 22 bp, Homo sapiens
aggccaagtgaacaatgctagt

SEQ ID NO: 7078418 - DNA, 22 bp, Homo sapiens
aggccctattcaatggggccca

SEQ ID NO: 7078419 - DNA, 22 bp, Homo sapiens
agggtctgaccaccagtaggga

SEQ ID NO: 7078420 - DNA, 22 bp, Homo sapiens
cctggccacccagccttggcca

SEQ ID NO: 7078421 - DNA, 22 bp, Homo sapiens
cctttattcaattagtcctaat

SEQ ID NO: 7078422 - DNA, 22 bp, Homo sapiens
cggccgcagcagtgtcggccca

SEQ ID NO: 7078423 - DNA, 22 bp, Homo sapiens
aggtggcagttgtggaaccatc

SEQ ID NO: 7078424 - DNA, 22 bp, Homo sapiens
ctcagacttttgttcaacgagt

SEQ ID NO: 7078425 - DNA, 22 bp, Homo sapiens
ctcagactagcctgtaccgaca

SEQ ID NO: 7078426 - DNA, 22 bp, Homo sapiens
ctcaaagagccaggtaatcacc

SEQ ID NO: 7078427 - DNA, 22 bp, Homo sapiens
ctcaaagataatcctatgtctc

SEQ ID NO: 7078428 - DNA, 22 bp, Homo sapiens
ctcaaagaagggaggtatttgg

SEQ ID NO: 7078429 - DNA, 22 bp, Homo sapiens
ctcaaagacaaaaatctgaggt

SEQ ID NO: 7078430 - DNA, 21 bp, Homo sapiens
ctcaaagaccaaaagtgtaga

SEQ ID NO: 7078431 - DNA, 22 bp, Homo sapiens
atggggctgaaacatggaagag

SEQ ID NO: 7078432 - DNA, 22 bp, Homo sapiens
gaggggagcatgatctagattg

SEQ ID NO: 7078433 - DNA, 22 bp, Homo sapiens
cttgttcatctcattgggactg

SEQ ID NO: 7078434 - DNA, 22 bp, Homo sapiens
attattcatggtcttccacaat

SEQ ID NO: 7078435 - DNA, 22 bp, Homo sapiens
attattcattggtaggcaagct

SEQ ID NO: 7078436 - DNA, 22 bp, Homo sapiens
attattcagtcttgtaaggagt

SEQ ID NO: 7078437 - DNA, 20 bp, Homo sapiens
attattcatacatgtgtgac

SEQ ID NO: 7078438 - DNA, 22 bp, Homo sapiens
attattcaatgttatttcagtg

SEQ ID NO: 7078439 - DNA, 22 bp, Homo sapiens
attattcaatcatattaaaagt

SEQ ID NO: 7078440 - DNA, 22 bp, Homo sapiens
gcgagcctctggagtcctctgg

SEQ ID NO: 7078441 - DNA, 22 bp, Homo sapiens
atttattgagagggaggggaat

SEQ ID NO: 7078442 - DNA, 22 bp, Homo sapiens
atttattggtttgcatggtgaa

SEQ ID NO: 7078443 - DNA, 22 bp, Homo sapiens
ggagggagtttcattcctgccc

SEQ ID NO: 7078444 - DNA, 22 bp, Homo sapiens
ggagggagcatccccttgctga

SEQ ID NO: 7078445 - DNA, 19 bp, Homo sapiens
caaagtacctggcacagtg

SEQ ID NO: 7078446 - DNA, 22 bp, Homo sapiens
caaggaggaagatgcaggggac

SEQ ID NO: 7078447 - DNA, 22 bp, Homo sapiens
gcttggccagcagccgggatgc

SEQ ID NO: 7078448 - DNA, 22 bp, Homo sapiens
gggcaagcagtgaggacagcac

SEQ ID NO: 7078449 - DNA, 22 bp, Homo sapiens
gggcaagcagtggctaccagta

SEQ ID NO: 7078450 - DNA, 22 bp, Homo sapiens
gggagggtctgccatgctccct

SEQ ID NO: 7078451 - DNA, 22 bp, Homo sapiens
gggaggtagcaagcctgcagct

SEQ ID NO: 7078452 - DNA, 22 bp, Homo sapiens
gggaaggacattctgggctcag

SEQ ID NO: 7078453 - DNA, 18 bp, Homo sapiens
gggaagccgggaagccgg

SEQ ID NO: 7078454 - DNA, 22 bp, Homo sapiens
gggactggagtagaggccggtg

SEQ ID NO: 7078455 - DNA, 22 bp, Homo sapiens
cagaagggcagcactgggaagg

SEQ ID NO: 7078456 - DNA, 22 bp, Homo sapiens
cactggcctaagcgcctcagcc

SEQ ID NO: 7078457 - DNA, 22 bp, Homo sapiens
cactggcccagccaggcctgtt

SEQ ID NO: 7078458 - DNA, 22 bp, Homo sapiens
cactggcccataaaggcctggg

SEQ ID NO: 7078459 - DNA, 22 bp, Homo sapiens
gggaaagagaggtggacgcagg

SEQ ID NO: 7078460 - DNA, 22 bp, Homo sapiens
gggaaagagtgcttgtccagag

SEQ ID NO: 7078461 - DNA, 22 bp, Homo sapiens
ggggaagaaatctgggttcttc

SEQ ID NO: 7078462 - DNA, 22 bp, Homo sapiens
gggcgccgtgggaaacagccgg

SEQ ID NO: 7078463 - DNA, 22 bp, Homo sapiens
gggcgcatcacctgaggtcagg

SEQ ID NO: 7078464 - DNA, 20 bp, Homo sapiens
ggggaagaaaaggatgtgat

SEQ ID NO: 7078465 - DNA, 22 bp, Homo sapiens
ggtgggtcttgcggggcagctt

SEQ ID NO: 7078466 - DNA, 22 bp, Homo sapiens
ggtgggtcttgtggggcagctt

SEQ ID NO: 7078467 - DNA, 22 bp, Homo sapiens
gggtgggaaggctaagggattg

SEQ ID NO: 7078468 - DNA, 22 bp, Homo sapiens
tcactcaggttcatgtctttgt

SEQ ID NO: 7078469 - DNA, 22 bp, Homo sapiens
tcactcagagatagcctcattt

SEQ ID NO: 7078470 - DNA, 22 bp, Homo sapiens
tcactcagatgttaaagggctt

SEQ ID NO: 7078471 - DNA, 22 bp, Homo sapiens
tcactcagctagcttcaggagc

SEQ ID NO: 7078472 - DNA, 22 bp, Homo sapiens
caggggcaggtgtgagatcatc

SEQ ID NO: 7078473 - DNA, 22 bp, Homo sapiens
tatggccaatcgggtggacgcc

SEQ ID NO: 7078474 - DNA, 22 bp, Homo sapiens
tatggccacaatggggagaaac

SEQ ID NO: 7078475 - DNA, 22 bp, Homo sapiens
tatggccacagcttgtttgcaa

SEQ ID NO: 7078476 - DNA, 22 bp, Homo sapiens
tatggccatgatggccaattgg

SEQ ID NO: 7078477 - DNA, 22 bp, Homo sapiens
tcaggaagtgcctaggctggcc

SEQ ID NO: 7078478 - DNA, 22 bp, Homo sapiens
tcatggggtttggctggatgtc

SEQ ID NO: 7078479 - DNA, 22 bp, Homo sapiens
tcatgggtgctccaggtggctg

SEQ ID NO: 7078480 - DNA, 22 bp, Homo sapiens
catggccaggcacgcgcatagc

SEQ ID NO: 7078481 - DNA, 22 bp, Homo sapiens
catggccagccctgaggttcag

SEQ ID NO: 7078482 - DNA, 23 bp, Homo sapiens
ccaggaagaggccatccacagtc

SEQ ID NO: 7078483 - DNA, 22 bp, Homo sapiens
ccaggaagctctgctccacggg

SEQ ID NO: 7078484 - DNA, 21 bp, Homo sapiens
ccaggaaggactgagctccct

SEQ ID NO: 7078485 - DNA, 22 bp, Homo sapiens
ccaagggagactgtgagacctc

SEQ ID NO: 7078486 - DNA, 22 bp, Homo sapiens
tcctggggagggttctggctcc

SEQ ID NO: 7078487 - DNA, 22 bp, Homo sapiens
ccagaagcttctacacaggaga

SEQ ID NO: 7078488 - DNA, 22 bp, Homo sapiens
tacagggtattcaagggtagtt

SEQ ID NO: 7078489 - DNA, 22 bp, Homo sapiens
tacaggtgctctacagacagga

SEQ ID NO: 7078490 - DNA, 22 bp, Homo sapiens
caggcaaggaggcactgaggga

SEQ ID NO: 7078491 - DNA, 22 bp, Homo sapiens
caggcaagattagagatgagca

SEQ ID NO: 7078492 - DNA, 22 bp, Homo sapiens
caggcaagcaaggggtcttgaa

SEQ ID NO: 7078493 - DNA, 22 bp, Homo sapiens
caggcaagatccagaggctgct

SEQ ID NO: 7078494 - DNA, 22 bp, Homo sapiens
gtttattccagcaatctgctta

SEQ ID NO: 7078495 - DNA, 22 bp, Homo sapiens
gtttattcttcagcaacatctg

SEQ ID NO: 7078496 - DNA, 22 bp, Homo sapiens
cagctttaggactcataataaa

SEQ ID NO: 7078497 - DNA, 22 bp, Homo sapiens
gttattcaacttgtgtctctta

SEQ ID NO: 7078498 - DNA, 22 bp, Homo sapiens
gttattcaatggcttataagga

SEQ ID NO: 7078499 - DNA, 22 bp, Homo sapiens
cctggggaatagagtcaagggg

SEQ ID NO: 7078500 - DNA, 22 bp, Homo sapiens
tgtcatggaggcctcccctaaa

SEQ ID NO: 7078501 - DNA, 22 bp, Homo sapiens
tgtcatggcactagagtggggt

SEQ ID NO: 7078502 - DNA, 22 bp, Homo sapiens
tgtcatggcactggtaggagtg

SEQ ID NO: 7078503 - DNA, 22 bp, Homo sapiens
tgtcatggctgaaagtgggggc

SEQ ID NO: 7078504 - DNA, 22 bp, Homo sapiens
cctggccagtttccaggccctg

SEQ ID NO: 7078505 - DNA, 22 bp, Homo sapiens
cctggccatagggcccaggaaa

SEQ ID NO: 7078506 - DNA, 22 bp, Homo sapiens
cctctcagtattgaactttata

SEQ ID NO: 7078507 - DNA, 22 bp, Homo sapiens
tggcaagaaactgaggcctgct

SEQ ID NO: 7078508 - DNA, 22 bp, Homo sapiens
tggcaagaatattggaccagaa

SEQ ID NO: 7078509 - DNA, 22 bp, Homo sapiens
tggcaagagggatgcaaggttt

SEQ ID NO: 7078510 - DNA, 17 bp, Homo sapiens
tggcaagaatggaaatg

SEQ ID NO: 7078511 - DNA, 22 bp, Homo sapiens
tgcagggaccccgaggctctct

SEQ ID NO: 7078512 - DNA, 22 bp, Homo sapiens
ttttattctcagctccagagag

SEQ ID NO: 7078513 - DNA, 22 bp, Homo sapiens
ttttattctcaagacaatggga

SEQ ID NO: 7078514 - DNA, 22 bp, Homo sapiens
ttttattcaaatagttcacact

SEQ ID NO: 7078515 - DNA, 22 bp, Homo sapiens
ttttattcatagggatggagag

SEQ ID NO: 7078516 - DNA, 22 bp, Homo sapiens
ttttattctaagtatgatggga

SEQ ID NO: 7078517 - DNA, 22 bp, Homo sapiens
ctagggaatgagagactggatc

SEQ ID NO: 7078518 - DNA, 22 bp, Homo sapiens
ctattcaacttgactgtttcac

SEQ ID NO: 7078519 - DNA, 22 bp, Homo sapiens
ctattcaattttgctattgtag

SEQ ID NO: 7078520 - DNA, 22 bp, Homo sapiens
ttccaaagaaattgaccaagac

SEQ ID NO: 7078521 - DNA, 22 bp, Homo sapiens
gactttatgaagagatgaccaa

SEQ ID NO: 7078522 - DNA, 22 bp, Homo sapiens
gactttatcctgcctgaccacg

SEQ ID NO: 7078523 - DNA, 22 bp, Homo sapiens
gactttataaatgagaggcgga

SEQ ID NO: 7078524 - DNA, 22 bp, Homo sapiens
gaaggcccgccctgagcaaggg

SEQ ID NO: 7078525 - DNA, 22 bp, Homo sapiens
gaaggaagtcattagtgcagac

SEQ ID NO: 7078526 - DNA, 22 bp, Homo sapiens
gacacagagctcacagtctcct

SEQ ID NO: 7078527 - DNA, 20 bp, Homo sapiens
ctttagttattaacagcact

SEQ ID NO: 7078528 - DNA, 22 bp, Homo sapiens
ctttagttatttagactacagt

SEQ ID NO: 7078529 - DNA, 22 bp, Homo sapiens
ctttagttgtctcctcaagggt

SEQ ID NO: 7078530 - DNA, 22 bp, Homo sapiens
ctttagtttgtaagagcaagag

SEQ ID NO: 7078531 - DNA, 22 bp, Homo sapiens
ctttatctagggtaagaaaacc

SEQ ID NO: 7078532 - DNA, 22 bp, Homo sapiens
cttctttcaagaatggattagg

SEQ ID NO: 7078533 - DNA, 22 bp, Homo sapiens
ctttgttctgcacacacagaca

SEQ ID NO: 7078534 - DNA, 22 bp, Homo sapiens
gaggagggagctggaagctctt

SEQ ID NO: 7078535 - DNA, 22 bp, Homo sapiens
gaggagggttggccttaggtag

SEQ ID NO: 7078536 - DNA, 22 bp, Homo sapiens
gaggaaggtcccatcagaattt

SEQ ID NO: 7078537 - DNA, 22 bp, Homo sapiens
gaggggcaagaagttggcctct

SEQ ID NO: 7078538 - DNA, 22 bp, Homo sapiens
gaggggcaatgagggaaagagt

SEQ ID NO: 7078539 - DNA, 22 bp, Homo sapiens
gaggggcacagtaaagggtccc

SEQ ID NO: 7078540 - DNA, 22 bp, Homo sapiens
gaggggcagaatgtgatcaggg

SEQ ID NO: 7078541 - DNA, 22 bp, Homo sapiens
gaggtccagccaagcggcaagg

SEQ ID NO: 7078542 - DNA, 22 bp, Homo sapiens
gaggtccaacacaatgggtgtt

SEQ ID NO: 7078543 - DNA, 22 bp, Homo sapiens
gaggtccactgaggcaacaggg

SEQ ID NO: 7078544 - DNA, 18 bp, Homo sapiens
gatggccatttcaatgtt

SEQ ID NO: 7078545 - DNA, 22 bp, Homo sapiens
gatgggggccagggcctgcttt

SEQ ID NO: 7078546 - DNA, 22 bp, Homo sapiens
gattcaaagacagactcatttc

SEQ ID NO: 7078547 - DNA, 22 bp, Homo sapiens
gattcaaagttaatgaagatgc

SEQ ID NO: 7078548 - DNA, 22 bp, Homo sapiens
gattcaaaaataagctcctatt

SEQ ID NO: 7078549 - DNA, 22 bp, Homo sapiens
gattcaaaagtttgagctccaa

SEQ ID NO: 7078550 - DNA, 22 bp, Homo sapiens
gcatggcttctgccaggcacct

SEQ ID NO: 7078551 - DNA, 22 bp, Homo sapiens
gctggccagggctgctcgcgga

SEQ ID NO: 7078552 - DNA, 22 bp, Homo sapiens
gctgggcaggcctcgtgagggc

SEQ ID NO: 7078553 - DNA, 22 bp, Homo sapiens
gccgccgctgtgcaatttagca

SEQ ID NO: 7078554 - DNA, 22 bp, Homo sapiens
gccgtgtcatctgcgggtggca

SEQ ID NO: 7078555 - DNA, 22 bp, Homo sapiens
gcctggccgctccgagctccgc

SEQ ID NO: 7078556 - DNA, 22 bp, Homo sapiens
ggagagggtaggggtcctgccc

SEQ ID NO: 7078557 - DNA, 23 bp, Homo sapiens
ggagaggggtgtgggcatcttta

SEQ ID NO: 7078558 - DNA, 22 bp, Homo sapiens
ggagagggggctccctgcttgg

SEQ ID NO: 7078559 - DNA, 22 bp, Homo sapiens
ggagaggggaacttgttgcttg

SEQ ID NO: 7078560 - DNA, 22 bp, Homo sapiens
ggaggaagcacacggcttgtat

SEQ ID NO: 7078561 - DNA, 22 bp, Homo sapiens
ggaggaagccctcggtgcccca

SEQ ID NO: 7078562 - DNA, 22 bp, Homo sapiens
ggaaagaaccctggatggctgg

SEQ ID NO: 7078563 - DNA, 21 bp, Homo sapiens
ggaaagaaggcaaggctcagg

SEQ ID NO: 7078564 - DNA, 22 bp, Homo sapiens
ggagggcccctccagtgggcag

SEQ ID NO: 7078565 - DNA, 22 bp, Homo sapiens
ggaggggaggtccagctgatct

SEQ ID NO: 7078566 - DNA, 22 bp, Homo sapiens
ggagggtccactgtgaggcaga

SEQ ID NO: 7078567 - DNA, 22 bp, Homo sapiens
ggcacagagctccagccttggc

SEQ ID NO: 7078568 - DNA, 22 bp, Homo sapiens
ggcacagaggttgcctccagat

SEQ ID NO: 7078569 - DNA, 22 bp, Homo sapiens
ggcaggcctgagaggcagggct

SEQ ID NO: 7078570 - DNA, 20 bp, Homo sapiens
gggaggcgagggctgagcag

SEQ ID NO: 7078571 - DNA, 22 bp, Homo sapiens
gggacgggcagtccaaggggtc

SEQ ID NO: 7078572 - DNA, 22 bp, Homo sapiens
gggacgggcagtccaaggggtc

SEQ ID NO: 7078573 - DNA, 22 bp, Homo sapiens
gggacgagccccaggctggagg

SEQ ID NO: 7078574 - DNA, 22 bp, Homo sapiens
gggacgagatcttggcagtgtg

SEQ ID NO: 7078575 - DNA, 22 bp, Homo sapiens
gggagggaaagcttgatctgtc

SEQ ID NO: 7078576 - DNA, 22 bp, Homo sapiens
gggagggaaggtacctgtgtga

SEQ ID NO: 7078577 - DNA, 22 bp, Homo sapiens
gggatggggagctggaaagggg

SEQ ID NO: 7078578 - DNA, 22 bp, Homo sapiens
gggatggggagctggaaagggg

SEQ ID NO: 7078579 - DNA, 22 bp, Homo sapiens
gggatggctcaaaggagtcagg

SEQ ID NO: 7078580 - DNA, 22 bp, Homo sapiens
gggatggctgcctgcatcagga

SEQ ID NO: 7078581 - DNA, 22 bp, Homo sapiens
ggggacgggacttagcatgagt

SEQ ID NO: 7078582 - DNA, 22 bp, Homo sapiens
ggccagaagctggggcatagga

SEQ ID NO: 7078583 - DNA, 22 bp, Homo sapiens
gtgggggtggaaaggcaagttg

SEQ ID NO: 7078584 - DNA, 22 bp, Homo sapiens
gtgggggtttcattaagacaat

SEQ ID NO: 7078585 - DNA, 22 bp, Homo sapiens
gttcaaagctcctggtacagta

SEQ ID NO: 7078586 - DNA, 22 bp, Homo sapiens
gttcaaaggcctgtggaaaggg

SEQ ID NO: 7078587 - DNA, 22 bp, Homo sapiens
gtctggggcagcaaggcgcgcg

SEQ ID NO: 7078588 - DNA, 22 bp, Homo sapiens
gtcctgggtccccgcaggtcag

SEQ ID NO: 7078589 - DNA, 22 bp, Homo sapiens
gtacagggcccctcagcagggc

SEQ ID NO: 7078590 - DNA, 22 bp, Homo sapiens
ggtgcaggaatctgcaattgaa

SEQ ID NO: 7078591 - DNA, 22 bp, Homo sapiens
ggtgcaggacgaagtgggggtt

SEQ ID NO: 7078592 - DNA, 22 bp, Homo sapiens
ggtgcaggcggtggggcaagta

SEQ ID NO: 7078593 - DNA, 22 bp, Homo sapiens
gtgacaggcccagtgggatgca

SEQ ID NO: 7078594 - DNA, 22 bp, Homo sapiens
tcctggggaggtcgaggctgag

SEQ ID NO: 7078595 - DNA, 21 bp, Homo sapiens
tcctggggggtaggtgagttt

SEQ ID NO: 7078596 - DNA, 20 bp, Homo sapiens
tcctggggtaagccatggtc

SEQ ID NO: 7078597 - DNA, 19 bp, Homo sapiens
tcctggggatgtggtcacc

SEQ ID NO: 7078598 - DNA, 22 bp, Homo sapiens
tcctggggccagcactggtgga

SEQ ID NO: 7078599 - DNA, 22 bp, Homo sapiens
tctaaagagagtgggtacatgt

SEQ ID NO: 7078600 - DNA, 22 bp, Homo sapiens
tctcaaagtagctcccacagat

SEQ ID NO: 7078601 - DNA, 22 bp, Homo sapiens
tctgggggaggaggcatggccc

SEQ ID NO: 7078602 - DNA, 22 bp, Homo sapiens
tctttattgctactggtttgtc

SEQ ID NO: 7078603 - DNA, 22 bp, Homo sapiens
tcttattcttttaaacaacgca

SEQ ID NO: 7078604 - DNA, 20 bp, Homo sapiens
tgcaaggaagcaggcaagtg

SEQ ID NO: 7078605 - DNA, 22 bp, Homo sapiens
tgcagaagaatgagcttggagt

SEQ ID NO: 7078606 - DNA, 22 bp, Homo sapiens
tgcactactgtgatacacagcc

SEQ ID NO: 7078607 - DNA, 19 bp, Homo sapiens
tgcatggcagatttaactt

SEQ ID NO: 7078608 - DNA, 20 bp, Homo sapiens
tgcatggcgcacatctgtgg

SEQ ID NO: 7078609 - DNA, 22 bp, Homo sapiens
tgcatggcttgtgagggtttga

SEQ ID NO: 7078610 - DNA, 22 bp, Homo sapiens
tgcagggatgctagaggtaaga

SEQ ID NO: 7078611 - DNA, 22 bp, Homo sapiens
tgcagggattagaggccgggga

SEQ ID NO: 7078612 - DNA, 22 bp, Homo sapiens
tgccgcagtgcggggagggccc

SEQ ID NO: 7078613 - DNA, 22 bp, Homo sapiens
tgagggtcatttggaagtggaa

SEQ ID NO: 7078614 - DNA, 22 bp, Homo sapiens
tgcgggtcatcagggagaacgt

SEQ ID NO: 7078615 - DNA, 20 bp, Homo sapiens
tggagggattgttggcaaat

SEQ ID NO: 7078616 - DNA, 22 bp, Homo sapiens
tggaaggggttacgcagcagga

SEQ ID NO: 7078617 - DNA, 22 bp, Homo sapiens
tggaaggggagctggaaagggg

SEQ ID NO: 7078618 - DNA, 22 bp, Homo sapiens
tggctcattctggggaagtcag

SEQ ID NO: 7078619 - DNA, 22 bp, Homo sapiens
tgggaggtctcttgcggcctag

SEQ ID NO: 7078620 - DNA, 22 bp, Homo sapiens
tgggagtccaaggcaggcggat

SEQ ID NO: 7078621 - DNA, 22 bp, Homo sapiens
tgggagtctgaggcgggtcgat

SEQ ID NO: 7078622 - DNA, 22 bp, Homo sapiens
tggggagtgatgcctcggataa

SEQ ID NO: 7078623 - DNA, 22 bp, Homo sapiens
tggggaggtaacaatttcaggc

SEQ ID NO: 7078624 - DNA, 22 bp, Homo sapiens
tggggaggttcgggaatcttgt

SEQ ID NO: 7078625 - DNA, 21 bp, Homo sapiens
tggggaggggacctgattatg

SEQ ID NO: 7078626 - DNA, 23 bp, Homo sapiens
tggggagggaagtcatttctgta

SEQ ID NO: 7078627 - DNA, 22 bp, Homo sapiens
tggggaggacgggcgccttcct

SEQ ID NO: 7078628 - DNA, 22 bp, Homo sapiens
tggggaggatatgtgagttatt

SEQ ID NO: 7078629 - DNA, 22 bp, Homo sapiens
tggggctcatgcctgctggaac

SEQ ID NO: 7078630 - DNA, 22 bp, Homo sapiens
tggggctcctcctggcaggagg

SEQ ID NO: 7078631 - DNA, 22 bp, Homo sapiens
tggggctcacctaggctggaag

SEQ ID NO: 7078632 - DNA, 22 bp, Homo sapiens
tgggggagcgacagacataatt

SEQ ID NO: 7078633 - DNA, 21 bp, Homo sapiens
tgggtgcaagctgcggatgct

SEQ ID NO: 7078634 - DNA, 21 bp, Homo sapiens
tgggggtcttcacggtgttgt

SEQ ID NO: 7078635 - DNA, 22 bp, Homo sapiens
tgggggtcctcctctgcttaag

SEQ ID NO: 7078636 - DNA, 22 bp, Homo sapiens
tggggtgtgagaagtagaggga

SEQ ID NO: 7078637 - DNA, 22 bp, Homo sapiens
tggggtgtgctcagagcagggg

SEQ ID NO: 7078638 - DNA, 22 bp, Homo sapiens
tggtgggtcggctgggagagct

SEQ ID NO: 7078639 - DNA, 22 bp, Homo sapiens
tggtgcagtagaaggccgactt

SEQ ID NO: 7078640 - DNA, 22 bp, Homo sapiens
tggtgcaggagttggcagggac

SEQ ID NO: 7078641 - DNA, 22 bp, Homo sapiens
tggtgcagtcattggcccaggg

SEQ ID NO: 7078642 - DNA, 22 bp, Homo sapiens
tggtgcagttcccagggccggg

SEQ ID NO: 7078643 - DNA, 22 bp, Homo sapiens
tggtgcagtccaaagggagcag

SEQ ID NO: 7078644 - DNA, 22 bp, Homo sapiens
tggtgcagacaggagccccgct

SEQ ID NO: 7078645 - DNA, 22 bp, Homo sapiens
tggtcctggggtgcaggctgac

SEQ ID NO: 7078646 - DNA, 22 bp, Homo sapiens
tggtcctggtagcggtgtgctt

SEQ ID NO: 7078647 - DNA, 23 bp, Homo sapiens
tggtcctggttgaggtgggcccc

SEQ ID NO: 7078648 - DNA, 22 bp, Homo sapiens
tggtcctggaaggtcctgaggg

SEQ ID NO: 7078649 - DNA, 22 bp, Homo sapiens
tggtcctgctacaggggattag

SEQ ID NO: 7078650 - DNA, 22 bp, Homo sapiens
ttatgcaaagaaatagactaat

SEQ ID NO: 7078651 - DNA, 22 bp, Homo sapiens
ttattcagggataacatccagg

SEQ ID NO: 7078652 - DNA, 22 bp, Homo sapiens
ttattccaagataggatagcat

SEQ ID NO: 7078653 - DNA, 22 bp, Homo sapiens
ttattcattaacagggaccaaa

SEQ ID NO: 7078654 - DNA, 22 bp, Homo sapiens
ttacaaagtttaaggtggcact

SEQ ID NO: 7078655 - DNA, 23 bp, Homo sapiens
ttatttggattttagtggaaaga

SEQ ID NO: 7078656 - DNA, 22 bp, Homo sapiens
ttcattcaaagaggcatccaag

SEQ ID NO: 7078657 - DNA, 22 bp, Homo sapiens
ttcattcagcacatatttattg

SEQ ID NO: 7078658 - DNA, 22 bp, Homo sapiens
ttcattcaggtgtatttatggg

SEQ ID NO: 7078659 - DNA, 22 bp, Homo sapiens
ttcattcatgtattgtctatgg

SEQ ID NO: 7078660 - DNA, 22 bp, Homo sapiens
agaggcatgcacagatgtgctg

SEQ ID NO: 7078661 - DNA, 22 bp, Homo sapiens
agagggcatgcttggtggcctg

SEQ ID NO: 7078662 - DNA, 22 bp, Homo sapiens
agagggcataaaatagagcacg

SEQ ID NO: 7078663 - DNA, 22 bp, Homo sapiens
aagtggagctataggctcagat

SEQ ID NO: 7078664 - DNA, 18 bp, Homo sapiens
aagtggcacaggagtgca

SEQ ID NO: 7078665 - DNA, 22 bp, Homo sapiens
aagtggcatgtataagaaagaa

SEQ ID NO: 7078666 - DNA, 22 bp, Homo sapiens
aagtggcagccttagaaggaga

SEQ ID NO: 7078667 - DNA, 22 bp, Homo sapiens
aagtggcagttcaggaagcaga

SEQ ID NO: 7078668 - DNA, 23 bp, Homo sapiens
aattcaaattcagtgtgactagg

SEQ ID NO: 7078669 - DNA, 22 bp, Homo sapiens
aattcaaatttgagtttgtgat

SEQ ID NO: 7078670 - DNA, 22 bp, Homo sapiens
aattcaaattacaatagttgtt

SEQ ID NO: 7078671 - DNA, 22 bp, Homo sapiens
aattcaaagccgcttgggaatc

SEQ ID NO: 7078672 - DNA, 22 bp, Homo sapiens
aattcaaagactagaattttgc

SEQ ID NO: 7078673 - DNA, 22 bp, Homo sapiens
aagaccagggtgggtacgttcc

SEQ ID NO: 7078674 - DNA, 22 bp, Homo sapiens
aagaggcagcccgctgaggctg

SEQ ID NO: 7078675 - DNA, 22 bp, Homo sapiens
aagggagcttaggagatcaggc

SEQ ID NO: 7078676 - DNA, 22 bp, Homo sapiens
aagggagcaaatggacagacgg

SEQ ID NO: 7078677 - DNA, 22 bp, Homo sapiens
aagggagccaagaaagcagggc

SEQ ID NO: 7078678 - DNA, 22 bp, Homo sapiens
aaggggagatgtcatgggccct

SEQ ID NO: 7078679 - DNA, 22 bp, Homo sapiens
aaggggagttagtgataaaacc

SEQ ID NO: 7078680 - DNA, 21 bp, Homo sapiens
aaggggcaaacccaggacacc

SEQ ID NO: 7078681 - DNA, 22 bp, Homo sapiens
aaggggcctcacagatgggctt

SEQ ID NO: 7078682 - DNA, 22 bp, Homo sapiens
aaggggcatgcttttgccagga

SEQ ID NO: 7078683 - DNA, 22 bp, Homo sapiens
aagaatggtggtggggccagca

SEQ ID NO: 7078684 - DNA, 22 bp, Homo sapiens
aaaggccaggttggctggtatt

SEQ ID NO: 7078685 - DNA, 21 bp, Homo sapiens
aaaggccataatcacggagca

SEQ ID NO: 7078686 - DNA, 22 bp, Homo sapiens
aaaggccatggttggagtgttt

SEQ ID NO: 7078687 - DNA, 22 bp, Homo sapiens
aaaggccaagcatgaggtggac

SEQ ID NO: 7078688 - DNA, 22 bp, Homo sapiens
aaaggccacacagagcagggag

SEQ ID NO: 7078689 - DNA, 22 bp, Homo sapiens
aaagtccaattttgttcaggct

SEQ ID NO: 7078690 - DNA, 22 bp, Homo sapiens
aaacacaggtactgcagaagtg

SEQ ID NO: 7078691 - DNA, 22 bp, Homo sapiens
aaacacagcatgtccttgggga

SEQ ID NO: 7078692 - DNA, 20 bp, Homo sapiens
aggcatgggatgcccagatt

SEQ ID NO: 7078693 - DNA, 22 bp, Homo sapiens
aggcatggcattcctcaagcaa

SEQ ID NO: 7078694 - DNA, 22 bp, Homo sapiens
aggcatggctttaggcaggcgt

SEQ ID NO: 7078695 - DNA, 20 bp, Homo sapiens
aggagggacctggattggcg

SEQ ID NO: 7078696 - DNA, 19 bp, Homo sapiens
aggaaggcggcggctgccc

SEQ ID NO: 7078697 - DNA, 22 bp, Homo sapiens
acagggtgactttgtgacagat

SEQ ID NO: 7078698 - DNA, 22 bp, Homo sapiens
acagggtggggatggtgagctt

SEQ ID NO: 7078699 - DNA, 22 bp, Homo sapiens
agaacctcaattatttttgcac

SEQ ID NO: 7078700 - DNA, 22 bp, Homo sapiens
agaaggcagatgggacggagca

SEQ ID NO: 7078701 - DNA, 21 bp, Homo sapiens
agaaggcaccagcaaggactg

SEQ ID NO: 7078702 - DNA, 22 bp, Homo sapiens
agaaagcacgggccccaggctc

SEQ ID NO: 7078703 - DNA, 22 bp, Homo sapiens
agaggggcaagtaaagagtctt

SEQ ID NO: 7078704 - DNA, 22 bp, Homo sapiens
agaggggctcaagcagtggtct

SEQ ID NO: 7078705 - DNA, 22 bp, Homo sapiens
agagggcagggcggtaagtcct

SEQ ID NO: 7078706 - DNA, 22 bp, Homo sapiens
agagggcagtctcagattggga

SEQ ID NO: 7078707 - DNA, 22 bp, Homo sapiens
agcaagaagggcaaggaagttt

SEQ ID NO: 7078708 - DNA, 22 bp, Homo sapiens
agcaagaaaatctctgtccaat

SEQ ID NO: 7078709 - DNA, 22 bp, Homo sapiens
caaagcaccacaaaccaggtga

SEQ ID NO: 7078710 - DNA, 22 bp, Homo sapiens
agagaagggtgtagcctgggcc

SEQ ID NO: 7078711 - DNA, 22 bp, Homo sapiens
agactttaatgtgcaaatgaaa

SEQ ID NO: 7078712 - DNA, 22 bp, Homo sapiens
atgaagggtgtccctgtgagca

SEQ ID NO: 7078713 - DNA, 22 bp, Homo sapiens
atgaagggaatataagtgctgc

SEQ ID NO: 7078714 - DNA, 20 bp, Homo sapiens
cagagaccaggccaggtgtc

SEQ ID NO: 7078715 - DNA, 22 bp, Homo sapiens
cagagacccctggcatggtggt

SEQ ID NO: 7078716 - DNA, 22 bp, Homo sapiens
cagagaccctaggcaggtgaca

SEQ ID NO: 7078717 - DNA, 22 bp, Homo sapiens
agcagggcactggaaggcactg

SEQ ID NO: 7078718 - DNA, 22 bp, Homo sapiens
agcagggcaaagtcaggctaac

SEQ ID NO: 7078719 - DNA, 22 bp, Homo sapiens
agcagggcaggtaaggatcaga

SEQ ID NO: 7078720 - DNA, 22 bp, Homo sapiens
agcatggctttggaggatagca

SEQ ID NO: 7078721 - DNA, 22 bp, Homo sapiens
agcatggccacgggggtaggta

SEQ ID NO: 7078722 - DNA, 22 bp, Homo sapiens
agcatggccatctgggccgtcc

SEQ ID NO: 7078723 - DNA, 19 bp, Homo sapiens
agcatggcctacagtgtgc

SEQ ID NO: 7078724 - DNA, 22 bp, Homo sapiens
agcatggcctcccgggcctggc

SEQ ID NO: 7078725 - DNA, 22 bp, Homo sapiens
agcatggcctgcagcggccacc

SEQ ID NO: 7078726 - DNA, 18 bp, Homo sapiens
agcatggcacaggctccc

SEQ ID NO: 7078727 - DNA, 22 bp, Homo sapiens
agcatggcactcaaggctcctg

SEQ ID NO: 7078728 - DNA, 22 bp, Homo sapiens
agcatggcattattggaaggac

SEQ ID NO: 7078729 - DNA, 22 bp, Homo sapiens
caaaggcctgagaactgagggg

SEQ ID NO: 7078730 - DNA, 22 bp, Homo sapiens
aggggaggcagcgataaacctg

SEQ ID NO: 7078731 - DNA, 22 bp, Homo sapiens
aggggatgatcctcccgcagcg

SEQ ID NO: 7078732 - DNA, 22 bp, Homo sapiens
aggggaggtgtccccaaatctc

SEQ ID NO: 7078733 - DNA, 22 bp, Homo sapiens
agggctggcatctctaatgctg

SEQ ID NO: 7078734 - DNA, 22 bp, Homo sapiens
aggggatggagctggaaggcag

SEQ ID NO: 7078735 - DNA, 22 bp, Homo sapiens
agggtagggccgtagggccatg

SEQ ID NO: 7078736 - DNA, 22 bp, Homo sapiens
agggcctggaactggagaccac

SEQ ID NO: 7078737 - DNA, 22 bp, Homo sapiens
agggcctggaactgtgggcagg

SEQ ID NO: 7078738 - DNA, 22 bp, Homo sapiens
agggcctggcgcgtggccgccg

SEQ ID NO: 7078739 - DNA, 19 bp, Homo sapiens
agggcctgcagctcaagct

SEQ ID NO: 7078740 - DNA, 22 bp, Homo sapiens
agggcctgaggctgacggggag

SEQ ID NO: 7078741 - DNA, 22 bp, Homo sapiens
agggcgaggagacggaggcaca

SEQ ID NO: 7078742 - DNA, 22 bp, Homo sapiens
agggctggagccacagctggga

SEQ ID NO: 7078743 - DNA, 22 bp, Homo sapiens
ccagaacagacctgcctgacct

SEQ ID NO: 7078744 - DNA, 22 bp, Homo sapiens
ccaggaaggtatgggaagaaaa

SEQ ID NO: 7078745 - DNA, 22 bp, Homo sapiens
ccaggaagtatgacccaacaga

SEQ ID NO: 7078746 - DNA, 22 bp, Homo sapiens
ccaggaaggcaggcctccccgc

SEQ ID NO: 7078747 - DNA, 22 bp, Homo sapiens
ccaggaaggcctggatgccccc

SEQ ID NO: 7078748 - DNA, 22 bp, Homo sapiens
agctttatttgtcattcacggc

SEQ ID NO: 7078749 - DNA, 22 bp, Homo sapiens
aggaaggggagaagttaaagct

SEQ ID NO: 7078750 - DNA, 22 bp, Homo sapiens
aggaagggtggatagtaacgtg

SEQ ID NO: 7078751 - DNA, 22 bp, Homo sapiens
aggaagggtgtcatgagccctt

SEQ ID NO: 7078752 - DNA, 22 bp, Homo sapiens
ccaaagacagacttgactagag

SEQ ID NO: 7078753 - DNA, 20 bp, Homo sapiens
ccaaagactgccccttccag

SEQ ID NO: 7078754 - DNA, 22 bp, Homo sapiens
aggtaaggaaattgaggcaatt

SEQ ID NO: 7078755 - DNA, 22 bp, Homo sapiens
aggtaaggtttggaggcagtgg

SEQ ID NO: 7078756 - DNA, 22 bp, Homo sapiens
cctgggggccaggaaggtgtga

SEQ ID NO: 7078757 - DNA, 21 bp, Homo sapiens
aggtgcagagccagggaccag

SEQ ID NO: 7078758 - DNA, 17 bp, Homo sapiens
aggtgcagaggcagagc

SEQ ID NO: 7078759 - DNA, 22 bp, Homo sapiens
aggtgcagcatgagtccaacgg

SEQ ID NO: 7078760 - DNA, 22 bp, Homo sapiens
aggtggcagactaacagaagga

SEQ ID NO: 7078761 - DNA, 22 bp, Homo sapiens
cctgtggggctgaaagaggctt

SEQ ID NO: 7078762 - DNA, 22 bp, Homo sapiens
ccttcattcattaatttagccc

SEQ ID NO: 7078763 - DNA, 22 bp, Homo sapiens
aggtggcagcaggagatgtgga

SEQ ID NO: 7078764 - DNA, 22 bp, Homo sapiens
agtggccagtgaaggcggcagc

SEQ ID NO: 7078765 - DNA, 22 bp, Homo sapiens
agtggccaggaaaggtccagcc

SEQ ID NO: 7078766 - DNA, 22 bp, Homo sapiens
agtggccagcagcctagcctag

SEQ ID NO: 7078767 - DNA, 22 bp, Homo sapiens
agtctttagggaggtcagagtt

SEQ ID NO: 7078768 - DNA, 22 bp, Homo sapiens
agtctttatgattgtcaaagta

SEQ ID NO: 7078769 - DNA, 22 bp, Homo sapiens
agtctttattcagccaagtact

SEQ ID NO: 7078770 - DNA, 22 bp, Homo sapiens
agtggccaccatgccagctctc

SEQ ID NO: 7078771 - DNA, 22 bp, Homo sapiens
agtggccactagaagctcagct

SEQ ID NO: 7078772 - DNA, 22 bp, Homo sapiens
atattcaaattacatttactaa

SEQ ID NO: 7078773 - DNA, 18 bp, Homo sapiens
atattcaagaagacagag

SEQ ID NO: 7078774 - DNA, 22 bp, Homo sapiens
atattcaagtgaggatggctaa

SEQ ID NO: 7078775 - DNA, 22 bp, Homo sapiens
atctggttcttcttaggcatca

SEQ ID NO: 7078776 - DNA, 22 bp, Homo sapiens
cttattcaatgctggaaatgtt

SEQ ID NO: 7078777 - DNA, 22 bp, Homo sapiens
cttattcatatattctcggtag

SEQ ID NO: 7078778 - DNA, 23 bp, Homo sapiens
cttattcattcatgtagcccatt

SEQ ID NO: 7078779 - DNA, 21 bp, Homo sapiens
cttattcactgttatttatca

SEQ ID NO: 7078780 - DNA, 22 bp, Homo sapiens
cttattcagaaggagaaatgga

SEQ ID NO: 7078781 - DNA, 22 bp, Homo sapiens
cttattcagaccttggattctt

SEQ ID NO: 7078782 - DNA, 22 bp, Homo sapiens
cttattcagatacagactcttg

SEQ ID NO: 7078783 - DNA, 22 bp, Homo sapiens
cttattcagcaagtttgggtac

SEQ ID NO: 7078784 - DNA, 22 bp, Homo sapiens
cttattcagcacttgctctgta

SEQ ID NO: 7078785 - DNA, 22 bp, Homo sapiens
cttattcataagtcagacacac

SEQ ID NO: 7078786 - DNA, 22 bp, Homo sapiens
gagctttaagggataaaatgat

SEQ ID NO: 7078787 - DNA, 22 bp, Homo sapiens
gaggaaggagggaaagcgcgcg

SEQ ID NO: 7078788 - DNA, 22 bp, Homo sapiens
gaggggtcacatgggctggctt

SEQ ID NO: 7078789 - DNA, 22 bp, Homo sapiens
gagggcaaaacagagaagatgt

SEQ ID NO: 7078790 - DNA, 18 bp, Homo sapiens
gatcgggggcgccccaag

SEQ ID NO: 7078791 - DNA, 22 bp, Homo sapiens
gcagaagggaataaggagcttt

SEQ ID NO: 7078792 - DNA, 22 bp, Homo sapiens
ggcccagaagccagaagcctcc

SEQ ID NO: 7078793 - DNA, 22 bp, Homo sapiens
ggcccagagacgtgcaatgtac

SEQ ID NO: 7078794 - DNA, 22 bp, Homo sapiens
gtgcatggggagggaagcgctc

SEQ ID NO: 7078795 - DNA, 22 bp, Homo sapiens
ggtgcaagagctccaggccctg

SEQ ID NO: 7078796 - DNA, 22 bp, Homo sapiens
ggtgcaagggttgagttgagtg

SEQ ID NO: 7078797 - DNA, 22 bp, Homo sapiens
ggtgcaagtggctagggaccag

SEQ ID NO: 7078798 - DNA, 22 bp, Homo sapiens
ggtgcaagttttttgaggaagt

SEQ ID NO: 7078799 - DNA, 22 bp, Homo sapiens
ggtgcagaaggaagggagctgg

SEQ ID NO: 7078800 - DNA, 22 bp, Homo sapiens
gtaagaagatgaatccaggctg

SEQ ID NO: 7078801 - DNA, 19 bp, Homo sapiens
gggcggagcctgacctggg

SEQ ID NO: 7078802 - DNA, 18 bp, Homo sapiens
cagaagcaggcagtgcag

SEQ ID NO: 7078803 - DNA, 22 bp, Homo sapiens
cagaagcactaggaggaaacgt

SEQ ID NO: 7078804 - DNA, 20 bp, Homo sapiens
cagaagcaaggcaggtacct

SEQ ID NO: 7078805 - DNA, 22 bp, Homo sapiens
cagaagcaagggccaaagtctt

SEQ ID NO: 7078806 - DNA, 22 bp, Homo sapiens
cagagcttttagatgttgaaca

SEQ ID NO: 7078807 - DNA, 22 bp, Homo sapiens
cagagctttttacattaatgat

SEQ ID NO: 7078808 - DNA, 22 bp, Homo sapiens
cagagcttgaatccaacaaaga

SEQ ID NO: 7078809 - DNA, 21 bp, Homo sapiens
cagagcttgctgagaggcctg

SEQ ID NO: 7078810 - DNA, 22 bp, Homo sapiens
gggggaggtgaatgcaataagg

SEQ ID NO: 7078811 - DNA, 22 bp, Homo sapiens
ccagagggaagaggaagcgctg

SEQ ID NO: 7078812 - DNA, 22 bp, Homo sapiens
tcctgagggactggttcctcgc

SEQ ID NO: 7078813 - DNA, 22 bp, Homo sapiens
tcctgaggtgctcagccaggaa

SEQ ID NO: 7078814 - DNA, 22 bp, Homo sapiens
ccaagaggaccttgccagggca

SEQ ID NO: 7078815 - DNA, 22 bp, Homo sapiens
ccaagaggggaagggccgcagc

SEQ ID NO: 7078816 - DNA, 22 bp, Homo sapiens
ccaagagggttgccctgagcgt

SEQ ID NO: 7078817 - DNA, 22 bp, Homo sapiens
ccaagaggtaatacgagatatc

SEQ ID NO: 7078818 - DNA, 22 bp, Homo sapiens
cagtcttttgtatattagcaga

SEQ ID NO: 7078819 - DNA, 22 bp, Homo sapiens
tcaaaggataactgagggcagt

SEQ ID NO: 7078820 - DNA, 19 bp, Homo sapiens
tcaaaggcaaggaggaact

SEQ ID NO: 7078821 - DNA, 22 bp, Homo sapiens
tcaaaggcaccaaggtcactgc

SEQ ID NO: 7078822 - DNA, 22 bp, Homo sapiens
tcaaaggaaacgtggtcctggc

SEQ ID NO: 7078823 - DNA, 22 bp, Homo sapiens
tcaaagcacacttagtggtaga

SEQ ID NO: 7078824 - DNA, 22 bp, Homo sapiens
tatattcacttgtgtccaacca

SEQ ID NO: 7078825 - DNA, 22 bp, Homo sapiens
tatattcattttaaagccatct

SEQ ID NO: 7078826 - DNA, 22 bp, Homo sapiens
tatgcaaagccacccagggacg

SEQ ID NO: 7078827 - DNA, 22 bp, Homo sapiens
tatgcaaatgactggtatgttt

SEQ ID NO: 7078828 - DNA, 22 bp, Homo sapiens
cctgcagggaatcgaggcagaa

SEQ ID NO: 7078829 - DNA, 19 bp, Homo sapiens
cctgcagggatgagaggtt

SEQ ID NO: 7078830 - DNA, 22 bp, Homo sapiens
cctgcaggttgcagaggcggaa

SEQ ID NO: 7078831 - DNA, 19 bp, Homo sapiens
cccagaggaatgcctggaa

SEQ ID NO: 7078832 - DNA, 21 bp, Homo sapiens
ttcttcatgatgattaatggc

SEQ ID NO: 7078833 - DNA, 23 bp, Homo sapiens
ttcttcattttcagagttgagca

SEQ ID NO: 7078834 - DNA, 22 bp, Homo sapiens
cgggaggaaaggcgaggctctg

SEQ ID NO: 7078835 - DNA, 22 bp, Homo sapiens
cctgcgggctggtaagaggctt

SEQ ID NO: 7078836 - DNA, 22 bp, Homo sapiens
tggttcatgctcatggtgatag

SEQ ID NO: 7078837 - DNA, 22 bp, Homo sapiens
cgcaccactgaattccagcctg

SEQ ID NO: 7078838 - DNA, 22 bp, Homo sapiens
ctgagggagaagtcacgggcag

SEQ ID NO: 7078839 - DNA, 22 bp, Homo sapiens
ctgagggagacagtgcggacta

SEQ ID NO: 7078840 - DNA, 22 bp, Homo sapiens
ctgagggaaggggtacatggct

SEQ ID NO: 7078841 - DNA, 22 bp, Homo sapiens
ctcaggctggtccttagtgaca

SEQ ID NO: 7078842 - DNA, 22 bp, Homo sapiens
ctcaggctctggccatccaagg

SEQ ID NO: 7078843 - DNA, 22 bp, Homo sapiens
tttcaaagtcaatatcattacc

SEQ ID NO: 7078844 - DNA, 22 bp, Homo sapiens
tttcaaagtcaagaaggatact

SEQ ID NO: 7078845 - DNA, 22 bp, Homo sapiens
tttcaaagtggagggatggtat

SEQ ID NO: 7078846 - DNA, 22 bp, Homo sapiens
tttcaaagtggagaattagaca

SEQ ID NO: 7078847 - DNA, 22 bp, Homo sapiens
tttcaaagttgggaattgtaat

SEQ ID NO: 7078848 - DNA, 22 bp, Homo sapiens
ctggtgcacatgaaagagaagg

SEQ ID NO: 7078849 - DNA, 22 bp, Homo sapiens
gagaggggacctgtgtgtctag

SEQ ID NO: 7078850 - DNA, 22 bp, Homo sapiens
gagagggctgcctggtgtgagg

SEQ ID NO: 7078851 - DNA, 22 bp, Homo sapiens
gagcatggcagctgagggcagg

SEQ ID NO: 7078852 - DNA, 21 bp, Homo sapiens
gagcatggcttacatcagcag

SEQ ID NO: 7078853 - DNA, 18 bp, Homo sapiens
gagcatgggcagtgggga

SEQ ID NO: 7078854 - DNA, 22 bp, Homo sapiens
gagcatggtgcttcagtgaagg

SEQ ID NO: 7078855 - DNA, 22 bp, Homo sapiens
gagggaggcatcatgaatccag

SEQ ID NO: 7078856 - DNA, 22 bp, Homo sapiens
gagggagccgccacagactggg

SEQ ID NO: 7078857 - DNA, 22 bp, Homo sapiens
gagggagggccaggtcccaacc

SEQ ID NO: 7078858 - DNA, 22 bp, Homo sapiens
gagggagggactagcattctct

SEQ ID NO: 7078859 - DNA, 22 bp, Homo sapiens
gagagggcaaacttgtagctaa

SEQ ID NO: 7078860 - DNA, 22 bp, Homo sapiens
gagacggggtttgagacgggtt

SEQ ID NO: 7078861 - DNA, 22 bp, Homo sapiens
gaagggaatttggagggtttca

SEQ ID NO: 7078862 - DNA, 22 bp, Homo sapiens
gaagggagaaggttgggtgacg

SEQ ID NO: 7078863 - DNA, 22 bp, Homo sapiens
gaaggcccagcttgaatgctgc

SEQ ID NO: 7078864 - DNA, 22 bp, Homo sapiens
gaaggcatcacagaggctgtga

SEQ ID NO: 7078865 - DNA, 22 bp, Homo sapiens
gaaggcatcacagaggctgtgg

SEQ ID NO: 7078866 - DNA, 22 bp, Homo sapiens
gaaggcatcagcaggcaccgat

SEQ ID NO: 7078867 - DNA, 18 bp, Homo sapiens
gaaggcattcagtggctt

SEQ ID NO: 7078868 - DNA, 22 bp, Homo sapiens
gaaggggaaagttgagcaaata

SEQ ID NO: 7078869 - DNA, 22 bp, Homo sapiens
gaaggggactggcagctgcaga

SEQ ID NO: 7078870 - DNA, 22 bp, Homo sapiens
gaagggctcatcaggtggccgc

SEQ ID NO: 7078871 - DNA, 22 bp, Homo sapiens
gaagggcttggctgggaggcca

SEQ ID NO: 7078872 - DNA, 22 bp, Homo sapiens
gaagggctttctgggagaagag

SEQ ID NO: 7078873 - DNA, 22 bp, Homo sapiens
gagggggacgtatcctggtatg

SEQ ID NO: 7078874 - DNA, 22 bp, Homo sapiens
gccaagggtagtggaggcccct

SEQ ID NO: 7078875 - DNA, 22 bp, Homo sapiens
gccaagggaactgagccggagg

SEQ ID NO: 7078876 - DNA, 17 bp, Homo sapiens
gcctactcctatactcc

SEQ ID NO: 7078877 - DNA, 22 bp, Homo sapiens
gctggtaaacttctggtgccat

SEQ ID NO: 7078878 - DNA, 22 bp, Homo sapiens
ggagaggcgatgagtcacagcc

SEQ ID NO: 7078879 - DNA, 19 bp, Homo sapiens
ggaagccctaaaggaccta

SEQ ID NO: 7078880 - DNA, 19 bp, Homo sapiens
ggaagccctgggtcagagc

SEQ ID NO: 7078881 - DNA, 22 bp, Homo sapiens
gcctggtctctggggttgggta

SEQ ID NO: 7078882 - DNA, 22 bp, Homo sapiens
ggcagaaggcctcccagctcct

SEQ ID NO: 7078883 - DNA, 22 bp, Homo sapiens
ggatggccgagaagacagcgta

SEQ ID NO: 7078884 - DNA, 20 bp, Homo sapiens
ggatggccggaccagagcct

SEQ ID NO: 7078885 - DNA, 22 bp, Homo sapiens
gggaagggagggacctcagtct

SEQ ID NO: 7078886 - DNA, 22 bp, Homo sapiens
ggctttatcaaatgagaccctg

SEQ ID NO: 7078887 - DNA, 21 bp, Homo sapiens
ggctttatgctcacccagcct

SEQ ID NO: 7078888 - DNA, 22 bp, Homo sapiens
ggctttattatgtggccatgtg

SEQ ID NO: 7078889 - DNA, 22 bp, Homo sapiens
ggctttatttcactgtaccata

SEQ ID NO: 7078890 - DNA, 22 bp, Homo sapiens
gggagggaggtgatgcttggct

SEQ ID NO: 7078891 - DNA, 22 bp, Homo sapiens
gggagggatctgctaggcaatg

SEQ ID NO: 7078892 - DNA, 22 bp, Homo sapiens
gggaggtgattaggaccatgta

SEQ ID NO: 7078893 - DNA, 22 bp, Homo sapiens
ggtacagggcttcctggacaag

SEQ ID NO: 7078894 - DNA, 22 bp, Homo sapiens
ggtccaggtatgtggtgtgaat

SEQ ID NO: 7078895 - DNA, 21 bp, Homo sapiens
ggtgcaggtaatgatgatata

SEQ ID NO: 7078896 - DNA, 22 bp, Homo sapiens
ggtgcagggagaggcaggcccc

SEQ ID NO: 7078897 - DNA, 22 bp, Homo sapiens
ggtgaaggtcagagcaggaaaa

SEQ ID NO: 7078898 - DNA, 22 bp, Homo sapiens
ggtgaagggccttaggagacag

SEQ ID NO: 7078899 - DNA, 22 bp, Homo sapiens
ggtgaaggcacaagagggcaag

SEQ ID NO: 7078900 - DNA, 20 bp, Homo sapiens
ggtgcgaggccagagcagac

SEQ ID NO: 7078901 - DNA, 22 bp, Homo sapiens
ggtgccaggctgtagtcagggt

SEQ ID NO: 7078902 - DNA, 23 bp, Homo sapiens
gggggccgtcctggggattatag

SEQ ID NO: 7078903 - DNA, 22 bp, Homo sapiens
gggggagagacgagcggctctg

SEQ ID NO: 7078904 - DNA, 22 bp, Homo sapiens
gggggaagaaagaacatggcat

SEQ ID NO: 7078905 - DNA, 22 bp, Homo sapiens
ggggatggtgggaaggcaatct

SEQ ID NO: 7078906 - DNA, 22 bp, Homo sapiens
gggcatgagaggcaggcaagtg

SEQ ID NO: 7078907 - DNA, 22 bp, Homo sapiens
gggcatgagagggcagctggca

SEQ ID NO: 7078908 - DNA, 21 bp, Homo sapiens
gggcctggctgcgcaggacgg

SEQ ID NO: 7078909 - DNA, 22 bp, Homo sapiens
gggcctggcatgcagccccgtt

SEQ ID NO: 7078910 - DNA, 22 bp, Homo sapiens
gtgcaagaaggggagactgggt

SEQ ID NO: 7078911 - DNA, 22 bp, Homo sapiens
gtgcaagaggacagtaagggtg

SEQ ID NO: 7078912 - DNA, 22 bp, Homo sapiens
tagtcaaaaggaaggatatgct

SEQ ID NO: 7078913 - DNA, 22 bp, Homo sapiens
tagtcaaatggcagggatattt

SEQ ID NO: 7078914 - DNA, 22 bp, Homo sapiens
tattcagagtattccatgaggt

SEQ ID NO: 7078915 - DNA, 22 bp, Homo sapiens
tattcagaataaagactacatt

SEQ ID NO: 7078916 - DNA, 17 bp, Homo sapiens
tattcagaggagtattt

SEQ ID NO: 7078917 - DNA, 22 bp, Homo sapiens
tattcaaagtgcgaggtcaggg

SEQ ID NO: 7078918 - DNA, 22 bp, Homo sapiens
tacttcaaacaatggtacaaac

SEQ ID NO: 7078919 - DNA, 22 bp, Homo sapiens
tactggtggaaagagtgaatga

SEQ ID NO: 7078920 - DNA, 22 bp, Homo sapiens
tccactcaaggccattgcacat

SEQ ID NO: 7078921 - DNA, 22 bp, Homo sapiens
tccagggagatggcagaggctg

SEQ ID NO: 7078922 - DNA, 22 bp, Homo sapiens
tcagctttctatgttgctaaac

SEQ ID NO: 7078923 - DNA, 22 bp, Homo sapiens
tcagctttctcagaggcctaac

SEQ ID NO: 7078924 - DNA, 22 bp, Homo sapiens
tcagtggggtcgatgtgaggga

SEQ ID NO: 7078925 - DNA, 22 bp, Homo sapiens
tcactggggccatgtgagggac

SEQ ID NO: 7078926 - DNA, 22 bp, Homo sapiens
tcactgggccctgaggtgggac

SEQ ID NO: 7078927 - DNA, 22 bp, Homo sapiens
tcagaagagtaatagggtgaga

SEQ ID NO: 7078928 - DNA, 22 bp, Homo sapiens
tcaaaagacacaggaggctagt

SEQ ID NO: 7078929 - DNA, 22 bp, Homo sapiens
tcacagacagaagggatgggat

SEQ ID NO: 7078930 - DNA, 22 bp, Homo sapiens
tcacagacatggtgaggtaaca

SEQ ID NO: 7078931 - DNA, 21 bp, Homo sapiens
tttatttatataggacacatg

SEQ ID NO: 7078932 - DNA, 22 bp, Homo sapiens
tttatgtcactttgaaagagag

SEQ ID NO: 7078933 - DNA, 22 bp, Homo sapiens
tttattggatatttacaagata

SEQ ID NO: 7078934 - DNA, 20 bp, Homo sapiens
tttattggcctttcaggaac

SEQ ID NO: 7078935 - DNA, 22 bp, Homo sapiens
ttgtattccagccaccacaggc

SEQ ID NO: 7078936 - DNA, 22 bp, Homo sapiens
ttccaagagctgctggggtaag

SEQ ID NO: 7078937 - DNA, 22 bp, Homo sapiens
ttccaagacttggccagcaggg

SEQ ID NO: 7078938 - DNA, 22 bp, Homo sapiens
ttcaatgaggatagaactggat

SEQ ID NO: 7078939 - DNA, 23 bp, Homo sapiens
ttcagaagaaatgagtacaggag

SEQ ID NO: 7078940 - DNA, 21 bp, Homo sapiens
ttcagaagttgagggcaggtt

SEQ ID NO: 7078941 - DNA, 22 bp, Homo sapiens
ttcatagacaggataacaggat

SEQ ID NO: 7078942 - DNA, 22 bp, Homo sapiens
agcagggcagttaaagggtcct

SEQ ID NO: 7078943 - DNA, 22 bp, Homo sapiens
agaagtatcttgggaaggcact

SEQ ID NO: 7078944 - DNA, 22 bp, Homo sapiens
aagggccattgctgagagcagt

SEQ ID NO: 7078945 - DNA, 22 bp, Homo sapiens
aagggagaaaacttgtggctta

SEQ ID NO: 7078946 - DNA, 20 bp, Homo sapiens
acaaagactggaaaagcaag

SEQ ID NO: 7078947 - DNA, 22 bp, Homo sapiens
aaagatcacactgtggggcagt

SEQ ID NO: 7078948 - DNA, 22 bp, Homo sapiens
aaagtacccaagaacagagtga

SEQ ID NO: 7078949 - DNA, 22 bp, Homo sapiens
aaagtgggaacaatggagagtg

SEQ ID NO: 7078950 - DNA, 22 bp, Homo sapiens
aaagtggggtctagagggcctg

SEQ ID NO: 7078951 - DNA, 22 bp, Homo sapiens
aaaagaccacctcctggtcgaa

SEQ ID NO: 7078952 - DNA, 22 bp, Homo sapiens
aaagaccatgtttacagctagg

SEQ ID NO: 7078953 - DNA, 22 bp, Homo sapiens
agtctttactaaacagaccacc

SEQ ID NO: 7078954 - DNA, 22 bp, Homo sapiens
acgctggtgaaagggtggtttt

SEQ ID NO: 7078955 - DNA, 22 bp, Homo sapiens
actcaggctgttttttccttgt

SEQ ID NO: 7078956 - DNA, 22 bp, Homo sapiens
actcagcttgcacacatcaatg

SEQ ID NO: 7078957 - DNA, 22 bp, Homo sapiens
aggtggcatgcctgagacataa

SEQ ID NO: 7078958 - DNA, 22 bp, Homo sapiens
acctgcaggcacaggtgtgcgc

SEQ ID NO: 7078959 - DNA, 22 bp, Homo sapiens
agaaagggtcactgaaagagga

SEQ ID NO: 7078960 - DNA, 22 bp, Homo sapiens
atctcaaacatctttgaccata

SEQ ID NO: 7078961 - DNA, 22 bp, Homo sapiens
aggctttaagtggcctacagct

SEQ ID NO: 7078962 - DNA, 22 bp, Homo sapiens
aggctttaattatctacaggag

SEQ ID NO: 7078963 - DNA, 22 bp, Homo sapiens
aggctttactgcctcaggactc

SEQ ID NO: 7078964 - DNA, 18 bp, Homo sapiens
agggagagaccgcgggtc

SEQ ID NO: 7078965 - DNA, 22 bp, Homo sapiens
atgggtgcagcatggtgggaac

SEQ ID NO: 7078966 - DNA, 22 bp, Homo sapiens
agagaagctgacaggggcgtgc

SEQ ID NO: 7078967 - DNA, 22 bp, Homo sapiens
agagaccagaatccagctgcct

SEQ ID NO: 7078968 - DNA, 19 bp, Homo sapiens
agagaccacagagctgcct

SEQ ID NO: 7078969 - DNA, 22 bp, Homo sapiens
agaccaagtgcaggtgccacta

SEQ ID NO: 7078970 - DNA, 22 bp, Homo sapiens
agaccagggtcccacagagtct

SEQ ID NO: 7078971 - DNA, 22 bp, Homo sapiens
attattcaacacttgagaaatt

SEQ ID NO: 7078972 - DNA, 22 bp, Homo sapiens
attattcaaattcccactatac

SEQ ID NO: 7078973 - DNA, 22 bp, Homo sapiens
caagaccaatttgaattaacca

SEQ ID NO: 7078974 - DNA, 21 bp, Homo sapiens
cacaagacacatagggtgttt

SEQ ID NO: 7078975 - DNA, 22 bp, Homo sapiens
agcccaagctatgaggtgacct

SEQ ID NO: 7078976 - DNA, 22 bp, Homo sapiens
agcccaaggccacacagttagt

SEQ ID NO: 7078977 - DNA, 22 bp, Homo sapiens
catagccagccattgctcccaa

SEQ ID NO: 7078978 - DNA, 22 bp, Homo sapiens
catagccatctttagcttccag

SEQ ID NO: 7078979 - DNA, 22 bp, Homo sapiens
caggtgcagctggatggaagcc

SEQ ID NO: 7078980 - DNA, 22 bp, Homo sapiens
aggaccaacatagcagcagtgg

SEQ ID NO: 7078981 - DNA, 22 bp, Homo sapiens
aggaccaagagcagaggcatca

SEQ ID NO: 7078982 - DNA, 21 bp, Homo sapiens
aggagggcacaaggccaggaa

SEQ ID NO: 7078983 - DNA, 22 bp, Homo sapiens
aggaggggcaatgatagtctgg

SEQ ID NO: 7078984 - DNA, 20 bp, Homo sapiens
aggaggggatagaatcaaag

SEQ ID NO: 7078985 - DNA, 22 bp, Homo sapiens
catgggggctgaggctgctgta

SEQ ID NO: 7078986 - DNA, 22 bp, Homo sapiens
catttgttcaaccattctcgct

SEQ ID NO: 7078987 - DNA, 22 bp, Homo sapiens
ccaagcgggaatgcaatggcgt

SEQ ID NO: 7078988 - DNA, 22 bp, Homo sapiens
ccaaggggattgcagaagcagc

SEQ ID NO: 7078989 - DNA, 22 bp, Homo sapiens
cagggtgcagagctagggtagt

SEQ ID NO: 7078990 - DNA, 22 bp, Homo sapiens
aggcatggcactgagcagcttc

SEQ ID NO: 7078991 - DNA, 22 bp, Homo sapiens
aggcatggatggatccagggct

SEQ ID NO: 7078992 - DNA, 22 bp, Homo sapiens
aggcatggacatttcggcagct

SEQ ID NO: 7078993 - DNA, 21 bp, Homo sapiens
aggcatggaaatggcacactg

SEQ ID NO: 7078994 - DNA, 22 bp, Homo sapiens
aggcaggggagctggaagggta

SEQ ID NO: 7078995 - DNA, 17 bp, Homo sapiens
aggggagagtgggaaga

SEQ ID NO: 7078996 - DNA, 22 bp, Homo sapiens
aggggctggcttatctgagagt

SEQ ID NO: 7078997 - DNA, 22 bp, Homo sapiens
aggggctgggacagagccaagc

SEQ ID NO: 7078998 - DNA, 22 bp, Homo sapiens
ccgcccacactaaatatgagcg

SEQ ID NO: 7078999 - DNA, 20 bp, Homo sapiens
cctttattatttgtatgatg

SEQ ID NO: 7079000 - DNA, 22 bp, Homo sapiens
cgtggccagcacaaggcagtga

SEQ ID NO: 7079001 - DNA, 22 bp, Homo sapiens
cgtggccagtttcaagctacca

SEQ ID NO: 7079002 - DNA, 20 bp, Homo sapiens
aggtgcaaggcatggcatgt

SEQ ID NO: 7079003 - DNA, 22 bp, Homo sapiens
ctgttattcaagacaaaggcag

SEQ ID NO: 7079004 - DNA, 19 bp, Homo sapiens
agtttattataggtgattc

SEQ ID NO: 7079005 - DNA, 20 bp, Homo sapiens
agtttattccaggagaactg

SEQ ID NO: 7079006 - DNA, 22 bp, Homo sapiens
ataggggcagatgaggaatggg

SEQ ID NO: 7079007 - DNA, 21 bp, Homo sapiens
atagaccagtatggataacag

SEQ ID NO: 7079008 - DNA, 22 bp, Homo sapiens
ataggccatttgagggccaggt

SEQ ID NO: 7079009 - DNA, 22 bp, Homo sapiens
gagaaggggtgatgtgggtaat

SEQ ID NO: 7079010 - DNA, 22 bp, Homo sapiens
atggcacacaggtctgcaaggg

SEQ ID NO: 7079011 - DNA, 22 bp, Homo sapiens
atggcacaggagaggagggctg

SEQ ID NO: 7079012 - DNA, 22 bp, Homo sapiens
atggagggtgtcagagagcgaa

SEQ ID NO: 7079013 - DNA, 22 bp, Homo sapiens
atgtgccaatttatagaggctc

SEQ ID NO: 7079014 - DNA, 22 bp, Homo sapiens
gaggcacagtcccgaggcaagg

SEQ ID NO: 7079015 - DNA, 22 bp, Homo sapiens
gaggcacagagccctaggagct

SEQ ID NO: 7079016 - DNA, 22 bp, Homo sapiens
gaggcacagagtaggtgcacac

SEQ ID NO: 7079017 - DNA, 23 bp, Homo sapiens
gaggagggtcgtgctgtgttcct

SEQ ID NO: 7079018 - DNA, 22 bp, Homo sapiens
gaaggagggagcggcgcggatt

SEQ ID NO: 7079019 - DNA, 22 bp, Homo sapiens
ctttttcaagtcaaagagggta

SEQ ID NO: 7079020 - DNA, 22 bp, Homo sapiens
ctttattctgcaaattgccttg

SEQ ID NO: 7079021 - DNA, 22 bp, Homo sapiens
ctttattcctacaagattttct

SEQ ID NO: 7079022 - DNA, 22 bp, Homo sapiens
gatggccaaggaccacgcatcg

SEQ ID NO: 7079023 - DNA, 22 bp, Homo sapiens
gatggccacatacatggctggg

SEQ ID NO: 7079024 - DNA, 21 bp, Homo sapiens
gcagagaatgaactttggctt

SEQ ID NO: 7079025 - DNA, 22 bp, Homo sapiens
gcatggcaaatatcgagggcag

SEQ ID NO: 7079026 - DNA, 22 bp, Homo sapiens
attgcaaagcgtagactctaaa

SEQ ID NO: 7079027 - DNA, 22 bp, Homo sapiens
attgcaaataactgtactgaat

SEQ ID NO: 7079028 - DNA, 22 bp, Homo sapiens
attgcaaataatgcgagccagt

SEQ ID NO: 7079029 - DNA, 22 bp, Homo sapiens
attcacaacaaaaggatatgag

SEQ ID NO: 7079030 - DNA, 22 bp, Homo sapiens
attcacaaagaagggaagtaca

SEQ ID NO: 7079031 - DNA, 22 bp, Homo sapiens
gcaggcaattttggaaggtcag

SEQ ID NO: 7079032 - DNA, 22 bp, Homo sapiens
gcaggcaaggtagacagaggaa

SEQ ID NO: 7079033 - DNA, 20 bp, Homo sapiens
caaagacatgctaggggtgg

SEQ ID NO: 7079034 - DNA, 22 bp, Homo sapiens
caaagaccatgtggcctgaaaa

SEQ ID NO: 7079035 - DNA, 19 bp, Homo sapiens
atttattgtatgattccat

SEQ ID NO: 7079036 - DNA, 22 bp, Homo sapiens
ggcaagggttgaagataaggta

SEQ ID NO: 7079037 - DNA, 22 bp, Homo sapiens
ggcaaggggtcaggctgagaca

SEQ ID NO: 7079038 - DNA, 22 bp, Homo sapiens
cactcaggctgtgtcaggagga

SEQ ID NO: 7079039 - DNA, 22 bp, Homo sapiens
caagaaggcatccccagtccct

SEQ ID NO: 7079040 - DNA, 22 bp, Homo sapiens
caagaaggctatatgggccagg

SEQ ID NO: 7079041 - DNA, 22 bp, Homo sapiens
gggaggcagtgctggaggctgg

SEQ ID NO: 7079042 - DNA, 22 bp, Homo sapiens
cagagaagagtctggcctctct

SEQ ID NO: 7079043 - DNA, 20 bp, Homo sapiens
gggtacagttctgcagttac

SEQ ID NO: 7079044 - DNA, 20 bp, Homo sapiens
gggtacagatatgcagtgaa

SEQ ID NO: 7079045 - DNA, 22 bp, Homo sapiens
gggtacagagagatgaggtaac

SEQ ID NO: 7079046 - DNA, 22 bp, Homo sapiens
ggtcctggaagtgtaagtggca

SEQ ID NO: 7079047 - DNA, 22 bp, Homo sapiens
ggtcctggcagctctgtgtcca

SEQ ID NO: 7079048 - DNA, 22 bp, Homo sapiens
ggtcaagaatttggccgtggct

SEQ ID NO: 7079049 - DNA, 22 bp, Homo sapiens
tctttatttaagtctgttgtaa

SEQ ID NO: 7079050 - DNA, 22 bp, Homo sapiens
tctttatttctgaatcccccat

SEQ ID NO: 7079051 - DNA, 22 bp, Homo sapiens
tctttattttatgcttgtgcaa

SEQ ID NO: 7079052 - DNA, 22 bp, Homo sapiens
ccatggcctcgctctacgtggg

SEQ ID NO: 7079053 - DNA, 22 bp, Homo sapiens
ccatggccgccgctgctcagga

SEQ ID NO: 7079054 - DNA, 22 bp, Homo sapiens
ccatggccaattgcaccttgct

SEQ ID NO: 7079055 - DNA, 20 bp, Homo sapiens
ccatggccacatctgtgctg

SEQ ID NO: 7079056 - DNA, 22 bp, Homo sapiens
ccatggccaggaaagccaaggt

SEQ ID NO: 7079057 - DNA, 23 bp, Homo sapiens
ccatggccaatgtcaagctacta

SEQ ID NO: 7079058 - DNA, 22 bp, Homo sapiens
cccaagagcttctaggacgctg

SEQ ID NO: 7079059 - DNA, 22 bp, Homo sapiens
tggaggtctgcaaggcgctgga

SEQ ID NO: 7079060 - DNA, 19 bp, Homo sapiens
tggaggtccaggagtaggg

SEQ ID NO: 7079061 - DNA, 22 bp, Homo sapiens
tggaggtcctgcaggatggcac

SEQ ID NO: 7079062 - DNA, 22 bp, Homo sapiens
tggaggtcgctagcgagcgggc

SEQ ID NO: 7079063 - DNA, 22 bp, Homo sapiens
ccctactctgccactttttctg

SEQ ID NO: 7079064 - DNA, 22 bp, Homo sapiens
ccctactcaccacacatcttta

SEQ ID NO: 7079065 - DNA, 22 bp, Homo sapiens
ccctactccatagtcaattcat

SEQ ID NO: 7079066 - DNA, 22 bp, Homo sapiens
cctggaggctctgggagggcag

SEQ ID NO: 7079067 - DNA, 22 bp, Homo sapiens
tggggtacttgtatcaaagcac

SEQ ID NO: 7079068 - DNA, 22 bp, Homo sapiens
cctgagggctcagcccccagcc

SEQ ID NO: 7079069 - DNA, 22 bp, Homo sapiens
cctgaggggctgcaggccagct

SEQ ID NO: 7079070 - DNA, 22 bp, Homo sapiens
tactcagaaggaattgtgtttt

SEQ ID NO: 7079071 - DNA, 22 bp, Homo sapiens
tactcagacttgaatctcaaga

SEQ ID NO: 7079072 - DNA, 22 bp, Homo sapiens
tactcagattcttcatattcag

SEQ ID NO: 7079073 - DNA, 22 bp, Homo sapiens
caggggaagatgccaagggaga

SEQ ID NO: 7079074 - DNA, 22 bp, Homo sapiens
caggggagtgagtccctctctg

SEQ ID NO: 7079075 - DNA, 22 bp, Homo sapiens
tcacagacctggtgggaggtgg

SEQ ID NO: 7079076 - DNA, 22 bp, Homo sapiens
tcaatgactggtccaaggtggc

SEQ ID NO: 7079077 - DNA, 22 bp, Homo sapiens
tcacaagaactttggagggata

SEQ ID NO: 7079078 - DNA, 18 bp, Homo sapiens
tcacagacttactgggcc

SEQ ID NO: 7079079 - DNA, 22 bp, Homo sapiens
tcacagacttgtctccagggat

SEQ ID NO: 7079080 - DNA, 22 bp, Homo sapiens
cagtgggggtgaggccgaggta

SEQ ID NO: 7079081 - DNA, 22 bp, Homo sapiens
cagtggggtttctgtgggtgct

SEQ ID NO: 7079082 - DNA, 22 bp, Homo sapiens
tcagacttctactttgcagagc

SEQ ID NO: 7079083 - DNA, 21 bp, Homo sapiens
tcagacttgagctcttctaca

SEQ ID NO: 7079084 - DNA, 22 bp, Homo sapiens
tcagacttgcctttttataaaa

SEQ ID NO: 7079085 - DNA, 22 bp, Homo sapiens
tcagacttttaaagactgaatg

SEQ ID NO: 7079086 - DNA, 22 bp, Homo sapiens
tcagctttttacatgtgaaata

SEQ ID NO: 7079087 - DNA, 18 bp, Homo sapiens
tcagcttttgaaaaccaa

SEQ ID NO: 7079088 - DNA, 22 bp, Homo sapiens
tcagctttgcaagttagaaaat

SEQ ID NO: 7079089 - DNA, 22 bp, Homo sapiens
tcagcttttaaaaacaagaagt

SEQ ID NO: 7079090 - DNA, 22 bp, Homo sapiens
cattcaaaggcatgtcctattt

SEQ ID NO: 7079091 - DNA, 22 bp, Homo sapiens
cattcaaattaagattttgtta

SEQ ID NO: 7079092 - DNA, 22 bp, Homo sapiens
cattcaaatgtgccactgtcct

SEQ ID NO: 7079093 - DNA, 20 bp, Homo sapiens
tcccactcttgtgttttcag

SEQ ID NO: 7079094 - DNA, 22 bp, Homo sapiens
cggggagggcagaggctccctc

SEQ ID NO: 7079095 - DNA, 22 bp, Homo sapiens
cggggaggcttcggattaaagc

SEQ ID NO: 7079096 - DNA, 22 bp, Homo sapiens
cgggcaaggcgagactaggccc

SEQ ID NO: 7079097 - DNA, 22 bp, Homo sapiens
ttattcagattggctacaggat

SEQ ID NO: 7079098 - DNA, 22 bp, Homo sapiens
ttcaaagtagggtagggggtcc

SEQ ID NO: 7079099 - DNA, 22 bp, Homo sapiens
ttattgcaactttagggataga

SEQ ID NO: 7079100 - DNA, 22 bp, Homo sapiens
ctcaggacccaccttattagga

SEQ ID NO: 7079101 - DNA, 22 bp, Homo sapiens
ctcaggacagattccagagaaa

SEQ ID NO: 7079102 - DNA, 22 bp, Homo sapiens
ctcaggactttcaaatagaaat

SEQ ID NO: 7079103 - DNA, 22 bp, Homo sapiens
ctcagtcttctcctccaatgga

SEQ ID NO: 7079104 - DNA, 22 bp, Homo sapiens
ctcagagctcagctttgttagt

SEQ ID NO: 7079105 - DNA, 22 bp, Homo sapiens
ctcagagcacagtttatgacag

SEQ ID NO: 7079106 - DNA, 22 bp, Homo sapiens
ctcagagcacttttgaaagctc

SEQ ID NO: 7079107 - DNA, 22 bp, Homo sapiens
ctcactcagtttttagttcatc

SEQ ID NO: 7079108 - DNA, 22 bp, Homo sapiens
cgtttattttgaagattccact

SEQ ID NO: 7079109 - DNA, 22 bp, Homo sapiens
cgtttattttgaagattccact

SEQ ID NO: 7079110 - DNA, 22 bp, Homo sapiens
tttatgcacacttagacatggc

SEQ ID NO: 7079111 - DNA, 23 bp, Homo sapiens
tttatgcagcatgtagaacatgg

SEQ ID NO: 7079112 - DNA, 22 bp, Homo sapiens
tttatgcagcctcagtatcaga

SEQ ID NO: 7079113 - DNA, 22 bp, Homo sapiens
tttattcactggggtctgcccg

SEQ ID NO: 7079114 - DNA, 22 bp, Homo sapiens
tttattcacttcagtgccaaag

SEQ ID NO: 7079115 - DNA, 19 bp, Homo sapiens
tttattcacctttaccttg

SEQ ID NO: 7079116 - DNA, 22 bp, Homo sapiens
tttattcactcattcagccagt

SEQ ID NO: 7079117 - DNA, 22 bp, Homo sapiens
tttattcatcatctgttcatat

SEQ ID NO: 7079118 - DNA, 22 bp, Homo sapiens
tttattcagcagcagcagtggt

SEQ ID NO: 7079119 - DNA, 20 bp, Homo sapiens
tttattcagcctaccctctt

SEQ ID NO: 7079120 - DNA, 22 bp, Homo sapiens
tttattcattgtttcgtcgcag

SEQ ID NO: 7079121 - DNA, 22 bp, Homo sapiens
ctgggggtcgcgcctctgggca

SEQ ID NO: 7079122 - DNA, 22 bp, Homo sapiens
ctgggggtcttgaaagggagag

SEQ ID NO: 7079123 - DNA, 22 bp, Homo sapiens
ctgggggtgagcagcagcgacg

SEQ ID NO: 7079124 - DNA, 19 bp, Homo sapiens
ctgggggtgctcacgctct

SEQ ID NO: 7079125 - DNA, 22 bp, Homo sapiens
ctgtgggagcagcaccaaggac

SEQ ID NO: 7079126 - DNA, 22 bp, Homo sapiens
cttcttcagcacaatattgatg

SEQ ID NO: 7079127 - DNA, 20 bp, Homo sapiens
cttcttcagcctatgcttca

SEQ ID NO: 7079128 - DNA, 20 bp, Homo sapiens
cttcttcagtagtttgttct

SEQ ID NO: 7079129 - DNA, 22 bp, Homo sapiens
cttcttcagttgcatgtattgg

SEQ ID NO: 7079130 - DNA, 22 bp, Homo sapiens
cttcttcaagagaatgggagac

SEQ ID NO: 7079131 - DNA, 22 bp, Homo sapiens
cttcaaagatttgataaagcca

SEQ ID NO: 7079132 - DNA, 20 bp, Homo sapiens
cttcaaaggcagtaacagcc

SEQ ID NO: 7079133 - DNA, 22 bp, Homo sapiens
cttcaaagggtcactatttatc

SEQ ID NO: 7079134 - DNA, 22 bp, Homo sapiens
gaagaagcaggagtgtgtagca

SEQ ID NO: 7079135 - DNA, 22 bp, Homo sapiens
gaagaagcctctgtggatctga

SEQ ID NO: 7079136 - DNA, 19 bp, Homo sapiens
gaagaagcttgagaagtag

SEQ ID NO: 7079137 - DNA, 22 bp, Homo sapiens
gaaagaccagaattatggactc

SEQ ID NO: 7079138 - DNA, 22 bp, Homo sapiens
gaaagaccagcatgaggcttta

SEQ ID NO: 7079139 - DNA, 22 bp, Homo sapiens
gaaagaccgtttgggctctaaa

SEQ ID NO: 7079140 - DNA, 22 bp, Homo sapiens
gaaagaagctttagatggctat

SEQ ID NO: 7079141 - DNA, 22 bp, Homo sapiens
gaggcatggcctgaggctagga

SEQ ID NO: 7079142 - DNA, 22 bp, Homo sapiens
gagggaccccaggctggccctt

SEQ ID NO: 7079143 - DNA, 22 bp, Homo sapiens
gagggcctagaagctccatatg

SEQ ID NO: 7079144 - DNA, 22 bp, Homo sapiens
gagggcctctgctgctccacat

SEQ ID NO: 7079145 - DNA, 22 bp, Homo sapiens
gagcaagattaaaaggctgggt

SEQ ID NO: 7079146 - DNA, 22 bp, Homo sapiens
gagaagcaatcagtggccaccc

SEQ ID NO: 7079147 - DNA, 22 bp, Homo sapiens
gaatggccccagagcaccactg

SEQ ID NO: 7079148 - DNA, 22 bp, Homo sapiens
gacctggggtggaaggaaggca

SEQ ID NO: 7079149 - DNA, 22 bp, Homo sapiens
gacatggcttctaggaagcttt

SEQ ID NO: 7079150 - DNA, 22 bp, Homo sapiens
gccaggaaaaaccggccctgct

SEQ ID NO: 7079151 - DNA, 22 bp, Homo sapiens
gcccaagacatttagtaaagag

SEQ ID NO: 7079152 - DNA, 22 bp, Homo sapiens
gcccaagagagcgaaggttggc

SEQ ID NO: 7079153 - DNA, 22 bp, Homo sapiens
gcccaagatctggagctgcagg

SEQ ID NO: 7079154 - DNA, 22 bp, Homo sapiens
gcagggccagtgcagagaggaa

SEQ ID NO: 7079155 - DNA, 22 bp, Homo sapiens
gcaggccctcctctagcaaggc

SEQ ID NO: 7079156 - DNA, 22 bp, Homo sapiens
gcagaaggatccgcaggtgcaa

SEQ ID NO: 7079157 - DNA, 22 bp, Homo sapiens
gcaaggagactgtagggccaag

SEQ ID NO: 7079158 - DNA, 22 bp, Homo sapiens
ggactttaaaaagatgaccttt

SEQ ID NO: 7079159 - DNA, 22 bp, Homo sapiens
ggactttaattctttcctaagc

SEQ ID NO: 7079160 - DNA, 22 bp, Homo sapiens
ggactttaggaagggccaagtg

SEQ ID NO: 7079161 - DNA, 22 bp, Homo sapiens
gctggccacagatccccaggga

SEQ ID NO: 7079162 - DNA, 19 bp, Homo sapiens
gctggccacgccccagttg

SEQ ID NO: 7079163 - DNA, 22 bp, Homo sapiens
gctgagggtaacacttcgggat

SEQ ID NO: 7079164 - DNA, 22 bp, Homo sapiens
gggaagccatgctcagaggtac

SEQ ID NO: 7079165 - DNA, 16 bp, Homo sapiens
gggagtgaaggagggt

SEQ ID NO: 7079166 - DNA, 22 bp, Homo sapiens
gggcagaggctctggcccatcc

SEQ ID NO: 7079167 - DNA, 22 bp, Homo sapiens
gggccggagctgggtcccgcgc

SEQ ID NO: 7079168 - DNA, 22 bp, Homo sapiens
gggccgtagaccacgtccgggc

SEQ ID NO: 7079169 - DNA, 22 bp, Homo sapiens
ggggagaattacatggcgtgga

SEQ ID NO: 7079170 - DNA, 22 bp, Homo sapiens
gggtgcaactaagaagaggtga

SEQ ID NO: 7079171 - DNA, 22 bp, Homo sapiens
gggtgcaagcaagtggcacaga

SEQ ID NO: 7079172 - DNA, 22 bp, Homo sapiens
gggtgcaagccaaagaagactg

SEQ ID NO: 7079173 - DNA, 22 bp, Homo sapiens
gggtggtctggcaggctggaaa

SEQ ID NO: 7079174 - DNA, 22 bp, Homo sapiens
ggttcagggatgtgggtgatgc

SEQ ID NO: 7079175 - DNA, 22 bp, Homo sapiens
ggttcagggctaccagtgggtg

SEQ ID NO: 7079176 - DNA, 22 bp, Homo sapiens
ggtgagggacatcactcagcca

SEQ ID NO: 7079177 - DNA, 22 bp, Homo sapiens
ggtgacagcgggtcaagaggag

SEQ ID NO: 7079178 - DNA, 22 bp, Homo sapiens
gtcaaagaaacgcaccttacat

SEQ ID NO: 7079179 - DNA, 22 bp, Homo sapiens
gtcaaagatcctatgagttaaa

SEQ ID NO: 7079180 - DNA, 18 bp, Homo sapiens
gtgccaggaggcgcagcc

SEQ ID NO: 7079181 - DNA, 22 bp, Homo sapiens
gtgccaggcccagggagcgggg

SEQ ID NO: 7079182 - DNA, 22 bp, Homo sapiens
gtgccagggagtggaggagctt

SEQ ID NO: 7079183 - DNA, 22 bp, Homo sapiens
gtgcagggagcccagaaggtcc

SEQ ID NO: 7079184 - DNA, 22 bp, Homo sapiens
gtgcagggtagcgacggcagga

SEQ ID NO: 7079185 - DNA, 22 bp, Homo sapiens
gtgcagggcagccgaatgggct

SEQ ID NO: 7079186 - DNA, 17 bp, Homo sapiens
gtgcagggatgaaggat

SEQ ID NO: 7079187 - DNA, 22 bp, Homo sapiens
gtctttatatttactaaagaat

SEQ ID NO: 7079188 - DNA, 22 bp, Homo sapiens
taaaagaccacaaggtggtaat

SEQ ID NO: 7079189 - DNA, 22 bp, Homo sapiens
taaagaccaaacacagtgcaga

SEQ ID NO: 7079190 - DNA, 22 bp, Homo sapiens
taagaccaaagttctgtaggga

SEQ ID NO: 7079191 - DNA, 22 bp, Homo sapiens
taagaccaatcctgtgtacctc

SEQ ID NO: 7079192 - DNA, 22 bp, Homo sapiens
taagaccagtatgcattttcac

SEQ ID NO: 7079193 - DNA, 22 bp, Homo sapiens
taagaccatacatttccacaga

SEQ ID NO: 7079194 - DNA, 22 bp, Homo sapiens
tcaaagaatgttatgagggtag

SEQ ID NO: 7079195 - DNA, 20 bp, Homo sapiens
tcaaagacaagctctcatcc

SEQ ID NO: 7079196 - DNA, 22 bp, Homo sapiens
tcaaagacagacatcagtcaaa

SEQ ID NO: 7079197 - DNA, 22 bp, Homo sapiens
tcaaagacatctggtagctgag

SEQ ID NO: 7079198 - DNA, 22 bp, Homo sapiens
tcaaagacatggggaagctgag

SEQ ID NO: 7079199 - DNA, 22 bp, Homo sapiens
tcaaagactatatattttattt

SEQ ID NO: 7079200 - DNA, 21 bp, Homo sapiens
tcaaagactggggctgtgtgc

SEQ ID NO: 7079201 - DNA, 22 bp, Homo sapiens
tcaaagatcagatggttgtagg

SEQ ID NO: 7079202 - DNA, 22 bp, Homo sapiens
tcaaaggcttgtggttctggga

SEQ ID NO: 7079203 - DNA, 22 bp, Homo sapiens
tatgggtgttaatggtgagaga

SEQ ID NO: 7079204 - DNA, 22 bp, Homo sapiens
tccatggggcccaggatgagag

SEQ ID NO: 7079205 - DNA, 22 bp, Homo sapiens
tccagggaagagcagaggctac

SEQ ID NO: 7079206 - DNA, 22 bp, Homo sapiens
tcctgaggaccctgtcaggggc

SEQ ID NO: 7079207 - DNA, 22 bp, Homo sapiens
tcctgaggactaacaggaagga

SEQ ID NO: 7079208 - DNA, 22 bp, Homo sapiens
tcctgaggcacaatcctagaat

SEQ ID NO: 7079209 - DNA, 22 bp, Homo sapiens
tcaagaagataatgtctagggt

SEQ ID NO: 7079210 - DNA, 23 bp, Homo sapiens
tcaacagagcagagggaggcttt

SEQ ID NO: 7079211 - DNA, 22 bp, Homo sapiens
tcaggcttcttctgagcaggga

SEQ ID NO: 7079212 - DNA, 22 bp, Homo sapiens
tcaggcttgggaggcccagggc

SEQ ID NO: 7079213 - DNA, 22 bp, Homo sapiens
tcaggcttgtctctagagcaat

SEQ ID NO: 7079214 - DNA, 22 bp, Homo sapiens
tcaggctttgggaatgccactt

SEQ ID NO: 7079215 - DNA, 22 bp, Homo sapiens
tccaaagaacctggctactgtc

SEQ ID NO: 7079216 - DNA, 22 bp, Homo sapiens
tccaaagaatagaggtgacatt

SEQ ID NO: 7079217 - DNA, 22 bp, Homo sapiens
tccaagggttcatgtgcattca

SEQ ID NO: 7079218 - DNA, 22 bp, Homo sapiens
tccaagggctttggcgtgaagt

SEQ ID NO: 7079219 - DNA, 22 bp, Homo sapiens
tccaagggctcatggacacttt

SEQ ID NO: 7079220 - DNA, 23 bp, Homo sapiens
tccaagggctacaaacacagacc

SEQ ID NO: 7079221 - DNA, 22 bp, Homo sapiens
tccaagggcagccatagaactt

SEQ ID NO: 7079222 - DNA, 22 bp, Homo sapiens
tccaagggcaacaatggaacac

SEQ ID NO: 7079223 - DNA, 22 bp, Homo sapiens
tccaagggaatgtgggcaatgc

SEQ ID NO: 7079224 - DNA, 22 bp, Homo sapiens
ttcttcaaatagcagggagtca

SEQ ID NO: 7079225 - DNA, 23 bp, Homo sapiens
ttcaaagatcttctgaaatctgt

SEQ ID NO: 7079226 - DNA, 22 bp, Homo sapiens
ttcaaagatggagggatagatt

SEQ ID NO: 7079227 - DNA, 22 bp, Homo sapiens
ttcaaagattagcatacgcaat

SEQ ID NO: 7079228 - DNA, 22 bp, Homo sapiens
ttcaaagattttcccaaagctc

SEQ ID NO: 7079229 - DNA, 22 bp, Homo sapiens
ttcaaagaattttgagacctga

SEQ ID NO: 7079230 - DNA, 20 bp, Homo sapiens
ttcaaagaccctcaggtcca

SEQ ID NO: 7079231 - DNA, 22 bp, Homo sapiens
ttcaaagaccttacttggcaaa

SEQ ID NO: 7079232 - DNA, 21 bp, Homo sapiens
ttcaaagacttgatgctgacc

SEQ ID NO: 7079233 - DNA, 22 bp, Homo sapiens
ttcaaagagaaattgtattttc

SEQ ID NO: 7079234 - DNA, 21 bp, Homo sapiens
ttcaaagagtgggcattgtca

SEQ ID NO: 7079235 - DNA, 22 bp, Homo sapiens
ttcaaagagttgggtgtctggg

SEQ ID NO: 7079236 - DNA, 22 bp, Homo sapiens
ttcaaagataatgtagcatttt

SEQ ID NO: 7079237 - DNA, 22 bp, Homo sapiens
ttcaaagataattaccaaacat

SEQ ID NO: 7079238 - DNA, 18 bp, Homo sapiens
ttcacagatccacaggaa

SEQ ID NO: 7079239 - DNA, 22 bp, Homo sapiens
ttattacagtcccagggagtag

SEQ ID NO: 7079240 - DNA, 22 bp, Homo sapiens
ttattaggttattctctgtact

SEQ ID NO: 7079241 - DNA, 23 bp, Homo sapiens
ttcaaacagctacaagggggtgg

SEQ ID NO: 7079242 - DNA, 22 bp, Homo sapiens
ttcaaacaggggtcagggagat

SEQ ID NO: 7079243 - DNA, 22 bp, Homo sapiens
ttcaaacactgttggcactggg

SEQ ID NO: 7079244 - DNA, 20 bp, Homo sapiens
tttattcacagagaagagtt

SEQ ID NO: 7079245 - DNA, 22 bp, Homo sapiens
tttcaaagtaaggattttcatc

SEQ ID NO: 7079246 - DNA, 22 bp, Homo sapiens
tttcaaaggttttgtcatgtct

SEQ ID NO: 7079247 - DNA, 22 bp, Homo sapiens
tttcaaaggtggaagagtgaat

SEQ ID NO: 7079248 - DNA, 19 bp, Homo sapiens
tttcaaagggcataagcct

SEQ ID NO: 7079249 - DNA, 22 bp, Homo sapiens
tttatccaccagggactaggac

SEQ ID NO: 7079250 - DNA, 22 bp, Homo sapiens
tttattcaagatgaggttcatg

SEQ ID NO: 7079251 - DNA, 22 bp, Homo sapiens
tttatctcttttgaccaagatt

SEQ ID NO: 7079252 - DNA, 22 bp, Homo sapiens
tttgattctgtaaaataacagg

SEQ ID NO: 7079253 - DNA, 22 bp, Homo sapiens
agaggcaaaaatctatggcaac

SEQ ID NO: 7079254 - DNA, 22 bp, Homo sapiens
aaggaaggttcatagtcaaaga

SEQ ID NO: 7079255 - DNA, 22 bp, Homo sapiens
aagggctggccctgggaagagt

SEQ ID NO: 7079256 - DNA, 19 bp, Homo sapiens
aagggtcacaagcagcaga

SEQ ID NO: 7079257 - DNA, 22 bp, Homo sapiens
agaagccactgctcccagtgag

SEQ ID NO: 7079258 - DNA, 18 bp, Homo sapiens
agaagccacgaggagtcc

SEQ ID NO: 7079259 - DNA, 22 bp, Homo sapiens
agaagccagccttgcctccttt

SEQ ID NO: 7079260 - DNA, 22 bp, Homo sapiens
aagaaggcctctgccctggctt

SEQ ID NO: 7079261 - DNA, 20 bp, Homo sapiens
aagaaggcctgcccagacac

SEQ ID NO: 7079262 - DNA, 22 bp, Homo sapiens
aagaaggcttcagagcccagga

SEQ ID NO: 7079263 - DNA, 22 bp, Homo sapiens
aaatgaccagaatacaggcttc

SEQ ID NO: 7079264 - DNA, 22 bp, Homo sapiens
aaagggagcatggctgcaggga

SEQ ID NO: 7079265 - DNA, 21 bp, Homo sapiens
aagcagggactgcccaggtcc

SEQ ID NO: 7079266 - DNA, 16 bp, Homo sapiens
aaggagggaagagaat

SEQ ID NO: 7079267 - DNA, 22 bp, Homo sapiens
aaggagggaaagcagtgcttct

SEQ ID NO: 7079268 - DNA, 22 bp, Homo sapiens
aaggagggttcccaggtcctgg

SEQ ID NO: 7079269 - DNA, 22 bp, Homo sapiens
agcaaggctcttaatgcccaaa

SEQ ID NO: 7079270 - DNA, 22 bp, Homo sapiens
agagctttgtttgattgtcaga

SEQ ID NO: 7079271 - DNA, 22 bp, Homo sapiens
agagcttttctgtaataacatc

SEQ ID NO: 7079272 - DNA, 22 bp, Homo sapiens
agagcttttgggaattcaggta

SEQ ID NO: 7079273 - DNA, 22 bp, Homo sapiens
agaggccggccgagcccatggg

SEQ ID NO: 7079274 - DNA, 22 bp, Homo sapiens
attcaaagaacctttagcattg

SEQ ID NO: 7079275 - DNA, 21 bp, Homo sapiens
attcaaagaagaggaaggccc

SEQ ID NO: 7079276 - DNA, 22 bp, Homo sapiens
attcgcgggcctggagggtggg

SEQ ID NO: 7079277 - DNA, 22 bp, Homo sapiens
cagcctttatggaaaggcctgg

SEQ ID NO: 7079278 - DNA, 22 bp, Homo sapiens
cagcctttctgtttcctaaggt

SEQ ID NO: 7079279 - DNA, 22 bp, Homo sapiens
cagccttttcttaaaatgcaag

SEQ ID NO: 7079280 - DNA, 22 bp, Homo sapiens
cagcctttgaacttcagaggtt

SEQ ID NO: 7079281 - DNA, 22 bp, Homo sapiens
cagcctttgggtcagaagattc

SEQ ID NO: 7079282 - DNA, 22 bp, Homo sapiens
agcgctgtgggcgtgcgaggag

SEQ ID NO: 7079283 - DNA, 22 bp, Homo sapiens
cagagcttcagggaataagaat

SEQ ID NO: 7079284 - DNA, 22 bp, Homo sapiens
cacacagacagctctctgaaga

SEQ ID NO: 7079285 - DNA, 22 bp, Homo sapiens
caaggaagttttaggagaggaa

SEQ ID NO: 7079286 - DNA, 22 bp, Homo sapiens
caaggaaggagagatgatgggt

SEQ ID NO: 7079287 - DNA, 22 bp, Homo sapiens
caagggacatttctcataggag

SEQ ID NO: 7079288 - DNA, 22 bp, Homo sapiens
caagggacctgagatggtctct

SEQ ID NO: 7079289 - DNA, 22 bp, Homo sapiens
caagggcagaggcagggccccg

SEQ ID NO: 7079290 - DNA, 22 bp, Homo sapiens
caagggagttgctgcatgcagg

SEQ ID NO: 7079291 - DNA, 22 bp, Homo sapiens
caagggccatctgagggcactg

SEQ ID NO: 7079292 - DNA, 21 bp, Homo sapiens
caagggccagtgagatgggat

SEQ ID NO: 7079293 - DNA, 22 bp, Homo sapiens
caagggcattgcttgggacctt

SEQ ID NO: 7079294 - DNA, 22 bp, Homo sapiens
caagggcaggagaggatggatg

SEQ ID NO: 7079295 - DNA, 22 bp, Homo sapiens
caagggcagatagctggtccaa

SEQ ID NO: 7079296 - DNA, 20 bp, Homo sapiens
caaggggagtagtatgggcc

SEQ ID NO: 7079297 - DNA, 22 bp, Homo sapiens
caagggggagatttagggtaat

SEQ ID NO: 7079298 - DNA, 22 bp, Homo sapiens
cactggggtgggcctggtagag

SEQ ID NO: 7079299 - DNA, 22 bp, Homo sapiens
agggtgagggtctggccttgag

SEQ ID NO: 7079300 - DNA, 22 bp, Homo sapiens
agggtgcaaaagcaaggacagt

SEQ ID NO: 7079301 - DNA, 22 bp, Homo sapiens
agggtgcagaacaaattaagac

SEQ ID NO: 7079302 - DNA, 22 bp, Homo sapiens
agggtgcagggacaggtgtgca

SEQ ID NO: 7079303 - DNA, 22 bp, Homo sapiens
aggtgcagtgaaggaaaaggaa

SEQ ID NO: 7079304 - DNA, 22 bp, Homo sapiens
aggtgcagtgtttaaaagtagc

SEQ ID NO: 7079305 - DNA, 19 bp, Homo sapiens
aggtgcaggtcacagggga

SEQ ID NO: 7079306 - DNA, 22 bp, Homo sapiens
aggtgcaggagctgtgcaggga

SEQ ID NO: 7079307 - DNA, 22 bp, Homo sapiens
agggtgcatgtttgcaagagtg

SEQ ID NO: 7079308 - DNA, 22 bp, Homo sapiens
agggtgcagtcacaggaaatgt

SEQ ID NO: 7079309 - DNA, 22 bp, Homo sapiens
actcagaggaccaaaaggaaag

SEQ ID NO: 7079310 - DNA, 22 bp, Homo sapiens
actcagaggctggaaatcaaag

SEQ ID NO: 7079311 - DNA, 22 bp, Homo sapiens
actcagctgatgaagcacaagt

SEQ ID NO: 7079312 - DNA, 22 bp, Homo sapiens
agtgggaggcggctgacgggcg

SEQ ID NO: 7079313 - DNA, 22 bp, Homo sapiens
agtgggaggaagtggtgatatt

SEQ ID NO: 7079314 - DNA, 22 bp, Homo sapiens
agaagccattgaagcagacctc

SEQ ID NO: 7079315 - DNA, 22 bp, Homo sapiens
agaagccattccctgtaggctc

SEQ ID NO: 7079316 - DNA, 22 bp, Homo sapiens
agaagccatatttagggaggag

SEQ ID NO: 7079317 - DNA, 22 bp, Homo sapiens
agggaggatagtagtcagttta

SEQ ID NO: 7079318 - DNA, 22 bp, Homo sapiens
agggaggatctgctccttgtct

SEQ ID NO: 7079319 - DNA, 22 bp, Homo sapiens
agggcaagggttgaagataaga

SEQ ID NO: 7079320 - DNA, 20 bp, Homo sapiens
aggggcctggaacaggcctt

SEQ ID NO: 7079321 - DNA, 22 bp, Homo sapiens
aggggaggagcttttcttgcct

SEQ ID NO: 7079322 - DNA, 22 bp, Homo sapiens
aggacaggtgtagtgggctctg

SEQ ID NO: 7079323 - DNA, 22 bp, Homo sapiens
agggggtcgtccggaagacctg

SEQ ID NO: 7079324 - DNA, 22 bp, Homo sapiens
agggggtctcctatcatggaag

SEQ ID NO: 7079325 - DNA, 22 bp, Homo sapiens
aggggctgactggaaagtgcca

SEQ ID NO: 7079326 - DNA, 21 bp, Homo sapiens
agggcctgtgctctccaggtc

SEQ ID NO: 7079327 - DNA, 22 bp, Homo sapiens
agggcctgggaagaggaaccct

SEQ ID NO: 7079328 - DNA, 22 bp, Homo sapiens
agggcctgtcagcggtgtcctg

SEQ ID NO: 7079329 - DNA, 20 bp, Homo sapiens
agggcctgttgcaagcgttt

SEQ ID NO: 7079330 - DNA, 22 bp, Homo sapiens
cctactcactcttttcatgctt

SEQ ID NO: 7079331 - DNA, 20 bp, Homo sapiens
ccactcagctgtattctcag

SEQ ID NO: 7079332 - DNA, 22 bp, Homo sapiens
ccactcaggagcttatctatgc

SEQ ID NO: 7079333 - DNA, 17 bp, Homo sapiens
ccactcagtaatttctc

SEQ ID NO: 7079334 - DNA, 22 bp, Homo sapiens
ccactcagttgctctctgtttt

SEQ ID NO: 7079335 - DNA, 22 bp, Homo sapiens
ccacgaggctatcctgctaggg

SEQ ID NO: 7079336 - DNA, 22 bp, Homo sapiens
aggcaagattaggaccagaaga

SEQ ID NO: 7079337 - DNA, 22 bp, Homo sapiens
aggcaagaacagacatgggagt

SEQ ID NO: 7079338 - DNA, 23 bp, Homo sapiens
aggcaagaacgggttgttcaccc

SEQ ID NO: 7079339 - DNA, 22 bp, Homo sapiens
aggcaagaccagaaagggctga

SEQ ID NO: 7079340 - DNA, 21 bp, Homo sapiens
caggactttcctccaaagtta

SEQ ID NO: 7079341 - DNA, 22 bp, Homo sapiens
aggtagggaagaaggcatgaaa

SEQ ID NO: 7079342 - DNA, 22 bp, Homo sapiens
aggtagggggtttgggaactgc

SEQ ID NO: 7079343 - DNA, 22 bp, Homo sapiens
atcaaagatgtttcagggtgta

SEQ ID NO: 7079344 - DNA, 22 bp, Homo sapiens
atcaaagagcttgacaatccta

SEQ ID NO: 7079345 - DNA, 22 bp, Homo sapiens
atcaaagagtgagatttttact

SEQ ID NO: 7079346 - DNA, 22 bp, Homo sapiens
atcaaagaaggagaggttcctg

SEQ ID NO: 7079347 - DNA, 22 bp, Homo sapiens
atcaaagaatgtgactgaaata

SEQ ID NO: 7079348 - DNA, 19 bp, Homo sapiens
atcaaagactgcaggattt

SEQ ID NO: 7079349 - DNA, 21 bp, Homo sapiens
atggccactatggtgcagcag

SEQ ID NO: 7079350 - DNA, 22 bp, Homo sapiens
gagggcctggcacagggaggct

SEQ ID NO: 7079351 - DNA, 22 bp, Homo sapiens
gaccacagagcacggcctgctt

SEQ ID NO: 7079352 - DNA, 22 bp, Homo sapiens
gaccacagattcctaagtggca

SEQ ID NO: 7079353 - DNA, 22 bp, Homo sapiens
gaccaaggccaggccagggcgt

SEQ ID NO: 7079354 - DNA, 22 bp, Homo sapiens
attcaaagtaataaccagaact

SEQ ID NO: 7079355 - DNA, 22 bp, Homo sapiens
attcaaagtctagatgtagtgt

SEQ ID NO: 7079356 - DNA, 22 bp, Homo sapiens
attcaaagtactagctattttt

SEQ ID NO: 7079357 - DNA, 22 bp, Homo sapiens
attcaaagtagatgaagtttca

SEQ ID NO: 7079358 - DNA, 22 bp, Homo sapiens
attcagaattgtgggcagtaca

SEQ ID NO: 7079359 - DNA, 22 bp, Homo sapiens
attcagaagcaatcacagtgag

SEQ ID NO: 7079360 - DNA, 16 bp, Homo sapiens
gccaaagggcaaagaa

SEQ ID NO: 7079361 - DNA, 22 bp, Homo sapiens
gccaagaaggtggggacatgca

SEQ ID NO: 7079362 - DNA, 20 bp, Homo sapiens
gccaagaatatgcccgactc

SEQ ID NO: 7079363 - DNA, 22 bp, Homo sapiens
gccaagaatgtggcatagctta

SEQ ID NO: 7079364 - DNA, 22 bp, Homo sapiens
gcataggccactagtgccagga

SEQ ID NO: 7079365 - DNA, 22 bp, Homo sapiens
caagggtgaaggcagaggacat

SEQ ID NO: 7079366 - DNA, 22 bp, Homo sapiens
caaggggttcagaaagaggtga

SEQ ID NO: 7079367 - DNA, 22 bp, Homo sapiens
caagggtggtattgggagcata

SEQ ID NO: 7079368 - DNA, 22 bp, Homo sapiens
caaggccacgttctgcatgcgg

SEQ ID NO: 7079369 - DNA, 21 bp, Homo sapiens
ggaagggctctgaggacggct

SEQ ID NO: 7079370 - DNA, 22 bp, Homo sapiens
cacagaagtgtgtataactctt

SEQ ID NO: 7079371 - DNA, 22 bp, Homo sapiens
ggaagggcctcgggcgtgggac

SEQ ID NO: 7079372 - DNA, 22 bp, Homo sapiens
cacagacccagaagggatgaag

SEQ ID NO: 7079373 - DNA, 22 bp, Homo sapiens
ggccaagaatgataggctcagt

SEQ ID NO: 7079374 - DNA, 22 bp, Homo sapiens
ggccgccctttccacggtttct

SEQ ID NO: 7079375 - DNA, 21 bp, Homo sapiens
ggccgccgccttgtgctctgc

SEQ ID NO: 7079376 - DNA, 22 bp, Homo sapiens
cagacctggggcctgggagccc

SEQ ID NO: 7079377 - DNA, 22 bp, Homo sapiens
cagacctgaggagcactgagcc

SEQ ID NO: 7079378 - DNA, 22 bp, Homo sapiens
cagacctgaggttgagtaccag

SEQ ID NO: 7079379 - DNA, 22 bp, Homo sapiens
gggccagacccttggcgatctg

SEQ ID NO: 7079380 - DNA, 22 bp, Homo sapiens
gggccagagcacagaggatgtt

SEQ ID NO: 7079381 - DNA, 22 bp, Homo sapiens
gggccagagcttggcagctggg

SEQ ID NO: 7079382 - DNA, 22 bp, Homo sapiens
ggtcagtggcagggggtacttc

SEQ ID NO: 7079383 - DNA, 22 bp, Homo sapiens
ggtcagtgcctatcatgtgggc

SEQ ID NO: 7079384 - DNA, 18 bp, Homo sapiens
ggtcctgggcctggctca

SEQ ID NO: 7079385 - DNA, 22 bp, Homo sapiens
ggtcattgttcttttctgtgat

SEQ ID NO: 7079386 - DNA, 21 bp, Homo sapiens
cagcaaggaagtcgagtaggt

SEQ ID NO: 7079387 - DNA, 22 bp, Homo sapiens
cagcaaggactgggcatgtgaa

SEQ ID NO: 7079388 - DNA, 22 bp, Homo sapiens
caggctttcaggacagcgagcc

SEQ ID NO: 7079389 - DNA, 22 bp, Homo sapiens
caggcttttatgaatttcagtg

SEQ ID NO: 7079390 - DNA, 22 bp, Homo sapiens
caggcttttgcatagcactggg

SEQ ID NO: 7079391 - DNA, 22 bp, Homo sapiens
tcccactcccaggcaggcctct

SEQ ID NO: 7079392 - DNA, 22 bp, Homo sapiens
tcccactcagtccttttcagtt

SEQ ID NO: 7079393 - DNA, 22 bp, Homo sapiens
catttattgagtggccacagtg

SEQ ID NO: 7079394 - DNA, 22 bp, Homo sapiens
catgggcagaagtggcatcatt

SEQ ID NO: 7079395 - DNA, 22 bp, Homo sapiens
catgggcccgtgagaggcaggg

SEQ ID NO: 7079396 - DNA, 22 bp, Homo sapiens
ccaagaggttgtgaggcaggca

SEQ ID NO: 7079397 - DNA, 22 bp, Homo sapiens
ccaaggagtagagcaggaagct

SEQ ID NO: 7079398 - DNA, 22 bp, Homo sapiens
ccaagggaaaccgagaggctgg

SEQ ID NO: 7079399 - DNA, 22 bp, Homo sapiens
catggccaaagaattatatttt

SEQ ID NO: 7079400 - DNA, 22 bp, Homo sapiens
catggccaaggatgctcaacca

SEQ ID NO: 7079401 - DNA, 22 bp, Homo sapiens
catggccacatctagctgcaag

SEQ ID NO: 7079402 - DNA, 22 bp, Homo sapiens
catggccacatgataatcaagt

SEQ ID NO: 7079403 - DNA, 22 bp, Homo sapiens
catggccacattggaccgaagc

SEQ ID NO: 7079404 - DNA, 22 bp, Homo sapiens
catggccagattctttcttctc

SEQ ID NO: 7079405 - DNA, 22 bp, Homo sapiens
catggccagcccccagttcctc

SEQ ID NO: 7079406 - DNA, 22 bp, Homo sapiens
catgaaggaattaaggtaagga

SEQ ID NO: 7079407 - DNA, 22 bp, Homo sapiens
catgaaggctgccagcaggcat

SEQ ID NO: 7079408 - DNA, 22 bp, Homo sapiens
catgaccagagaggacggccag

SEQ ID NO: 7079409 - DNA, 22 bp, Homo sapiens
ccatggcctgaaggagtgcatc

SEQ ID NO: 7079410 - DNA, 21 bp, Homo sapiens
tgggggagaattggttgcttt

SEQ ID NO: 7079411 - DNA, 22 bp, Homo sapiens
tgggggactgcactggcgtcag

SEQ ID NO: 7079412 - DNA, 22 bp, Homo sapiens
tggggaggaagtcagatttcag

SEQ ID NO: 7079413 - DNA, 22 bp, Homo sapiens
ctattattagcaaaaggtggat

SEQ ID NO: 7079414 - DNA, 22 bp, Homo sapiens
tttagtcatagatacccaaggt

SEQ ID NO: 7079415 - DNA, 22 bp, Homo sapiens
ctcttattcctacagtaacagg

SEQ ID NO: 7079416 - DNA, 22 bp, Homo sapiens
cttatattttaggaacagacaa

SEQ ID NO: 7079417 - DNA, 22 bp, Homo sapiens
cttcaaagattattgaaaacaa

SEQ ID NO: 7079418 - DNA, 22 bp, Homo sapiens
ctttatgtccaccagactgcaa

SEQ ID NO: 7079419 - DNA, 22 bp, Homo sapiens
gaggcacatcacttggtgcatt

SEQ ID NO: 7079420 - DNA, 22 bp, Homo sapiens
gagaagggggctcgagtgtcct

SEQ ID NO: 7079421 - DNA, 22 bp, Homo sapiens
gaagaccaatttgggccatggc

SEQ ID NO: 7079422 - DNA, 22 bp, Homo sapiens
gaagaccaccccctacagcaca

SEQ ID NO: 7079423 - DNA, 22 bp, Homo sapiens
gaagaccactgtgaaatgccat

SEQ ID NO: 7079424 - DNA, 22 bp, Homo sapiens
gaagaccatattcagcaggcat

SEQ ID NO: 7079425 - DNA, 23 bp, Homo sapiens
ctttcattgtggtttcacagagc

SEQ ID NO: 7079426 - DNA, 22 bp, Homo sapiens
gcatggccaggaaaggtagaaa

SEQ ID NO: 7079427 - DNA, 22 bp, Homo sapiens
gcatggccatggcactatggac

SEQ ID NO: 7079428 - DNA, 22 bp, Homo sapiens
gcatggcctccagccaacagca

SEQ ID NO: 7079429 - DNA, 22 bp, Homo sapiens
gcatggcctctgtgcttgttgc

SEQ ID NO: 7079430 - DNA, 22 bp, Homo sapiens
gcatggccttcagggacagctg

SEQ ID NO: 7079431 - DNA, 22 bp, Homo sapiens
gcatggccttgctgtagtggta

SEQ ID NO: 7079432 - DNA, 22 bp, Homo sapiens
gcatggccttgtgctccttctc

SEQ ID NO: 7079433 - DNA, 22 bp, Homo sapiens
gcatggctattatgaggcagaa

SEQ ID NO: 7079434 - DNA, 22 bp, Homo sapiens
gcatggctggtgtcctgaggga

SEQ ID NO: 7079435 - DNA, 22 bp, Homo sapiens
gcatggcttacagaggctgcag

SEQ ID NO: 7079436 - DNA, 22 bp, Homo sapiens
gcatggcttccaaaagtgctaa

SEQ ID NO: 7079437 - DNA, 20 bp, Homo sapiens
gccagccctgacacaggagc

SEQ ID NO: 7079438 - DNA, 22 bp, Homo sapiens
gcaaagacaaattagaactcct

SEQ ID NO: 7079439 - DNA, 22 bp, Homo sapiens
gcaaagacaatttgaatagctt

SEQ ID NO: 7079440 - DNA, 18 bp, Homo sapiens
gcaaagacaggctgggct

SEQ ID NO: 7079441 - DNA, 22 bp, Homo sapiens
gcaaagacccaggtgtctatcc

SEQ ID NO: 7079442 - DNA, 22 bp, Homo sapiens
gcaaagacggactcaggagtgc

SEQ ID NO: 7079443 - DNA, 23 bp, Homo sapiens
gcaaagactctgccaaaaactgc

SEQ ID NO: 7079444 - DNA, 22 bp, Homo sapiens
gcaaagactgcaattacttttg

SEQ ID NO: 7079445 - DNA, 22 bp, Homo sapiens
gcagacttataatctgtcccag

SEQ ID NO: 7079446 - DNA, 22 bp, Homo sapiens
gcagggaagacccggagcagcg

SEQ ID NO: 7079447 - DNA, 22 bp, Homo sapiens
gcctttatttacgaaagggaaa

SEQ ID NO: 7079448 - DNA, 22 bp, Homo sapiens
gcctttatgtctgaaaatcagc

SEQ ID NO: 7079449 - DNA, 22 bp, Homo sapiens
gcctttatccctgtacaaggtg

SEQ ID NO: 7079450 - DNA, 22 bp, Homo sapiens
gctgagggcagcctcctaggtc

SEQ ID NO: 7079451 - DNA, 18 bp, Homo sapiens
gctttatttcttggggaa

SEQ ID NO: 7079452 - DNA, 22 bp, Homo sapiens
gctttattttgtgagggattac

SEQ ID NO: 7079453 - DNA, 20 bp, Homo sapiens
ggcatggcaaatgttcttgc

SEQ ID NO: 7079454 - DNA, 19 bp, Homo sapiens
ggcatggggtccggggacc

SEQ ID NO: 7079455 - DNA, 21 bp, Homo sapiens
ggcatggcacctctgggcagg

SEQ ID NO: 7079456 - DNA, 22 bp, Homo sapiens
ggcatggcacgggaaacaccag

SEQ ID NO: 7079457 - DNA, 22 bp, Homo sapiens
ggcatggcctgtaagacggaga

SEQ ID NO: 7079458 - DNA, 22 bp, Homo sapiens
ggcatggctcggagtcagaaca

SEQ ID NO: 7079459 - DNA, 22 bp, Homo sapiens
ggcatggctgggttctggtgag

SEQ ID NO: 7079460 - DNA, 22 bp, Homo sapiens
ggcatggctgttggggatagag

SEQ ID NO: 7079461 - DNA, 21 bp, Homo sapiens
ggccacaagcggaggagccgc

SEQ ID NO: 7079462 - DNA, 20 bp, Homo sapiens
ggcatgggtggggctcccag

SEQ ID NO: 7079463 - DNA, 22 bp, Homo sapiens
ggcgagaagttgttagtggctt

SEQ ID NO: 7079464 - DNA, 22 bp, Homo sapiens
ggcaagaaggcttcaggtagct

SEQ ID NO: 7079465 - DNA, 22 bp, Homo sapiens
gggaggaaggcttgggtgagta

SEQ ID NO: 7079466 - DNA, 22 bp, Homo sapiens
gggcaagcacagcgagcgtgcg

SEQ ID NO: 7079467 - DNA, 23 bp, Homo sapiens
gggcatggagtgtaggtggaagg

SEQ ID NO: 7079468 - DNA, 22 bp, Homo sapiens
gggagagcgcgctagggccgag

SEQ ID NO: 7079469 - DNA, 22 bp, Homo sapiens
gggagagagaaaacgtggcgca

SEQ ID NO: 7079470 - DNA, 22 bp, Homo sapiens
gggcttggctcataagtggatg

SEQ ID NO: 7079471 - DNA, 22 bp, Homo sapiens
gggcttggccccagaagagcta

SEQ ID NO: 7079472 - DNA, 22 bp, Homo sapiens
gggcatggtggcaggcacctgt

SEQ ID NO: 7079473 - DNA, 22 bp, Homo sapiens
ggggctggctcactaagagact

SEQ ID NO: 7079474 - DNA, 22 bp, Homo sapiens
ggggccgaccgcggttcaggcc

SEQ ID NO: 7079475 - DNA, 22 bp, Homo sapiens
ggggaagagcattgcacggtgt

SEQ ID NO: 7079476 - DNA, 22 bp, Homo sapiens
gggtaggcaaagcaatgacgtt

SEQ ID NO: 7079477 - DNA, 22 bp, Homo sapiens
ggggctgggatttgaacccagg

SEQ ID NO: 7079478 - DNA, 22 bp, Homo sapiens
gtccaaggcaagtgtgcagagt

SEQ ID NO: 7079479 - DNA, 22 bp, Homo sapiens
gtacggtgaatcagtggatgaa

SEQ ID NO: 7079480 - DNA, 22 bp, Homo sapiens
gtattcaagcgagcagatgtct

SEQ ID NO: 7079481 - DNA, 22 bp, Homo sapiens
gtattcaaggattttgttctac

SEQ ID NO: 7079482 - DNA, 22 bp, Homo sapiens
gtgcagagaggtggagggactt

SEQ ID NO: 7079483 - DNA, 22 bp, Homo sapiens
gtgcagagaaggagcagtagtt

SEQ ID NO: 7079484 - DNA, 22 bp, Homo sapiens
gtgctaggattacaggcatggg

SEQ ID NO: 7079485 - DNA, 22 bp, Homo sapiens
gtgctagggacaaagcagtgaa

SEQ ID NO: 7079486 - DNA, 22 bp, Homo sapiens
gtgctagggttggagtggggct

SEQ ID NO: 7079487 - DNA, 22 bp, Homo sapiens
gtgcagagcaagggctgagggc

SEQ ID NO: 7079488 - DNA, 21 bp, Homo sapiens
gtgcagaggaatgtagggggc

SEQ ID NO: 7079489 - DNA, 22 bp, Homo sapiens
gtcctgggcggagggctgctgt

SEQ ID NO: 7079490 - DNA, 22 bp, Homo sapiens
gtcctgggggcagctgtgtcca

SEQ ID NO: 7079491 - DNA, 22 bp, Homo sapiens
tcagagctttggagaccaggaa

SEQ ID NO: 7079492 - DNA, 22 bp, Homo sapiens
tcagagcttcacctgttacatt

SEQ ID NO: 7079493 - DNA, 22 bp, Homo sapiens
tcagagctgcccatgcaagggg

SEQ ID NO: 7079494 - DNA, 22 bp, Homo sapiens
tcagagctgggtgcttcttcct

SEQ ID NO: 7079495 - DNA, 22 bp, Homo sapiens
tcagagctgtgcttcaggaaag

SEQ ID NO: 7079496 - DNA, 22 bp, Homo sapiens
tcagagctaaggggagagcaaa

SEQ ID NO: 7079497 - DNA, 22 bp, Homo sapiens
tcaagagaagtgctccacagta

SEQ ID NO: 7079498 - DNA, 21 bp, Homo sapiens
tcatggccagcaagtggcaga

SEQ ID NO: 7079499 - DNA, 22 bp, Homo sapiens
tcatggccaaagtcaggagtgt

SEQ ID NO: 7079500 - DNA, 22 bp, Homo sapiens
tcagtctttgcttatgacaata

SEQ ID NO: 7079501 - DNA, 22 bp, Homo sapiens
tcagtcttctagcaaatccagg

SEQ ID NO: 7079502 - DNA, 22 bp, Homo sapiens
tcagccttctgaggacctggga

SEQ ID NO: 7079503 - DNA, 22 bp, Homo sapiens
tcaggaagaagacggggcagga

SEQ ID NO: 7079504 - DNA, 22 bp, Homo sapiens
tcaggaagctactgccagcagc

SEQ ID NO: 7079505 - DNA, 22 bp, Homo sapiens
tcaggaaggagctggcctgcca

SEQ ID NO: 7079506 - DNA, 22 bp, Homo sapiens
tcaggaaggcgccccatcagga

SEQ ID NO: 7079507 - DNA, 22 bp, Homo sapiens
tattaggcatttgaggataaac

SEQ ID NO: 7079508 - DNA, 22 bp, Homo sapiens
tattccaaaggtagggattact

SEQ ID NO: 7079509 - DNA, 22 bp, Homo sapiens
tattcaaagtaccttcattgcc

SEQ ID NO: 7079510 - DNA, 22 bp, Homo sapiens
tattagcgtcaggaggtgagta

SEQ ID NO: 7079511 - DNA, 22 bp, Homo sapiens
tacaaagatggaaggttatgtt

SEQ ID NO: 7079512 - DNA, 22 bp, Homo sapiens
ttaattcagtcaaagaaaccat

SEQ ID NO: 7079513 - DNA, 23 bp, Homo sapiens
tgttattccaggttaatgtactt

SEQ ID NO: 7079514 - DNA, 22 bp, Homo sapiens
tgttattctagtggatcacgtc

SEQ ID NO: 7079515 - DNA, 22 bp, Homo sapiens
tgttattctggccagcaccgtt

SEQ ID NO: 7079516 - DNA, 22 bp, Homo sapiens
ttcaaaggagacagagggaagg

SEQ ID NO: 7079517 - DNA, 22 bp, Homo sapiens
ttcaacgagtatttactgagtc

SEQ ID NO: 7079518 - DNA, 22 bp, Homo sapiens
ttgattcaaaacaggaggtagg

SEQ ID NO: 7079519 - DNA, 22 bp, Homo sapiens
ttgattcatggacaggccaggt

SEQ ID NO: 7079520 - DNA, 22 bp, Homo sapiens
ttgattcatcttctaataccca

SEQ ID NO: 7079521 - DNA, 22 bp, Homo sapiens
ttgattcacaattaccaagact

SEQ ID NO: 7079522 - DNA, 23 bp, Homo sapiens
ttgcaaagggcaaaggtcatgtg

SEQ ID NO: 7079523 - DNA, 22 bp, Homo sapiens
tttgttcacatttaggactctc

SEQ ID NO: 7079524 - DNA, 17 bp, Homo sapiens
tttcaaagcagtcagga

SEQ ID NO: 7079525 - DNA, 22 bp, Homo sapiens
tttcaaaggaggctgagaggat

SEQ ID NO: 7079526 - DNA, 22 bp, Homo sapiens
tttcaaagcaactgaaaaggaa

SEQ ID NO: 7079527 - DNA, 23 bp, Homo sapiens
tttcaaagactttcccttagagt

SEQ ID NO: 7079528 - DNA, 22 bp, Homo sapiens
tttcaaagagaggcagaaggaa

SEQ ID NO: 7079529 - DNA, 22 bp, Homo sapiens
tttcaaagagttgtaaattact

SEQ ID NO: 7079530 - DNA, 22 bp, Homo sapiens
tttcaaagacagccatatttgt

SEQ ID NO: 7079531 - DNA, 22 bp, Homo sapiens
tttcaaagaccattaactatca

SEQ ID NO: 7079532 - DNA, 20 bp, Homo sapiens
tttcaaaggcacctatgaag

SEQ ID NO: 7079533 - DNA, 22 bp, Homo sapiens
tttcaaagggaagttatgaagt

SEQ ID NO: 7079534 - DNA, 22 bp, Homo sapiens
tttcttcagtaacacaaaccat

SEQ ID NO: 7079535 - DNA, 21 bp, Homo sapiens
tttagttcaagtacagaacca

SEQ ID NO: 7079536 - DNA, 22 bp, Homo sapiens
tttagttcataaaaccagggtg

SEQ ID NO: 7079537 - DNA, 22 bp, Homo sapiens
tttattagtgcttgtatcactg

SEQ ID NO: 7079538 - DNA, 22 bp, Homo sapiens
tttattaattagtgacccaatg

SEQ ID NO: 7079539 - DNA, 22 bp, Homo sapiens
cagcaaggactgggcatgtgaa

SEQ ID NO: 7079540 - DNA, 22 bp, Homo sapiens
cagcaaggactgggcatgtgaa

SEQ ID NO: 7079541 - DNA, 22 bp, Homo sapiens
cagcaaggactgggcatgtgaa

SEQ ID NO: 7079542 - DNA, 22 bp, Homo sapiens
cagcaaggactgggcatgtgaa

SEQ ID NO: 7079543 - DNA, 22 bp, Homo sapiens
ggtgctgactctgtcgtgagca

SEQ ID NO: 7079544 - DNA, 22 bp, Homo sapiens
ggtgctgcctatagtctgaaac

SEQ ID NO: 7079545 - DNA, 22 bp, Homo sapiens
ggtgctgctgctgaacccagct

SEQ ID NO: 7079546 - DNA, 22 bp, Homo sapiens
ggtgctgatttgttgctgagat

SEQ ID NO: 7079547 - DNA, 22 bp, Homo sapiens
ggtgctgctgctgaacccagct

SEQ ID NO: 7079548 - DNA, 22 bp, Homo sapiens
ggtgctgggaacgaggaattca

SEQ ID NO: 7079549 - DNA, 22 bp, Homo sapiens
ggtgctgggaacgaggaattca

SEQ ID NO: 7079550 - DNA, 22 bp, Homo sapiens
ggtgctgggaacgaggaattca

SEQ ID NO: 7079551 - DNA, 22 bp, Homo sapiens
cagcacagtacaaggcacggat

SEQ ID NO: 7079552 - DNA, 22 bp, Homo sapiens
cagcacagtacaaggcacggat

SEQ ID NO: 7079553 - DNA, 22 bp, Homo sapiens
cagcacaattttcaggagtcca

SEQ ID NO: 7079554 - DNA, 22 bp, Homo sapiens
cagcacaattttcaggagtcca

SEQ ID NO: 7079555 - DNA, 22 bp, Homo sapiens
cagcacacagtgactcgcacct

SEQ ID NO: 7079556 - DNA, 23 bp, Homo sapiens
cagcacagtacatttcctgtctc

SEQ ID NO: 7079557 - DNA, 23 bp, Homo sapiens
cagcacagtacatttcctgtctc

SEQ ID NO: 7079558 - DNA, 23 bp, Homo sapiens
cagcacagtacatttcctgtctc

SEQ ID NO: 7079559 - DNA, 21 bp, Homo sapiens
cagcacagtactgggtcttgc

SEQ ID NO: 7079560 - DNA, 21 bp, Homo sapiens
cagcacagtactgggtcttgc

SEQ ID NO: 7079561 - DNA, 21 bp, Homo sapiens
cagcacagtactgggtcttgc

SEQ ID NO: 7079562 - DNA, 22 bp, Homo sapiens
cagcacagtagagtagttgtaa

SEQ ID NO: 7079563 - DNA, 22 bp, Homo sapiens
cagcacagtagagtagttgtaa

SEQ ID NO: 7079564 - DNA, 22 bp, Homo sapiens
cagcacatgctcatcagggaag

SEQ ID NO: 7079565 - DNA, 22 bp, Homo sapiens
cagcacatcttctgatcttttg

SEQ ID NO: 7079566 - DNA, 22 bp, Homo sapiens
cagcacatggatggagttagga

SEQ ID NO: 7079567 - DNA, 22 bp, Homo sapiens
cagcacatggatggagttagga

SEQ ID NO: 7079568 - DNA, 22 bp, Homo sapiens
cagcacattgatcagagacgct

SEQ ID NO: 7079569 - DNA, 22 bp, Homo sapiens
cagcacatttactcagccctca

SEQ ID NO: 7079570 - DNA, 22 bp, Homo sapiens
cagcaccagcatattccagggc

SEQ ID NO: 7079571 - DNA, 22 bp, Homo sapiens
cagcaccattttcctggtcagc

SEQ ID NO: 7079572 - DNA, 22 bp, Homo sapiens
cagcacatctgattatatgact

SEQ ID NO: 7079573 - DNA, 22 bp, Homo sapiens
cagcacatctccaagaatttct

SEQ ID NO: 7079574 - DNA, 22 bp, Homo sapiens
cagcacatctccaagaatttct

SEQ ID NO: 7079575 - DNA, 22 bp, Homo sapiens
cagcacataatcagtgattgtg

SEQ ID NO: 7079576 - DNA, 22 bp, Homo sapiens
cagcacatagcatgcttgtcag

SEQ ID NO: 7079577 - DNA, 22 bp, Homo sapiens
cagcacataatcagtgattgtg

SEQ ID NO: 7079578 - DNA, 22 bp, Homo sapiens
cagcacatagcatgcttgtcag

SEQ ID NO: 7079579 - DNA, 22 bp, Homo sapiens
cagcacatagcatgcttgtcag

SEQ ID NO: 7079580 - DNA, 22 bp, Homo sapiens
cagcacatagtaggtattcact

SEQ ID NO: 7079581 - DNA, 22 bp, Homo sapiens
cagcacatagtaggtattcact

SEQ ID NO: 7079582 - DNA, 22 bp, Homo sapiens
cagcacagtttgcttggcagag

SEQ ID NO: 7079583 - DNA, 22 bp, Homo sapiens
cagcacagtttgcttggcagag

SEQ ID NO: 7079584 - DNA, 22 bp, Homo sapiens
cagcacagtttgcttggcagag

SEQ ID NO: 7079585 - DNA, 22 bp, Homo sapiens
cagcacataagccgaagactgt

SEQ ID NO: 7079586 - DNA, 22 bp, Homo sapiens
cagcacataatcagtgattgtg

SEQ ID NO: 7079587 - DNA, 22 bp, Homo sapiens
cagcacagtcctttgcttactg

SEQ ID NO: 7079588 - DNA, 22 bp, Homo sapiens
cagcacagtcctttgcttactg

SEQ ID NO: 7079589 - DNA, 22 bp, Homo sapiens
cagcacagtgaccagacccact

SEQ ID NO: 7079590 - DNA, 22 bp, Homo sapiens
cagcacagtgaccagacccact

SEQ ID NO: 7079591 - DNA, 22 bp, Homo sapiens
cagcacagtgaccagacccact

SEQ ID NO: 7079592 - DNA, 22 bp, Homo sapiens
cagcacagtgaccagacccact

SEQ ID NO: 7079593 - DNA, 22 bp, Homo sapiens
cagcacagtgcagatgctgact

SEQ ID NO: 7079594 - DNA, 22 bp, Homo sapiens
cagcacagtgcagatgctgact

SEQ ID NO: 7079595 - DNA, 22 bp, Homo sapiens
cagcacagtgcagatgctgact

SEQ ID NO: 7079596 - DNA, 22 bp, Homo sapiens
cagcacagtgcagatgctgact

SEQ ID NO: 7079597 - DNA, 22 bp, Homo sapiens
cagcacagtgttaggtaatttg

SEQ ID NO: 7079598 - DNA, 22 bp, Homo sapiens
cagcacagtgttaggtaatttg

SEQ ID NO: 7079599 - DNA, 22 bp, Homo sapiens
cagcacagtttcccccatgagc

SEQ ID NO: 7079600 - DNA, 22 bp, Homo sapiens
cagcacagtttcccccatgagc

SEQ ID NO: 7079601 - DNA, 22 bp, Homo sapiens
cagcacagtttcccccatgagc

SEQ ID NO: 7079602 - DNA, 22 bp, Homo sapiens
cagcacagtttcccccatgagc

SEQ ID NO: 7079603 - DNA, 22 bp, Homo sapiens
cagcacagtttctggcccgccg

SEQ ID NO: 7079604 - DNA, 22 bp, Homo sapiens
cagcacagtttctggcccgccg

SEQ ID NO: 7079605 - DNA, 22 bp, Homo sapiens
cagcacagtttctggcccgccg

SEQ ID NO: 7079606 - DNA, 22 bp, Homo sapiens
cagcacagtttgcttggcagag

SEQ ID NO: 7079607 - DNA, 22 bp, Homo sapiens
cagcacagtttgcttggcagag

SEQ ID NO: 7079608 - DNA, 22 bp, Homo sapiens
cagcacagtttgcttggcagag

SEQ ID NO: 7079609 - DNA, 22 bp, Homo sapiens
cagcaagatttttaaagcaagg

SEQ ID NO: 7079610 - DNA, 22 bp, Homo sapiens
cagcaagccaaatgtggcccga

SEQ ID NO: 7079611 - DNA, 21 bp, Homo sapiens
cagcaaggaagtcgagtaggt

SEQ ID NO: 7079612 - DNA, 22 bp, Homo sapiens
cagcaagatttttaaagcaagg

SEQ ID NO: 7079613 - DNA, 22 bp, Homo sapiens
cagcaagacttcagggcttggt

SEQ ID NO: 7079614 - DNA, 22 bp, Homo sapiens
cagcaagagactgttctctaag

SEQ ID NO: 7079615 - DNA, 22 bp, Homo sapiens
cagcaagagactgttctctaag

SEQ ID NO: 7079616 - DNA, 22 bp, Homo sapiens
cagcaagagactgttctctaag

SEQ ID NO: 7079617 - DNA, 22 bp, Homo sapiens
cagcaagagggtaaggttgaag

SEQ ID NO: 7079618 - DNA, 22 bp, Homo sapiens
cagcaagagttggggttgttgg

SEQ ID NO: 7079619 - DNA, 22 bp, Homo sapiens
ggtgacggggcccaggtttcct

SEQ ID NO: 7079620 - DNA, 22 bp, Homo sapiens
ggtgacggggcccaggtttcct

SEQ ID NO: 7079621 - DNA, 22 bp, Homo sapiens
ggtgactcccagctgctctctt

SEQ ID NO: 7079622 - DNA, 22 bp, Homo sapiens
ggtgactggagggacccaggcc

SEQ ID NO: 7079623 - DNA, 22 bp, Homo sapiens
ggtgacttgaaggcaactgaag

SEQ ID NO: 7079624 - DNA, 22 bp, Homo sapiens
ggtgagaaaaatgagtatgatt

SEQ ID NO: 7079625 - DNA, 22 bp, Homo sapiens
ggtgagaaaaatgagtatgatt

SEQ ID NO: 7079626 - DNA, 20 bp, Homo sapiens
ggtgagacaggcttctgcac

SEQ ID NO: 7079627 - DNA, 22 bp, Homo sapiens
cagcaaagtaagctgacatgta

SEQ ID NO: 7079628 - DNA, 22 bp, Homo sapiens
cagcaaagtaagctgacatgta

SEQ ID NO: 7079629 - DNA, 22 bp, Homo sapiens
cagcaaagtaagctgacatgta

SEQ ID NO: 7079630 - DNA, 22 bp, Homo sapiens
cagcaagacaaggaacaaactg

SEQ ID NO: 7079631 - DNA, 22 bp, Homo sapiens
cagcaagacaaggaacaaactg

SEQ ID NO: 7079632 - DNA, 22 bp, Homo sapiens
cagcaagacaggattcccgtgg

SEQ ID NO: 7079633 - DNA, 22 bp, Homo sapiens
cagcaagacagtttcctaagtg

SEQ ID NO: 7079634 - DNA, 21 bp, Homo sapiens
cagcaagacatgtttatcaag

SEQ ID NO: 7079635 - DNA, 22 bp, Homo sapiens
ggtgacctcacctggtcccacc

SEQ ID NO: 7079636 - DNA, 22 bp, Homo sapiens
ggtgacctcacctggtcccacc

SEQ ID NO: 7079637 - DNA, 22 bp, Homo sapiens
ggtgaccagggtcagtagcttt

SEQ ID NO: 7079638 - DNA, 22 bp, Homo sapiens
ggtgacctcacctggtcccacc

SEQ ID NO: 7079639 - DNA, 22 bp, Homo sapiens
ggtgacctcacctggtcccacc

SEQ ID NO: 7079640 - DNA, 22 bp, Homo sapiens
ggtgacagttccggaggtacag

SEQ ID NO: 7079641 - DNA, 22 bp, Homo sapiens
ggtgacattatcattattttaa

SEQ ID NO: 7079642 - DNA, 19 bp, Homo sapiens
ggtgaccacctggtcagtg

SEQ ID NO: 7079643 - DNA, 22 bp, Homo sapiens
ggtgacagcgggtcaagaggag

SEQ ID NO: 7079644 - DNA, 22 bp, Homo sapiens
ggtgacagtggttaaaatttgt

SEQ ID NO: 7079645 - DNA, 22 bp, Homo sapiens
ggtgacagtggttaaaatttgt

SEQ ID NO: 7079646 - DNA, 22 bp, Homo sapiens
ggtctggaacccctcaagtgac

SEQ ID NO: 7079647 - DNA, 22 bp, Homo sapiens
ggtctggaacgaggtctaagcc

SEQ ID NO: 7079648 - DNA, 22 bp, Homo sapiens
ggtctggaagcgcagtaggctg

SEQ ID NO: 7079649 - DNA, 22 bp, Homo sapiens
ggtctggaagcgcagtaggctg

SEQ ID NO: 7079650 - DNA, 22 bp, Homo sapiens
ggtctggaagcgtcccaaaggt

SEQ ID NO: 7079651 - DNA, 22 bp, Homo sapiens
ggtctggaagcgtcccaaaggt

SEQ ID NO: 7079652 - DNA, 22 bp, Homo sapiens
ggtctggaataaggtccaggaa

SEQ ID NO: 7079653 - DNA, 22 bp, Homo sapiens
ggtctgccctgggtggaggcgc

SEQ ID NO: 7079654 - DNA, 22 bp, Homo sapiens
ggtctgcgatggcaagggtctt

SEQ ID NO: 7079655 - DNA, 22 bp, Homo sapiens
ggtctgccctgggtggaggcgc

SEQ ID NO: 7079656 - DNA, 22 bp, Homo sapiens
ggtctgagtggtgctgactcag

SEQ ID NO: 7079657 - DNA, 22 bp, Homo sapiens
ggtctgagtggggcctgagatt

SEQ ID NO: 7079658 - DNA, 22 bp, Homo sapiens
ggtctgagtggtgctgactcag

SEQ ID NO: 7079659 - DNA, 22 bp, Homo sapiens
ggtctgagtgggcaggggccgg

SEQ ID NO: 7079660 - DNA, 22 bp, Homo sapiens
ggtctgagtgggcaggggccgg

SEQ ID NO: 7079661 - DNA, 22 bp, Homo sapiens
ggtctgaggtgggacccaggaa

SEQ ID NO: 7079662 - DNA, 22 bp, Homo sapiens
ggtctgagtgccagggagagaa

SEQ ID NO: 7079663 - DNA, 22 bp, Homo sapiens
ggtctgagtgccagggagagaa

SEQ ID NO: 7079664 - DNA, 22 bp, Homo sapiens
ggtctgaggctccaaggaggtg

SEQ ID NO: 7079665 - DNA, 22 bp, Homo sapiens
ggtctgaggctccaaggaggtg

SEQ ID NO: 7079666 - DNA, 22 bp, Homo sapiens
ggtctgaggtgggacccaggaa

SEQ ID NO: 7079667 - DNA, 22 bp, Homo sapiens
ggtctgaggtttgggattcact

SEQ ID NO: 7079668 - DNA, 22 bp, Homo sapiens
ggtctgagtagagggctggcga

SEQ ID NO: 7079669 - DNA, 22 bp, Homo sapiens
ggtctgagcttgagcccatgct

SEQ ID NO: 7079670 - DNA, 22 bp, Homo sapiens
ggtctgagctctaaaactaact

SEQ ID NO: 7079671 - DNA, 22 bp, Homo sapiens
ggtcattttcactttcaagtta

SEQ ID NO: 7079672 - DNA, 22 bp, Homo sapiens
ggtccaaggctcggtggcgggg

SEQ ID NO: 7079673 - DNA, 22 bp, Homo sapiens
ggtccagaagctggtagggtag

SEQ ID NO: 7079674 - DNA, 22 bp, Homo sapiens
ggtcatgagggagcagtgcagg

SEQ ID NO: 7079675 - DNA, 22 bp, Homo sapiens
ggtcatcttgaatttccattct

SEQ ID NO: 7079676 - DNA, 20 bp, Homo sapiens
ggtcatcttccaatcccagg

SEQ ID NO: 7079677 - DNA, 22 bp, Homo sapiens
ggtcatgaggagggagaaggtt

SEQ ID NO: 7079678 - DNA, 22 bp, Homo sapiens
ggtcatgagggagcagtgcagg

SEQ ID NO: 7079679 - DNA, 15 bp, Homo sapiens
ggtcatgagtagaga

SEQ ID NO: 7079680 - DNA, 22 bp, Homo sapiens
ggtcatgctgtgaatcagtgct

SEQ ID NO: 7079681 - DNA, 22 bp, Homo sapiens
ggtcatggatagctggagcctt

SEQ ID NO: 7079682 - DNA, 22 bp, Homo sapiens
cagagtccaattgctcagagcg

SEQ ID NO: 7079683 - DNA, 22 bp, Homo sapiens
cagagtccaattgctcagagcg

SEQ ID NO: 7079684 - DNA, 18 bp, Homo sapiens
ggtcctgggcctggctca

SEQ ID NO: 7079685 - DNA, 22 bp, Homo sapiens
ggtcctgggaagatgctcatga

SEQ ID NO: 7079686 - DNA, 22 bp, Homo sapiens
cagagtctgcgagcagaggggc

SEQ ID NO: 7079687 - DNA, 22 bp, Homo sapiens
cagagtctgcgagcagaggggc

SEQ ID NO: 7079688 - DNA, 22 bp, Homo sapiens
cagagtctgcgagcagaggggc

SEQ ID NO: 7079689 - DNA, 22 bp, Homo sapiens
cagagtctctgggaggctgggt

SEQ ID NO: 7079690 - DNA, 22 bp, Homo sapiens
cagagtctctgggaggctgggt

SEQ ID NO: 7079691 - DNA, 22 bp, Homo sapiens
cagagtcctgcaccagctccag

SEQ ID NO: 7079692 - DNA, 22 bp, Homo sapiens
cagagtcctggacacagagaca

SEQ ID NO: 7079693 - DNA, 22 bp, Homo sapiens
cagagtcctggacacagagaca

SEQ ID NO: 7079694 - DNA, 19 bp, Homo sapiens
cagagtccttgaccagtcc

SEQ ID NO: 7079695 - DNA, 19 bp, Homo sapiens
cagagtccttgaccagtcc

SEQ ID NO: 7079696 - DNA, 22 bp, Homo sapiens
ggtcagtgcctatcatgtgggc

SEQ ID NO: 7079697 - DNA, 22 bp, Homo sapiens
ggtcagtgcctatcatgtgggc

SEQ ID NO: 7079698 - DNA, 23 bp, Homo sapiens
ggtcagtgagttcgtttctctgg

SEQ ID NO: 7079699 - DNA, 22 bp, Homo sapiens
ggtcagtgcgatttcccactcc

SEQ ID NO: 7079700 - DNA, 22 bp, Homo sapiens
ggtcagtgcgtgcccgcgcgtg

SEQ ID NO: 7079701 - DNA, 22 bp, Homo sapiens
ggtcagtgctgccagagtgacc

SEQ ID NO: 7079702 - DNA, 22 bp, Homo sapiens
ggtcagtgctgccagagtgacc

SEQ ID NO: 7079703 - DNA, 22 bp, Homo sapiens
ggtcaggtttttaggagtgacc

SEQ ID NO: 7079704 - DNA, 22 bp, Homo sapiens
ggtcagtctctcccgagtgttg

SEQ ID NO: 7079705 - DNA, 22 bp, Homo sapiens
ggtcagtgaatgtttgagcaga

SEQ ID NO: 7079706 - DNA, 22 bp, Homo sapiens
ggtcagtgacttttttctgtgg

SEQ ID NO: 7079707 - DNA, 22 bp, Homo sapiens
ggtcagtgagacaatttaagcc

SEQ ID NO: 7079708 - DNA, 22 bp, Homo sapiens
ggtcagtgagcaaacaaccacg

SEQ ID NO: 7079709 - DNA, 22 bp, Homo sapiens
ggtcagtggacaaaggagtttc

SEQ ID NO: 7079710 - DNA, 22 bp, Homo sapiens
ggtcagtggacaaaggagtttc

SEQ ID NO: 7079711 - DNA, 22 bp, Homo sapiens
ggtcagtggagccggaaagacc

SEQ ID NO: 7079712 - DNA, 22 bp, Homo sapiens
ggtcagtggcagggggtacttc

SEQ ID NO: 7079713 - DNA, 22 bp, Homo sapiens
ggtcagtggccaggaagcagtc

SEQ ID NO: 7079714 - DNA, 22 bp, Homo sapiens
ggtcagtggccaggaagcagtc

SEQ ID NO: 7079715 - DNA, 21 bp, Homo sapiens
ggtcagtggctttcttgcacc

SEQ ID NO: 7079716 - DNA, 22 bp, Homo sapiens
ggtcatagaatcacaggatctt

SEQ ID NO: 7079717 - DNA, 22 bp, Homo sapiens
ggtcataatggatttgctgttc

SEQ ID NO: 7079718 - DNA, 22 bp, Homo sapiens
ggtcagtgtacacatgtgcagg

SEQ ID NO: 7079719 - DNA, 22 bp, Homo sapiens
ggtcagtgtacacatgtgcagg

SEQ ID NO: 7079720 - DNA, 22 bp, Homo sapiens
ggtcagtgtatgtattgataag

SEQ ID NO: 7079721 - DNA, 22 bp, Homo sapiens
ggtcagtgtatgtattgataag

SEQ ID NO: 7079722 - DNA, 22 bp, Homo sapiens
ggtcagtgtttcatctgtgaaa

SEQ ID NO: 7079723 - DNA, 22 bp, Homo sapiens
ggtcagtgtttcatctgtgaaa

SEQ ID NO: 7079724 - DNA, 22 bp, Homo sapiens
cagagggttgatgtgaggctta

SEQ ID NO: 7079725 - DNA, 22 bp, Homo sapiens
cagagggttgatgtgaggctta

SEQ ID NO: 7079726 - DNA, 23 bp, Homo sapiens
cagagggttccatggagcatggt

SEQ ID NO: 7079727 - DNA, 22 bp, Homo sapiens
cagagggttgatgtgaggctta

SEQ ID NO: 7079728 - DNA, 21 bp, Homo sapiens
cagagggtttctcaggtgttt

SEQ ID NO: 7079729 - DNA, 22 bp, Homo sapiens
cagagggttgtcaggcgccttg

SEQ ID NO: 7079730 - DNA, 22 bp, Homo sapiens
cagagggttgtcaggcgccttg

SEQ ID NO: 7079731 - DNA, 22 bp, Homo sapiens
cagaggtaccagcagcctctgg

SEQ ID NO: 7079732 - DNA, 22 bp, Homo sapiens
cagaggtacagccattgaagat

SEQ ID NO: 7079733 - DNA, 22 bp, Homo sapiens
cagaggtacaagctaagttggg

SEQ ID NO: 7079734 - DNA, 21 bp, Homo sapiens
cagagggtttctcaggtgttt

SEQ ID NO: 7079735 - DNA, 22 bp, Homo sapiens
ggtcacaggggagaagagtgat

SEQ ID NO: 7079736 - DNA, 22 bp, Homo sapiens
ggtcaggtaggaagttaactat

SEQ ID NO: 7079737 - DNA, 22 bp, Homo sapiens
cagaggtagccgagtgcaatcg

SEQ ID NO: 7079738 - DNA, 22 bp, Homo sapiens
cagaggtagcatgctgtggctt

SEQ ID NO: 7079739 - DNA, 22 bp, Homo sapiens
cagaggtagaaggcatgcagtg

SEQ ID NO: 7079740 - DNA, 22 bp, Homo sapiens
cagaggtagaaggcatgcagtg

SEQ ID NO: 7079741 - DNA, 22 bp, Homo sapiens
cagaggtagaactggccctcac

SEQ ID NO: 7079742 - DNA, 22 bp, Homo sapiens
cagagggtgtgaaggggatgaa

SEQ ID NO: 7079743 - DNA, 22 bp, Homo sapiens
cagagggtgtgaaggggatgaa

SEQ ID NO: 7079744 - DNA, 23 bp, Homo sapiens
cagagggttccatggagcatggt

SEQ ID NO: 7079745 - DNA, 23 bp, Homo sapiens
cagagggttccatggagcatggt

SEQ ID NO: 7079746 - DNA, 22 bp, Homo sapiens
cagaggggctgacacccttggc

SEQ ID NO: 7079747 - DNA, 22 bp, Homo sapiens
cagaggggtgtagagatcactg

SEQ ID NO: 7079748 - DNA, 22 bp, Homo sapiens
cagaggggtgtagagatcactg

SEQ ID NO: 7079749 - DNA, 22 bp, Homo sapiens
cagagggtggaggccaggctct

SEQ ID NO: 7079750 - DNA, 21 bp, Homo sapiens
cagaggggctagcctggctgc

SEQ ID NO: 7079751 - DNA, 22 bp, Homo sapiens
cagaggggctgacacccttggc

SEQ ID NO: 7079752 - DNA, 21 bp, Homo sapiens
cagaggggctagcctggctgc

SEQ ID NO: 7079753 - DNA, 21 bp, Homo sapiens
cagaggggctagcctggctgc

SEQ ID NO: 7079754 - DNA, 22 bp, Homo sapiens
cagaggggataacaggtgtaga

SEQ ID NO: 7079755 - DNA, 22 bp, Homo sapiens
cagaggggataacaggtgtaga

SEQ ID NO: 7079756 - DNA, 22 bp, Homo sapiens
cagagggcttcaggttcaggat

SEQ ID NO: 7079757 - DNA, 22 bp, Homo sapiens
cagagggctcttggctgcctgc

SEQ ID NO: 7079758 - DNA, 21 bp, Homo sapiens
cagagggccggcatgtggtct

SEQ ID NO: 7079759 - DNA, 22 bp, Homo sapiens
cagagggcgtccgggttaactt

SEQ ID NO: 7079760 - DNA, 22 bp, Homo sapiens
cagagggaaaaggggagtaata

SEQ ID NO: 7079761 - DNA, 22 bp, Homo sapiens
cagagggaaaaggggagtaata

SEQ ID NO: 7079762 - DNA, 22 bp, Homo sapiens
cagagggctgccctgagttcgt

SEQ ID NO: 7079763 - DNA, 22 bp, Homo sapiens
cagagggctgccctgagttcgt

SEQ ID NO: 7079764 - DNA, 22 bp, Homo sapiens
cagagggctcttggctgcctgc

SEQ ID NO: 7079765 - DNA, 22 bp, Homo sapiens
cagagggctcttggctgcctgc

SEQ ID NO: 7079766 - DNA, 22 bp, Homo sapiens
cagagggctgtgtaaggatgtt

SEQ ID NO: 7079767 - DNA, 22 bp, Homo sapiens
cagagggcttcaggttcaggat

SEQ ID NO: 7079768 - DNA, 22 bp, Homo sapiens
cagagggcttcaggttcaggat

SEQ ID NO: 7079769 - DNA, 22 bp, Homo sapiens
cagaggcacaagaaagcaaggc

SEQ ID NO: 7079770 - DNA, 22 bp, Homo sapiens
cagaggcacagcttcttttaat

SEQ ID NO: 7079771 - DNA, 22 bp, Homo sapiens
cagaggcacagtgcgggccact

SEQ ID NO: 7079772 - DNA, 22 bp, Homo sapiens
cagaggcacagtgcgggccact

SEQ ID NO: 7079773 - DNA, 22 bp, Homo sapiens
cagaggcacaagaaagcaaggc

SEQ ID NO: 7079774 - DNA, 22 bp, Homo sapiens
cagaggcacaagaaagcaaggc

SEQ ID NO: 7079775 - DNA, 19 bp, Homo sapiens
cagaggcaccaggtataga

SEQ ID NO: 7079776 - DNA, 22 bp, Homo sapiens
cagaggcacagtgcgggccact

SEQ ID NO: 7079777 - DNA, 22 bp, Homo sapiens
ggggagaccatctgaaggtgat

SEQ ID NO: 7079778 - DNA, 16 bp, Homo sapiens
cagaggcacctggctc

SEQ ID NO: 7079779 - DNA, 19 bp, Homo sapiens
cagaggcaccaggtataga

SEQ ID NO: 7079780 - DNA, 22 bp, Homo sapiens
ggggagagtattttattcaagt

SEQ ID NO: 7079781 - DNA, 22 bp, Homo sapiens
ggggagagtattttattcaagt

SEQ ID NO: 7079782 - DNA, 22 bp, Homo sapiens
ggggagagtcctttccagttcc

SEQ ID NO: 7079783 - DNA, 22 bp, Homo sapiens
ggggagagtcctttccagttcc

SEQ ID NO: 7079784 - DNA, 22 bp, Homo sapiens
ggggagagtcctttccagttcc

SEQ ID NO: 7079785 - DNA, 22 bp, Homo sapiens
ggggagagtcctttccagttcc

SEQ ID NO: 7079786 - DNA, 22 bp, Homo sapiens
ggggagctgggaggtgagttac

SEQ ID NO: 7079787 - DNA, 22 bp, Homo sapiens
ggggagctgggaggtgagttac

SEQ ID NO: 7079788 - DNA, 22 bp, Homo sapiens
ggggagcttagggtctctgaat

SEQ ID NO: 7079789 - DNA, 22 bp, Homo sapiens
ggggagcttagggtctctgaat

SEQ ID NO: 7079790 - DNA, 22 bp, Homo sapiens
ggggagcttagggtctctgaat

SEQ ID NO: 7079791 - DNA, 22 bp, Homo sapiens
ggggagctgggaggtgagttac

SEQ ID NO: 7079792 - DNA, 22 bp, Homo sapiens
ggggagctgggaggtgagttac

SEQ ID NO: 7079793 - DNA, 22 bp, Homo sapiens
ggggagcttcaggtggcttaca

SEQ ID NO: 7079794 - DNA, 22 bp, Homo sapiens
ggggagcttcaggtggcttaca

SEQ ID NO: 7079795 - DNA, 22 bp, Homo sapiens
ggggagcttcaggtggcttaca

SEQ ID NO: 7079796 - DNA, 22 bp, Homo sapiens
ggggagcttggttattcatgca

SEQ ID NO: 7079797 - DNA, 22 bp, Homo sapiens
ggggagcttggttattcatgca

SEQ ID NO: 7079798 - DNA, 22 bp, Homo sapiens
ggggagcttggttattcatgca

SEQ ID NO: 7079799 - DNA, 22 bp, Homo sapiens
ggggagcaggctgggctgtctg

SEQ ID NO: 7079800 - DNA, 22 bp, Homo sapiens
ggggagcaggctgggctgtctg

SEQ ID NO: 7079801 - DNA, 22 bp, Homo sapiens
ggggagctcatgatgtctttgt

SEQ ID NO: 7079802 - DNA, 22 bp, Homo sapiens
ggggagctcatgatgtctttgt

SEQ ID NO: 7079803 - DNA, 22 bp, Homo sapiens
ggggagctgacaaccacatcct

SEQ ID NO: 7079804 - DNA, 22 bp, Homo sapiens
ggggagctgacaaccacatcct

SEQ ID NO: 7079805 - DNA, 22 bp, Homo sapiens
ggggagctgagacactgccctc

SEQ ID NO: 7079806 - DNA, 22 bp, Homo sapiens
ggggagctgagacactgccctc

SEQ ID NO: 7079807 - DNA, 22 bp, Homo sapiens
ggggagctgccacagttctctg

SEQ ID NO: 7079808 - DNA, 22 bp, Homo sapiens
ggggagctgccacagttctctg

SEQ ID NO: 7079809 - DNA, 22 bp, Homo sapiens
ggggagcaatagttgaggtgtg

SEQ ID NO: 7079810 - DNA, 22 bp, Homo sapiens
ggggagcaatagttgaggtgtg

SEQ ID NO: 7079811 - DNA, 22 bp, Homo sapiens
ggggagcaatagttgaggtgtg

SEQ ID NO: 7079812 - DNA, 22 bp, Homo sapiens
ggggagagtcctttccagttcc

SEQ ID NO: 7079813 - DNA, 22 bp, Homo sapiens
ggggagagtcctttccagttcc

SEQ ID NO: 7079814 - DNA, 22 bp, Homo sapiens
ggggagatgcttaggtccgggg

SEQ ID NO: 7079815 - DNA, 22 bp, Homo sapiens
ggggagcaattgcccccttaga

SEQ ID NO: 7079816 - DNA, 22 bp, Homo sapiens
ggggagcagaagcagcaacaac

SEQ ID NO: 7079817 - DNA, 22 bp, Homo sapiens
ggggagcagaagcagcaacaac

SEQ ID NO: 7079818 - DNA, 22 bp, Homo sapiens
ggggagcagaagcagcaacaac

SEQ ID NO: 7079819 - DNA, 18 bp, Homo sapiens
ggggagcagactgaactc

SEQ ID NO: 7079820 - DNA, 18 bp, Homo sapiens
ggggagcagactgaactc

SEQ ID NO: 7079821 - DNA, 22 bp, Homo sapiens
gggccagagcttggcagctggg

SEQ ID NO: 7079822 - DNA, 22 bp, Homo sapiens
gggccagcagtatcggaggcat

SEQ ID NO: 7079823 - DNA, 22 bp, Homo sapiens
gggccagcagtatcggaggcat

SEQ ID NO: 7079824 - DNA, 22 bp, Homo sapiens
gggccagagcttggcagctggg

SEQ ID NO: 7079825 - DNA, 22 bp, Homo sapiens
gggccagagcttggcagctggg

SEQ ID NO: 7079826 - DNA, 22 bp, Homo sapiens
gggccagagcacagaggatgtt

SEQ ID NO: 7079827 - DNA, 22 bp, Homo sapiens
gggccagagcacagaggatgtt

SEQ ID NO: 7079828 - DNA, 22 bp, Homo sapiens
gggccagagcacagaggatgtt

SEQ ID NO: 7079829 - DNA, 22 bp, Homo sapiens
gggccagacccttggcgatctg

SEQ ID NO: 7079830 - DNA, 22 bp, Homo sapiens
gggccagacctcttctcaggga

SEQ ID NO: 7079831 - DNA, 22 bp, Homo sapiens
gggccagacctcttctcaggga

SEQ ID NO: 7079832 - DNA, 22 bp, Homo sapiens
gggccagcagtatcggaggcat

SEQ ID NO: 7079833 - DNA, 22 bp, Homo sapiens
gggccagcagtatcggaggcat

SEQ ID NO: 7079834 - DNA, 22 bp, Homo sapiens
gggccagcctactgctagaccc

SEQ ID NO: 7079835 - DNA, 22 bp, Homo sapiens
gggccagctctgtgatgtaggg

SEQ ID NO: 7079836 - DNA, 22 bp, Homo sapiens
gggctctgcgggcccggactcc

SEQ ID NO: 7079837 - DNA, 22 bp, Homo sapiens
gggctctgcgggcccggactcc

SEQ ID NO: 7079838 - DNA, 20 bp, Homo sapiens
gggctctgcttggcagaagt

SEQ ID NO: 7079839 - DNA, 20 bp, Homo sapiens
gggctctgcttggcagaagt

SEQ ID NO: 7079840 - DNA, 20 bp, Homo sapiens
gggctctgcttggcagaagt

SEQ ID NO: 7079841 - DNA, 20 bp, Homo sapiens
gggctctgcttggcagaagt

SEQ ID NO: 7079842 - DNA, 22 bp, Homo sapiens
gggctctgtgttctagctctcg

SEQ ID NO: 7079843 - DNA, 22 bp, Homo sapiens
gggccagacccttggcgatctg

SEQ ID NO: 7079844 - DNA, 22 bp, Homo sapiens
gggccactcctggctgctgagt

SEQ ID NO: 7079845 - DNA, 21 bp, Homo sapiens
gggccactctagagaaagaaa

SEQ ID NO: 7079846 - DNA, 22 bp, Homo sapiens
gggccactgggtcctgctggcc

SEQ ID NO: 7079847 - DNA, 22 bp, Homo sapiens
gggccactgggtcctgctggcc

SEQ ID NO: 7079848 - DNA, 22 bp, Homo sapiens
gggccaccccactgcccacgct

SEQ ID NO: 7079849 - DNA, 22 bp, Homo sapiens
gggccacctggattccatgtgt

SEQ ID NO: 7079850 - DNA, 22 bp, Homo sapiens
gggccacggaaggaccagtggg

SEQ ID NO: 7079851 - DNA, 22 bp, Homo sapiens
gggccacggaaggaccagtggg

SEQ ID NO: 7079852 - DNA, 22 bp, Homo sapiens
gggccactcagattgtcccctt

SEQ ID NO: 7079853 - DNA, 22 bp, Homo sapiens
gggccactcctggctgctgagt

SEQ ID NO: 7079854 - DNA, 22 bp, Homo sapiens
gggcagtgtcggggcccaggga

SEQ ID NO: 7079855 - DNA, 22 bp, Homo sapiens
gggcagtgtcgaggtctggtcc

SEQ ID NO: 7079856 - DNA, 22 bp, Homo sapiens
gggcagtgtcggggcccaggga

SEQ ID NO: 7079857 - DNA, 22 bp, Homo sapiens
gggcagtgtctggcccccaggc

SEQ ID NO: 7079858 - DNA, 22 bp, Homo sapiens
gggcagtgtctggcccccaggc

SEQ ID NO: 7079859 - DNA, 22 bp, Homo sapiens
cagagcctcatcatccactcca

SEQ ID NO: 7079860 - DNA, 22 bp, Homo sapiens
cagagcctcatcatccactcca

SEQ ID NO: 7079861 - DNA, 22 bp, Homo sapiens
cagagcctccctcctctgccat

SEQ ID NO: 7079862 - DNA, 22 bp, Homo sapiens
cagagcctccctcctctgccat

SEQ ID NO: 7079863 - DNA, 22 bp, Homo sapiens
cagagcctccctcctctgccat

SEQ ID NO: 7079864 - DNA, 22 bp, Homo sapiens
cagagcctccctcctctgccat

SEQ ID NO: 7079865 - DNA, 19 bp, Homo sapiens
cagagcctcagagctagaa

SEQ ID NO: 7079866 - DNA, 19 bp, Homo sapiens
cagagcctcagagctagaa

SEQ ID NO: 7079867 - DNA, 22 bp, Homo sapiens
cagagcctcagaatcctgtgga

SEQ ID NO: 7079868 - DNA, 22 bp, Homo sapiens
cagagcctcagaatcctgtgga

SEQ ID NO: 7079869 - DNA, 22 bp, Homo sapiens
cagagcctaaaacgactccact

SEQ ID NO: 7079870 - DNA, 22 bp, Homo sapiens
cagagcctaaaacgactccact

SEQ ID NO: 7079871 - DNA, 22 bp, Homo sapiens
cagagcctaaaacgactccact

SEQ ID NO: 7079872 - DNA, 22 bp, Homo sapiens
cagagccgggagccagtcacag

SEQ ID NO: 7079873 - DNA, 22 bp, Homo sapiens
cagagcctaaaacgactccact

SEQ ID NO: 7079874 - DNA, 22 bp, Homo sapiens
gggctgagaagttgatcccaag

SEQ ID NO: 7079875 - DNA, 22 bp, Homo sapiens
gggctgactcaaccttgcaaag

SEQ ID NO: 7079876 - DNA, 22 bp, Homo sapiens
gggctgactcctattggatgaa

SEQ ID NO: 7079877 - DNA, 22 bp, Homo sapiens
gggctgactctgcactgagcca

SEQ ID NO: 7079878 - DNA, 22 bp, Homo sapiens
gggctgactcaaccttgcaaag

SEQ ID NO: 7079879 - DNA, 22 bp, Homo sapiens
gggctgacgaaggccatgtgtg

SEQ ID NO: 7079880 - DNA, 22 bp, Homo sapiens
gggctgacgaaggccatgtgtg

SEQ ID NO: 7079881 - DNA, 22 bp, Homo sapiens
gggctgacgaaggccatgtgtg

SEQ ID NO: 7079882 - DNA, 22 bp, Homo sapiens
gggctgacaaccatctgacaag

SEQ ID NO: 7079883 - DNA, 22 bp, Homo sapiens
gggctgaaaggccgcctcagat

SEQ ID NO: 7079884 - DNA, 22 bp, Homo sapiens
gggctctgtttagatcagagat

SEQ ID NO: 7079885 - DNA, 22 bp, Homo sapiens
gggctctgtttagatcagagat

SEQ ID NO: 7079886 - DNA, 22 bp, Homo sapiens
gggctctgtttagaccagagat

SEQ ID NO: 7079887 - DNA, 22 bp, Homo sapiens
gggctctgtttagatcagagat

SEQ ID NO: 7079888 - DNA, 22 bp, Homo sapiens
gggctctgtttagatcagagat

SEQ ID NO: 7079889 - DNA, 22 bp, Homo sapiens
gggctctgtttagaccagagat

SEQ ID NO: 7079890 - DNA, 22 bp, Homo sapiens
gggctctgtttagaccagagat

SEQ ID NO: 7079891 - DNA, 22 bp, Homo sapiens
gggctctgtttagaccagagat

SEQ ID NO: 7079892 - DNA, 22 bp, Homo sapiens
gggctgacaaccatctgacaag

SEQ ID NO: 7079893 - DNA, 22 bp, Homo sapiens
gggctgacaaccatctgacaag

SEQ ID NO: 7079894 - DNA, 22 bp, Homo sapiens
gggctgacaaccatctgacaag

SEQ ID NO: 7079895 - DNA, 22 bp, Homo sapiens
gggctgacaatctctttactta

SEQ ID NO: 7079896 - DNA, 22 bp, Homo sapiens
gggctgacaatctctttactta

SEQ ID NO: 7079897 - DNA, 22 bp, Homo sapiens
gggctgacaccacccaggcgca

SEQ ID NO: 7079898 - DNA, 22 bp, Homo sapiens
gggctgacaccacccaggcgca

SEQ ID NO: 7079899 - DNA, 22 bp, Homo sapiens
gggctgacaccacccaggcgca

SEQ ID NO: 7079900 - DNA, 22 bp, Homo sapiens
gggctgacaccacccaggcgca

SEQ ID NO: 7079901 - DNA, 22 bp, Homo sapiens
gggctgacagcacgccttctgt

SEQ ID NO: 7079902 - DNA, 22 bp, Homo sapiens
gggctgacagcacgccttctgt

SEQ ID NO: 7079903 - DNA, 17 bp, Homo sapiens
gggctgacagtggcctc

SEQ ID NO: 7079904 - DNA, 17 bp, Homo sapiens
gggctgacagtggcctc

SEQ ID NO: 7079905 - DNA, 17 bp, Homo sapiens
gggctgacagtggcctc

SEQ ID NO: 7079906 - DNA, 22 bp, Homo sapiens
gggctgacagtttcccctgaaa

SEQ ID NO: 7079907 - DNA, 22 bp, Homo sapiens
gggctgacagtttcccctgaaa

SEQ ID NO: 7079908 - DNA, 22 bp, Homo sapiens
gggctgacatatttggtgctct

SEQ ID NO: 7079909 - DNA, 22 bp, Homo sapiens
gggctgacatatttggtgctct

SEQ ID NO: 7079910 - DNA, 22 bp, Homo sapiens
gggctgaccaatgccttgcttt

SEQ ID NO: 7079911 - DNA, 22 bp, Homo sapiens
gggctgaccccacccctcactc

SEQ ID NO: 7079912 - DNA, 22 bp, Homo sapiens
gggctgaccccacccctcactc

SEQ ID NO: 7079913 - DNA, 22 bp, Homo sapiens
cagagctgggtttgggaaacct

SEQ ID NO: 7079914 - DNA, 22 bp, Homo sapiens
cagagctggggactgttggatg

SEQ ID NO: 7079915 - DNA, 22 bp, Homo sapiens
cagagctggggactgttggatg

SEQ ID NO: 7079916 - DNA, 22 bp, Homo sapiens
cagagctgggtttgggaaacct

SEQ ID NO: 7079917 - DNA, 22 bp, Homo sapiens
cagagctggggactgttggatg

SEQ ID NO: 7079918 - DNA, 22 bp, Homo sapiens
cagagctggggactgttggatg

SEQ ID NO: 7079919 - DNA, 22 bp, Homo sapiens
cagagctgggatcccatgggcg

SEQ ID NO: 7079920 - DNA, 22 bp, Homo sapiens
cagagctgggatcccatgggcg

SEQ ID NO: 7079921 - DNA, 22 bp, Homo sapiens
cagagctgggatcccatgggcg

SEQ ID NO: 7079922 - DNA, 20 bp, Homo sapiens
cagagctgggatttgaacac

SEQ ID NO: 7079923 - DNA, 22 bp, Homo sapiens
cagagctgggcatggtgaaagg

SEQ ID NO: 7079924 - DNA, 22 bp, Homo sapiens
cagagctgggcatggtgaaagg

SEQ ID NO: 7079925 - DNA, 22 bp, Homo sapiens
cagagctgggatcccatgggcg

SEQ ID NO: 7079926 - DNA, 23 bp, Homo sapiens
cagagctggcttcatgggtgtgc

SEQ ID NO: 7079927 - DNA, 23 bp, Homo sapiens
cagagctggcttcatgggtgtgc

SEQ ID NO: 7079928 - DNA, 23 bp, Homo sapiens
cagagctggcttcatgggtgtgc

SEQ ID NO: 7079929 - DNA, 22 bp, Homo sapiens
cagagctgggatcccatgggcg

SEQ ID NO: 7079930 - DNA, 22 bp, Homo sapiens
cagagctgggatcccatgggcg

SEQ ID NO: 7079931 - DNA, 22 bp, Homo sapiens
cagagctgcttcccagtttgtg

SEQ ID NO: 7079932 - DNA, 19 bp, Homo sapiens
cagagctgctggcctcgtc

SEQ ID NO: 7079933 - DNA, 22 bp, Homo sapiens
cagagcctgcctctggctgtgg

SEQ ID NO: 7079934 - DNA, 23 bp, Homo sapiens
cagagctggctcagagctgcctg

SEQ ID NO: 7079935 - DNA, 23 bp, Homo sapiens
cagagctggctcagagctgcctg

SEQ ID NO: 7079936 - DNA, 22 bp, Homo sapiens
cagagctggctctgcatgtaca

SEQ ID NO: 7079937 - DNA, 22 bp, Homo sapiens
cagagctggctctgcatgtaca

SEQ ID NO: 7079938 - DNA, 22 bp, Homo sapiens
cagagctggctctgcatgtaca

SEQ ID NO: 7079939 - DNA, 22 bp, Homo sapiens
cagagctggctctgcatgtaca

SEQ ID NO: 7079940 - DNA, 22 bp, Homo sapiens
cagagcctctcagccccttggg

SEQ ID NO: 7079941 - DNA, 22 bp, Homo sapiens
cagagcctctcagccccttggg

SEQ ID NO: 7079942 - DNA, 22 bp, Homo sapiens
cagagcctctcagccccttggg

SEQ ID NO: 7079943 - DNA, 22 bp, Homo sapiens
cagagcctctcagccccttggg

SEQ ID NO: 7079944 - DNA, 22 bp, Homo sapiens
cagagcctgccacctttctccc

SEQ ID NO: 7079945 - DNA, 22 bp, Homo sapiens
cagagcctgcctctggctgtgg

SEQ ID NO: 7079946 - DNA, 22 bp, Homo sapiens
cagagcctctgccctgggcact

SEQ ID NO: 7079947 - DNA, 22 bp, Homo sapiens
cagagcctctgccctgggcact

SEQ ID NO: 7079948 - DNA, 22 bp, Homo sapiens
cagagcctctgccctgggcact

SEQ ID NO: 7079949 - DNA, 22 bp, Homo sapiens
cagaggcaaaagaggtggaggt

SEQ ID NO: 7079950 - DNA, 20 bp, Homo sapiens
cagaggcaaggagacttgga

SEQ ID NO: 7079951 - DNA, 20 bp, Homo sapiens
cagaggcaaggagacttgga

SEQ ID NO: 7079952 - DNA, 22 bp, Homo sapiens
cagaggcaaaagaggtggaggt

SEQ ID NO: 7079953 - DNA, 20 bp, Homo sapiens
cagaggcaaggagacttgga

SEQ ID NO: 7079954 - DNA, 22 bp, Homo sapiens
cagaggcacaagaaagcaaggc

SEQ ID NO: 7079955 - DNA, 22 bp, Homo sapiens
cagaggcacaagaaagcaaggc

SEQ ID NO: 7079956 - DNA, 22 bp, Homo sapiens
gggctgagtgggcctcttactt

SEQ ID NO: 7079957 - DNA, 22 bp, Homo sapiens
gggctgagtgacctcaggccaa

SEQ ID NO: 7079958 - DNA, 22 bp, Homo sapiens
cagaggagttcagtacacagcc

SEQ ID NO: 7079959 - DNA, 22 bp, Homo sapiens
cagaggcaaaagaggtggaggt

SEQ ID NO: 7079960 - DNA, 22 bp, Homo sapiens
cagaggcaaaagaggtggaggt

SEQ ID NO: 7079961 - DNA, 22 bp, Homo sapiens
gggctgaggggtatctcatggg

SEQ ID NO: 7079962 - DNA, 22 bp, Homo sapiens
gggctgaggggtatctcatggg

SEQ ID NO: 7079963 - DNA, 22 bp, Homo sapiens
gggctgaggggtatctcatggg

SEQ ID NO: 7079964 - DNA, 22 bp, Homo sapiens
cagagctgggtttgggaaacct

SEQ ID NO: 7079965 - DNA, 22 bp, Homo sapiens
gggctgaggggtatctcatggg

SEQ ID NO: 7079966 - DNA, 22 bp, Homo sapiens
gggctgaggggtatctcatggg

SEQ ID NO: 7079967 - DNA, 22 bp, Homo sapiens
gggctgagtcatctggggcctc

SEQ ID NO: 7079968 - DNA, 22 bp, Homo sapiens
gggctgagtcatctggggcctc

SEQ ID NO: 7079969 - DNA, 22 bp, Homo sapiens
gggctgagtcatctggggcctc

SEQ ID NO: 7079970 - DNA, 22 bp, Homo sapiens
gggctgagtcatctggggcctc

SEQ ID NO: 7079971 - DNA, 22 bp, Homo sapiens
gggctgagtcatctggggcctc

SEQ ID NO: 7079972 - DNA, 22 bp, Homo sapiens
gggctgagtcatctggggcctc

SEQ ID NO: 7079973 - DNA, 22 bp, Homo sapiens
gggctgagtctgctgcctgtca

SEQ ID NO: 7079974 - DNA, 22 bp, Homo sapiens
gggctgagtctgctgcctgtca

SEQ ID NO: 7079975 - DNA, 22 bp, Homo sapiens
gggctgagtctgctgcctgtca

SEQ ID NO: 7079976 - DNA, 22 bp, Homo sapiens
gggctgagtgacctcaggccaa

SEQ ID NO: 7079977 - DNA, 22 bp, Homo sapiens
gggctgagtgacctcaggccaa

SEQ ID NO: 7079978 - DNA, 22 bp, Homo sapiens
gggctgagtgacctcaggccaa

SEQ ID NO: 7079979 - DNA, 22 bp, Homo sapiens
gggctgagtgacctcaggccaa

SEQ ID NO: 7079980 - DNA, 20 bp, Homo sapiens
cagacctgcacccacttcga

SEQ ID NO: 7079981 - DNA, 22 bp, Homo sapiens
cagacctgaggagcactgagcc

SEQ ID NO: 7079982 - DNA, 22 bp, Homo sapiens
cagacctgaggagcactgagcc

SEQ ID NO: 7079983 - DNA, 17 bp, Homo sapiens
cagacctctgtgaagcc

SEQ ID NO: 7079984 - DNA, 22 bp, Homo sapiens
cagacctctatggggtaaatct

SEQ ID NO: 7079985 - DNA, 22 bp, Homo sapiens
cagacctctttttagcactccc

SEQ ID NO: 7079986 - DNA, 22 bp, Homo sapiens
cagacctctttttagcactccc

SEQ ID NO: 7079987 - DNA, 20 bp, Homo sapiens
cagacctgcacccacttcga

SEQ ID NO: 7079988 - DNA, 22 bp, Homo sapiens
cagacctggaaaacaggcttgc

SEQ ID NO: 7079989 - DNA, 22 bp, Homo sapiens
cagacctggggcctgggagccc

SEQ ID NO: 7079990 - DNA, 22 bp, Homo sapiens
cagacctggggcctgggagccc

SEQ ID NO: 7079991 - DNA, 22 bp, Homo sapiens
cagacctgggtccctggcctgt

SEQ ID NO: 7079992 - DNA, 22 bp, Homo sapiens
cagacctggggcctgggagccc

SEQ ID NO: 7079993 - DNA, 19 bp, Homo sapiens
cagacctgtccagcctgtg

SEQ ID NO: 7079994 - DNA, 19 bp, Homo sapiens
cagacctgtccagcctgtg

SEQ ID NO: 7079995 - DNA, 22 bp, Homo sapiens
cagacctgggtccctggcctgt

SEQ ID NO: 7079996 - DNA, 19 bp, Homo sapiens
cagacctgtccagcctgtg

SEQ ID NO: 7079997 - DNA, 19 bp, Homo sapiens
cagacctgtccagcctgtg

SEQ ID NO: 7079998 - DNA, 22 bp, Homo sapiens
cagacgggctcatggcagtccc

SEQ ID NO: 7079999 - DNA, 22 bp, Homo sapiens
cagacgggtggtctgcgaggcc

SEQ ID NO: 7080000 - DNA, 22 bp, Homo sapiens
cagactctgatgcagccttgtg

SEQ ID NO: 7080001 - DNA, 22 bp, Homo sapiens
cagactcttgagctgattgtat

SEQ ID NO: 7080002 - DNA, 22 bp, Homo sapiens
cagactgactttctgtggctat

SEQ ID NO: 7080003 - DNA, 22 bp, Homo sapiens
cagactgagggcatcacatacg

SEQ ID NO: 7080004 - DNA, 22 bp, Homo sapiens
cagactggccacatctgcactg

SEQ ID NO: 7080005 - DNA, 22 bp, Homo sapiens
cagactggccacatctgcactg

SEQ ID NO: 7080006 - DNA, 22 bp, Homo sapiens
cagactggctgaaggccgagtg

SEQ ID NO: 7080007 - DNA, 22 bp, Homo sapiens
cagactgtagagtttgagaagt

SEQ ID NO: 7080008 - DNA, 22 bp, Homo sapiens
gggcagagaaatggacagttgg

SEQ ID NO: 7080009 - DNA, 22 bp, Homo sapiens
gggcagagaaatggacagttgg

SEQ ID NO: 7080010 - DNA, 22 bp, Homo sapiens
gggcagagaaatggacagttgg

SEQ ID NO: 7080011 - DNA, 22 bp, Homo sapiens
gggcagagactcagaaacagaa

SEQ ID NO: 7080012 - DNA, 22 bp, Homo sapiens
gggcagcagagccctgccgagt

SEQ ID NO: 7080013 - DNA, 22 bp, Homo sapiens
ggcttagcaactcctgaggctc

SEQ ID NO: 7080014 - DNA, 22 bp, Homo sapiens
ggcttagcaactcctgaggctc

SEQ ID NO: 7080015 - DNA, 20 bp, Homo sapiens
ggcttagactgagttctcac

SEQ ID NO: 7080016 - DNA, 22 bp, Homo sapiens
ggcttcacagccccattagtgc

SEQ ID NO: 7080017 - DNA, 22 bp, Homo sapiens
ggcttcacagttgtagcagctc

SEQ ID NO: 7080018 - DNA, 22 bp, Homo sapiens
ggcttcactcataattaggttc

SEQ ID NO: 7080019 - DNA, 22 bp, Homo sapiens
ggcttcagaagactggacaggt

SEQ ID NO: 7080020 - DNA, 22 bp, Homo sapiens
ggcttcagaagactggacaggt

SEQ ID NO: 7080021 - DNA, 22 bp, Homo sapiens
ggcttcagaggggaggtagtgc

SEQ ID NO: 7080022 - DNA, 22 bp, Homo sapiens
cagacagggtcctgtccgtcac

SEQ ID NO: 7080023 - DNA, 22 bp, Homo sapiens
cagacagggtcctgtccgtcac

SEQ ID NO: 7080024 - DNA, 22 bp, Homo sapiens
cagacctcagtcctcagtagga

SEQ ID NO: 7080025 - DNA, 22 bp, Homo sapiens
cagacctcaaagctgcagtgct

SEQ ID NO: 7080026 - DNA, 22 bp, Homo sapiens
cagacctcaattatgtaagtaa

SEQ ID NO: 7080027 - DNA, 22 bp, Homo sapiens
cagaccctgggccacagaggag

SEQ ID NO: 7080028 - DNA, 22 bp, Homo sapiens
cagacccttttctgagaggacc

SEQ ID NO: 7080029 - DNA, 22 bp, Homo sapiens
cagacctaggctctgtgagagc

SEQ ID NO: 7080030 - DNA, 22 bp, Homo sapiens
cagacctcaaagctgcagtgct

SEQ ID NO: 7080031 - DNA, 21 bp, Homo sapiens
cagaccctctagaggccacct

SEQ ID NO: 7080032 - DNA, 21 bp, Homo sapiens
cagaccctctagaggccacct

SEQ ID NO: 7080033 - DNA, 22 bp, Homo sapiens
cagacagggtgggtttctgggc

SEQ ID NO: 7080034 - DNA, 22 bp, Homo sapiens
cagaccagaaggaagccgacaa

SEQ ID NO: 7080035 - DNA, 22 bp, Homo sapiens
cagaccagccatttgcctcttc

SEQ ID NO: 7080036 - DNA, 22 bp, Homo sapiens
cagaccagccatttgcctcttc

SEQ ID NO: 7080037 - DNA, 22 bp, Homo sapiens
cagacccaggatccaaatgttg

SEQ ID NO: 7080038 - DNA, 21 bp, Homo sapiens
cagaccattgcatgagcaggt

SEQ ID NO: 7080039 - DNA, 21 bp, Homo sapiens
cagaccattgcatgagcaggt

SEQ ID NO: 7080040 - DNA, 22 bp, Homo sapiens
cagaccagtagggctcatccca

SEQ ID NO: 7080041 - DNA, 22 bp, Homo sapiens
cagaccatcttgaagcaaactg

SEQ ID NO: 7080042 - DNA, 22 bp, Homo sapiens
cagaccccgagtttgcagagtt

SEQ ID NO: 7080043 - DNA, 22 bp, Homo sapiens
gggcagcagcaggaggtctctg

SEQ ID NO: 7080044 - DNA, 22 bp, Homo sapiens
gggcagcagcaggaggtctctg

SEQ ID NO: 7080045 - DNA, 22 bp, Homo sapiens
gggcagcagcaggaggtctctg

SEQ ID NO: 7080046 - DNA, 22 bp, Homo sapiens
gggcagcagcaggaggtctctg

SEQ ID NO: 7080047 - DNA, 22 bp, Homo sapiens
gggcagcaggctccacgttcct

SEQ ID NO: 7080048 - DNA, 22 bp, Homo sapiens
gggcagcaggctccacgttcct

SEQ ID NO: 7080049 - DNA, 22 bp, Homo sapiens
gggcagcagagccctgccgagt

SEQ ID NO: 7080050 - DNA, 22 bp, Homo sapiens
gggcagcagaggatcccttaat

SEQ ID NO: 7080051 - DNA, 21 bp, Homo sapiens
gggcagcagcagcaacaaggg

SEQ ID NO: 7080052 - DNA, 22 bp, Homo sapiens
gggcagcagttgccctaatcaa

SEQ ID NO: 7080053 - DNA, 22 bp, Homo sapiens
gggcagcagttgccctaatcaa

SEQ ID NO: 7080054 - DNA, 22 bp, Homo sapiens
gggcagcagttgccctaatcaa

SEQ ID NO: 7080055 - DNA, 22 bp, Homo sapiens
gggcagcataacaatcactgaa

SEQ ID NO: 7080056 - DNA, 22 bp, Homo sapiens
gggcagcatcaggaggggcttt

SEQ ID NO: 7080057 - DNA, 22 bp, Homo sapiens
gggcagcatcaggaggggcttt

SEQ ID NO: 7080058 - DNA, 22 bp, Homo sapiens
gggcagcatcaggaggggcttt

SEQ ID NO: 7080059 - DNA, 22 bp, Homo sapiens
gggcagcatgaggaccctcatc

SEQ ID NO: 7080060 - DNA, 22 bp, Homo sapiens
gggcagcatgaggaccctcatc

SEQ ID NO: 7080061 - DNA, 22 bp, Homo sapiens
gggcagcatgaggaccctcatc

SEQ ID NO: 7080062 - DNA, 22 bp, Homo sapiens
gggcagcatcaggaggggcttt

SEQ ID NO: 7080063 - DNA, 22 bp, Homo sapiens
gggcagcatcaggaggggcttt

SEQ ID NO: 7080064 - DNA, 22 bp, Homo sapiens
gggcagcatcaggaggggcttt

SEQ ID NO: 7080065 - DNA, 22 bp, Homo sapiens
gggcagcatcaggaggggcttt

SEQ ID NO: 7080066 - DNA, 22 bp, Homo sapiens
cagagacaggaatcagctgcag

SEQ ID NO: 7080067 - DNA, 22 bp, Homo sapiens
cagagacaggaatcagctgcag

SEQ ID NO: 7080068 - DNA, 22 bp, Homo sapiens
cagagacagcctgggagggaca

SEQ ID NO: 7080069 - DNA, 22 bp, Homo sapiens
cagagacagcctgggagggaca

SEQ ID NO: 7080070 - DNA, 22 bp, Homo sapiens
cagagacagcctgggagggaca

SEQ ID NO: 7080071 - DNA, 22 bp, Homo sapiens
cagagacagcctgggagggaca

SEQ ID NO: 7080072 - DNA, 22 bp, Homo sapiens
cagagacaggaatcagctgcag

SEQ ID NO: 7080073 - DNA, 22 bp, Homo sapiens
cagagacaggaatcagctgcag

SEQ ID NO: 7080074 - DNA, 22 bp, Homo sapiens
gggcagcccagaactgctgcag

SEQ ID NO: 7080075 - DNA, 22 bp, Homo sapiens
cagagacagcctgggagggaca

SEQ ID NO: 7080076 - DNA, 22 bp, Homo sapiens
cagagacagcctgggagggaca

SEQ ID NO: 7080077 - DNA, 22 bp, Homo sapiens
cagagacagcctgggagggaca

SEQ ID NO: 7080078 - DNA, 22 bp, Homo sapiens
gggcagcattctgtgggcaggt

SEQ ID NO: 7080079 - DNA, 22 bp, Homo sapiens
gggcagcattctgtgggcaggt

SEQ ID NO: 7080080 - DNA, 22 bp, Homo sapiens
gggcagcattctgtgggcaggt

SEQ ID NO: 7080081 - DNA, 22 bp, Homo sapiens
gggcagcattctgtgggcaggt

SEQ ID NO: 7080082 - DNA, 22 bp, Homo sapiens
gggcagcattctgtgggcaggt

SEQ ID NO: 7080083 - DNA, 22 bp, Homo sapiens
gggcagcattctgtgggcaggt

SEQ ID NO: 7080084 - DNA, 22 bp, Homo sapiens
gggcagcattctgtgggcaggt

SEQ ID NO: 7080085 - DNA, 22 bp, Homo sapiens
gggcagcattctgtgggcaggt

SEQ ID NO: 7080086 - DNA, 22 bp, Homo sapiens
gggcagcatttgaaaaacagat

SEQ ID NO: 7080087 - DNA, 22 bp, Homo sapiens
gggcagtggttacacagctgag

SEQ ID NO: 7080088 - DNA, 22 bp, Homo sapiens
gggcagtgtcgaggtctggtcc

SEQ ID NO: 7080089 - DNA, 22 bp, Homo sapiens
gggcagtgggtggctgcagcct

SEQ ID NO: 7080090 - DNA, 22 bp, Homo sapiens
gggcagtgggtggctgcagcct

SEQ ID NO: 7080091 - DNA, 22 bp, Homo sapiens
gggcagtggtccaggctacagc

SEQ ID NO: 7080092 - DNA, 22 bp, Homo sapiens
gggcagtggtccaggctacagc

SEQ ID NO: 7080093 - DNA, 22 bp, Homo sapiens
gggcagtgggtggctgcagcct

SEQ ID NO: 7080094 - DNA, 22 bp, Homo sapiens
gggcagtgggaccaggcaccag

SEQ ID NO: 7080095 - DNA, 22 bp, Homo sapiens
gggcagtgggtggctgcagcct

SEQ ID NO: 7080096 - DNA, 22 bp, Homo sapiens
gggcagtgggtggctgcagcct

SEQ ID NO: 7080097 - DNA, 19 bp, Homo sapiens
gggcagtggcactagggag

SEQ ID NO: 7080098 - DNA, 22 bp, Homo sapiens
gggcagtggctcacgcctgtaa

SEQ ID NO: 7080099 - DNA, 22 bp, Homo sapiens
gggcagtgggaccaggcaccag

SEQ ID NO: 7080100 - DNA, 22 bp, Homo sapiens
cagagacaggcttgccctccac

SEQ ID NO: 7080101 - DNA, 22 bp, Homo sapiens
cagagacaggcttgccctccac

SEQ ID NO: 7080102 - DNA, 22 bp, Homo sapiens
cagagacaggcttgccctccac

SEQ ID NO: 7080103 - DNA, 22 bp, Homo sapiens
cagagacagggcagggagtgtg

SEQ ID NO: 7080104 - DNA, 22 bp, Homo sapiens
cagagacagggcagggagtgtg

SEQ ID NO: 7080105 - DNA, 22 bp, Homo sapiens
cagagacagggcagggagtgtg

SEQ ID NO: 7080106 - DNA, 22 bp, Homo sapiens
cagagacagggcagggagtgtg

SEQ ID NO: 7080107 - DNA, 22 bp, Homo sapiens
cagagacagggcagggagtgtg

SEQ ID NO: 7080108 - DNA, 22 bp, Homo sapiens
cagagacagggcagggagtgtg

SEQ ID NO: 7080109 - DNA, 22 bp, Homo sapiens
cagagacagtttcacagggtct

SEQ ID NO: 7080110 - DNA, 22 bp, Homo sapiens
cagagacagtttcacagggtct

SEQ ID NO: 7080111 - DNA, 22 bp, Homo sapiens
gggcaggtatttatcttctatt

SEQ ID NO: 7080112 - DNA, 21 bp, Homo sapiens
gggcaggtctctgatgtcaac

SEQ ID NO: 7080113 - DNA, 22 bp, Homo sapiens
cagagacaggatctcgaagact

SEQ ID NO: 7080114 - DNA, 22 bp, Homo sapiens
cagagacaggatctcgaagact

SEQ ID NO: 7080115 - DNA, 22 bp, Homo sapiens
cagagacaggatctcgaagact

SEQ ID NO: 7080116 - DNA, 22 bp, Homo sapiens
cagagacaggatctcgaagact

SEQ ID NO: 7080117 - DNA, 22 bp, Homo sapiens
cagagacaggagtgctcccagt

SEQ ID NO: 7080118 - DNA, 22 bp, Homo sapiens
cagagacaggagtgctcccagt

SEQ ID NO: 7080119 - DNA, 22 bp, Homo sapiens
cagagacaggagtgctcccagt

SEQ ID NO: 7080120 - DNA, 22 bp, Homo sapiens
gtccctggggaatcagctggag

SEQ ID NO: 7080121 - DNA, 22 bp, Homo sapiens
gtccctggggaatcagctggag

SEQ ID NO: 7080122 - DNA, 19 bp, Homo sapiens
gtccctgggcagaggcacc

SEQ ID NO: 7080123 - DNA, 22 bp, Homo sapiens
gtcccaggctccatggcagcca

SEQ ID NO: 7080124 - DNA, 22 bp, Homo sapiens
gtcccaggcttatgtggagctt

SEQ ID NO: 7080125 - DNA, 22 bp, Homo sapiens
gtcccaggcttatgtggagctt

SEQ ID NO: 7080126 - DNA, 22 bp, Homo sapiens
gtcccagggaagaaggcagcac

SEQ ID NO: 7080127 - DNA, 22 bp, Homo sapiens
gtcccagggaagaaggcagcac

SEQ ID NO: 7080128 - DNA, 22 bp, Homo sapiens
gtccctggcgctttcgagcctt

SEQ ID NO: 7080129 - DNA, 22 bp, Homo sapiens
gtccctgggtctaaggcagtaa

SEQ ID NO: 7080130 - DNA, 22 bp, Homo sapiens
gtccctgggtctaaggcagtaa

SEQ ID NO: 7080131 - DNA, 22 bp, Homo sapiens
gtccctgggtctaaggcagtaa

SEQ ID NO: 7080132 - DNA, 22 bp, Homo sapiens
gtccctgggggtttaggactca

SEQ ID NO: 7080133 - DNA, 22 bp, Homo sapiens
gtccctgggtagctcagtggct

SEQ ID NO: 7080134 - DNA, 22 bp, Homo sapiens
gtccctgggtagctcagtggct

SEQ ID NO: 7080135 - DNA, 22 bp, Homo sapiens
gtccctggtctaccgtggcttc

SEQ ID NO: 7080136 - DNA, 22 bp, Homo sapiens
gtccctggtctaccgtggcttc

SEQ ID NO: 7080137 - DNA, 22 bp, Homo sapiens
gtctgcttttctgccctttcat

SEQ ID NO: 7080138 - DNA, 22 bp, Homo sapiens
gtctcttttatggtgagttgat

SEQ ID NO: 7080139 - DNA, 22 bp, Homo sapiens
gtccctgtgcccagagaggcgg

SEQ ID NO: 7080140 - DNA, 22 bp, Homo sapiens
gtcccttcctcattccacttta

SEQ ID NO: 7080141 - DNA, 22 bp, Homo sapiens
gtcccttggctcacaaacagct

SEQ ID NO: 7080142 - DNA, 22 bp, Homo sapiens
gtctggaagaacctgtgccagt

SEQ ID NO: 7080143 - DNA, 22 bp, Homo sapiens
gtctggaagaacctgtgccagt

SEQ ID NO: 7080144 - DNA, 22 bp, Homo sapiens
gtctggaaccaatatttgaggg

SEQ ID NO: 7080145 - DNA, 22 bp, Homo sapiens
gtctggaaccaatatttgaggg

SEQ ID NO: 7080146 - DNA, 22 bp, Homo sapiens
gtctggaaatttaaggtatgag

SEQ ID NO: 7080147 - DNA, 22 bp, Homo sapiens
gtctggaaatttaaggtatgag

SEQ ID NO: 7080148 - DNA, 22 bp, Homo sapiens
gtctggaaatttaaggtatgag

SEQ ID NO: 7080149 - DNA, 22 bp, Homo sapiens
gtctggaaccaagacgtgtagc

SEQ ID NO: 7080150 - DNA, 22 bp, Homo sapiens
gtctggaaccaagacgtgtagc

SEQ ID NO: 7080151 - DNA, 22 bp, Homo sapiens
gtctggaaagagctgaggttca

SEQ ID NO: 7080152 - DNA, 22 bp, Homo sapiens
gtctggaaagagctgaggttca

SEQ ID NO: 7080153 - DNA, 22 bp, Homo sapiens
gtctggaaaggggcttttatct

SEQ ID NO: 7080154 - DNA, 22 bp, Homo sapiens
gtctggaaaggggcttttatct

SEQ ID NO: 7080155 - DNA, 22 bp, Homo sapiens
gtctggaaaggtatttgtctca

SEQ ID NO: 7080156 - DNA, 22 bp, Homo sapiens
gtctggaaatattgacttcaga

SEQ ID NO: 7080157 - DNA, 22 bp, Homo sapiens
gtctggaaattaagaggaggtt

SEQ ID NO: 7080158 - DNA, 22 bp, Homo sapiens
gtctggaaattaagaggaggtt

SEQ ID NO: 7080159 - DNA, 22 bp, Homo sapiens
gtctggaaattcaatttaatgc

SEQ ID NO: 7080160 - DNA, 22 bp, Homo sapiens
gtctggaagaactagggatgtt

SEQ ID NO: 7080161 - DNA, 22 bp, Homo sapiens
gtctggaagaactagggatgtt

SEQ ID NO: 7080162 - DNA, 22 bp, Homo sapiens
gtctggaagaactagggatgtt

SEQ ID NO: 7080163 - DNA, 22 bp, Homo sapiens
gtctggaagagcaggaataaac

SEQ ID NO: 7080164 - DNA, 22 bp, Homo sapiens
gtctggaagctctaggggagaa

SEQ ID NO: 7080165 - DNA, 22 bp, Homo sapiens
gtctggaagctctaggggagaa

SEQ ID NO: 7080166 - DNA, 22 bp, Homo sapiens
gtctggaaggaggagatggagc

SEQ ID NO: 7080167 - DNA, 22 bp, Homo sapiens
gtctggaaggaggagatggagc

SEQ ID NO: 7080168 - DNA, 22 bp, Homo sapiens
gtctggaaggaggagatggagc

SEQ ID NO: 7080169 - DNA, 22 bp, Homo sapiens
gtctggaagggagtgcattttc

SEQ ID NO: 7080170 - DNA, 22 bp, Homo sapiens
gtctggaagggagtgcattttc

SEQ ID NO: 7080171 - DNA, 22 bp, Homo sapiens
gtctggaagtgtcttgttaagt

SEQ ID NO: 7080172 - DNA, 22 bp, Homo sapiens
gtctggaatatagcaagctctt

SEQ ID NO: 7080173 - DNA, 22 bp, Homo sapiens
gtctggaatatagcaagctctt

SEQ ID NO: 7080174 - DNA, 22 bp, Homo sapiens
gtctggacagcagcacctcggc

SEQ ID NO: 7080175 - DNA, 22 bp, Homo sapiens
cagccaggcctggtgaccaaag

SEQ ID NO: 7080176 - DNA, 22 bp, Homo sapiens
cagccaggcctggtgaccaaag

SEQ ID NO: 7080177 - DNA, 22 bp, Homo sapiens
cagccaggcccccgagtcgttg

SEQ ID NO: 7080178 - DNA, 22 bp, Homo sapiens
cagccaggcctggtgaccaaag

SEQ ID NO: 7080179 - DNA, 22 bp, Homo sapiens
cagccaggcctggtgaccaaag

SEQ ID NO: 7080180 - DNA, 22 bp, Homo sapiens
cagccagggagggcaaatgaga

SEQ ID NO: 7080181 - DNA, 22 bp, Homo sapiens
cagccagggagggcaaatgaga

SEQ ID NO: 7080182 - DNA, 22 bp, Homo sapiens
cagccagggagggcaaatgaga

SEQ ID NO: 7080183 - DNA, 22 bp, Homo sapiens
cagccagggagcaaagagttga

SEQ ID NO: 7080184 - DNA, 22 bp, Homo sapiens
cagccagggagcaaagagttga

SEQ ID NO: 7080185 - DNA, 22 bp, Homo sapiens
cagccagggagcaaagagttga

SEQ ID NO: 7080186 - DNA, 22 bp, Homo sapiens
cagccagggagcaaagagttga

SEQ ID NO: 7080187 - DNA, 22 bp, Homo sapiens
gtctggagacttgggtcatcaa

SEQ ID NO: 7080188 - DNA, 22 bp, Homo sapiens
gtctggagacttgggtcatcaa

SEQ ID NO: 7080189 - DNA, 22 bp, Homo sapiens
gtctggagagctgagcagagtt

SEQ ID NO: 7080190 - DNA, 22 bp, Homo sapiens
gtctggagagctgagcagagtt

SEQ ID NO: 7080191 - DNA, 22 bp, Homo sapiens
gtctggagagctgagcagagtt

SEQ ID NO: 7080192 - DNA, 22 bp, Homo sapiens
gtctggagagctgagcagagtt

SEQ ID NO: 7080193 - DNA, 22 bp, Homo sapiens
gtctggagccaccctaagcatt

SEQ ID NO: 7080194 - DNA, 22 bp, Homo sapiens
gtctggagccactgctgctgct

SEQ ID NO: 7080195 - DNA, 22 bp, Homo sapiens
gtctggagccactgctgctgct

SEQ ID NO: 7080196 - DNA, 22 bp, Homo sapiens
gtctggagccccagtcaatgag

SEQ ID NO: 7080197 - DNA, 22 bp, Homo sapiens
cagcccctcacagagctgtcct

SEQ ID NO: 7080198 - DNA, 22 bp, Homo sapiens
cagcccctccctcaggcaggtg

SEQ ID NO: 7080199 - DNA, 22 bp, Homo sapiens
cagcccctccctcaggcaggtg

SEQ ID NO: 7080200 - DNA, 22 bp, Homo sapiens
cagcccctccctcaggcaggtg

SEQ ID NO: 7080201 - DNA, 22 bp, Homo sapiens
cagcccctggcgcacgccgagc

SEQ ID NO: 7080202 - DNA, 22 bp, Homo sapiens
cagccccatggtgtgctccagc

SEQ ID NO: 7080203 - DNA, 22 bp, Homo sapiens
cagccccatggtgtgctccagc

SEQ ID NO: 7080204 - DNA, 22 bp, Homo sapiens
cagccccatggtgtgctccagc

SEQ ID NO: 7080205 - DNA, 22 bp, Homo sapiens
cagcccctcacagagctgtcct

SEQ ID NO: 7080206 - DNA, 22 bp, Homo sapiens
cagccccttcctggcatctgga

SEQ ID NO: 7080207 - DNA, 22 bp, Homo sapiens
cagcccctggcgcacgccgagc

SEQ ID NO: 7080208 - DNA, 22 bp, Homo sapiens
cagccccttcctggcatctgga

SEQ ID NO: 7080209 - DNA, 22 bp, Homo sapiens
cagccctcaaaccacttccagg

SEQ ID NO: 7080210 - DNA, 22 bp, Homo sapiens
cagccctcaaaccacttccagg

SEQ ID NO: 7080211 - DNA, 22 bp, Homo sapiens
cagccctcaaaccacttccagg

SEQ ID NO: 7080212 - DNA, 22 bp, Homo sapiens
cagccccttgtccggtagccac

SEQ ID NO: 7080213 - DNA, 22 bp, Homo sapiens
cagccccttgtccggtagccac

SEQ ID NO: 7080214 - DNA, 22 bp, Homo sapiens
cagccccttgtccggtagccac

SEQ ID NO: 7080215 - DNA, 22 bp, Homo sapiens
cagccaggtatgggcgtgcggg

SEQ ID NO: 7080216 - DNA, 22 bp, Homo sapiens
cagccaggttagtgctaattgt

SEQ ID NO: 7080217 - DNA, 22 bp, Homo sapiens
cagccaggttagtgctaattgt

SEQ ID NO: 7080218 - DNA, 22 bp, Homo sapiens
cagccaggtatgggcgtgcggg

SEQ ID NO: 7080219 - DNA, 22 bp, Homo sapiens
cagccaggttagtgctaattgt

SEQ ID NO: 7080220 - DNA, 22 bp, Homo sapiens
cagccaggttcaagtccttata

SEQ ID NO: 7080221 - DNA, 22 bp, Homo sapiens
cagccaggttcaagtccttata

SEQ ID NO: 7080222 - DNA, 22 bp, Homo sapiens
cagcccaggctcagatgttggg

SEQ ID NO: 7080223 - DNA, 22 bp, Homo sapiens
cagcccaggctcagatgttggg

SEQ ID NO: 7080224 - DNA, 22 bp, Homo sapiens
cagcccaggctcagatgttggg

SEQ ID NO: 7080225 - DNA, 16 bp, Homo sapiens
cagcccaggggcgggc

SEQ ID NO: 7080226 - DNA, 22 bp, Homo sapiens
cagccagggtcaggcagcttct

SEQ ID NO: 7080227 - DNA, 22 bp, Homo sapiens
cagccagggagggcaaatgaga

SEQ ID NO: 7080228 - DNA, 22 bp, Homo sapiens
cagccaggggctggcgtgttga

SEQ ID NO: 7080229 - DNA, 22 bp, Homo sapiens
cagccaggggctggcgtgttga

SEQ ID NO: 7080230 - DNA, 22 bp, Homo sapiens
cagccagggtcaggcagcttct

SEQ ID NO: 7080231 - DNA, 22 bp, Homo sapiens
cagccaggtatgggcgtgcggg

SEQ ID NO: 7080232 - DNA, 22 bp, Homo sapiens
cagccaggtatgggcgtgcggg

SEQ ID NO: 7080233 - DNA, 22 bp, Homo sapiens
cagccagggtcaggcagcttct

SEQ ID NO: 7080234 - DNA, 22 bp, Homo sapiens
cagccagggtcaggcagcttct

SEQ ID NO: 7080235 - DNA, 22 bp, Homo sapiens
cagccagggtcaggcagcttct

SEQ ID NO: 7080236 - DNA, 22 bp, Homo sapiens
cagccagggtcaggcagcttct

SEQ ID NO: 7080237 - DNA, 22 bp, Homo sapiens
gtctgtatcagaggagtgaatg

SEQ ID NO: 7080238 - DNA, 22 bp, Homo sapiens
cagccctcaggtcctcagcagc

SEQ ID NO: 7080239 - DNA, 22 bp, Homo sapiens
cagccctcaggtcctcagcagc

SEQ ID NO: 7080240 - DNA, 22 bp, Homo sapiens
cagccctcaggtcctcagcagc

SEQ ID NO: 7080241 - DNA, 22 bp, Homo sapiens
cagccctcaggtcctcagcagc

SEQ ID NO: 7080242 - DNA, 22 bp, Homo sapiens
cagccctcaggtcctcagcagc

SEQ ID NO: 7080243 - DNA, 22 bp, Homo sapiens
cagccctcatcccgcctgcgtt

SEQ ID NO: 7080244 - DNA, 22 bp, Homo sapiens
cagccctcatcccgcctgcgtt

SEQ ID NO: 7080245 - DNA, 22 bp, Homo sapiens
cagccctcatcccgcctgcgtt

SEQ ID NO: 7080246 - DNA, 22 bp, Homo sapiens
gtctgtggcaggggagaagttt

SEQ ID NO: 7080247 - DNA, 22 bp, Homo sapiens
gtctgtggcaggggagaagttt

SEQ ID NO: 7080248 - DNA, 22 bp, Homo sapiens
gtctgtgcagttactagctggt

SEQ ID NO: 7080249 - DNA, 22 bp, Homo sapiens
gtctgtgcagttactagctggt

SEQ ID NO: 7080250 - DNA, 22 bp, Homo sapiens
gtctgtggtagacaggaaggca

SEQ ID NO: 7080251 - DNA, 22 bp, Homo sapiens
gtctgtggtagacaggaaggca

SEQ ID NO: 7080252 - DNA, 22 bp, Homo sapiens
gtctgtggtagacaggaaggca

SEQ ID NO: 7080253 - DNA, 22 bp, Homo sapiens
gtctgtggtccctgctggggac

SEQ ID NO: 7080254 - DNA, 22 bp, Homo sapiens
gtctgtggtccctgctggggac

SEQ ID NO: 7080255 - DNA, 19 bp, Homo sapiens
gtctgtgtatttgttgctg

SEQ ID NO: 7080256 - DNA, 19 bp, Homo sapiens
gtctgtgtatttgttgctg

SEQ ID NO: 7080257 - DNA, 22 bp, Homo sapiens
gtctgtggtccctgctggggac

SEQ ID NO: 7080258 - DNA, 22 bp, Homo sapiens
gtctgtgtgcacagagctttgg

SEQ ID NO: 7080259 - DNA, 22 bp, Homo sapiens
gtctgtgtgcacagcgagtgcc

SEQ ID NO: 7080260 - DNA, 22 bp, Homo sapiens
gtctgtgtgcacagcgagtgcc

SEQ ID NO: 7080261 - DNA, 22 bp, Homo sapiens
gtctgtgtgcacagcgagtgcc

SEQ ID NO: 7080262 - DNA, 22 bp, Homo sapiens
gtctgtgtgcacagcgagtgcc

SEQ ID NO: 7080263 - DNA, 18 bp, Homo sapiens
gtctgtgtggcttgggga

SEQ ID NO: 7080264 - DNA, 18 bp, Homo sapiens
gtctgtgtggcttgggga

SEQ ID NO: 7080265 - DNA, 22 bp, Homo sapiens
gtctgttacctccaagaccatt

SEQ ID NO: 7080266 - DNA, 22 bp, Homo sapiens
gtcagcattgcagatatatggc

SEQ ID NO: 7080267 - DNA, 22 bp, Homo sapiens
gtcagcctgcactcagggagcg

SEQ ID NO: 7080268 - DNA, 22 bp, Homo sapiens
gtcagcattagcaatgactggt

SEQ ID NO: 7080269 - DNA, 22 bp, Homo sapiens
gtcagcatccagctgtgaaagg

SEQ ID NO: 7080270 - DNA, 22 bp, Homo sapiens
gtcagcatgagcaagggctgac

SEQ ID NO: 7080271 - DNA, 22 bp, Homo sapiens
cagcaggaagtactagctttga

SEQ ID NO: 7080272 - DNA, 20 bp, Homo sapiens
cagcaggaaaagtgcctcag

SEQ ID NO: 7080273 - DNA, 20 bp, Homo sapiens
cagcaggaaaagtgcctcag

SEQ ID NO: 7080274 - DNA, 22 bp, Homo sapiens
cagcaggaaacttaaaggtaat

SEQ ID NO: 7080275 - DNA, 22 bp, Homo sapiens
cagcaggaaagacatctgagca

SEQ ID NO: 7080276 - DNA, 22 bp, Homo sapiens
cagcaggaaacttaaaggtaat

SEQ ID NO: 7080277 - DNA, 22 bp, Homo sapiens
cagcaggaaagacatctgagca

SEQ ID NO: 7080278 - DNA, 22 bp, Homo sapiens
cagcaggaaggtttcccctgca

SEQ ID NO: 7080279 - DNA, 22 bp, Homo sapiens
cagcagcttctgttgatcagaa

SEQ ID NO: 7080280 - DNA, 22 bp, Homo sapiens
cagcagcttctgttgatcagaa

SEQ ID NO: 7080281 - DNA, 22 bp, Homo sapiens
cagcagcttctgttgatcagaa

SEQ ID NO: 7080282 - DNA, 22 bp, Homo sapiens
cagcagcttctgttgatcagaa

SEQ ID NO: 7080283 - DNA, 22 bp, Homo sapiens
cagcagcttttgcattctcatt

SEQ ID NO: 7080284 - DNA, 20 bp, Homo sapiens
cagcaggaaaagtgcctcag

SEQ ID NO: 7080285 - DNA, 20 bp, Homo sapiens
cagcaggaaaagtgcctcag

SEQ ID NO: 7080286 - DNA, 22 bp, Homo sapiens
cagcagctggtgagacacagcc

SEQ ID NO: 7080287 - DNA, 22 bp, Homo sapiens
cagcagctggtgagacacagcc

SEQ ID NO: 7080288 - DNA, 22 bp, Homo sapiens
cagcagctggttatacctgtgg

SEQ ID NO: 7080289 - DNA, 22 bp, Homo sapiens
cagcagctggttatacctgtgg

SEQ ID NO: 7080290 - DNA, 22 bp, Homo sapiens
cagcagctggttgaatccttct

SEQ ID NO: 7080291 - DNA, 22 bp, Homo sapiens
cagcagctgcgtgcccaggccg

SEQ ID NO: 7080292 - DNA, 22 bp, Homo sapiens
cagcagctgcgtgcccaggccg

SEQ ID NO: 7080293 - DNA, 22 bp, Homo sapiens
cagcagctgcgtgcccaggccg

SEQ ID NO: 7080294 - DNA, 22 bp, Homo sapiens
cagcagctggtgagacacagcc

SEQ ID NO: 7080295 - DNA, 22 bp, Homo sapiens
cagcagctggtgagacacagcc

SEQ ID NO: 7080296 - DNA, 22 bp, Homo sapiens
cagcagctgcaaatggaaacag

SEQ ID NO: 7080297 - DNA, 22 bp, Homo sapiens
cagcagctgcaaatggaaacag

SEQ ID NO: 7080298 - DNA, 22 bp, Homo sapiens
cagcagctgcctcagctgggga

SEQ ID NO: 7080299 - DNA, 22 bp, Homo sapiens
cagcacctacccatcctgagtc

SEQ ID NO: 7080300 - DNA, 22 bp, Homo sapiens
cagcaccctttccactgccttg

SEQ ID NO: 7080301 - DNA, 22 bp, Homo sapiens
cagcacctacccatcctgagtc

SEQ ID NO: 7080302 - DNA, 22 bp, Homo sapiens
cagcacctaggacagtagtcag

SEQ ID NO: 7080303 - DNA, 22 bp, Homo sapiens
cagcacctccgcagttcacctg

SEQ ID NO: 7080304 - DNA, 22 bp, Homo sapiens
cagcacctccgcagttcacctg

SEQ ID NO: 7080305 - DNA, 22 bp, Homo sapiens
cagcacctctgggtcttgtctt

SEQ ID NO: 7080306 - DNA, 22 bp, Homo sapiens
cagcacctctgggtcttgtctt

SEQ ID NO: 7080307 - DNA, 22 bp, Homo sapiens
cagcacctgctcttagacacgg

SEQ ID NO: 7080308 - DNA, 22 bp, Homo sapiens
cagcacctgctcttagacacgg

SEQ ID NO: 7080309 - DNA, 22 bp, Homo sapiens
cagcacccctcctggctatgaa

SEQ ID NO: 7080310 - DNA, 22 bp, Homo sapiens
cagcacctggcacaggagggcc

SEQ ID NO: 7080311 - DNA, 22 bp, Homo sapiens
cagcacctggcacaggagggcc

SEQ ID NO: 7080312 - DNA, 22 bp, Homo sapiens
cagcacctgttagcattaaata

SEQ ID NO: 7080313 - DNA, 22 bp, Homo sapiens
cagcacctgttagcattaaata

SEQ ID NO: 7080314 - DNA, 22 bp, Homo sapiens
cagcacctgttagcattaaata

SEQ ID NO: 7080315 - DNA, 22 bp, Homo sapiens
cagcaccttcctatccaggaga

SEQ ID NO: 7080316 - DNA, 22 bp, Homo sapiens
cagcaccttccttaactccagg

SEQ ID NO: 7080317 - DNA, 22 bp, Homo sapiens
cagcactaatcctgcaatttct

SEQ ID NO: 7080318 - DNA, 22 bp, Homo sapiens
cagcactaggatatacatttcc

SEQ ID NO: 7080319 - DNA, 22 bp, Homo sapiens
cagcactaggatatacatttcc

SEQ ID NO: 7080320 - DNA, 22 bp, Homo sapiens
cagcagctacttggagcagcag

SEQ ID NO: 7080321 - DNA, 22 bp, Homo sapiens
gtcccagatgtctggaactccc

SEQ ID NO: 7080322 - DNA, 22 bp, Homo sapiens
gtcccagaggctttggccacag

SEQ ID NO: 7080323 - DNA, 22 bp, Homo sapiens
gtcccagaggacagggtcacat

SEQ ID NO: 7080324 - DNA, 22 bp, Homo sapiens
gtcccagaggctttggccacag

SEQ ID NO: 7080325 - DNA, 22 bp, Homo sapiens
gtcccagagagcactagtccat

SEQ ID NO: 7080326 - DNA, 22 bp, Homo sapiens
gtcccaggaacattctggctag

SEQ ID NO: 7080327 - DNA, 22 bp, Homo sapiens
gtcccaggaacattctggctag

SEQ ID NO: 7080328 - DNA, 22 bp, Homo sapiens
gtcccaggaacattctggctag

SEQ ID NO: 7080329 - DNA, 22 bp, Homo sapiens
gtcccaggaacattctggctag

SEQ ID NO: 7080330 - DNA, 22 bp, Homo sapiens
gtcccaggagttgctgggcctt

SEQ ID NO: 7080331 - DNA, 22 bp, Homo sapiens
gtcccaggcagagtcaggaggg

SEQ ID NO: 7080332 - DNA, 22 bp, Homo sapiens
gtcccaggcaggccactggcag

SEQ ID NO: 7080333 - DNA, 22 bp, Homo sapiens
gtcccaggcaggccactggcag

SEQ ID NO: 7080334 - DNA, 22 bp, Homo sapiens
gtcccaggcaggccactggcag

SEQ ID NO: 7080335 - DNA, 22 bp, Homo sapiens
gtcccaggctccatggcagcca

SEQ ID NO: 7080336 - DNA, 22 bp, Homo sapiens
gtcccaggctccatggcagcca

SEQ ID NO: 7080337 - DNA, 22 bp, Homo sapiens
gtcccaggctccatggcagcca

SEQ ID NO: 7080338 - DNA, 22 bp, Homo sapiens
cagcagggaagctgtgctgttt

SEQ ID NO: 7080339 - DNA, 22 bp, Homo sapiens
cagcaggctgcgattgctcatt

SEQ ID NO: 7080340 - DNA, 22 bp, Homo sapiens
cagcaggctgcgattgctcatt

SEQ ID NO: 7080341 - DNA, 22 bp, Homo sapiens
cagcaggctgtggaaatcctgg

SEQ ID NO: 7080342 - DNA, 22 bp, Homo sapiens
cagcagggaagctgtgctgttt

SEQ ID NO: 7080343 - DNA, 22 bp, Homo sapiens
cagcagggaagctgtgctgttt

SEQ ID NO: 7080344 - DNA, 22 bp, Homo sapiens
gtccagccagctggtccttgcc

SEQ ID NO: 7080345 - DNA, 22 bp, Homo sapiens
cagcaggctgcgattgctcatt

SEQ ID NO: 7080346 - DNA, 22 bp, Homo sapiens
cagcaggctctgagtggctgcc

SEQ ID NO: 7080347 - DNA, 22 bp, Homo sapiens
cagcaggctctgagtggctgcc

SEQ ID NO: 7080348 - DNA, 22 bp, Homo sapiens
cagcaggctctgagtggctgcc

SEQ ID NO: 7080349 - DNA, 22 bp, Homo sapiens
cagcaggctctgagtggctgcc

SEQ ID NO: 7080350 - DNA, 22 bp, Homo sapiens
cagcaggctctgagtggctgcc

SEQ ID NO: 7080351 - DNA, 22 bp, Homo sapiens
cagcaggctctgagtggctgcc

SEQ ID NO: 7080352 - DNA, 22 bp, Homo sapiens
cagcaggctctgagtggctgcc

SEQ ID NO: 7080353 - DNA, 22 bp, Homo sapiens
cagcaggctctgagtggctgcc

SEQ ID NO: 7080354 - DNA, 20 bp, Homo sapiens
cagcaggctatggggcaccc

SEQ ID NO: 7080355 - DNA, 22 bp, Homo sapiens
cagcaggctctgagtggctgcc

SEQ ID NO: 7080356 - DNA, 22 bp, Homo sapiens
cagcaggctctgagtggctgcc

SEQ ID NO: 7080357 - DNA, 22 bp, Homo sapiens
gtcatcttaaggactgctatag

SEQ ID NO: 7080358 - DNA, 22 bp, Homo sapiens
gtcatctcttatcactgacttc

SEQ ID NO: 7080359 - DNA, 22 bp, Homo sapiens
gtcatctctttacttttgctga

SEQ ID NO: 7080360 - DNA, 22 bp, Homo sapiens
gtcatattggctccacttcctc

SEQ ID NO: 7080361 - DNA, 22 bp, Homo sapiens
gtcatcatttttagcatatggg

SEQ ID NO: 7080362 - DNA, 22 bp, Homo sapiens
gtcatccaacaagaggctcttg

SEQ ID NO: 7080363 - DNA, 22 bp, Homo sapiens
gtcatctcaagtaagtgaacaa

SEQ ID NO: 7080364 - DNA, 22 bp, Homo sapiens
gtcatctcacagcagggctagt

SEQ ID NO: 7080365 - DNA, 22 bp, Homo sapiens
gtcatatacactgcatgtaatc

SEQ ID NO: 7080366 - DNA, 22 bp, Homo sapiens
gtcataaagcttgttgcattta

SEQ ID NO: 7080367 - DNA, 22 bp, Homo sapiens
gtcataatataaaaactgactt

SEQ ID NO: 7080368 - DNA, 22 bp, Homo sapiens
gtcataaagcttgttgcattta

SEQ ID NO: 7080369 - DNA, 22 bp, Homo sapiens
gtcatacagctagtgaagtcag

SEQ ID NO: 7080370 - DNA, 22 bp, Homo sapiens
gtcatagaggcctatataattt

SEQ ID NO: 7080371 - DNA, 22 bp, Homo sapiens
gtcataggttcaaaaggcagat

SEQ ID NO: 7080372 - DNA, 20 bp, Homo sapiens
cagcaggctatggggcaccc

SEQ ID NO: 7080373 - DNA, 20 bp, Homo sapiens
cagcaggctatggggcaccc

SEQ ID NO: 7080374 - DNA, 22 bp, Homo sapiens
cagcaggcgttgggagaaagac

SEQ ID NO: 7080375 - DNA, 20 bp, Homo sapiens
cagcaggctatggggcaccc

SEQ ID NO: 7080376 - DNA, 20 bp, Homo sapiens
cagcaggctatggggcaccc

SEQ ID NO: 7080377 - DNA, 20 bp, Homo sapiens
cagcaggctatggggcaccc

SEQ ID NO: 7080378 - DNA, 22 bp, Homo sapiens
cagcaggcggcccgcgggcccg

SEQ ID NO: 7080379 - DNA, 22 bp, Homo sapiens
cagcaggcgttgggagaaagac

SEQ ID NO: 7080380 - DNA, 22 bp, Homo sapiens
cagcaggcgttgggagaaagac

SEQ ID NO: 7080381 - DNA, 22 bp, Homo sapiens
cagcaggcggcccgcgggcccg

SEQ ID NO: 7080382 - DNA, 22 bp, Homo sapiens
gtcattataccattataattgt

SEQ ID NO: 7080383 - DNA, 22 bp, Homo sapiens
gtcatgtgaataagtgtggggt

SEQ ID NO: 7080384 - DNA, 22 bp, Homo sapiens
gtcatggtgctagcgggaatgt

SEQ ID NO: 7080385 - DNA, 22 bp, Homo sapiens
gtcatggtgctagcgggaatgt

SEQ ID NO: 7080386 - DNA, 22 bp, Homo sapiens
gtcatgaaattctagagcttga

SEQ ID NO: 7080387 - DNA, 22 bp, Homo sapiens
gtcatgaaattctagagcttga

SEQ ID NO: 7080388 - DNA, 22 bp, Homo sapiens
gtcatgagttctcggggcagac

SEQ ID NO: 7080389 - DNA, 22 bp, Homo sapiens
gtcatgcagacagggttgtttt

SEQ ID NO: 7080390 - DNA, 22 bp, Homo sapiens
gtcatgcagacagggttgtttt

SEQ ID NO: 7080391 - DNA, 22 bp, Homo sapiens
gtcatgcatgggctctgaagaa

SEQ ID NO: 7080392 - DNA, 22 bp, Homo sapiens
gtcatgcatgggctctgaagaa

SEQ ID NO: 7080393 - DNA, 22 bp, Homo sapiens
gtgctgtgtgatccatgctggc

SEQ ID NO: 7080394 - DNA, 22 bp, Homo sapiens
gtgctgtgtctatcaggaataa

SEQ ID NO: 7080395 - DNA, 22 bp, Homo sapiens
gtgctgtgtgatccatgctggc

SEQ ID NO: 7080396 - DNA, 22 bp, Homo sapiens
gtgctgtgtgatccatgctggc

SEQ ID NO: 7080397 - DNA, 18 bp, Homo sapiens
gtgctgtgggcagtggcc

SEQ ID NO: 7080398 - DNA, 22 bp, Homo sapiens
gtgctgtgtctatcaggaataa

SEQ ID NO: 7080399 - DNA, 18 bp, Homo sapiens
gtgctgtgggcagtggcc

SEQ ID NO: 7080400 - DNA, 22 bp, Homo sapiens
gtgctgtgcgctttttctgtat

SEQ ID NO: 7080401 - DNA, 22 bp, Homo sapiens
gtgccctcctgaagccatcaca

SEQ ID NO: 7080402 - DNA, 22 bp, Homo sapiens
gtgctgagtagaatgaatgcct

SEQ ID NO: 7080403 - DNA, 22 bp, Homo sapiens
gtgctgagtagaatgaatgcct

SEQ ID NO: 7080404 - DNA, 22 bp, Homo sapiens
gtgctgtgcgctttttctgtat

SEQ ID NO: 7080405 - DNA, 22 bp, Homo sapiens
gtgctgtgcgctttttctgtat

SEQ ID NO: 7080406 - DNA, 22 bp, Homo sapiens
gtgctgtgcgctttttctgtat

SEQ ID NO: 7080407 - DNA, 22 bp, Homo sapiens
gtgctgtgcgctttttctgtat

SEQ ID NO: 7080408 - DNA, 22 bp, Homo sapiens
gtgccctcctgaagccatcaca

SEQ ID NO: 7080409 - DNA, 22 bp, Homo sapiens
gtgcccagttgaggccaggact

SEQ ID NO: 7080410 - DNA, 22 bp, Homo sapiens
gtgcccagttgaggccaggact

SEQ ID NO: 7080411 - DNA, 22 bp, Homo sapiens
gtgcccagttgaggccaggact

SEQ ID NO: 7080412 - DNA, 22 bp, Homo sapiens
gtgcccagttgaggccaggact

SEQ ID NO: 7080413 - DNA, 20 bp, Homo sapiens
gtgcccagttggtgacagac

SEQ ID NO: 7080414 - DNA, 20 bp, Homo sapiens
gtgcccagttggtgacagac

SEQ ID NO: 7080415 - DNA, 20 bp, Homo sapiens
gtgcccagttggtgacagac

SEQ ID NO: 7080416 - DNA, 20 bp, Homo sapiens
gtgcccagttggtgacagac

SEQ ID NO: 7080417 - DNA, 20 bp, Homo sapiens
gtgcccagttggtgacagac

SEQ ID NO: 7080418 - DNA, 22 bp, Homo sapiens
cagcctgccgtcagccaggtag

SEQ ID NO: 7080419 - DNA, 22 bp, Homo sapiens
cagcctgccgtcagccaggtag

SEQ ID NO: 7080420 - DNA, 22 bp, Homo sapiens
cagcctgcctcagtttccctct

SEQ ID NO: 7080421 - DNA, 22 bp, Homo sapiens
cagcctgctagggcaatgcctt

SEQ ID NO: 7080422 - DNA, 22 bp, Homo sapiens
cagcctgccctggaagcccagc

SEQ ID NO: 7080423 - DNA, 22 bp, Homo sapiens
cagcctgccgtcagccaggtag

SEQ ID NO: 7080424 - DNA, 22 bp, Homo sapiens
cagcctgcatttgtatctgtat

SEQ ID NO: 7080425 - DNA, 22 bp, Homo sapiens
cagcctgcatttgtatctgtat

SEQ ID NO: 7080426 - DNA, 22 bp, Homo sapiens
cagcctgccctggaagcccagc

SEQ ID NO: 7080427 - DNA, 22 bp, Homo sapiens
cagcctgcagggctgcctgttg

SEQ ID NO: 7080428 - DNA, 22 bp, Homo sapiens
cagcctgcagggctgcctgttg

SEQ ID NO: 7080429 - DNA, 16 bp, Homo sapiens
cagcctgcagtggtca

SEQ ID NO: 7080430 - DNA, 20 bp, Homo sapiens
cagcctgcatcatctgcagc

SEQ ID NO: 7080431 - DNA, 20 bp, Homo sapiens
cagcctgcatcatctgcagc

SEQ ID NO: 7080432 - DNA, 22 bp, Homo sapiens
cagcctgcaggaggccgtcagc

SEQ ID NO: 7080433 - DNA, 22 bp, Homo sapiens
cagcctgcaggaggccgtcagc

SEQ ID NO: 7080434 - DNA, 22 bp, Homo sapiens
cagcctgcagggctgcctgttg

SEQ ID NO: 7080435 - DNA, 22 bp, Homo sapiens
cagcctgcagggctgcctgttg

SEQ ID NO: 7080436 - DNA, 22 bp, Homo sapiens
cagcctctttccacatcaggca

SEQ ID NO: 7080437 - DNA, 20 bp, Homo sapiens
cagcctccactcactcagct

SEQ ID NO: 7080438 - DNA, 20 bp, Homo sapiens
cagcctccactcactcagct

SEQ ID NO: 7080439 - DNA, 20 bp, Homo sapiens
cagcctccactcactcagct

SEQ ID NO: 7080440 - DNA, 23 bp, Homo sapiens
cagccctggagatgtgggaggca

SEQ ID NO: 7080441 - DNA, 23 bp, Homo sapiens
cagccctggagatgtgggaggca

SEQ ID NO: 7080442 - DNA, 22 bp, Homo sapiens
cagccctggcagctttcagggt

SEQ ID NO: 7080443 - DNA, 22 bp, Homo sapiens
cagccctggcccaggtgcctta

SEQ ID NO: 7080444 - DNA, 22 bp, Homo sapiens
cagccctggcagctttcagggt

SEQ ID NO: 7080445 - DNA, 23 bp, Homo sapiens
cagccctggagatgtgggaggca

SEQ ID NO: 7080446 - DNA, 22 bp, Homo sapiens
cagccctggaacagctgactca

SEQ ID NO: 7080447 - DNA, 23 bp, Homo sapiens
cagccctggagatgtgggaggca

SEQ ID NO: 7080448 - DNA, 23 bp, Homo sapiens
cagccctggagatgtgggaggca

SEQ ID NO: 7080449 - DNA, 23 bp, Homo sapiens
cagccctggagatgtgggaggca

SEQ ID NO: 7080450 - DNA, 23 bp, Homo sapiens
cagccctggagatgtgggaggca

SEQ ID NO: 7080451 - DNA, 22 bp, Homo sapiens
cagccctgcttccccgctagtt

SEQ ID NO: 7080452 - DNA, 22 bp, Homo sapiens
cagccctgcttccccgctagtt

SEQ ID NO: 7080453 - DNA, 22 bp, Homo sapiens
cagccctggaacagctgactca

SEQ ID NO: 7080454 - DNA, 22 bp, Homo sapiens
cagccctggaacagctgactca

SEQ ID NO: 7080455 - DNA, 22 bp, Homo sapiens
cagccctgcttccccgctagtt

SEQ ID NO: 7080456 - DNA, 22 bp, Homo sapiens
cagccctgcttccccgctagtt

SEQ ID NO: 7080457 - DNA, 22 bp, Homo sapiens
cagccctgctggcaatgatgag

SEQ ID NO: 7080458 - DNA, 22 bp, Homo sapiens
cagccctgctggttttgggcaa

SEQ ID NO: 7080459 - DNA, 22 bp, Homo sapiens
cagccctgctggttttgggcaa

SEQ ID NO: 7080460 - DNA, 22 bp, Homo sapiens
cagccctgcttccccgctagtt

SEQ ID NO: 7080461 - DNA, 22 bp, Homo sapiens
cagccctgcttccccgctagtt

SEQ ID NO: 7080462 - DNA, 22 bp, Homo sapiens
cagccctgcttccccgctagtt

SEQ ID NO: 7080463 - DNA, 22 bp, Homo sapiens
cagccctgctcttagtgtctcc

SEQ ID NO: 7080464 - DNA, 22 bp, Homo sapiens
cagccctgctgacactgtctga

SEQ ID NO: 7080465 - DNA, 22 bp, Homo sapiens
cagccctgctgacactgtctga

SEQ ID NO: 7080466 - DNA, 22 bp, Homo sapiens
cagccctgctgccttagtgcct

SEQ ID NO: 7080467 - DNA, 22 bp, Homo sapiens
cagccctgctggcaatgatgag

SEQ ID NO: 7080468 - DNA, 22 bp, Homo sapiens
cagccctgctgacactgtctga

SEQ ID NO: 7080469 - DNA, 22 bp, Homo sapiens
cagccctgctcttagtgtctcc

SEQ ID NO: 7080470 - DNA, 22 bp, Homo sapiens
cagccctgccatggagcctcct

SEQ ID NO: 7080471 - DNA, 22 bp, Homo sapiens
cagccctgccatggagcctcct

SEQ ID NO: 7080472 - DNA, 22 bp, Homo sapiens
cagccctgccatggagcctcct

SEQ ID NO: 7080473 - DNA, 22 bp, Homo sapiens
cagccctgccatggagcctcct

SEQ ID NO: 7080474 - DNA, 22 bp, Homo sapiens
cagccctgccatggagcctcct

SEQ ID NO: 7080475 - DNA, 22 bp, Homo sapiens
cagccctgcagctggatctcac

SEQ ID NO: 7080476 - DNA, 22 bp, Homo sapiens
cagccctgccatggagcctcct

SEQ ID NO: 7080477 - DNA, 17 bp, Homo sapiens
cagccctgccgttccca

SEQ ID NO: 7080478 - DNA, 17 bp, Homo sapiens
cagccctgccgttccca

SEQ ID NO: 7080479 - DNA, 17 bp, Homo sapiens
cagccctgccgttccca

SEQ ID NO: 7080480 - DNA, 22 bp, Homo sapiens
cagccctgcggaggtgtatact

SEQ ID NO: 7080481 - DNA, 22 bp, Homo sapiens
cagccctgcggaggtgtatact

SEQ ID NO: 7080482 - DNA, 22 bp, Homo sapiens
cagccctgaaacaacctcctct

SEQ ID NO: 7080483 - DNA, 23 bp, Homo sapiens
cagccctgaaatcgaggtgacac

SEQ ID NO: 7080484 - DNA, 23 bp, Homo sapiens
cagccctgaaatcgaggtgacac

SEQ ID NO: 7080485 - DNA, 22 bp, Homo sapiens
cagccctgcagccatggcctgt

SEQ ID NO: 7080486 - DNA, 22 bp, Homo sapiens
cagccctgcagccatggcctgt

SEQ ID NO: 7080487 - DNA, 22 bp, Homo sapiens
cagccctgcagccatggcctgt

SEQ ID NO: 7080488 - DNA, 22 bp, Homo sapiens
cagccctgcagccatggcctgt

SEQ ID NO: 7080489 - DNA, 22 bp, Homo sapiens
cagccctgcagccatggcctgt

SEQ ID NO: 7080490 - DNA, 22 bp, Homo sapiens
cagccctgcagctggatctcac

SEQ ID NO: 7080491 - DNA, 22 bp, Homo sapiens
cagcctgtggcagaggtctaat

SEQ ID NO: 7080492 - DNA, 22 bp, Homo sapiens
cagccttagcaggatcatctga

SEQ ID NO: 7080493 - DNA, 22 bp, Homo sapiens
cagccttcaaggcttagctcag

SEQ ID NO: 7080494 - DNA, 22 bp, Homo sapiens
cagcctgtctgggcagagtgga

SEQ ID NO: 7080495 - DNA, 22 bp, Homo sapiens
cagcctgtagtctggtccaggt

SEQ ID NO: 7080496 - DNA, 22 bp, Homo sapiens
cagcctggtccccggctcaccc

SEQ ID NO: 7080497 - DNA, 22 bp, Homo sapiens
cagcctggcctgggactgctga

SEQ ID NO: 7080498 - DNA, 22 bp, Homo sapiens
cagcctggcctgggactgctga

SEQ ID NO: 7080499 - DNA, 22 bp, Homo sapiens
cagcctggcctgggactgctga

SEQ ID NO: 7080500 - DNA, 22 bp, Homo sapiens
cagcctggcctgggactgctga

SEQ ID NO: 7080501 - DNA, 22 bp, Homo sapiens
cagcctgggctccagagtccct

SEQ ID NO: 7080502 - DNA, 22 bp, Homo sapiens
cagcctgggctccagagtccct

SEQ ID NO: 7080503 - DNA, 22 bp, Homo sapiens
cagcctgggctccagagtccct

SEQ ID NO: 7080504 - DNA, 22 bp, Homo sapiens
cagcctgggctccagagtccct

SEQ ID NO: 7080505 - DNA, 22 bp, Homo sapiens
cagcctgggctccagagtccct

SEQ ID NO: 7080506 - DNA, 22 bp, Homo sapiens
cagcctgggctccagagtccct

SEQ ID NO: 7080507 - DNA, 22 bp, Homo sapiens
cagcctggtccccggctcaccc

SEQ ID NO: 7080508 - DNA, 22 bp, Homo sapiens
cagcctggtccccggctcaccc

SEQ ID NO: 7080509 - DNA, 21 bp, Homo sapiens
cagcctgctgctccagggcca

SEQ ID NO: 7080510 - DNA, 21 bp, Homo sapiens
cagcctgctgctccagggcca

SEQ ID NO: 7080511 - DNA, 22 bp, Homo sapiens
cagcctggacagcgaccagagt

SEQ ID NO: 7080512 - DNA, 22 bp, Homo sapiens
cagcctggacagcgaccagagt

SEQ ID NO: 7080513 - DNA, 22 bp, Homo sapiens
cagcctggacagcgaccagagt

SEQ ID NO: 7080514 - DNA, 22 bp, Homo sapiens
cagcctggacagcgaccagagt

SEQ ID NO: 7080515 - DNA, 22 bp, Homo sapiens
cagcctggacagcgaccagagt

SEQ ID NO: 7080516 - DNA, 22 bp, Homo sapiens
cagcctggacagcgaccagagt

SEQ ID NO: 7080517 - DNA, 22 bp, Homo sapiens
cagcctggacagcgaccagagt

SEQ ID NO: 7080518 - DNA, 22 bp, Homo sapiens
cagcctgctagggcaatgcctt

SEQ ID NO: 7080519 - DNA, 22 bp, Homo sapiens
cagcctgctagggcaatgcctt

SEQ ID NO: 7080520 - DNA, 22 bp, Homo sapiens
cagcctgctctcagatgttgag

SEQ ID NO: 7080521 - DNA, 21 bp, Homo sapiens
cagcctgctgctccagggcca

SEQ ID NO: 7080522 - DNA, 21 bp, Homo sapiens
cagcctgctgctccagggcca

SEQ ID NO: 7080523 - DNA, 21 bp, Homo sapiens
cagcctgctgctccagggcca

SEQ ID NO: 7080524 - DNA, 21 bp, Homo sapiens
cagcctgctgctccagggcca

SEQ ID NO: 7080525 - DNA, 21 bp, Homo sapiens
cagcctgctgctccagggcca

SEQ ID NO: 7080526 - DNA, 22 bp, Homo sapiens
cagcctggagccacagcccagg

SEQ ID NO: 7080527 - DNA, 22 bp, Homo sapiens
cagcctggagccacagcccagg

SEQ ID NO: 7080528 - DNA, 22 bp, Homo sapiens
cagcctggagccacagcccagg

SEQ ID NO: 7080529 - DNA, 22 bp, Homo sapiens
cagcctggagccacagcccagg

SEQ ID NO: 7080530 - DNA, 22 bp, Homo sapiens
cagcctggagccacagcccagg

SEQ ID NO: 7080531 - DNA, 22 bp, Homo sapiens
cagcctggattgcagaatgcta

SEQ ID NO: 7080532 - DNA, 22 bp, Homo sapiens
cagcctggattgcagaatgcta

SEQ ID NO: 7080533 - DNA, 22 bp, Homo sapiens
cagcctggattgcagaatgcta

SEQ ID NO: 7080534 - DNA, 22 bp, Homo sapiens
cagcctggattgcagaatgcta

SEQ ID NO: 7080535 - DNA, 22 bp, Homo sapiens
cagcctggattgcagaatgcta

SEQ ID NO: 7080536 - DNA, 22 bp, Homo sapiens
cagcctggattgcagaatgcta

SEQ ID NO: 7080537 - DNA, 22 bp, Homo sapiens
cagctacagttccactgagcat

SEQ ID NO: 7080538 - DNA, 22 bp, Homo sapiens
cagctacagttccactgagcat

SEQ ID NO: 7080539 - DNA, 22 bp, Homo sapiens
cagctacagttccactgagcat

SEQ ID NO: 7080540 - DNA, 22 bp, Homo sapiens
cagctagaaagtctgttaggga

SEQ ID NO: 7080541 - DNA, 22 bp, Homo sapiens
cagctagaaagtctgttaggga

SEQ ID NO: 7080542 - DNA, 22 bp, Homo sapiens
cagctagaaatgggattggtat

SEQ ID NO: 7080543 - DNA, 22 bp, Homo sapiens
cagctagaaatgggattggtat

SEQ ID NO: 7080544 - DNA, 22 bp, Homo sapiens
cagctagcggtgctggcggctc

SEQ ID NO: 7080545 - DNA, 22 bp, Homo sapiens
cagctagctaagaaggccagag

SEQ ID NO: 7080546 - DNA, 22 bp, Homo sapiens
cagctaggaaaccagagggcag

SEQ ID NO: 7080547 - DNA, 22 bp, Homo sapiens
cagctacaaatacttttgtatg

SEQ ID NO: 7080548 - DNA, 22 bp, Homo sapiens
cagctacacaccagaactatta

SEQ ID NO: 7080549 - DNA, 22 bp, Homo sapiens
cagctacacaccagaactatta

SEQ ID NO: 7080550 - DNA, 22 bp, Homo sapiens
cagctacacgtgcccctggggt

SEQ ID NO: 7080551 - DNA, 22 bp, Homo sapiens
cagctacacttctgggtgtgtc

SEQ ID NO: 7080552 - DNA, 22 bp, Homo sapiens
cagctacagaggccacatggct

SEQ ID NO: 7080553 - DNA, 22 bp, Homo sapiens
cagctacagaggccacatggct

SEQ ID NO: 7080554 - DNA, 22 bp, Homo sapiens
cagctacagaggccacatggct

SEQ ID NO: 7080555 - DNA, 22 bp, Homo sapiens
cagctacaggacctgatgcacc

SEQ ID NO: 7080556 - DNA, 22 bp, Homo sapiens
cagctacaggacctgatgcacc

SEQ ID NO: 7080557 - DNA, 22 bp, Homo sapiens
cagctacaggacgggcatctgc

SEQ ID NO: 7080558 - DNA, 22 bp, Homo sapiens
gtgcccagtgcaggcccgcagg

SEQ ID NO: 7080559 - DNA, 22 bp, Homo sapiens
gtgcccagtaaatgaaagcttt

SEQ ID NO: 7080560 - DNA, 22 bp, Homo sapiens
gtgcccagtcctgccttgacag

SEQ ID NO: 7080561 - DNA, 22 bp, Homo sapiens
gtgcccagtcctgccttgacag

SEQ ID NO: 7080562 - DNA, 22 bp, Homo sapiens
gtgcccagtcctgccttgacag

SEQ ID NO: 7080563 - DNA, 22 bp, Homo sapiens
gtgcccagtaaatgaaagcttt

SEQ ID NO: 7080564 - DNA, 22 bp, Homo sapiens
gtgcccagtaaatgaaagcttt

SEQ ID NO: 7080565 - DNA, 22 bp, Homo sapiens
gtgcccagtaaatgaaagcttt

SEQ ID NO: 7080566 - DNA, 22 bp, Homo sapiens
gtgcccaggtgtccctgagaag

SEQ ID NO: 7080567 - DNA, 22 bp, Homo sapiens
cagctattctctgaaatgaata

SEQ ID NO: 7080568 - DNA, 22 bp, Homo sapiens
cagctattccaggagtagaatc

SEQ ID NO: 7080569 - DNA, 22 bp, Homo sapiens
cagctattattttctctaaatt

SEQ ID NO: 7080570 - DNA, 22 bp, Homo sapiens
cagctattattttctctaaatt

SEQ ID NO: 7080571 - DNA, 22 bp, Homo sapiens
cagctattccaggagtagaatc

SEQ ID NO: 7080572 - DNA, 22 bp, Homo sapiens
cagctatagatggactgaagag

SEQ ID NO: 7080573 - DNA, 22 bp, Homo sapiens
cagctattaatgtttttgctga

SEQ ID NO: 7080574 - DNA, 22 bp, Homo sapiens
cagctagtacaatgggagagca

SEQ ID NO: 7080575 - DNA, 22 bp, Homo sapiens
cagctagtgagagaaaggacac

SEQ ID NO: 7080576 - DNA, 22 bp, Homo sapiens
cagctaggaaaccagagggcag

SEQ ID NO: 7080577 - DNA, 22 bp, Homo sapiens
cagctagggagtggcagagctt

SEQ ID NO: 7080578 - DNA, 22 bp, Homo sapiens
cagctagggagtggcagagctt

SEQ ID NO: 7080579 - DNA, 22 bp, Homo sapiens
cagctagggagtggcagagctt

SEQ ID NO: 7080580 - DNA, 22 bp, Homo sapiens
cagctagggagtggcagagctt

SEQ ID NO: 7080581 - DNA, 22 bp, Homo sapiens
cagctagtaaatggcaagacta

SEQ ID NO: 7080582 - DNA, 21 bp, Homo sapiens
ggccgccgccttgtgctctgc

SEQ ID NO: 7080583 - DNA, 21 bp, Homo sapiens
ggccgccgccttgtgctctgc

SEQ ID NO: 7080584 - DNA, 21 bp, Homo sapiens
ggccgccgccttgtgctctgc

SEQ ID NO: 7080585 - DNA, 19 bp, Homo sapiens
ggccgcggcccgcagtggg

SEQ ID NO: 7080586 - DNA, 22 bp, Homo sapiens
ggccgctctccggtgtggatct

SEQ ID NO: 7080587 - DNA, 22 bp, Homo sapiens
ggccgctgcgcctccaaccgag

SEQ ID NO: 7080588 - DNA, 22 bp, Homo sapiens
ggccggcctttgcgagcattct

SEQ ID NO: 7080589 - DNA, 22 bp, Homo sapiens
ggccggctgccgtagggctcag

SEQ ID NO: 7080590 - DNA, 22 bp, Homo sapiens
ggccggcttactgggtagggtg

SEQ ID NO: 7080591 - DNA, 22 bp, Homo sapiens
ggccggcttactgggtagggtg

SEQ ID NO: 7080592 - DNA, 22 bp, Homo sapiens
ggccgggcaggtctcagccagc

SEQ ID NO: 7080593 - DNA, 20 bp, Homo sapiens
ggccggggagctctccaggg

SEQ ID NO: 7080594 - DNA, 22 bp, Homo sapiens
ggccggggcctgctcgcctgtg

SEQ ID NO: 7080595 - DNA, 22 bp, Homo sapiens
cacctgggtcattgctggtgtt

SEQ ID NO: 7080596 - DNA, 22 bp, Homo sapiens
cacctggttctagtgaaagtct

SEQ ID NO: 7080597 - DNA, 22 bp, Homo sapiens
cacctgtacagggccgggctgg

SEQ ID NO: 7080598 - DNA, 22 bp, Homo sapiens
cacctgtacagggccgggctgg

SEQ ID NO: 7080599 - DNA, 22 bp, Homo sapiens
cacctgtccacgcagtctgcct

SEQ ID NO: 7080600 - DNA, 22 bp, Homo sapiens
caccttttgtgtctgcgtttgt

SEQ ID NO: 7080601 - DNA, 22 bp, Homo sapiens
caccttttgtgtctgcgtttgt

SEQ ID NO: 7080602 - DNA, 22 bp, Homo sapiens
cacctttgttctcggccagagt

SEQ ID NO: 7080603 - DNA, 22 bp, Homo sapiens
cacctttgcaaaccaaatctga

SEQ ID NO: 7080604 - DNA, 22 bp, Homo sapiens
cacctttaatgagcaccagccg

SEQ ID NO: 7080605 - DNA, 22 bp, Homo sapiens
cacctttgaccttgcagcgcac

SEQ ID NO: 7080606 - DNA, 22 bp, Homo sapiens
caccttggccttgctatttctc

SEQ ID NO: 7080607 - DNA, 22 bp, Homo sapiens
caccttactccctctggatgcc

SEQ ID NO: 7080608 - DNA, 22 bp, Homo sapiens
caccttgcattcttttaattta

SEQ ID NO: 7080609 - DNA, 22 bp, Homo sapiens
cacgcacgctgggtggaggcgc

SEQ ID NO: 7080610 - DNA, 22 bp, Homo sapiens
cacgcacgctgggtggaggcgc

SEQ ID NO: 7080611 - DNA, 22 bp, Homo sapiens
ggcctctctccagtcagtgcag

SEQ ID NO: 7080612 - DNA, 22 bp, Homo sapiens
ggcctctctccctggcttgcag

SEQ ID NO: 7080613 - DNA, 22 bp, Homo sapiens
ggcctctctccctggcttgcag

SEQ ID NO: 7080614 - DNA, 22 bp, Homo sapiens
cacgaggccatctccttctgga

SEQ ID NO: 7080615 - DNA, 22 bp, Homo sapiens
cacgaggccatctccttctgga

SEQ ID NO: 7080616 - DNA, 22 bp, Homo sapiens
cacgagggcacacgtgggaggg

SEQ ID NO: 7080617 - DNA, 22 bp, Homo sapiens
cacgagggcacacgtgggaggg

SEQ ID NO: 7080618 - DNA, 22 bp, Homo sapiens
cacgcacgctgggtggaggcgc

SEQ ID NO: 7080619 - DNA, 22 bp, Homo sapiens
ggccgccctttccacggtttct

SEQ ID NO: 7080620 - DNA, 22 bp, Homo sapiens
ggcccttgcagcaggcgctggc

SEQ ID NO: 7080621 - DNA, 22 bp, Homo sapiens
ggcccttggagcctccacagtg

SEQ ID NO: 7080622 - DNA, 22 bp, Homo sapiens
ggcccttggagcctccacagtg

SEQ ID NO: 7080623 - DNA, 22 bp, Homo sapiens
ggcccttcctgctctcttagct

SEQ ID NO: 7080624 - DNA, 22 bp, Homo sapiens
ggcccttcctgctctcttagct

SEQ ID NO: 7080625 - DNA, 22 bp, Homo sapiens
ggcccttcctgctctcttagct

SEQ ID NO: 7080626 - DNA, 22 bp, Homo sapiens
ggcccttcctcttgtgctggca

SEQ ID NO: 7080627 - DNA, 22 bp, Homo sapiens
ggcccttgcagcaggcgctggc

SEQ ID NO: 7080628 - DNA, 22 bp, Homo sapiens
ggcccttgcagcaggcgctggc

SEQ ID NO: 7080629 - DNA, 22 bp, Homo sapiens
ggccctgtggttttgcaaagtc

SEQ ID NO: 7080630 - DNA, 22 bp, Homo sapiens
ggccctgtggttttgcaaagtc

SEQ ID NO: 7080631 - DNA, 22 bp, Homo sapiens
ggccctgttccacgtggggtgt

SEQ ID NO: 7080632 - DNA, 22 bp, Homo sapiens
ggccctgtccctggccgtctgt

SEQ ID NO: 7080633 - DNA, 22 bp, Homo sapiens
ggccctgtcctggctgtctccg

SEQ ID NO: 7080634 - DNA, 22 bp, Homo sapiens
ggccctgtcctggctgtctccg

SEQ ID NO: 7080635 - DNA, 22 bp, Homo sapiens
ggccctgtcctggctgtctccg

SEQ ID NO: 7080636 - DNA, 22 bp, Homo sapiens
ggccctgtctgtctgcccagct

SEQ ID NO: 7080637 - DNA, 22 bp, Homo sapiens
ggccccagggattaggccaacc

SEQ ID NO: 7080638 - DNA, 22 bp, Homo sapiens
ggccccaggtagaagatataga

SEQ ID NO: 7080639 - DNA, 21 bp, Homo sapiens
ggccctggttacgcctcctct

SEQ ID NO: 7080640 - DNA, 22 bp, Homo sapiens
ggccctgtccccttcagttttg

SEQ ID NO: 7080641 - DNA, 22 bp, Homo sapiens
ggccactgctgctctggtggag

SEQ ID NO: 7080642 - DNA, 22 bp, Homo sapiens
ggccactgtttcctgggcagtt

SEQ ID NO: 7080643 - DNA, 22 bp, Homo sapiens
ggccactgtttcctgggcagtt

SEQ ID NO: 7080644 - DNA, 22 bp, Homo sapiens
ggccactgctctccagcctggg

SEQ ID NO: 7080645 - DNA, 22 bp, Homo sapiens
ggccactgctctccagcctggg

SEQ ID NO: 7080646 - DNA, 22 bp, Homo sapiens
ggccactgacctacatctgggg

SEQ ID NO: 7080647 - DNA, 23 bp, Homo sapiens
ggccactgaattttctgcatctt

SEQ ID NO: 7080648 - DNA, 23 bp, Homo sapiens
ggccactgaattttctgcatctt

SEQ ID NO: 7080649 - DNA, 22 bp, Homo sapiens
ggccactgacctacatctgggg

SEQ ID NO: 7080650 - DNA, 22 bp, Homo sapiens
ggccactgccctggctacaccg

SEQ ID NO: 7080651 - DNA, 22 bp, Homo sapiens
ggccactgccctggctacaccg

SEQ ID NO: 7080652 - DNA, 22 bp, Homo sapiens
ggccactgcctccgccatggct

SEQ ID NO: 7080653 - DNA, 22 bp, Homo sapiens
ggccactgcctccgccatggct

SEQ ID NO: 7080654 - DNA, 22 bp, Homo sapiens
ggccactgcctccgccatggct

SEQ ID NO: 7080655 - DNA, 22 bp, Homo sapiens
ggcatttttgacaaagagcaat

SEQ ID NO: 7080656 - DNA, 22 bp, Homo sapiens
ggccaaaagcataatcctcaca

SEQ ID NO: 7080657 - DNA, 22 bp, Homo sapiens
ggccaaaagcataatcctcaca

SEQ ID NO: 7080658 - DNA, 22 bp, Homo sapiens
ggccaaaccgcaattatttttg

SEQ ID NO: 7080659 - DNA, 23 bp, Homo sapiens
ggccactgaattttctgcatctt

SEQ ID NO: 7080660 - DNA, 22 bp, Homo sapiens
ggccactccgctgctactggaa

SEQ ID NO: 7080661 - DNA, 19 bp, Homo sapiens
ggccactcctggtgactgg

SEQ ID NO: 7080662 - DNA, 19 bp, Homo sapiens
ggccactcctggtgactgg

SEQ ID NO: 7080663 - DNA, 22 bp, Homo sapiens
ggccaaggatggtggctctggt

SEQ ID NO: 7080664 - DNA, 22 bp, Homo sapiens
ggccaaggatggtggctctggt

SEQ ID NO: 7080665 - DNA, 22 bp, Homo sapiens
ggccaaggatggtggctctggt

SEQ ID NO: 7080666 - DNA, 22 bp, Homo sapiens
ggccaagctctcattccagcac

SEQ ID NO: 7080667 - DNA, 22 bp, Homo sapiens
ggccaagctctcattccagcac

SEQ ID NO: 7080668 - DNA, 22 bp, Homo sapiens
ggccaagctctcattccagcac

SEQ ID NO: 7080669 - DNA, 22 bp, Homo sapiens
ggccaaggatggtggctctggt

SEQ ID NO: 7080670 - DNA, 22 bp, Homo sapiens
ggccaaggatggtggctctggt

SEQ ID NO: 7080671 - DNA, 22 bp, Homo sapiens
ggcaggtgccttctgtgctagc

SEQ ID NO: 7080672 - DNA, 22 bp, Homo sapiens
ggcaggtgccttctgtgctagc

SEQ ID NO: 7080673 - DNA, 22 bp, Homo sapiens
ggcatcaggagcttcttcaggt

SEQ ID NO: 7080674 - DNA, 22 bp, Homo sapiens
ggcattcaaagaatggtaatta

SEQ ID NO: 7080675 - DNA, 22 bp, Homo sapiens
ggcattgttctaggtggttgga

SEQ ID NO: 7080676 - DNA, 22 bp, Homo sapiens
ggcattgttctaggtggttgga

SEQ ID NO: 7080677 - DNA, 22 bp, Homo sapiens
ggcatttgaaactattcggaga

SEQ ID NO: 7080678 - DNA, 22 bp, Homo sapiens
ggcatttaggcagataacagac

SEQ ID NO: 7080679 - DNA, 22 bp, Homo sapiens
ggcaggtgcccagagagcacga

SEQ ID NO: 7080680 - DNA, 22 bp, Homo sapiens
ggcaggtgcccagagagcacga

SEQ ID NO: 7080681 - DNA, 22 bp, Homo sapiens
ggcaggtgcccagagagcacga

SEQ ID NO: 7080682 - DNA, 22 bp, Homo sapiens
ggcaggtgcccagagagcacga

SEQ ID NO: 7080683 - DNA, 22 bp, Homo sapiens
ggcaggtgcccagagagcacga

SEQ ID NO: 7080684 - DNA, 22 bp, Homo sapiens
ggcaggtgcccagagagcacga

SEQ ID NO: 7080685 - DNA, 22 bp, Homo sapiens
ggcaggtgccagttggcttggg

SEQ ID NO: 7080686 - DNA, 22 bp, Homo sapiens
ggcaggtgccagttggcttggg

SEQ ID NO: 7080687 - DNA, 22 bp, Homo sapiens
ggcaggtgccagttggcttggg

SEQ ID NO: 7080688 - DNA, 22 bp, Homo sapiens
ggcaggtgccagttggcttggg

SEQ ID NO: 7080689 - DNA, 22 bp, Homo sapiens
ggcaggtgatctagagtcaata

SEQ ID NO: 7080690 - DNA, 22 bp, Homo sapiens
ggcaggtgatctagagtcaata

SEQ ID NO: 7080691 - DNA, 22 bp, Homo sapiens
ggcagggcaggaaagtcaggaa

SEQ ID NO: 7080692 - DNA, 22 bp, Homo sapiens
ggcaggtgatctagagtcaata

SEQ ID NO: 7080693 - DNA, 22 bp, Homo sapiens
ggcaggtgatctagagtcaata

SEQ ID NO: 7080694 - DNA, 22 bp, Homo sapiens
ggcaggtgatctagagtcaata

SEQ ID NO: 7080695 - DNA, 22 bp, Homo sapiens
ggcaggtgcacctgagccatct

SEQ ID NO: 7080696 - DNA, 22 bp, Homo sapiens
ggcaggtgcacctgagccatct

SEQ ID NO: 7080697 - DNA, 22 bp, Homo sapiens
ggcaggtgcacctgagccatct

SEQ ID NO: 7080698 - DNA, 22 bp, Homo sapiens
ggcagggcagcgctgattaggg

SEQ ID NO: 7080699 - DNA, 22 bp, Homo sapiens
ggcagggcagcgctgattaggg

SEQ ID NO: 7080700 - DNA, 22 bp, Homo sapiens
ggcagggcagcgctgattaggg

SEQ ID NO: 7080701 - DNA, 22 bp, Homo sapiens
ggcagggcagcgctgattaggg

SEQ ID NO: 7080702 - DNA, 22 bp, Homo sapiens
ggcagggagtggagactcccta

SEQ ID NO: 7080703 - DNA, 20 bp, Homo sapiens
ggcagggagggatactgagg

SEQ ID NO: 7080704 - DNA, 22 bp, Homo sapiens
ggcagggagtggagactcccta

SEQ ID NO: 7080705 - DNA, 22 bp, Homo sapiens
ggcagggagtggagactcccta

SEQ ID NO: 7080706 - DNA, 22 bp, Homo sapiens
ggcagggcaggaaagtcaggaa

SEQ ID NO: 7080707 - DNA, 22 bp, Homo sapiens
ggcagggcaggaaagtcaggaa

SEQ ID NO: 7080708 - DNA, 22 bp, Homo sapiens
ggcagggcaggaaagtcaggaa

SEQ ID NO: 7080709 - DNA, 22 bp, Homo sapiens
ggcagggcaggaaagtcaggaa

SEQ ID NO: 7080710 - DNA, 22 bp, Homo sapiens
ggcagggcaggaaagtcaggaa

SEQ ID NO: 7080711 - DNA, 22 bp, Homo sapiens
ggcagggcaggaaagtcaggaa

SEQ ID NO: 7080712 - DNA, 22 bp, Homo sapiens
ggcagggcaggaaagtcaggaa

SEQ ID NO: 7080713 - DNA, 22 bp, Homo sapiens
ggcagggcaggaaagtcaggaa

SEQ ID NO: 7080714 - DNA, 22 bp, Homo sapiens
cacatacattcatgttactcta

SEQ ID NO: 7080715 - DNA, 22 bp, Homo sapiens
cacatactattttggttgggtt

SEQ ID NO: 7080716 - DNA, 22 bp, Homo sapiens
cacatactgagaatcacaccca

SEQ ID NO: 7080717 - DNA, 22 bp, Homo sapiens
cacatacttgtgtgtacatatg

SEQ ID NO: 7080718 - DNA, 22 bp, Homo sapiens
cacatacttgtgtgtacatatg

SEQ ID NO: 7080719 - DNA, 22 bp, Homo sapiens
cacatacatgcacacctaaata

SEQ ID NO: 7080720 - DNA, 22 bp, Homo sapiens
cacatacattcatgttactcta

SEQ ID NO: 7080721 - DNA, 22 bp, Homo sapiens
cacatacatacgtatgtataca

SEQ ID NO: 7080722 - DNA, 22 bp, Homo sapiens
cacatacatacgtatgtataca

SEQ ID NO: 7080723 - DNA, 19 bp, Homo sapiens
cacatacagaaaagagtaa

SEQ ID NO: 7080724 - DNA, 19 bp, Homo sapiens
cacatacagaaaagagtaa

SEQ ID NO: 7080725 - DNA, 22 bp, Homo sapiens
cacatacatacgtatgtataca

SEQ ID NO: 7080726 - DNA, 22 bp, Homo sapiens
cacatacatacgtatgtataca

SEQ ID NO: 7080727 - DNA, 22 bp, Homo sapiens
cacataagaaatgaatatgaga

SEQ ID NO: 7080728 - DNA, 22 bp, Homo sapiens
cacataagtgggttccattgca

SEQ ID NO: 7080729 - DNA, 22 bp, Homo sapiens
cacataagtgggttccattgca

SEQ ID NO: 7080730 - DNA, 22 bp, Homo sapiens
cacagttttgcccagggcttct

SEQ ID NO: 7080731 - DNA, 22 bp, Homo sapiens
cacagttttgtcttggtttcca

SEQ ID NO: 7080732 - DNA, 22 bp, Homo sapiens
cacagttttgtcttggtttcca

SEQ ID NO: 7080733 - DNA, 22 bp, Homo sapiens
cacataataaatgttcctgatg

SEQ ID NO: 7080734 - DNA, 22 bp, Homo sapiens
cacataatacatgttccactta

SEQ ID NO: 7080735 - DNA, 22 bp, Homo sapiens
cacataattgaacgtgatgagt

SEQ ID NO: 7080736 - DNA, 22 bp, Homo sapiens
cacataattgaacgtgatgagt

SEQ ID NO: 7080737 - DNA, 22 bp, Homo sapiens
cacatacaagccatggggggat

SEQ ID NO: 7080738 - DNA, 22 bp, Homo sapiens
cacatacaaggcacactggagg

SEQ ID NO: 7080739 - DNA, 22 bp, Homo sapiens
cacatacaatggtgttatttgg

SEQ ID NO: 7080740 - DNA, 22 bp, Homo sapiens
ggaggtggagctggaagttcca

SEQ ID NO: 7080741 - DNA, 22 bp, Homo sapiens
ggaggtgctggcggccagctct

SEQ ID NO: 7080742 - DNA, 22 bp, Homo sapiens
ggaggtgctggcggccagctct

SEQ ID NO: 7080743 - DNA, 22 bp, Homo sapiens
ggaggtggagctggaagttcca

SEQ ID NO: 7080744 - DNA, 22 bp, Homo sapiens
ggaggtggagctggaagttcca

SEQ ID NO: 7080745 - DNA, 22 bp, Homo sapiens
ggaggtgctgatcccagtcaac

SEQ ID NO: 7080746 - DNA, 22 bp, Homo sapiens
ggaggtggaggttgcaatgagc

SEQ ID NO: 7080747 - DNA, 22 bp, Homo sapiens
ggaggtggaggttgcaatgagc

SEQ ID NO: 7080748 - DNA, 22 bp, Homo sapiens
ggaggtggaggttgcaatgagc

SEQ ID NO: 7080749 - DNA, 22 bp, Homo sapiens
ggaggtggagctggaagttcca

SEQ ID NO: 7080750 - DNA, 22 bp, Homo sapiens
ggaggtggagctggaagttcca

SEQ ID NO: 7080751 - DNA, 22 bp, Homo sapiens
ggaggtggagctggaagttcca

SEQ ID NO: 7080752 - DNA, 22 bp, Homo sapiens
ggaggtggaggttgcagtgagc

SEQ ID NO: 7080753 - DNA, 22 bp, Homo sapiens
ggaggtggaggttgcagtgagc

SEQ ID NO: 7080754 - DNA, 22 bp, Homo sapiens
ggaggtggaggttgcagtgagc

SEQ ID NO: 7080755 - DNA, 22 bp, Homo sapiens
cacagtgtgggcatggtgcctg

SEQ ID NO: 7080756 - DNA, 22 bp, Homo sapiens
cacagttttatcttatactgat

SEQ ID NO: 7080757 - DNA, 22 bp, Homo sapiens
cacagggaacaactagaacaaa

SEQ ID NO: 7080758 - DNA, 22 bp, Homo sapiens
cacaggcttttttggctgatgt

SEQ ID NO: 7080759 - DNA, 22 bp, Homo sapiens
cacaggcttttttggctgatgt

SEQ ID NO: 7080760 - DNA, 22 bp, Homo sapiens
cacagggaaccaaggctgggcc

SEQ ID NO: 7080761 - DNA, 22 bp, Homo sapiens
cacagggaaccaaggctgggcc

SEQ ID NO: 7080762 - DNA, 22 bp, Homo sapiens
cacagggaaccaaggctgggcc

SEQ ID NO: 7080763 - DNA, 22 bp, Homo sapiens
cacagggaaccaaggctgggcc

SEQ ID NO: 7080764 - DNA, 22 bp, Homo sapiens
cacagggaaccaaggctgggcc

SEQ ID NO: 7080765 - DNA, 22 bp, Homo sapiens
ggaggtcccaggcctggcagca

SEQ ID NO: 7080766 - DNA, 21 bp, Homo sapiens
ggaggtcccttctggtttcag

SEQ ID NO: 7080767 - DNA, 22 bp, Homo sapiens
ggaggtgcagagtagggttggt

SEQ ID NO: 7080768 - DNA, 22 bp, Homo sapiens
ggaggtgatcagagttttgagg

SEQ ID NO: 7080769 - DNA, 22 bp, Homo sapiens
ggaggtgcagagtagggttggt

SEQ ID NO: 7080770 - DNA, 22 bp, Homo sapiens
ggaggtgcagagtagggttggt

SEQ ID NO: 7080771 - DNA, 22 bp, Homo sapiens
ggaggtgcagagtagggttggt

SEQ ID NO: 7080772 - DNA, 22 bp, Homo sapiens
ggaggtgcagagtagggttggt

SEQ ID NO: 7080773 - DNA, 22 bp, Homo sapiens
ggaggtgaggccgtagggtgtg

SEQ ID NO: 7080774 - DNA, 22 bp, Homo sapiens
ggaggtgaggccgtagggtgtg

SEQ ID NO: 7080775 - DNA, 22 bp, Homo sapiens
ggaggtgaggccgtagggtgtg

SEQ ID NO: 7080776 - DNA, 22 bp, Homo sapiens
ggaggtgaggccgtagggtgtg

SEQ ID NO: 7080777 - DNA, 22 bp, Homo sapiens
ggaggtgaggccgtagggtgtg

SEQ ID NO: 7080778 - DNA, 22 bp, Homo sapiens
ggaggtgaggccgtagggtgtg

SEQ ID NO: 7080779 - DNA, 22 bp, Homo sapiens
ggaggtgactggatcatgggca

SEQ ID NO: 7080780 - DNA, 22 bp, Homo sapiens
ggaggtgacgaaaagaaattgt

SEQ ID NO: 7080781 - DNA, 22 bp, Homo sapiens
ggaggtgactggatcatgggca

SEQ ID NO: 7080782 - DNA, 23 bp, Homo sapiens
cacatatagcagccactaaggtc

SEQ ID NO: 7080783 - DNA, 23 bp, Homo sapiens
cacatatagcagccactaaggtc

SEQ ID NO: 7080784 - DNA, 22 bp, Homo sapiens
cacatatatgaaatgaggaatt

SEQ ID NO: 7080785 - DNA, 22 bp, Homo sapiens
cacatatatgaaatgaggaatt

SEQ ID NO: 7080786 - DNA, 22 bp, Homo sapiens
cacatatatgaaatgaggaatt

SEQ ID NO: 7080787 - DNA, 22 bp, Homo sapiens
cacattctgtgaagctgatttt

SEQ ID NO: 7080788 - DNA, 22 bp, Homo sapiens
cacattcttgagttacagtcta

SEQ ID NO: 7080789 - DNA, 22 bp, Homo sapiens
cacatataacctagacaaggcc

SEQ ID NO: 7080790 - DNA, 22 bp, Homo sapiens
cacatataacctagacaaggcc

SEQ ID NO: 7080791 - DNA, 22 bp, Homo sapiens
cacatataccagccgcggtacg

SEQ ID NO: 7080792 - DNA, 22 bp, Homo sapiens
cacatataccagccgcggtacg

SEQ ID NO: 7080793 - DNA, 22 bp, Homo sapiens
cacatatacctcttcttgagtt

SEQ ID NO: 7080794 - DNA, 22 bp, Homo sapiens
cacatatacctcttcttgagtt

SEQ ID NO: 7080795 - DNA, 22 bp, Homo sapiens
cacatagataggcagaagaaca

SEQ ID NO: 7080796 - DNA, 22 bp, Homo sapiens
cacattcttggtcaccttgtgg

SEQ ID NO: 7080797 - DNA, 22 bp, Homo sapiens
cacattcttggtcaccttgtgg

SEQ ID NO: 7080798 - DNA, 22 bp, Homo sapiens
cacattctttcacagttctgaa

SEQ ID NO: 7080799 - DNA, 22 bp, Homo sapiens
cacatttacatataaaactttc

SEQ ID NO: 7080800 - DNA, 18 bp, Homo sapiens
cacatttacctggctccc

SEQ ID NO: 7080801 - DNA, 22 bp, Homo sapiens
cacatttagaggttagcatggt

SEQ ID NO: 7080802 - DNA, 22 bp, Homo sapiens
cacatttacttttatcccttgg

SEQ ID NO: 7080803 - DNA, 22 bp, Homo sapiens
cacatttagaggttagcatggt

SEQ ID NO: 7080804 - DNA, 22 bp, Homo sapiens
cacatttaggttcctatagcca

SEQ ID NO: 7080805 - DNA, 22 bp, Homo sapiens
cacatttaggttcctatagcca

SEQ ID NO: 7080806 - DNA, 22 bp, Homo sapiens
cacatttatctgttctttctag

SEQ ID NO: 7080807 - DNA, 20 bp, Homo sapiens
ggcagggagggatactgagg

SEQ ID NO: 7080808 - DNA, 20 bp, Homo sapiens
ggcagggagggatactgagg

SEQ ID NO: 7080809 - DNA, 20 bp, Homo sapiens
ggcagggagggatactgagg

SEQ ID NO: 7080810 - DNA, 22 bp, Homo sapiens
ggcagggaggaggtgaaagtga

SEQ ID NO: 7080811 - DNA, 22 bp, Homo sapiens
ggcagggaggaggtgaaagtga

SEQ ID NO: 7080812 - DNA, 22 bp, Homo sapiens
ggcagggagagcatgctgataa

SEQ ID NO: 7080813 - DNA, 22 bp, Homo sapiens
ggcaggcatggggtctgccatt

SEQ ID NO: 7080814 - DNA, 22 bp, Homo sapiens
ggcaggcatggggtctgccatt

SEQ ID NO: 7080815 - DNA, 22 bp, Homo sapiens
ggcaggcatggccactccctag

SEQ ID NO: 7080816 - DNA, 22 bp, Homo sapiens
ggcaggcatggccactccctag

SEQ ID NO: 7080817 - DNA, 22 bp, Homo sapiens
ggcaggcatggccactccctag

SEQ ID NO: 7080818 - DNA, 22 bp, Homo sapiens
ggcaggcatggccactccctag

SEQ ID NO: 7080819 - DNA, 22 bp, Homo sapiens
ggcaggcatggccactccctag

SEQ ID NO: 7080820 - DNA, 22 bp, Homo sapiens
ggcaggcatggggtctgccatt

SEQ ID NO: 7080821 - DNA, 22 bp, Homo sapiens
ggcaggcatggggtctgccatt

SEQ ID NO: 7080822 - DNA, 22 bp, Homo sapiens
ggcaggcatggccactccctag

SEQ ID NO: 7080823 - DNA, 22 bp, Homo sapiens
ggcaggcatggggtctgccatt

SEQ ID NO: 7080824 - DNA, 22 bp, Homo sapiens
ggcaggcatggggtctgccatt

SEQ ID NO: 7080825 - DNA, 22 bp, Homo sapiens
ggcaggcatcatgtggtcatta

SEQ ID NO: 7080826 - DNA, 22 bp, Homo sapiens
ggcaggcatcatcagttgatca

SEQ ID NO: 7080827 - DNA, 22 bp, Homo sapiens
ggcaggcatcatgtggtcatta

SEQ ID NO: 7080828 - DNA, 22 bp, Homo sapiens
ggcaggcatcatgtggtcatta

SEQ ID NO: 7080829 - DNA, 22 bp, Homo sapiens
ggcaggcagtgtggtgtgaaac

SEQ ID NO: 7080830 - DNA, 22 bp, Homo sapiens
ggcaggcagtgtggtgtgaaac

SEQ ID NO: 7080831 - DNA, 22 bp, Homo sapiens
ggcaggcagtgtggtgtgaaac

SEQ ID NO: 7080832 - DNA, 22 bp, Homo sapiens
ggcaggcagtgtggtgtgaaac

SEQ ID NO: 7080833 - DNA, 22 bp, Homo sapiens
ggcaggcagtgtggtgtgaaac

SEQ ID NO: 7080834 - DNA, 22 bp, Homo sapiens
ggcaggcagtgtggtgtgaaac

SEQ ID NO: 7080835 - DNA, 22 bp, Homo sapiens
ggcaggcatcatcagttgatca

SEQ ID NO: 7080836 - DNA, 22 bp, Homo sapiens
ggcaggcatcatcagttgatca

SEQ ID NO: 7080837 - DNA, 22 bp, Homo sapiens
ggcaggcatcatcagttgatca

SEQ ID NO: 7080838 - DNA, 20 bp, Homo sapiens
ggcaggcaggaggtttccag

SEQ ID NO: 7080839 - DNA, 20 bp, Homo sapiens
ggcaggcaggaggtttccag

SEQ ID NO: 7080840 - DNA, 22 bp, Homo sapiens
ggcaggcaggtcttcatggccc

SEQ ID NO: 7080841 - DNA, 22 bp, Homo sapiens
ggcaggcaggtcttcatggccc

SEQ ID NO: 7080842 - DNA, 22 bp, Homo sapiens
ggcaggcaggtcttcatggccc

SEQ ID NO: 7080843 - DNA, 22 bp, Homo sapiens
ggcaggcaggtcttcatggccc

SEQ ID NO: 7080844 - DNA, 22 bp, Homo sapiens
ggcaggcaggagcgtgcttggg

SEQ ID NO: 7080845 - DNA, 22 bp, Homo sapiens
ggcaggcaggagcgtgcttggg

SEQ ID NO: 7080846 - DNA, 22 bp, Homo sapiens
ggcaggcaggagctctgtctcc

SEQ ID NO: 7080847 - DNA, 22 bp, Homo sapiens
ggcaggcaggagctctgtctcc

SEQ ID NO: 7080848 - DNA, 22 bp, Homo sapiens
ggcaggcaggagcgtgcttggg

SEQ ID NO: 7080849 - DNA, 22 bp, Homo sapiens
ggctgtagtcagtgacatggta

SEQ ID NO: 7080850 - DNA, 22 bp, Homo sapiens
ggctgtcaattcataggtcaga

SEQ ID NO: 7080851 - DNA, 22 bp, Homo sapiens
ggctgtccacctaccatgccgg

SEQ ID NO: 7080852 - DNA, 22 bp, Homo sapiens
ggctgtccacctaccatgccgg

SEQ ID NO: 7080853 - DNA, 22 bp, Homo sapiens
ggctgtccacctaccatgccgg

SEQ ID NO: 7080854 - DNA, 20 bp, Homo sapiens
ggctgtcccgcggctgccgg

SEQ ID NO: 7080855 - DNA, 20 bp, Homo sapiens
ggctgtcccgcggctgccgg

SEQ ID NO: 7080856 - DNA, 22 bp, Homo sapiens
ggctgtccttggccaaggcact

SEQ ID NO: 7080857 - DNA, 22 bp, Homo sapiens
ggctgtccttggccaaggcact

SEQ ID NO: 7080858 - DNA, 22 bp, Homo sapiens
ggctggtgttacagtcggcagc

SEQ ID NO: 7080859 - DNA, 22 bp, Homo sapiens
ggctggtgttacagtcggcagc

SEQ ID NO: 7080860 - DNA, 22 bp, Homo sapiens
ggctggtgttacagtcggcagc

SEQ ID NO: 7080861 - DNA, 21 bp, Homo sapiens
ggctggtgtttagctgtgata

SEQ ID NO: 7080862 - DNA, 21 bp, Homo sapiens
ggctggtgtttagctgtgata

SEQ ID NO: 7080863 - DNA, 21 bp, Homo sapiens
ggctggtgtttagctgtgata

SEQ ID NO: 7080864 - DNA, 21 bp, Homo sapiens
ggctggtgtttagctgtgata

SEQ ID NO: 7080865 - DNA, 22 bp, Homo sapiens
ggctggttcagctagtgctgtt

SEQ ID NO: 7080866 - DNA, 22 bp, Homo sapiens
ggctggttttcagttactgagt

SEQ ID NO: 7080867 - DNA, 22 bp, Homo sapiens
ggctgttcctctgagagctgat

SEQ ID NO: 7080868 - DNA, 22 bp, Homo sapiens
ggctgtgtttctgtttgacatt

SEQ ID NO: 7080869 - DNA, 22 bp, Homo sapiens
ggctgtgtttctgtttgacatt

SEQ ID NO: 7080870 - DNA, 22 bp, Homo sapiens
ggcttaaaactttgaaagtgtt

SEQ ID NO: 7080871 - DNA, 22 bp, Homo sapiens
ggcttaaaaggaaaatgagagt

SEQ ID NO: 7080872 - DNA, 22 bp, Homo sapiens
ggctgtttttatagagtccata

SEQ ID NO: 7080873 - DNA, 22 bp, Homo sapiens
ggcttaaagaattaacagagat

SEQ ID NO: 7080874 - DNA, 22 bp, Homo sapiens
ggcttaaagttttctagaataa

SEQ ID NO: 7080875 - DNA, 22 bp, Homo sapiens
ggcttaaatcacagtgactttt

SEQ ID NO: 7080876 - DNA, 22 bp, Homo sapiens
ggcttaacttgtagcaatagat

SEQ ID NO: 7080877 - DNA, 22 bp, Homo sapiens
ggctgtgaagtagcaggggcag

SEQ ID NO: 7080878 - DNA, 22 bp, Homo sapiens
ggctgtgaagtagcaggggcag

SEQ ID NO: 7080879 - DNA, 22 bp, Homo sapiens
ggctgtgaagtagcaggggcag

SEQ ID NO: 7080880 - DNA, 22 bp, Homo sapiens
ggctgtgaaccctggcagtgtg

SEQ ID NO: 7080881 - DNA, 22 bp, Homo sapiens
ggctgtgaaccctggcagtgtg

SEQ ID NO: 7080882 - DNA, 22 bp, Homo sapiens
ggctgtgaaccctggcagtgtg

SEQ ID NO: 7080883 - DNA, 22 bp, Homo sapiens
ggctgtctctgtgactgccacc

SEQ ID NO: 7080884 - DNA, 22 bp, Homo sapiens
ggctgtctctgtgactgccacc

SEQ ID NO: 7080885 - DNA, 22 bp, Homo sapiens
ggctgtctgtggtggagcgttg

SEQ ID NO: 7080886 - DNA, 22 bp, Homo sapiens
ggctgtctgtggtggagcgttg

SEQ ID NO: 7080887 - DNA, 22 bp, Homo sapiens
ggctgtgaacactcttagcatc

SEQ ID NO: 7080888 - DNA, 22 bp, Homo sapiens
ggctgtgaacactcttagcatc

SEQ ID NO: 7080889 - DNA, 23 bp, Homo sapiens
cagaaagtttgagaagatacatc

SEQ ID NO: 7080890 - DNA, 23 bp, Homo sapiens
cagaaagtttgagaagatacatc

SEQ ID NO: 7080891 - DNA, 18 bp, Homo sapiens
cagaaagttatttactct

SEQ ID NO: 7080892 - DNA, 18 bp, Homo sapiens
cagaaagttatttactct

SEQ ID NO: 7080893 - DNA, 18 bp, Homo sapiens
cagaaagttatttactct

SEQ ID NO: 7080894 - DNA, 22 bp, Homo sapiens
cagaaagtgatttgctattcca

SEQ ID NO: 7080895 - DNA, 22 bp, Homo sapiens
cagaaagtgatttgctattcca

SEQ ID NO: 7080896 - DNA, 22 bp, Homo sapiens
cagaaaggtatgtgtgcctttg

SEQ ID NO: 7080897 - DNA, 22 bp, Homo sapiens
cagaaaggcacccactgggtct

SEQ ID NO: 7080898 - DNA, 22 bp, Homo sapiens
cagaaaggactttggttggctt

SEQ ID NO: 7080899 - DNA, 22 bp, Homo sapiens
cagaaaggacagagtgagggtg

SEQ ID NO: 7080900 - DNA, 22 bp, Homo sapiens
cagaaagcttaggcaagttgga

SEQ ID NO: 7080901 - DNA, 22 bp, Homo sapiens
ggctgggaggatgacttgctac

SEQ ID NO: 7080902 - DNA, 22 bp, Homo sapiens
ggctgggaggatgacttgctac

SEQ ID NO: 7080903 - DNA, 22 bp, Homo sapiens
ggctgggaggatgacttgctac

SEQ ID NO: 7080904 - DNA, 22 bp, Homo sapiens
cagaaatagacaatggcagtgg

SEQ ID NO: 7080905 - DNA, 22 bp, Homo sapiens
cagaaatagacaatggcagtgg

SEQ ID NO: 7080906 - DNA, 22 bp, Homo sapiens
cagaaatagacaatggcagtgg

SEQ ID NO: 7080907 - DNA, 22 bp, Homo sapiens
cagaaataaagtggacagagta

SEQ ID NO: 7080908 - DNA, 22 bp, Homo sapiens
cagaaataaagtggacagagta

SEQ ID NO: 7080909 - DNA, 22 bp, Homo sapiens
cagaaataaagtggacagagta

SEQ ID NO: 7080910 - DNA, 22 bp, Homo sapiens
cagaaatacccagcatttggag

SEQ ID NO: 7080911 - DNA, 22 bp, Homo sapiens
cagaaatacccagcatttggag

SEQ ID NO: 7080912 - DNA, 22 bp, Homo sapiens
cagaaatacccagcatttggag

SEQ ID NO: 7080913 - DNA, 23 bp, Homo sapiens
cagaaataaactggtttgtagat

SEQ ID NO: 7080914 - DNA, 23 bp, Homo sapiens
cagaaataaactggtttgtagat

SEQ ID NO: 7080915 - DNA, 23 bp, Homo sapiens
cagaaataaactggtttgtagat

SEQ ID NO: 7080916 - DNA, 23 bp, Homo sapiens
cagaaataaactggtttgtagat

SEQ ID NO: 7080917 - DNA, 23 bp, Homo sapiens
cagaaataaactggtttgtagat

SEQ ID NO: 7080918 - DNA, 22 bp, Homo sapiens
cagaaataaacttctcacatcg

SEQ ID NO: 7080919 - DNA, 22 bp, Homo sapiens
cagaaataaacttctcacatcg

SEQ ID NO: 7080920 - DNA, 22 bp, Homo sapiens
cagaaataaacttctcacatcg

SEQ ID NO: 7080921 - DNA, 22 bp, Homo sapiens
cagaaataaacttctcacatcg

SEQ ID NO: 7080922 - DNA, 22 bp, Homo sapiens
cagaaataaacttctcacatcg

SEQ ID NO: 7080923 - DNA, 22 bp, Homo sapiens
cagaaagccgacttacaatgga

SEQ ID NO: 7080924 - DNA, 22 bp, Homo sapiens
cagaaagccgacttacaatgga

SEQ ID NO: 7080925 - DNA, 22 bp, Homo sapiens
cagaaagccgacttacaatgga

SEQ ID NO: 7080926 - DNA, 22 bp, Homo sapiens
cagaaagccctatgtacagtgg

SEQ ID NO: 7080927 - DNA, 22 bp, Homo sapiens
cagaaagccgacttacaatgga

SEQ ID NO: 7080928 - DNA, 22 bp, Homo sapiens
cagaaagccgacttacaatgga

SEQ ID NO: 7080929 - DNA, 22 bp, Homo sapiens
cagaaagcgggatgcagcatgt

SEQ ID NO: 7080930 - DNA, 22 bp, Homo sapiens
cagaaagcaagccattcactgt

SEQ ID NO: 7080931 - DNA, 22 bp, Homo sapiens
cagaaagcagagctgagccttt

SEQ ID NO: 7080932 - DNA, 22 bp, Homo sapiens
cagaaagcagttgtcaatgggc

SEQ ID NO: 7080933 - DNA, 22 bp, Homo sapiens
cagaaagcagagctgagccttt

SEQ ID NO: 7080934 - DNA, 22 bp, Homo sapiens
cagaaagcagttgtcaatgggc

SEQ ID NO: 7080935 - DNA, 22 bp, Homo sapiens
cagaaagccaactccaactgtc

SEQ ID NO: 7080936 - DNA, 22 bp, Homo sapiens
cagaaagccctatgtacagtgg

SEQ ID NO: 7080937 - DNA, 22 bp, Homo sapiens
ggctgccctcggggtcgcaggc

SEQ ID NO: 7080938 - DNA, 22 bp, Homo sapiens
ggctgccctcggggtcgcaggc

SEQ ID NO: 7080939 - DNA, 22 bp, Homo sapiens
ggctgccctcggggtcgcaggc

SEQ ID NO: 7080940 - DNA, 22 bp, Homo sapiens
ggctgccctcgtctactgccca

SEQ ID NO: 7080941 - DNA, 22 bp, Homo sapiens
ggctgccctgggaggcaagggt

SEQ ID NO: 7080942 - DNA, 22 bp, Homo sapiens
ggctgcctactttcccagagtt

SEQ ID NO: 7080943 - DNA, 22 bp, Homo sapiens
ggctgcctcaaagctcaagctc

SEQ ID NO: 7080944 - DNA, 22 bp, Homo sapiens
cagaaacatgtataaagttgta

SEQ ID NO: 7080945 - DNA, 22 bp, Homo sapiens
cagaaacatgtataaagttgta

SEQ ID NO: 7080946 - DNA, 22 bp, Homo sapiens
cagaaacatgtataaagttgta

SEQ ID NO: 7080947 - DNA, 22 bp, Homo sapiens
cagaaacatgtataaagttgta

SEQ ID NO: 7080948 - DNA, 22 bp, Homo sapiens
cagaaacatgtataaagttgta

SEQ ID NO: 7080949 - DNA, 22 bp, Homo sapiens
cagaaaataaacatttgtggaa

SEQ ID NO: 7080950 - DNA, 22 bp, Homo sapiens
cagaaaataaagtttctacgca

SEQ ID NO: 7080951 - DNA, 22 bp, Homo sapiens
cagaaaataaacatttgtggaa

SEQ ID NO: 7080952 - DNA, 22 bp, Homo sapiens
cagaaaaggaagagctatgtaa

SEQ ID NO: 7080953 - DNA, 22 bp, Homo sapiens
cagaaaaggaagagctatgtaa

SEQ ID NO: 7080954 - DNA, 22 bp, Homo sapiens
cagaaaaggaagagctatgtaa

SEQ ID NO: 7080955 - DNA, 22 bp, Homo sapiens
cagaaaagggtgtttgttcagg

SEQ ID NO: 7080956 - DNA, 22 bp, Homo sapiens
ggctgccccagtgctcatggct

SEQ ID NO: 7080957 - DNA, 22 bp, Homo sapiens
ggctgccccagtgctcatggct

SEQ ID NO: 7080958 - DNA, 22 bp, Homo sapiens
ggctgccccatgggctgggctg

SEQ ID NO: 7080959 - DNA, 22 bp, Homo sapiens
ggctgccccatgggctgggctg

SEQ ID NO: 7080960 - DNA, 22 bp, Homo sapiens
ggctgccctagagctggcaagg

SEQ ID NO: 7080961 - DNA, 22 bp, Homo sapiens
ggctgccataacagagtaccac

SEQ ID NO: 7080962 - DNA, 22 bp, Homo sapiens
ggctgccataactgataccata

SEQ ID NO: 7080963 - DNA, 22 bp, Homo sapiens
ggctgccataactgataccata

SEQ ID NO: 7080964 - DNA, 20 bp, Homo sapiens
ggctgcccactccagagtac

SEQ ID NO: 7080965 - DNA, 22 bp, Homo sapiens
ggctgccccagtgctcatggct

SEQ ID NO: 7080966 - DNA, 22 bp, Homo sapiens
cagaaaacctgactctagaact

SEQ ID NO: 7080967 - DNA, 22 bp, Homo sapiens
cagaaaacctgactctagaact

SEQ ID NO: 7080968 - DNA, 22 bp, Homo sapiens
cagaaaacctgactctagaact

SEQ ID NO: 7080969 - DNA, 22 bp, Homo sapiens
cagaaaacctgactctagaact

SEQ ID NO: 7080970 - DNA, 23 bp, Homo sapiens
cagaaaacccagagctcagtccc

SEQ ID NO: 7080971 - DNA, 22 bp, Homo sapiens
cagaaaacaaacctatcctgag

SEQ ID NO: 7080972 - DNA, 22 bp, Homo sapiens
cagaaaacaaacctatcctgag

SEQ ID NO: 7080973 - DNA, 22 bp, Homo sapiens
cacttttaacaggagaattccc

SEQ ID NO: 7080974 - DNA, 22 bp, Homo sapiens
cacttttaacaggagaattccc

SEQ ID NO: 7080975 - DNA, 22 bp, Homo sapiens
cacttttaaatgggtccgtgtt

SEQ ID NO: 7080976 - DNA, 17 bp, Homo sapiens
cactttgttgctgtggg

SEQ ID NO: 7080977 - DNA, 22 bp, Homo sapiens
cactttggtagctgttttggga

SEQ ID NO: 7080978 - DNA, 22 bp, Homo sapiens
cactttggtagctgttttggga

SEQ ID NO: 7080979 - DNA, 22 bp, Homo sapiens
cactttggttcacctgagtttc

SEQ ID NO: 7080980 - DNA, 22 bp, Homo sapiens
cactttggttcacctgagtttc

SEQ ID NO: 7080981 - DNA, 21 bp, Homo sapiens
cactttaatggatatttgttt

SEQ ID NO: 7080982 - DNA, 22 bp, Homo sapiens
cactttggatgccactggtcta

SEQ ID NO: 7080983 - DNA, 22 bp, Homo sapiens
cactttggggtatgacaagttt

SEQ ID NO: 7080984 - DNA, 22 bp, Homo sapiens
cactttggggtatgacaagttt

SEQ ID NO: 7080985 - DNA, 22 bp, Homo sapiens
cactttgggtttatgtcaatca

SEQ ID NO: 7080986 - DNA, 22 bp, Homo sapiens
cactttgggtttatgtcaatca

SEQ ID NO: 7080987 - DNA, 22 bp, Homo sapiens
ggctctggtcagtgaggggcct

SEQ ID NO: 7080988 - DNA, 22 bp, Homo sapiens
ggctctggtcagtgaggggcct

SEQ ID NO: 7080989 - DNA, 22 bp, Homo sapiens
ggctctggtcagtgaggggcct

SEQ ID NO: 7080990 - DNA, 22 bp, Homo sapiens
ggctctggtcagtgaggggcct

SEQ ID NO: 7080991 - DNA, 22 bp, Homo sapiens
ggctctgggttctgcaatgcgt

SEQ ID NO: 7080992 - DNA, 22 bp, Homo sapiens
ggctctggtcagtgaggggcct

SEQ ID NO: 7080993 - DNA, 20 bp, Homo sapiens
ggctctggaatctggtgggc

SEQ ID NO: 7080994 - DNA, 20 bp, Homo sapiens
ggctctggaatctggtgggc

SEQ ID NO: 7080995 - DNA, 20 bp, Homo sapiens
ggctctggaatctggtgggc

SEQ ID NO: 7080996 - DNA, 22 bp, Homo sapiens
ggctctggaatgtgtagtcagg

SEQ ID NO: 7080997 - DNA, 22 bp, Homo sapiens
ggctctggaatgtgtagtcagg

SEQ ID NO: 7080998 - DNA, 22 bp, Homo sapiens
ggctctggtcagtgaggggcct

SEQ ID NO: 7080999 - DNA, 22 bp, Homo sapiens
ggctctgggttctgcaatgcgt

SEQ ID NO: 7081000 - DNA, 22 bp, Homo sapiens
ggctctggaatgtgtagtcagg

SEQ ID NO: 7081001 - DNA, 22 bp, Homo sapiens
ggctctggaatgtgtagtcagg

SEQ ID NO: 7081002 - DNA, 22 bp, Homo sapiens
ggctctgggttctgcaatgcgt

SEQ ID NO: 7081003 - DNA, 22 bp, Homo sapiens
ggctccaggtgcatgccaggct

SEQ ID NO: 7081004 - DNA, 22 bp, Homo sapiens
ggctccaggtgcatgccaggct

SEQ ID NO: 7081005 - DNA, 18 bp, Homo sapiens
ggctccagtcttcagtgg

SEQ ID NO: 7081006 - DNA, 18 bp, Homo sapiens
ggctccagtcttcagtgg

SEQ ID NO: 7081007 - DNA, 22 bp, Homo sapiens
ggctccagtttccccttggggc

SEQ ID NO: 7081008 - DNA, 22 bp, Homo sapiens
ggctccagtttccccttggggc

SEQ ID NO: 7081009 - DNA, 22 bp, Homo sapiens
ggctccagggtctctccttgtg

SEQ ID NO: 7081010 - DNA, 22 bp, Homo sapiens
ggctccagggtacccctggatg

SEQ ID NO: 7081011 - DNA, 22 bp, Homo sapiens
ggctccagggtctctccttgtg

SEQ ID NO: 7081012 - DNA, 22 bp, Homo sapiens
ggctccaggtacgtatgggagg

SEQ ID NO: 7081013 - DNA, 22 bp, Homo sapiens
ggctccaggtgcatgccaggct

SEQ ID NO: 7081014 - DNA, 22 bp, Homo sapiens
ggctccaggtgcatgccaggct

SEQ ID NO: 7081015 - DNA, 22 bp, Homo sapiens
ggctccaggtgcatgccaggct

SEQ ID NO: 7081016 - DNA, 22 bp, Homo sapiens
ggctcaggttaccagtccctcc

SEQ ID NO: 7081017 - DNA, 22 bp, Homo sapiens
ggctcaggttaccagtccctcc

SEQ ID NO: 7081018 - DNA, 22 bp, Homo sapiens
ggctcaggttaccagtccctcc

SEQ ID NO: 7081019 - DNA, 22 bp, Homo sapiens
ggctcaggttaccagtccctcc

SEQ ID NO: 7081020 - DNA, 22 bp, Homo sapiens
ggctcaggttaccagtccctcc

SEQ ID NO: 7081021 - DNA, 22 bp, Homo sapiens
ggctcaggttgggtcacatgac

SEQ ID NO: 7081022 - DNA, 22 bp, Homo sapiens
ggctcaggttgggtcacatgac

SEQ ID NO: 7081023 - DNA, 22 bp, Homo sapiens
ggctcaggttgggtcacatgac

SEQ ID NO: 7081024 - DNA, 22 bp, Homo sapiens
ggctcaggttgggtcacatgac

SEQ ID NO: 7081025 - DNA, 22 bp, Homo sapiens
ggctcaggtttaaagtgcttta

SEQ ID NO: 7081026 - DNA, 22 bp, Homo sapiens
ggctcaggtttaaagtgcttta

SEQ ID NO: 7081027 - DNA, 22 bp, Homo sapiens
ggctccagggtacccctggatg

SEQ ID NO: 7081028 - DNA, 22 bp, Homo sapiens
ggctccagggtacccctggatg

SEQ ID NO: 7081029 - DNA, 22 bp, Homo sapiens
ggctccagggtacccctggatg

SEQ ID NO: 7081030 - DNA, 22 bp, Homo sapiens
ggctccagggtacccctggatg

SEQ ID NO: 7081031 - DNA, 22 bp, Homo sapiens
ggctctggtgtgaagcagcctc

SEQ ID NO: 7081032 - DNA, 22 bp, Homo sapiens
ggctctggtgtgaagcagcctc

SEQ ID NO: 7081033 - DNA, 22 bp, Homo sapiens
ggctgagccccctctgcgtagg

SEQ ID NO: 7081034 - DNA, 22 bp, Homo sapiens
ggctgagccccctctgcgtagg

SEQ ID NO: 7081035 - DNA, 22 bp, Homo sapiens
ggctctggtgtgaagcagcctc

SEQ ID NO: 7081036 - DNA, 22 bp, Homo sapiens
ggctctggtgggaaggttagat

SEQ ID NO: 7081037 - DNA, 22 bp, Homo sapiens
ggctctggtgggaaggttagat

SEQ ID NO: 7081038 - DNA, 22 bp, Homo sapiens
ggctctggtgggaaggttagat

SEQ ID NO: 7081039 - DNA, 22 bp, Homo sapiens
ggctctggtgccctggctccca

SEQ ID NO: 7081040 - DNA, 22 bp, Homo sapiens
ggctctggtgccctggctccca

SEQ ID NO: 7081041 - DNA, 22 bp, Homo sapiens
ggctctggtgccctggctccca

SEQ ID NO: 7081042 - DNA, 22 bp, Homo sapiens
ggctctggtgccctggctccca

SEQ ID NO: 7081043 - DNA, 22 bp, Homo sapiens
ggctctggtggcaattgactgg

SEQ ID NO: 7081044 - DNA, 22 bp, Homo sapiens
ggctctggtggcaattgactgg

SEQ ID NO: 7081045 - DNA, 22 bp, Homo sapiens
ggctctggtgggaaggttagat

SEQ ID NO: 7081046 - DNA, 22 bp, Homo sapiens
ggctctggtgagggtaggagat

SEQ ID NO: 7081047 - DNA, 22 bp, Homo sapiens
ggctctggtgccctggctccca

SEQ ID NO: 7081048 - DNA, 22 bp, Homo sapiens
ggctctggtgccctggctccca

SEQ ID NO: 7081049 - DNA, 22 bp, Homo sapiens
ggctctggtgagggtaggagat

SEQ ID NO: 7081050 - DNA, 22 bp, Homo sapiens
ggctctggtgagggtaggagat

SEQ ID NO: 7081051 - DNA, 22 bp, Homo sapiens
ggctctggtgagggtaggagat

SEQ ID NO: 7081052 - DNA, 22 bp, Homo sapiens
ggctctggtgagggtaggagat

SEQ ID NO: 7081053 - DNA, 22 bp, Homo sapiens
ggctctggtgagggtaggagat

SEQ ID NO: 7081054 - DNA, 22 bp, Homo sapiens
ggctgagcgtggctgccgtggg

SEQ ID NO: 7081055 - DNA, 22 bp, Homo sapiens
ggctgagcggactggggtccct

SEQ ID NO: 7081056 - DNA, 22 bp, Homo sapiens
ggctgagcggactggggtccct

SEQ ID NO: 7081057 - DNA, 22 bp, Homo sapiens
ggctgagctcaggggcagcagg

SEQ ID NO: 7081058 - DNA, 22 bp, Homo sapiens
ggctgagctcaggggcagcagg

SEQ ID NO: 7081059 - DNA, 22 bp, Homo sapiens
ggctgagcctggagcatctggt

SEQ ID NO: 7081060 - DNA, 22 bp, Homo sapiens
ggctgagcctggagcatctggt

SEQ ID NO: 7081061 - DNA, 22 bp, Homo sapiens
ggctgagcctggagcatctggt

SEQ ID NO: 7081062 - DNA, 19 bp, Homo sapiens
ggctgagcgccttggctgc

SEQ ID NO: 7081063 - DNA, 19 bp, Homo sapiens
ggctgagcgccttggctgc

SEQ ID NO: 7081064 - DNA, 19 bp, Homo sapiens
ggctgagcgccttggctgc

SEQ ID NO: 7081065 - DNA, 22 bp, Homo sapiens
ggctgaggcggcgatgcccttg

SEQ ID NO: 7081066 - DNA, 22 bp, Homo sapiens
ggctgaggcggcgatgcccttg

SEQ ID NO: 7081067 - DNA, 22 bp, Homo sapiens
ggctgaggcggcgatgcccttg

SEQ ID NO: 7081068 - DNA, 22 bp, Homo sapiens
ggctgagcttttcatgatggtt

SEQ ID NO: 7081069 - DNA, 22 bp, Homo sapiens
ggctgagcttttcatgatggtt

SEQ ID NO: 7081070 - DNA, 22 bp, Homo sapiens
ggctgagctcaggggcagcagg

SEQ ID NO: 7081071 - DNA, 22 bp, Homo sapiens
ggctgagctccaagtattccat

SEQ ID NO: 7081072 - DNA, 22 bp, Homo sapiens
ggctgaggcggcgatgcccttg

SEQ ID NO: 7081073 - DNA, 22 bp, Homo sapiens
ggctgaggctcatgccatcttg

SEQ ID NO: 7081074 - DNA, 22 bp, Homo sapiens
ggctgaggcggcgatgcccttg

SEQ ID NO: 7081075 - DNA, 22 bp, Homo sapiens
ggcctgaggcgtcccagctgtg

SEQ ID NO: 7081076 - DNA, 22 bp, Homo sapiens
ggcctgaggcgtcccagctgtg

SEQ ID NO: 7081077 - DNA, 22 bp, Homo sapiens
ggcctgaggcgtcccagctgtg

SEQ ID NO: 7081078 - DNA, 22 bp, Homo sapiens
ggcctgaggcgtcccagctgtg

SEQ ID NO: 7081079 - DNA, 22 bp, Homo sapiens
ggcctgggctccgggagttact

SEQ ID NO: 7081080 - DNA, 22 bp, Homo sapiens
ggcctgggctccgggagttact

SEQ ID NO: 7081081 - DNA, 22 bp, Homo sapiens
ggcctgaggccaccagcagccc

SEQ ID NO: 7081082 - DNA, 22 bp, Homo sapiens
ggcctgaggccaccagcagccc

SEQ ID NO: 7081083 - DNA, 22 bp, Homo sapiens
ggcctgaggccaccagcagccc

SEQ ID NO: 7081084 - DNA, 22 bp, Homo sapiens
ggcctgtccagcctgcctggct

SEQ ID NO: 7081085 - DNA, 22 bp, Homo sapiens
ggcctgtgagaatcaaggaaaa

SEQ ID NO: 7081086 - DNA, 22 bp, Homo sapiens
ggcctgtgagaatcaaggaaaa

SEQ ID NO: 7081087 - DNA, 22 bp, Homo sapiens
ggcctgtgagaatcaaggaaaa

SEQ ID NO: 7081088 - DNA, 22 bp, Homo sapiens
ggcctgtgagaatcaaggaaaa

SEQ ID NO: 7081089 - DNA, 22 bp, Homo sapiens
ggcctgtgagcccttgcatgta

SEQ ID NO: 7081090 - DNA, 22 bp, Homo sapiens
ggcctgtgagccttagtttata

SEQ ID NO: 7081091 - DNA, 22 bp, Homo sapiens
ggcctgtgcaagacagcacccc

SEQ ID NO: 7081092 - DNA, 22 bp, Homo sapiens
ggcctgtgcacatgtgcaggaa

SEQ ID NO: 7081093 - DNA, 22 bp, Homo sapiens
ggcctgtgcacatgtgcaggaa

SEQ ID NO: 7081094 - DNA, 22 bp, Homo sapiens
ggcctgtgcacatgtgcaggaa

SEQ ID NO: 7081095 - DNA, 22 bp, Homo sapiens
ggcctgtgcacatgtgcaggaa

SEQ ID NO: 7081096 - DNA, 22 bp, Homo sapiens
ggcctgaggcaatagtcagaca

SEQ ID NO: 7081097 - DNA, 22 bp, Homo sapiens
ggcctgaggcaatagtcagaca

SEQ ID NO: 7081098 - DNA, 22 bp, Homo sapiens
ggcctgaggcaatagtcagaca

SEQ ID NO: 7081099 - DNA, 19 bp, Homo sapiens
ggcctgaggccacagatcc

SEQ ID NO: 7081100 - DNA, 22 bp, Homo sapiens
ggcctgagctctggggaggcaa

SEQ ID NO: 7081101 - DNA, 22 bp, Homo sapiens
ggcctgagctctggggaggcaa

SEQ ID NO: 7081102 - DNA, 22 bp, Homo sapiens
ggcctgagctctggggaggcaa

SEQ ID NO: 7081103 - DNA, 22 bp, Homo sapiens
ggcctgagcttgggcagcgtat

SEQ ID NO: 7081104 - DNA, 22 bp, Homo sapiens
ggcctgagcttgggcagcgtat

SEQ ID NO: 7081105 - DNA, 22 bp, Homo sapiens
ggcctgagcagacagcatgatg

SEQ ID NO: 7081106 - DNA, 22 bp, Homo sapiens
ggcctgagcagacagcatgatg

SEQ ID NO: 7081107 - DNA, 20 bp, Homo sapiens
ggcctgagcatggctggcag

SEQ ID NO: 7081108 - DNA, 20 bp, Homo sapiens
ggcctgagcatggctggcag

SEQ ID NO: 7081109 - DNA, 20 bp, Homo sapiens
ggcctgagcatggctggcag

SEQ ID NO: 7081110 - DNA, 20 bp, Homo sapiens
ggcctgagcatggctggcag

SEQ ID NO: 7081111 - DNA, 22 bp, Homo sapiens
ggcctgagcagacagcatgatg

SEQ ID NO: 7081112 - DNA, 22 bp, Homo sapiens
ggcctgagcagacagcatgatg

SEQ ID NO: 7081113 - DNA, 22 bp, Homo sapiens
ggcctctctccctggcttgcag

SEQ ID NO: 7081114 - DNA, 22 bp, Homo sapiens
ggcctctctccttggcttgcag

SEQ ID NO: 7081115 - DNA, 21 bp, Homo sapiens
ggcctgagcacctgtccacct

SEQ ID NO: 7081116 - DNA, 22 bp, Homo sapiens
ggcctctctccttggcttgcag

SEQ ID NO: 7081117 - DNA, 22 bp, Homo sapiens
ggcctgtggtgcgctatttcag

SEQ ID NO: 7081118 - DNA, 22 bp, Homo sapiens
ggcctgtggtttctagtaggtt

SEQ ID NO: 7081119 - DNA, 22 bp, Homo sapiens
ggcctgtggtttctagtaggtt

SEQ ID NO: 7081120 - DNA, 22 bp, Homo sapiens
ggcctgtgggaggacagctggg

SEQ ID NO: 7081121 - DNA, 22 bp, Homo sapiens
ggcctgtgggaggacagctggg

SEQ ID NO: 7081122 - DNA, 22 bp, Homo sapiens
ggcctgtgggaggacagctggg

SEQ ID NO: 7081123 - DNA, 22 bp, Homo sapiens
ggcctgtggcaaggtgagaatg

SEQ ID NO: 7081124 - DNA, 22 bp, Homo sapiens
ggcctgtggcaaggtgagaatg

SEQ ID NO: 7081125 - DNA, 22 bp, Homo sapiens
ggcctgtggctttggcgtctaa

SEQ ID NO: 7081126 - DNA, 22 bp, Homo sapiens
ggcctgtggctttggcgtctaa

SEQ ID NO: 7081127 - DNA, 19 bp, Homo sapiens
ggcctgtgcagagcccgtc

SEQ ID NO: 7081128 - DNA, 19 bp, Homo sapiens
ggcctgtgcagagcccgtc

SEQ ID NO: 7081129 - DNA, 22 bp, Homo sapiens
ggcctgtgctgagaacctggct

SEQ ID NO: 7081130 - DNA, 22 bp, Homo sapiens
ggcctgtgctgagaacctggct

SEQ ID NO: 7081131 - DNA, 22 bp, Homo sapiens
ggcctgtgctgagaacctggct

SEQ ID NO: 7081132 - DNA, 22 bp, Homo sapiens
ggcctgtgctgtcagccctagt

SEQ ID NO: 7081133 - DNA, 22 bp, Homo sapiens
ggcctgtgctgtcagccctagt

SEQ ID NO: 7081134 - DNA, 22 bp, Homo sapiens
ggcctgtgctgtcagccctagt

SEQ ID NO: 7081135 - DNA, 22 bp, Homo sapiens
ggcctgtggatctgatgaacca

SEQ ID NO: 7081136 - DNA, 22 bp, Homo sapiens
ggcctgtggatctgatgaacca

SEQ ID NO: 7081137 - DNA, 22 bp, Homo sapiens
ggcctgtgtcctccttgccctg

SEQ ID NO: 7081138 - DNA, 22 bp, Homo sapiens
ggcctgtgtcctccttgccctg

SEQ ID NO: 7081139 - DNA, 22 bp, Homo sapiens
ggcctgtgtcggccccgggttc

SEQ ID NO: 7081140 - DNA, 22 bp, Homo sapiens
ggcctgtgtcggccccgggttc

SEQ ID NO: 7081141 - DNA, 22 bp, Homo sapiens
ggcctgtgtctgtgcctgtcct

SEQ ID NO: 7081142 - DNA, 22 bp, Homo sapiens
ggcctgtgtctgtgcctgtcct

SEQ ID NO: 7081143 - DNA, 17 bp, Homo sapiens
ggcctgtgtggctgcag

SEQ ID NO: 7081144 - DNA, 17 bp, Homo sapiens
ggcctgtgtggctgcag

SEQ ID NO: 7081145 - DNA, 17 bp, Homo sapiens
ggcctgtgtggctgcag

SEQ ID NO: 7081146 - DNA, 22 bp, Homo sapiens
ggctcaatgcaacttctgcctc

SEQ ID NO: 7081147 - DNA, 22 bp, Homo sapiens
ggctcaggctggagtgcagtgg

SEQ ID NO: 7081148 - DNA, 22 bp, Homo sapiens
ggctcaggctggagtgcagtgg

SEQ ID NO: 7081149 - DNA, 22 bp, Homo sapiens
ggctcagggaatgaggaagaat

SEQ ID NO: 7081150 - DNA, 22 bp, Homo sapiens
ggctcacacatgactgggctct

SEQ ID NO: 7081151 - DNA, 18 bp, Homo sapiens
ggctcaggctatcctaac

SEQ ID NO: 7081152 - DNA, 18 bp, Homo sapiens
ggctcaggctatcctaac

SEQ ID NO: 7081153 - DNA, 22 bp, Homo sapiens
ggctcaggctggagtgcagtgg

SEQ ID NO: 7081154 - DNA, 22 bp, Homo sapiens
ggctcagggaatgaggaagaat

SEQ ID NO: 7081155 - DNA, 19 bp, Homo sapiens
ggctcagggcgctgccgcc

SEQ ID NO: 7081156 - DNA, 19 bp, Homo sapiens
ggctcagggcgctgccgcc

SEQ ID NO: 7081157 - DNA, 22 bp, Homo sapiens
ggctcagggaatgaggaagaat

SEQ ID NO: 7081158 - DNA, 22 bp, Homo sapiens
ggctcagggaatgaggaagaat

SEQ ID NO: 7081159 - DNA, 22 bp, Homo sapiens
ggctcaggggccaggcctgtcc

SEQ ID NO: 7081160 - DNA, 22 bp, Homo sapiens
ggctcaggggccaggcctgtcc

SEQ ID NO: 7081161 - DNA, 22 bp, Homo sapiens
ggctcaggggccaggcctgtcc

SEQ ID NO: 7081162 - DNA, 19 bp, Homo sapiens
ggctcagggcgctgccgcc

SEQ ID NO: 7081163 - DNA, 22 bp, Homo sapiens
cacagactccccgccatagtgg

SEQ ID NO: 7081164 - DNA, 22 bp, Homo sapiens
cacagactccccgccatagtgg

SEQ ID NO: 7081165 - DNA, 20 bp, Homo sapiens
cacagactgtatgggcacca

SEQ ID NO: 7081166 - DNA, 20 bp, Homo sapiens
cacagactgtatgggcacca

SEQ ID NO: 7081167 - DNA, 22 bp, Homo sapiens
cacagaattttctctttacaat

SEQ ID NO: 7081168 - DNA, 22 bp, Homo sapiens
cacagacagtgtccctttgttg

SEQ ID NO: 7081169 - DNA, 22 bp, Homo sapiens
cacagaattaagggagaaatat

SEQ ID NO: 7081170 - DNA, 22 bp, Homo sapiens
cacagaattaagggagaaatat

SEQ ID NO: 7081171 - DNA, 22 bp, Homo sapiens
ggactgggagaatggaggcaag

SEQ ID NO: 7081172 - DNA, 22 bp, Homo sapiens
ggactgggagaatggaggcaag

SEQ ID NO: 7081173 - DNA, 22 bp, Homo sapiens
ggactgggagaatggaggcaag

SEQ ID NO: 7081174 - DNA, 22 bp, Homo sapiens
ggactgggagaatggaggcaag

SEQ ID NO: 7081175 - DNA, 22 bp, Homo sapiens
ggactgggagaatggaggcaag

SEQ ID NO: 7081176 - DNA, 22 bp, Homo sapiens
ggactgggagaatggaggcaag

SEQ ID NO: 7081177 - DNA, 22 bp, Homo sapiens
ggactgggagaatggaggcaag

SEQ ID NO: 7081178 - DNA, 22 bp, Homo sapiens
ggactgggagaatggaggcaag

SEQ ID NO: 7081179 - DNA, 22 bp, Homo sapiens
cacagagaaaatgttggtgctt

SEQ ID NO: 7081180 - DNA, 22 bp, Homo sapiens
cacagagaaaatgttggtgctt

SEQ ID NO: 7081181 - DNA, 22 bp, Homo sapiens
cacagagaactgtgggagtgtg

SEQ ID NO: 7081182 - DNA, 22 bp, Homo sapiens
cacagacttgagaagcacctta

SEQ ID NO: 7081183 - DNA, 22 bp, Homo sapiens
cacagagaaaatgttggtgctt

SEQ ID NO: 7081184 - DNA, 22 bp, Homo sapiens
cacagagaaaatgttggtgctt

SEQ ID NO: 7081185 - DNA, 22 bp, Homo sapiens
ggactgggattctggatctgct

SEQ ID NO: 7081186 - DNA, 22 bp, Homo sapiens
ggactgggattctggatctgct

SEQ ID NO: 7081187 - DNA, 22 bp, Homo sapiens
ggactgggcatgggtgctctgc

SEQ ID NO: 7081188 - DNA, 22 bp, Homo sapiens
ggactgggcatgggtgctctgc

SEQ ID NO: 7081189 - DNA, 22 bp, Homo sapiens
ggactgggcatgggtgctctgc

SEQ ID NO: 7081190 - DNA, 22 bp, Homo sapiens
ggactgggccaggggttggact

SEQ ID NO: 7081191 - DNA, 22 bp, Homo sapiens
ggactgggccaggggttggact

SEQ ID NO: 7081192 - DNA, 22 bp, Homo sapiens
ggactgggccaggggttggact

SEQ ID NO: 7081193 - DNA, 17 bp, Homo sapiens
ggactgggcggggcagg

SEQ ID NO: 7081194 - DNA, 17 bp, Homo sapiens
ggactgggcggggcagg

SEQ ID NO: 7081195 - DNA, 17 bp, Homo sapiens
ggactgggcggggcagg

SEQ ID NO: 7081196 - DNA, 22 bp, Homo sapiens
ggactgggccaggggttggact

SEQ ID NO: 7081197 - DNA, 22 bp, Homo sapiens
ggactgggccaggggttggact

SEQ ID NO: 7081198 - DNA, 22 bp, Homo sapiens
ggactgggtaggagcccagggc

SEQ ID NO: 7081199 - DNA, 22 bp, Homo sapiens
ggactgggtaggagcccagggc

SEQ ID NO: 7081200 - DNA, 22 bp, Homo sapiens
ggactggggccaacacctccct

SEQ ID NO: 7081201 - DNA, 22 bp, Homo sapiens
cacagagaccccttctggggcc

SEQ ID NO: 7081202 - DNA, 22 bp, Homo sapiens
cacagagaccccttctggggcc

SEQ ID NO: 7081203 - DNA, 22 bp, Homo sapiens
cacagagagctacgtgcagcgt

SEQ ID NO: 7081204 - DNA, 22 bp, Homo sapiens
cacagagagctacgtgcagcgt

SEQ ID NO: 7081205 - DNA, 22 bp, Homo sapiens
cacagagagctacgtgcagcgt

SEQ ID NO: 7081206 - DNA, 22 bp, Homo sapiens
cacagaggaaatgactttctta

SEQ ID NO: 7081207 - DNA, 22 bp, Homo sapiens
cacagaggaaatgactttctta

SEQ ID NO: 7081208 - DNA, 22 bp, Homo sapiens
cacagaggaatgcatcagcaga

SEQ ID NO: 7081209 - DNA, 22 bp, Homo sapiens
cacagaggactgtagcggggag

SEQ ID NO: 7081210 - DNA, 22 bp, Homo sapiens
cacagaggactgtagcggggag

SEQ ID NO: 7081211 - DNA, 22 bp, Homo sapiens
cacagaggagtgcacactctct

SEQ ID NO: 7081212 - DNA, 22 bp, Homo sapiens
cacagagagctacgtgcagcgt

SEQ ID NO: 7081213 - DNA, 22 bp, Homo sapiens
cacagagagctacgtgcagcgt

SEQ ID NO: 7081214 - DNA, 22 bp, Homo sapiens
cacagagagctacgtgcagcgt

SEQ ID NO: 7081215 - DNA, 22 bp, Homo sapiens
cacagagctgaacctgggtcat

SEQ ID NO: 7081216 - DNA, 22 bp, Homo sapiens
cacagagctggaaaggctgggc

SEQ ID NO: 7081217 - DNA, 22 bp, Homo sapiens
cacagagctggaaaggctgggc

SEQ ID NO: 7081218 - DNA, 22 bp, Homo sapiens
cacagagctggaaaggctgggc

SEQ ID NO: 7081219 - DNA, 22 bp, Homo sapiens
cacagaggaaaggcagttggta

SEQ ID NO: 7081220 - DNA, 22 bp, Homo sapiens
cacagaggaaaggcagttggta

SEQ ID NO: 7081221 - DNA, 22 bp, Homo sapiens
cacagaggctcaaagccaggtg

SEQ ID NO: 7081222 - DNA, 22 bp, Homo sapiens
cacagaggcggaaaattctgaa

SEQ ID NO: 7081223 - DNA, 22 bp, Homo sapiens
cacagaggctcaaagccaggtg

SEQ ID NO: 7081224 - DNA, 22 bp, Homo sapiens
cacagaggcatgaccctgccct

SEQ ID NO: 7081225 - DNA, 22 bp, Homo sapiens
cacagaggcatgaccctgccct

SEQ ID NO: 7081226 - DNA, 21 bp, Homo sapiens
cacagaggcgctgtatggctg

SEQ ID NO: 7081227 - DNA, 22 bp, Homo sapiens
cacagaggatgcccaagcgatc

SEQ ID NO: 7081228 - DNA, 22 bp, Homo sapiens
cacagaggatgcccaagcgatc

SEQ ID NO: 7081229 - DNA, 22 bp, Homo sapiens
cacagaggatgcccaagcgatc

SEQ ID NO: 7081230 - DNA, 22 bp, Homo sapiens
cacagaggatgcccaagcgatc

SEQ ID NO: 7081231 - DNA, 22 bp, Homo sapiens
cacagaggatgcccaagcgatc

SEQ ID NO: 7081232 - DNA, 22 bp, Homo sapiens
cacagaggatttttagggcagt

SEQ ID NO: 7081233 - DNA, 22 bp, Homo sapiens
cacagaggatttttagggcagt

SEQ ID NO: 7081234 - DNA, 22 bp, Homo sapiens
cacagaggatttttagggcagt

SEQ ID NO: 7081235 - DNA, 22 bp, Homo sapiens
cacagaggatttttagggcagt

SEQ ID NO: 7081236 - DNA, 22 bp, Homo sapiens
cacagaggatttttagggcagt

SEQ ID NO: 7081237 - DNA, 22 bp, Homo sapiens
cacagaggcaaccttctggggt

SEQ ID NO: 7081238 - DNA, 22 bp, Homo sapiens
ggaagggcctcgggcgtgggac

SEQ ID NO: 7081239 - DNA, 22 bp, Homo sapiens
ggaagggcctcgggcgtgggac

SEQ ID NO: 7081240 - DNA, 22 bp, Homo sapiens
ggaagggcctcgggcgtgggac

SEQ ID NO: 7081241 - DNA, 22 bp, Homo sapiens
ggaagggcctcgggcgtgggac

SEQ ID NO: 7081242 - DNA, 21 bp, Homo sapiens
cacacagctgcccttaggtag

SEQ ID NO: 7081243 - DNA, 21 bp, Homo sapiens
cacacagctgcccttaggtag

SEQ ID NO: 7081244 - DNA, 22 bp, Homo sapiens
cacacaggaaaattggaattaa

SEQ ID NO: 7081245 - DNA, 22 bp, Homo sapiens
cacacaggagagtgctggaggt

SEQ ID NO: 7081246 - DNA, 22 bp, Homo sapiens
cacacaggagagtgctggaggt

SEQ ID NO: 7081247 - DNA, 22 bp, Homo sapiens
cacacagcaacaagaatagcca

SEQ ID NO: 7081248 - DNA, 22 bp, Homo sapiens
cacacagctagtgacaggagaa

SEQ ID NO: 7081249 - DNA, 22 bp, Homo sapiens
cacacagctagtgacaggagaa

SEQ ID NO: 7081250 - DNA, 22 bp, Homo sapiens
cacacagctagtgacaggagaa

SEQ ID NO: 7081251 - DNA, 22 bp, Homo sapiens
cacacagctagtgacaggagaa

SEQ ID NO: 7081252 - DNA, 22 bp, Homo sapiens
cacacagctagtgacaggagaa

SEQ ID NO: 7081253 - DNA, 22 bp, Homo sapiens
cacacagctagtgacaggagaa

SEQ ID NO: 7081254 - DNA, 22 bp, Homo sapiens
cacacagctagtgacaggagaa

SEQ ID NO: 7081255 - DNA, 22 bp, Homo sapiens
cacacagctagtgacaggagaa

SEQ ID NO: 7081256 - DNA, 22 bp, Homo sapiens
cacacagctcaggggcactgcc

SEQ ID NO: 7081257 - DNA, 22 bp, Homo sapiens
cacacagctcaggggcactgcc

SEQ ID NO: 7081258 - DNA, 22 bp, Homo sapiens
cacacagctcaggggcactgcc

SEQ ID NO: 7081259 - DNA, 22 bp, Homo sapiens
cacacagctcaggggcactgcc

SEQ ID NO: 7081260 - DNA, 22 bp, Homo sapiens
cacacagctcaggggcactgcc

SEQ ID NO: 7081261 - DNA, 22 bp, Homo sapiens
cacacagatggtaagggaggga

SEQ ID NO: 7081262 - DNA, 22 bp, Homo sapiens
cacacagatggtaagggaggga

SEQ ID NO: 7081263 - DNA, 22 bp, Homo sapiens
cacacagacagctctctgaaga

SEQ ID NO: 7081264 - DNA, 22 bp, Homo sapiens
cacacagacagctctctgaaga

SEQ ID NO: 7081265 - DNA, 22 bp, Homo sapiens
cacacagacagctctctgaaga

SEQ ID NO: 7081266 - DNA, 22 bp, Homo sapiens
cacaattttaatacacagtcaa

SEQ ID NO: 7081267 - DNA, 22 bp, Homo sapiens
caatgtttgtgatctactgact

SEQ ID NO: 7081268 - DNA, 22 bp, Homo sapiens
caatgtttgtgatctactgact

SEQ ID NO: 7081269 - DNA, 22 bp, Homo sapiens
caatgtttgttagagctctaga

SEQ ID NO: 7081270 - DNA, 22 bp, Homo sapiens
caatgtttgttagagctctaga

SEQ ID NO: 7081271 - DNA, 22 bp, Homo sapiens
caatgtttgttagagctctaga

SEQ ID NO: 7081272 - DNA, 18 bp, Homo sapiens
caatgttttagatctcta

SEQ ID NO: 7081273 - DNA, 18 bp, Homo sapiens
caatgttttagatctcta

SEQ ID NO: 7081274 - DNA, 22 bp, Homo sapiens
caatgttttcaactgacaagta

SEQ ID NO: 7081275 - DNA, 22 bp, Homo sapiens
cacagaagtgtgtataactctt

SEQ ID NO: 7081276 - DNA, 22 bp, Homo sapiens
cacagaagaatcatgctgtgtt

SEQ ID NO: 7081277 - DNA, 22 bp, Homo sapiens
cacagaactggttaatagcaga

SEQ ID NO: 7081278 - DNA, 20 bp, Homo sapiens
ggaaggggcaaagtgtgtga

SEQ ID NO: 7081279 - DNA, 22 bp, Homo sapiens
cacactgtccccttctccccag

SEQ ID NO: 7081280 - DNA, 22 bp, Homo sapiens
cacactgtctttatgagctgta

SEQ ID NO: 7081281 - DNA, 22 bp, Homo sapiens
cacactgtctttcagaatggtt

SEQ ID NO: 7081282 - DNA, 22 bp, Homo sapiens
cacactgttgaggacgagatgt

SEQ ID NO: 7081283 - DNA, 22 bp, Homo sapiens
cacagaataattcacatggctc

SEQ ID NO: 7081284 - DNA, 22 bp, Homo sapiens
cacagaataattcacatggctc

SEQ ID NO: 7081285 - DNA, 22 bp, Homo sapiens
cacagaagtttcatagtctcga

SEQ ID NO: 7081286 - DNA, 22 bp, Homo sapiens
cacagaagtttcatagtctcga

SEQ ID NO: 7081287 - DNA, 22 bp, Homo sapiens
cacagaatcatattgtcagttt

SEQ ID NO: 7081288 - DNA, 22 bp, Homo sapiens
cacagaatggaccagttttaga

SEQ ID NO: 7081289 - DNA, 22 bp, Homo sapiens
ggaaggggagctaaatctactg

SEQ ID NO: 7081290 - DNA, 22 bp, Homo sapiens
ggaaggggagctaaatctactg

SEQ ID NO: 7081291 - DNA, 21 bp, Homo sapiens
ggaagggctctgaggacggct

SEQ ID NO: 7081292 - DNA, 21 bp, Homo sapiens
ggaagggctctgaggacggct

SEQ ID NO: 7081293 - DNA, 21 bp, Homo sapiens
ggaagggctctgaggacggct

SEQ ID NO: 7081294 - DNA, 22 bp, Homo sapiens
ggaagggcctcgggcgtgggac

SEQ ID NO: 7081295 - DNA, 22 bp, Homo sapiens
ggaaggggagctggaaagggta

SEQ ID NO: 7081296 - DNA, 22 bp, Homo sapiens
ggaaggggagctggaaagggta

SEQ ID NO: 7081297 - DNA, 22 bp, Homo sapiens
ggaaggggagctggaaagggta

SEQ ID NO: 7081298 - DNA, 22 bp, Homo sapiens
ggaaggggagctaaatctactg

SEQ ID NO: 7081299 - DNA, 22 bp, Homo sapiens
ggaaggggagctaaatctactg

SEQ ID NO: 7081300 - DNA, 22 bp, Homo sapiens
ggaaggggagctggaaagggta

SEQ ID NO: 7081301 - DNA, 20 bp, Homo sapiens
ggaaggggcaaagtgtgtga

SEQ ID NO: 7081302 - DNA, 20 bp, Homo sapiens
ggaaggggcaaagtgtgtga

SEQ ID NO: 7081303 - DNA, 20 bp, Homo sapiens
ggaaggggcaaagtgtgtga

SEQ ID NO: 7081304 - DNA, 22 bp, Homo sapiens
ggaaggggagctggaaagggta

SEQ ID NO: 7081305 - DNA, 22 bp, Homo sapiens
ggaaggggagctggaaagggta

SEQ ID NO: 7081306 - DNA, 22 bp, Homo sapiens
ggaaggggagctggaaagggta

SEQ ID NO: 7081307 - DNA, 22 bp, Homo sapiens
ggaaggggagctggaaagggta

SEQ ID NO: 7081308 - DNA, 22 bp, Homo sapiens
ggaaggggagctggaaagggta

SEQ ID NO: 7081309 - DNA, 22 bp, Homo sapiens
ggaaggggagctggaaagggta

SEQ ID NO: 7081310 - DNA, 22 bp, Homo sapiens
ggagctggaatatattgaaacc

SEQ ID NO: 7081311 - DNA, 23 bp, Homo sapiens
ggagctggacccttacacctttc

SEQ ID NO: 7081312 - DNA, 22 bp, Homo sapiens
ggagctggaatatattgaaacc

SEQ ID NO: 7081313 - DNA, 23 bp, Homo sapiens
ggagctgctgttgggggagctgc

SEQ ID NO: 7081314 - DNA, 22 bp, Homo sapiens
ggagctgcttcttgctgtgggt

SEQ ID NO: 7081315 - DNA, 22 bp, Homo sapiens
ggagctggagagtacagagttt

SEQ ID NO: 7081316 - DNA, 22 bp, Homo sapiens
ggagctggagagtacagagttt

SEQ ID NO: 7081317 - DNA, 22 bp, Homo sapiens
ggagctggagagctagcctagg

SEQ ID NO: 7081318 - DNA, 22 bp, Homo sapiens
ggagctggagagctagcctagg

SEQ ID NO: 7081319 - DNA, 23 bp, Homo sapiens
ggagctggacccttacacctttc

SEQ ID NO: 7081320 - DNA, 22 bp, Homo sapiens
ggagctggcagcgcaacccaga

SEQ ID NO: 7081321 - DNA, 22 bp, Homo sapiens
ggagctggcagcgcaacccaga

SEQ ID NO: 7081322 - DNA, 22 bp, Homo sapiens
ggagctggagagctagcctagg

SEQ ID NO: 7081323 - DNA, 22 bp, Homo sapiens
ggagctggagagtacagagttt

SEQ ID NO: 7081324 - DNA, 20 bp, Homo sapiens
ggagctggcatccagcctct

SEQ ID NO: 7081325 - DNA, 20 bp, Homo sapiens
ggagctggcatccagcctct

SEQ ID NO: 7081326 - DNA, 20 bp, Homo sapiens
ggagctggcatccagcctct

SEQ ID NO: 7081327 - DNA, 22 bp, Homo sapiens
ggagcctgaaaagtctgcattt

SEQ ID NO: 7081328 - DNA, 22 bp, Homo sapiens
ggagcctgacagtgcccagcat

SEQ ID NO: 7081329 - DNA, 22 bp, Homo sapiens
ggagcctgacagtgcccagcat

SEQ ID NO: 7081330 - DNA, 22 bp, Homo sapiens
ggagcctgacagtgcccagcat

SEQ ID NO: 7081331 - DNA, 22 bp, Homo sapiens
ggagcctgacagtgcccagcat

SEQ ID NO: 7081332 - DNA, 22 bp, Homo sapiens
ggagcctgagcggcccagggcc

SEQ ID NO: 7081333 - DNA, 22 bp, Homo sapiens
ggagcctgagggccctcttgga

SEQ ID NO: 7081334 - DNA, 22 bp, Homo sapiens
ggagcctgagggccctcttgga

SEQ ID NO: 7081335 - DNA, 22 bp, Homo sapiens
ggagcctgcgggagctcccatt

SEQ ID NO: 7081336 - DNA, 22 bp, Homo sapiens
ggagcctgcgggagctcccatt

SEQ ID NO: 7081337 - DNA, 19 bp, Homo sapiens
ggagcctggagcacgtgcc

SEQ ID NO: 7081338 - DNA, 22 bp, Homo sapiens
ggagctgctccttcagccaagt

SEQ ID NO: 7081339 - DNA, 23 bp, Homo sapiens
ggagctgctgttgggggagctgc

SEQ ID NO: 7081340 - DNA, 22 bp, Homo sapiens
ggagccggagggccactggcag

SEQ ID NO: 7081341 - DNA, 19 bp, Homo sapiens
ggagccgccgcccttcatt

SEQ ID NO: 7081342 - DNA, 19 bp, Homo sapiens
ggagccgccgcccttcatt

SEQ ID NO: 7081343 - DNA, 19 bp, Homo sapiens
ggagccgccgcccttcatt

SEQ ID NO: 7081344 - DNA, 22 bp, Homo sapiens
cacagattatgagacgagatac

SEQ ID NO: 7081345 - DNA, 22 bp, Homo sapiens
cacagatttcctaagcatcaat

SEQ ID NO: 7081346 - DNA, 22 bp, Homo sapiens
cacagatttctggtcttcaccc

SEQ ID NO: 7081347 - DNA, 22 bp, Homo sapiens
ggagcaggcagggccgtgtctg

SEQ ID NO: 7081348 - DNA, 22 bp, Homo sapiens
ggagcaggcagggccgtgtctg

SEQ ID NO: 7081349 - DNA, 22 bp, Homo sapiens
ggagccctgccctaggcagctc

SEQ ID NO: 7081350 - DNA, 22 bp, Homo sapiens
ggagccctgccctaggcagctc

SEQ ID NO: 7081351 - DNA, 22 bp, Homo sapiens
cacagaggtgatagtggtcaag

SEQ ID NO: 7081352 - DNA, 22 bp, Homo sapiens
cacagaggtgatagtggtcaag

SEQ ID NO: 7081353 - DNA, 22 bp, Homo sapiens
cacagaggtgatagtggtcaag

SEQ ID NO: 7081354 - DNA, 22 bp, Homo sapiens
cacagaggtctgggcccagcag

SEQ ID NO: 7081355 - DNA, 20 bp, Homo sapiens
cacagagtcttgcagcgttc

SEQ ID NO: 7081356 - DNA, 22 bp, Homo sapiens
cacagagtggaggcttggcctg

SEQ ID NO: 7081357 - DNA, 22 bp, Homo sapiens
cacagagttgaatattgacatt

SEQ ID NO: 7081358 - DNA, 22 bp, Homo sapiens
cacagagttgaatattgacatt

SEQ ID NO: 7081359 - DNA, 22 bp, Homo sapiens
cacagataaggatgttaatttt

SEQ ID NO: 7081360 - DNA, 22 bp, Homo sapiens
cacagatacctagtgaaacata

SEQ ID NO: 7081361 - DNA, 22 bp, Homo sapiens
cacagatagaccttatgagatt

SEQ ID NO: 7081362 - DNA, 19 bp, Homo sapiens
cacagatgattgacacata

SEQ ID NO: 7081363 - DNA, 19 bp, Homo sapiens
cacagatgattgacacata

SEQ ID NO: 7081364 - DNA, 20 bp, Homo sapiens
cacagatgggacaggaaagg

SEQ ID NO: 7081365 - DNA, 22 bp, Homo sapiens
cacaggcttttctgacataggc

SEQ ID NO: 7081366 - DNA, 22 bp, Homo sapiens
cacaggcttttctgacataggc

SEQ ID NO: 7081367 - DNA, 22 bp, Homo sapiens
cacaggcttgtcagcatgaggc

SEQ ID NO: 7081368 - DNA, 22 bp, Homo sapiens
cacaggcttgtcagcatgaggc

SEQ ID NO: 7081369 - DNA, 22 bp, Homo sapiens
cacaggcttgtcagcatgaggc

SEQ ID NO: 7081370 - DNA, 22 bp, Homo sapiens
cacaggcttgtcagcatgaggc

SEQ ID NO: 7081371 - DNA, 22 bp, Homo sapiens
cacaggcttgtcagcatgaggc

SEQ ID NO: 7081372 - DNA, 22 bp, Homo sapiens
cacaggcttgtcagcatgaggc

SEQ ID NO: 7081373 - DNA, 22 bp, Homo sapiens
cacaggcttgtcagcatgaggc

SEQ ID NO: 7081374 - DNA, 22 bp, Homo sapiens
cacaggcttgtcagcatgaggc

SEQ ID NO: 7081375 - DNA, 21 bp, Homo sapiens
cacaggcttctatacacaatg

SEQ ID NO: 7081376 - DNA, 22 bp, Homo sapiens
cacaggcttccagtccccagct

SEQ ID NO: 7081377 - DNA, 20 bp, Homo sapiens
cacaggcttacagtttagat

SEQ ID NO: 7081378 - DNA, 22 bp, Homo sapiens
cacaggcttccagtccccagct

SEQ ID NO: 7081379 - DNA, 22 bp, Homo sapiens
cacaggctgggaagcctaggcc

SEQ ID NO: 7081380 - DNA, 22 bp, Homo sapiens
cacaggctgggaagcctaggcc

SEQ ID NO: 7081381 - DNA, 23 bp, Homo sapiens
cacaggctgcgcataagcttctc

SEQ ID NO: 7081382 - DNA, 20 bp, Homo sapiens
cacaggctatatgagagcca

SEQ ID NO: 7081383 - DNA, 20 bp, Homo sapiens
cacaggccttgtgagcagac

SEQ ID NO: 7081384 - DNA, 20 bp, Homo sapiens
cacaggctatatgagagcca

SEQ ID NO: 7081385 - DNA, 20 bp, Homo sapiens
cacaggccttgtgagcagac

SEQ ID NO: 7081386 - DNA, 22 bp, Homo sapiens
ggaggccaaggcaggcggatca

SEQ ID NO: 7081387 - DNA, 22 bp, Homo sapiens
ggaggccaaggcaggcggatca

SEQ ID NO: 7081388 - DNA, 22 bp, Homo sapiens
ggaggccaaggaggagcttgcc

SEQ ID NO: 7081389 - DNA, 22 bp, Homo sapiens
ggaggccaaggaggagcttgcc

SEQ ID NO: 7081390 - DNA, 22 bp, Homo sapiens
ggaggccaaggagggcggatca

SEQ ID NO: 7081391 - DNA, 22 bp, Homo sapiens
ggaggccaaggagggcggatca

SEQ ID NO: 7081392 - DNA, 22 bp, Homo sapiens
ggaggcattatggggaagactt

SEQ ID NO: 7081393 - DNA, 22 bp, Homo sapiens
ggaggcaggaaagacaggttca

SEQ ID NO: 7081394 - DNA, 22 bp, Homo sapiens
ggaggccaaagtgtgggcggct

SEQ ID NO: 7081395 - DNA, 22 bp, Homo sapiens
ggaggccaaagtgtgggcggct

SEQ ID NO: 7081396 - DNA, 22 bp, Homo sapiens
ggaggccaaggaggagcttgcc

SEQ ID NO: 7081397 - DNA, 22 bp, Homo sapiens
cacagctttgctttccttaata

SEQ ID NO: 7081398 - DNA, 22 bp, Homo sapiens
cacaggaaaaatgggtccttta

SEQ ID NO: 7081399 - DNA, 22 bp, Homo sapiens
cacagctttgctttccttaata

SEQ ID NO: 7081400 - DNA, 22 bp, Homo sapiens
cacaggaagtggtcagtgccag

SEQ ID NO: 7081401 - DNA, 22 bp, Homo sapiens
cacaggaagtggtcagtgccag

SEQ ID NO: 7081402 - DNA, 22 bp, Homo sapiens
cacaggaagtggtcagtgccag

SEQ ID NO: 7081403 - DNA, 22 bp, Homo sapiens
cacaggaagtggtcagtgccag

SEQ ID NO: 7081404 - DNA, 22 bp, Homo sapiens
cacaggaatcagcattaatggc

SEQ ID NO: 7081405 - DNA, 22 bp, Homo sapiens
cacaggaatcgtcacttagcgc

SEQ ID NO: 7081406 - DNA, 22 bp, Homo sapiens
cacaggaatcgtcacttagcgc

SEQ ID NO: 7081407 - DNA, 22 bp, Homo sapiens
cacaggaataagtcaaacttca

SEQ ID NO: 7081408 - DNA, 22 bp, Homo sapiens
cacaggactcgactgcagacag

SEQ ID NO: 7081409 - DNA, 22 bp, Homo sapiens
cacaggactcgactgcagacag

SEQ ID NO: 7081410 - DNA, 22 bp, Homo sapiens
cacaggactcgactgcagacag

SEQ ID NO: 7081411 - DNA, 22 bp, Homo sapiens
cacaggactcgactgcagacag

SEQ ID NO: 7081412 - DNA, 22 bp, Homo sapiens
cacaggaattagcagcctaaaa

SEQ ID NO: 7081413 - DNA, 22 bp, Homo sapiens
cacaggaccaattcacattcca

SEQ ID NO: 7081414 - DNA, 22 bp, Homo sapiens
cacaggaatgaacagggaaaga

SEQ ID NO: 7081415 - DNA, 22 bp, Homo sapiens
cacaggaatgaacagggaaaga

SEQ ID NO: 7081416 - DNA, 22 bp, Homo sapiens
cacaggaatgaacagggaaaga

SEQ ID NO: 7081417 - DNA, 22 bp, Homo sapiens
cacaggaatgaacagggaaaga

SEQ ID NO: 7081418 - DNA, 22 bp, Homo sapiens
ggaggcagaatagagtgtgggt

SEQ ID NO: 7081419 - DNA, 22 bp, Homo sapiens
ggaggcagaatagagtgtgggt

SEQ ID NO: 7081420 - DNA, 22 bp, Homo sapiens
cacaggactcgactgcagacag

SEQ ID NO: 7081421 - DNA, 22 bp, Homo sapiens
ggaggcagaatagagtgtgggt

SEQ ID NO: 7081422 - DNA, 22 bp, Homo sapiens
ggaggcagaatagagtgtgggt

SEQ ID NO: 7081423 - DNA, 22 bp, Homo sapiens
ggaggcagaatagagtgtgggt

SEQ ID NO: 7081424 - DNA, 22 bp, Homo sapiens
ggaggcaggaaagacaggttca

SEQ ID NO: 7081425 - DNA, 22 bp, Homo sapiens
ggaggcaggaaagacaggttca

SEQ ID NO: 7081426 - DNA, 22 bp, Homo sapiens
caaggccactccagagactggt

SEQ ID NO: 7081427 - DNA, 22 bp, Homo sapiens
caaggccacgttctgcatgcgg

SEQ ID NO: 7081428 - DNA, 22 bp, Homo sapiens
caaggccacgttctgcatgcgg

SEQ ID NO: 7081429 - DNA, 22 bp, Homo sapiens
caaggccactccagagactggt

SEQ ID NO: 7081430 - DNA, 22 bp, Homo sapiens
caaggccactgctcaggtttcc

SEQ ID NO: 7081431 - DNA, 22 bp, Homo sapiens
caaggcaggaagcctgtcttat

SEQ ID NO: 7081432 - DNA, 22 bp, Homo sapiens
caaggcaggaagcctgtcttat

SEQ ID NO: 7081433 - DNA, 22 bp, Homo sapiens
caaggccaaggttttgtgaact

SEQ ID NO: 7081434 - DNA, 22 bp, Homo sapiens
caaggccaagtctctgtgaaga

SEQ ID NO: 7081435 - DNA, 22 bp, Homo sapiens
caaggccaagtctctgtgaaga

SEQ ID NO: 7081436 - DNA, 19 bp, Homo sapiens
caaggccaccatttctccg

SEQ ID NO: 7081437 - DNA, 22 bp, Homo sapiens
gctggaggatggactggaagaa

SEQ ID NO: 7081438 - DNA, 22 bp, Homo sapiens
gctggaggcagttcagacacca

SEQ ID NO: 7081439 - DNA, 22 bp, Homo sapiens
gctggaggcagttcagacacca

SEQ ID NO: 7081440 - DNA, 22 bp, Homo sapiens
gctggaggcagttcagacacca

SEQ ID NO: 7081441 - DNA, 22 bp, Homo sapiens
gctggaggcagttcagacacca

SEQ ID NO: 7081442 - DNA, 22 bp, Homo sapiens
gctggaggcagttcagacacca

SEQ ID NO: 7081443 - DNA, 22 bp, Homo sapiens
gctggaggcagttcagacacca

SEQ ID NO: 7081444 - DNA, 22 bp, Homo sapiens
gctggaggctggagtgcagtgg

SEQ ID NO: 7081445 - DNA, 22 bp, Homo sapiens
gctggaggctggagtgcagtgg

SEQ ID NO: 7081446 - DNA, 22 bp, Homo sapiens
gctggaggctggagtgcagtgg

SEQ ID NO: 7081447 - DNA, 22 bp, Homo sapiens
gctggaggctggagtgcagtgg

SEQ ID NO: 7081448 - DNA, 22 bp, Homo sapiens
caaggcagcttaatagaatttg

SEQ ID NO: 7081449 - DNA, 22 bp, Homo sapiens
caaggcagcttaatagaatttg

SEQ ID NO: 7081450 - DNA, 22 bp, Homo sapiens
caaggcagcttaatagaatttg

SEQ ID NO: 7081451 - DNA, 22 bp, Homo sapiens
caaggcctaatcatactgctaa

SEQ ID NO: 7081452 - DNA, 22 bp, Homo sapiens
caaggccatgagcagcgagtgt

SEQ ID NO: 7081453 - DNA, 22 bp, Homo sapiens
caaggccctgcaacctgacttg

SEQ ID NO: 7081454 - DNA, 22 bp, Homo sapiens
caaggccatattgcctgtatgt

SEQ ID NO: 7081455 - DNA, 22 bp, Homo sapiens
caaggccatgagcagcgagtgt

SEQ ID NO: 7081456 - DNA, 22 bp, Homo sapiens
caaggcctatgcacacctagga

SEQ ID NO: 7081457 - DNA, 22 bp, Homo sapiens
caaggcctcctgggcccagaga

SEQ ID NO: 7081458 - DNA, 22 bp, Homo sapiens
caaggcctcctgggcccagaga

SEQ ID NO: 7081459 - DNA, 20 bp, Homo sapiens
caaggcctggatctagttgc

SEQ ID NO: 7081460 - DNA, 22 bp, Homo sapiens
caaggccactgctcaggtttcc

SEQ ID NO: 7081461 - DNA, 22 bp, Homo sapiens
caaggccagagccagcgataag

SEQ ID NO: 7081462 - DNA, 22 bp, Homo sapiens
caaggccagagccagcgataag

SEQ ID NO: 7081463 - DNA, 17 bp, Homo sapiens
caaggccagcatcttca

SEQ ID NO: 7081464 - DNA, 22 bp, Homo sapiens
caaggccagggaatttttctgg

SEQ ID NO: 7081465 - DNA, 22 bp, Homo sapiens
caaggccagtccattttggaag

SEQ ID NO: 7081466 - DNA, 22 bp, Homo sapiens
caaggccagttcaccaagggca

SEQ ID NO: 7081467 - DNA, 22 bp, Homo sapiens
caaggccagttcaccaagggca

SEQ ID NO: 7081468 - DNA, 22 bp, Homo sapiens
caaggccagttcaccaagggca

SEQ ID NO: 7081469 - DNA, 22 bp, Homo sapiens
caaggccagttcaccaagggca

SEQ ID NO: 7081470 - DNA, 22 bp, Homo sapiens
caaggccagtttctcctagtca

SEQ ID NO: 7081471 - DNA, 22 bp, Homo sapiens
caaggccataagagatacaaaa

SEQ ID NO: 7081472 - DNA, 22 bp, Homo sapiens
caaggccataagagatacaaaa

SEQ ID NO: 7081473 - DNA, 22 bp, Homo sapiens
caagggtggtattgggagcata

SEQ ID NO: 7081474 - DNA, 22 bp, Homo sapiens
caagggtggtattgggagcata

SEQ ID NO: 7081475 - DNA, 20 bp, Homo sapiens
caagggtttgcattggcttt

SEQ ID NO: 7081476 - DNA, 20 bp, Homo sapiens
caagggtttgcattggcttt

SEQ ID NO: 7081477 - DNA, 19 bp, Homo sapiens
caagggttgggtctgtcat

SEQ ID NO: 7081478 - DNA, 19 bp, Homo sapiens
caagggttgggtctgtcat

SEQ ID NO: 7081479 - DNA, 22 bp, Homo sapiens
caagggggcaggatcacacttg

SEQ ID NO: 7081480 - DNA, 22 bp, Homo sapiens
caagggaagaggacagggacct

SEQ ID NO: 7081481 - DNA, 22 bp, Homo sapiens
caagggtgaaggcagaggacat

SEQ ID NO: 7081482 - DNA, 19 bp, Homo sapiens
caagggtcatgacaggaac

SEQ ID NO: 7081483 - DNA, 19 bp, Homo sapiens
caagggtcatgacaggaac

SEQ ID NO: 7081484 - DNA, 22 bp, Homo sapiens
caagggtggtattgggagcata

SEQ ID NO: 7081485 - DNA, 22 bp, Homo sapiens
caagggtgaaggctcctccagg

SEQ ID NO: 7081486 - DNA, 21 bp, Homo sapiens
gctggctgtcccagggaagca

SEQ ID NO: 7081487 - DNA, 22 bp, Homo sapiens
gctggctgtatcacctggccag

SEQ ID NO: 7081488 - DNA, 21 bp, Homo sapiens
gctggctgtcccagggaagca

SEQ ID NO: 7081489 - DNA, 22 bp, Homo sapiens
caaggcttcacgtccccagtgc

SEQ ID NO: 7081490 - DNA, 22 bp, Homo sapiens
caagggaagaggacagggacct

SEQ ID NO: 7081491 - DNA, 22 bp, Homo sapiens
gctggctgtatcacctggccag

SEQ ID NO: 7081492 - DNA, 22 bp, Homo sapiens
gctggctgtatcacctggccag

SEQ ID NO: 7081493 - DNA, 22 bp, Homo sapiens
gctggctggtccagcaggggct

SEQ ID NO: 7081494 - DNA, 22 bp, Homo sapiens
gctggctgggtccctgagaggc

SEQ ID NO: 7081495 - DNA, 22 bp, Homo sapiens
gctggctggtccagcaggggct

SEQ ID NO: 7081496 - DNA, 22 bp, Homo sapiens
gctggctggtccagcaggggct

SEQ ID NO: 7081497 - DNA, 22 bp, Homo sapiens
gctggctggtccagcaggggct

SEQ ID NO: 7081498 - DNA, 22 bp, Homo sapiens
caaggccttcttgggagagatt

SEQ ID NO: 7081499 - DNA, 22 bp, Homo sapiens
caaggccttcttgggagagatt

SEQ ID NO: 7081500 - DNA, 22 bp, Homo sapiens
gctggctggctgtgcaaaggca

SEQ ID NO: 7081501 - DNA, 22 bp, Homo sapiens
gctggctgggtccctgagaggc

SEQ ID NO: 7081502 - DNA, 22 bp, Homo sapiens
gctggctgggtccctgagaggc

SEQ ID NO: 7081503 - DNA, 22 bp, Homo sapiens
caaatgtatgttttcctatgta

SEQ ID NO: 7081504 - DNA, 22 bp, Homo sapiens
caaatgtatcagcccagggatt

SEQ ID NO: 7081505 - DNA, 22 bp, Homo sapiens
caaatgtataaatgtactttct

SEQ ID NO: 7081506 - DNA, 23 bp, Homo sapiens
caaatgtagtgtgtccacccctg

SEQ ID NO: 7081507 - DNA, 22 bp, Homo sapiens
caaatgtaattgcggtttttgc

SEQ ID NO: 7081508 - DNA, 22 bp, Homo sapiens
caaatgtaattgcggtttttgc

SEQ ID NO: 7081509 - DNA, 22 bp, Homo sapiens
caaatgtaatggcaggttttgc

SEQ ID NO: 7081510 - DNA, 22 bp, Homo sapiens
caaatgtaatggcaggttttgc

SEQ ID NO: 7081511 - DNA, 22 bp, Homo sapiens
caaatgtaataaggagtttccc

SEQ ID NO: 7081512 - DNA, 22 bp, Homo sapiens
caaatgtaaattcttttgaagc

SEQ ID NO: 7081513 - DNA, 22 bp, Homo sapiens
caaatggtcatttctcttttgt

SEQ ID NO: 7081514 - DNA, 22 bp, Homo sapiens
caaatggctggcatccttctac

SEQ ID NO: 7081515 - DNA, 20 bp, Homo sapiens
caaatggcttttatttcctt

SEQ ID NO: 7081516 - DNA, 20 bp, Homo sapiens
caaatggcttttatttcctt

SEQ ID NO: 7081517 - DNA, 22 bp, Homo sapiens
caagcagggatactgcagggag

SEQ ID NO: 7081518 - DNA, 22 bp, Homo sapiens
caagcagggagcatcaagggag

SEQ ID NO: 7081519 - DNA, 22 bp, Homo sapiens
caagcaggatgaagcccaggga

SEQ ID NO: 7081520 - DNA, 22 bp, Homo sapiens
caagcaggcctggctggaccgt

SEQ ID NO: 7081521 - DNA, 22 bp, Homo sapiens
caagcaggaggagaagtttctg

SEQ ID NO: 7081522 - DNA, 22 bp, Homo sapiens
caagcagccccaacatgaggat

SEQ ID NO: 7081523 - DNA, 22 bp, Homo sapiens
caagcagccccaacatgaggat

SEQ ID NO: 7081524 - DNA, 22 bp, Homo sapiens
caagatttaagagtcagccttg

SEQ ID NO: 7081525 - DNA, 22 bp, Homo sapiens
caaatgtattctcacttcaggg

SEQ ID NO: 7081526 - DNA, 22 bp, Homo sapiens
caaatgtattctcacttcaggg

SEQ ID NO: 7081527 - DNA, 22 bp, Homo sapiens
caagattatcttcttcttgtta

SEQ ID NO: 7081528 - DNA, 22 bp, Homo sapiens
caaatgtggtttctcagcattc

SEQ ID NO: 7081529 - DNA, 22 bp, Homo sapiens
caaatgtggtttctcagcattc

SEQ ID NO: 7081530 - DNA, 22 bp, Homo sapiens
caagcagtcagcctgaagactg

SEQ ID NO: 7081531 - DNA, 22 bp, Homo sapiens
caagcatactgtgagagtttta

SEQ ID NO: 7081532 - DNA, 22 bp, Homo sapiens
caagcatactgtgagagtttta

SEQ ID NO: 7081533 - DNA, 22 bp, Homo sapiens
caagcagggatactgcagggag

SEQ ID NO: 7081534 - DNA, 22 bp, Homo sapiens
caagcagggatactgcagggag

SEQ ID NO: 7081535 - DNA, 22 bp, Homo sapiens
caagcagggtttatgcatggag

SEQ ID NO: 7081536 - DNA, 22 bp, Homo sapiens
caagcagggatactgcagggag

SEQ ID NO: 7081537 - DNA, 22 bp, Homo sapiens
caagccagctcctgccacagag

SEQ ID NO: 7081538 - DNA, 22 bp, Homo sapiens
caagccagctcctgccacagag

SEQ ID NO: 7081539 - DNA, 22 bp, Homo sapiens
caagccagctcctgccacagag

SEQ ID NO: 7081540 - DNA, 22 bp, Homo sapiens
caagccagcttgatgacctgtc

SEQ ID NO: 7081541 - DNA, 22 bp, Homo sapiens
caagccaggtgaacataacaag

SEQ ID NO: 7081542 - DNA, 22 bp, Homo sapiens
caagccaggtgaacataacaag

SEQ ID NO: 7081543 - DNA, 22 bp, Homo sapiens
caagccagtcagctcagtagat

SEQ ID NO: 7081544 - DNA, 22 bp, Homo sapiens
caagccagtcagctcagtagat

SEQ ID NO: 7081545 - DNA, 22 bp, Homo sapiens
caagccagtcagctcagtagat

SEQ ID NO: 7081546 - DNA, 22 bp, Homo sapiens
caagccagtgacagccagggaa

SEQ ID NO: 7081547 - DNA, 22 bp, Homo sapiens
gctggaggatggactggaagaa

SEQ ID NO: 7081548 - DNA, 22 bp, Homo sapiens
gctggaggatggactggaagaa

SEQ ID NO: 7081549 - DNA, 22 bp, Homo sapiens
gctggaggatggactggaagaa

SEQ ID NO: 7081550 - DNA, 22 bp, Homo sapiens
gctggaggatggactggaagaa

SEQ ID NO: 7081551 - DNA, 22 bp, Homo sapiens
gctggaggatggactggaagaa

SEQ ID NO: 7081552 - DNA, 22 bp, Homo sapiens
gctggaggatggactggaagaa

SEQ ID NO: 7081553 - DNA, 22 bp, Homo sapiens
gctggaggatggactggaagaa

SEQ ID NO: 7081554 - DNA, 22 bp, Homo sapiens
gctggaggatggactggaagaa

SEQ ID NO: 7081555 - DNA, 22 bp, Homo sapiens
gctggaggatggactggaagaa

SEQ ID NO: 7081556 - DNA, 22 bp, Homo sapiens
gctggaggatcacttgagccca

SEQ ID NO: 7081557 - DNA, 22 bp, Homo sapiens
gctggaggaggaagtgtgaggg

SEQ ID NO: 7081558 - DNA, 22 bp, Homo sapiens
gctggaggaggaagtgtgaggg

SEQ ID NO: 7081559 - DNA, 22 bp, Homo sapiens
gctggaggaggaagtgtgaggg

SEQ ID NO: 7081560 - DNA, 22 bp, Homo sapiens
gctggagcttgagaggacaggg

SEQ ID NO: 7081561 - DNA, 22 bp, Homo sapiens
caagccagtttgtagttctctc

SEQ ID NO: 7081562 - DNA, 22 bp, Homo sapiens
caagccagtttgtagttctctc

SEQ ID NO: 7081563 - DNA, 22 bp, Homo sapiens
gctggaggaggaagtgtgaggg

SEQ ID NO: 7081564 - DNA, 22 bp, Homo sapiens
gctggaggaggaagtgtgaggg

SEQ ID NO: 7081565 - DNA, 22 bp, Homo sapiens
gctggaggaggaagtgtgaggg

SEQ ID NO: 7081566 - DNA, 22 bp, Homo sapiens
gctggaggaggaagtgtgaggg

SEQ ID NO: 7081567 - DNA, 22 bp, Homo sapiens
gctggaggatcacttgagccca

SEQ ID NO: 7081568 - DNA, 22 bp, Homo sapiens
gctggaggatcacttgagccca

SEQ ID NO: 7081569 - DNA, 22 bp, Homo sapiens
gctggaggatcacttgagccca

SEQ ID NO: 7081570 - DNA, 22 bp, Homo sapiens
caagtttaaggcactgataagt

SEQ ID NO: 7081571 - DNA, 22 bp, Homo sapiens
gctgttgcaatcaaggccatgg

SEQ ID NO: 7081572 - DNA, 22 bp, Homo sapiens
caagtttacaatgtgtatgtgt

SEQ ID NO: 7081573 - DNA, 20 bp, Homo sapiens
gctgttctgaagcagaaggc

SEQ ID NO: 7081574 - DNA, 19 bp, Homo sapiens
gctgttaaggaccctcgga

SEQ ID NO: 7081575 - DNA, 22 bp, Homo sapiens
gctgtggcggcagcagctggtg

SEQ ID NO: 7081576 - DNA, 22 bp, Homo sapiens
gctgttattttacaagacttat

SEQ ID NO: 7081577 - DNA, 22 bp, Homo sapiens
gctgttcacggaggaggatggg

SEQ ID NO: 7081578 - DNA, 22 bp, Homo sapiens
gctgttcagggcactcatgggc

SEQ ID NO: 7081579 - DNA, 22 bp, Homo sapiens
caagtattttaaggactagtgg

SEQ ID NO: 7081580 - DNA, 22 bp, Homo sapiens
caagtattttaaggactagtgg

SEQ ID NO: 7081581 - DNA, 22 bp, Homo sapiens
caagtcaatacctgtggacaaa

SEQ ID NO: 7081582 - DNA, 22 bp, Homo sapiens
gctgtggcctggcgcagagctg

SEQ ID NO: 7081583 - DNA, 22 bp, Homo sapiens
gctgtggcggcagcagctggtg

SEQ ID NO: 7081584 - DNA, 22 bp, Homo sapiens
gctgtggcggcagcagctggtg

SEQ ID NO: 7081585 - DNA, 22 bp, Homo sapiens
gctgtggcggcagcagctggtg

SEQ ID NO: 7081586 - DNA, 22 bp, Homo sapiens
caaggttttggaagattttcgt

SEQ ID NO: 7081587 - DNA, 22 bp, Homo sapiens
caaggttttgcttgtaagggaa

SEQ ID NO: 7081588 - DNA, 22 bp, Homo sapiens
caaggtttgaaaacgccatggc

SEQ ID NO: 7081589 - DNA, 22 bp, Homo sapiens
caaggtttctatgctcaaagga

SEQ ID NO: 7081590 - DNA, 22 bp, Homo sapiens
caaggtttcgagttcccaacca

SEQ ID NO: 7081591 - DNA, 22 bp, Homo sapiens
caaggtttactttatgatccag

SEQ ID NO: 7081592 - DNA, 22 bp, Homo sapiens
caaggtttacattgggctatca

SEQ ID NO: 7081593 - DNA, 22 bp, Homo sapiens
caaggtgccatgctgggcgggg

SEQ ID NO: 7081594 - DNA, 22 bp, Homo sapiens
caaggtcacataacttgtcaaa

SEQ ID NO: 7081595 - DNA, 22 bp, Homo sapiens
caaggtctggttcctctgggtg

SEQ ID NO: 7081596 - DNA, 22 bp, Homo sapiens
caaggtgaacttgctgtacagc

SEQ ID NO: 7081597 - DNA, 22 bp, Homo sapiens
caaggtgaacttgctgtacagc

SEQ ID NO: 7081598 - DNA, 22 bp, Homo sapiens
caaggtgcagctggctgtgtga

SEQ ID NO: 7081599 - DNA, 22 bp, Homo sapiens
caaggtgccatgctgggcgggg

SEQ ID NO: 7081600 - DNA, 22 bp, Homo sapiens
caaggtgccatgctgggcgggg

SEQ ID NO: 7081601 - DNA, 22 bp, Homo sapiens
caaggtgccatgctgggcgggg

SEQ ID NO: 7081602 - DNA, 22 bp, Homo sapiens
caaggtgccatgctgggcgggg

SEQ ID NO: 7081603 - DNA, 22 bp, Homo sapiens
caagtatatttgaacatgtaaa

SEQ ID NO: 7081604 - DNA, 22 bp, Homo sapiens
caagtatatttgaacatgtaaa

SEQ ID NO: 7081605 - DNA, 22 bp, Homo sapiens
caagtattctgtaaaaagtcaa

SEQ ID NO: 7081606 - DNA, 22 bp, Homo sapiens
caagtatttgcggagttccacg

SEQ ID NO: 7081607 - DNA, 22 bp, Homo sapiens
caagtacaagggtgtcagttta

SEQ ID NO: 7081608 - DNA, 22 bp, Homo sapiens
caagtacaatagctctggaact

SEQ ID NO: 7081609 - DNA, 22 bp, Homo sapiens
caagtactgtgatagctgaagt

SEQ ID NO: 7081610 - DNA, 22 bp, Homo sapiens
caagtactttgaaaagttgaat

SEQ ID NO: 7081611 - DNA, 22 bp, Homo sapiens
caagtactttgaaaagttgaat

SEQ ID NO: 7081612 - DNA, 22 bp, Homo sapiens
caagtaaacaatatgtgattca

SEQ ID NO: 7081613 - DNA, 22 bp, Homo sapiens
caagtaaacaatatgtgattca

SEQ ID NO: 7081614 - DNA, 22 bp, Homo sapiens
caagtaaacaatatgtgattca

SEQ ID NO: 7081615 - DNA, 22 bp, Homo sapiens
caagtaaagaatcacatttctt

SEQ ID NO: 7081616 - DNA, 22 bp, Homo sapiens
caagtaaagaatcacatttctt

SEQ ID NO: 7081617 - DNA, 22 bp, Homo sapiens
caagtaaatgtgaactggaagg

SEQ ID NO: 7081618 - DNA, 22 bp, Homo sapiens
caagtaatggttttataatagt

SEQ ID NO: 7081619 - DNA, 22 bp, Homo sapiens
caagtaattctgcaagaaacca

SEQ ID NO: 7081620 - DNA, 22 bp, Homo sapiens
caagtacaaaatgatatttagt

SEQ ID NO: 7081621 - DNA, 22 bp, Homo sapiens
caagtacaaaatgatatttagt

SEQ ID NO: 7081622 - DNA, 22 bp, Homo sapiens
caagtttacaatgtgtatgtgt

SEQ ID NO: 7081623 - DNA, 22 bp, Homo sapiens
caagtttggattatgaaaaagt

SEQ ID NO: 7081624 - DNA, 22 bp, Homo sapiens
caagttttagcaagtggaaagg

SEQ ID NO: 7081625 - DNA, 22 bp, Homo sapiens
caagttttagcaagtggaaagg

SEQ ID NO: 7081626 - DNA, 22 bp, Homo sapiens
caagttttctgggttcagagca

SEQ ID NO: 7081627 - DNA, 22 bp, Homo sapiens
caagttttgattttgcagtaaa

SEQ ID NO: 7081628 - DNA, 22 bp, Homo sapiens
caagttttagaaatatctggat

SEQ ID NO: 7081629 - DNA, 22 bp, Homo sapiens
caagttttagaaatatctggat

SEQ ID NO: 7081630 - DNA, 21 bp, Homo sapiens
caataaactgcacattgagac

SEQ ID NO: 7081631 - DNA, 22 bp, Homo sapiens
caataaagaagatttttgcaat

SEQ ID NO: 7081632 - DNA, 22 bp, Homo sapiens
caataaagaagatttttgcaat

SEQ ID NO: 7081633 - DNA, 22 bp, Homo sapiens
caataaagaagatttttgcaat

SEQ ID NO: 7081634 - DNA, 22 bp, Homo sapiens
caataaagaagatttttgcaat

SEQ ID NO: 7081635 - DNA, 22 bp, Homo sapiens
caataaagtggaggcccgggct

SEQ ID NO: 7081636 - DNA, 22 bp, Homo sapiens
caagttttgcatagttctgtat

SEQ ID NO: 7081637 - DNA, 22 bp, Homo sapiens
caagttttgcatagttctgtat

SEQ ID NO: 7081638 - DNA, 21 bp, Homo sapiens
caataaactgcacattgagac

SEQ ID NO: 7081639 - DNA, 21 bp, Homo sapiens
caataaactgcacattgagac

SEQ ID NO: 7081640 - DNA, 22 bp, Homo sapiens
caagttttgattttgcagtaaa

SEQ ID NO: 7081641 - DNA, 22 bp, Homo sapiens
caagttttgattttgcagtaaa

SEQ ID NO: 7081642 - DNA, 22 bp, Homo sapiens
gctttcttagtgtgttaattgg

SEQ ID NO: 7081643 - DNA, 22 bp, Homo sapiens
gcttggggagctcagtgtcctt

SEQ ID NO: 7081644 - DNA, 22 bp, Homo sapiens
gcttggggagctcagtgtcctt

SEQ ID NO: 7081645 - DNA, 22 bp, Homo sapiens
gcttggggagctcagtgtcctt

SEQ ID NO: 7081646 - DNA, 22 bp, Homo sapiens
gcttggggagctcagtgtcctt

SEQ ID NO: 7081647 - DNA, 17 bp, Homo sapiens
gcttgggctgcctgttg

SEQ ID NO: 7081648 - DNA, 22 bp, Homo sapiens
gcttgggcttaactgtaggttc

SEQ ID NO: 7081649 - DNA, 22 bp, Homo sapiens
gcttggggtcatgaggctgctg

SEQ ID NO: 7081650 - DNA, 22 bp, Homo sapiens
gctttctggtttgtgctacagg

SEQ ID NO: 7081651 - DNA, 22 bp, Homo sapiens
gctttgcacaacctttaagaca

SEQ ID NO: 7081652 - DNA, 22 bp, Homo sapiens
gctttgaagtctgtgtcttttg

SEQ ID NO: 7081653 - DNA, 22 bp, Homo sapiens
gctttgaagtctgtgtcttttg

SEQ ID NO: 7081654 - DNA, 22 bp, Homo sapiens
gctttcttgctgcatggtggct

SEQ ID NO: 7081655 - DNA, 22 bp, Homo sapiens
gctttcttcatactcaagcatc

SEQ ID NO: 7081656 - DNA, 22 bp, Homo sapiens
gctttcttcatactcaagcatc

SEQ ID NO: 7081657 - DNA, 22 bp, Homo sapiens
gctttcttcatactcaagcatc

SEQ ID NO: 7081658 - DNA, 18 bp, Homo sapiens
gctttgcagaaatacaga

SEQ ID NO: 7081659 - DNA, 22 bp, Homo sapiens
gctttgcattcttgtgtgatca

SEQ ID NO: 7081660 - DNA, 22 bp, Homo sapiens
gctttgcattgtgatgggatgc

SEQ ID NO: 7081661 - DNA, 22 bp, Homo sapiens
caatgtatcaagaagcatcagt

SEQ ID NO: 7081662 - DNA, 22 bp, Homo sapiens
caatgtcaaggagaccaaaacg

SEQ ID NO: 7081663 - DNA, 22 bp, Homo sapiens
caatgtcaaggagaccaaaacg

SEQ ID NO: 7081664 - DNA, 22 bp, Homo sapiens
caatgtcagaattacagttgat

SEQ ID NO: 7081665 - DNA, 22 bp, Homo sapiens
caatgtcagaattacagttgat

SEQ ID NO: 7081666 - DNA, 22 bp, Homo sapiens
caatgtcagagaagctcatatc

SEQ ID NO: 7081667 - DNA, 22 bp, Homo sapiens
caatgtcagagaagctcatatc

SEQ ID NO: 7081668 - DNA, 22 bp, Homo sapiens
caatgtcagtcaagcagcaaat

SEQ ID NO: 7081669 - DNA, 22 bp, Homo sapiens
caatgtcagtcaagcagcaaat

SEQ ID NO: 7081670 - DNA, 22 bp, Homo sapiens
caatgtcatgattttccattag

SEQ ID NO: 7081671 - DNA, 22 bp, Homo sapiens
caatgtcatttcactgggctta

SEQ ID NO: 7081672 - DNA, 22 bp, Homo sapiens
caatgtctgaccgttttgccca

SEQ ID NO: 7081673 - DNA, 21 bp, Homo sapiens
caatgtctgctctctgcctag

SEQ ID NO: 7081674 - DNA, 21 bp, Homo sapiens
caatgtctgctctctgcctag

SEQ ID NO: 7081675 - DNA, 22 bp, Homo sapiens
caatgtctgggagacctgtgat

SEQ ID NO: 7081676 - DNA, 22 bp, Homo sapiens
caatgtgtttgcatattaaaat

SEQ ID NO: 7081677 - DNA, 22 bp, Homo sapiens
caatgtttactggggacccaga

SEQ ID NO: 7081678 - DNA, 22 bp, Homo sapiens
caatgtttactggggacccaga

SEQ ID NO: 7081679 - DNA, 22 bp, Homo sapiens
caatgtttcttgtaaccagtga

SEQ ID NO: 7081680 - DNA, 22 bp, Homo sapiens
caatgtttcttgtaaccagtga

SEQ ID NO: 7081681 - DNA, 22 bp, Homo sapiens
caatgtttgagtaggagcataa

SEQ ID NO: 7081682 - DNA, 22 bp, Homo sapiens
caatgtttgagtaggagcataa

SEQ ID NO: 7081683 - DNA, 22 bp, Homo sapiens
caatgtttgagtaggagcataa

SEQ ID NO: 7081684 - DNA, 22 bp, Homo sapiens
caatgtttgagtaggagcataa

SEQ ID NO: 7081685 - DNA, 22 bp, Homo sapiens
gcataggcactttcctcctcct

SEQ ID NO: 7081686 - DNA, 22 bp, Homo sapiens
gcataggccactagtgccagga

SEQ ID NO: 7081687 - DNA, 15 bp, Homo sapiens
gcatatcacattcat

SEQ ID NO: 7081688 - DNA, 22 bp, Homo sapiens
gcatatatgtgcaggctcacac

SEQ ID NO: 7081689 - DNA, 22 bp, Homo sapiens
gcatatcagcatcaaaacacag

SEQ ID NO: 7081690 - DNA, 22 bp, Homo sapiens
gcatattttcacaagctcttgg

SEQ ID NO: 7081691 - DNA, 22 bp, Homo sapiens
gcatattttcacaagctcttgg

SEQ ID NO: 7081692 - DNA, 22 bp, Homo sapiens
gcatatgatcacgtgtgtcggt

SEQ ID NO: 7081693 - DNA, 22 bp, Homo sapiens
gcatatgatcacgtgtgtcggt

SEQ ID NO: 7081694 - DNA, 22 bp, Homo sapiens
gcatatcatgacttctatctta

SEQ ID NO: 7081695 - DNA, 22 bp, Homo sapiens
gcatatgatcacgtgtgtcggt

SEQ ID NO: 7081696 - DNA, 22 bp, Homo sapiens
attgtagcaatttctcttaatt

SEQ ID NO: 7081697 - DNA, 22 bp, Homo sapiens
attgtataacagcatgtatttt

SEQ ID NO: 7081698 - DNA, 22 bp, Homo sapiens
attgtataacagcatgtatttt

SEQ ID NO: 7081699 - DNA, 22 bp, Homo sapiens
attgtataacagcatgtatttt

SEQ ID NO: 7081700 - DNA, 17 bp, Homo sapiens
gcatcacagataacacg

SEQ ID NO: 7081701 - DNA, 22 bp, Homo sapiens
gcatcagaatcatccggggaat

SEQ ID NO: 7081702 - DNA, 17 bp, Homo sapiens
gcatcacagataacacg

SEQ ID NO: 7081703 - DNA, 17 bp, Homo sapiens
gcatcacagataacacg

SEQ ID NO: 7081704 - DNA, 19 bp, Homo sapiens
gcatcaaagctgactcctg

SEQ ID NO: 7081705 - DNA, 22 bp, Homo sapiens
gcatcaagacgatgtgaaatcg

SEQ ID NO: 7081706 - DNA, 22 bp, Homo sapiens
gcatattttcacaagctcttgg

SEQ ID NO: 7081707 - DNA, 22 bp, Homo sapiens
gcatattttcacaagctcttgg

SEQ ID NO: 7081708 - DNA, 22 bp, Homo sapiens
gcatattttcacaagctcttgg

SEQ ID NO: 7081709 - DNA, 22 bp, Homo sapiens
attgtcattggcttctatgtct

SEQ ID NO: 7081710 - DNA, 22 bp, Homo sapiens
attgtcattggcttctatgtct

SEQ ID NO: 7081711 - DNA, 22 bp, Homo sapiens
attgtcattccagtcattgtta

SEQ ID NO: 7081712 - DNA, 22 bp, Homo sapiens
attgtcattccagtcattgtta

SEQ ID NO: 7081713 - DNA, 22 bp, Homo sapiens
attgtcgtcaatggacacatag

SEQ ID NO: 7081714 - DNA, 22 bp, Homo sapiens
attgtctaattgacttggtgtg

SEQ ID NO: 7081715 - DNA, 22 bp, Homo sapiens
attgtctatggctgctttcact

SEQ ID NO: 7081716 - DNA, 22 bp, Homo sapiens
attgtctatggctgctttcact

SEQ ID NO: 7081717 - DNA, 22 bp, Homo sapiens
attgtctcttaaatgtggaaat

SEQ ID NO: 7081718 - DNA, 22 bp, Homo sapiens
attgtatttgtacaagacatgt

SEQ ID NO: 7081719 - DNA, 22 bp, Homo sapiens
attgtcacttaaaagtgcatgt

SEQ ID NO: 7081720 - DNA, 18 bp, Homo sapiens
attgtcagaagtcatgtg

SEQ ID NO: 7081721 - DNA, 22 bp, Homo sapiens
attgtcagccttcatagatcct

SEQ ID NO: 7081722 - DNA, 22 bp, Homo sapiens
attgtcagctcgaaatgcatca

SEQ ID NO: 7081723 - DNA, 22 bp, Homo sapiens
gcagtgtgtgtccccacactgg

SEQ ID NO: 7081724 - DNA, 22 bp, Homo sapiens
gcagtgtgtgtccccacactgg

SEQ ID NO: 7081725 - DNA, 22 bp, Homo sapiens
gcagtgtgtttctgagatatgg

SEQ ID NO: 7081726 - DNA, 22 bp, Homo sapiens
gcagtgtgtttggataacacac

SEQ ID NO: 7081727 - DNA, 22 bp, Homo sapiens
gcagtgttaaacaactgctgct

SEQ ID NO: 7081728 - DNA, 22 bp, Homo sapiens
gcagtgttaccttgggctggtt

SEQ ID NO: 7081729 - DNA, 22 bp, Homo sapiens
gcagtgttacctcttcagtggg

SEQ ID NO: 7081730 - DNA, 22 bp, Homo sapiens
gcagtgttaatgcgagtgttca

SEQ ID NO: 7081731 - DNA, 22 bp, Homo sapiens
gcagtgttacttggagtactaa

SEQ ID NO: 7081732 - DNA, 22 bp, Homo sapiens
gcagtgttacttggtttgcaga

SEQ ID NO: 7081733 - DNA, 22 bp, Homo sapiens
gcatacaaaggtttacaactga

SEQ ID NO: 7081734 - DNA, 18 bp, Homo sapiens
gcatacagaggggaagta

SEQ ID NO: 7081735 - DNA, 22 bp, Homo sapiens
gcatacatacaatagctgccac

SEQ ID NO: 7081736 - DNA, 22 bp, Homo sapiens
gcatacatgaaaaggtactgac

SEQ ID NO: 7081737 - DNA, 22 bp, Homo sapiens
gcatacatgggtgcagggacat

SEQ ID NO: 7081738 - DNA, 22 bp, Homo sapiens
gcatacattgcaccctggtagt

SEQ ID NO: 7081739 - DNA, 22 bp, Homo sapiens
gcatagaaggttttggtatcaa

SEQ ID NO: 7081740 - DNA, 22 bp, Homo sapiens
gcatagaatttagagacaaaag

SEQ ID NO: 7081741 - DNA, 22 bp, Homo sapiens
gcagtgtggccccagtatcacg

SEQ ID NO: 7081742 - DNA, 22 bp, Homo sapiens
gcagtgtggccccagtatcacg

SEQ ID NO: 7081743 - DNA, 22 bp, Homo sapiens
gcagtgtggcgtggggacctaa

SEQ ID NO: 7081744 - DNA, 20 bp, Homo sapiens
gcagtgtgtatgaatagctg

SEQ ID NO: 7081745 - DNA, 22 bp, Homo sapiens
gcagtgtgaccgagcttgcttc

SEQ ID NO: 7081746 - DNA, 22 bp, Homo sapiens
gcagtgcttgaagaggtggcca

SEQ ID NO: 7081747 - DNA, 22 bp, Homo sapiens
gcagtgcttgaagaggtggcca

SEQ ID NO: 7081748 - DNA, 22 bp, Homo sapiens
gccaagaatgtggcatagctta

SEQ ID NO: 7081749 - DNA, 22 bp, Homo sapiens
gccaagaatgcgacagccgtca

SEQ ID NO: 7081750 - DNA, 20 bp, Homo sapiens
gccaagaatatgcccgactc

SEQ ID NO: 7081751 - DNA, 22 bp, Homo sapiens
gccaagaagtatggttggggct

SEQ ID NO: 7081752 - DNA, 22 bp, Homo sapiens
gccaagaagggccatgtggatt

SEQ ID NO: 7081753 - DNA, 22 bp, Homo sapiens
gccaagaaggtggggacatgca

SEQ ID NO: 7081754 - DNA, 22 bp, Homo sapiens
gccaagaaggtggggacatgca

SEQ ID NO: 7081755 - DNA, 22 bp, Homo sapiens
gccaagaggctcattagcattc

SEQ ID NO: 7081756 - DNA, 22 bp, Homo sapiens
gccaagagtttccagctgcaag

SEQ ID NO: 7081757 - DNA, 22 bp, Homo sapiens
gccaagcctgggaagagcccat

SEQ ID NO: 7081758 - DNA, 22 bp, Homo sapiens
gccacagggattgttttgtgag

SEQ ID NO: 7081759 - DNA, 22 bp, Homo sapiens
gccacagggattgttttgtgag

SEQ ID NO: 7081760 - DNA, 22 bp, Homo sapiens
gccaagcctgggaagagcccat

SEQ ID NO: 7081761 - DNA, 22 bp, Homo sapiens
gccacagggcagatgcgcagag

SEQ ID NO: 7081762 - DNA, 22 bp, Homo sapiens
gccacagggcagatgcgcagag

SEQ ID NO: 7081763 - DNA, 22 bp, Homo sapiens
gccacagggcagatgcgcagag

SEQ ID NO: 7081764 - DNA, 22 bp, Homo sapiens
gccacagggcagatgcgcagag

SEQ ID NO: 7081765 - DNA, 22 bp, Homo sapiens
gccacagggcagatgcgcagag

SEQ ID NO: 7081766 - DNA, 22 bp, Homo sapiens
gccacagggcgagcggaggcca

SEQ ID NO: 7081767 - DNA, 22 bp, Homo sapiens
gccacagggcgagcggaggcca

SEQ ID NO: 7081768 - DNA, 22 bp, Homo sapiens
gccacagggcgagcggaggcca

SEQ ID NO: 7081769 - DNA, 22 bp, Homo sapiens
gccacagggcgagcggaggcca

SEQ ID NO: 7081770 - DNA, 23 bp, Homo sapiens
gccaaaggtctgttcagtggtga

SEQ ID NO: 7081771 - DNA, 17 bp, Homo sapiens
gccaaagggttccaatc

SEQ ID NO: 7081772 - DNA, 22 bp, Homo sapiens
gccaaaggcccttctgaaggca

SEQ ID NO: 7081773 - DNA, 16 bp, Homo sapiens
gccaaagggcaaagaa

SEQ ID NO: 7081774 - DNA, 22 bp, Homo sapiens
gccaaagctggaggtggaggtg

SEQ ID NO: 7081775 - DNA, 22 bp, Homo sapiens
gccaaaggacctgtgggtgaca

SEQ ID NO: 7081776 - DNA, 22 bp, Homo sapiens
gccaaaggacctgtgggtgaca

SEQ ID NO: 7081777 - DNA, 22 bp, Homo sapiens
gccaaaggattctatggagata

SEQ ID NO: 7081778 - DNA, 22 bp, Homo sapiens
gccaaaggattctatggagata

SEQ ID NO: 7081779 - DNA, 22 bp, Homo sapiens
gccaaagtacctagccctctgc

SEQ ID NO: 7081780 - DNA, 23 bp, Homo sapiens
gccaaaggtctgttcagtggtga

SEQ ID NO: 7081781 - DNA, 22 bp, Homo sapiens
gccaaaggttggcctgtgagtt

SEQ ID NO: 7081782 - DNA, 22 bp, Homo sapiens
gccaaataagtggaatcacaca

SEQ ID NO: 7081783 - DNA, 22 bp, Homo sapiens
gccaacaggccttgctctgctc

SEQ ID NO: 7081784 - DNA, 20 bp, Homo sapiens
gccaacgcgctggggctgcc

SEQ ID NO: 7081785 - DNA, 22 bp, Homo sapiens
gccaagaaagaacagcagggaa

SEQ ID NO: 7081786 - DNA, 22 bp, Homo sapiens
gccaagaaagtggcacccctag

SEQ ID NO: 7081787 - DNA, 22 bp, Homo sapiens
gccaagaaatgcccctcacaga

SEQ ID NO: 7081788 - DNA, 22 bp, Homo sapiens
gccaagaaatgcccctcacaga

SEQ ID NO: 7081789 - DNA, 22 bp, Homo sapiens
gccaagaaatgtgtcgggcagc

SEQ ID NO: 7081790 - DNA, 21 bp, Homo sapiens
gccaagaacaagacagacatg

SEQ ID NO: 7081791 - DNA, 21 bp, Homo sapiens
gccaagaacaagacagacatg

SEQ ID NO: 7081792 - DNA, 22 bp, Homo sapiens
attgtctctttcaataacttgt

SEQ ID NO: 7081793 - DNA, 22 bp, Homo sapiens
attgtctgaatccaaagctctg

SEQ ID NO: 7081794 - DNA, 22 bp, Homo sapiens
attgtctgtactttaaaaatgt

SEQ ID NO: 7081795 - DNA, 22 bp, Homo sapiens
attgtctgtactttaaaaatgt

SEQ ID NO: 7081796 - DNA, 22 bp, Homo sapiens
attgtcttaaacaaatgtgttt

SEQ ID NO: 7081797 - DNA, 20 bp, Homo sapiens
attgtgaatactgcatatgt

SEQ ID NO: 7081798 - DNA, 20 bp, Homo sapiens
attgtgaatactgcatatgt

SEQ ID NO: 7081799 - DNA, 22 bp, Homo sapiens
attgtgaattgagagtacttct

SEQ ID NO: 7081800 - DNA, 22 bp, Homo sapiens
attgtgaatagtgccgcagtaa

SEQ ID NO: 7081801 - DNA, 23 bp, Homo sapiens
attgtgagattactatcacactg

SEQ ID NO: 7081802 - DNA, 22 bp, Homo sapiens
attgtgaggcagggaaaggtgg

SEQ ID NO: 7081803 - DNA, 22 bp, Homo sapiens
gcattcctttataggaaaatgg

SEQ ID NO: 7081804 - DNA, 22 bp, Homo sapiens
gcattctagacagctacagaaa

SEQ ID NO: 7081805 - DNA, 22 bp, Homo sapiens
gccaaagagctgagtacatgta

SEQ ID NO: 7081806 - DNA, 22 bp, Homo sapiens
gccaaaactcccatattttaat

SEQ ID NO: 7081807 - DNA, 18 bp, Homo sapiens
gcagggctggacaagtca

SEQ ID NO: 7081808 - DNA, 22 bp, Homo sapiens
gcagggctgggacttactggta

SEQ ID NO: 7081809 - DNA, 22 bp, Homo sapiens
gcagggctgctgaaacttgttt

SEQ ID NO: 7081810 - DNA, 22 bp, Homo sapiens
gcagggctgcagagggcactgt

SEQ ID NO: 7081811 - DNA, 22 bp, Homo sapiens
gcagggctgcagagggcactgt

SEQ ID NO: 7081812 - DNA, 22 bp, Homo sapiens
gcagggctgagtcatgtgtgcc

SEQ ID NO: 7081813 - DNA, 22 bp, Homo sapiens
gcagggctgagtcatgtgtgcc

SEQ ID NO: 7081814 - DNA, 22 bp, Homo sapiens
gcagggctgagtcatgtgtgcc

SEQ ID NO: 7081815 - DNA, 22 bp, Homo sapiens
gcagggctgatggcttccctca

SEQ ID NO: 7081816 - DNA, 22 bp, Homo sapiens
gcagggctgatgttattgacga

SEQ ID NO: 7081817 - DNA, 22 bp, Homo sapiens
gcagggctgatgttattgacga

SEQ ID NO: 7081818 - DNA, 18 bp, Homo sapiens
gcagggctgcacacgcat

SEQ ID NO: 7081819 - DNA, 22 bp, Homo sapiens
attgcaaagaaatacatgctta

SEQ ID NO: 7081820 - DNA, 22 bp, Homo sapiens
attgatttgtagtgcctgcact

SEQ ID NO: 7081821 - DNA, 22 bp, Homo sapiens
attgattttcagactatgcgag

SEQ ID NO: 7081822 - DNA, 22 bp, Homo sapiens
gcagggctgactcagccaccct

SEQ ID NO: 7081823 - DNA, 22 bp, Homo sapiens
gcagggctgactcagccaccct

SEQ ID NO: 7081824 - DNA, 22 bp, Homo sapiens
attgcaaagaaatacatgctta

SEQ ID NO: 7081825 - DNA, 22 bp, Homo sapiens
attgatgttagaatctactcct

SEQ ID NO: 7081826 - DNA, 22 bp, Homo sapiens
attgattgaagtaaaataacct

SEQ ID NO: 7081827 - DNA, 22 bp, Homo sapiens
attgatttagctcaagacacat

SEQ ID NO: 7081828 - DNA, 22 bp, Homo sapiens
attgatttagctcaagacacat

SEQ ID NO: 7081829 - DNA, 22 bp, Homo sapiens
attgatttaggcttgttatgac

SEQ ID NO: 7081830 - DNA, 22 bp, Homo sapiens
attgatttaggcttgttatgac

SEQ ID NO: 7081831 - DNA, 22 bp, Homo sapiens
attgatttgaacaaagatatta

SEQ ID NO: 7081832 - DNA, 22 bp, Homo sapiens
attgatttgaacaaagatatta

SEQ ID NO: 7081833 - DNA, 22 bp, Homo sapiens
attgatggaaaacaaatgatga

SEQ ID NO: 7081834 - DNA, 22 bp, Homo sapiens
attgatggagagatttccattg

SEQ ID NO: 7081835 - DNA, 22 bp, Homo sapiens
attgatggcggcctctccatat

SEQ ID NO: 7081836 - DNA, 22 bp, Homo sapiens
attgatatattatttctaactg

SEQ ID NO: 7081837 - DNA, 22 bp, Homo sapiens
attgatatcagtttgctgattg

SEQ ID NO: 7081838 - DNA, 22 bp, Homo sapiens
attgatgggaatggctaaactt

SEQ ID NO: 7081839 - DNA, 22 bp, Homo sapiens
attgatgggtgccaatggagtg

SEQ ID NO: 7081840 - DNA, 22 bp, Homo sapiens
attgatggtgatagtgctgtgg

SEQ ID NO: 7081841 - DNA, 22 bp, Homo sapiens
attgatggtgcttatagtcatg

SEQ ID NO: 7081842 - DNA, 22 bp, Homo sapiens
attgatgtagtttcagatttca

SEQ ID NO: 7081843 - DNA, 22 bp, Homo sapiens
attgatgtgccgaaatagaggc

SEQ ID NO: 7081844 - DNA, 22 bp, Homo sapiens
attgatgtgtcacaagagattt

SEQ ID NO: 7081845 - DNA, 23 bp, Homo sapiens
attgacctgtttagtctctccct

SEQ ID NO: 7081846 - DNA, 22 bp, Homo sapiens
attgagaaaataagtatggata

SEQ ID NO: 7081847 - DNA, 22 bp, Homo sapiens
attgagaaaataagtatggata

SEQ ID NO: 7081848 - DNA, 22 bp, Homo sapiens
attgatatattatttctaactg

SEQ ID NO: 7081849 - DNA, 22 bp, Homo sapiens
gcaggcctttatccctgcctca

SEQ ID NO: 7081850 - DNA, 22 bp, Homo sapiens
gcaggcggaggttgcagtgagc

SEQ ID NO: 7081851 - DNA, 22 bp, Homo sapiens
attgacctattggacatgaaac

SEQ ID NO: 7081852 - DNA, 22 bp, Homo sapiens
attgacctgattgttcctggaa

SEQ ID NO: 7081853 - DNA, 22 bp, Homo sapiens
gcaggcctgactgtagggggca

SEQ ID NO: 7081854 - DNA, 22 bp, Homo sapiens
gcaggcctgactgtagggggca

SEQ ID NO: 7081855 - DNA, 22 bp, Homo sapiens
gcaggcctgactgtagggggca

SEQ ID NO: 7081856 - DNA, 22 bp, Homo sapiens
gcaggcctgcaggtatggccgg

SEQ ID NO: 7081857 - DNA, 22 bp, Homo sapiens
gcaggcctgcccagcaggatgg

SEQ ID NO: 7081858 - DNA, 22 bp, Homo sapiens
gcaggcctgcccagcaggatgg

SEQ ID NO: 7081859 - DNA, 22 bp, Homo sapiens
gcaggcctgcccagcaggatgg

SEQ ID NO: 7081860 - DNA, 22 bp, Homo sapiens
gcaggcctgcccagcaggatgg

SEQ ID NO: 7081861 - DNA, 22 bp, Homo sapiens
gcaggcctgcccagcaggatgg

SEQ ID NO: 7081862 - DNA, 22 bp, Homo sapiens
gcaggcctgcccagcaggatgg

SEQ ID NO: 7081863 - DNA, 22 bp, Homo sapiens
gcaggcctggtttacatggtag

SEQ ID NO: 7081864 - DNA, 22 bp, Homo sapiens
gcaggcctggtttacatggtag

SEQ ID NO: 7081865 - DNA, 22 bp, Homo sapiens
gcaggcctgggagtcatcttgt

SEQ ID NO: 7081866 - DNA, 22 bp, Homo sapiens
gcaggcctggtttacatggtag

SEQ ID NO: 7081867 - DNA, 22 bp, Homo sapiens
gcaggcctgtaatgaagggaca

SEQ ID NO: 7081868 - DNA, 22 bp, Homo sapiens
gcaggcctgtaatgaagggaca

SEQ ID NO: 7081869 - DNA, 22 bp, Homo sapiens
gcaggcctgtaatgaagggaca

SEQ ID NO: 7081870 - DNA, 22 bp, Homo sapiens
gcaggcctgtcttgctcgccct

SEQ ID NO: 7081871 - DNA, 22 bp, Homo sapiens
gcaggccttggcaatgagcctg

SEQ ID NO: 7081872 - DNA, 22 bp, Homo sapiens
gcaggccttggcaatgagcctg

SEQ ID NO: 7081873 - DNA, 22 bp, Homo sapiens
gcaggccttggcaatgagcctg

SEQ ID NO: 7081874 - DNA, 22 bp, Homo sapiens
gcaggccttggcaatgagcctg

SEQ ID NO: 7081875 - DNA, 22 bp, Homo sapiens
gcaggcctttatccctgcctca

SEQ ID NO: 7081876 - DNA, 22 bp, Homo sapiens
gcaggcctttatccctgcctca

SEQ ID NO: 7081877 - DNA, 22 bp, Homo sapiens
attcttgatatagatagttaat

SEQ ID NO: 7081878 - DNA, 22 bp, Homo sapiens
attcttgcttcacactcctctg

SEQ ID NO: 7081879 - DNA, 22 bp, Homo sapiens
attcttgcagtatacaactact

SEQ ID NO: 7081880 - DNA, 22 bp, Homo sapiens
attcttgcttcacactcctctg

SEQ ID NO: 7081881 - DNA, 22 bp, Homo sapiens
attcttggagcagtcaaagaag

SEQ ID NO: 7081882 - DNA, 22 bp, Homo sapiens
attcttggcaaggagatttaaa

SEQ ID NO: 7081883 - DNA, 22 bp, Homo sapiens
attcttggcccgtcctcacgca

SEQ ID NO: 7081884 - DNA, 21 bp, Homo sapiens
attcttggcttagctctctgg

SEQ ID NO: 7081885 - DNA, 22 bp, Homo sapiens
attcttgggatgggtgtcacaa

SEQ ID NO: 7081886 - DNA, 22 bp, Homo sapiens
attccttgggaattattgaatg

SEQ ID NO: 7081887 - DNA, 22 bp, Homo sapiens
attccttggaacagatgcgaag

SEQ ID NO: 7081888 - DNA, 22 bp, Homo sapiens
attccttggcattctggacttg

SEQ ID NO: 7081889 - DNA, 22 bp, Homo sapiens
attccttgggctgccttattat

SEQ ID NO: 7081890 - DNA, 22 bp, Homo sapiens
attccttgtatatctacatgca

SEQ ID NO: 7081891 - DNA, 22 bp, Homo sapiens
attctttagttggcttcttgcc

SEQ ID NO: 7081892 - DNA, 22 bp, Homo sapiens
attctttagttggcttcttgcc

SEQ ID NO: 7081893 - DNA, 22 bp, Homo sapiens
attctttagccagcaggtatat

SEQ ID NO: 7081894 - DNA, 22 bp, Homo sapiens
attctttagttggcttcttgcc

SEQ ID NO: 7081895 - DNA, 22 bp, Homo sapiens
attctttcatataaaggctcag

SEQ ID NO: 7081896 - DNA, 22 bp, Homo sapiens
attctttcatataaaggctcag

SEQ ID NO: 7081897 - DNA, 22 bp, Homo sapiens
attctttcaaggaatagttatt

SEQ ID NO: 7081898 - DNA, 22 bp, Homo sapiens
attctttaattcaattgaagga

SEQ ID NO: 7081899 - DNA, 22 bp, Homo sapiens
attctttaattcaattgaagga

SEQ ID NO: 7081900 - DNA, 22 bp, Homo sapiens
attcttgtttaatttgcatccc

SEQ ID NO: 7081901 - DNA, 22 bp, Homo sapiens
attcttgtaaattttgtgtgaa

SEQ ID NO: 7081902 - DNA, 22 bp, Homo sapiens
attcttgtaaattttgtgtgaa

SEQ ID NO: 7081903 - DNA, 22 bp, Homo sapiens
attctttaattcaattgaagga

SEQ ID NO: 7081904 - DNA, 22 bp, Homo sapiens
attctttacattggcttcttcc

SEQ ID NO: 7081905 - DNA, 22 bp, Homo sapiens
attctttacattggcttcttcc

SEQ ID NO: 7081906 - DNA, 22 bp, Homo sapiens
gcagctgctggaagttcctgcc

SEQ ID NO: 7081907 - DNA, 22 bp, Homo sapiens
gcagctgctggaagttcctgcc

SEQ ID NO: 7081908 - DNA, 22 bp, Homo sapiens
gcagctgctcccttttacagtg

SEQ ID NO: 7081909 - DNA, 22 bp, Homo sapiens
gcagctgctcccttttacagtg

SEQ ID NO: 7081910 - DNA, 22 bp, Homo sapiens
gcagctgctggaagttcctgcc

SEQ ID NO: 7081911 - DNA, 22 bp, Homo sapiens
gcagctgctggaagttcctgcc

SEQ ID NO: 7081912 - DNA, 22 bp, Homo sapiens
gcagctgctggagggaggcagg

SEQ ID NO: 7081913 - DNA, 22 bp, Homo sapiens
gcagctgcgaagaagtctatct

SEQ ID NO: 7081914 - DNA, 22 bp, Homo sapiens
gcagctgcgctggtgtggggca

SEQ ID NO: 7081915 - DNA, 22 bp, Homo sapiens
gcagctgcgctggtgtggggca

SEQ ID NO: 7081916 - DNA, 22 bp, Homo sapiens
gcagctgcgctggtgtggggca

SEQ ID NO: 7081917 - DNA, 22 bp, Homo sapiens
gcagctgctcacattctcacaa

SEQ ID NO: 7081918 - DNA, 22 bp, Homo sapiens
gcagctgctcacattctcacaa

SEQ ID NO: 7081919 - DNA, 22 bp, Homo sapiens
gcagcgaggtgatgaaatagct

SEQ ID NO: 7081920 - DNA, 22 bp, Homo sapiens
gcagcgaggtgatgaaatagct

SEQ ID NO: 7081921 - DNA, 22 bp, Homo sapiens
gcagcgaggtgatgaaatagct

SEQ ID NO: 7081922 - DNA, 22 bp, Homo sapiens
gcagcgaggtgatgaaatagct

SEQ ID NO: 7081923 - DNA, 22 bp, Homo sapiens
gcagctgcctattcagggcttg

SEQ ID NO: 7081924 - DNA, 22 bp, Homo sapiens
gcagctgcctattcagggcttg

SEQ ID NO: 7081925 - DNA, 22 bp, Homo sapiens
gcagctgccttcagctggatgg

SEQ ID NO: 7081926 - DNA, 22 bp, Homo sapiens
gcagctgccttcagctggatgg

SEQ ID NO: 7081927 - DNA, 22 bp, Homo sapiens
gcagctgccttcagctggatgg

SEQ ID NO: 7081928 - DNA, 22 bp, Homo sapiens
gcagctgcgaagaagtctatct

SEQ ID NO: 7081929 - DNA, 22 bp, Homo sapiens
gcagctggacccacacggctta

SEQ ID NO: 7081930 - DNA, 22 bp, Homo sapiens
gcagctggacccacacggctta

SEQ ID NO: 7081931 - DNA, 22 bp, Homo sapiens
gcagctggacccacacggctta

SEQ ID NO: 7081932 - DNA, 22 bp, Homo sapiens
attccttgcacatcagatagtt

SEQ ID NO: 7081933 - DNA, 22 bp, Homo sapiens
attccttgcacatcagatagtt

SEQ ID NO: 7081934 - DNA, 22 bp, Homo sapiens
attccttgctctcatcaacctt

SEQ ID NO: 7081935 - DNA, 22 bp, Homo sapiens
gcagctgctggagggaggcagg

SEQ ID NO: 7081936 - DNA, 22 bp, Homo sapiens
gcagctgctggagggaggcagg

SEQ ID NO: 7081937 - DNA, 22 bp, Homo sapiens
gcagctgctggagggaggcagg

SEQ ID NO: 7081938 - DNA, 22 bp, Homo sapiens
gcagctgctgggatcatttagg

SEQ ID NO: 7081939 - DNA, 22 bp, Homo sapiens
gcagctgctgggatcatttagg

SEQ ID NO: 7081940 - DNA, 22 bp, Homo sapiens
gcagctgctgtggcatcaagct

SEQ ID NO: 7081941 - DNA, 22 bp, Homo sapiens
gcagctgctgtggcatcaagct

SEQ ID NO: 7081942 - DNA, 19 bp, Homo sapiens
gcagctgcttgaaaagaaa

SEQ ID NO: 7081943 - DNA, 19 bp, Homo sapiens
gcagctgcttgaaaagaaa

SEQ ID NO: 7081944 - DNA, 19 bp, Homo sapiens
gcagctgcttgaaaagaaa

SEQ ID NO: 7081945 - DNA, 22 bp, Homo sapiens
gcagctggaagtgacactctgt

SEQ ID NO: 7081946 - DNA, 22 bp, Homo sapiens
gcagctggaagtgacactctgt

SEQ ID NO: 7081947 - DNA, 22 bp, Homo sapiens
attcagaagcaatcacagtgag

SEQ ID NO: 7081948 - DNA, 22 bp, Homo sapiens
attcagaagcaatcacagtgag

SEQ ID NO: 7081949 - DNA, 22 bp, Homo sapiens
attcagaagctattcttagttc

SEQ ID NO: 7081950 - DNA, 20 bp, Homo sapiens
attcagaataggcatgtaaa

SEQ ID NO: 7081951 - DNA, 22 bp, Homo sapiens
attcagaattgtgggcagtaca

SEQ ID NO: 7081952 - DNA, 22 bp, Homo sapiens
attcagaatggcaaacttctag

SEQ ID NO: 7081953 - DNA, 22 bp, Homo sapiens
gcagatggaaagtgcttgaggg

SEQ ID NO: 7081954 - DNA, 20 bp, Homo sapiens
gcagcagacagacaggggac

SEQ ID NO: 7081955 - DNA, 22 bp, Homo sapiens
gcagatggaaagtgcttgaggg

SEQ ID NO: 7081956 - DNA, 22 bp, Homo sapiens
attcagaattgtgggcagtaca

SEQ ID NO: 7081957 - DNA, 23 bp, Homo sapiens
attcagaattgtgtgtttgtata

SEQ ID NO: 7081958 - DNA, 22 bp, Homo sapiens
attcagaattttggggagctaa

SEQ ID NO: 7081959 - DNA, 22 bp, Homo sapiens
gcagcagaggccctactctttg

SEQ ID NO: 7081960 - DNA, 21 bp, Homo sapiens
gcagcagaggcttgacagaca

SEQ ID NO: 7081961 - DNA, 21 bp, Homo sapiens
gcagcagaggcttgacagaca

SEQ ID NO: 7081962 - DNA, 22 bp, Homo sapiens
gcagcagagtagacagagccct

SEQ ID NO: 7081963 - DNA, 22 bp, Homo sapiens
gcagcagagaccccaggaagga

SEQ ID NO: 7081964 - DNA, 22 bp, Homo sapiens
gcagcagagaccccaggaagga

SEQ ID NO: 7081965 - DNA, 22 bp, Homo sapiens
gcagcagagaccccaggaagga

SEQ ID NO: 7081966 - DNA, 17 bp, Homo sapiens
gcagcagagagaccctc

SEQ ID NO: 7081967 - DNA, 20 bp, Homo sapiens
gcagcagacagacaggggac

SEQ ID NO: 7081968 - DNA, 20 bp, Homo sapiens
gcagcagacagacaggggac

SEQ ID NO: 7081969 - DNA, 22 bp, Homo sapiens
gcagcagagaacacaatgatgg

SEQ ID NO: 7081970 - DNA, 22 bp, Homo sapiens
gcagcagagaccccaggaagga

SEQ ID NO: 7081971 - DNA, 22 bp, Homo sapiens
attcataacggcaaatgtcacc

SEQ ID NO: 7081972 - DNA, 22 bp, Homo sapiens
attcataagtaaatgattacct

SEQ ID NO: 7081973 - DNA, 22 bp, Homo sapiens
attcatagctcagtacagactc

SEQ ID NO: 7081974 - DNA, 22 bp, Homo sapiens
attcatatcatagagttattga

SEQ ID NO: 7081975 - DNA, 22 bp, Homo sapiens
attcatatcatagagttattga

SEQ ID NO: 7081976 - DNA, 22 bp, Homo sapiens
attcatatcatagagttattga

SEQ ID NO: 7081977 - DNA, 22 bp, Homo sapiens
attcatcagctaatggacattt

SEQ ID NO: 7081978 - DNA, 22 bp, Homo sapiens
attcatcagctaatggacattt

SEQ ID NO: 7081979 - DNA, 22 bp, Homo sapiens
attcatccttaccagtccccgg

SEQ ID NO: 7081980 - DNA, 22 bp, Homo sapiens
attcatccttaccagtccccgg

SEQ ID NO: 7081981 - DNA, 22 bp, Homo sapiens
attcatctatgactctaatgtg

SEQ ID NO: 7081982 - DNA, 22 bp, Homo sapiens
attcatctctgcatatagagtc

SEQ ID NO: 7081983 - DNA, 22 bp, Homo sapiens
attcatctgtacttcaatatct

SEQ ID NO: 7081984 - DNA, 22 bp, Homo sapiens
gcagcgaggtgatgaaatagct

SEQ ID NO: 7081985 - DNA, 22 bp, Homo sapiens
attcagtttcaatcattgtagt

SEQ ID NO: 7081986 - DNA, 22 bp, Homo sapiens
attcagttctaaggtcagtgcc

SEQ ID NO: 7081987 - DNA, 22 bp, Homo sapiens
gcagcagagtttgggagatggt

SEQ ID NO: 7081988 - DNA, 22 bp, Homo sapiens
gcagcagagtttgggagatggt

SEQ ID NO: 7081989 - DNA, 22 bp, Homo sapiens
gcagcagagtttgggagatggt

SEQ ID NO: 7081990 - DNA, 22 bp, Homo sapiens
gcagcagagtttgggagatggt

SEQ ID NO: 7081991 - DNA, 22 bp, Homo sapiens
gcagcagagtttgggagatggt

SEQ ID NO: 7081992 - DNA, 22 bp, Homo sapiens
gcagcagatgctttcatggaca

SEQ ID NO: 7081993 - DNA, 22 bp, Homo sapiens
gcagcagatgctttcatggaca

SEQ ID NO: 7081994 - DNA, 22 bp, Homo sapiens
attcagaaagcaagtgctgggt

SEQ ID NO: 7081995 - DNA, 21 bp, Homo sapiens
attcagaaagggaataaactc

SEQ ID NO: 7081996 - DNA, 22 bp, Homo sapiens
attcagaaagggttgcctggtt

SEQ ID NO: 7081997 - DNA, 22 bp, Homo sapiens
attcagaaagttgtcatatttg

SEQ ID NO: 7081998 - DNA, 22 bp, Homo sapiens
attcagaaatagaaaatttgat

SEQ ID NO: 7081999 - DNA, 22 bp, Homo sapiens
attcagaagcaatcacagtgag

SEQ ID NO: 7082000 - DNA, 22 bp, Homo sapiens
attcagaagcaatcacagtgag

SEQ ID NO: 7082001 - DNA, 22 bp, Homo sapiens
attcactgtcagcttgcatggg

SEQ ID NO: 7082002 - DNA, 22 bp, Homo sapiens
attcactgtggtgactgatata

SEQ ID NO: 7082003 - DNA, 22 bp, Homo sapiens
attcactgtggtgtctgatata

SEQ ID NO: 7082004 - DNA, 22 bp, Homo sapiens
attcagaaactctgggcagaac

SEQ ID NO: 7082005 - DNA, 22 bp, Homo sapiens
attcagaaagatatgcctggtt

SEQ ID NO: 7082006 - DNA, 22 bp, Homo sapiens
attcacctttccccaaaatgag

SEQ ID NO: 7082007 - DNA, 22 bp, Homo sapiens
attcactggcagacagaactca

SEQ ID NO: 7082008 - DNA, 22 bp, Homo sapiens
attcactggcagacagaactca

SEQ ID NO: 7082009 - DNA, 23 bp, Homo sapiens
attcactcagtgagagggcagcc

SEQ ID NO: 7082010 - DNA, 22 bp, Homo sapiens
attcactggtgtcagggatcag

SEQ ID NO: 7082011 - DNA, 22 bp, Homo sapiens
attcactggtgtcagggatcag

SEQ ID NO: 7082012 - DNA, 22 bp, Homo sapiens
attcactgtcagcttgcatggg

SEQ ID NO: 7082013 - DNA, 22 bp, Homo sapiens
attcacatgcccaagcagcacc

SEQ ID NO: 7082014 - DNA, 22 bp, Homo sapiens
attcacatgcccaagcagcacc

SEQ ID NO: 7082015 - DNA, 22 bp, Homo sapiens
attcacatgtgcttcttatcac

SEQ ID NO: 7082016 - DNA, 22 bp, Homo sapiens
attcacatgcccaagcagcacc

SEQ ID NO: 7082017 - DNA, 22 bp, Homo sapiens
attcacatgttgaagccctaac

SEQ ID NO: 7082018 - DNA, 22 bp, Homo sapiens
attcacattgagcttcactgtg

SEQ ID NO: 7082019 - DNA, 22 bp, Homo sapiens
attcacattgagcttcactgtg

SEQ ID NO: 7082020 - DNA, 22 bp, Homo sapiens
attcacattgagcttcactgtg

SEQ ID NO: 7082021 - DNA, 22 bp, Homo sapiens
attcacatttacaaagcactca

SEQ ID NO: 7082022 - DNA, 22 bp, Homo sapiens
attcacatttagacatcaggta

SEQ ID NO: 7082023 - DNA, 22 bp, Homo sapiens
attcacatttagacatcaggta

SEQ ID NO: 7082024 - DNA, 22 bp, Homo sapiens
attcacattttatttcactgga

SEQ ID NO: 7082025 - DNA, 22 bp, Homo sapiens
attcacattttatttcactgga

SEQ ID NO: 7082026 - DNA, 22 bp, Homo sapiens
attcacattttatttcactgga

SEQ ID NO: 7082027 - DNA, 22 bp, Homo sapiens
attcaccaagaatgatttcagt

SEQ ID NO: 7082028 - DNA, 22 bp, Homo sapiens
attcaccatggaccaggggcct

SEQ ID NO: 7082029 - DNA, 22 bp, Homo sapiens
attcacccagcacagtggcagc

SEQ ID NO: 7082030 - DNA, 22 bp, Homo sapiens
gcacctggggtacacagctaca

SEQ ID NO: 7082031 - DNA, 22 bp, Homo sapiens
attcaagtaaacactgaaggaa

SEQ ID NO: 7082032 - DNA, 22 bp, Homo sapiens
attcaaggtatttaaaacataa

SEQ ID NO: 7082033 - DNA, 22 bp, Homo sapiens
attcaagattaattctatgtca

SEQ ID NO: 7082034 - DNA, 22 bp, Homo sapiens
attcaagaggaacaatgaagat

SEQ ID NO: 7082035 - DNA, 22 bp, Homo sapiens
gcacggctaatttttgtatttt

SEQ ID NO: 7082036 - DNA, 22 bp, Homo sapiens
gcacggcctcgcccttggaacc

SEQ ID NO: 7082037 - DNA, 22 bp, Homo sapiens
gcacctttggaatgaaaagttg

SEQ ID NO: 7082038 - DNA, 22 bp, Homo sapiens
gcacctttttctaggagaatgt

SEQ ID NO: 7082039 - DNA, 22 bp, Homo sapiens
gcacctggtttatataatcata

SEQ ID NO: 7082040 - DNA, 22 bp, Homo sapiens
gcacctggggtacacagctaca

SEQ ID NO: 7082041 - DNA, 22 bp, Homo sapiens
gcaccttggctttcttggtggc

SEQ ID NO: 7082042 - DNA, 22 bp, Homo sapiens
gcaccttggctttcttggtggc

SEQ ID NO: 7082043 - DNA, 22 bp, Homo sapiens
gcaccttgggaagcgccagttg

SEQ ID NO: 7082044 - DNA, 22 bp, Homo sapiens
gcacctttctatattcagtggc

SEQ ID NO: 7082045 - DNA, 22 bp, Homo sapiens
gcactaaaccaacatgtaataa

SEQ ID NO: 7082046 - DNA, 22 bp, Homo sapiens
gcacgtgcacacatgtgtacaa

SEQ ID NO: 7082047 - DNA, 22 bp, Homo sapiens
gcacgtggaatgctcatgagcc

SEQ ID NO: 7082048 - DNA, 22 bp, Homo sapiens
gcacgtggaatgctcatgagcc

SEQ ID NO: 7082049 - DNA, 22 bp, Homo sapiens
gcacggctaatttttgtatttt

SEQ ID NO: 7082050 - DNA, 22 bp, Homo sapiens
gcacggctaatttttgtatttt

SEQ ID NO: 7082051 - DNA, 22 bp, Homo sapiens
gcacggctaatttttgtatttt

SEQ ID NO: 7082052 - DNA, 22 bp, Homo sapiens
gcactagaagtacgccttgtaa

SEQ ID NO: 7082053 - DNA, 22 bp, Homo sapiens
gcactagaatcccttcaagaag

SEQ ID NO: 7082054 - DNA, 22 bp, Homo sapiens
gcactaggtaagtgggtggcaa

SEQ ID NO: 7082055 - DNA, 22 bp, Homo sapiens
gcactagattctgaagcagcag

SEQ ID NO: 7082056 - DNA, 22 bp, Homo sapiens
gcactagtcaagtgaacaattt

SEQ ID NO: 7082057 - DNA, 22 bp, Homo sapiens
gcactagtctaggtgctaagat

SEQ ID NO: 7082058 - DNA, 22 bp, Homo sapiens
attcacagtttcctcatattct

SEQ ID NO: 7082059 - DNA, 22 bp, Homo sapiens
attcacatgatgtatgtagggc

SEQ ID NO: 7082060 - DNA, 22 bp, Homo sapiens
attcacaatgatacataagcga

SEQ ID NO: 7082061 - DNA, 22 bp, Homo sapiens
attcacaatgatacataagcga

SEQ ID NO: 7082062 - DNA, 22 bp, Homo sapiens
attcacaatagcagcttgcatg

SEQ ID NO: 7082063 - DNA, 22 bp, Homo sapiens
gcactagtctaggtgctaagat

SEQ ID NO: 7082064 - DNA, 22 bp, Homo sapiens
gcactagtgttcttcagtaata

SEQ ID NO: 7082065 - DNA, 22 bp, Homo sapiens
gcactagttctactgccagcaa

SEQ ID NO: 7082066 - DNA, 22 bp, Homo sapiens
gcactatagctgcagcacagag

SEQ ID NO: 7082067 - DNA, 22 bp, Homo sapiens
attcaaagtactagctattttt

SEQ ID NO: 7082068 - DNA, 22 bp, Homo sapiens
attcaaagtctagatgtagtgt

SEQ ID NO: 7082069 - DNA, 22 bp, Homo sapiens
attcaaatgtcaaatccaccag

SEQ ID NO: 7082070 - DNA, 22 bp, Homo sapiens
attcaaattaagttaattcagc

SEQ ID NO: 7082071 - DNA, 22 bp, Homo sapiens
attcaaattaagttaattcagc

SEQ ID NO: 7082072 - DNA, 22 bp, Homo sapiens
attcaacatattctgagtaaaa

SEQ ID NO: 7082073 - DNA, 22 bp, Homo sapiens
attcaacatattctgagtaaaa

SEQ ID NO: 7082074 - DNA, 22 bp, Homo sapiens
attcaacatattctgagtaaaa

SEQ ID NO: 7082075 - DNA, 21 bp, Homo sapiens
attcaactagatgattatttc

SEQ ID NO: 7082076 - DNA, 21 bp, Homo sapiens
attcaactagatgattatttc

SEQ ID NO: 7082077 - DNA, 22 bp, Homo sapiens
attcaactagtgattgtgttat

SEQ ID NO: 7082078 - DNA, 22 bp, Homo sapiens
attcaactagtgattgtgttat

SEQ ID NO: 7082079 - DNA, 22 bp, Homo sapiens
attcaagagcccatgtttcctg

SEQ ID NO: 7082080 - DNA, 22 bp, Homo sapiens
attcaactgtaaacttgttcac

SEQ ID NO: 7082081 - DNA, 22 bp, Homo sapiens
attcaacttataagatattaat

SEQ ID NO: 7082082 - DNA, 22 bp, Homo sapiens
attcaacttataagatattaat

SEQ ID NO: 7082083 - DNA, 22 bp, Homo sapiens
attcaactatgtatagtcttct

SEQ ID NO: 7082084 - DNA, 22 bp, Homo sapiens
attcaactgtaaacttgttcac

SEQ ID NO: 7082085 - DNA, 22 bp, Homo sapiens
attcaacttacaaaggagaaga

SEQ ID NO: 7082086 - DNA, 22 bp, Homo sapiens
attatttctcactcacataata

SEQ ID NO: 7082087 - DNA, 22 bp, Homo sapiens
attcaaagtactagctattttt

SEQ ID NO: 7082088 - DNA, 22 bp, Homo sapiens
attcaaagtactagctattttt

SEQ ID NO: 7082089 - DNA, 22 bp, Homo sapiens
attatttccttgctttgaggaa

SEQ ID NO: 7082090 - DNA, 22 bp, Homo sapiens
attagtgttcttatcttctagg

SEQ ID NO: 7082091 - DNA, 22 bp, Homo sapiens
attatttccttgctttgaggaa

SEQ ID NO: 7082092 - DNA, 22 bp, Homo sapiens
attagtgttcttatcttctagg

SEQ ID NO: 7082093 - DNA, 22 bp, Homo sapiens
attagtgttgtaagaagctgcc

SEQ ID NO: 7082094 - DNA, 22 bp, Homo sapiens
attagtgttgtggcttcatggc

SEQ ID NO: 7082095 - DNA, 22 bp, Homo sapiens
attagttgaacaagttaagtaa

SEQ ID NO: 7082096 - DNA, 22 bp, Homo sapiens
attagttgatctatatccaaag

SEQ ID NO: 7082097 - DNA, 22 bp, Homo sapiens
attagttggggtggagaaggat

SEQ ID NO: 7082098 - DNA, 22 bp, Homo sapiens
attagtgtggaccctaatttaa

SEQ ID NO: 7082099 - DNA, 22 bp, Homo sapiens
attagtgtgtaggctggaaaaa

SEQ ID NO: 7082100 - DNA, 22 bp, Homo sapiens
attagtgtctgtgaataattct

SEQ ID NO: 7082101 - DNA, 22 bp, Homo sapiens
attagtgtctgtgaataattct

SEQ ID NO: 7082102 - DNA, 22 bp, Homo sapiens
attagtgtggaccctaatttaa

SEQ ID NO: 7082103 - DNA, 22 bp, Homo sapiens
attagtgtacatctcacacgca

SEQ ID NO: 7082104 - DNA, 22 bp, Homo sapiens
attagtgtcatgttgaggactt

SEQ ID NO: 7082105 - DNA, 22 bp, Homo sapiens
attagtcttcacctctctttgg

SEQ ID NO: 7082106 - DNA, 22 bp, Homo sapiens
attagtcttctcatttggatcc

SEQ ID NO: 7082107 - DNA, 22 bp, Homo sapiens
attagtcttctcatttggatcc

SEQ ID NO: 7082108 - DNA, 22 bp, Homo sapiens
attaggtggggttgttactgtt

SEQ ID NO: 7082109 - DNA, 22 bp, Homo sapiens
attaggtaatctttagatacac

SEQ ID NO: 7082110 - DNA, 22 bp, Homo sapiens
attaggtagtataatctttgtt

SEQ ID NO: 7082111 - DNA, 22 bp, Homo sapiens
attaggtatgattctcatttca

SEQ ID NO: 7082112 - DNA, 22 bp, Homo sapiens
attaggttgtgctttgtggaca

SEQ ID NO: 7082113 - DNA, 22 bp, Homo sapiens
attagtaaaacattgtatatgt

SEQ ID NO: 7082114 - DNA, 22 bp, Homo sapiens
attagtaaaacattgtatatgt

SEQ ID NO: 7082115 - DNA, 22 bp, Homo sapiens
attagtattcagtttataacac

SEQ ID NO: 7082116 - DNA, 22 bp, Homo sapiens
attagtattcagtttataacac

SEQ ID NO: 7082117 - DNA, 22 bp, Homo sapiens
attagtattcagtttataacac

SEQ ID NO: 7082118 - DNA, 22 bp, Homo sapiens
attagtctactgtctaataaat

SEQ ID NO: 7082119 - DNA, 22 bp, Homo sapiens
attaggcaattctgggcatctc

SEQ ID NO: 7082120 - DNA, 22 bp, Homo sapiens
attaggcaattctgggcatctc

SEQ ID NO: 7082121 - DNA, 22 bp, Homo sapiens
attaggcactagaatgtcaatt

SEQ ID NO: 7082122 - DNA, 22 bp, Homo sapiens
attaggcactagaatgtcaatt

SEQ ID NO: 7082123 - DNA, 22 bp, Homo sapiens
attaggcagacaacgtagccgg

SEQ ID NO: 7082124 - DNA, 22 bp, Homo sapiens
attaggcagggcatggtggctc

SEQ ID NO: 7082125 - DNA, 22 bp, Homo sapiens
attaggcatatatgcttttaat

SEQ ID NO: 7082126 - DNA, 22 bp, Homo sapiens
attaggcatatatgcttttaat

SEQ ID NO: 7082127 - DNA, 22 bp, Homo sapiens
attaggcagtgccattgtacgg

SEQ ID NO: 7082128 - DNA, 22 bp, Homo sapiens
attaggcagtgccattgtacgg

SEQ ID NO: 7082129 - DNA, 22 bp, Homo sapiens
attaggcttcctcaagaggagt

SEQ ID NO: 7082130 - DNA, 22 bp, Homo sapiens
attagggaaactgacttgtctc

SEQ ID NO: 7082131 - DNA, 22 bp, Homo sapiens
attagggctggatgcaaggaaa

SEQ ID NO: 7082132 - DNA, 22 bp, Homo sapiens
attaggtaagataaagcagagg

SEQ ID NO: 7082133 - DNA, 22 bp, Homo sapiens
attaggcattatggggataagg

SEQ ID NO: 7082134 - DNA, 22 bp, Homo sapiens
attaggcattatggggataagg

SEQ ID NO: 7082135 - DNA, 22 bp, Homo sapiens
attaggcattatggggataagg

SEQ ID NO: 7082136 - DNA, 22 bp, Homo sapiens
attaggcattcatgcagctcct

SEQ ID NO: 7082137 - DNA, 22 bp, Homo sapiens
attaggcattctgaatgaggtc

SEQ ID NO: 7082138 - DNA, 22 bp, Homo sapiens
attaggcattctgaatgaggtc

SEQ ID NO: 7082139 - DNA, 22 bp, Homo sapiens
attaggccggagaagagggaca

SEQ ID NO: 7082140 - DNA, 22 bp, Homo sapiens
attaggctctttgtgctagtta

SEQ ID NO: 7082141 - DNA, 22 bp, Homo sapiens
attaggatgtgtatattgtgtt

SEQ ID NO: 7082142 - DNA, 22 bp, Homo sapiens
attaggaagaggatgtcagcat

SEQ ID NO: 7082143 - DNA, 22 bp, Homo sapiens
attagctttaaaccacagcagt

SEQ ID NO: 7082144 - DNA, 22 bp, Homo sapiens
attagctttaaagactttgatt

SEQ ID NO: 7082145 - DNA, 22 bp, Homo sapiens
attagctttatttgaaatagga

SEQ ID NO: 7082146 - DNA, 22 bp, Homo sapiens
attagctttggattcagaagat

SEQ ID NO: 7082147 - DNA, 22 bp, Homo sapiens
attagctttggtggaaaggagt

SEQ ID NO: 7082148 - DNA, 22 bp, Homo sapiens
attagatacacagatttccact

SEQ ID NO: 7082149 - DNA, 22 bp, Homo sapiens
attagatacacagatttccact

SEQ ID NO: 7082150 - DNA, 22 bp, Homo sapiens
attagatgtgaccttagataaa

SEQ ID NO: 7082151 - DNA, 22 bp, Homo sapiens
attagcttaggcatgaagagaa

SEQ ID NO: 7082152 - DNA, 22 bp, Homo sapiens
attagcttagtgtttccgtaat

SEQ ID NO: 7082153 - DNA, 22 bp, Homo sapiens
attagcttatcacacaagctgc

SEQ ID NO: 7082154 - DNA, 22 bp, Homo sapiens
attagcttatcccatttctgaa

SEQ ID NO: 7082155 - DNA, 22 bp, Homo sapiens
attagcttattgtaaggtgaaa

SEQ ID NO: 7082156 - DNA, 21 bp, Homo sapiens
attagcttcaaaagcttgtct

SEQ ID NO: 7082157 - DNA, 22 bp, Homo sapiens
attagcttcaaagccatcaacc

SEQ ID NO: 7082158 - DNA, 22 bp, Homo sapiens
attagcttcctatagtaagggg

SEQ ID NO: 7082159 - DNA, 22 bp, Homo sapiens
attagcttctgaagcccttgaa

SEQ ID NO: 7082160 - DNA, 22 bp, Homo sapiens
attagcttctgtgcatggactt

SEQ ID NO: 7082161 - DNA, 20 bp, Homo sapiens
attagcttggagacagtggc

SEQ ID NO: 7082162 - DNA, 22 bp, Homo sapiens
attagcttggtatgccataaag

SEQ ID NO: 7082163 - DNA, 22 bp, Homo sapiens
attacagtgggtaaacagaatt

SEQ ID NO: 7082164 - DNA, 22 bp, Homo sapiens
attacaatcgagagaaacaaat

SEQ ID NO: 7082165 - DNA, 22 bp, Homo sapiens
attacaatcgagagaaacaaat

SEQ ID NO: 7082166 - DNA, 22 bp, Homo sapiens
attacaatcgagagaaacaaat

SEQ ID NO: 7082167 - DNA, 22 bp, Homo sapiens
gatatttaactctcacaggtcc

SEQ ID NO: 7082168 - DNA, 22 bp, Homo sapiens
attacaatcgagagaaacaaat

SEQ ID NO: 7082169 - DNA, 22 bp, Homo sapiens
attacaatcgagagaaacaaat

SEQ ID NO: 7082170 - DNA, 19 bp, Homo sapiens
gatattgcttgagtaactg

SEQ ID NO: 7082171 - DNA, 22 bp, Homo sapiens
gatatttaactctcacaggtcc

SEQ ID NO: 7082172 - DNA, 22 bp, Homo sapiens
gatatttaactctcacaggtcc

SEQ ID NO: 7082173 - DNA, 22 bp, Homo sapiens
gatattcataggcaggtattta

SEQ ID NO: 7082174 - DNA, 22 bp, Homo sapiens
gatattcataggcaggtattta

SEQ ID NO: 7082175 - DNA, 22 bp, Homo sapiens
gatattcaagtggaattattct

SEQ ID NO: 7082176 - DNA, 22 bp, Homo sapiens
gatattctacctgctgaccaag

SEQ ID NO: 7082177 - DNA, 22 bp, Homo sapiens
gatattctacctgctgaccaag

SEQ ID NO: 7082178 - DNA, 22 bp, Homo sapiens
gatattctatgtagaatgagct

SEQ ID NO: 7082179 - DNA, 22 bp, Homo sapiens
gatattctattttagccagcta

SEQ ID NO: 7082180 - DNA, 22 bp, Homo sapiens
gatattctggtgaaacctttgg

SEQ ID NO: 7082181 - DNA, 22 bp, Homo sapiens
gatatgtattccactataaagg

SEQ ID NO: 7082182 - DNA, 22 bp, Homo sapiens
gatatgtattgaatgatcattt

SEQ ID NO: 7082183 - DNA, 22 bp, Homo sapiens
gatatgtgcttgtaatatttat

SEQ ID NO: 7082184 - DNA, 22 bp, Homo sapiens
gatattcaaagattactgatat

SEQ ID NO: 7082185 - DNA, 22 bp, Homo sapiens
gatattcaactaaagtgaatta

SEQ ID NO: 7082186 - DNA, 22 bp, Homo sapiens
gatattcaagtggaattattct

SEQ ID NO: 7082187 - DNA, 22 bp, Homo sapiens
gatattcaagtggaattattct

SEQ ID NO: 7082188 - DNA, 22 bp, Homo sapiens
gatattcaagtggaattattct

SEQ ID NO: 7082189 - DNA, 22 bp, Homo sapiens
attactctgtctgcctctgacc

SEQ ID NO: 7082190 - DNA, 22 bp, Homo sapiens
attactccttttctagcaggtg

SEQ ID NO: 7082191 - DNA, 22 bp, Homo sapiens
attactgagcaacggtcatttc

SEQ ID NO: 7082192 - DNA, 22 bp, Homo sapiens
attactgagcttgtagctgcat

SEQ ID NO: 7082193 - DNA, 22 bp, Homo sapiens
attactagattgtcaagattta

SEQ ID NO: 7082194 - DNA, 23 bp, Homo sapiens
attacatgagcaaatatagctat

SEQ ID NO: 7082195 - DNA, 23 bp, Homo sapiens
attacatgagcaaatatagctat

SEQ ID NO: 7082196 - DNA, 22 bp, Homo sapiens
attacctatgctctagtaatca

SEQ ID NO: 7082197 - DNA, 22 bp, Homo sapiens
attacatatgttggcaacattt

SEQ ID NO: 7082198 - DNA, 22 bp, Homo sapiens
attacatgagagaatgtaaata

SEQ ID NO: 7082199 - DNA, 22 bp, Homo sapiens
attagaggttgttttgtaaaga

SEQ ID NO: 7082200 - DNA, 22 bp, Homo sapiens
gatttctaaggaggctgaactt

SEQ ID NO: 7082201 - DNA, 22 bp, Homo sapiens
gatttctacttgaacttgctaa

SEQ ID NO: 7082202 - DNA, 22 bp, Homo sapiens
gatttccttgcatattggtaat

SEQ ID NO: 7082203 - DNA, 22 bp, Homo sapiens
gatttccttgcatattggtaat

SEQ ID NO: 7082204 - DNA, 17 bp, Homo sapiens
gatttcctgaagttctt

SEQ ID NO: 7082205 - DNA, 22 bp, Homo sapiens
gatttcctcactaacatccatc

SEQ ID NO: 7082206 - DNA, 22 bp, Homo sapiens
gatttcctagacatggggcaga

SEQ ID NO: 7082207 - DNA, 22 bp, Homo sapiens
gatttcctaatgtggatctctg

SEQ ID NO: 7082208 - DNA, 22 bp, Homo sapiens
gatttcccagcaaaagctggtt

SEQ ID NO: 7082209 - DNA, 22 bp, Homo sapiens
gatttccctatagttttctctt

SEQ ID NO: 7082210 - DNA, 22 bp, Homo sapiens
gatttcccagaaaagtgatctc

SEQ ID NO: 7082211 - DNA, 23 bp, Homo sapiens
attagaaaggctttctggtgaaa

SEQ ID NO: 7082212 - DNA, 22 bp, Homo sapiens
gatttcaggctatctatgcaga

SEQ ID NO: 7082213 - DNA, 22 bp, Homo sapiens
attactgaggcaaagtagtttt

SEQ ID NO: 7082214 - DNA, 22 bp, Homo sapiens
attactgaggcaaagtagtttt

SEQ ID NO: 7082215 - DNA, 15 bp, Homo sapiens
attactgagtggtca

SEQ ID NO: 7082216 - DNA, 22 bp, Homo sapiens
attagaaaaactcaagggctct

SEQ ID NO: 7082217 - DNA, 22 bp, Homo sapiens
attagaaaaactcaagggctct

SEQ ID NO: 7082218 - DNA, 22 bp, Homo sapiens
attagaaaaactcaagggctct

SEQ ID NO: 7082219 - DNA, 23 bp, Homo sapiens
attagaaaggctttctggtgaaa

SEQ ID NO: 7082220 - DNA, 22 bp, Homo sapiens
atttctcagtgtgatcaggcct

SEQ ID NO: 7082221 - DNA, 22 bp, Homo sapiens
atttctcagttcctactgttta

SEQ ID NO: 7082222 - DNA, 22 bp, Homo sapiens
atttctcagttcctactgttta

SEQ ID NO: 7082223 - DNA, 17 bp, Homo sapiens
gcccacccttaggagct

SEQ ID NO: 7082224 - DNA, 22 bp, Homo sapiens
atttctgtagtccacattcttt

SEQ ID NO: 7082225 - DNA, 22 bp, Homo sapiens
atttctgctctgacctgaaagt

SEQ ID NO: 7082226 - DNA, 22 bp, Homo sapiens
atttctgctactgcaccctagt

SEQ ID NO: 7082227 - DNA, 22 bp, Homo sapiens
gccccaggttgcctgtcccagg

SEQ ID NO: 7082228 - DNA, 22 bp, Homo sapiens
gccccaggttgcctgtcccagg

SEQ ID NO: 7082229 - DNA, 22 bp, Homo sapiens
gcccccacaggcgggctcgggt

SEQ ID NO: 7082230 - DNA, 22 bp, Homo sapiens
gcccccacaggcgggctcgggt

SEQ ID NO: 7082231 - DNA, 22 bp, Homo sapiens
gcccccacaggcgggctcgggt

SEQ ID NO: 7082232 - DNA, 22 bp, Homo sapiens
atttctgttgcttataaattac

SEQ ID NO: 7082233 - DNA, 22 bp, Homo sapiens
atttctgtatcctgctgtcaga

SEQ ID NO: 7082234 - DNA, 22 bp, Homo sapiens
atttctgtggcttcattctcct

SEQ ID NO: 7082235 - DNA, 22 bp, Homo sapiens
atttctgttatacctttctcag

SEQ ID NO: 7082236 - DNA, 22 bp, Homo sapiens
atttctgttatacctttctcag

SEQ ID NO: 7082237 - DNA, 22 bp, Homo sapiens
atttccattatcatgacaaatt

SEQ ID NO: 7082238 - DNA, 22 bp, Homo sapiens
atttccatacacccatttctga

SEQ ID NO: 7082239 - DNA, 22 bp, Homo sapiens
atttccatagagcgtctcacag

SEQ ID NO: 7082240 - DNA, 21 bp, Homo sapiens
gcccacagtgaggaggatccc

SEQ ID NO: 7082241 - DNA, 21 bp, Homo sapiens
gcccacagtgaggaggatccc

SEQ ID NO: 7082242 - DNA, 22 bp, Homo sapiens
gcccacagtgtagcaggtactc

SEQ ID NO: 7082243 - DNA, 22 bp, Homo sapiens
gcccacagttaatgggggctct

SEQ ID NO: 7082244 - DNA, 22 bp, Homo sapiens
gcccacatttttggcttagagg

SEQ ID NO: 7082245 - DNA, 23 bp, Homo sapiens
gcccaccctcagcgtcctcacgg

SEQ ID NO: 7082246 - DNA, 23 bp, Homo sapiens
gcccaccctcagcgtcctcacgg

SEQ ID NO: 7082247 - DNA, 23 bp, Homo sapiens
gcccaccctcagcgtcctcacgg

SEQ ID NO: 7082248 - DNA, 23 bp, Homo sapiens
gcccaccctcagcgtcctcacgg

SEQ ID NO: 7082249 - DNA, 23 bp, Homo sapiens
gcccaccctcagcgtcctcacgg

SEQ ID NO: 7082250 - DNA, 23 bp, Homo sapiens
gcccaccctcagcgtcctcacgg

SEQ ID NO: 7082251 - DNA, 17 bp, Homo sapiens
gcccacccttaggagct

SEQ ID NO: 7082252 - DNA, 17 bp, Homo sapiens
gcccacccttaggagct

SEQ ID NO: 7082253 - DNA, 17 bp, Homo sapiens
gcccacccttaggagct

SEQ ID NO: 7082254 - DNA, 17 bp, Homo sapiens
gcccacccttaggagct

SEQ ID NO: 7082255 - DNA, 22 bp, Homo sapiens
gccaggctggtcttgaactcct

SEQ ID NO: 7082256 - DNA, 22 bp, Homo sapiens
gccaggctggggggagatgtct

SEQ ID NO: 7082257 - DNA, 22 bp, Homo sapiens
gccaggctggggggagatgtct

SEQ ID NO: 7082258 - DNA, 22 bp, Homo sapiens
gccaggctggccagcaccttct

SEQ ID NO: 7082259 - DNA, 22 bp, Homo sapiens
gccaggctggccagcaccttct

SEQ ID NO: 7082260 - DNA, 22 bp, Homo sapiens
gccaggctggccagcaccttct

SEQ ID NO: 7082261 - DNA, 22 bp, Homo sapiens
gccaggctggcaaaaggaaacc

SEQ ID NO: 7082262 - DNA, 22 bp, Homo sapiens
gccaggctggaaagaacagaca

SEQ ID NO: 7082263 - DNA, 22 bp, Homo sapiens
gccaggctggcaaaaggaaacc

SEQ ID NO: 7082264 - DNA, 22 bp, Homo sapiens
gccaggctggaaagaacagaca

SEQ ID NO: 7082265 - DNA, 22 bp, Homo sapiens
gccaggctgctggctgctgtcc

SEQ ID NO: 7082266 - DNA, 22 bp, Homo sapiens
gccaggcgggtctcaaactcct

SEQ ID NO: 7082267 - DNA, 22 bp, Homo sapiens
gccaggcgggtctcaaactcct

SEQ ID NO: 7082268 - DNA, 22 bp, Homo sapiens
gccaggctgctggctgctgtcc

SEQ ID NO: 7082269 - DNA, 19 bp, Homo sapiens
gccaggcctggacctgcag

SEQ ID NO: 7082270 - DNA, 19 bp, Homo sapiens
gccaggcctggacctgcag

SEQ ID NO: 7082271 - DNA, 19 bp, Homo sapiens
gccaggcctggacctgcag

SEQ ID NO: 7082272 - DNA, 22 bp, Homo sapiens
gccacaggtggaattaagaaat

SEQ ID NO: 7082273 - DNA, 22 bp, Homo sapiens
gccacaggtggaattaagaaat

SEQ ID NO: 7082274 - DNA, 22 bp, Homo sapiens
gccacaggtgggctctgggaaa

SEQ ID NO: 7082275 - DNA, 22 bp, Homo sapiens
gccacaggtgggctctgggaaa

SEQ ID NO: 7082276 - DNA, 22 bp, Homo sapiens
gccacaggtgggctctgggaaa

SEQ ID NO: 7082277 - DNA, 22 bp, Homo sapiens
gccacaggtgggctctgggaaa

SEQ ID NO: 7082278 - DNA, 22 bp, Homo sapiens
gccacaggtgggctctgggaaa

SEQ ID NO: 7082279 - DNA, 22 bp, Homo sapiens
gccacagtcactgctgcagggg

SEQ ID NO: 7082280 - DNA, 22 bp, Homo sapiens
gccacaggtcggctagagggtc

SEQ ID NO: 7082281 - DNA, 22 bp, Homo sapiens
gccacaggtcggctagagggtc

SEQ ID NO: 7082282 - DNA, 22 bp, Homo sapiens
gccacaggtcggctagagggtc

SEQ ID NO: 7082283 - DNA, 22 bp, Homo sapiens
gccacaggtactatgggagaga

SEQ ID NO: 7082284 - DNA, 22 bp, Homo sapiens
gccacaggtaggaacctacctc

SEQ ID NO: 7082285 - DNA, 22 bp, Homo sapiens
gccacaggtaggaacctacctc

SEQ ID NO: 7082286 - DNA, 22 bp, Homo sapiens
gccacaggtactatgggagaga

SEQ ID NO: 7082287 - DNA, 22 bp, Homo sapiens
gccacaggtactatgggagaga

SEQ ID NO: 7082288 - DNA, 22 bp, Homo sapiens
gccacaggtactatgggagaga

SEQ ID NO: 7082289 - DNA, 22 bp, Homo sapiens
gccacaggtactatgggagaga

SEQ ID NO: 7082290 - DNA, 22 bp, Homo sapiens
gccaggtgagaggactgaggct

SEQ ID NO: 7082291 - DNA, 19 bp, Homo sapiens
gccaggtcttgggtccagg

SEQ ID NO: 7082292 - DNA, 22 bp, Homo sapiens
gccaggctggtgcaaggatatt

SEQ ID NO: 7082293 - DNA, 19 bp, Homo sapiens
gccaggtcttgggtccagg

SEQ ID NO: 7082294 - DNA, 19 bp, Homo sapiens
gccaggtcttgggtccagg

SEQ ID NO: 7082295 - DNA, 22 bp, Homo sapiens
gccaggtgagaggactgaggct

SEQ ID NO: 7082296 - DNA, 22 bp, Homo sapiens
gccaggtgagtgcgcgccgtcc

SEQ ID NO: 7082297 - DNA, 22 bp, Homo sapiens
gccaggtgagtgcgcgccgtcc

SEQ ID NO: 7082298 - DNA, 22 bp, Homo sapiens
gccaggtgatttcaaagtcctt

SEQ ID NO: 7082299 - DNA, 22 bp, Homo sapiens
gccaggtgcacctgccctggcc

SEQ ID NO: 7082300 - DNA, 22 bp, Homo sapiens
gccaggtgcacctgccctggcc

SEQ ID NO: 7082301 - DNA, 22 bp, Homo sapiens
gccaggtggaggttgcagtgag

SEQ ID NO: 7082302 - DNA, 22 bp, Homo sapiens
gccaggtggaggttgcagtgag

SEQ ID NO: 7082303 - DNA, 22 bp, Homo sapiens
gccaggtggaggttgcagtgag

SEQ ID NO: 7082304 - DNA, 22 bp, Homo sapiens
gccaggtggaggttgcagtgag

SEQ ID NO: 7082305 - DNA, 22 bp, Homo sapiens
gccaggtgctatccctgcgctg

SEQ ID NO: 7082306 - DNA, 22 bp, Homo sapiens
gccaggtgctatccctgcgctg

SEQ ID NO: 7082307 - DNA, 22 bp, Homo sapiens
gccaggtgctatccctgcgctg

SEQ ID NO: 7082308 - DNA, 22 bp, Homo sapiens
gccaggtgcatggctgagtctc

SEQ ID NO: 7082309 - DNA, 22 bp, Homo sapiens
gccaggtgcatggctgagtctc

SEQ ID NO: 7082310 - DNA, 22 bp, Homo sapiens
gccaggtgcatattagaagcat

SEQ ID NO: 7082311 - DNA, 22 bp, Homo sapiens
gccaggtgcatggctgagtctc

SEQ ID NO: 7082312 - DNA, 22 bp, Homo sapiens
gccaggtgcacctgccctggcc

SEQ ID NO: 7082313 - DNA, 22 bp, Homo sapiens
gccaggtgcatattagaagcat

SEQ ID NO: 7082314 - DNA, 22 bp, Homo sapiens
gccaggtgcatattagaagcat

SEQ ID NO: 7082315 - DNA, 22 bp, Homo sapiens
gccaggtgcatattagaagcat

SEQ ID NO: 7082316 - DNA, 22 bp, Homo sapiens
atttccaggagttgaggtctga

SEQ ID NO: 7082317 - DNA, 22 bp, Homo sapiens
gccaggtggctgagcagctgca

SEQ ID NO: 7082318 - DNA, 22 bp, Homo sapiens
gccaggtggaggttgcagtgag

SEQ ID NO: 7082319 - DNA, 22 bp, Homo sapiens
gccaggtggctgagcagctgca

SEQ ID NO: 7082320 - DNA, 22 bp, Homo sapiens
gccaggtggctgagcagctgca

SEQ ID NO: 7082321 - DNA, 22 bp, Homo sapiens
gccaggtggctgagcagctgca

SEQ ID NO: 7082322 - DNA, 22 bp, Homo sapiens
gccaggtggctgagcagctgca

SEQ ID NO: 7082323 - DNA, 22 bp, Homo sapiens
gccaggtggctgagcagctgca

SEQ ID NO: 7082324 - DNA, 22 bp, Homo sapiens
atttccaggctgttttgtgaat

SEQ ID NO: 7082325 - DNA, 22 bp, Homo sapiens
atttcattgaagttaattcttc

SEQ ID NO: 7082326 - DNA, 22 bp, Homo sapiens
atttccagtcctaatgatctgg

SEQ ID NO: 7082327 - DNA, 22 bp, Homo sapiens
gcccccagaagggccacagatt

SEQ ID NO: 7082328 - DNA, 22 bp, Homo sapiens
gcccccagaagggccacagatt

SEQ ID NO: 7082329 - DNA, 22 bp, Homo sapiens
gcccccagaagggccacagatt

SEQ ID NO: 7082330 - DNA, 22 bp, Homo sapiens
gcccccagacctcagtgggctg

SEQ ID NO: 7082331 - DNA, 22 bp, Homo sapiens
gcccccagctctcaagctcaaa

SEQ ID NO: 7082332 - DNA, 22 bp, Homo sapiens
gcccccagctctcaagctcaaa

SEQ ID NO: 7082333 - DNA, 22 bp, Homo sapiens
gcccccaggtgacttatccaca

SEQ ID NO: 7082334 - DNA, 22 bp, Homo sapiens
gcccccgtagtagatgaggcgc

SEQ ID NO: 7082335 - DNA, 22 bp, Homo sapiens
gcccccgtagtagatgaggcgc

SEQ ID NO: 7082336 - DNA, 22 bp, Homo sapiens
atttggaaatgcatctcttgag

SEQ ID NO: 7082337 - DNA, 22 bp, Homo sapiens
atttggaaatgcatctcttgag

SEQ ID NO: 7082338 - DNA, 22 bp, Homo sapiens
atttggaaatgtaagaatgcaa

SEQ ID NO: 7082339 - DNA, 22 bp, Homo sapiens
atttggaaatgtaagaatgcaa

SEQ ID NO: 7082340 - DNA, 19 bp, Homo sapiens
atttggaaataaggtcttc

SEQ ID NO: 7082341 - DNA, 19 bp, Homo sapiens
atttggaaataaggtcttc

SEQ ID NO: 7082342 - DNA, 22 bp, Homo sapiens
atttggaaatacgcgcttttgg

SEQ ID NO: 7082343 - DNA, 22 bp, Homo sapiens
atttggaaacaattatattctt

SEQ ID NO: 7082344 - DNA, 22 bp, Homo sapiens
atttggaaacaattatattctt

SEQ ID NO: 7082345 - DNA, 22 bp, Homo sapiens
atttggaaacatgctgaccatg

SEQ ID NO: 7082346 - DNA, 22 bp, Homo sapiens
atttggaaacaaatggtttcgc

SEQ ID NO: 7082347 - DNA, 22 bp, Homo sapiens
atttggaaaatctggttataga

SEQ ID NO: 7082348 - DNA, 22 bp, Homo sapiens
atttggaaaagtttcttcaact

SEQ ID NO: 7082349 - DNA, 22 bp, Homo sapiens
atttggaaaagtttcttcaact

SEQ ID NO: 7082350 - DNA, 22 bp, Homo sapiens
atttgctgagctcaaagaaaag

SEQ ID NO: 7082351 - DNA, 22 bp, Homo sapiens
gccccctctttggagccagcca

SEQ ID NO: 7082352 - DNA, 22 bp, Homo sapiens
atttgctagcaagtattctgaa

SEQ ID NO: 7082353 - DNA, 22 bp, Homo sapiens
gcctaggggtaagagtactggc

SEQ ID NO: 7082354 - DNA, 20 bp, Homo sapiens
gcctaggggttgggaaagca

SEQ ID NO: 7082355 - DNA, 21 bp, Homo sapiens
gcctagggagatgggactgcc

SEQ ID NO: 7082356 - DNA, 22 bp, Homo sapiens
gcctaggagtggggatggcggt

SEQ ID NO: 7082357 - DNA, 22 bp, Homo sapiens
gcctaggagtacagaatggttt

SEQ ID NO: 7082358 - DNA, 22 bp, Homo sapiens
atttggaagaaatctgtcacag

SEQ ID NO: 7082359 - DNA, 22 bp, Homo sapiens
atttggaagaaatctgtcacag

SEQ ID NO: 7082360 - DNA, 22 bp, Homo sapiens
atttggaacttataataagttt

SEQ ID NO: 7082361 - DNA, 22 bp, Homo sapiens
atttggaacttataataagttt

SEQ ID NO: 7082362 - DNA, 22 bp, Homo sapiens
atttggaacttataataagttt

SEQ ID NO: 7082363 - DNA, 22 bp, Homo sapiens
atttggaactgggcatgcaaac

SEQ ID NO: 7082364 - DNA, 22 bp, Homo sapiens
atttggaactgggcatgcaaac

SEQ ID NO: 7082365 - DNA, 22 bp, Homo sapiens
atttggaacaaatattagtaaa

SEQ ID NO: 7082366 - DNA, 22 bp, Homo sapiens
atttggaaatgtaagaatgcaa

SEQ ID NO: 7082367 - DNA, 22 bp, Homo sapiens
atttggaacaaatattagtaaa

SEQ ID NO: 7082368 - DNA, 22 bp, Homo sapiens
gcctctgatggaggccagcgct

SEQ ID NO: 7082369 - DNA, 22 bp, Homo sapiens
gcctctgagtttggagaagagc

SEQ ID NO: 7082370 - DNA, 22 bp, Homo sapiens
gcctcaagacatttttaattgc

SEQ ID NO: 7082371 - DNA, 22 bp, Homo sapiens
gcctcacagactgactgaaagc

SEQ ID NO: 7082372 - DNA, 22 bp, Homo sapiens
gcctcacagactgactgaaagc

SEQ ID NO: 7082373 - DNA, 22 bp, Homo sapiens
gcctcacatattcatggttact

SEQ ID NO: 7082374 - DNA, 22 bp, Homo sapiens
gcctcaaatgtggagcactatt

SEQ ID NO: 7082375 - DNA, 22 bp, Homo sapiens
gcctagggttggcctgagaatc

SEQ ID NO: 7082376 - DNA, 22 bp, Homo sapiens
gcctagggtgctcagggacgag

SEQ ID NO: 7082377 - DNA, 22 bp, Homo sapiens
gcctagggtgctcagggacgag

SEQ ID NO: 7082378 - DNA, 22 bp, Homo sapiens
gcctagggtgctcagggacgag

SEQ ID NO: 7082379 - DNA, 22 bp, Homo sapiens
gcctgagagttgaagttcagtg

SEQ ID NO: 7082380 - DNA, 22 bp, Homo sapiens
gcctgagatcaggagaaagcca

SEQ ID NO: 7082381 - DNA, 22 bp, Homo sapiens
gcctgagagttgaagttcagtg

SEQ ID NO: 7082382 - DNA, 22 bp, Homo sapiens
gcctgagacagtgtggtccaat

SEQ ID NO: 7082383 - DNA, 22 bp, Homo sapiens
gcctgagagaactgaccaagag

SEQ ID NO: 7082384 - DNA, 22 bp, Homo sapiens
gcctgagagaactgaccaagag

SEQ ID NO: 7082385 - DNA, 22 bp, Homo sapiens
gcctgagagaactgaccaagag

SEQ ID NO: 7082386 - DNA, 22 bp, Homo sapiens
gcctgagagacccatggggcaa

SEQ ID NO: 7082387 - DNA, 22 bp, Homo sapiens
gcctgagagtctccagaccttg

SEQ ID NO: 7082388 - DNA, 22 bp, Homo sapiens
gcctgagagtctccagaccttg

SEQ ID NO: 7082389 - DNA, 22 bp, Homo sapiens
gcctgagagacccatggggcaa

SEQ ID NO: 7082390 - DNA, 22 bp, Homo sapiens
gcctgagaaggataggaagcga

SEQ ID NO: 7082391 - DNA, 22 bp, Homo sapiens
gcctgagaaggacacagcaggt

SEQ ID NO: 7082392 - DNA, 22 bp, Homo sapiens
gcctgagaaggacacagcaggt

SEQ ID NO: 7082393 - DNA, 22 bp, Homo sapiens
gcctgagaaggacacagcaggt

SEQ ID NO: 7082394 - DNA, 22 bp, Homo sapiens
gcctgacttgtgtattttacat

SEQ ID NO: 7082395 - DNA, 22 bp, Homo sapiens
atttggaatagctgtagaaata

SEQ ID NO: 7082396 - DNA, 22 bp, Homo sapiens
atttggaatagctgtagaaata

SEQ ID NO: 7082397 - DNA, 22 bp, Homo sapiens
atttggaagtttggagtgaagg

SEQ ID NO: 7082398 - DNA, 22 bp, Homo sapiens
atttggaagtttttgtgggaat

SEQ ID NO: 7082399 - DNA, 22 bp, Homo sapiens
atttggaagtttggagtgaagg

SEQ ID NO: 7082400 - DNA, 22 bp, Homo sapiens
atttggaagtttggagtgaagg

SEQ ID NO: 7082401 - DNA, 22 bp, Homo sapiens
atttggaaggcgtttctctgta

SEQ ID NO: 7082402 - DNA, 22 bp, Homo sapiens
atttggaaggtttacaaagaga

SEQ ID NO: 7082403 - DNA, 22 bp, Homo sapiens
atttggaaggtttacaaagaga

SEQ ID NO: 7082404 - DNA, 22 bp, Homo sapiens
atttggaaggcgtttctctgta

SEQ ID NO: 7082405 - DNA, 22 bp, Homo sapiens
atttggaaggcgtttctctgta

SEQ ID NO: 7082406 - DNA, 22 bp, Homo sapiens
atttggaaggagctgcacagca

SEQ ID NO: 7082407 - DNA, 22 bp, Homo sapiens
atttggaagcttgaagattatt

SEQ ID NO: 7082408 - DNA, 22 bp, Homo sapiens
atttggaagcttgaagattatt

SEQ ID NO: 7082409 - DNA, 22 bp, Homo sapiens
atttggaagcttgaagattatt

SEQ ID NO: 7082410 - DNA, 22 bp, Homo sapiens
atttggaagcatttccaaagca

SEQ ID NO: 7082411 - DNA, 22 bp, Homo sapiens
gcctggcacattgcagtggatt

SEQ ID NO: 7082412 - DNA, 22 bp, Homo sapiens
gcctggcaccacagcctttcag

SEQ ID NO: 7082413 - DNA, 22 bp, Homo sapiens
gcctggcaccacagcctttcag

SEQ ID NO: 7082414 - DNA, 22 bp, Homo sapiens
gcctggcacattgcagtggatt

SEQ ID NO: 7082415 - DNA, 22 bp, Homo sapiens
gcctggcacattgcagtggatt

SEQ ID NO: 7082416 - DNA, 22 bp, Homo sapiens
gcctggcacattgcagtggatt

SEQ ID NO: 7082417 - DNA, 22 bp, Homo sapiens
gcctggcacattgcagtggatt

SEQ ID NO: 7082418 - DNA, 22 bp, Homo sapiens
attttactactccaattaatga

SEQ ID NO: 7082419 - DNA, 22 bp, Homo sapiens
attttacttagtgtaatgtcca

SEQ ID NO: 7082420 - DNA, 21 bp, Homo sapiens
gcctggcaaaaaccggccctg

SEQ ID NO: 7082421 - DNA, 23 bp, Homo sapiens
gcctggcaaagcactaccgagag

SEQ ID NO: 7082422 - DNA, 23 bp, Homo sapiens
gcctggcaaagcactaccgagag

SEQ ID NO: 7082423 - DNA, 23 bp, Homo sapiens
gcctggcaaagcactaccgagag

SEQ ID NO: 7082424 - DNA, 23 bp, Homo sapiens
gcctggcaaagcactaccgagag

SEQ ID NO: 7082425 - DNA, 23 bp, Homo sapiens
gcctggcaaagcactaccgagag

SEQ ID NO: 7082426 - DNA, 22 bp, Homo sapiens
gcctggcaaggccctgttgact

SEQ ID NO: 7082427 - DNA, 22 bp, Homo sapiens
gcctggcaaggccctgttgact

SEQ ID NO: 7082428 - DNA, 22 bp, Homo sapiens
gcctggcaaggccctgttgact

SEQ ID NO: 7082429 - DNA, 22 bp, Homo sapiens
gcctggcaatggcctcaggaag

SEQ ID NO: 7082430 - DNA, 22 bp, Homo sapiens
gcctggcaatggcctcaggaag

SEQ ID NO: 7082431 - DNA, 22 bp, Homo sapiens
gcctggcaatggcctcaggaag

SEQ ID NO: 7082432 - DNA, 22 bp, Homo sapiens
gcctggcaatggcctcaggaag

SEQ ID NO: 7082433 - DNA, 22 bp, Homo sapiens
gcctggcaatggcctcaggaag

SEQ ID NO: 7082434 - DNA, 22 bp, Homo sapiens
gcctggcaatggcctcaggaag

SEQ ID NO: 7082435 - DNA, 22 bp, Homo sapiens
gcctggcacaggaattaggagg

SEQ ID NO: 7082436 - DNA, 22 bp, Homo sapiens
gcctggcacaggaattaggagg

SEQ ID NO: 7082437 - DNA, 22 bp, Homo sapiens
gcctggcacaggaattaggagg

SEQ ID NO: 7082438 - DNA, 22 bp, Homo sapiens
gcctggcacagtagggacccaa

SEQ ID NO: 7082439 - DNA, 22 bp, Homo sapiens
gcctggcacagtagggacccaa

SEQ ID NO: 7082440 - DNA, 22 bp, Homo sapiens
gcctggcacagtagggacccaa

SEQ ID NO: 7082441 - DNA, 22 bp, Homo sapiens
gcctggcacagtagggacccaa

SEQ ID NO: 7082442 - DNA, 22 bp, Homo sapiens
atttggaatgtgtttgatcacc

SEQ ID NO: 7082443 - DNA, 22 bp, Homo sapiens
atttggaatggtctggcatttg

SEQ ID NO: 7082444 - DNA, 22 bp, Homo sapiens
atttggaatgggagcctggcat

SEQ ID NO: 7082445 - DNA, 22 bp, Homo sapiens
atttggaatgctagtgaatgta

SEQ ID NO: 7082446 - DNA, 22 bp, Homo sapiens
atttggaatgctagtgaatgta

SEQ ID NO: 7082447 - DNA, 22 bp, Homo sapiens
gcctggaggaatgtagctgagg

SEQ ID NO: 7082448 - DNA, 22 bp, Homo sapiens
gcctggaggaatgtagctgagg

SEQ ID NO: 7082449 - DNA, 20 bp, Homo sapiens
gcctggaggcaatgggaaga

SEQ ID NO: 7082450 - DNA, 20 bp, Homo sapiens
gcctggaggcaatgggaaga

SEQ ID NO: 7082451 - DNA, 20 bp, Homo sapiens
gcctggaggcaatgggaaga

SEQ ID NO: 7082452 - DNA, 22 bp, Homo sapiens
gcctggagttgaaactattatt

SEQ ID NO: 7082453 - DNA, 22 bp, Homo sapiens
gcctggagttgaaactattatt

SEQ ID NO: 7082454 - DNA, 22 bp, Homo sapiens
gcctggagttgaaactattatt

SEQ ID NO: 7082455 - DNA, 22 bp, Homo sapiens
gcctggagttgtggtgaagcca

SEQ ID NO: 7082456 - DNA, 22 bp, Homo sapiens
gcctggagttgtggtgaagcca

SEQ ID NO: 7082457 - DNA, 22 bp, Homo sapiens
gcctggagttgtggtgaagcca

SEQ ID NO: 7082458 - DNA, 22 bp, Homo sapiens
gcctggagttgtggtgaagcca

SEQ ID NO: 7082459 - DNA, 22 bp, Homo sapiens
gcctggatcccagggagtcagg

SEQ ID NO: 7082460 - DNA, 22 bp, Homo sapiens
gcctggattccttgtttctcag

SEQ ID NO: 7082461 - DNA, 22 bp, Homo sapiens
gcctggattccttgtttctcag

SEQ ID NO: 7082462 - DNA, 21 bp, Homo sapiens
gcctggcaaaaaccggccctg

SEQ ID NO: 7082463 - DNA, 21 bp, Homo sapiens
gcctggcaaaaaccggccctg

SEQ ID NO: 7082464 - DNA, 21 bp, Homo sapiens
gcctggcaaaaaccggccctg

SEQ ID NO: 7082465 - DNA, 22 bp, Homo sapiens
gctcttgtcaaaaattagttga

SEQ ID NO: 7082466 - DNA, 22 bp, Homo sapiens
gctcttggccaagtggaagggt

SEQ ID NO: 7082467 - DNA, 22 bp, Homo sapiens
gctcttgggggacagatggagt

SEQ ID NO: 7082468 - DNA, 22 bp, Homo sapiens
caaatagactctagaatttatt

SEQ ID NO: 7082469 - DNA, 22 bp, Homo sapiens
caaatagactctagaatttatt

SEQ ID NO: 7082470 - DNA, 22 bp, Homo sapiens
gctctggttccagttccgcacc

SEQ ID NO: 7082471 - DNA, 22 bp, Homo sapiens
gctctggttccagttccgcacc

SEQ ID NO: 7082472 - DNA, 18 bp, Homo sapiens
gctctggttccttcaacc

SEQ ID NO: 7082473 - DNA, 21 bp, Homo sapiens
gctcttggaaggggctcagct

SEQ ID NO: 7082474 - DNA, 22 bp, Homo sapiens
gctgacccctacaggttgtgtt

SEQ ID NO: 7082475 - DNA, 22 bp, Homo sapiens
gctgacccctacaggttgtgtt

SEQ ID NO: 7082476 - DNA, 22 bp, Homo sapiens
gctgacccctacaggttgtgtt

SEQ ID NO: 7082477 - DNA, 22 bp, Homo sapiens
gctgacattccctgtgaaactt

SEQ ID NO: 7082478 - DNA, 22 bp, Homo sapiens
gctgacccctacaggttgtgtt

SEQ ID NO: 7082479 - DNA, 22 bp, Homo sapiens
gctgacagttactgctgtaaca

SEQ ID NO: 7082480 - DNA, 22 bp, Homo sapiens
gctgacagcgtttccagtgatg

SEQ ID NO: 7082481 - DNA, 22 bp, Homo sapiens
gctgacagcgtttccagtgatg

SEQ ID NO: 7082482 - DNA, 22 bp, Homo sapiens
gctgacagcaaggggctgccct

SEQ ID NO: 7082483 - DNA, 22 bp, Homo sapiens
gctgacaggctctgtgtatgct

SEQ ID NO: 7082484 - DNA, 22 bp, Homo sapiens
gctgaaatgaaaacacaggtcg

SEQ ID NO: 7082485 - DNA, 22 bp, Homo sapiens
gctcttttcacagtccaaaatg

SEQ ID NO: 7082486 - DNA, 22 bp, Homo sapiens
gctgaaaaatagtgtcgtgttt

SEQ ID NO: 7082487 - DNA, 22 bp, Homo sapiens
caaatgctaacttctttccaaa

SEQ ID NO: 7082488 - DNA, 22 bp, Homo sapiens
caaatgctactaataggcaagt

SEQ ID NO: 7082489 - DNA, 22 bp, Homo sapiens
caaatgcatgagaaataagagg

SEQ ID NO: 7082490 - DNA, 22 bp, Homo sapiens
caaatgcatgagaaataagagg

SEQ ID NO: 7082491 - DNA, 22 bp, Homo sapiens
caaatgctatgattttgagttt

SEQ ID NO: 7082492 - DNA, 21 bp, Homo sapiens
caaatgctggctggatgagga

SEQ ID NO: 7082493 - DNA, 22 bp, Homo sapiens
caaatggaaagagcagaagctt

SEQ ID NO: 7082494 - DNA, 22 bp, Homo sapiens
caaatggaaagagcagaagctt

SEQ ID NO: 7082495 - DNA, 22 bp, Homo sapiens
caaatggatacaggcaaacatt

SEQ ID NO: 7082496 - DNA, 22 bp, Homo sapiens
caaatggcaacaagaacactgg

SEQ ID NO: 7082497 - DNA, 22 bp, Homo sapiens
caaatggcaacaagaacactgg

SEQ ID NO: 7082498 - DNA, 22 bp, Homo sapiens
caaatggcaacaagaacactgg

SEQ ID NO: 7082499 - DNA, 22 bp, Homo sapiens
caaatggctggcatccttctac

SEQ ID NO: 7082500 - DNA, 22 bp, Homo sapiens
caaatggctggcatccttctac

SEQ ID NO: 7082501 - DNA, 22 bp, Homo sapiens
caaatgcatagtttataagaag

SEQ ID NO: 7082502 - DNA, 22 bp, Homo sapiens
caaatgcatagtttataagaag

SEQ ID NO: 7082503 - DNA, 22 bp, Homo sapiens
caaatgatacctattactaggc

SEQ ID NO: 7082504 - DNA, 22 bp, Homo sapiens
caaatgatacctattactaggc

SEQ ID NO: 7082505 - DNA, 22 bp, Homo sapiens
caaatgatacctattactaggc

SEQ ID NO: 7082506 - DNA, 22 bp, Homo sapiens
gctgactgtccgctgctcccgg

SEQ ID NO: 7082507 - DNA, 23 bp, Homo sapiens
gctgacgtttatccataaatata

SEQ ID NO: 7082508 - DNA, 22 bp, Homo sapiens
gctgactctttgacaaaatgca

SEQ ID NO: 7082509 - DNA, 22 bp, Homo sapiens
gctgactgagctggcttttcgt

SEQ ID NO: 7082510 - DNA, 22 bp, Homo sapiens
gctgactgagctggcttttcgt

SEQ ID NO: 7082511 - DNA, 22 bp, Homo sapiens
gctgactgctcagggccagctg

SEQ ID NO: 7082512 - DNA, 22 bp, Homo sapiens
gctgactggttcaggtcccgct

SEQ ID NO: 7082513 - DNA, 22 bp, Homo sapiens
caaatactaaacataagatttt

SEQ ID NO: 7082514 - DNA, 22 bp, Homo sapiens
caaatactacgattcttgcagt

SEQ ID NO: 7082515 - DNA, 22 bp, Homo sapiens
caaataattactatcctcactt

SEQ ID NO: 7082516 - DNA, 22 bp, Homo sapiens
caaatacaaatacgggcagctt

SEQ ID NO: 7082517 - DNA, 22 bp, Homo sapiens
caaatacaaatacgggcagctt

SEQ ID NO: 7082518 - DNA, 22 bp, Homo sapiens
caaatacaaatacgggcagctt

SEQ ID NO: 7082519 - DNA, 22 bp, Homo sapiens
caaatacaaatacgggcagctt

SEQ ID NO: 7082520 - DNA, 22 bp, Homo sapiens
caaatactaaacataagatttt

SEQ ID NO: 7082521 - DNA, 22 bp, Homo sapiens
caaaggcaacatatacttgttt

SEQ ID NO: 7082522 - DNA, 22 bp, Homo sapiens
caaagtgctggaattacaggtg

SEQ ID NO: 7082523 - DNA, 22 bp, Homo sapiens
caaagtgctggaattacaggtg

SEQ ID NO: 7082524 - DNA, 22 bp, Homo sapiens
caaataattactatcctcactt

SEQ ID NO: 7082525 - DNA, 21 bp, Homo sapiens
caaaggactgtagctcactga

SEQ ID NO: 7082526 - DNA, 21 bp, Homo sapiens
caaaggactgtagctcactga

SEQ ID NO: 7082527 - DNA, 22 bp, Homo sapiens
caaaggacccataattaaaacc

SEQ ID NO: 7082528 - DNA, 22 bp, Homo sapiens
caaaggaggtgataggccctct

SEQ ID NO: 7082529 - DNA, 22 bp, Homo sapiens
caaagctgacgaggtcagcatc

SEQ ID NO: 7082530 - DNA, 22 bp, Homo sapiens
caaagctgatactcagcaagta

SEQ ID NO: 7082531 - DNA, 22 bp, Homo sapiens
caaagctggaaaaggaggctgg

SEQ ID NO: 7082532 - DNA, 22 bp, Homo sapiens
caaagctgtgaattcctacaaa

SEQ ID NO: 7082533 - DNA, 22 bp, Homo sapiens
caaagcttggagaagcagctgg

SEQ ID NO: 7082534 - DNA, 22 bp, Homo sapiens
caaaggaaatactaatctggaa

SEQ ID NO: 7082535 - DNA, 22 bp, Homo sapiens
caaaggaaatactaatctggaa

SEQ ID NO: 7082536 - DNA, 22 bp, Homo sapiens
caaagctgacgaggtcagcatc

SEQ ID NO: 7082537 - DNA, 22 bp, Homo sapiens
caaagcccagaggcctcacttt

SEQ ID NO: 7082538 - DNA, 22 bp, Homo sapiens
caaagcctctgatttcacttgt

SEQ ID NO: 7082539 - DNA, 22 bp, Homo sapiens
caaatagacaagatggcaggaa

SEQ ID NO: 7082540 - DNA, 21 bp, Homo sapiens
caaatagacatggctagagga

SEQ ID NO: 7082541 - DNA, 22 bp, Homo sapiens
caaatagaaggtactcagagaa

SEQ ID NO: 7082542 - DNA, 22 bp, Homo sapiens
caaatagaaggtactcagagaa

SEQ ID NO: 7082543 - DNA, 22 bp, Homo sapiens
caaatagaaggtactcagagaa

SEQ ID NO: 7082544 - DNA, 22 bp, Homo sapiens
caaatagaactcacagacaaga

SEQ ID NO: 7082545 - DNA, 22 bp, Homo sapiens
caaatagaactcacagacaaga

SEQ ID NO: 7082546 - DNA, 22 bp, Homo sapiens
caaatagaactcacagacaaga

SEQ ID NO: 7082547 - DNA, 22 bp, Homo sapiens
caaatactttatatacttcaaa

SEQ ID NO: 7082548 - DNA, 22 bp, Homo sapiens
caaatactttatatacttcaaa

SEQ ID NO: 7082549 - DNA, 22 bp, Homo sapiens
caaatactttatatacttcaaa

SEQ ID NO: 7082550 - DNA, 22 bp, Homo sapiens
caaatactttatatacttcaaa

SEQ ID NO: 7082551 - DNA, 21 bp, Homo sapiens
caaatacttagaaacttaaga

SEQ ID NO: 7082552 - DNA, 21 bp, Homo sapiens
caaatacttagaaacttaaga

SEQ ID NO: 7082553 - DNA, 21 bp, Homo sapiens
caaatacttagaaacttaaga

SEQ ID NO: 7082554 - DNA, 21 bp, Homo sapiens
caaatacttagaaacttaaga

SEQ ID NO: 7082555 - DNA, 18 bp, Homo sapiens
caaatactgttgtcttat

SEQ ID NO: 7082556 - DNA, 18 bp, Homo sapiens
caaatactgttgtcttat

SEQ ID NO: 7082557 - DNA, 18 bp, Homo sapiens
caaatactgttgtcttat

SEQ ID NO: 7082558 - DNA, 22 bp, Homo sapiens
caaatacttactgaacctgtgc

SEQ ID NO: 7082559 - DNA, 22 bp, Homo sapiens
caaatacttactgaacctgtgc

SEQ ID NO: 7082560 - DNA, 22 bp, Homo sapiens
caaatactgggtaagttaattt

SEQ ID NO: 7082561 - DNA, 22 bp, Homo sapiens
caaatactgggtaagttaattt

SEQ ID NO: 7082562 - DNA, 22 bp, Homo sapiens
caaatactgtactgaacactgt

SEQ ID NO: 7082563 - DNA, 22 bp, Homo sapiens
caaatactgtactgaacactgt

SEQ ID NO: 7082564 - DNA, 22 bp, Homo sapiens
caaatactctggatgtgtttgt

SEQ ID NO: 7082565 - DNA, 22 bp, Homo sapiens
caaatactctggatgtgtttgt

SEQ ID NO: 7082566 - DNA, 22 bp, Homo sapiens
caaatactgagtttattttcaa

SEQ ID NO: 7082567 - DNA, 22 bp, Homo sapiens
caaatactgagtttattttcaa

SEQ ID NO: 7082568 - DNA, 22 bp, Homo sapiens
atttttccaattaggataaaga

SEQ ID NO: 7082569 - DNA, 22 bp, Homo sapiens
atttttcagcttcattgaggca

SEQ ID NO: 7082570 - DNA, 22 bp, Homo sapiens
atttttcagcttcattgaggca

SEQ ID NO: 7082571 - DNA, 22 bp, Homo sapiens
atttttatgacaaaccatcctc

SEQ ID NO: 7082572 - DNA, 22 bp, Homo sapiens
atttttcaactttggaaatggc

SEQ ID NO: 7082573 - DNA, 22 bp, Homo sapiens
atttttaggctctaccctcaga

SEQ ID NO: 7082574 - DNA, 22 bp, Homo sapiens
atttttatgacaaaccatcctc

SEQ ID NO: 7082575 - DNA, 22 bp, Homo sapiens
atttttatgacaaaccatcctc

SEQ ID NO: 7082576 - DNA, 22 bp, Homo sapiens
atttttatgacaaaccatcctc

SEQ ID NO: 7082577 - DNA, 22 bp, Homo sapiens
attttgtttcctttggagtaga

SEQ ID NO: 7082578 - DNA, 23 bp, Homo sapiens
atttttagcctctctgagctgag

SEQ ID NO: 7082579 - DNA, 22 bp, Homo sapiens
attttgtttcctttggagtaga

SEQ ID NO: 7082580 - DNA, 22 bp, Homo sapiens
attttacttcatttgaaatgcc

SEQ ID NO: 7082581 - DNA, 22 bp, Homo sapiens
attttactttgtgaatattgac

SEQ ID NO: 7082582 - DNA, 22 bp, Homo sapiens
attttactttgtgaatattgac

SEQ ID NO: 7082583 - DNA, 22 bp, Homo sapiens
attttacttagtgtaatgtcca

SEQ ID NO: 7082584 - DNA, 22 bp, Homo sapiens
attttacttcatttgaaatgcc

SEQ ID NO: 7082585 - DNA, 22 bp, Homo sapiens
attttacttcatttgaaatgcc

SEQ ID NO: 7082586 - DNA, 22 bp, Homo sapiens
attttacttcatttgaaatgcc

SEQ ID NO: 7082587 - DNA, 22 bp, Homo sapiens
attttagagaaacaaacgtagg

SEQ ID NO: 7082588 - DNA, 22 bp, Homo sapiens
attttagagctccaagtacagc

SEQ ID NO: 7082589 - DNA, 22 bp, Homo sapiens
attttgctgtggtacattagga

SEQ ID NO: 7082590 - DNA, 22 bp, Homo sapiens
attttgctttatgtaaatatgt

SEQ ID NO: 7082591 - DNA, 22 bp, Homo sapiens
attttgctttatgtaaatatgt

SEQ ID NO: 7082592 - DNA, 22 bp, Homo sapiens
attttagagaaacaaacgtagg

SEQ ID NO: 7082593 - DNA, 22 bp, Homo sapiens
attttagagctccaagtacagc

SEQ ID NO: 7082594 - DNA, 22 bp, Homo sapiens
attttagagctccaagtacagc

SEQ ID NO: 7082595 - DNA, 22 bp, Homo sapiens
atttttctctccactccattaa

SEQ ID NO: 7082596 - DNA, 22 bp, Homo sapiens
atttttctctccactccattaa

SEQ ID NO: 7082597 - DNA, 22 bp, Homo sapiens
atttttctctccactccattaa

SEQ ID NO: 7082598 - DNA, 22 bp, Homo sapiens
atttttctctcacacttaccag

SEQ ID NO: 7082599 - DNA, 22 bp, Homo sapiens
atttttctctcacacttaccag

SEQ ID NO: 7082600 - DNA, 22 bp, Homo sapiens
atttttctctccactccattaa

SEQ ID NO: 7082601 - DNA, 22 bp, Homo sapiens
atttttctctcacacttaccag

SEQ ID NO: 7082602 - DNA, 22 bp, Homo sapiens
atttttcctgggtgctttagtt

SEQ ID NO: 7082603 - DNA, 23 bp, Homo sapiens
atttttcctggaacagtcaccca

SEQ ID NO: 7082604 - DNA, 22 bp, Homo sapiens
atttttccattctctgttagta

SEQ ID NO: 7082605 - DNA, 18 bp, Homo sapiens
atttttcccagatggata

SEQ ID NO: 7082606 - DNA, 22 bp, Homo sapiens
atttttgagctgtgaacatagc

SEQ ID NO: 7082607 - DNA, 22 bp, Homo sapiens
atttttgagctgtgaacatagc

SEQ ID NO: 7082608 - DNA, 19 bp, Homo sapiens
atttttcttcctctgtgca

SEQ ID NO: 7082609 - DNA, 19 bp, Homo sapiens
atttttcttcctctgtgca

SEQ ID NO: 7082610 - DNA, 22 bp, Homo sapiens
atttttctctttccactgagat

SEQ ID NO: 7082611 - DNA, 22 bp, Homo sapiens
atttttctctttccactgagat

SEQ ID NO: 7082612 - DNA, 22 bp, Homo sapiens
atttttctctttccactgagat

SEQ ID NO: 7082613 - DNA, 19 bp, Homo sapiens
atttttcttcctctgtgca

SEQ ID NO: 7082614 - DNA, 22 bp, Homo sapiens
attttttagaacctggcctgat

SEQ ID NO: 7082615 - DNA, 22 bp, Homo sapiens
atttttgtatccccagctcctg

SEQ ID NO: 7082616 - DNA, 22 bp, Homo sapiens
attttttagaacctggcctgat

SEQ ID NO: 7082617 - DNA, 22 bp, Homo sapiens
atttttgccctgcagtacataa

SEQ ID NO: 7082618 - DNA, 22 bp, Homo sapiens
caaaagcagttctatctgagtt

SEQ ID NO: 7082619 - DNA, 22 bp, Homo sapiens
caaaagcagttctatctgagtt

SEQ ID NO: 7082620 - DNA, 22 bp, Homo sapiens
caaaagcagttctatctgagtt

SEQ ID NO: 7082621 - DNA, 22 bp, Homo sapiens
caaaagcagttctatctgagtt

SEQ ID NO: 7082622 - DNA, 22 bp, Homo sapiens
caaaataccacgacttgtttta

SEQ ID NO: 7082623 - DNA, 22 bp, Homo sapiens
caaaatgatgtgattttattgt

SEQ ID NO: 7082624 - DNA, 22 bp, Homo sapiens
caaaatgatgtgattttattgt

SEQ ID NO: 7082625 - DNA, 22 bp, Homo sapiens
caaaataccacgacttgtttta

SEQ ID NO: 7082626 - DNA, 22 bp, Homo sapiens
caaaatagatgttaacctggaa

SEQ ID NO: 7082627 - DNA, 22 bp, Homo sapiens
caaaatgatgtgattttattgt

SEQ ID NO: 7082628 - DNA, 22 bp, Homo sapiens
caaaatgatgtgattttattgt

SEQ ID NO: 7082629 - DNA, 22 bp, Homo sapiens
caaaatgttctggcacctttaa

SEQ ID NO: 7082630 - DNA, 22 bp, Homo sapiens
caaaatgtgagtcccacctcaa

SEQ ID NO: 7082631 - DNA, 22 bp, Homo sapiens
caaaatgtgagtcccacctcaa

SEQ ID NO: 7082632 - DNA, 22 bp, Homo sapiens
caaaattagaaatgcagctgtt

SEQ ID NO: 7082633 - DNA, 22 bp, Homo sapiens
caaaattagggagtgagctgga

SEQ ID NO: 7082634 - DNA, 22 bp, Homo sapiens
caaaattagaaatgcagctgtt

SEQ ID NO: 7082635 - DNA, 22 bp, Homo sapiens
caaaattagggagtgagctgga

SEQ ID NO: 7082636 - DNA, 22 bp, Homo sapiens
caaacattcaagtacaagtctt

SEQ ID NO: 7082637 - DNA, 22 bp, Homo sapiens
caaacatagtgaagcaatgaca

SEQ ID NO: 7082638 - DNA, 22 bp, Homo sapiens
caaacatagtgaagcaatgaca

SEQ ID NO: 7082639 - DNA, 22 bp, Homo sapiens
caaacatagtgaagcaatgaca

SEQ ID NO: 7082640 - DNA, 22 bp, Homo sapiens
caaacaatttgcatttccttag

SEQ ID NO: 7082641 - DNA, 22 bp, Homo sapiens
caaaattgttgatgctgctttg

SEQ ID NO: 7082642 - DNA, 22 bp, Homo sapiens
caaaattgatgaatgtatgatt

SEQ ID NO: 7082643 - DNA, 22 bp, Homo sapiens
caaaattgattgtggtgatggt

SEQ ID NO: 7082644 - DNA, 22 bp, Homo sapiens
caaagagttttttcatataatg

SEQ ID NO: 7082645 - DNA, 22 bp, Homo sapiens
caaagagttttttcatataatg

SEQ ID NO: 7082646 - DNA, 22 bp, Homo sapiens
caaagaggttttgagggcagct

SEQ ID NO: 7082647 - DNA, 22 bp, Homo sapiens
caaacattccgcttctcccagg

SEQ ID NO: 7082648 - DNA, 22 bp, Homo sapiens
caaacattcaagtacaagtctt

SEQ ID NO: 7082649 - DNA, 22 bp, Homo sapiens
caaacattcaagtacaagtctt

SEQ ID NO: 7082650 - DNA, 22 bp, Homo sapiens
caaacattcagatgcaatggta

SEQ ID NO: 7082651 - DNA, 22 bp, Homo sapiens
caaagcagacgcagtaagggta

SEQ ID NO: 7082652 - DNA, 22 bp, Homo sapiens
caaagcagcctgcagtgtggac

SEQ ID NO: 7082653 - DNA, 22 bp, Homo sapiens
caaagcagcctgcagtgtggac

SEQ ID NO: 7082654 - DNA, 22 bp, Homo sapiens
caaagcagcctgcagtgtggac

SEQ ID NO: 7082655 - DNA, 22 bp, Homo sapiens
caaagcaggaagaatattgaaa

SEQ ID NO: 7082656 - DNA, 20 bp, Homo sapiens
caaagcagtaggataaaaat

SEQ ID NO: 7082657 - DNA, 20 bp, Homo sapiens
caaagcagtaggataaaaat

SEQ ID NO: 7082658 - DNA, 20 bp, Homo sapiens
caaagcagtaggataaaaat

SEQ ID NO: 7082659 - DNA, 20 bp, Homo sapiens
caaagcagtaggataaaaat

SEQ ID NO: 7082660 - DNA, 22 bp, Homo sapiens
caaagcaggcttgtcaaattgc

SEQ ID NO: 7082661 - DNA, 22 bp, Homo sapiens
caaagcaggcttgtcaaattgc

SEQ ID NO: 7082662 - DNA, 18 bp, Homo sapiens
caaagcaggtgacagtgt

SEQ ID NO: 7082663 - DNA, 22 bp, Homo sapiens
caaagccaggctttctaatgta

SEQ ID NO: 7082664 - DNA, 21 bp, Homo sapiens
caaagccaggcaactctctcc

SEQ ID NO: 7082665 - DNA, 21 bp, Homo sapiens
caaagccaggcaactctctcc

SEQ ID NO: 7082666 - DNA, 21 bp, Homo sapiens
caaagccaggcaactctctcc

SEQ ID NO: 7082667 - DNA, 22 bp, Homo sapiens
caaagcagttttaatcaagtag

SEQ ID NO: 7082668 - DNA, 22 bp, Homo sapiens
caaagcagttttaatcaagtag

SEQ ID NO: 7082669 - DNA, 22 bp, Homo sapiens
caaagcagttttaatcaagtag

SEQ ID NO: 7082670 - DNA, 22 bp, Homo sapiens
caaagccatagagtagataaga

SEQ ID NO: 7082671 - DNA, 21 bp, Homo sapiens
caaagccaggcaactctctcc

SEQ ID NO: 7082672 - DNA, 22 bp, Homo sapiens
caaagccaggctttctaatgta

SEQ ID NO: 7082673 - DNA, 22 bp, Homo sapiens
gaccaaggccctcagtgggagg

SEQ ID NO: 7082674 - DNA, 22 bp, Homo sapiens
gaccacacgtcccagagagccc

SEQ ID NO: 7082675 - DNA, 22 bp, Homo sapiens
gaccacacttttcccctgctag

SEQ ID NO: 7082676 - DNA, 22 bp, Homo sapiens
gaccaaggaagaggggagccag

SEQ ID NO: 7082677 - DNA, 22 bp, Homo sapiens
gaccaaggccaggccagggcgt

SEQ ID NO: 7082678 - DNA, 22 bp, Homo sapiens
gacatttgtatgacactttaaa

SEQ ID NO: 7082679 - DNA, 22 bp, Homo sapiens
gacatttgttaaagcacttagc

SEQ ID NO: 7082680 - DNA, 22 bp, Homo sapiens
gacatttgttcctctaagtgac

SEQ ID NO: 7082681 - DNA, 22 bp, Homo sapiens
gaccaaagaagccacccgtcct

SEQ ID NO: 7082682 - DNA, 21 bp, Homo sapiens
gaccaaagggctggcactgcc

SEQ ID NO: 7082683 - DNA, 22 bp, Homo sapiens
gaccaacagaatttcctgtttt

SEQ ID NO: 7082684 - DNA, 22 bp, Homo sapiens
gaccaagatacagcatcataga

SEQ ID NO: 7082685 - DNA, 22 bp, Homo sapiens
gaccaagatacagcatcataga

SEQ ID NO: 7082686 - DNA, 22 bp, Homo sapiens
gaccacagcagtgcaagaggag

SEQ ID NO: 7082687 - DNA, 22 bp, Homo sapiens
atgctattaatatccagtctga

SEQ ID NO: 7082688 - DNA, 22 bp, Homo sapiens
gaccacagagcacggcctgctt

SEQ ID NO: 7082689 - DNA, 22 bp, Homo sapiens
gaccacagaagccttgataggg

SEQ ID NO: 7082690 - DNA, 22 bp, Homo sapiens
gaccacagaggtgtgggagaga

SEQ ID NO: 7082691 - DNA, 22 bp, Homo sapiens
gacataaatgaagtttgactat

SEQ ID NO: 7082692 - DNA, 22 bp, Homo sapiens
gacactctcctccagtggatag

SEQ ID NO: 7082693 - DNA, 22 bp, Homo sapiens
gacactcagtaggacttcaagg

SEQ ID NO: 7082694 - DNA, 22 bp, Homo sapiens
gacatacaagctggtacctcct

SEQ ID NO: 7082695 - DNA, 22 bp, Homo sapiens
gacatttattagaaaactatca

SEQ ID NO: 7082696 - DNA, 22 bp, Homo sapiens
gacatttattagaaaactatca

SEQ ID NO: 7082697 - DNA, 22 bp, Homo sapiens
gacatttgtatcttaggggaaa

SEQ ID NO: 7082698 - DNA, 22 bp, Homo sapiens
gacatttattggattttacgag

SEQ ID NO: 7082699 - DNA, 22 bp, Homo sapiens
gacaccagaagacataagcaga

SEQ ID NO: 7082700 - DNA, 22 bp, Homo sapiens
gacacatgtcagacggacaccc

SEQ ID NO: 7082701 - DNA, 22 bp, Homo sapiens
gacacatgtcagacggacaccc

SEQ ID NO: 7082702 - DNA, 22 bp, Homo sapiens
gacacattgatgtgagtacata

SEQ ID NO: 7082703 - DNA, 22 bp, Homo sapiens
gacacatgaccataaatgctaa

SEQ ID NO: 7082704 - DNA, 16 bp, Homo sapiens
gacacatgggggaaaa

SEQ ID NO: 7082705 - DNA, 22 bp, Homo sapiens
gacacatacagcagtaagtcta

SEQ ID NO: 7082706 - DNA, 22 bp, Homo sapiens
gacacatagatctatctcactc

SEQ ID NO: 7082707 - DNA, 22 bp, Homo sapiens
gacacagtttttctcacggtgg

SEQ ID NO: 7082708 - DNA, 22 bp, Homo sapiens
gacacatatgcgtatagtttag

SEQ ID NO: 7082709 - DNA, 18 bp, Homo sapiens
gacacatccccaggcctc

SEQ ID NO: 7082710 - DNA, 18 bp, Homo sapiens
gacaccagcctctgcccc

SEQ ID NO: 7082711 - DNA, 22 bp, Homo sapiens
gacaccagagactgatgaggcc

SEQ ID NO: 7082712 - DNA, 22 bp, Homo sapiens
gacaccaggtctgttgtcctcc

SEQ ID NO: 7082713 - DNA, 23 bp, Homo sapiens
gacaccaggcgtggccctcgaca

SEQ ID NO: 7082714 - DNA, 18 bp, Homo sapiens
gacaccagcctctgcccc

SEQ ID NO: 7082715 - DNA, 22 bp, Homo sapiens
gacaccagtaaatattcaaaag

SEQ ID NO: 7082716 - DNA, 22 bp, Homo sapiens
gacacccctttcaacttggtgg

SEQ ID NO: 7082717 - DNA, 22 bp, Homo sapiens
gacacaaagtttgtcagaaatt

SEQ ID NO: 7082718 - DNA, 21 bp, Homo sapiens
gacacaaagggtagtaatggt

SEQ ID NO: 7082719 - DNA, 21 bp, Homo sapiens
gacacaaagggtagtaatggt

SEQ ID NO: 7082720 - DNA, 22 bp, Homo sapiens
gacacaaagtttgtcagaaatt

SEQ ID NO: 7082721 - DNA, 22 bp, Homo sapiens
gacacaaagtttgtcagaaatt

SEQ ID NO: 7082722 - DNA, 22 bp, Homo sapiens
gacacactgtttggactagggt

SEQ ID NO: 7082723 - DNA, 22 bp, Homo sapiens
gacaatgtgcaattgcagctag

SEQ ID NO: 7082724 - DNA, 22 bp, Homo sapiens
gacaattgcttttgccgaataa

SEQ ID NO: 7082725 - DNA, 22 bp, Homo sapiens
gacaatttctcaatatagaaac

SEQ ID NO: 7082726 - DNA, 22 bp, Homo sapiens
gacaatttctcaatatagaaac

SEQ ID NO: 7082727 - DNA, 21 bp, Homo sapiens
gacacaaagggtagtaatggt

SEQ ID NO: 7082728 - DNA, 21 bp, Homo sapiens
gacacaaagggtagtaatggt

SEQ ID NO: 7082729 - DNA, 22 bp, Homo sapiens
gaccctggcagataccgtcaca

SEQ ID NO: 7082730 - DNA, 22 bp, Homo sapiens
gaccctggagccgtctgaggca

SEQ ID NO: 7082731 - DNA, 22 bp, Homo sapiens
gaccctggcaggtagcctcaca

SEQ ID NO: 7082732 - DNA, 22 bp, Homo sapiens
gaccttgtgatccacccgcttt

SEQ ID NO: 7082733 - DNA, 22 bp, Homo sapiens
gaccttgtgatccacccgcttt

SEQ ID NO: 7082734 - DNA, 22 bp, Homo sapiens
gaccttgtgatccacctgcctt

SEQ ID NO: 7082735 - DNA, 22 bp, Homo sapiens
gaccttgtgatccacctgcctt

SEQ ID NO: 7082736 - DNA, 22 bp, Homo sapiens
atgctctataaatatgacatgt

SEQ ID NO: 7082737 - DNA, 17 bp, Homo sapiens
atgctctatagtcagtg

SEQ ID NO: 7082738 - DNA, 17 bp, Homo sapiens
atgctctatagtcagtg

SEQ ID NO: 7082739 - DNA, 23 bp, Homo sapiens
atgctctatttgggatatgacag

SEQ ID NO: 7082740 - DNA, 22 bp, Homo sapiens
atgctctctgtcctgctcagag

SEQ ID NO: 7082741 - DNA, 22 bp, Homo sapiens
atgctctgggcaggagccctgg

SEQ ID NO: 7082742 - DNA, 22 bp, Homo sapiens
gaccttgtgatccagccacctt

SEQ ID NO: 7082743 - DNA, 22 bp, Homo sapiens
gaccttgtgatccagccacctt

SEQ ID NO: 7082744 - DNA, 22 bp, Homo sapiens
gaccttgtgatccagccacctt

SEQ ID NO: 7082745 - DNA, 22 bp, Homo sapiens
gaccttgtgatccccctgcctt

SEQ ID NO: 7082746 - DNA, 22 bp, Homo sapiens
gaccttgtgatccgcccgcctt

SEQ ID NO: 7082747 - DNA, 22 bp, Homo sapiens
gaccttgtgatctgcccacctt

SEQ ID NO: 7082748 - DNA, 22 bp, Homo sapiens
gaccttgtgatctgcctgcctt

SEQ ID NO: 7082749 - DNA, 22 bp, Homo sapiens
gaccttgtgatctgcccacctt

SEQ ID NO: 7082750 - DNA, 22 bp, Homo sapiens
gaccttgtgatctgcctgcctt

SEQ ID NO: 7082751 - DNA, 22 bp, Homo sapiens
gaccttgtgctccgaggcgggc

SEQ ID NO: 7082752 - DNA, 22 bp, Homo sapiens
gacctttaatgtttctaccact

SEQ ID NO: 7082753 - DNA, 21 bp, Homo sapiens
gacctttacatttttcactgt

SEQ ID NO: 7082754 - DNA, 22 bp, Homo sapiens
atgctccaccttttgcaggaac

SEQ ID NO: 7082755 - DNA, 22 bp, Homo sapiens
atgctccagtgtgatgcttcat

SEQ ID NO: 7082756 - DNA, 17 bp, Homo sapiens
atgctccattcagaagc

SEQ ID NO: 7082757 - DNA, 18 bp, Homo sapiens
atgctcctatctctgagc

SEQ ID NO: 7082758 - DNA, 20 bp, Homo sapiens
atgctcgtcccactaagctc

SEQ ID NO: 7082759 - DNA, 22 bp, Homo sapiens
atgctctaagcttagtgaggca

SEQ ID NO: 7082760 - DNA, 22 bp, Homo sapiens
atgctctacttacggctttcag

SEQ ID NO: 7082761 - DNA, 22 bp, Homo sapiens
atgctctagacatactggctat

SEQ ID NO: 7082762 - DNA, 22 bp, Homo sapiens
atgctctagagctcttttcact

SEQ ID NO: 7082763 - DNA, 18 bp, Homo sapiens
atgctctagtctttcctg

SEQ ID NO: 7082764 - DNA, 22 bp, Homo sapiens
atgctcacttcagagaagatga

SEQ ID NO: 7082765 - DNA, 22 bp, Homo sapiens
atgctatttaccacacatcatt

SEQ ID NO: 7082766 - DNA, 22 bp, Homo sapiens
atgctattttacataggaatgg

SEQ ID NO: 7082767 - DNA, 22 bp, Homo sapiens
atgctattttacataggaatgg

SEQ ID NO: 7082768 - DNA, 22 bp, Homo sapiens
gactgggagggttcagctgggt

SEQ ID NO: 7082769 - DNA, 22 bp, Homo sapiens
gactgggatcagctagatgatt

SEQ ID NO: 7082770 - DNA, 22 bp, Homo sapiens
gactgggcagccggtagggaag

SEQ ID NO: 7082771 - DNA, 22 bp, Homo sapiens
gactggatattgagtactgcaa

SEQ ID NO: 7082772 - DNA, 22 bp, Homo sapiens
gactggatttaaggacttctga

SEQ ID NO: 7082773 - DNA, 22 bp, Homo sapiens
gactggatttatagatatcata

SEQ ID NO: 7082774 - DNA, 22 bp, Homo sapiens
gactggcctggggctgggcaca

SEQ ID NO: 7082775 - DNA, 22 bp, Homo sapiens
gactggagcccccaaggacacc

SEQ ID NO: 7082776 - DNA, 22 bp, Homo sapiens
gactggagcccccaaggacacc

SEQ ID NO: 7082777 - DNA, 22 bp, Homo sapiens
gactggagtcaatgagcagcac

SEQ ID NO: 7082778 - DNA, 22 bp, Homo sapiens
gactggagtcaatgagcagcac

SEQ ID NO: 7082779 - DNA, 22 bp, Homo sapiens
gactggagtcaatgagcagcac

SEQ ID NO: 7082780 - DNA, 22 bp, Homo sapiens
gactggagtgcctccaggaaag

SEQ ID NO: 7082781 - DNA, 22 bp, Homo sapiens
gactggagtgcctccaggaaag

SEQ ID NO: 7082782 - DNA, 21 bp, Homo sapiens
gactggagagaggaagtctgg

SEQ ID NO: 7082783 - DNA, 22 bp, Homo sapiens
gactggagataaaaccatgagt

SEQ ID NO: 7082784 - DNA, 22 bp, Homo sapiens
gacggagctggttgctgcggct

SEQ ID NO: 7082785 - DNA, 22 bp, Homo sapiens
gacgcctcttccctgctgcact

SEQ ID NO: 7082786 - DNA, 22 bp, Homo sapiens
gacggagctggttgctgcggct

SEQ ID NO: 7082787 - DNA, 22 bp, Homo sapiens
gacggagctggttgctgcggct

SEQ ID NO: 7082788 - DNA, 22 bp, Homo sapiens
gacggggcagccagctggtggc

SEQ ID NO: 7082789 - DNA, 22 bp, Homo sapiens
gacctttaatgtttctaccact

SEQ ID NO: 7082790 - DNA, 22 bp, Homo sapiens
gacctttagtgtcatgttatat

SEQ ID NO: 7082791 - DNA, 22 bp, Homo sapiens
gacctttagtgtccaatattca

SEQ ID NO: 7082792 - DNA, 22 bp, Homo sapiens
gacctttagtgtccaatattca

SEQ ID NO: 7082793 - DNA, 17 bp, Homo sapiens
gacctttctctagcatt

SEQ ID NO: 7082794 - DNA, 22 bp, Homo sapiens
gacctttttactgtgtacgctg

SEQ ID NO: 7082795 - DNA, 22 bp, Homo sapiens
gacctttttactgtgtacgctg

SEQ ID NO: 7082796 - DNA, 22 bp, Homo sapiens
gacctttcaaatgtttacatga

SEQ ID NO: 7082797 - DNA, 22 bp, Homo sapiens
gacgcatcaggaggcgaggagc

SEQ ID NO: 7082798 - DNA, 22 bp, Homo sapiens
gactacaggccggcatcagaga

SEQ ID NO: 7082799 - DNA, 22 bp, Homo sapiens
gactacagatagccaattaagt

SEQ ID NO: 7082800 - DNA, 22 bp, Homo sapiens
gactacaacaataagaacagct

SEQ ID NO: 7082801 - DNA, 22 bp, Homo sapiens
gactacaacaataagaacagct

SEQ ID NO: 7082802 - DNA, 22 bp, Homo sapiens
gactacaacaataagaacagct

SEQ ID NO: 7082803 - DNA, 22 bp, Homo sapiens
gactacaactcccagaagactt

SEQ ID NO: 7082804 - DNA, 19 bp, Homo sapiens
gactacagggggaagaagt

SEQ ID NO: 7082805 - DNA, 22 bp, Homo sapiens
gactacagatagccaattaagt

SEQ ID NO: 7082806 - DNA, 22 bp, Homo sapiens
gactggaaagcctgtcctcaga

SEQ ID NO: 7082807 - DNA, 22 bp, Homo sapiens
gactggaaagcctgtcctcaga

SEQ ID NO: 7082808 - DNA, 22 bp, Homo sapiens
gacggggcagccagctggtggc

SEQ ID NO: 7082809 - DNA, 22 bp, Homo sapiens
gacggggcagccagctggtggc

SEQ ID NO: 7082810 - DNA, 22 bp, Homo sapiens
gacgggtgtatgctcccagcca

SEQ ID NO: 7082811 - DNA, 22 bp, Homo sapiens
gactaaatgctttgtgcatgca

SEQ ID NO: 7082812 - DNA, 22 bp, Homo sapiens
gactaacagtctccgcttgaaa

SEQ ID NO: 7082813 - DNA, 22 bp, Homo sapiens
atgcacagtaatgagctggttg

SEQ ID NO: 7082814 - DNA, 22 bp, Homo sapiens
atgcacaggaccacacataatg

SEQ ID NO: 7082815 - DNA, 22 bp, Homo sapiens
gaagtcttttcttccacccaaa

SEQ ID NO: 7082816 - DNA, 22 bp, Homo sapiens
gaagtcttttagcaaaacgaac

SEQ ID NO: 7082817 - DNA, 22 bp, Homo sapiens
gaagtcttgaagagcactgtaa

SEQ ID NO: 7082818 - DNA, 22 bp, Homo sapiens
gaagtcttggctgaaaaccctc

SEQ ID NO: 7082819 - DNA, 22 bp, Homo sapiens
gaagtcttcatctgatgctctg

SEQ ID NO: 7082820 - DNA, 22 bp, Homo sapiens
gaagtcttcattctctctgaga

SEQ ID NO: 7082821 - DNA, 22 bp, Homo sapiens
gaagtcttgaaacacaaactag

SEQ ID NO: 7082822 - DNA, 22 bp, Homo sapiens
gaataatagcagaaattagcag

SEQ ID NO: 7082823 - DNA, 17 bp, Homo sapiens
gaataagtggatggcac

SEQ ID NO: 7082824 - DNA, 22 bp, Homo sapiens
gaataatagcagaaattagcag

SEQ ID NO: 7082825 - DNA, 22 bp, Homo sapiens
gaataagtgaagttggcagctt

SEQ ID NO: 7082826 - DNA, 22 bp, Homo sapiens
gaataacattttttcctttaca

SEQ ID NO: 7082827 - DNA, 22 bp, Homo sapiens
gaataacattttttcctttaca

SEQ ID NO: 7082828 - DNA, 22 bp, Homo sapiens
gaagtcttttagcaaaacgaac

SEQ ID NO: 7082829 - DNA, 22 bp, Homo sapiens
gaataacattttttcctttaca

SEQ ID NO: 7082830 - DNA, 22 bp, Homo sapiens
gaataatagcagaaattagcag

SEQ ID NO: 7082831 - DNA, 22 bp, Homo sapiens
gaataatattgactttgcaggc

SEQ ID NO: 7082832 - DNA, 22 bp, Homo sapiens
gaataatcatgaaattcagtga

SEQ ID NO: 7082833 - DNA, 22 bp, Homo sapiens
gaataatattgactttgcaggc

SEQ ID NO: 7082834 - DNA, 22 bp, Homo sapiens
gaataattgtgatgcttgaagt

SEQ ID NO: 7082835 - DNA, 22 bp, Homo sapiens
gaatacaaacttaaggctttac

SEQ ID NO: 7082836 - DNA, 22 bp, Homo sapiens
gaatacaaacttaaggctttac

SEQ ID NO: 7082837 - DNA, 22 bp, Homo sapiens
gaatacaaacttaaggctttac

SEQ ID NO: 7082838 - DNA, 22 bp, Homo sapiens
gaataattgtgatgcttgaagt

SEQ ID NO: 7082839 - DNA, 22 bp, Homo sapiens
gaataattttgatcagaaggga

SEQ ID NO: 7082840 - DNA, 22 bp, Homo sapiens
gaataattttgatcagaaggga

SEQ ID NO: 7082841 - DNA, 22 bp, Homo sapiens
gaatacaaagcagaactcatac

SEQ ID NO: 7082842 - DNA, 22 bp, Homo sapiens
gaatacaaagcagaactcatac

SEQ ID NO: 7082843 - DNA, 22 bp, Homo sapiens
gaatacaaagcagaactcatac

SEQ ID NO: 7082844 - DNA, 22 bp, Homo sapiens
gaatacaaagcagaactcatac

SEQ ID NO: 7082845 - DNA, 22 bp, Homo sapiens
gaatacaaataataccaaggtg

SEQ ID NO: 7082846 - DNA, 23 bp, Homo sapiens
gaatacaaagcagatggtccagc

SEQ ID NO: 7082847 - DNA, 22 bp, Homo sapiens
gaatacaaagcagaactcatac

SEQ ID NO: 7082848 - DNA, 22 bp, Homo sapiens
gaatattttcagtacagatggt

SEQ ID NO: 7082849 - DNA, 22 bp, Homo sapiens
gaatacaaataataccaaggtg

SEQ ID NO: 7082850 - DNA, 22 bp, Homo sapiens
gaatattttcagtacagatggt

SEQ ID NO: 7082851 - DNA, 22 bp, Homo sapiens
gaatattttcagtacagatggt

SEQ ID NO: 7082852 - DNA, 22 bp, Homo sapiens
gaatcaatggtagattaagtaa

SEQ ID NO: 7082853 - DNA, 22 bp, Homo sapiens
gaatcaattatccaggctgttg

SEQ ID NO: 7082854 - DNA, 22 bp, Homo sapiens
gaatcaattgtgaagactatga

SEQ ID NO: 7082855 - DNA, 22 bp, Homo sapiens
gaatcacggtattctgcacggg

SEQ ID NO: 7082856 - DNA, 22 bp, Homo sapiens
gaatcagaatctctaaggtggg

SEQ ID NO: 7082857 - DNA, 22 bp, Homo sapiens
gacaataaagtgatacatggga

SEQ ID NO: 7082858 - DNA, 22 bp, Homo sapiens
gacaataagaaaagaggaggca

SEQ ID NO: 7082859 - DNA, 22 bp, Homo sapiens
gacaataagaacagatactgtg

SEQ ID NO: 7082860 - DNA, 22 bp, Homo sapiens
gacaatctggacccagtcttca

SEQ ID NO: 7082861 - DNA, 22 bp, Homo sapiens
gacaatgcagaagtacttgttc

SEQ ID NO: 7082862 - DNA, 22 bp, Homo sapiens
gacaatgcagaagtacttgttc

SEQ ID NO: 7082863 - DNA, 21 bp, Homo sapiens
gacaatgcagtcttttttgga

SEQ ID NO: 7082864 - DNA, 22 bp, Homo sapiens
gacaatgcattgtgattgtgac

SEQ ID NO: 7082865 - DNA, 22 bp, Homo sapiens
gaatcagaatctgcatgttaag

SEQ ID NO: 7082866 - DNA, 22 bp, Homo sapiens
gaatcagaatctgcatttttaa

SEQ ID NO: 7082867 - DNA, 22 bp, Homo sapiens
gaatcagataataagcaagcat

SEQ ID NO: 7082868 - DNA, 22 bp, Homo sapiens
gaatcagatgcggtttagctta

SEQ ID NO: 7082869 - DNA, 22 bp, Homo sapiens
gaattttatcttattacttgca

SEQ ID NO: 7082870 - DNA, 22 bp, Homo sapiens
gacaataaagtgatacatggga

SEQ ID NO: 7082871 - DNA, 22 bp, Homo sapiens
atgcacagaaaaattgcttact

SEQ ID NO: 7082872 - DNA, 22 bp, Homo sapiens
atgcacagatccccaggaccct

SEQ ID NO: 7082873 - DNA, 22 bp, Homo sapiens
atgcacagacccaaaggccatc

SEQ ID NO: 7082874 - DNA, 22 bp, Homo sapiens
atgcacaggacagcctctactc

SEQ ID NO: 7082875 - DNA, 22 bp, Homo sapiens
atgcacaggacagcctctactc

SEQ ID NO: 7082876 - DNA, 22 bp, Homo sapiens
atgcacagctgaacactctaaa

SEQ ID NO: 7082877 - DNA, 22 bp, Homo sapiens
atgcacagctgaacactctaaa

SEQ ID NO: 7082878 - DNA, 22 bp, Homo sapiens
gaaggctgtttctggtagtgat

SEQ ID NO: 7082879 - DNA, 22 bp, Homo sapiens
gaaggctgtggctggtctcagt

SEQ ID NO: 7082880 - DNA, 22 bp, Homo sapiens
gaaggctgtttctggtagtgat

SEQ ID NO: 7082881 - DNA, 22 bp, Homo sapiens
gaaggctgtttctggtagtgat

SEQ ID NO: 7082882 - DNA, 22 bp, Homo sapiens
atgcacaattaggatatagctt

SEQ ID NO: 7082883 - DNA, 22 bp, Homo sapiens
gaaggctgtcagagaggagggc

SEQ ID NO: 7082884 - DNA, 22 bp, Homo sapiens
gaaggctgtcagagaggagggc

SEQ ID NO: 7082885 - DNA, 22 bp, Homo sapiens
gaaggctgtcagagaggagggc

SEQ ID NO: 7082886 - DNA, 22 bp, Homo sapiens
gaaggctgtcagagaggagggc

SEQ ID NO: 7082887 - DNA, 22 bp, Homo sapiens
gaaggctgtcagagaggagggc

SEQ ID NO: 7082888 - DNA, 22 bp, Homo sapiens
gaaggctggggcatcagtgaaa

SEQ ID NO: 7082889 - DNA, 22 bp, Homo sapiens
gaaggctggctttctgagagca

SEQ ID NO: 7082890 - DNA, 22 bp, Homo sapiens
gaaggctggctttctgagagca

SEQ ID NO: 7082891 - DNA, 22 bp, Homo sapiens
gaaggctggaaggcaagtagga

SEQ ID NO: 7082892 - DNA, 22 bp, Homo sapiens
gaaggctggaaggcaagtagga

SEQ ID NO: 7082893 - DNA, 22 bp, Homo sapiens
gaaggctggaaggcaagtagga

SEQ ID NO: 7082894 - DNA, 22 bp, Homo sapiens
gaaggctggaaggcaagtagga

SEQ ID NO: 7082895 - DNA, 22 bp, Homo sapiens
gaaggctgctgggaagtgtggt

SEQ ID NO: 7082896 - DNA, 22 bp, Homo sapiens
gaaggctgctgggaagtgtggt

SEQ ID NO: 7082897 - DNA, 22 bp, Homo sapiens
gaacaactttgaaacatgaaga

SEQ ID NO: 7082898 - DNA, 22 bp, Homo sapiens
gaacaatacaggctttattcct

SEQ ID NO: 7082899 - DNA, 22 bp, Homo sapiens
gaacaatagtggtaacaaagcc

SEQ ID NO: 7082900 - DNA, 22 bp, Homo sapiens
gaacaatagtggtaacaaagcc

SEQ ID NO: 7082901 - DNA, 22 bp, Homo sapiens
gaacaatagtggtaacaaagcc

SEQ ID NO: 7082902 - DNA, 22 bp, Homo sapiens
gaacaatgaaagacataaactc

SEQ ID NO: 7082903 - DNA, 22 bp, Homo sapiens
gaaggcaagcagcataaatgtc

SEQ ID NO: 7082904 - DNA, 22 bp, Homo sapiens
gaacaaacacatcccagcagtg

SEQ ID NO: 7082905 - DNA, 22 bp, Homo sapiens
gaacaaacagaagaggcggaac

SEQ ID NO: 7082906 - DNA, 22 bp, Homo sapiens
gaacaaacagtcaggacagtct

SEQ ID NO: 7082907 - DNA, 22 bp, Homo sapiens
gaacaaacatttttggcagtat

SEQ ID NO: 7082908 - DNA, 22 bp, Homo sapiens
gaacaaactgggtcccaatgat

SEQ ID NO: 7082909 - DNA, 19 bp, Homo sapiens
gaacaaacttaaacttttc

SEQ ID NO: 7082910 - DNA, 19 bp, Homo sapiens
gaacaaacttaaacttttc

SEQ ID NO: 7082911 - DNA, 22 bp, Homo sapiens
gaacaaagacatggaggaggat

SEQ ID NO: 7082912 - DNA, 22 bp, Homo sapiens
gaacaaagacatggaggaggat

SEQ ID NO: 7082913 - DNA, 22 bp, Homo sapiens
gaacaaattctcatcaacttgt

SEQ ID NO: 7082914 - DNA, 22 bp, Homo sapiens
gaacaaattctcatcaacttgt

SEQ ID NO: 7082915 - DNA, 22 bp, Homo sapiens
gaacaaattggagaaatcagga

SEQ ID NO: 7082916 - DNA, 22 bp, Homo sapiens
gaacaactccaagggacatcat

SEQ ID NO: 7082917 - DNA, 22 bp, Homo sapiens
gaacaactcttcttgagagatg

SEQ ID NO: 7082918 - DNA, 22 bp, Homo sapiens
gaacaactcttcttgagagatg

SEQ ID NO: 7082919 - DNA, 22 bp, Homo sapiens
gaacaactcttcttgagagatg

SEQ ID NO: 7082920 - DNA, 22 bp, Homo sapiens
gaacaactttgaaacatgaaga

SEQ ID NO: 7082921 - DNA, 22 bp, Homo sapiens
ctttcccagagtagttgatgct

SEQ ID NO: 7082922 - DNA, 22 bp, Homo sapiens
ctttcccacgcagtggatgaga

SEQ ID NO: 7082923 - DNA, 22 bp, Homo sapiens
ctttcccagagtagttgatgct

SEQ ID NO: 7082924 - DNA, 22 bp, Homo sapiens
ctttccctgcttagaaggattt

SEQ ID NO: 7082925 - DNA, 22 bp, Homo sapiens
ctttcctagtagttacagaatg

SEQ ID NO: 7082926 - DNA, 22 bp, Homo sapiens
ctttcctagatggccatctttc

SEQ ID NO: 7082927 - DNA, 22 bp, Homo sapiens
ctttcctagatggccatctttc

SEQ ID NO: 7082928 - DNA, 22 bp, Homo sapiens
ctttcctagaaatatatactta

SEQ ID NO: 7082929 - DNA, 22 bp, Homo sapiens
ctttcctagaaatatatactta

SEQ ID NO: 7082930 - DNA, 22 bp, Homo sapiens
ctttcccttttgccttgcgtgg

SEQ ID NO: 7082931 - DNA, 22 bp, Homo sapiens
atctggctcacctgggtaaata

SEQ ID NO: 7082932 - DNA, 22 bp, Homo sapiens
atctggctcacttagtctagga

SEQ ID NO: 7082933 - DNA, 22 bp, Homo sapiens
atctggctcacttagtctagga

SEQ ID NO: 7082934 - DNA, 22 bp, Homo sapiens
ctttcaaagaccttggcatggg

SEQ ID NO: 7082935 - DNA, 22 bp, Homo sapiens
ctttcaaagaccttggcatggg

SEQ ID NO: 7082936 - DNA, 22 bp, Homo sapiens
ctttcaaagagtaggaggtttt

SEQ ID NO: 7082937 - DNA, 22 bp, Homo sapiens
ctttcaaagagtaggaggtttt

SEQ ID NO: 7082938 - DNA, 19 bp, Homo sapiens
ctttccagctcgagcaatt

SEQ ID NO: 7082939 - DNA, 22 bp, Homo sapiens
ctttccaggaatcctcacagcc

SEQ ID NO: 7082940 - DNA, 22 bp, Homo sapiens
ctttccaggacttgcatttctg

SEQ ID NO: 7082941 - DNA, 22 bp, Homo sapiens
ctttccaggacttgcatttctg

SEQ ID NO: 7082942 - DNA, 19 bp, Homo sapiens
ctttccaggagatgctgag

SEQ ID NO: 7082943 - DNA, 22 bp, Homo sapiens
ctttccaggctgagtttgcttg

SEQ ID NO: 7082944 - DNA, 22 bp, Homo sapiens
ctttccaggtctaaaggcaggg

SEQ ID NO: 7082945 - DNA, 22 bp, Homo sapiens
ctttccaggtctaaaggcaggg

SEQ ID NO: 7082946 - DNA, 22 bp, Homo sapiens
ctttccagtaccaggaagcgga

SEQ ID NO: 7082947 - DNA, 22 bp, Homo sapiens
ctttccagtaccaggaagcgga

SEQ ID NO: 7082948 - DNA, 22 bp, Homo sapiens
ctttccagtttctaagtacagt

SEQ ID NO: 7082949 - DNA, 22 bp, Homo sapiens
cttctttactttctagaaataa

SEQ ID NO: 7082950 - DNA, 22 bp, Homo sapiens
cttctttactttctagaaataa

SEQ ID NO: 7082951 - DNA, 22 bp, Homo sapiens
cttctttaccaagagatagagt

SEQ ID NO: 7082952 - DNA, 22 bp, Homo sapiens
cttctttaccaagagatagagt

SEQ ID NO: 7082953 - DNA, 22 bp, Homo sapiens
atctggagaataaatgtccaag

SEQ ID NO: 7082954 - DNA, 22 bp, Homo sapiens
atctggagaatgtttgtctccg

SEQ ID NO: 7082955 - DNA, 22 bp, Homo sapiens
atctggagagatcttcacaaaa

SEQ ID NO: 7082956 - DNA, 22 bp, Homo sapiens
atctggagagatcttcacaaaa

SEQ ID NO: 7082957 - DNA, 22 bp, Homo sapiens
atctggagagctggcagcccag

SEQ ID NO: 7082958 - DNA, 22 bp, Homo sapiens
atctggagatcagctggtggca

SEQ ID NO: 7082959 - DNA, 22 bp, Homo sapiens
cttctttaatgtatacaaaaga

SEQ ID NO: 7082960 - DNA, 22 bp, Homo sapiens
cttctttaatgtatacaaaaga

SEQ ID NO: 7082961 - DNA, 22 bp, Homo sapiens
cttcttgtcaatttgccattgt

SEQ ID NO: 7082962 - DNA, 22 bp, Homo sapiens
cttcttgtcagtgatttcttcc

SEQ ID NO: 7082963 - DNA, 22 bp, Homo sapiens
cttcttgtgcactctctatgta

SEQ ID NO: 7082964 - DNA, 22 bp, Homo sapiens
cttcttgtgcccatacgttaga

SEQ ID NO: 7082965 - DNA, 22 bp, Homo sapiens
cttcttgtgctgggccagcttc

SEQ ID NO: 7082966 - DNA, 22 bp, Homo sapiens
cttcttgtgctgggccagcttc

SEQ ID NO: 7082967 - DNA, 18 bp, Homo sapiens
cttcttgtttgatttggg

SEQ ID NO: 7082968 - DNA, 22 bp, Homo sapiens
cttcttgttttagccctcatac

SEQ ID NO: 7082969 - DNA, 22 bp, Homo sapiens
cttcttgttttagccctcatac

SEQ ID NO: 7082970 - DNA, 22 bp, Homo sapiens
atctggagatctgaattttgtg

SEQ ID NO: 7082971 - DNA, 22 bp, Homo sapiens
atctggagatgggtctgtcacc

SEQ ID NO: 7082972 - DNA, 22 bp, Homo sapiens
atctggagatttcttttcaata

SEQ ID NO: 7082973 - DNA, 22 bp, Homo sapiens
atctggagcaagattaagagat

SEQ ID NO: 7082974 - DNA, 22 bp, Homo sapiens
atctggagcaagattaagagat

SEQ ID NO: 7082975 - DNA, 22 bp, Homo sapiens
atctggagcagggccacaaggc

SEQ ID NO: 7082976 - DNA, 22 bp, Homo sapiens
atctggagctctgcacacctgg

SEQ ID NO: 7082977 - DNA, 22 bp, Homo sapiens
atctggagcttaagcttatata

SEQ ID NO: 7082978 - DNA, 22 bp, Homo sapiens
atctggagcttgttagatgttt

SEQ ID NO: 7082979 - DNA, 22 bp, Homo sapiens
atctggagcttgttagatgttt

SEQ ID NO: 7082980 - DNA, 22 bp, Homo sapiens
atctggaggattctgggacttg

SEQ ID NO: 7082981 - DNA, 22 bp, Homo sapiens
atctggaggattctgggacttg

SEQ ID NO: 7082982 - DNA, 22 bp, Homo sapiens
atctggaggcaaaggggcgtga

SEQ ID NO: 7082983 - DNA, 22 bp, Homo sapiens
atctggaggcaaaggggcgtga

SEQ ID NO: 7082984 - DNA, 22 bp, Homo sapiens
atctggaggcattactctgtct

SEQ ID NO: 7082985 - DNA, 22 bp, Homo sapiens
atctggaggcctgtcttatccc

SEQ ID NO: 7082986 - DNA, 22 bp, Homo sapiens
atctggaggctaagtcatttgc

SEQ ID NO: 7082987 - DNA, 22 bp, Homo sapiens
atctggaggtcatcgtttgttc

SEQ ID NO: 7082988 - DNA, 22 bp, Homo sapiens
atctggagtagaaaaatcgctt

SEQ ID NO: 7082989 - DNA, 22 bp, Homo sapiens
atctggagtagaaaaatcgctt

SEQ ID NO: 7082990 - DNA, 22 bp, Homo sapiens
atctggagtgggacacagaaat

SEQ ID NO: 7082991 - DNA, 22 bp, Homo sapiens
atctggagtgggacacagaaat

SEQ ID NO: 7082992 - DNA, 23 bp, Homo sapiens
atctggagtgttgagtaggtact

SEQ ID NO: 7082993 - DNA, 22 bp, Homo sapiens
atctggagtttcagttttctgg

SEQ ID NO: 7082994 - DNA, 22 bp, Homo sapiens
atctggattctagatctagatc

SEQ ID NO: 7082995 - DNA, 20 bp, Homo sapiens
atgaaattcctgttttctga

SEQ ID NO: 7082996 - DNA, 22 bp, Homo sapiens
atgaacagtacaaagcacagac

SEQ ID NO: 7082997 - DNA, 22 bp, Homo sapiens
atgaacagtatgcaacatgatt

SEQ ID NO: 7082998 - DNA, 22 bp, Homo sapiens
atgaacagtatgcaacatgatt

SEQ ID NO: 7082999 - DNA, 22 bp, Homo sapiens
atgaacatcggaaatgagactg

SEQ ID NO: 7083000 - DNA, 22 bp, Homo sapiens
atgaacatcggaaatgagactg

SEQ ID NO: 7083001 - DNA, 22 bp, Homo sapiens
atgaacatcggaaatgagactg

SEQ ID NO: 7083002 - DNA, 22 bp, Homo sapiens
atgaaacagtgaattagtcaag

SEQ ID NO: 7083003 - DNA, 22 bp, Homo sapiens
atgaaacagtgaattagtcaag

SEQ ID NO: 7083004 - DNA, 22 bp, Homo sapiens
atgaaacagtgaattagtcaag

SEQ ID NO: 7083005 - DNA, 22 bp, Homo sapiens
atgaaacagtgtgtatagcaaa

SEQ ID NO: 7083006 - DNA, 22 bp, Homo sapiens
atgaaacagtgtgtatagcaaa

SEQ ID NO: 7083007 - DNA, 22 bp, Homo sapiens
atgaaacagagtacttaatata

SEQ ID NO: 7083008 - DNA, 22 bp, Homo sapiens
atgaaacagtgaattagtcaag

SEQ ID NO: 7083009 - DNA, 22 bp, Homo sapiens
atgaaacagtgtgtatagcaaa

SEQ ID NO: 7083010 - DNA, 22 bp, Homo sapiens
atgaaacagtgtgtatagcaaa

SEQ ID NO: 7083011 - DNA, 22 bp, Homo sapiens
atgaaattcatctgagaatgct

SEQ ID NO: 7083012 - DNA, 22 bp, Homo sapiens
atgaaaatgtacatgtgtataa

SEQ ID NO: 7083013 - DNA, 22 bp, Homo sapiens
atgaaaattctatgcaggccag

SEQ ID NO: 7083014 - DNA, 22 bp, Homo sapiens
atgaaaatgtacatgtgtataa

SEQ ID NO: 7083015 - DNA, 22 bp, Homo sapiens
atgaaaatactgtggttgatag

SEQ ID NO: 7083016 - DNA, 22 bp, Homo sapiens
atgaaaattgacagcggaagta

SEQ ID NO: 7083017 - DNA, 22 bp, Homo sapiens
atgaaacaaacctctatggagt

SEQ ID NO: 7083018 - DNA, 22 bp, Homo sapiens
atgaaacaaacctctatggagt

SEQ ID NO: 7083019 - DNA, 22 bp, Homo sapiens
atgaaacaacagacttggtcaa

SEQ ID NO: 7083020 - DNA, 22 bp, Homo sapiens
atgaaacagagtacttaatata

SEQ ID NO: 7083021 - DNA, 22 bp, Homo sapiens
atgaaacagagtacttaatata

SEQ ID NO: 7083022 - DNA, 22 bp, Homo sapiens
atgaagaaactgttctgggtgg

SEQ ID NO: 7083023 - DNA, 22 bp, Homo sapiens
atgaagaaaaatccagctgtcc

SEQ ID NO: 7083024 - DNA, 22 bp, Homo sapiens
atgaagacaaacgacgttgcaa

SEQ ID NO: 7083025 - DNA, 22 bp, Homo sapiens
atgaagacaaacgacgttgcaa

SEQ ID NO: 7083026 - DNA, 22 bp, Homo sapiens
atgaagacaaactgggtagaaa

SEQ ID NO: 7083027 - DNA, 22 bp, Homo sapiens
atgaagacaaactgggtagaaa

SEQ ID NO: 7083028 - DNA, 20 bp, Homo sapiens
atgaagacaaatccgacttg

SEQ ID NO: 7083029 - DNA, 20 bp, Homo sapiens
atgaagacaaatccgacttg

SEQ ID NO: 7083030 - DNA, 22 bp, Homo sapiens
atgaactcatttattttcctct

SEQ ID NO: 7083031 - DNA, 22 bp, Homo sapiens
atgaactcttctggttattttt

SEQ ID NO: 7083032 - DNA, 22 bp, Homo sapiens
atgaactcttctggttattttt

SEQ ID NO: 7083033 - DNA, 22 bp, Homo sapiens
atgaactcttgctttatttcag

SEQ ID NO: 7083034 - DNA, 22 bp, Homo sapiens
atgaactcttgctttatttcag

SEQ ID NO: 7083035 - DNA, 22 bp, Homo sapiens
atgaactgagcttaattgctga

SEQ ID NO: 7083036 - DNA, 22 bp, Homo sapiens
atgaactgcatgtattttagtg

SEQ ID NO: 7083037 - DNA, 22 bp, Homo sapiens
atgaactgcagtataaacttgg

SEQ ID NO: 7083038 - DNA, 22 bp, Homo sapiens
atgaactgcatgttttctactg

SEQ ID NO: 7083039 - DNA, 22 bp, Homo sapiens
atgaactgtccaatcttagagg

SEQ ID NO: 7083040 - DNA, 22 bp, Homo sapiens
atgaacttccagagcttggtga

SEQ ID NO: 7083041 - DNA, 22 bp, Homo sapiens
atgaactttctttacagttttg

SEQ ID NO: 7083042 - DNA, 22 bp, Homo sapiens
atgaactttctttacagttttg

SEQ ID NO: 7083043 - DNA, 22 bp, Homo sapiens
atgaacttatttctgaactttt

SEQ ID NO: 7083044 - DNA, 22 bp, Homo sapiens
atgaacatctctgatccaagca

SEQ ID NO: 7083045 - DNA, 22 bp, Homo sapiens
atgaacatgtgactcagacctg

SEQ ID NO: 7083046 - DNA, 22 bp, Homo sapiens
atgaacatgtgactcagacctg

SEQ ID NO: 7083047 - DNA, 23 bp, Homo sapiens
atgaacattagtttcagatattg

SEQ ID NO: 7083048 - DNA, 23 bp, Homo sapiens
atgaacattagtttcagatattg

SEQ ID NO: 7083049 - DNA, 22 bp, Homo sapiens
atgaacatttggtttggcagca

SEQ ID NO: 7083050 - DNA, 22 bp, Homo sapiens
atgaaccttgatttgttcatct

SEQ ID NO: 7083051 - DNA, 22 bp, Homo sapiens
atgaactaagagtcattagtgt

SEQ ID NO: 7083052 - DNA, 22 bp, Homo sapiens
atgaactcatttattttcctct

SEQ ID NO: 7083053 - DNA, 22 bp, Homo sapiens
ctttcttcaacctcattctgca

SEQ ID NO: 7083054 - DNA, 22 bp, Homo sapiens
ctttcttcaacctcattctgca

SEQ ID NO: 7083055 - DNA, 22 bp, Homo sapiens
ctttcttaatttttaaggacac

SEQ ID NO: 7083056 - DNA, 22 bp, Homo sapiens
ctttctggctgaagtgatgaat

SEQ ID NO: 7083057 - DNA, 22 bp, Homo sapiens
ctttcttaatttttaaggacac

SEQ ID NO: 7083058 - DNA, 22 bp, Homo sapiens
ctttctgatccctgcaaccctc

SEQ ID NO: 7083059 - DNA, 22 bp, Homo sapiens
ctttctgatgtaaggaactagg

SEQ ID NO: 7083060 - DNA, 22 bp, Homo sapiens
ctttctgattttaagctctaat

SEQ ID NO: 7083061 - DNA, 22 bp, Homo sapiens
ctttctgattttaagctctaat

SEQ ID NO: 7083062 - DNA, 22 bp, Homo sapiens
ctttctggacaagacagaggga

SEQ ID NO: 7083063 - DNA, 22 bp, Homo sapiens
ctttctggagtggaaaggtatt

SEQ ID NO: 7083064 - DNA, 22 bp, Homo sapiens
ctttctggagtggaaaggtatt

SEQ ID NO: 7083065 - DNA, 22 bp, Homo sapiens
ctttctggcacagccgcgggat

SEQ ID NO: 7083066 - DNA, 22 bp, Homo sapiens
ctttctgaaagacattttaact

SEQ ID NO: 7083067 - DNA, 22 bp, Homo sapiens
ctttctgaagtttaagttctaa

SEQ ID NO: 7083068 - DNA, 22 bp, Homo sapiens
ctttctgaagtttaagttctaa

SEQ ID NO: 7083069 - DNA, 22 bp, Homo sapiens
ctttctgaagtttaagttctaa

SEQ ID NO: 7083070 - DNA, 22 bp, Homo sapiens
atgaagacaggtctcatcacca

SEQ ID NO: 7083071 - DNA, 22 bp, Homo sapiens
atgaagacaggtctcatcacca

SEQ ID NO: 7083072 - DNA, 22 bp, Homo sapiens
atgaagacaggtctcatcacca

SEQ ID NO: 7083073 - DNA, 23 bp, Homo sapiens
atgaagacccgtggtgtccccac

SEQ ID NO: 7083074 - DNA, 23 bp, Homo sapiens
atgaagacccgtggtgtccccac

SEQ ID NO: 7083075 - DNA, 22 bp, Homo sapiens
atgaagactaatgtgaatggga

SEQ ID NO: 7083076 - DNA, 22 bp, Homo sapiens
atgaagactaatgtgaatggga

SEQ ID NO: 7083077 - DNA, 22 bp, Homo sapiens
ctttctcttcgaaaacctgccc

SEQ ID NO: 7083078 - DNA, 23 bp, Homo sapiens
atgaagacccgtggtgtccccac

SEQ ID NO: 7083079 - DNA, 22 bp, Homo sapiens
gaaatagaagctgccaatttct

SEQ ID NO: 7083080 - DNA, 22 bp, Homo sapiens
gaaatagacactttctatgaat

SEQ ID NO: 7083081 - DNA, 22 bp, Homo sapiens
gaaatagacactttctatgaat

SEQ ID NO: 7083082 - DNA, 22 bp, Homo sapiens
gaaatagacactttctatgaat

SEQ ID NO: 7083083 - DNA, 22 bp, Homo sapiens
gaaatagacactttctatgaat

SEQ ID NO: 7083084 - DNA, 22 bp, Homo sapiens
gaaatagaagctgccaatttct

SEQ ID NO: 7083085 - DNA, 22 bp, Homo sapiens
gaaatactgtaaagttattatt

SEQ ID NO: 7083086 - DNA, 22 bp, Homo sapiens
gaaagtgcagtcagacaaggca

SEQ ID NO: 7083087 - DNA, 22 bp, Homo sapiens
gaaagtgcagtcagacaaggca

SEQ ID NO: 7083088 - DNA, 22 bp, Homo sapiens
gaaatacagttgggaggaggta

SEQ ID NO: 7083089 - DNA, 22 bp, Homo sapiens
gaaatacagttgggaggaggta

SEQ ID NO: 7083090 - DNA, 22 bp, Homo sapiens
gaaatacagttgggaggaggta

SEQ ID NO: 7083091 - DNA, 22 bp, Homo sapiens
gaaatacagttgggaggaggta

SEQ ID NO: 7083092 - DNA, 21 bp, Homo sapiens
gaaatactgccttaggagctg

SEQ ID NO: 7083093 - DNA, 22 bp, Homo sapiens
gaaagtattagcctagaagtca

SEQ ID NO: 7083094 - DNA, 22 bp, Homo sapiens
gaaagtacagattcctggccag

SEQ ID NO: 7083095 - DNA, 22 bp, Homo sapiens
gaaaggtttggcttttcagtag

SEQ ID NO: 7083096 - DNA, 22 bp, Homo sapiens
gaaaggtttggcttttcagtag

SEQ ID NO: 7083097 - DNA, 22 bp, Homo sapiens
gaaagtaacatttcttgaatta

SEQ ID NO: 7083098 - DNA, 22 bp, Homo sapiens
gaaaggtttcatctacttttca

SEQ ID NO: 7083099 - DNA, 22 bp, Homo sapiens
gaaaggtttcatctacttttca

SEQ ID NO: 7083100 - DNA, 23 bp, Homo sapiens
gaaagtcaatatggtagctttga

SEQ ID NO: 7083101 - DNA, 22 bp, Homo sapiens
gaaagtcatggatgaacactac

SEQ ID NO: 7083102 - DNA, 22 bp, Homo sapiens
gaaatttattatctacatcatt

SEQ ID NO: 7083103 - DNA, 22 bp, Homo sapiens
gaaatttattatctacatcatt

SEQ ID NO: 7083104 - DNA, 22 bp, Homo sapiens
atgatgaaattttctatcatgt

SEQ ID NO: 7083105 - DNA, 22 bp, Homo sapiens
atgatgaaattttctatcatgt

SEQ ID NO: 7083106 - DNA, 22 bp, Homo sapiens
atgatgaattttaaaagcacca

SEQ ID NO: 7083107 - DNA, 19 bp, Homo sapiens
atgatgcagagctgactca

SEQ ID NO: 7083108 - DNA, 22 bp, Homo sapiens
atgatgaggtcccaagatctca

SEQ ID NO: 7083109 - DNA, 22 bp, Homo sapiens
atgatgcataatttatacatgc

SEQ ID NO: 7083110 - DNA, 22 bp, Homo sapiens
atgatgctgtttatcatatact

SEQ ID NO: 7083111 - DNA, 22 bp, Homo sapiens
atgatgaaatgataggtttgtt

SEQ ID NO: 7083112 - DNA, 22 bp, Homo sapiens
atgatgaaaactgaaggttagg

SEQ ID NO: 7083113 - DNA, 22 bp, Homo sapiens
atgatgaaactaggaactagag

SEQ ID NO: 7083114 - DNA, 22 bp, Homo sapiens
atgatctgataatcatccacta

SEQ ID NO: 7083115 - DNA, 22 bp, Homo sapiens
atgatctgataatcatccacta

SEQ ID NO: 7083116 - DNA, 22 bp, Homo sapiens
atgatcatacagagccctggta

SEQ ID NO: 7083117 - DNA, 22 bp, Homo sapiens
atgatcatacagagccctggta

SEQ ID NO: 7083118 - DNA, 22 bp, Homo sapiens
atgatcagggcagaagcagaag

SEQ ID NO: 7083119 - DNA, 22 bp, Homo sapiens
atgatcagggcagaagcagaag

SEQ ID NO: 7083120 - DNA, 22 bp, Homo sapiens
atgatcatggaagtgcacccat

SEQ ID NO: 7083121 - DNA, 22 bp, Homo sapiens
atgatcatggaagtgcacccat

SEQ ID NO: 7083122 - DNA, 22 bp, Homo sapiens
gaaatagatctctgggatgcaa

SEQ ID NO: 7083123 - DNA, 22 bp, Homo sapiens
gaaatagtacagcatagttctt

SEQ ID NO: 7083124 - DNA, 22 bp, Homo sapiens
gaaatagaggacagctggatca

SEQ ID NO: 7083125 - DNA, 22 bp, Homo sapiens
gaaatagaggacagctggatca

SEQ ID NO: 7083126 - DNA, 22 bp, Homo sapiens
gaaatagaggacagctggatca

SEQ ID NO: 7083127 - DNA, 22 bp, Homo sapiens
gaaatagaggacagctggatca

SEQ ID NO: 7083128 - DNA, 19 bp, Homo sapiens
atgatacaggtgaaaattg

SEQ ID NO: 7083129 - DNA, 19 bp, Homo sapiens
atgatacaggtgaaaattg

SEQ ID NO: 7083130 - DNA, 22 bp, Homo sapiens
gaaatatacatgaagtcggctg

SEQ ID NO: 7083131 - DNA, 22 bp, Homo sapiens
gaaatatacatgaagtcggctg

SEQ ID NO: 7083132 - DNA, 22 bp, Homo sapiens
atgatatttgcaatgtgcttgc

SEQ ID NO: 7083133 - DNA, 22 bp, Homo sapiens
atgatatttgcaatgtgcttgc

SEQ ID NO: 7083134 - DNA, 22 bp, Homo sapiens
atgatatttgcaatgtgcttgc

SEQ ID NO: 7083135 - DNA, 22 bp, Homo sapiens
atgatatttgcaatgtgcttgc

SEQ ID NO: 7083136 - DNA, 22 bp, Homo sapiens
atgatattattctagcccagag

SEQ ID NO: 7083137 - DNA, 22 bp, Homo sapiens
atgatattattctagcccagag

SEQ ID NO: 7083138 - DNA, 22 bp, Homo sapiens
atgatcaagaattttgtattcc

SEQ ID NO: 7083139 - DNA, 22 bp, Homo sapiens
atgatattttagtaaagtgata

SEQ ID NO: 7083140 - DNA, 22 bp, Homo sapiens
atgatcagcagttttcagtgtt

SEQ ID NO: 7083141 - DNA, 22 bp, Homo sapiens
atgatcagcagttttcagtgtt

SEQ ID NO: 7083142 - DNA, 22 bp, Homo sapiens
atgatattttagtaaagtgata

SEQ ID NO: 7083143 - DNA, 22 bp, Homo sapiens
atgatattttagtaaagtgata

SEQ ID NO: 7083144 - DNA, 22 bp, Homo sapiens
atgatattttagtaaagtgata

SEQ ID NO: 7083145 - DNA, 22 bp, Homo sapiens
gaaaggtttcatctacttttca

SEQ ID NO: 7083146 - DNA, 22 bp, Homo sapiens
gaaaggtttaagtaggatttgt

SEQ ID NO: 7083147 - DNA, 22 bp, Homo sapiens
gaaaggttgtaacaagactctt

SEQ ID NO: 7083148 - DNA, 17 bp, Homo sapiens
gaaagcatcacatgctc

SEQ ID NO: 7083149 - DNA, 22 bp, Homo sapiens
gaaagcagtatttagttctgtt

SEQ ID NO: 7083150 - DNA, 22 bp, Homo sapiens
gaaagcataactaatatttatt

SEQ ID NO: 7083151 - DNA, 22 bp, Homo sapiens
gaaagcagtatttagttctgtt

SEQ ID NO: 7083152 - DNA, 22 bp, Homo sapiens
atgacatgaggcatctttggag

SEQ ID NO: 7083153 - DNA, 22 bp, Homo sapiens
atgacatgattctttctttcat

SEQ ID NO: 7083154 - DNA, 22 bp, Homo sapiens
atgacatgaataaaaatcgtgt

SEQ ID NO: 7083155 - DNA, 22 bp, Homo sapiens
atgacatgacctggtagagaca

SEQ ID NO: 7083156 - DNA, 22 bp, Homo sapiens
atgacatgacctggtagagaca

SEQ ID NO: 7083157 - DNA, 22 bp, Homo sapiens
atgacatcaacagtggtgctgt

SEQ ID NO: 7083158 - DNA, 22 bp, Homo sapiens
atgacatcactacattattcct

SEQ ID NO: 7083159 - DNA, 22 bp, Homo sapiens
atgacagtactggtgacaatac

SEQ ID NO: 7083160 - DNA, 22 bp, Homo sapiens
atgacagtaggtaaatgatagc

SEQ ID NO: 7083161 - DNA, 22 bp, Homo sapiens
atgacagtaggtaaatgatagc

SEQ ID NO: 7083162 - DNA, 22 bp, Homo sapiens
atgacagtgggtcttgcaaaga

SEQ ID NO: 7083163 - DNA, 22 bp, Homo sapiens
gaaacatttgttgagtacttgc

SEQ ID NO: 7083164 - DNA, 22 bp, Homo sapiens
gaaacatttgttgagtacttgc

SEQ ID NO: 7083165 - DNA, 22 bp, Homo sapiens
gaaaccagataagggaggctga

SEQ ID NO: 7083166 - DNA, 22 bp, Homo sapiens
atgacagatagtcttcatttgc

SEQ ID NO: 7083167 - DNA, 21 bp, Homo sapiens
atgacagatgctgcagatcgt

SEQ ID NO: 7083168 - DNA, 21 bp, Homo sapiens
atgacagatgctgcagatcgt

SEQ ID NO: 7083169 - DNA, 22 bp, Homo sapiens
atgacagatgctgtggggaggt

SEQ ID NO: 7083170 - DNA, 22 bp, Homo sapiens
atgacagatgctgtggggaggt

SEQ ID NO: 7083171 - DNA, 22 bp, Homo sapiens
atgacagcattcaagacataga

SEQ ID NO: 7083172 - DNA, 22 bp, Homo sapiens
atgacaggaggcagctgggcag

SEQ ID NO: 7083173 - DNA, 22 bp, Homo sapiens
atgacaggaggcagctgggcag

SEQ ID NO: 7083174 - DNA, 22 bp, Homo sapiens
atgacaggtatgccttataatc

SEQ ID NO: 7083175 - DNA, 22 bp, Homo sapiens
atgacaggtgattttatgcttt

SEQ ID NO: 7083176 - DNA, 22 bp, Homo sapiens
atgacagtactggtgacaatac

SEQ ID NO: 7083177 - DNA, 22 bp, Homo sapiens
gaaacattgtgttctacagatt

SEQ ID NO: 7083178 - DNA, 20 bp, Homo sapiens
gaaacattggcagcaactga

SEQ ID NO: 7083179 - DNA, 22 bp, Homo sapiens
gaaacattgagcagaaggagaa

SEQ ID NO: 7083180 - DNA, 20 bp, Homo sapiens
gaaacattggcagcaactga

SEQ ID NO: 7083181 - DNA, 20 bp, Homo sapiens
gaaacattggcagcaactga

SEQ ID NO: 7083182 - DNA, 22 bp, Homo sapiens
gaaacattcagtcaacagtgtt

SEQ ID NO: 7083183 - DNA, 22 bp, Homo sapiens
gaaacattcagtcaacagtgtt

SEQ ID NO: 7083184 - DNA, 22 bp, Homo sapiens
gaaacattcagtcaacagtgtt

SEQ ID NO: 7083185 - DNA, 22 bp, Homo sapiens
gaaacattcatatgagaaacct

SEQ ID NO: 7083186 - DNA, 22 bp, Homo sapiens
gaaacattcatatgagaaacct

SEQ ID NO: 7083187 - DNA, 22 bp, Homo sapiens
gaaacattcatatgagaaacct

SEQ ID NO: 7083188 - DNA, 22 bp, Homo sapiens
gaaacatagttgagacactgct

SEQ ID NO: 7083189 - DNA, 22 bp, Homo sapiens
gaaacatacgatttaggagaaa

SEQ ID NO: 7083190 - DNA, 22 bp, Homo sapiens
gaaacatacgatttaggagaaa

SEQ ID NO: 7083191 - DNA, 22 bp, Homo sapiens
gaaacatattaatccagtgaaa

SEQ ID NO: 7083192 - DNA, 22 bp, Homo sapiens
gaaacatattaatccagtgaaa

SEQ ID NO: 7083193 - DNA, 22 bp, Homo sapiens
gaaacattcagtcaacagtgtt

SEQ ID NO: 7083194 - DNA, 22 bp, Homo sapiens
ctttctttcgaagacgtgatta

SEQ ID NO: 7083195 - DNA, 22 bp, Homo sapiens
gaaaatgttagcttcatagtca

SEQ ID NO: 7083196 - DNA, 22 bp, Homo sapiens
gaaaatgttagcttcatagtca

SEQ ID NO: 7083197 - DNA, 22 bp, Homo sapiens
gaaacaggtggcaggctagatt

SEQ ID NO: 7083198 - DNA, 22 bp, Homo sapiens
ctttctttcgaagacgtgatta

SEQ ID NO: 7083199 - DNA, 22 bp, Homo sapiens
ctttctttcgaagacgtgatta

SEQ ID NO: 7083200 - DNA, 22 bp, Homo sapiens
ctttctttcgaagacgtgatta

SEQ ID NO: 7083201 - DNA, 22 bp, Homo sapiens
ctttcttgcataatttgaaacc

SEQ ID NO: 7083202 - DNA, 22 bp, Homo sapiens
ctttcttctccctcaatattac

SEQ ID NO: 7083203 - DNA, 22 bp, Homo sapiens
ctttcttccatagggcccagtc

SEQ ID NO: 7083204 - DNA, 22 bp, Homo sapiens
ctttcttccatagggcccagtc

SEQ ID NO: 7083205 - DNA, 22 bp, Homo sapiens
ctttcttcatcaagtgccacgt

SEQ ID NO: 7083206 - DNA, 22 bp, Homo sapiens
ctttcttcatctgtaatatgga

SEQ ID NO: 7083207 - DNA, 22 bp, Homo sapiens
ctttcttcatctgtaatatgga

SEQ ID NO: 7083208 - DNA, 22 bp, Homo sapiens
gagggcctggcacagggaggct

SEQ ID NO: 7083209 - DNA, 22 bp, Homo sapiens
gagggcagagacagtgattcac

SEQ ID NO: 7083210 - DNA, 22 bp, Homo sapiens
gagggcagagacagtgattcac

SEQ ID NO: 7083211 - DNA, 22 bp, Homo sapiens
gagggcgcttcagagagatgaa

SEQ ID NO: 7083212 - DNA, 22 bp, Homo sapiens
gagggcgcttcagagagatgaa

SEQ ID NO: 7083213 - DNA, 22 bp, Homo sapiens
gagggcgcttcagagagatgaa

SEQ ID NO: 7083214 - DNA, 22 bp, Homo sapiens
gagggcgcttcagagagatgaa

SEQ ID NO: 7083215 - DNA, 22 bp, Homo sapiens
gagggcgttcagtcagtgtctc

SEQ ID NO: 7083216 - DNA, 20 bp, Homo sapiens
atgtctgaagtaatccattt

SEQ ID NO: 7083217 - DNA, 22 bp, Homo sapiens
atgtctgagtctgctccagttg

SEQ ID NO: 7083218 - DNA, 19 bp, Homo sapiens
atgtctctgtagcacatac

SEQ ID NO: 7083219 - DNA, 19 bp, Homo sapiens
atgtctctgtagcacatac

SEQ ID NO: 7083220 - DNA, 22 bp, Homo sapiens
gagggctccattccccgtgccc

SEQ ID NO: 7083221 - DNA, 19 bp, Homo sapiens
gagggctcatttgaacaat

SEQ ID NO: 7083222 - DNA, 22 bp, Homo sapiens
gagggctctgtctggaagggaa

SEQ ID NO: 7083223 - DNA, 22 bp, Homo sapiens
gagggctctgtctggaagggaa

SEQ ID NO: 7083224 - DNA, 22 bp, Homo sapiens
gagggctgaagattgtggcccc

SEQ ID NO: 7083225 - DNA, 22 bp, Homo sapiens
gagggctgaagattgtggcccc

SEQ ID NO: 7083226 - DNA, 22 bp, Homo sapiens
gagggctgaagattgtggcccc

SEQ ID NO: 7083227 - DNA, 22 bp, Homo sapiens
gagggctgaagattgtggcccc

SEQ ID NO: 7083228 - DNA, 22 bp, Homo sapiens
gagggctctgaaaggaggtcac

SEQ ID NO: 7083229 - DNA, 22 bp, Homo sapiens
gagggctctgaaaggaggtcac

SEQ ID NO: 7083230 - DNA, 23 bp, Homo sapiens
gagggctctgagtgcttgggcca

SEQ ID NO: 7083231 - DNA, 23 bp, Homo sapiens
gagggctctgagtgcttgggcca

SEQ ID NO: 7083232 - DNA, 22 bp, Homo sapiens
atgtgaggaagaaagaggtaag

SEQ ID NO: 7083233 - DNA, 22 bp, Homo sapiens
atgtgaggcagcacggagatta

SEQ ID NO: 7083234 - DNA, 22 bp, Homo sapiens
atgtgagcatcaccaggaggac

SEQ ID NO: 7083235 - DNA, 22 bp, Homo sapiens
atgtgagatgcacataattata

SEQ ID NO: 7083236 - DNA, 22 bp, Homo sapiens
atgtgactagcccttcatgacc

SEQ ID NO: 7083237 - DNA, 22 bp, Homo sapiens
atgtgagaataactcaaaacaa

SEQ ID NO: 7083238 - DNA, 22 bp, Homo sapiens
atgtgagaactcaggaaatact

SEQ ID NO: 7083239 - DNA, 22 bp, Homo sapiens
atgtgagaataactcaaaacaa

SEQ ID NO: 7083240 - DNA, 22 bp, Homo sapiens
atgtgagactaaaaagatgtgc

SEQ ID NO: 7083241 - DNA, 22 bp, Homo sapiens
gaggtggatgttgcagtgagct

SEQ ID NO: 7083242 - DNA, 20 bp, Homo sapiens
gaggtagggcttaaggcaag

SEQ ID NO: 7083243 - DNA, 22 bp, Homo sapiens
gaggtggatgttgcagtgagct

SEQ ID NO: 7083244 - DNA, 22 bp, Homo sapiens
gaggtggatgttgcagtgagct

SEQ ID NO: 7083245 - DNA, 23 bp, Homo sapiens
gaggtggcaatgagggcagttgg

SEQ ID NO: 7083246 - DNA, 22 bp, Homo sapiens
atgtgagggaaatcagtcagaa

SEQ ID NO: 7083247 - DNA, 22 bp, Homo sapiens
atgtgagggaaatcagtcagaa

SEQ ID NO: 7083248 - DNA, 22 bp, Homo sapiens
atgtgagggctcaggctgactg

SEQ ID NO: 7083249 - DNA, 22 bp, Homo sapiens
gaggtagggcagaggctgaatg

SEQ ID NO: 7083250 - DNA, 20 bp, Homo sapiens
gaggtagggcttaaggcaag

SEQ ID NO: 7083251 - DNA, 22 bp, Homo sapiens
atgtgaaactgaagcatccata

SEQ ID NO: 7083252 - DNA, 20 bp, Homo sapiens
atgtgaaagatcagttgtct

SEQ ID NO: 7083253 - DNA, 22 bp, Homo sapiens
atgtgaactctgtactctctga

SEQ ID NO: 7083254 - DNA, 20 bp, Homo sapiens
atgtgaagtaggaagggtgt

SEQ ID NO: 7083255 - DNA, 22 bp, Homo sapiens
atgtgacagtgtttgacagatg

SEQ ID NO: 7083256 - DNA, 21 bp, Homo sapiens
atgtgaaatatcatcagagca

SEQ ID NO: 7083257 - DNA, 22 bp, Homo sapiens
gaggcagcggctcacagagaaa

SEQ ID NO: 7083258 - DNA, 22 bp, Homo sapiens
gaggcagcggctcacagagaaa

SEQ ID NO: 7083259 - DNA, 22 bp, Homo sapiens
gaggcagcggctcacagagaaa

SEQ ID NO: 7083260 - DNA, 22 bp, Homo sapiens
gaggcagcgggtcaggaccgtg

SEQ ID NO: 7083261 - DNA, 22 bp, Homo sapiens
gaggcagcgggtcaggaccgtg

SEQ ID NO: 7083262 - DNA, 22 bp, Homo sapiens
atgtagaacaggttaatgacag

SEQ ID NO: 7083263 - DNA, 22 bp, Homo sapiens
atgtagaattccttctactttg

SEQ ID NO: 7083264 - DNA, 22 bp, Homo sapiens
atgtagaagtgggcattataga

SEQ ID NO: 7083265 - DNA, 22 bp, Homo sapiens
atgtagaagtgggcattataga

SEQ ID NO: 7083266 - DNA, 22 bp, Homo sapiens
atgtagaagctgacagtgctgt

SEQ ID NO: 7083267 - DNA, 22 bp, Homo sapiens
atgtagaacaggttaatgacag

SEQ ID NO: 7083268 - DNA, 22 bp, Homo sapiens
atgtagctgcagatgataatgc

SEQ ID NO: 7083269 - DNA, 22 bp, Homo sapiens
atgtagctgcagatgataatgc

SEQ ID NO: 7083270 - DNA, 22 bp, Homo sapiens
atgtcatgaaatgctactaact

SEQ ID NO: 7083271 - DNA, 22 bp, Homo sapiens
atgtagcatgaggcactgtgcc

SEQ ID NO: 7083272 - DNA, 22 bp, Homo sapiens
atgtagcatgcatgttgttttg

SEQ ID NO: 7083273 - DNA, 22 bp, Homo sapiens
atgtagctgcagatgataatgc

SEQ ID NO: 7083274 - DNA, 20 bp, Homo sapiens
atgtagcagtgtgctgggaa

SEQ ID NO: 7083275 - DNA, 20 bp, Homo sapiens
atgtagcagtgtgctgggaa

SEQ ID NO: 7083276 - DNA, 22 bp, Homo sapiens
atgtagcatctatcctgataaa

SEQ ID NO: 7083277 - DNA, 22 bp, Homo sapiens
atgtagagtagaatagtacaac

SEQ ID NO: 7083278 - DNA, 22 bp, Homo sapiens
atgtagatttgcttctcctgcc

SEQ ID NO: 7083279 - DNA, 22 bp, Homo sapiens
atgtagcagaagatgttttcct

SEQ ID NO: 7083280 - DNA, 22 bp, Homo sapiens
atgtagcagaggagacgtgtgt

SEQ ID NO: 7083281 - DNA, 22 bp, Homo sapiens
atgtagcagatatttgtgcaca

SEQ ID NO: 7083282 - DNA, 22 bp, Homo sapiens
atgtccctcactcctcattcag

SEQ ID NO: 7083283 - DNA, 22 bp, Homo sapiens
atgtcctcaaaactgattgcag

SEQ ID NO: 7083284 - DNA, 20 bp, Homo sapiens
atgtcctcagccactgccct

SEQ ID NO: 7083285 - DNA, 22 bp, Homo sapiens
atgtcctcggctctgtgctgct

SEQ ID NO: 7083286 - DNA, 20 bp, Homo sapiens
atgtcctcagccactgccct

SEQ ID NO: 7083287 - DNA, 22 bp, Homo sapiens
atgtcctcttctgcctcaggcc

SEQ ID NO: 7083288 - DNA, 22 bp, Homo sapiens
atgtcctcttctgcctcaggcc

SEQ ID NO: 7083289 - DNA, 20 bp, Homo sapiens
atgtcctgttgctgccccag

SEQ ID NO: 7083290 - DNA, 22 bp, Homo sapiens
atgtcctgttttggcttgctct

SEQ ID NO: 7083291 - DNA, 22 bp, Homo sapiens
atgtcctggtctagcttccggg

SEQ ID NO: 7083292 - DNA, 22 bp, Homo sapiens
atgtcctgggctgggttatgtt

SEQ ID NO: 7083293 - DNA, 22 bp, Homo sapiens
atgtcctggggtcttctcttca

SEQ ID NO: 7083294 - DNA, 23 bp, Homo sapiens
atgtcctgcatagttgcttctgt

SEQ ID NO: 7083295 - DNA, 20 bp, Homo sapiens
atgtcctgcttctcctcacc

SEQ ID NO: 7083296 - DNA, 22 bp, Homo sapiens
atgtccttgggccagggtgcct

SEQ ID NO: 7083297 - DNA, 22 bp, Homo sapiens
atgtccttggggctggggaact

SEQ ID NO: 7083298 - DNA, 22 bp, Homo sapiens
atgtccttggggctggggaact

SEQ ID NO: 7083299 - DNA, 22 bp, Homo sapiens
atgtccttgtgagtaaatgatg

SEQ ID NO: 7083300 - DNA, 22 bp, Homo sapiens
atgtccttgtgagtaaatgatg

SEQ ID NO: 7083301 - DNA, 22 bp, Homo sapiens
atgtccttgttttggtgacact

SEQ ID NO: 7083302 - DNA, 22 bp, Homo sapiens
atgtcctttaaatgacttaata

SEQ ID NO: 7083303 - DNA, 21 bp, Homo sapiens
atgtcctttgctctcccacat

SEQ ID NO: 7083304 - DNA, 22 bp, Homo sapiens
atgtccttctcctcttacctgc

SEQ ID NO: 7083305 - DNA, 22 bp, Homo sapiens
atgtccttctctggggcccaga

SEQ ID NO: 7083306 - DNA, 22 bp, Homo sapiens
atgtccttcttgagggcttgtt

SEQ ID NO: 7083307 - DNA, 22 bp, Homo sapiens
atgtccttgagaccctcctcgg

SEQ ID NO: 7083308 - DNA, 22 bp, Homo sapiens
atgtccttggaacacctgaggt

SEQ ID NO: 7083309 - DNA, 22 bp, Homo sapiens
atgtccttggagtccactttcc

SEQ ID NO: 7083310 - DNA, 22 bp, Homo sapiens
atgtccttggagtccactttcc

SEQ ID NO: 7083311 - DNA, 22 bp, Homo sapiens
atgtccttcctgagatccctgt

SEQ ID NO: 7083312 - DNA, 22 bp, Homo sapiens
atgtccttcggacaaaattctt

SEQ ID NO: 7083313 - DNA, 22 bp, Homo sapiens
atgtccttcgtaggggcagcag

SEQ ID NO: 7083314 - DNA, 22 bp, Homo sapiens
atgtccttaatctgaatgttag

SEQ ID NO: 7083315 - DNA, 22 bp, Homo sapiens
atgtccttaatctgaatgttag

SEQ ID NO: 7083316 - DNA, 22 bp, Homo sapiens
atgtccttcatctaggagatgg

SEQ ID NO: 7083317 - DNA, 22 bp, Homo sapiens
atgtccttccattttgatctgt

SEQ ID NO: 7083318 - DNA, 22 bp, Homo sapiens
atgtccttccattttgatctgt

SEQ ID NO: 7083319 - DNA, 22 bp, Homo sapiens
atgtcctttgttctgagggagt

SEQ ID NO: 7083320 - DNA, 22 bp, Homo sapiens
atgtccttttaaaatgtgagaa

SEQ ID NO: 7083321 - DNA, 22 bp, Homo sapiens
atgtccttttaaaatgtgagaa

SEQ ID NO: 7083322 - DNA, 22 bp, Homo sapiens
atgtccttttatttaaagcagg

SEQ ID NO: 7083323 - DNA, 22 bp, Homo sapiens
atgtcctttgcttctctggtcc

SEQ ID NO: 7083324 - DNA, 22 bp, Homo sapiens
atgtcctttgtatccctaggca

SEQ ID NO: 7083325 - DNA, 22 bp, Homo sapiens
atgtcctttgtatgcttgtact

SEQ ID NO: 7083326 - DNA, 22 bp, Homo sapiens
atgtcctttgtgtgtagctctc

SEQ ID NO: 7083327 - DNA, 22 bp, Homo sapiens
atgtctatatagtcaataatca

SEQ ID NO: 7083328 - DNA, 22 bp, Homo sapiens
atgtctatgttctttactgtgt

SEQ ID NO: 7083329 - DNA, 22 bp, Homo sapiens
atgtctcagagtggtcactggg

SEQ ID NO: 7083330 - DNA, 22 bp, Homo sapiens
atgtctcagagtggtcactggg

SEQ ID NO: 7083331 - DNA, 22 bp, Homo sapiens
atgtctctcaggtttaacttta

SEQ ID NO: 7083332 - DNA, 22 bp, Homo sapiens
atgtctcggctctaaacgatcg

SEQ ID NO: 7083333 - DNA, 22 bp, Homo sapiens
atgtctctctctgagtgccaga

SEQ ID NO: 7083334 - DNA, 22 bp, Homo sapiens
atgtctctgccccagagagctt

SEQ ID NO: 7083335 - DNA, 22 bp, Homo sapiens
atgtctctgccccagagagctt

SEQ ID NO: 7083336 - DNA, 22 bp, Homo sapiens
atgtctctgctgtggttagctt

SEQ ID NO: 7083337 - DNA, 22 bp, Homo sapiens
atgtctctgctgtggttagctt

SEQ ID NO: 7083338 - DNA, 19 bp, Homo sapiens
atgtctctgtagcacatac

SEQ ID NO: 7083339 - DNA, 22 bp, Homo sapiens
gaggtggcccttgctcagcctt

SEQ ID NO: 7083340 - DNA, 22 bp, Homo sapiens
gaggtggcccttgctcagcctt

SEQ ID NO: 7083341 - DNA, 22 bp, Homo sapiens
gaggtggcctcaagcagtcttc

SEQ ID NO: 7083342 - DNA, 22 bp, Homo sapiens
gaggtggcctcaagcagtcttc

SEQ ID NO: 7083343 - DNA, 22 bp, Homo sapiens
gaggtggcctcaagcagtcttc

SEQ ID NO: 7083344 - DNA, 22 bp, Homo sapiens
gaggtggccaagcgaggaaggg

SEQ ID NO: 7083345 - DNA, 22 bp, Homo sapiens
gaggtggccaagcgaggaaggg

SEQ ID NO: 7083346 - DNA, 22 bp, Homo sapiens
gaggtggccaagcgaggaaggg

SEQ ID NO: 7083347 - DNA, 22 bp, Homo sapiens
gaggtggccagagtcaagagcc

SEQ ID NO: 7083348 - DNA, 22 bp, Homo sapiens
gaggtggccagagtcaagagcc

SEQ ID NO: 7083349 - DNA, 22 bp, Homo sapiens
gaggtggccagagtcaagagcc

SEQ ID NO: 7083350 - DNA, 22 bp, Homo sapiens
gaggtggcactgtgaggagcac

SEQ ID NO: 7083351 - DNA, 22 bp, Homo sapiens
gaggtggcactgtgaggagcac

SEQ ID NO: 7083352 - DNA, 22 bp, Homo sapiens
gaggtggcactgtgaggagcac

SEQ ID NO: 7083353 - DNA, 22 bp, Homo sapiens
gaggtggcagaggcctggacct

SEQ ID NO: 7083354 - DNA, 22 bp, Homo sapiens
gaggtggcattaagattctggt

SEQ ID NO: 7083355 - DNA, 22 bp, Homo sapiens
gaggtggcactgtgaggagcac

SEQ ID NO: 7083356 - DNA, 22 bp, Homo sapiens
gaggtggcactgtgaggagcac

SEQ ID NO: 7083357 - DNA, 22 bp, Homo sapiens
gaggtggcaatttaatgcagtc

SEQ ID NO: 7083358 - DNA, 22 bp, Homo sapiens
gaggtggcactgtgaggagcac

SEQ ID NO: 7083359 - DNA, 22 bp, Homo sapiens
gaggtggcgcgccatccctgcc

SEQ ID NO: 7083360 - DNA, 22 bp, Homo sapiens
atgtgtccttataagaagaaga

SEQ ID NO: 7083361 - DNA, 22 bp, Homo sapiens
atgtgtccttataagaagaaga

SEQ ID NO: 7083362 - DNA, 22 bp, Homo sapiens
atgtgtccttgttcccattcca

SEQ ID NO: 7083363 - DNA, 22 bp, Homo sapiens
atgtgtctaattccaggagcac

SEQ ID NO: 7083364 - DNA, 22 bp, Homo sapiens
atgtgtctaattccaggagcac

SEQ ID NO: 7083365 - DNA, 22 bp, Homo sapiens
atgtgtctagattgctgtaccg

SEQ ID NO: 7083366 - DNA, 22 bp, Homo sapiens
atgtgtctagattgctgtaccg

SEQ ID NO: 7083367 - DNA, 17 bp, Homo sapiens
atgtgtctagtgcaacc

SEQ ID NO: 7083368 - DNA, 17 bp, Homo sapiens
atgtgtctagtgcaacc

SEQ ID NO: 7083369 - DNA, 22 bp, Homo sapiens
atgtgtctctaaaatttagtaa

SEQ ID NO: 7083370 - DNA, 22 bp, Homo sapiens
atgtgtctctaaaatttagtaa

SEQ ID NO: 7083371 - DNA, 22 bp, Homo sapiens
atgtgtctctaccaatgcaatt

SEQ ID NO: 7083372 - DNA, 22 bp, Homo sapiens
atgtgtctctaccaatgcaatt

SEQ ID NO: 7083373 - DNA, 22 bp, Homo sapiens
atgtgtctgaccactgtattgg

SEQ ID NO: 7083374 - DNA, 22 bp, Homo sapiens
atgtgtctgaccactgtattgg

SEQ ID NO: 7083375 - DNA, 17 bp, Homo sapiens
atgtgtctgagtgtcct

SEQ ID NO: 7083376 - DNA, 17 bp, Homo sapiens
atgtgtctgagtgtcct

SEQ ID NO: 7083377 - DNA, 17 bp, Homo sapiens
atgtgtctgagtgtcct

SEQ ID NO: 7083378 - DNA, 17 bp, Homo sapiens
atgtgtctgagtgtcct

SEQ ID NO: 7083379 - DNA, 22 bp, Homo sapiens
atgtgtctgatggccctgaatt

SEQ ID NO: 7083380 - DNA, 22 bp, Homo sapiens
atgtgtctgatggccctgaatt

SEQ ID NO: 7083381 - DNA, 20 bp, Homo sapiens
atgtgtctgcctctgtgttc

SEQ ID NO: 7083382 - DNA, 20 bp, Homo sapiens
atgtgtctgcctctgtgttc

SEQ ID NO: 7083383 - DNA, 22 bp, Homo sapiens
atgtgtctggcatggaaagtgt

SEQ ID NO: 7083384 - DNA, 22 bp, Homo sapiens
atgtgtctggcatggaaagtgt

SEQ ID NO: 7083385 - DNA, 22 bp, Homo sapiens
atgtgtcttctgtgggtttgaa

SEQ ID NO: 7083386 - DNA, 22 bp, Homo sapiens
atgtgtcttctgtgggtttgaa

SEQ ID NO: 7083387 - DNA, 22 bp, Homo sapiens
atgttattttggaaaatacaaa

SEQ ID NO: 7083388 - DNA, 22 bp, Homo sapiens
atgttattttggaaaatacaaa

SEQ ID NO: 7083389 - DNA, 22 bp, Homo sapiens
atgttattttggaaaatacaaa

SEQ ID NO: 7083390 - DNA, 22 bp, Homo sapiens
atgtgtctggcatggctctatt

SEQ ID NO: 7083391 - DNA, 22 bp, Homo sapiens
atgtgtctggcatggctctatt

SEQ ID NO: 7083392 - DNA, 22 bp, Homo sapiens
atgtgtctggcatggctctatt

SEQ ID NO: 7083393 - DNA, 22 bp, Homo sapiens
atgtgtctggttattgacatgc

SEQ ID NO: 7083394 - DNA, 22 bp, Homo sapiens
atgtgtctggttattgacatgc

SEQ ID NO: 7083395 - DNA, 20 bp, Homo sapiens
atgtgtctgtaaacaactct

SEQ ID NO: 7083396 - DNA, 20 bp, Homo sapiens
atgtgtctgtaaacaactct

SEQ ID NO: 7083397 - DNA, 20 bp, Homo sapiens
atgtgtctgtaaacaactct

SEQ ID NO: 7083398 - DNA, 22 bp, Homo sapiens
atgtgtctgtgggcacacacac

SEQ ID NO: 7083399 - DNA, 22 bp, Homo sapiens
atgtgtctgtgggcacacacac

SEQ ID NO: 7083400 - DNA, 20 bp, Homo sapiens
atgtgtcttagagcatcagg

SEQ ID NO: 7083401 - DNA, 20 bp, Homo sapiens
atgtgtcttagagcatcagg

SEQ ID NO: 7083402 - DNA, 20 bp, Homo sapiens
atgtgtcttagagcatcagg

SEQ ID NO: 7083403 - DNA, 22 bp, Homo sapiens
atgtgtcttatttgattccaca

SEQ ID NO: 7083404 - DNA, 22 bp, Homo sapiens
atgtgtcttatttgattccaca

SEQ ID NO: 7083405 - DNA, 22 bp, Homo sapiens
atgtgtcttctaagccaagcct

SEQ ID NO: 7083406 - DNA, 22 bp, Homo sapiens
atgtgtcttctaagccaagcct

SEQ ID NO: 7083407 - DNA, 22 bp, Homo sapiens
atgttctttggaatttatgaaa

SEQ ID NO: 7083408 - DNA, 22 bp, Homo sapiens
atgttgaactaggatctcttga

SEQ ID NO: 7083409 - DNA, 22 bp, Homo sapiens
atgttgagagctgagatcagcc

SEQ ID NO: 7083410 - DNA, 22 bp, Homo sapiens
atgttgagtggatgaacaaaca

SEQ ID NO: 7083411 - DNA, 22 bp, Homo sapiens
atgttgatggtgcagacacatt

SEQ ID NO: 7083412 - DNA, 22 bp, Homo sapiens
atgttgatggtgcagacacatt

SEQ ID NO: 7083413 - DNA, 22 bp, Homo sapiens
atgttgcacaaagtccatccat

SEQ ID NO: 7083414 - DNA, 22 bp, Homo sapiens
atgttctttgaaatattttaga

SEQ ID NO: 7083415 - DNA, 22 bp, Homo sapiens
atgttctttcagccagtgcatc

SEQ ID NO: 7083416 - DNA, 22 bp, Homo sapiens
atgttcttgttcaaatgtcagt

SEQ ID NO: 7083417 - DNA, 22 bp, Homo sapiens
atgttctttcagccagtgcatc

SEQ ID NO: 7083418 - DNA, 22 bp, Homo sapiens
atgttcttggatgttgtgtata

SEQ ID NO: 7083419 - DNA, 22 bp, Homo sapiens
atgttcttgttcaaatgtcagt

SEQ ID NO: 7083420 - DNA, 20 bp, Homo sapiens
atgttcttcatttaatgttc

SEQ ID NO: 7083421 - DNA, 22 bp, Homo sapiens
atgttcttccaaatctgtaaca

SEQ ID NO: 7083422 - DNA, 20 bp, Homo sapiens
atgttcttcatttaatgttc

SEQ ID NO: 7083423 - DNA, 22 bp, Homo sapiens
atgttcttagcaaagtacttgc

SEQ ID NO: 7083424 - DNA, 22 bp, Homo sapiens
atgttcttatcattctttcgga

SEQ ID NO: 7083425 - DNA, 22 bp, Homo sapiens
gagttctattatggttagaagt

SEQ ID NO: 7083426 - DNA, 22 bp, Homo sapiens
gagttccttctgcctcagcttg

SEQ ID NO: 7083427 - DNA, 22 bp, Homo sapiens
gataatattagaagatacaaat

SEQ ID NO: 7083428 - DNA, 22 bp, Homo sapiens
gagttcagtgtttctagtagtg

SEQ ID NO: 7083429 - DNA, 22 bp, Homo sapiens
atgtttaatcggctgcctttcc

SEQ ID NO: 7083430 - DNA, 22 bp, Homo sapiens
atgtttaaggaactggtttgct

SEQ ID NO: 7083431 - DNA, 22 bp, Homo sapiens
atgtttaaggaactggtttgct

SEQ ID NO: 7083432 - DNA, 22 bp, Homo sapiens
atgtttaaggaactggtttgct

SEQ ID NO: 7083433 - DNA, 22 bp, Homo sapiens
atgtttaagaaagtcttccata

SEQ ID NO: 7083434 - DNA, 22 bp, Homo sapiens
atgtttaaatttatagacagtg

SEQ ID NO: 7083435 - DNA, 22 bp, Homo sapiens
atgtttaaatttatagacagtg

SEQ ID NO: 7083436 - DNA, 22 bp, Homo sapiens
atgtttaaagggttgagaaata

SEQ ID NO: 7083437 - DNA, 22 bp, Homo sapiens
atgtttaaagggttgagaaata

SEQ ID NO: 7083438 - DNA, 22 bp, Homo sapiens
atgtttaaagggttgagaaata

SEQ ID NO: 7083439 - DNA, 22 bp, Homo sapiens
atgtttaaagggttgagaaata

SEQ ID NO: 7083440 - DNA, 22 bp, Homo sapiens
atgttggagtcgtaaggcatgg

SEQ ID NO: 7083441 - DNA, 22 bp, Homo sapiens
atgttggagtcgtaaggcatgg

SEQ ID NO: 7083442 - DNA, 22 bp, Homo sapiens
atgttggactaggctcttaatt

SEQ ID NO: 7083443 - DNA, 22 bp, Homo sapiens
atgttggactaggctcttaatt

SEQ ID NO: 7083444 - DNA, 22 bp, Homo sapiens
atgttggagtcgtaaggcatgg

SEQ ID NO: 7083445 - DNA, 22 bp, Homo sapiens
atgttgttttttcataaagtat

SEQ ID NO: 7083446 - DNA, 22 bp, Homo sapiens
atgtttaaaggagtcagagact

SEQ ID NO: 7083447 - DNA, 22 bp, Homo sapiens
gatatgaagtggcattgtgaag

SEQ ID NO: 7083448 - DNA, 19 bp, Homo sapiens
gatatgaacgttactggcc

SEQ ID NO: 7083449 - DNA, 22 bp, Homo sapiens
gatatgaagtggcattgtgaag

SEQ ID NO: 7083450 - DNA, 22 bp, Homo sapiens
gatatgaagtggcattgtgaag

SEQ ID NO: 7083451 - DNA, 22 bp, Homo sapiens
gatatcagagacttggctacca

SEQ ID NO: 7083452 - DNA, 22 bp, Homo sapiens
gatatcatgggaaggtgtactt

SEQ ID NO: 7083453 - DNA, 22 bp, Homo sapiens
gatatcattgagcccaggagtt

SEQ ID NO: 7083454 - DNA, 22 bp, Homo sapiens
gatatcatgggaaggtgtactt

SEQ ID NO: 7083455 - DNA, 18 bp, Homo sapiens
gatatggaaggccatgcc

SEQ ID NO: 7083456 - DNA, 18 bp, Homo sapiens
gatatggaaggccatgcc

SEQ ID NO: 7083457 - DNA, 18 bp, Homo sapiens
gatatggaaggccatgcc

SEQ ID NO: 7083458 - DNA, 22 bp, Homo sapiens
gatatgtaccacctcttaaaag

SEQ ID NO: 7083459 - DNA, 22 bp, Homo sapiens
gatatgtatgaggagtatgtat

SEQ ID NO: 7083460 - DNA, 22 bp, Homo sapiens
gatatattttccatggtctgca

SEQ ID NO: 7083461 - DNA, 22 bp, Homo sapiens
gatacaaattcatgtctgaatt

SEQ ID NO: 7083462 - DNA, 22 bp, Homo sapiens
gatacaaattcatgtctgaatt

SEQ ID NO: 7083463 - DNA, 22 bp, Homo sapiens
gatacacaagtggaaggagacg

SEQ ID NO: 7083464 - DNA, 22 bp, Homo sapiens
gataattataggctaagccact

SEQ ID NO: 7083465 - DNA, 22 bp, Homo sapiens
gataattataggctaagccact

SEQ ID NO: 7083466 - DNA, 22 bp, Homo sapiens
gataatttaagtcttgggggct

SEQ ID NO: 7083467 - DNA, 22 bp, Homo sapiens
gataatttaagtcttgggggct

SEQ ID NO: 7083468 - DNA, 22 bp, Homo sapiens
gataatttctccatctcaaggt

SEQ ID NO: 7083469 - DNA, 22 bp, Homo sapiens
gataatttgatacctcaatcag

SEQ ID NO: 7083470 - DNA, 22 bp, Homo sapiens
gataatttctccatctcaaggt

SEQ ID NO: 7083471 - DNA, 22 bp, Homo sapiens
gataatgtgccgataatttcta

SEQ ID NO: 7083472 - DNA, 22 bp, Homo sapiens
gataatgtggatttattgtgat

SEQ ID NO: 7083473 - DNA, 22 bp, Homo sapiens
gataatgtggatttattgtgat

SEQ ID NO: 7083474 - DNA, 22 bp, Homo sapiens
gataatgtgccgataatttcta

SEQ ID NO: 7083475 - DNA, 22 bp, Homo sapiens
gataattttagtctgaaaattg

SEQ ID NO: 7083476 - DNA, 22 bp, Homo sapiens
gataattttagtctgaaaattg

SEQ ID NO: 7083477 - DNA, 22 bp, Homo sapiens
gataatttgatacctcaatcag

SEQ ID NO: 7083478 - DNA, 22 bp, Homo sapiens
gataatttgatacctcaatcag

SEQ ID NO: 7083479 - DNA, 22 bp, Homo sapiens
gataattttagtctgaaaattg

SEQ ID NO: 7083480 - DNA, 22 bp, Homo sapiens
gataattttagtctgaaaattg

SEQ ID NO: 7083481 - DNA, 22 bp, Homo sapiens
gataattttggttccaggttgg

SEQ ID NO: 7083482 - DNA, 22 bp, Homo sapiens
gataattttggttccaggttgg

SEQ ID NO: 7083483 - DNA, 22 bp, Homo sapiens
gataattttggttccaggttgg

SEQ ID NO: 7083484 - DNA, 22 bp, Homo sapiens
gatacaaaatataaatggagag

SEQ ID NO: 7083485 - DNA, 22 bp, Homo sapiens
gatacaaaatataaatggagag

SEQ ID NO: 7083486 - DNA, 22 bp, Homo sapiens
gatacaaattcatgtctgaatt

SEQ ID NO: 7083487 - DNA, 22 bp, Homo sapiens
gatacaaattcatgtctgaatt

SEQ ID NO: 7083488 - DNA, 22 bp, Homo sapiens
gatacaaattcatgtctgaatt

SEQ ID NO: 7083489 - DNA, 22 bp, Homo sapiens
gatacaaaatataaatggagag

SEQ ID NO: 7083490 - DNA, 22 bp, Homo sapiens
gatacaaaatataaatggagag

SEQ ID NO: 7083491 - DNA, 22 bp, Homo sapiens
gatacaaaatataaatggagag

SEQ ID NO: 7083492 - DNA, 21 bp, Homo sapiens
atggccactatggtgcagcag

SEQ ID NO: 7083493 - DNA, 22 bp, Homo sapiens
atggccagagaaggcagggtca

SEQ ID NO: 7083494 - DNA, 22 bp, Homo sapiens
atggccagagaaggcagggtca

SEQ ID NO: 7083495 - DNA, 22 bp, Homo sapiens
atggcatttatgttgacaatgg

SEQ ID NO: 7083496 - DNA, 22 bp, Homo sapiens
atggcattgcaagggcaggagg

SEQ ID NO: 7083497 - DNA, 22 bp, Homo sapiens
gagatggtagcctcagaagagt

SEQ ID NO: 7083498 - DNA, 22 bp, Homo sapiens
gagatggtagcctcagaagagt

SEQ ID NO: 7083499 - DNA, 22 bp, Homo sapiens
atggcattatagcaatggtttg

SEQ ID NO: 7083500 - DNA, 17 bp, Homo sapiens
gagatgggtggatcacc

SEQ ID NO: 7083501 - DNA, 22 bp, Homo sapiens
gagatggggtcttgctatgttg

SEQ ID NO: 7083502 - DNA, 17 bp, Homo sapiens
gagatgggtggatcacc

SEQ ID NO: 7083503 - DNA, 17 bp, Homo sapiens
gagatgggtggatcacc

SEQ ID NO: 7083504 - DNA, 17 bp, Homo sapiens
gagatgggtggatcacc

SEQ ID NO: 7083505 - DNA, 22 bp, Homo sapiens
gagatgggcgagaaggtggact

SEQ ID NO: 7083506 - DNA, 22 bp, Homo sapiens
gagatggggaataggagcaagc

SEQ ID NO: 7083507 - DNA, 22 bp, Homo sapiens
gagatggggaataggagcaagc

SEQ ID NO: 7083508 - DNA, 22 bp, Homo sapiens
gagatggggaataggagcaagc

SEQ ID NO: 7083509 - DNA, 22 bp, Homo sapiens
gagatggggaataggagcaagc

SEQ ID NO: 7083510 - DNA, 22 bp, Homo sapiens
gagatggggaataggagcaagc

SEQ ID NO: 7083511 - DNA, 22 bp, Homo sapiens
gagatggggtcagctgggacat

SEQ ID NO: 7083512 - DNA, 22 bp, Homo sapiens
gagatggggtcagctgggacat

SEQ ID NO: 7083513 - DNA, 22 bp, Homo sapiens
gagatggggtcagctgggacat

SEQ ID NO: 7083514 - DNA, 22 bp, Homo sapiens
gagatggggtcagctgggacat

SEQ ID NO: 7083515 - DNA, 22 bp, Homo sapiens
gagatggggtcttgctatgttg

SEQ ID NO: 7083516 - DNA, 22 bp, Homo sapiens
atggcttgtccaagcggcagac

SEQ ID NO: 7083517 - DNA, 22 bp, Homo sapiens
atggctttcagatggtgaaaga

SEQ ID NO: 7083518 - DNA, 22 bp, Homo sapiens
atggctttcagatggtgaaaga

SEQ ID NO: 7083519 - DNA, 22 bp, Homo sapiens
atggctttcagatttctatgtt

SEQ ID NO: 7083520 - DNA, 22 bp, Homo sapiens
atggctttccggactttggcca

SEQ ID NO: 7083521 - DNA, 22 bp, Homo sapiens
atggctttccggactttggcca

SEQ ID NO: 7083522 - DNA, 22 bp, Homo sapiens
atggcttctgtcttggaaactt

SEQ ID NO: 7083523 - DNA, 22 bp, Homo sapiens
atggcttctgtcttggaaattt

SEQ ID NO: 7083524 - DNA, 22 bp, Homo sapiens
atggctttctgtgtttccgtag

SEQ ID NO: 7083525 - DNA, 22 bp, Homo sapiens
atggctttgactgtaagtggta

SEQ ID NO: 7083526 - DNA, 22 bp, Homo sapiens
atggcttttaactttgatggca

SEQ ID NO: 7083527 - DNA, 22 bp, Homo sapiens
atgggaaagaagccactgccca

SEQ ID NO: 7083528 - DNA, 22 bp, Homo sapiens
atggcttaagaatgcttttgtg

SEQ ID NO: 7083529 - DNA, 22 bp, Homo sapiens
atggcttaagaatgcttttgtg

SEQ ID NO: 7083530 - DNA, 22 bp, Homo sapiens
atggcttccaaggccctccgtg

SEQ ID NO: 7083531 - DNA, 22 bp, Homo sapiens
atggcttccaaggccctccgtg

SEQ ID NO: 7083532 - DNA, 22 bp, Homo sapiens
atggcttcgagtatatacatag

SEQ ID NO: 7083533 - DNA, 21 bp, Homo sapiens
atggcttctcaggtgcactga

SEQ ID NO: 7083534 - DNA, 22 bp, Homo sapiens
atggcttctcgctggcacctgt

SEQ ID NO: 7083535 - DNA, 22 bp, Homo sapiens
atggctggcatccaggtgggct

SEQ ID NO: 7083536 - DNA, 21 bp, Homo sapiens
atggccagatctattaggtgg

SEQ ID NO: 7083537 - DNA, 22 bp, Homo sapiens
atggccagagagagcacacctg

SEQ ID NO: 7083538 - DNA, 22 bp, Homo sapiens
atggccagagaggccagcctgg

SEQ ID NO: 7083539 - DNA, 22 bp, Homo sapiens
atggccagagaggccagcctgg

SEQ ID NO: 7083540 - DNA, 22 bp, Homo sapiens
atggctggcatgtgcataacgg

SEQ ID NO: 7083541 - DNA, 22 bp, Homo sapiens
atggctgttggcaggaggcctc

SEQ ID NO: 7083542 - DNA, 22 bp, Homo sapiens
atggctgtttagcttctctgct

SEQ ID NO: 7083543 - DNA, 22 bp, Homo sapiens
atggctgtttagcttctctgct

SEQ ID NO: 7083544 - DNA, 22 bp, Homo sapiens
atggctgtttagcttctctgct

SEQ ID NO: 7083545 - DNA, 22 bp, Homo sapiens
atggctgttttgtgacttctca

SEQ ID NO: 7083546 - DNA, 22 bp, Homo sapiens
atggctgttttgtgacttctca

SEQ ID NO: 7083547 - DNA, 22 bp, Homo sapiens
gagagaggcctccatgtactga

SEQ ID NO: 7083548 - DNA, 22 bp, Homo sapiens
gagagaggcctccatgtactga

SEQ ID NO: 7083549 - DNA, 22 bp, Homo sapiens
gagagaggcctccatgtactga

SEQ ID NO: 7083550 - DNA, 22 bp, Homo sapiens
gagagaggcctccatgtactga

SEQ ID NO: 7083551 - DNA, 22 bp, Homo sapiens
gagagaggcctccatgtactga

SEQ ID NO: 7083552 - DNA, 22 bp, Homo sapiens
gagagataggttgcaggaagct

SEQ ID NO: 7083553 - DNA, 22 bp, Homo sapiens
gagagagaggtgctgccaggca

SEQ ID NO: 7083554 - DNA, 23 bp, Homo sapiens
gagagagattgctaaaccactcc

SEQ ID NO: 7083555 - DNA, 22 bp, Homo sapiens
gagagagctctgtgcctgggat

SEQ ID NO: 7083556 - DNA, 22 bp, Homo sapiens
gagagagctctgtgcctgggat

SEQ ID NO: 7083557 - DNA, 22 bp, Homo sapiens
gagagagctctgtgcctgggat

SEQ ID NO: 7083558 - DNA, 22 bp, Homo sapiens
gagagataggttgcaggaagct

SEQ ID NO: 7083559 - DNA, 22 bp, Homo sapiens
gagagatccagactgtgggtga

SEQ ID NO: 7083560 - DNA, 23 bp, Homo sapiens
gagagcaatgagatgtaaacact

SEQ ID NO: 7083561 - DNA, 23 bp, Homo sapiens
gagagcaatgagatgtaaacact

SEQ ID NO: 7083562 - DNA, 22 bp, Homo sapiens
gagagcaatggggacgggcagg

SEQ ID NO: 7083563 - DNA, 22 bp, Homo sapiens
gagagcaatggggacgggcagg

SEQ ID NO: 7083564 - DNA, 22 bp, Homo sapiens
gagagcaatggggacgggcagg

SEQ ID NO: 7083565 - DNA, 22 bp, Homo sapiens
gagagcacatgaacatggagga

SEQ ID NO: 7083566 - DNA, 22 bp, Homo sapiens
gagagcacatgaacatggagga

SEQ ID NO: 7083567 - DNA, 22 bp, Homo sapiens
gagagcacggtcttgggcatgg

SEQ ID NO: 7083568 - DNA, 22 bp, Homo sapiens
gagagcagactctcaaagctgg

SEQ ID NO: 7083569 - DNA, 22 bp, Homo sapiens
gagagcagactctcaaagctgg

SEQ ID NO: 7083570 - DNA, 22 bp, Homo sapiens
gagagcagactctcaaagctgg

SEQ ID NO: 7083571 - DNA, 22 bp, Homo sapiens
gactgggctccaagagggagag

SEQ ID NO: 7083572 - DNA, 22 bp, Homo sapiens
gactggggaaggacccgagacc

SEQ ID NO: 7083573 - DNA, 22 bp, Homo sapiens
gactggggctctagccaggcct

SEQ ID NO: 7083574 - DNA, 22 bp, Homo sapiens
gagacagtgtcagccattgaaa

SEQ ID NO: 7083575 - DNA, 22 bp, Homo sapiens
gagacagtgctccgtgggtcca

SEQ ID NO: 7083576 - DNA, 22 bp, Homo sapiens
gagacagtgtccatccaggggc

SEQ ID NO: 7083577 - DNA, 22 bp, Homo sapiens
gagagagaagtgggtgtcacct

SEQ ID NO: 7083578 - DNA, 22 bp, Homo sapiens
gagagagaagtgggtgtcacct

SEQ ID NO: 7083579 - DNA, 22 bp, Homo sapiens
gagagagacatgtaaacgcggt

SEQ ID NO: 7083580 - DNA, 22 bp, Homo sapiens
gagagagacatgtaaacgcggt

SEQ ID NO: 7083581 - DNA, 22 bp, Homo sapiens
gagagagagctaatattaagct

SEQ ID NO: 7083582 - DNA, 22 bp, Homo sapiens
gagagagaggtgctgccaggca

SEQ ID NO: 7083583 - DNA, 22 bp, Homo sapiens
gagagagaggtgctgccaggca

SEQ ID NO: 7083584 - DNA, 22 bp, Homo sapiens
gagagagaggtgctgccaggca

SEQ ID NO: 7083585 - DNA, 22 bp, Homo sapiens
gagagagaggtgctgccaggca

SEQ ID NO: 7083586 - DNA, 22 bp, Homo sapiens
gagagagaggtgctgccaggca

SEQ ID NO: 7083587 - DNA, 17 bp, Homo sapiens
atggaggcagacaggtc

SEQ ID NO: 7083588 - DNA, 17 bp, Homo sapiens
atggaggcagacaggtc

SEQ ID NO: 7083589 - DNA, 22 bp, Homo sapiens
atggaggatgtgcagcatgggc

SEQ ID NO: 7083590 - DNA, 17 bp, Homo sapiens
atggaggcagacaggtc

SEQ ID NO: 7083591 - DNA, 18 bp, Homo sapiens
atggaggcagagagctga

SEQ ID NO: 7083592 - DNA, 22 bp, Homo sapiens
atggagggaaaagtggagagcc

SEQ ID NO: 7083593 - DNA, 22 bp, Homo sapiens
atggagggaaaagtggagagcc

SEQ ID NO: 7083594 - DNA, 22 bp, Homo sapiens
atggagggaaaagtggagagcc

SEQ ID NO: 7083595 - DNA, 22 bp, Homo sapiens
atggagggaaaagtggagagcc

SEQ ID NO: 7083596 - DNA, 22 bp, Homo sapiens
atggagggaaaagtggagagcc

SEQ ID NO: 7083597 - DNA, 21 bp, Homo sapiens
atggagggaccagggaagcag

SEQ ID NO: 7083598 - DNA, 21 bp, Homo sapiens
atggagggaccagggaagcag

SEQ ID NO: 7083599 - DNA, 22 bp, Homo sapiens
atggagggtggtaagacagaga

SEQ ID NO: 7083600 - DNA, 22 bp, Homo sapiens
atggagggtggtaagacagaga

SEQ ID NO: 7083601 - DNA, 22 bp, Homo sapiens
atggagggtggtaagacagaga

SEQ ID NO: 7083602 - DNA, 22 bp, Homo sapiens
atggagggaaaagtggagagcc

SEQ ID NO: 7083603 - DNA, 22 bp, Homo sapiens
atggagggaaaagtggagagcc

SEQ ID NO: 7083604 - DNA, 22 bp, Homo sapiens
atggagggaaaagtggagagcc

SEQ ID NO: 7083605 - DNA, 22 bp, Homo sapiens
atggagggaaaagtggagagcc

SEQ ID NO: 7083606 - DNA, 21 bp, Homo sapiens
atggagggaccagggaagcag

SEQ ID NO: 7083607 - DNA, 21 bp, Homo sapiens
atggagggaccagggaagcag

SEQ ID NO: 7083608 - DNA, 21 bp, Homo sapiens
atggagggaccagggaagcag

SEQ ID NO: 7083609 - DNA, 22 bp, Homo sapiens
atggagggtggtaagacagaga

SEQ ID NO: 7083610 - DNA, 22 bp, Homo sapiens
atggagggtgtcagagagcgaa

SEQ ID NO: 7083611 - DNA, 22 bp, Homo sapiens
atggagggtgtcagagagcgaa

SEQ ID NO: 7083612 - DNA, 22 bp, Homo sapiens
gagagtcactgtctgcatttcc

SEQ ID NO: 7083613 - DNA, 22 bp, Homo sapiens
gagagtccaggtctgggtcctt

SEQ ID NO: 7083614 - DNA, 22 bp, Homo sapiens
gagatggccagtgccaggacaa

SEQ ID NO: 7083615 - DNA, 21 bp, Homo sapiens
gagatggcccagtagcgggcc

SEQ ID NO: 7083616 - DNA, 21 bp, Homo sapiens
gagatggcccagtagcgggcc

SEQ ID NO: 7083617 - DNA, 22 bp, Homo sapiens
gagatggccctggcatgtagct

SEQ ID NO: 7083618 - DNA, 23 bp, Homo sapiens
gagatggctggttgtcctctgaa

SEQ ID NO: 7083619 - DNA, 22 bp, Homo sapiens
gagatggcttgctctcacgtgg

SEQ ID NO: 7083620 - DNA, 22 bp, Homo sapiens
gagatgggcgagaaggtggact

SEQ ID NO: 7083621 - DNA, 22 bp, Homo sapiens
gagatgggcgagaaggtggact

SEQ ID NO: 7083622 - DNA, 22 bp, Homo sapiens
gagatgggcgagaaggtggact

SEQ ID NO: 7083623 - DNA, 22 bp, Homo sapiens
gagatgggcgagaaggtggact

SEQ ID NO: 7083624 - DNA, 22 bp, Homo sapiens
gagatgggcgagaaggtggact

SEQ ID NO: 7083625 - DNA, 22 bp, Homo sapiens
atggtgaagcttcatgggtgtt

SEQ ID NO: 7083626 - DNA, 22 bp, Homo sapiens
atggtgccaaagatttctaagc

SEQ ID NO: 7083627 - DNA, 18 bp, Homo sapiens
atggtctcatactgggag

SEQ ID NO: 7083628 - DNA, 22 bp, Homo sapiens
atggtcttgggcttaggcagag

SEQ ID NO: 7083629 - DNA, 22 bp, Homo sapiens
gaggagaatgcgcaccacatat

SEQ ID NO: 7083630 - DNA, 22 bp, Homo sapiens
gaggagaatgcgcaccacatat

SEQ ID NO: 7083631 - DNA, 18 bp, Homo sapiens
atggtctcatactgggag

SEQ ID NO: 7083632 - DNA, 18 bp, Homo sapiens
atggtctcatactgggag

SEQ ID NO: 7083633 - DNA, 18 bp, Homo sapiens
atggtctcatactgggag

SEQ ID NO: 7083634 - DNA, 18 bp, Homo sapiens
atggtctcatactgggag

SEQ ID NO: 7083635 - DNA, 22 bp, Homo sapiens
gaggagaagctattggaaggac

SEQ ID NO: 7083636 - DNA, 22 bp, Homo sapiens
gaggagaagggcacggagaaaa

SEQ ID NO: 7083637 - DNA, 22 bp, Homo sapiens
gaggagaagggcacggagaaaa

SEQ ID NO: 7083638 - DNA, 22 bp, Homo sapiens
gaggagaagggcacggagaaaa

SEQ ID NO: 7083639 - DNA, 22 bp, Homo sapiens
gaggagaagctattggaaggac

SEQ ID NO: 7083640 - DNA, 22 bp, Homo sapiens
gaggagaagctaagaaacacag

SEQ ID NO: 7083641 - DNA, 22 bp, Homo sapiens
gaggagaagctaagaaacacag

SEQ ID NO: 7083642 - DNA, 22 bp, Homo sapiens
gaggagaagctattggaaggac

SEQ ID NO: 7083643 - DNA, 22 bp, Homo sapiens
gaggagaagctattggaaggac

SEQ ID NO: 7083644 - DNA, 22 bp, Homo sapiens
gaggagaagctaagaaacacag

SEQ ID NO: 7083645 - DNA, 22 bp, Homo sapiens
gaggagaaatttggggacctga

SEQ ID NO: 7083646 - DNA, 22 bp, Homo sapiens
gaggagaaatttggggacctga

SEQ ID NO: 7083647 - DNA, 22 bp, Homo sapiens
gaggaagggactttattatctg

SEQ ID NO: 7083648 - DNA, 22 bp, Homo sapiens
gaggagaaattatccttggtgt

SEQ ID NO: 7083649 - DNA, 22 bp, Homo sapiens
gaggcagcctcagtggacctcg

SEQ ID NO: 7083650 - DNA, 22 bp, Homo sapiens
gaggcagcctcagtggacctcg

SEQ ID NO: 7083651 - DNA, 22 bp, Homo sapiens
gaggcagcggctcacagagaaa

SEQ ID NO: 7083652 - DNA, 22 bp, Homo sapiens
gaggcagcctcagtggacctcg

SEQ ID NO: 7083653 - DNA, 22 bp, Homo sapiens
gaggcagcctcagtggacctcg

SEQ ID NO: 7083654 - DNA, 22 bp, Homo sapiens
gaggcagccagaggttctcatt

SEQ ID NO: 7083655 - DNA, 22 bp, Homo sapiens
gaggcagcattcgcatagacag

SEQ ID NO: 7083656 - DNA, 22 bp, Homo sapiens
gaggcagcattcgcatagacag

SEQ ID NO: 7083657 - DNA, 22 bp, Homo sapiens
gaggcagcatggtaccttggag

SEQ ID NO: 7083658 - DNA, 22 bp, Homo sapiens
gaggcagcatggtaccttggag

SEQ ID NO: 7083659 - DNA, 22 bp, Homo sapiens
gaggcagcatggtaccttggag

SEQ ID NO: 7083660 - DNA, 22 bp, Homo sapiens
gaggcagcatctatggtgggaa

SEQ ID NO: 7083661 - DNA, 22 bp, Homo sapiens
gaggcagcatggtaccttggag

SEQ ID NO: 7083662 - DNA, 22 bp, Homo sapiens
gaggcagcatctatggtgggaa

SEQ ID NO: 7083663 - DNA, 22 bp, Homo sapiens
gaggcagcatctatggtgggaa

SEQ ID NO: 7083664 - DNA, 22 bp, Homo sapiens
gaggcagcatctatggtgggaa

SEQ ID NO: 7083665 - DNA, 22 bp, Homo sapiens
gaggcacatcacttggtgcatt

SEQ ID NO: 7083666 - DNA, 22 bp, Homo sapiens
gaggcacatatatacagagccc

SEQ ID NO: 7083667 - DNA, 22 bp, Homo sapiens
gaggcacatatatacagagccc

SEQ ID NO: 7083668 - DNA, 22 bp, Homo sapiens
gaggcacatatatacagagccc

SEQ ID NO: 7083669 - DNA, 22 bp, Homo sapiens
atggttaaattggttatttatg

SEQ ID NO: 7083670 - DNA, 22 bp, Homo sapiens
atggttatgcaaacatgatgca

SEQ ID NO: 7083671 - DNA, 22 bp, Homo sapiens
atggtggtgaagagcacagtga

SEQ ID NO: 7083672 - DNA, 22 bp, Homo sapiens
atggtgttgagtctctcttcac

SEQ ID NO: 7083673 - DNA, 22 bp, Homo sapiens
atggtgttgagtctctcttcac

SEQ ID NO: 7083674 - DNA, 22 bp, Homo sapiens
atggggagagaagggctgagct

SEQ ID NO: 7083675 - DNA, 22 bp, Homo sapiens
atggggagagaagggctgagct

SEQ ID NO: 7083676 - DNA, 22 bp, Homo sapiens
atggggagagaagggctgagct

SEQ ID NO: 7083677 - DNA, 22 bp, Homo sapiens
atggggaagagccagtgagctg

SEQ ID NO: 7083678 - DNA, 22 bp, Homo sapiens
atggggaagcaattggatttcc

SEQ ID NO: 7083679 - DNA, 22 bp, Homo sapiens
atggggagagaagggctgagct

SEQ ID NO: 7083680 - DNA, 22 bp, Homo sapiens
atggggagagaagggctgagct

SEQ ID NO: 7083681 - DNA, 22 bp, Homo sapiens
atggggaagagccagtgagctg

SEQ ID NO: 7083682 - DNA, 22 bp, Homo sapiens
atgggctgtgggaccctggacc

SEQ ID NO: 7083683 - DNA, 22 bp, Homo sapiens
atgggctgtgggaccctggacc

SEQ ID NO: 7083684 - DNA, 22 bp, Homo sapiens
atgggcttgaccctacagaaag

SEQ ID NO: 7083685 - DNA, 22 bp, Homo sapiens
atggggagagaagggctgagct

SEQ ID NO: 7083686 - DNA, 22 bp, Homo sapiens
atggggagagaagggctgagct

SEQ ID NO: 7083687 - DNA, 22 bp, Homo sapiens
atggggagagcctctgtcccca

SEQ ID NO: 7083688 - DNA, 22 bp, Homo sapiens
atggggagagcctctgtcccca

SEQ ID NO: 7083689 - DNA, 22 bp, Homo sapiens
atggggagagcctctgtcccca

SEQ ID NO: 7083690 - DNA, 22 bp, Homo sapiens
atggggagctcaccacctgttt

SEQ ID NO: 7083691 - DNA, 22 bp, Homo sapiens
atggggagctcaccacctgttt

SEQ ID NO: 7083692 - DNA, 22 bp, Homo sapiens
atggggagctcaccacctgttt

SEQ ID NO: 7083693 - DNA, 22 bp, Homo sapiens
atggggagctcaccacctgttt

SEQ ID NO: 7083694 - DNA, 22 bp, Homo sapiens
atggggctagacaaccagtgcc

SEQ ID NO: 7083695 - DNA, 22 bp, Homo sapiens
atggggctagacaaccagtgcc

SEQ ID NO: 7083696 - DNA, 23 bp, Homo sapiens
atggggctcaacacttagtagct

SEQ ID NO: 7083697 - DNA, 22 bp, Homo sapiens
atgggctgtccattgctggctg

SEQ ID NO: 7083698 - DNA, 20 bp, Homo sapiens
atgggctggttaggaagtgt

SEQ ID NO: 7083699 - DNA, 20 bp, Homo sapiens
atgggctggttaggaagtgt

SEQ ID NO: 7083700 - DNA, 20 bp, Homo sapiens
atgggctggttaggaagtgt

SEQ ID NO: 7083701 - DNA, 22 bp, Homo sapiens
atgggctggggaagctcactcc

SEQ ID NO: 7083702 - DNA, 22 bp, Homo sapiens
atgggctggggaagctcactcc

SEQ ID NO: 7083703 - DNA, 22 bp, Homo sapiens
atgggctgtcctagtccagccc

SEQ ID NO: 7083704 - DNA, 22 bp, Homo sapiens
atgggctgtcctagtccagccc

SEQ ID NO: 7083705 - DNA, 22 bp, Homo sapiens
atgggctgtgaggtccggcagg

SEQ ID NO: 7083706 - DNA, 22 bp, Homo sapiens
atgggctggggaagctcactcc

SEQ ID NO: 7083707 - DNA, 22 bp, Homo sapiens
atgggctgggatctgagtgtca

SEQ ID NO: 7083708 - DNA, 22 bp, Homo sapiens
atgggctgggatctgagtgtca

SEQ ID NO: 7083709 - DNA, 22 bp, Homo sapiens
atgggctgggaatacacagggg

SEQ ID NO: 7083710 - DNA, 22 bp, Homo sapiens
atgggctgggaatacacagggg

SEQ ID NO: 7083711 - DNA, 22 bp, Homo sapiens
atgggctgggatctgagtgtca

SEQ ID NO: 7083712 - DNA, 22 bp, Homo sapiens
atgggctggcctttcccgctct

SEQ ID NO: 7083713 - DNA, 22 bp, Homo sapiens
atgggctgcttggcttccaccc

SEQ ID NO: 7083714 - DNA, 22 bp, Homo sapiens
atgggctggcagcctgaacagc

SEQ ID NO: 7083715 - DNA, 22 bp, Homo sapiens
atgggctggcagcctgaacagc

SEQ ID NO: 7083716 - DNA, 22 bp, Homo sapiens
atgggctggcctttcccgctct

SEQ ID NO: 7083717 - DNA, 22 bp, Homo sapiens
atgggctgcttctccagcacct

SEQ ID NO: 7083718 - DNA, 22 bp, Homo sapiens
atgggctgcttggcttccaccc

SEQ ID NO: 7083719 - DNA, 22 bp, Homo sapiens
atgggacatagatccttgaggt

SEQ ID NO: 7083720 - DNA, 22 bp, Homo sapiens
atgggacagggctggctggtcc

SEQ ID NO: 7083721 - DNA, 22 bp, Homo sapiens
atgggacaggtactagaaaggg

SEQ ID NO: 7083722 - DNA, 22 bp, Homo sapiens
atgggaatataattttagcaac

SEQ ID NO: 7083723 - DNA, 22 bp, Homo sapiens
atgggacacagtccgccctcta

SEQ ID NO: 7083724 - DNA, 22 bp, Homo sapiens
atgggacaatttgaacacagtg

SEQ ID NO: 7083725 - DNA, 22 bp, Homo sapiens
atgggaagtgttagaagatttt

SEQ ID NO: 7083726 - DNA, 22 bp, Homo sapiens
atgggaaggttttgagagcggg

SEQ ID NO: 7083727 - DNA, 22 bp, Homo sapiens
atgggaaggttttgagagcggg

SEQ ID NO: 7083728 - DNA, 22 bp, Homo sapiens
atgggaagtgaagtcagggagg

SEQ ID NO: 7083729 - DNA, 22 bp, Homo sapiens
atgggaaagaagccactgccca

SEQ ID NO: 7083730 - DNA, 19 bp, Homo sapiens
atgggaagcggccagcgga

SEQ ID NO: 7083731 - DNA, 22 bp, Homo sapiens
atgggaaagaagccactgccca

SEQ ID NO: 7083732 - DNA, 19 bp, Homo sapiens
atgggaagcggccagcgga

SEQ ID NO: 7083733 - DNA, 22 bp, Homo sapiens
atgggaagctgacctgcatgga

SEQ ID NO: 7083734 - DNA, 22 bp, Homo sapiens
atgggaaggttttgagagcggg

SEQ ID NO: 7083735 - DNA, 22 bp, Homo sapiens
atgggagaaacatcatgaggca

SEQ ID NO: 7083736 - DNA, 22 bp, Homo sapiens
atgggagaaacatcatgaggca

SEQ ID NO: 7083737 - DNA, 22 bp, Homo sapiens
atgggagaaacatcatgaggca

SEQ ID NO: 7083738 - DNA, 22 bp, Homo sapiens
atgggcaggcctctcatttctg

SEQ ID NO: 7083739 - DNA, 22 bp, Homo sapiens
atgggcagggcagtgtataaga

SEQ ID NO: 7083740 - DNA, 22 bp, Homo sapiens
atgggcagggcagtgtataaga

SEQ ID NO: 7083741 - DNA, 22 bp, Homo sapiens
atgggctgaaagagtaagctgt

SEQ ID NO: 7083742 - DNA, 22 bp, Homo sapiens
atgggctgaaagagtaagctgt

SEQ ID NO: 7083743 - DNA, 22 bp, Homo sapiens
atgggctgacaagacatgcata

SEQ ID NO: 7083744 - DNA, 22 bp, Homo sapiens
atgggctgacaagacatgcata

SEQ ID NO: 7083745 - DNA, 22 bp, Homo sapiens
atgggcagtaacagtggcagtc

SEQ ID NO: 7083746 - DNA, 22 bp, Homo sapiens
atgggcagggcagtgtataaga

SEQ ID NO: 7083747 - DNA, 18 bp, Homo sapiens
atgggcaggtaagatcca

SEQ ID NO: 7083748 - DNA, 22 bp, Homo sapiens
atgggctgacccagtcgtggca

SEQ ID NO: 7083749 - DNA, 22 bp, Homo sapiens
atgggctgactaatggtaaact

SEQ ID NO: 7083750 - DNA, 22 bp, Homo sapiens
atgggctgacccagtcgtggca

SEQ ID NO: 7083751 - DNA, 22 bp, Homo sapiens
atgggctgacccagtcgtggca

SEQ ID NO: 7083752 - DNA, 22 bp, Homo sapiens
atgggctgaggtgggatagaag

SEQ ID NO: 7083753 - DNA, 22 bp, Homo sapiens
atgggctgaggtgggatagaag

SEQ ID NO: 7083754 - DNA, 22 bp, Homo sapiens
atgggctgcttctccagcacct

SEQ ID NO: 7083755 - DNA, 22 bp, Homo sapiens
atgggctgcttctccagcacct

SEQ ID NO: 7083756 - DNA, 22 bp, Homo sapiens
atgggctgagaatcaagaatat

SEQ ID NO: 7083757 - DNA, 22 bp, Homo sapiens
atgggctgaggaagctcctgag

SEQ ID NO: 7083758 - DNA, 22 bp, Homo sapiens
atgggctgaggaagctcctgag

SEQ ID NO: 7083759 - DNA, 22 bp, Homo sapiens
atgggctgaggaagctcctgag

SEQ ID NO: 7083760 - DNA, 22 bp, Homo sapiens
atcaaagagcttgacaatccta

SEQ ID NO: 7083761 - DNA, 19 bp, Homo sapiens
atcaaagactgcaggattt

SEQ ID NO: 7083762 - DNA, 19 bp, Homo sapiens
atcaaagactgcaggattt

SEQ ID NO: 7083763 - DNA, 22 bp, Homo sapiens
atcaaagaatgtgactgaaata

SEQ ID NO: 7083764 - DNA, 22 bp, Homo sapiens
atcaaagaatgtgactgaaata

SEQ ID NO: 7083765 - DNA, 22 bp, Homo sapiens
atcaaaatggaagaatttggct

SEQ ID NO: 7083766 - DNA, 22 bp, Homo sapiens
atcaaaatggaagaatttggct

SEQ ID NO: 7083767 - DNA, 22 bp, Homo sapiens
atatttaactggtcccaatata

SEQ ID NO: 7083768 - DNA, 22 bp, Homo sapiens
atatttaactggtcccaatata

SEQ ID NO: 7083769 - DNA, 22 bp, Homo sapiens
atatttaactggtcccaatata

SEQ ID NO: 7083770 - DNA, 22 bp, Homo sapiens
atatttactgctgtggtgaagg

SEQ ID NO: 7083771 - DNA, 22 bp, Homo sapiens
atatttactgctgtggtgaagg

SEQ ID NO: 7083772 - DNA, 22 bp, Homo sapiens
atatttactgctgtggtgaagg

SEQ ID NO: 7083773 - DNA, 22 bp, Homo sapiens
atatttactgctgtggtgaagg

SEQ ID NO: 7083774 - DNA, 22 bp, Homo sapiens
atattttggggtgatgtgcatc

SEQ ID NO: 7083775 - DNA, 22 bp, Homo sapiens
atcaaagatgtttcagggtgta

SEQ ID NO: 7083776 - DNA, 22 bp, Homo sapiens
atcaaagagcttgacaatccta

SEQ ID NO: 7083777 - DNA, 23 bp, Homo sapiens
atcaaaggatgtagagaagaagc

SEQ ID NO: 7083778 - DNA, 22 bp, Homo sapiens
atcaaaggtatctatgctgtct

SEQ ID NO: 7083779 - DNA, 22 bp, Homo sapiens
atcaaagtatctcaatatggta

SEQ ID NO: 7083780 - DNA, 22 bp, Homo sapiens
atcaaagttcgtaactgataac

SEQ ID NO: 7083781 - DNA, 22 bp, Homo sapiens
atcaaagtggaagtttactagg

SEQ ID NO: 7083782 - DNA, 23 bp, Homo sapiens
atcaaagtggaaatcaattatct

SEQ ID NO: 7083783 - DNA, 22 bp, Homo sapiens
atcaaagtggaagtttactagg

SEQ ID NO: 7083784 - DNA, 22 bp, Homo sapiens
atcaaagtccatcagaaggtag

SEQ ID NO: 7083785 - DNA, 22 bp, Homo sapiens
atcaaagtccatcagaaggtag

SEQ ID NO: 7083786 - DNA, 22 bp, Homo sapiens
atcaaagtgatttgtaaacagg

SEQ ID NO: 7083787 - DNA, 22 bp, Homo sapiens
atattgtactagggttacatgt

SEQ ID NO: 7083788 - DNA, 22 bp, Homo sapiens
atattgtactagggttacatgt

SEQ ID NO: 7083789 - DNA, 22 bp, Homo sapiens
atattgtactagggttacatgt

SEQ ID NO: 7083790 - DNA, 22 bp, Homo sapiens
atattgggattttaggttaaag

SEQ ID NO: 7083791 - DNA, 22 bp, Homo sapiens
atattgggcagggaagccagtg

SEQ ID NO: 7083792 - DNA, 22 bp, Homo sapiens
atattggggataattgtgctgc

SEQ ID NO: 7083793 - DNA, 22 bp, Homo sapiens
atattggtaaagtggattaaca

SEQ ID NO: 7083794 - DNA, 21 bp, Homo sapiens
atattggtatctttttaaatc

SEQ ID NO: 7083795 - DNA, 22 bp, Homo sapiens
atattgggtgtgggcatcaggg

SEQ ID NO: 7083796 - DNA, 22 bp, Homo sapiens
atattggtgaaatgctagcaaa

SEQ ID NO: 7083797 - DNA, 22 bp, Homo sapiens
atattggtgattagccaatgct

SEQ ID NO: 7083798 - DNA, 22 bp, Homo sapiens
atatttaaacagggtaccaata

SEQ ID NO: 7083799 - DNA, 22 bp, Homo sapiens
atatttaaacagggtaccaata

SEQ ID NO: 7083800 - DNA, 22 bp, Homo sapiens
atatttaaacagggtaccaata

SEQ ID NO: 7083801 - DNA, 22 bp, Homo sapiens
atattgttagtaatatttcgaa

SEQ ID NO: 7083802 - DNA, 22 bp, Homo sapiens
atattgttgactataagagtaa

SEQ ID NO: 7083803 - DNA, 22 bp, Homo sapiens
atattcttgtgattataaagta

SEQ ID NO: 7083804 - DNA, 22 bp, Homo sapiens
atattgagataagaactgacat

SEQ ID NO: 7083805 - DNA, 22 bp, Homo sapiens
atattgagataagaactgacat

SEQ ID NO: 7083806 - DNA, 22 bp, Homo sapiens
atattgagatgaggatattaac

SEQ ID NO: 7083807 - DNA, 22 bp, Homo sapiens
atattgagatgaggatattaac

SEQ ID NO: 7083808 - DNA, 22 bp, Homo sapiens
atattcttgtgattataaagta

SEQ ID NO: 7083809 - DNA, 22 bp, Homo sapiens
atattcttgtgattataaagta

SEQ ID NO: 7083810 - DNA, 22 bp, Homo sapiens
atattcttgtgattataaagta

SEQ ID NO: 7083811 - DNA, 22 bp, Homo sapiens
atattcttgtgattataaagta

SEQ ID NO: 7083812 - DNA, 22 bp, Homo sapiens
atattcttgtgattataaagta

SEQ ID NO: 7083813 - DNA, 22 bp, Homo sapiens
atattcttgtgattataaagta

SEQ ID NO: 7083814 - DNA, 23 bp, Homo sapiens
atattgggagatagggcctttaa

SEQ ID NO: 7083815 - DNA, 18 bp, Homo sapiens
atattgggagcaggggca

SEQ ID NO: 7083816 - DNA, 22 bp, Homo sapiens
atattgggagctgagatctatt

SEQ ID NO: 7083817 - DNA, 22 bp, Homo sapiens
atattgggatgtttggaaatgc

SEQ ID NO: 7083818 - DNA, 22 bp, Homo sapiens
atattgcagtgtgtttatgtga

SEQ ID NO: 7083819 - DNA, 22 bp, Homo sapiens
atattgcaatagatgcatcatt

SEQ ID NO: 7083820 - DNA, 22 bp, Homo sapiens
atattgatggaggtgttagaca

SEQ ID NO: 7083821 - DNA, 22 bp, Homo sapiens
atattgatggaggtgttagaca

SEQ ID NO: 7083822 - DNA, 22 bp, Homo sapiens
atcagaagaaatggatgtgact

SEQ ID NO: 7083823 - DNA, 22 bp, Homo sapiens
atcagaagaaatggatgtgact

SEQ ID NO: 7083824 - DNA, 22 bp, Homo sapiens
atcagaacaaaagaacagttta

SEQ ID NO: 7083825 - DNA, 22 bp, Homo sapiens
atcagaacaaaagaacagttta

SEQ ID NO: 7083826 - DNA, 22 bp, Homo sapiens
atcagaaattgctaccagtgga

SEQ ID NO: 7083827 - DNA, 22 bp, Homo sapiens
atcagaaattgctaccagtgga

SEQ ID NO: 7083828 - DNA, 22 bp, Homo sapiens
atcagaagaaatggatgtgact

SEQ ID NO: 7083829 - DNA, 22 bp, Homo sapiens
atcagaagcaggaggaatgaag

SEQ ID NO: 7083830 - DNA, 22 bp, Homo sapiens
atcagaagcaggaggaatgaag

SEQ ID NO: 7083831 - DNA, 22 bp, Homo sapiens
atcagaagcttgtagtctctct

SEQ ID NO: 7083832 - DNA, 22 bp, Homo sapiens
atcagaagcttgtagtctctct

SEQ ID NO: 7083833 - DNA, 22 bp, Homo sapiens
atcagaaggggaggtaaagaag

SEQ ID NO: 7083834 - DNA, 22 bp, Homo sapiens
atcagaaggggaggtaaagaag

SEQ ID NO: 7083835 - DNA, 22 bp, Homo sapiens
atcagaaggggaggtaaagaag

SEQ ID NO: 7083836 - DNA, 20 bp, Homo sapiens
atcagaagtgatattaacca

SEQ ID NO: 7083837 - DNA, 20 bp, Homo sapiens
atcagaagtgatattaacca

SEQ ID NO: 7083838 - DNA, 20 bp, Homo sapiens
atcagaagtgatattaacca

SEQ ID NO: 7083839 - DNA, 20 bp, Homo sapiens
atcagaagtgatattaacca

SEQ ID NO: 7083840 - DNA, 22 bp, Homo sapiens
atcagaagtgatgtgtgttatt

SEQ ID NO: 7083841 - DNA, 22 bp, Homo sapiens
atcagaagtgatgtgtgttatt

SEQ ID NO: 7083842 - DNA, 22 bp, Homo sapiens
atcagaagttgtgcatgcatgg

SEQ ID NO: 7083843 - DNA, 22 bp, Homo sapiens
atcagaagttgtgcatgcatgg

SEQ ID NO: 7083844 - DNA, 21 bp, Homo sapiens
atcagaatctctagatttgga

SEQ ID NO: 7083845 - DNA, 22 bp, Homo sapiens
atcagaaaatacccagtgttta

SEQ ID NO: 7083846 - DNA, 22 bp, Homo sapiens
atcagaaaatacccagtgttta

SEQ ID NO: 7083847 - DNA, 22 bp, Homo sapiens
atcagaaaaatgagaagagctg

SEQ ID NO: 7083848 - DNA, 22 bp, Homo sapiens
atcagaaaaatgagaagagctg

SEQ ID NO: 7083849 - DNA, 22 bp, Homo sapiens
atcagaaaaatgagaagagctg

SEQ ID NO: 7083850 - DNA, 21 bp, Homo sapiens
atcagaaaatgtaatggagca

SEQ ID NO: 7083851 - DNA, 21 bp, Homo sapiens
atcagaaaatgtaatggagca

SEQ ID NO: 7083852 - DNA, 21 bp, Homo sapiens
atcagaaaatgtaatggagca

SEQ ID NO: 7083853 - DNA, 22 bp, Homo sapiens
atcagaaactcttagagcaggg

SEQ ID NO: 7083854 - DNA, 22 bp, Homo sapiens
atcagaaactcttagagcaggg

SEQ ID NO: 7083855 - DNA, 22 bp, Homo sapiens
atcagaaactcttagagcaggg

SEQ ID NO: 7083856 - DNA, 22 bp, Homo sapiens
atcagaaactcttagagcaggg

SEQ ID NO: 7083857 - DNA, 22 bp, Homo sapiens
atcagaaaggtgggcaagcaga

SEQ ID NO: 7083858 - DNA, 22 bp, Homo sapiens
atcagaaaggtgggcaagcaga

SEQ ID NO: 7083859 - DNA, 22 bp, Homo sapiens
atcagaaaggtgggcaagcaga

SEQ ID NO: 7083860 - DNA, 22 bp, Homo sapiens
atcagaaagttcatcatgtttg

SEQ ID NO: 7083861 - DNA, 22 bp, Homo sapiens
atcagaaagttcatcatgtttg

SEQ ID NO: 7083862 - DNA, 22 bp, Homo sapiens
atcagaaatagtcatgttactt

SEQ ID NO: 7083863 - DNA, 22 bp, Homo sapiens
atcagaaatctaggattcagaa

SEQ ID NO: 7083864 - DNA, 22 bp, Homo sapiens
atcagaaatctaggattcagaa

SEQ ID NO: 7083865 - DNA, 22 bp, Homo sapiens
atcagaaattgcccagctgttt

SEQ ID NO: 7083866 - DNA, 22 bp, Homo sapiens
atcagaaattgcccagctgttt

SEQ ID NO: 7083867 - DNA, 22 bp, Homo sapiens
atcaaatacaaagggcataagg

SEQ ID NO: 7083868 - DNA, 22 bp, Homo sapiens
atcaaagtttcccagaagttgt

SEQ ID NO: 7083869 - DNA, 22 bp, Homo sapiens
atcaaataaaggtacctagctt

SEQ ID NO: 7083870 - DNA, 22 bp, Homo sapiens
atcaaatataataattttcgct

SEQ ID NO: 7083871 - DNA, 22 bp, Homo sapiens
atcaaatcattgcattaatgtt

SEQ ID NO: 7083872 - DNA, 22 bp, Homo sapiens
atcaaatcattgcattaatgtt

SEQ ID NO: 7083873 - DNA, 23 bp, Homo sapiens
atcaaatgattggccattcagtg

SEQ ID NO: 7083874 - DNA, 23 bp, Homo sapiens
atcaaatgattggccattcagtg

SEQ ID NO: 7083875 - DNA, 23 bp, Homo sapiens
atcaaatgattggccattcagtg

SEQ ID NO: 7083876 - DNA, 22 bp, Homo sapiens
atcaaattatgtgctacaagaa

SEQ ID NO: 7083877 - DNA, 22 bp, Homo sapiens
atcaaattatgtgctacaagaa

SEQ ID NO: 7083878 - DNA, 23 bp, Homo sapiens
atcaaatgattggccattcagtg

SEQ ID NO: 7083879 - DNA, 22 bp, Homo sapiens
atcaacaggtatggatgagatt

SEQ ID NO: 7083880 - DNA, 22 bp, Homo sapiens
atcaacatgaatttctctgaag

SEQ ID NO: 7083881 - DNA, 22 bp, Homo sapiens
atcaacatggcaatgcccatct

SEQ ID NO: 7083882 - DNA, 22 bp, Homo sapiens
atcaacatatgcatgggaaagt

SEQ ID NO: 7083883 - DNA, 22 bp, Homo sapiens
atcaacatgaatttctctgaag

SEQ ID NO: 7083884 - DNA, 22 bp, Homo sapiens
atcaacatgtcataaagtgaaa

SEQ ID NO: 7083885 - DNA, 22 bp, Homo sapiens
atcaacatgtgagagcaccagt

SEQ ID NO: 7083886 - DNA, 22 bp, Homo sapiens
atcaacttaaagaaaagatact

SEQ ID NO: 7083887 - DNA, 22 bp, Homo sapiens
atcaacttaaagaaaagatact

SEQ ID NO: 7083888 - DNA, 22 bp, Homo sapiens
atcacattctttcaaagcagtc

SEQ ID NO: 7083889 - DNA, 22 bp, Homo sapiens
atcagaaaaacataatgttatt

SEQ ID NO: 7083890 - DNA, 22 bp, Homo sapiens
atcactttggtaccaattcagc

SEQ ID NO: 7083891 - DNA, 22 bp, Homo sapiens
atcagaaaaacataatgttatt

SEQ ID NO: 7083892 - DNA, 22 bp, Homo sapiens
ctgggctcacctgtggctggca

SEQ ID NO: 7083893 - DNA, 22 bp, Homo sapiens
ctgggctcacctgtggctggca

SEQ ID NO: 7083894 - DNA, 22 bp, Homo sapiens
ctgggctcagatgagaggaagg

SEQ ID NO: 7083895 - DNA, 22 bp, Homo sapiens
ctgggctcagaaccttgttaag

SEQ ID NO: 7083896 - DNA, 22 bp, Homo sapiens
atatgcatatgtcaaaacttat

SEQ ID NO: 7083897 - DNA, 22 bp, Homo sapiens
atatgcatataaagcttttagt

SEQ ID NO: 7083898 - DNA, 22 bp, Homo sapiens
atatgcagtctcttgcccttct

SEQ ID NO: 7083899 - DNA, 22 bp, Homo sapiens
atatgcacatacatacataggt

SEQ ID NO: 7083900 - DNA, 22 bp, Homo sapiens
atatgcacgcatacacacataa

SEQ ID NO: 7083901 - DNA, 22 bp, Homo sapiens
atatgcagagagcatgaatagg

SEQ ID NO: 7083902 - DNA, 22 bp, Homo sapiens
atatgcagagagcatgaatagg

SEQ ID NO: 7083903 - DNA, 22 bp, Homo sapiens
atatgcagtctcttgcccttct

SEQ ID NO: 7083904 - DNA, 22 bp, Homo sapiens
atatgcagtctcttgcccttct

SEQ ID NO: 7083905 - DNA, 22 bp, Homo sapiens
ctgggctcaagtgatccaccca

SEQ ID NO: 7083906 - DNA, 20 bp, Homo sapiens
ctgggctcaagtgatcctcc

SEQ ID NO: 7083907 - DNA, 20 bp, Homo sapiens
ctgggctcaagtgagcctcc

SEQ ID NO: 7083908 - DNA, 20 bp, Homo sapiens
ctgggctcaagtgagcctcc

SEQ ID NO: 7083909 - DNA, 22 bp, Homo sapiens
ctgggcctggggctgttgagag

SEQ ID NO: 7083910 - DNA, 20 bp, Homo sapiens
ctggcttcgggaactagttt

SEQ ID NO: 7083911 - DNA, 22 bp, Homo sapiens
ctggcttctgggccagggcaga

SEQ ID NO: 7083912 - DNA, 22 bp, Homo sapiens
ctgggcctggtagggcttgaaa

SEQ ID NO: 7083913 - DNA, 21 bp, Homo sapiens
ctgggctcaagcaatcctttc

SEQ ID NO: 7083914 - DNA, 21 bp, Homo sapiens
ctgggctcaagcaatcctttc

SEQ ID NO: 7083915 - DNA, 22 bp, Homo sapiens
ctggcttcctcaggagcagtgg

SEQ ID NO: 7083916 - DNA, 22 bp, Homo sapiens
ctggcttcctgagtccattacc

SEQ ID NO: 7083917 - DNA, 22 bp, Homo sapiens
ctggcttccctgtcttatggaa

SEQ ID NO: 7083918 - DNA, 22 bp, Homo sapiens
ctggcttccctgtcttatggaa

SEQ ID NO: 7083919 - DNA, 22 bp, Homo sapiens
ctggcttccatgctgtagtggc

SEQ ID NO: 7083920 - DNA, 22 bp, Homo sapiens
ctggcttccatgctgtagtggc

SEQ ID NO: 7083921 - DNA, 22 bp, Homo sapiens
ctggctgtttcaggcagtgtcc

SEQ ID NO: 7083922 - DNA, 22 bp, Homo sapiens
ctggctgtgtcttggaggagct

SEQ ID NO: 7083923 - DNA, 22 bp, Homo sapiens
ctggctgttttcaatgttgatg

SEQ ID NO: 7083924 - DNA, 19 bp, Homo sapiens
ctggcttcaagcagtcctc

SEQ ID NO: 7083925 - DNA, 19 bp, Homo sapiens
ctggcttcaagcagtcctc

SEQ ID NO: 7083926 - DNA, 19 bp, Homo sapiens
ctggcttcaagcagtcctc

SEQ ID NO: 7083927 - DNA, 22 bp, Homo sapiens
ctggcttcagctgccatcaatg

SEQ ID NO: 7083928 - DNA, 22 bp, Homo sapiens
ctggctggccggagcgaggcgg

SEQ ID NO: 7083929 - DNA, 22 bp, Homo sapiens
ctggctgggaagtagagtaggt

SEQ ID NO: 7083930 - DNA, 22 bp, Homo sapiens
ctggctgggaagtagagtaggt

SEQ ID NO: 7083931 - DNA, 22 bp, Homo sapiens
ctggctgggaagtagagtaggt

SEQ ID NO: 7083932 - DNA, 22 bp, Homo sapiens
ctggctggctcatttttcattg

SEQ ID NO: 7083933 - DNA, 22 bp, Homo sapiens
ctggctggctgtgcccctgccg

SEQ ID NO: 7083934 - DNA, 22 bp, Homo sapiens
ctggctgggagcgagctgctca

SEQ ID NO: 7083935 - DNA, 22 bp, Homo sapiens
ctggctgggagcgagctgctca

SEQ ID NO: 7083936 - DNA, 22 bp, Homo sapiens
ctggctgggagcgagctgctca

SEQ ID NO: 7083937 - DNA, 22 bp, Homo sapiens
ctggctgtgtcttggaggagct

SEQ ID NO: 7083938 - DNA, 22 bp, Homo sapiens
ctggctgtgtcttggaggagct

SEQ ID NO: 7083939 - DNA, 22 bp, Homo sapiens
atattcactgagcataaagcca

SEQ ID NO: 7083940 - DNA, 22 bp, Homo sapiens
atattcactgggtactaaaaag

SEQ ID NO: 7083941 - DNA, 22 bp, Homo sapiens
atattcactgggtactaaaaag

SEQ ID NO: 7083942 - DNA, 19 bp, Homo sapiens
ctgggctgaggtctgcctt

SEQ ID NO: 7083943 - DNA, 22 bp, Homo sapiens
atattcatcgtgtagaaatact

SEQ ID NO: 7083944 - DNA, 22 bp, Homo sapiens
atattcttgaaagatcctggta

SEQ ID NO: 7083945 - DNA, 22 bp, Homo sapiens
atattcttgaagggagattata

SEQ ID NO: 7083946 - DNA, 22 bp, Homo sapiens
atattcttgaagggagattata

SEQ ID NO: 7083947 - DNA, 19 bp, Homo sapiens
ctgggctgaggtctgcctt

SEQ ID NO: 7083948 - DNA, 19 bp, Homo sapiens
ctgggctgaggtctgcctt

SEQ ID NO: 7083949 - DNA, 22 bp, Homo sapiens
ctgggctgagctgtggaaactc

SEQ ID NO: 7083950 - DNA, 19 bp, Homo sapiens
ctgggctgaggtctgcctt

SEQ ID NO: 7083951 - DNA, 19 bp, Homo sapiens
ctgggctgaggtctgcctt

SEQ ID NO: 7083952 - DNA, 22 bp, Homo sapiens
ctgggctgagcctgggctgtgt

SEQ ID NO: 7083953 - DNA, 22 bp, Homo sapiens
ctgggctgagcctgggctgtgt

SEQ ID NO: 7083954 - DNA, 22 bp, Homo sapiens
ctgggctgagcctgggctgtgt

SEQ ID NO: 7083955 - DNA, 22 bp, Homo sapiens
ctgggctgagcctgggctgtgt

SEQ ID NO: 7083956 - DNA, 22 bp, Homo sapiens
ctgggctgagcctgggctgtgt

SEQ ID NO: 7083957 - DNA, 22 bp, Homo sapiens
ctgggctgagcctgggctgtgt

SEQ ID NO: 7083958 - DNA, 22 bp, Homo sapiens
atattatgctaagggaaataag

SEQ ID NO: 7083959 - DNA, 22 bp, Homo sapiens
atattatggccccatctaagct

SEQ ID NO: 7083960 - DNA, 22 bp, Homo sapiens
atattatggccccatctaagct

SEQ ID NO: 7083961 - DNA, 22 bp, Homo sapiens
ctgggctctgcggtgtcgctct

SEQ ID NO: 7083962 - DNA, 22 bp, Homo sapiens
ctgggctctggggtcccggtgc

SEQ ID NO: 7083963 - DNA, 22 bp, Homo sapiens
atattataagttatttcaagtt

SEQ ID NO: 7083964 - DNA, 22 bp, Homo sapiens
atattatagacagagtcttctg

SEQ ID NO: 7083965 - DNA, 22 bp, Homo sapiens
atattatagacagagtcttctg

SEQ ID NO: 7083966 - DNA, 22 bp, Homo sapiens
atattatagacagagtcttctg

SEQ ID NO: 7083967 - DNA, 22 bp, Homo sapiens
atattatagacagagtcttctg

SEQ ID NO: 7083968 - DNA, 22 bp, Homo sapiens
atattatagacagagtcttctg

SEQ ID NO: 7083969 - DNA, 22 bp, Homo sapiens
ctgggctctgtgtttcagtttc

SEQ ID NO: 7083970 - DNA, 22 bp, Homo sapiens
ctgggctcttcccagatccaga

SEQ ID NO: 7083971 - DNA, 22 bp, Homo sapiens
ctgggctgaaggctccccacac

SEQ ID NO: 7083972 - DNA, 22 bp, Homo sapiens
ctgggctgaaggctccccacac

SEQ ID NO: 7083973 - DNA, 22 bp, Homo sapiens
ctgggctgaaggctccccacac

SEQ ID NO: 7083974 - DNA, 22 bp, Homo sapiens
ctgggctgaaagtgttccttga

SEQ ID NO: 7083975 - DNA, 22 bp, Homo sapiens
ctgggctgaaagtgttccttga

SEQ ID NO: 7083976 - DNA, 22 bp, Homo sapiens
ctgggctgaaagtgttccttga

SEQ ID NO: 7083977 - DNA, 22 bp, Homo sapiens
ctgggctcttctcaccctgttt

SEQ ID NO: 7083978 - DNA, 22 bp, Homo sapiens
ctgggctcttctcaccctgttt

SEQ ID NO: 7083979 - DNA, 22 bp, Homo sapiens
atattaaaactatggttttcag

SEQ ID NO: 7083980 - DNA, 22 bp, Homo sapiens
atattaaaactatggttttcag

SEQ ID NO: 7083981 - DNA, 22 bp, Homo sapiens
atattaaaactatggttttcag

SEQ ID NO: 7083982 - DNA, 22 bp, Homo sapiens
atatgctatgttgaataatttg

SEQ ID NO: 7083983 - DNA, 22 bp, Homo sapiens
atatgctatgttgaataatttg

SEQ ID NO: 7083984 - DNA, 22 bp, Homo sapiens
atatgctattgctgtaatttaa

SEQ ID NO: 7083985 - DNA, 22 bp, Homo sapiens
atatgctaattagagggcatta

SEQ ID NO: 7083986 - DNA, 22 bp, Homo sapiens
atatgctaattagagggcatta

SEQ ID NO: 7083987 - DNA, 20 bp, Homo sapiens
atatgctaatttttagtggg

SEQ ID NO: 7083988 - DNA, 22 bp, Homo sapiens
atatgctacaaataaactttta

SEQ ID NO: 7083989 - DNA, 22 bp, Homo sapiens
atatgctacaaataaactttta

SEQ ID NO: 7083990 - DNA, 22 bp, Homo sapiens
atatgctacaaataaactttta

SEQ ID NO: 7083991 - DNA, 22 bp, Homo sapiens
atatgctagtgtgcttatactt

SEQ ID NO: 7083992 - DNA, 22 bp, Homo sapiens
atatgctatgtatgtaaatgag

SEQ ID NO: 7083993 - DNA, 21 bp, Homo sapiens
atatgccaaatgccagtaacc

SEQ ID NO: 7083994 - DNA, 22 bp, Homo sapiens
atatgccatactgtacaatact

SEQ ID NO: 7083995 - DNA, 22 bp, Homo sapiens
atatgcatgcatgcttgtgaga

SEQ ID NO: 7083996 - DNA, 20 bp, Homo sapiens
atatgcatgtgttttcactt

SEQ ID NO: 7083997 - DNA, 22 bp, Homo sapiens
atattataagttatttcaagtt

SEQ ID NO: 7083998 - DNA, 22 bp, Homo sapiens
atattataagttatttcaagtt

SEQ ID NO: 7083999 - DNA, 22 bp, Homo sapiens
atattataagttatttcaagtt

SEQ ID NO: 7084000 - DNA, 22 bp, Homo sapiens
atattataagttatttcaagtt

SEQ ID NO: 7084001 - DNA, 22 bp, Homo sapiens
atattagggtctctaaattcta

SEQ ID NO: 7084002 - DNA, 22 bp, Homo sapiens
atattagggtctctaaattcta

SEQ ID NO: 7084003 - DNA, 22 bp, Homo sapiens
atattaggcaaggagattattt

SEQ ID NO: 7084004 - DNA, 23 bp, Homo sapiens
atattagggagattagccctcta

SEQ ID NO: 7084005 - DNA, 22 bp, Homo sapiens
atattaggtgctcaatacatgc

SEQ ID NO: 7084006 - DNA, 22 bp, Homo sapiens
atattaggttggtgcaaaagta

SEQ ID NO: 7084007 - DNA, 22 bp, Homo sapiens
atattagtgtaggtagctaata

SEQ ID NO: 7084008 - DNA, 22 bp, Homo sapiens
atattagtgtaggtagctaata

SEQ ID NO: 7084009 - DNA, 22 bp, Homo sapiens
atattagtttggagactacaat

SEQ ID NO: 7084010 - DNA, 22 bp, Homo sapiens
atattacataaacatgagtgaa

SEQ ID NO: 7084011 - DNA, 22 bp, Homo sapiens
atattactctgatttagtaaat

SEQ ID NO: 7084012 - DNA, 22 bp, Homo sapiens
atattactctgatttagtaaat

SEQ ID NO: 7084013 - DNA, 22 bp, Homo sapiens
atattactctgatttagtaaat

SEQ ID NO: 7084014 - DNA, 22 bp, Homo sapiens
atattagcagtgatcaaaatgg

SEQ ID NO: 7084015 - DNA, 22 bp, Homo sapiens
atattagcagtgatcaaaatgg

SEQ ID NO: 7084016 - DNA, 22 bp, Homo sapiens
atattaggagttaaatgtatta

SEQ ID NO: 7084017 - DNA, 22 bp, Homo sapiens
cttcccaccaaagcccttgttg

SEQ ID NO: 7084018 - DNA, 22 bp, Homo sapiens
cttcccaccaaagcccttgttg

SEQ ID NO: 7084019 - DNA, 22 bp, Homo sapiens
cttcccactaaagcccttgttg

SEQ ID NO: 7084020 - DNA, 22 bp, Homo sapiens
cttcccactaaagcccttgttg

SEQ ID NO: 7084021 - DNA, 22 bp, Homo sapiens
cttcccactagtatcacagagc

SEQ ID NO: 7084022 - DNA, 21 bp, Homo sapiens
cttcccaaggcttcaaagcct

SEQ ID NO: 7084023 - DNA, 21 bp, Homo sapiens
cttcccaaggcttcaaagcct

SEQ ID NO: 7084024 - DNA, 22 bp, Homo sapiens
cttcccaagactgtattgcaag

SEQ ID NO: 7084025 - DNA, 22 bp, Homo sapiens
cttccatacagacaatgcaatg

SEQ ID NO: 7084026 - DNA, 22 bp, Homo sapiens
cttccagtggttctggagggag

SEQ ID NO: 7084027 - DNA, 22 bp, Homo sapiens
cttccagtttccccttccagtc

SEQ ID NO: 7084028 - DNA, 22 bp, Homo sapiens
cttccagtcttttcagtggagt

SEQ ID NO: 7084029 - DNA, 22 bp, Homo sapiens
cttccagtgcataggtagatca

SEQ ID NO: 7084030 - DNA, 23 bp, Homo sapiens
cttccagtactgcacactcaagg

SEQ ID NO: 7084031 - DNA, 22 bp, Homo sapiens
cttccagtagtatcattctcat

SEQ ID NO: 7084032 - DNA, 22 bp, Homo sapiens
cttccagtagtatcattctcat

SEQ ID NO: 7084033 - DNA, 22 bp, Homo sapiens
cttcctaaaagcttcaagagaa

SEQ ID NO: 7084034 - DNA, 22 bp, Homo sapiens
cttcctagagccggcagtgagg

SEQ ID NO: 7084035 - DNA, 22 bp, Homo sapiens
cttcctagagccggcagtgagg

SEQ ID NO: 7084036 - DNA, 22 bp, Homo sapiens
cttcctaggaagtcagacttcc

SEQ ID NO: 7084037 - DNA, 22 bp, Homo sapiens
cttcctagagccggcagtgagg

SEQ ID NO: 7084038 - DNA, 22 bp, Homo sapiens
cttcctcccggcccatgctctg

SEQ ID NO: 7084039 - DNA, 22 bp, Homo sapiens
cttcctcccggcccatgctctg

SEQ ID NO: 7084040 - DNA, 22 bp, Homo sapiens
cttcctcccggcccatgctctg

SEQ ID NO: 7084041 - DNA, 18 bp, Homo sapiens
cttcctcatcgctctccc

SEQ ID NO: 7084042 - DNA, 22 bp, Homo sapiens
cttcctcatgtgcaatgcaagc

SEQ ID NO: 7084043 - DNA, 18 bp, Homo sapiens
cttcctcatcgctctccc

SEQ ID NO: 7084044 - DNA, 22 bp, Homo sapiens
cttcctcacggtgcaacaggaa

SEQ ID NO: 7084045 - DNA, 22 bp, Homo sapiens
atcctgtggggcggctgcaggg

SEQ ID NO: 7084046 - DNA, 22 bp, Homo sapiens
atcctgtggctccagggagccg

SEQ ID NO: 7084047 - DNA, 22 bp, Homo sapiens
atcctgtgtccactgctctgtg

SEQ ID NO: 7084048 - DNA, 22 bp, Homo sapiens
atcctgtggccctgcctctgct

SEQ ID NO: 7084049 - DNA, 22 bp, Homo sapiens
atcctgtgttgctactggagga

SEQ ID NO: 7084050 - DNA, 22 bp, Homo sapiens
cttagaacattctgcctgggaa

SEQ ID NO: 7084051 - DNA, 22 bp, Homo sapiens
cttagagatgggttttacttag

SEQ ID NO: 7084052 - DNA, 22 bp, Homo sapiens
cttagagatgggttttacttag

SEQ ID NO: 7084053 - DNA, 22 bp, Homo sapiens
cttagagccttactcttcttgt

SEQ ID NO: 7084054 - DNA, 22 bp, Homo sapiens
cttagatgaagtcacagaaccc

SEQ ID NO: 7084055 - DNA, 22 bp, Homo sapiens
cttagatgaagtcacagaaccc

SEQ ID NO: 7084056 - DNA, 22 bp, Homo sapiens
cttagatgaagtcacagaaccc

SEQ ID NO: 7084057 - DNA, 22 bp, Homo sapiens
cttagatgaagtcacagaaccc

SEQ ID NO: 7084058 - DNA, 22 bp, Homo sapiens
cttagatgaagtcacagaaccc

SEQ ID NO: 7084059 - DNA, 19 bp, Homo sapiens
atctgaagtaggtgcagct

SEQ ID NO: 7084060 - DNA, 19 bp, Homo sapiens
atctgaagtaggtgcagct

SEQ ID NO: 7084061 - DNA, 22 bp, Homo sapiens
atctgaagggaagtggaaggca

SEQ ID NO: 7084062 - DNA, 22 bp, Homo sapiens
atctgaagtccttataatctga

SEQ ID NO: 7084063 - DNA, 21 bp, Homo sapiens
atctgaagtttgagaggaaag

SEQ ID NO: 7084064 - DNA, 22 bp, Homo sapiens
atctgacaacctattgacttga

SEQ ID NO: 7084065 - DNA, 21 bp, Homo sapiens
atctgaaatgtcaaagcagat

SEQ ID NO: 7084066 - DNA, 21 bp, Homo sapiens
atctgaaatgtcaaagcagat

SEQ ID NO: 7084067 - DNA, 21 bp, Homo sapiens
atctgaaatgtcaaagcagat

SEQ ID NO: 7084068 - DNA, 22 bp, Homo sapiens
atctgaagaatgaatggaatta

SEQ ID NO: 7084069 - DNA, 22 bp, Homo sapiens
atctgaagaggtcatggctgac

SEQ ID NO: 7084070 - DNA, 22 bp, Homo sapiens
atctgaaagctaggagttctca

SEQ ID NO: 7084071 - DNA, 22 bp, Homo sapiens
atctgaaactctgacattgtct

SEQ ID NO: 7084072 - DNA, 22 bp, Homo sapiens
atctgaaactctgacattgtct

SEQ ID NO: 7084073 - DNA, 22 bp, Homo sapiens
atctgaaactctgacattgtct

SEQ ID NO: 7084074 - DNA, 22 bp, Homo sapiens
atctgaaaagctttaatgagct

SEQ ID NO: 7084075 - DNA, 23 bp, Homo sapiens
atctgaaaaggcattttcttccc

SEQ ID NO: 7084076 - DNA, 22 bp, Homo sapiens
atctgaaaaatctcctttgtca

SEQ ID NO: 7084077 - DNA, 22 bp, Homo sapiens
cttcctctatgttcaggtagaa

SEQ ID NO: 7084078 - DNA, 22 bp, Homo sapiens
cttcctctagcctagtaatgcc

SEQ ID NO: 7084079 - DNA, 22 bp, Homo sapiens
cttcctctagcctagtaatgcc

SEQ ID NO: 7084080 - DNA, 22 bp, Homo sapiens
cttcctctagcctagtaatgcc

SEQ ID NO: 7084081 - DNA, 22 bp, Homo sapiens
cttcctcccggcccatgctctg

SEQ ID NO: 7084082 - DNA, 22 bp, Homo sapiens
cttcctcctccatctcgaaggc

SEQ ID NO: 7084083 - DNA, 22 bp, Homo sapiens
atctgacaaggccacatattct

SEQ ID NO: 7084084 - DNA, 22 bp, Homo sapiens
atctgacaaggccacatattct

SEQ ID NO: 7084085 - DNA, 22 bp, Homo sapiens
atctgacaagttgtgtgtatag

SEQ ID NO: 7084086 - DNA, 22 bp, Homo sapiens
atctgacaagttgtgtgtatag

SEQ ID NO: 7084087 - DNA, 22 bp, Homo sapiens
atctgacatctccctctgacat

SEQ ID NO: 7084088 - DNA, 22 bp, Homo sapiens
atctgacatctccctctgacat

SEQ ID NO: 7084089 - DNA, 22 bp, Homo sapiens
atctgacttcacgcccatgcca

SEQ ID NO: 7084090 - DNA, 19 bp, Homo sapiens
atctgagattataaacaga

SEQ ID NO: 7084091 - DNA, 19 bp, Homo sapiens
atctgaggcctcatctggg

SEQ ID NO: 7084092 - DNA, 22 bp, Homo sapiens
atctgcagaggacaggcgagga

SEQ ID NO: 7084093 - DNA, 22 bp, Homo sapiens
atctgcaggaatgtgtgcagag

SEQ ID NO: 7084094 - DNA, 21 bp, Homo sapiens
atctgatgtataaatacctct

SEQ ID NO: 7084095 - DNA, 20 bp, Homo sapiens
atctgaggctgtcgctggaa

SEQ ID NO: 7084096 - DNA, 20 bp, Homo sapiens
atctgaggctgtcgctggaa

SEQ ID NO: 7084097 - DNA, 22 bp, Homo sapiens
atctgagctccgcctcctgtca

SEQ ID NO: 7084098 - DNA, 22 bp, Homo sapiens
atctgagggtttgggcatcagc

SEQ ID NO: 7084099 - DNA, 22 bp, Homo sapiens
atctgaggtatatgactggcta

SEQ ID NO: 7084100 - DNA, 22 bp, Homo sapiens
atctgagtcaaatatttcattt

SEQ ID NO: 7084101 - DNA, 22 bp, Homo sapiens
atctgagtctctgacagcatgt

SEQ ID NO: 7084102 - DNA, 22 bp, Homo sapiens
atctgagtgttggatttattgt

SEQ ID NO: 7084103 - DNA, 18 bp, Homo sapiens
atctgatgcaattcaata

SEQ ID NO: 7084104 - DNA, 22 bp, Homo sapiens
cttcttggtgatggcttacctg

SEQ ID NO: 7084105 - DNA, 22 bp, Homo sapiens
cttcttgggttctgagattaca

SEQ ID NO: 7084106 - DNA, 22 bp, Homo sapiens
cttcttggttggtttcattcca

SEQ ID NO: 7084107 - DNA, 21 bp, Homo sapiens
cttcttggggagcagctagac

SEQ ID NO: 7084108 - DNA, 22 bp, Homo sapiens
cttcttgggtcagagaatcatt

SEQ ID NO: 7084109 - DNA, 22 bp, Homo sapiens
cttcttgggtcagagaatcatt

SEQ ID NO: 7084110 - DNA, 22 bp, Homo sapiens
cttcttgggtcagagaatcatt

SEQ ID NO: 7084111 - DNA, 22 bp, Homo sapiens
cttcttggaagtcgtccttcca

SEQ ID NO: 7084112 - DNA, 20 bp, Homo sapiens
cttcttggagatggtgtttt

SEQ ID NO: 7084113 - DNA, 22 bp, Homo sapiens
cttcttggctgcaagtctctgt

SEQ ID NO: 7084114 - DNA, 22 bp, Homo sapiens
cttcttggctgcaagtctctgt

SEQ ID NO: 7084115 - DNA, 22 bp, Homo sapiens
atctgcagtttgttttctcttg

SEQ ID NO: 7084116 - DNA, 22 bp, Homo sapiens
cttcttggaagtcgtccttcca

SEQ ID NO: 7084117 - DNA, 22 bp, Homo sapiens
cttcttgcaattttcatcttat

SEQ ID NO: 7084118 - DNA, 22 bp, Homo sapiens
cttcttatctgaaagtaatatt

SEQ ID NO: 7084119 - DNA, 22 bp, Homo sapiens
ctgtggctaggaagctgtggga

SEQ ID NO: 7084120 - DNA, 22 bp, Homo sapiens
ctgtggccttggaccagcatct

SEQ ID NO: 7084121 - DNA, 22 bp, Homo sapiens
ctgtggccttggaccagcatct

SEQ ID NO: 7084122 - DNA, 22 bp, Homo sapiens
ctgtggcctttgttggaggtcc

SEQ ID NO: 7084123 - DNA, 22 bp, Homo sapiens
ctgtggcctttgttggaggtcc

SEQ ID NO: 7084124 - DNA, 19 bp, Homo sapiens
ctgtggcctccaggaggga

SEQ ID NO: 7084125 - DNA, 22 bp, Homo sapiens
ctgtggcctgtgccagaactgg

SEQ ID NO: 7084126 - DNA, 22 bp, Homo sapiens
ctgtggccttggaccagcatct

SEQ ID NO: 7084127 - DNA, 22 bp, Homo sapiens
ctgtggccttggaccagcatct

SEQ ID NO: 7084128 - DNA, 22 bp, Homo sapiens
ctgtggagttccatcaggggag

SEQ ID NO: 7084129 - DNA, 22 bp, Homo sapiens
ctgtggagttccatcaggggag

SEQ ID NO: 7084130 - DNA, 23 bp, Homo sapiens
ctgtggccctgcttcatgcagcc

SEQ ID NO: 7084131 - DNA, 23 bp, Homo sapiens
ctgtggccctgcttcatgcagcc

SEQ ID NO: 7084132 - DNA, 22 bp, Homo sapiens
ctgtggccctgtgatctggcac

SEQ ID NO: 7084133 - DNA, 22 bp, Homo sapiens
ctgtggccctgtgatctggcac

SEQ ID NO: 7084134 - DNA, 19 bp, Homo sapiens
ctgtggcctccaggaggga

SEQ ID NO: 7084135 - DNA, 19 bp, Homo sapiens
ctgtggcctccaggaggga

SEQ ID NO: 7084136 - DNA, 22 bp, Homo sapiens
ctgtggagtgtagatgctgggt

SEQ ID NO: 7084137 - DNA, 22 bp, Homo sapiens
ctgtggagtgtagatgctgggt

SEQ ID NO: 7084138 - DNA, 22 bp, Homo sapiens
atcagagattgtagtatgtgca

SEQ ID NO: 7084139 - DNA, 20 bp, Homo sapiens
atcagacttttaggaacata

SEQ ID NO: 7084140 - DNA, 22 bp, Homo sapiens
atcagagaccggtcaagtcatg

SEQ ID NO: 7084141 - DNA, 22 bp, Homo sapiens
atcagagaccggtcaagtcatg

SEQ ID NO: 7084142 - DNA, 22 bp, Homo sapiens
atcagagatggctccagtgctc

SEQ ID NO: 7084143 - DNA, 22 bp, Homo sapiens
atcagacaattgttgagtactg

SEQ ID NO: 7084144 - DNA, 22 bp, Homo sapiens
atcagacactagtggactagaa

SEQ ID NO: 7084145 - DNA, 22 bp, Homo sapiens
atcagacagggagttctgtgtc

SEQ ID NO: 7084146 - DNA, 22 bp, Homo sapiens
atcagaccatccagcgtggatg

SEQ ID NO: 7084147 - DNA, 22 bp, Homo sapiens
atcagacctgtctcctcttgcc

SEQ ID NO: 7084148 - DNA, 22 bp, Homo sapiens
atcagactcagaaatgacgtgg

SEQ ID NO: 7084149 - DNA, 22 bp, Homo sapiens
atcagactctgcattgcagtct

SEQ ID NO: 7084150 - DNA, 20 bp, Homo sapiens
atcagacttgcatttcagga

SEQ ID NO: 7084151 - DNA, 22 bp, Homo sapiens
ctgtggcttttccggggagcct

SEQ ID NO: 7084152 - DNA, 22 bp, Homo sapiens
ctgtgggaaaggatgagattgc

SEQ ID NO: 7084153 - DNA, 22 bp, Homo sapiens
ctgtggctaggattattcctga

SEQ ID NO: 7084154 - DNA, 22 bp, Homo sapiens
ctgtggctaggaagctgtggga

SEQ ID NO: 7084155 - DNA, 22 bp, Homo sapiens
ctgtggctcaaaatcccatgat

SEQ ID NO: 7084156 - DNA, 22 bp, Homo sapiens
ctgtggctcaaaatcccatgat

SEQ ID NO: 7084157 - DNA, 22 bp, Homo sapiens
ctgtggctcaaaatcccatgat

SEQ ID NO: 7084158 - DNA, 22 bp, Homo sapiens
ctgtggctcaattgcctactga

SEQ ID NO: 7084159 - DNA, 22 bp, Homo sapiens
ctgtgggaatactgcgagtgta

SEQ ID NO: 7084160 - DNA, 21 bp, Homo sapiens
ctgtgggaccaagcactggga

SEQ ID NO: 7084161 - DNA, 21 bp, Homo sapiens
ctgtgggaccaagcactggga

SEQ ID NO: 7084162 - DNA, 21 bp, Homo sapiens
ctgtgggaccaagcactggga

SEQ ID NO: 7084163 - DNA, 22 bp, Homo sapiens
ctgtgggagaagctagcacagg

SEQ ID NO: 7084164 - DNA, 22 bp, Homo sapiens
ctgtgggagaagctagcacagg

SEQ ID NO: 7084165 - DNA, 22 bp, Homo sapiens
ctgtgggagaagctagcacagg

SEQ ID NO: 7084166 - DNA, 22 bp, Homo sapiens
ctgtgggagaagggctttttct

SEQ ID NO: 7084167 - DNA, 23 bp, Homo sapiens
ctgtgggaagtcggggagcgcgc

SEQ ID NO: 7084168 - DNA, 23 bp, Homo sapiens
ctgtgggaagtcggggagcgcgc

SEQ ID NO: 7084169 - DNA, 22 bp, Homo sapiens
ctgtgggaatactgcgagtgta

SEQ ID NO: 7084170 - DNA, 22 bp, Homo sapiens
ctgtgggaaaggatgagattgc

SEQ ID NO: 7084171 - DNA, 22 bp, Homo sapiens
ctgtgggaacactgaggacttc

SEQ ID NO: 7084172 - DNA, 22 bp, Homo sapiens
ctgtgggaacactgaggacttc

SEQ ID NO: 7084173 - DNA, 18 bp, Homo sapiens
ctgtgggaagagtttggg

SEQ ID NO: 7084174 - DNA, 18 bp, Homo sapiens
ctgtgggaagagtttggg

SEQ ID NO: 7084175 - DNA, 22 bp, Homo sapiens
ctgtgtgctgaaatgcagtgag

SEQ ID NO: 7084176 - DNA, 22 bp, Homo sapiens
ctgtgtgcctcctgtgatcagg

SEQ ID NO: 7084177 - DNA, 22 bp, Homo sapiens
ctgtgtgctcggatggactcgt

SEQ ID NO: 7084178 - DNA, 22 bp, Homo sapiens
ctgtgtgctgaaatgcagtgag

SEQ ID NO: 7084179 - DNA, 22 bp, Homo sapiens
ctgtgtgctgttagggagctgc

SEQ ID NO: 7084180 - DNA, 22 bp, Homo sapiens
ctgtgtggactggttgaggccc

SEQ ID NO: 7084181 - DNA, 22 bp, Homo sapiens
ctgtgtggcctcaagccagcct

SEQ ID NO: 7084182 - DNA, 22 bp, Homo sapiens
ctgtgtgtcctcggacgagttt

SEQ ID NO: 7084183 - DNA, 22 bp, Homo sapiens
atcctgaaaacttacgaagtgg

SEQ ID NO: 7084184 - DNA, 22 bp, Homo sapiens
ctgtgtgtcctcggacgagttt

SEQ ID NO: 7084185 - DNA, 22 bp, Homo sapiens
ctgtgtgtcctcggacgagttt

SEQ ID NO: 7084186 - DNA, 22 bp, Homo sapiens
ctgtgtgtcctcggacgagttt

SEQ ID NO: 7084187 - DNA, 22 bp, Homo sapiens
ctgtgtgtcctcggacgagttt

SEQ ID NO: 7084188 - DNA, 22 bp, Homo sapiens
ctgtgtgtcatttgtcaatcct

SEQ ID NO: 7084189 - DNA, 22 bp, Homo sapiens
ctgtgtgtcctcggacgagttt

SEQ ID NO: 7084190 - DNA, 22 bp, Homo sapiens
ctgtgtgtcatttgtcaatcct

SEQ ID NO: 7084191 - DNA, 22 bp, Homo sapiens
ctgtgtgtcatttgtcaatcct

SEQ ID NO: 7084192 - DNA, 22 bp, Homo sapiens
ctgtgtgtcatttgtcaatcct

SEQ ID NO: 7084193 - DNA, 22 bp, Homo sapiens
ctgtgtgtcatttgtcaatcct

SEQ ID NO: 7084194 - DNA, 22 bp, Homo sapiens
atcctgggcagttttgagtgct

SEQ ID NO: 7084195 - DNA, 18 bp, Homo sapiens
atcctgggccagtctttc

SEQ ID NO: 7084196 - DNA, 22 bp, Homo sapiens
atcctgggcagtgtgtcactct

SEQ ID NO: 7084197 - DNA, 22 bp, Homo sapiens
atcctgggcaaagtatgctgtc

SEQ ID NO: 7084198 - DNA, 22 bp, Homo sapiens
atcctgggcaagtcaatgtccc

SEQ ID NO: 7084199 - DNA, 22 bp, Homo sapiens
atcctgggctgcaccctcagcc

SEQ ID NO: 7084200 - DNA, 22 bp, Homo sapiens
atcctgggtaagttccttttaa

SEQ ID NO: 7084201 - DNA, 19 bp, Homo sapiens
atcctgggtcctccagctg

SEQ ID NO: 7084202 - DNA, 22 bp, Homo sapiens
atcctgggcctcagaggtgtgt

SEQ ID NO: 7084203 - DNA, 22 bp, Homo sapiens
atcctgggcctcagaggtgtgt

SEQ ID NO: 7084204 - DNA, 22 bp, Homo sapiens
atcctgggctgcaccctcagcc

SEQ ID NO: 7084205 - DNA, 22 bp, Homo sapiens
atcctgtagtctcacagcccca

SEQ ID NO: 7084206 - DNA, 19 bp, Homo sapiens
atcctgggtcctccagctg

SEQ ID NO: 7084207 - DNA, 22 bp, Homo sapiens
atcctgggtttgtgagtttatg

SEQ ID NO: 7084208 - DNA, 22 bp, Homo sapiens
ctgtgtgcaggtgctgggtacc

SEQ ID NO: 7084209 - DNA, 22 bp, Homo sapiens
ctgtgtgcatagttgtgctcaa

SEQ ID NO: 7084210 - DNA, 22 bp, Homo sapiens
ctgtgtgcatagttgtgctcaa

SEQ ID NO: 7084211 - DNA, 22 bp, Homo sapiens
ctgtgtgcctagagggtggccg

SEQ ID NO: 7084212 - DNA, 22 bp, Homo sapiens
ctgtgtgcctagagggtggccg

SEQ ID NO: 7084213 - DNA, 22 bp, Homo sapiens
ctgtgtgcagggcacaatggaa

SEQ ID NO: 7084214 - DNA, 22 bp, Homo sapiens
ctgtgtgcaacttgcagttttg

SEQ ID NO: 7084215 - DNA, 22 bp, Homo sapiens
atccagtgagtgcagctgttgt

SEQ ID NO: 7084216 - DNA, 22 bp, Homo sapiens
atccagtctggggtgctgcatg

SEQ ID NO: 7084217 - DNA, 22 bp, Homo sapiens
atccagtccatgacattctgtt

SEQ ID NO: 7084218 - DNA, 22 bp, Homo sapiens
atccagtcccacacatgctctg

SEQ ID NO: 7084219 - DNA, 22 bp, Homo sapiens
atccagggtgtggagagagctc

SEQ ID NO: 7084220 - DNA, 22 bp, Homo sapiens
atccagggtgtggagagagctc

SEQ ID NO: 7084221 - DNA, 22 bp, Homo sapiens
atccagtatctgtgatgggtta

SEQ ID NO: 7084222 - DNA, 22 bp, Homo sapiens
atccagggataaaagtaaggtt

SEQ ID NO: 7084223 - DNA, 22 bp, Homo sapiens
atccaggcttaatgggagccac

SEQ ID NO: 7084224 - DNA, 22 bp, Homo sapiens
atccaggcttaatgggagccac

SEQ ID NO: 7084225 - DNA, 22 bp, Homo sapiens
atccaggcttcagctgcctact

SEQ ID NO: 7084226 - DNA, 22 bp, Homo sapiens
atccaggctgctttctatgccc

SEQ ID NO: 7084227 - DNA, 22 bp, Homo sapiens
atccaggctgcgggtctcaagt

SEQ ID NO: 7084228 - DNA, 22 bp, Homo sapiens
atccaggcgaatgcagaaggcc

SEQ ID NO: 7084229 - DNA, 22 bp, Homo sapiens
atccaggctgcgggtctcaagt

SEQ ID NO: 7084230 - DNA, 22 bp, Homo sapiens
atccaggctgctatgaggatga

SEQ ID NO: 7084231 - DNA, 22 bp, Homo sapiens
atccaggctgctttctatgccc

SEQ ID NO: 7084232 - DNA, 22 bp, Homo sapiens
atccaggctggagtgcattggt

SEQ ID NO: 7084233 - DNA, 22 bp, Homo sapiens
atccaggctgggtgtggctact

SEQ ID NO: 7084234 - DNA, 22 bp, Homo sapiens
atccaggctgtctaatgggaga

SEQ ID NO: 7084235 - DNA, 22 bp, Homo sapiens
atccaggcctgagtctggtcct

SEQ ID NO: 7084236 - DNA, 22 bp, Homo sapiens
atccaggcctgagtctggtcct

SEQ ID NO: 7084237 - DNA, 22 bp, Homo sapiens
atccaggccccaagaccccgac

SEQ ID NO: 7084238 - DNA, 22 bp, Homo sapiens
atccaggccttgaagtaccagt

SEQ ID NO: 7084239 - DNA, 22 bp, Homo sapiens
atccaggcgaatgcagaaggcc

SEQ ID NO: 7084240 - DNA, 22 bp, Homo sapiens
atccaccctgtggtggctttct

SEQ ID NO: 7084241 - DNA, 22 bp, Homo sapiens
atccactccctaacaccatgtt

SEQ ID NO: 7084242 - DNA, 22 bp, Homo sapiens
atccactccctaacaccatgtt

SEQ ID NO: 7084243 - DNA, 22 bp, Homo sapiens
atccactcctggaggtgcccca

SEQ ID NO: 7084244 - DNA, 22 bp, Homo sapiens
atccactcggagggaatgttta

SEQ ID NO: 7084245 - DNA, 22 bp, Homo sapiens
agttatttaaaatgattgtcct

SEQ ID NO: 7084246 - DNA, 22 bp, Homo sapiens
agttatttaaaatgattgtcct

SEQ ID NO: 7084247 - DNA, 22 bp, Homo sapiens
agttatttaaaatgattgtcct

SEQ ID NO: 7084248 - DNA, 22 bp, Homo sapiens
agttatttaaaatgattgtcct

SEQ ID NO: 7084249 - DNA, 22 bp, Homo sapiens
agttatttactcctttgtctct

SEQ ID NO: 7084250 - DNA, 22 bp, Homo sapiens
agttatttaaaatgattgtcct

SEQ ID NO: 7084251 - DNA, 22 bp, Homo sapiens
agttatttactcctttgtctct

SEQ ID NO: 7084252 - DNA, 22 bp, Homo sapiens
agttatttactcctttgtctct

SEQ ID NO: 7084253 - DNA, 22 bp, Homo sapiens
agttattgagtatctataatgt

SEQ ID NO: 7084254 - DNA, 19 bp, Homo sapiens
agttattgatctattcagg

SEQ ID NO: 7084255 - DNA, 22 bp, Homo sapiens
agttatcatcccttacactttg

SEQ ID NO: 7084256 - DNA, 22 bp, Homo sapiens
agttatattccatagattcaga

SEQ ID NO: 7084257 - DNA, 22 bp, Homo sapiens
agttattactctttaacatatt

SEQ ID NO: 7084258 - DNA, 22 bp, Homo sapiens
agttattaagtcctgttttgag

SEQ ID NO: 7084259 - DNA, 22 bp, Homo sapiens
ctgaggagctgaaggccctcca

SEQ ID NO: 7084260 - DNA, 22 bp, Homo sapiens
agttatataactatctagatgc

SEQ ID NO: 7084261 - DNA, 22 bp, Homo sapiens
agttatattccatagattcaga

SEQ ID NO: 7084262 - DNA, 22 bp, Homo sapiens
ctgaggagcgttggtcacgtgt

SEQ ID NO: 7084263 - DNA, 22 bp, Homo sapiens
ctgaggagctgaaggccctcca

SEQ ID NO: 7084264 - DNA, 22 bp, Homo sapiens
ctgaggagccccctctcagcat

SEQ ID NO: 7084265 - DNA, 22 bp, Homo sapiens
ctgaggagcagctggcccgcta

SEQ ID NO: 7084266 - DNA, 22 bp, Homo sapiens
ctgaggagcagctggcccgcta

SEQ ID NO: 7084267 - DNA, 22 bp, Homo sapiens
ctgaggagcagctggcccgcta

SEQ ID NO: 7084268 - DNA, 22 bp, Homo sapiens
ctgaggagaggtggcctgtgtt

SEQ ID NO: 7084269 - DNA, 22 bp, Homo sapiens
ctgaggagcaaccccgtgccct

SEQ ID NO: 7084270 - DNA, 22 bp, Homo sapiens
ctgaggagcaaccccgtgccct

SEQ ID NO: 7084271 - DNA, 22 bp, Homo sapiens
ctgcaaatcaagttcttataat

SEQ ID NO: 7084272 - DNA, 22 bp, Homo sapiens
ctgcaaatcaagttcttataat

SEQ ID NO: 7084273 - DNA, 22 bp, Homo sapiens
ctgcaaatcaagttcttataat

SEQ ID NO: 7084274 - DNA, 22 bp, Homo sapiens
ctgcaaatccctactgggcaca

SEQ ID NO: 7084275 - DNA, 22 bp, Homo sapiens
ctgcaaatccctactgggcaca

SEQ ID NO: 7084276 - DNA, 22 bp, Homo sapiens
ctgcaaatccctactgggcaca

SEQ ID NO: 7084277 - DNA, 22 bp, Homo sapiens
ctgcaaatcctcagaaagggtt

SEQ ID NO: 7084278 - DNA, 22 bp, Homo sapiens
ctgcaaatcctcagaaagggtt

SEQ ID NO: 7084279 - DNA, 21 bp, Homo sapiens
ctgcaaatgcaaggtgaccag

SEQ ID NO: 7084280 - DNA, 21 bp, Homo sapiens
ctgcaaatgcaaggtgaccag

SEQ ID NO: 7084281 - DNA, 22 bp, Homo sapiens
ctgcaaatgccgtgagagcagg

SEQ ID NO: 7084282 - DNA, 22 bp, Homo sapiens
ctgcaaatgccgtgagagcagg

SEQ ID NO: 7084283 - DNA, 22 bp, Homo sapiens
ctgcaaatgcctcggtgtgcgg

SEQ ID NO: 7084284 - DNA, 22 bp, Homo sapiens
ctgcaaatgcctcggtgtgcgg

SEQ ID NO: 7084285 - DNA, 22 bp, Homo sapiens
ctgcaaatgcctcggtgtgcgg

SEQ ID NO: 7084286 - DNA, 22 bp, Homo sapiens
ctgcaaatgggctttaggtggc

SEQ ID NO: 7084287 - DNA, 22 bp, Homo sapiens
ctgcaaatgggctttaggtggc

SEQ ID NO: 7084288 - DNA, 21 bp, Homo sapiens
ctgcaaatgtaatgagtttgg

SEQ ID NO: 7084289 - DNA, 21 bp, Homo sapiens
ctgcaaatgtaatgagtttgg

SEQ ID NO: 7084290 - DNA, 22 bp, Homo sapiens
ctgcaaattggtggtgaggcaa

SEQ ID NO: 7084291 - DNA, 22 bp, Homo sapiens
ctgcaaattggtggtgaggcaa

SEQ ID NO: 7084292 - DNA, 22 bp, Homo sapiens
ctgcaaataggggtgtgaataa

SEQ ID NO: 7084293 - DNA, 21 bp, Homo sapiens
ctgatcccaaacctctgccct

SEQ ID NO: 7084294 - DNA, 22 bp, Homo sapiens
ctgatcccattggcagtccagt

SEQ ID NO: 7084295 - DNA, 22 bp, Homo sapiens
ctgatatttgcccaactgccct

SEQ ID NO: 7084296 - DNA, 22 bp, Homo sapiens
ctgatcatgtgggaggatatgt

SEQ ID NO: 7084297 - DNA, 22 bp, Homo sapiens
ctgatcattgttgttgctgtaa

SEQ ID NO: 7084298 - DNA, 22 bp, Homo sapiens
agttatttactcctttgtctct

SEQ ID NO: 7084299 - DNA, 22 bp, Homo sapiens
agttatttactcctttgtctct

SEQ ID NO: 7084300 - DNA, 22 bp, Homo sapiens
agttatttcagtaacataatag

SEQ ID NO: 7084301 - DNA, 22 bp, Homo sapiens
agttatttcagtaacataatag

SEQ ID NO: 7084302 - DNA, 22 bp, Homo sapiens
ctgcaatagtttagaataattg

SEQ ID NO: 7084303 - DNA, 22 bp, Homo sapiens
ctgcaatatgatgtctgagaaa

SEQ ID NO: 7084304 - DNA, 22 bp, Homo sapiens
ctgcaatatgatgtctgagaaa

SEQ ID NO: 7084305 - DNA, 23 bp, Homo sapiens
ctgcaaggtacaagatgctggat

SEQ ID NO: 7084306 - DNA, 23 bp, Homo sapiens
ctgcaaggtacaagatgctggat

SEQ ID NO: 7084307 - DNA, 22 bp, Homo sapiens
ctgcaaggtcatgactctctgg

SEQ ID NO: 7084308 - DNA, 22 bp, Homo sapiens
ctgcaagcaaatcaactctttg

SEQ ID NO: 7084309 - DNA, 21 bp, Homo sapiens
ctgcaagacatgctgttcttg

SEQ ID NO: 7084310 - DNA, 22 bp, Homo sapiens
ctgcaagccagggagagatgcc

SEQ ID NO: 7084311 - DNA, 22 bp, Homo sapiens
ctgcaagccagggagagatgcc

SEQ ID NO: 7084312 - DNA, 22 bp, Homo sapiens
ctgcaagctggtaataagcaga

SEQ ID NO: 7084313 - DNA, 22 bp, Homo sapiens
ctgcaagctggtaataagcaga

SEQ ID NO: 7084314 - DNA, 22 bp, Homo sapiens
ctgcagagagtgccgggcagcc

SEQ ID NO: 7084315 - DNA, 22 bp, Homo sapiens
ctgcagagagtgccgggcagcc

SEQ ID NO: 7084316 - DNA, 22 bp, Homo sapiens
ctgcagagatgaagaaggtggc

SEQ ID NO: 7084317 - DNA, 22 bp, Homo sapiens
ctgcagagagtgccgggcagcc

SEQ ID NO: 7084318 - DNA, 22 bp, Homo sapiens
ctgcagagagtaactgaaatat

SEQ ID NO: 7084319 - DNA, 22 bp, Homo sapiens
ctgcagagaattgtggggcttc

SEQ ID NO: 7084320 - DNA, 22 bp, Homo sapiens
ctgcagagacctaggtcaggtt

SEQ ID NO: 7084321 - DNA, 22 bp, Homo sapiens
ctgcagagacctaggtcaggtt

SEQ ID NO: 7084322 - DNA, 23 bp, Homo sapiens
ctgcagagaactgagggacagcc

SEQ ID NO: 7084323 - DNA, 23 bp, Homo sapiens
ctgcagagaactgagggacagcc

SEQ ID NO: 7084324 - DNA, 22 bp, Homo sapiens
ctgcagagcaagtaacatcctc

SEQ ID NO: 7084325 - DNA, 22 bp, Homo sapiens
ctgcagagatgaagaaggtggc

SEQ ID NO: 7084326 - DNA, 22 bp, Homo sapiens
ctgcagagcaagtaacatcctc

SEQ ID NO: 7084327 - DNA, 22 bp, Homo sapiens
ctgcagagatgaagaaggtggc

SEQ ID NO: 7084328 - DNA, 22 bp, Homo sapiens
ctgcagagcaagttctctgttg

SEQ ID NO: 7084329 - DNA, 22 bp, Homo sapiens
ctgcagggagaggggacagcct

SEQ ID NO: 7084330 - DNA, 22 bp, Homo sapiens
ctgcagggagaggggacagcct

SEQ ID NO: 7084331 - DNA, 22 bp, Homo sapiens
ctgcagggagaggggacagcct

SEQ ID NO: 7084332 - DNA, 22 bp, Homo sapiens
ctgcaggggctggagttggctt

SEQ ID NO: 7084333 - DNA, 20 bp, Homo sapiens
ctgcagggtgagtgggcgat

SEQ ID NO: 7084334 - DNA, 20 bp, Homo sapiens
ctgcagggtgagtgggcgat

SEQ ID NO: 7084335 - DNA, 20 bp, Homo sapiens
ctgcagggtgagtgggcgat

SEQ ID NO: 7084336 - DNA, 20 bp, Homo sapiens
ctgcagggttagaggctcca

SEQ ID NO: 7084337 - DNA, 22 bp, Homo sapiens
ctgcagggtgacgttgcccacc

SEQ ID NO: 7084338 - DNA, 22 bp, Homo sapiens
ctgcagggtgacgttgcccacc

SEQ ID NO: 7084339 - DNA, 22 bp, Homo sapiens
ctgcaggggtgtcctgtattgg

SEQ ID NO: 7084340 - DNA, 22 bp, Homo sapiens
ctgcaggggtgtcctgtattgg

SEQ ID NO: 7084341 - DNA, 22 bp, Homo sapiens
ctgcatgaagtcttttttatag

SEQ ID NO: 7084342 - DNA, 22 bp, Homo sapiens
ctgcatggtagggataagatgg

SEQ ID NO: 7084343 - DNA, 22 bp, Homo sapiens
ctgcatggttcaaatgagctaa

SEQ ID NO: 7084344 - DNA, 22 bp, Homo sapiens
ctgcatggttcaaatgagctaa

SEQ ID NO: 7084345 - DNA, 22 bp, Homo sapiens
ctgcatctctgctagtcagtca

SEQ ID NO: 7084346 - DNA, 22 bp, Homo sapiens
ctgcatctctgtgccagagggc

SEQ ID NO: 7084347 - DNA, 20 bp, Homo sapiens
ctgcatctgtgacttgcaaa

SEQ ID NO: 7084348 - DNA, 23 bp, Homo sapiens
ctgcatgtccactggtgtaaatg

SEQ ID NO: 7084349 - DNA, 22 bp, Homo sapiens
ctgcatgtgttatatttggttc

SEQ ID NO: 7084350 - DNA, 22 bp, Homo sapiens
ctgcatgtgtttctgctgggtt

SEQ ID NO: 7084351 - DNA, 22 bp, Homo sapiens
ctgcatgtgttatatttggttc

SEQ ID NO: 7084352 - DNA, 20 bp, Homo sapiens
ctgcatgttggaggtgtacc

SEQ ID NO: 7084353 - DNA, 22 bp, Homo sapiens
ctgcatgtttacatttttgaga

SEQ ID NO: 7084354 - DNA, 22 bp, Homo sapiens
ctgcatgttttcttaattgtga

SEQ ID NO: 7084355 - DNA, 20 bp, Homo sapiens
ctgcatgttggaggtgtacc

SEQ ID NO: 7084356 - DNA, 22 bp, Homo sapiens
ctgcattgatcaggcagaatct

SEQ ID NO: 7084357 - DNA, 22 bp, Homo sapiens
ctgcatcctaacctccatgcag

SEQ ID NO: 7084358 - DNA, 22 bp, Homo sapiens
ctgcatcctggaaatagctaag

SEQ ID NO: 7084359 - DNA, 22 bp, Homo sapiens
ctgcatcccagggagcaatggg

SEQ ID NO: 7084360 - DNA, 22 bp, Homo sapiens
ctgcagggttttaacaatggac

SEQ ID NO: 7084361 - DNA, 22 bp, Homo sapiens
ctgcagggttttaacaatggac

SEQ ID NO: 7084362 - DNA, 22 bp, Homo sapiens
ctgcagggtttcgccagttgtg

SEQ ID NO: 7084363 - DNA, 22 bp, Homo sapiens
ctgcagggtttcgccagttgtg

SEQ ID NO: 7084364 - DNA, 22 bp, Homo sapiens
ctgcagggttttaacaatggac

SEQ ID NO: 7084365 - DNA, 22 bp, Homo sapiens
ctgcagggtttttcaaggacaa

SEQ ID NO: 7084366 - DNA, 22 bp, Homo sapiens
ctgcagggtttttcaaggacaa

SEQ ID NO: 7084367 - DNA, 22 bp, Homo sapiens
ctgcagggtttcgccagttgtg

SEQ ID NO: 7084368 - DNA, 22 bp, Homo sapiens
ctgcagggtttcgccagttgtg

SEQ ID NO: 7084369 - DNA, 22 bp, Homo sapiens
ctgcagggtttcgccagttgtg

SEQ ID NO: 7084370 - DNA, 22 bp, Homo sapiens
ctgcagggttcggagagttccc

SEQ ID NO: 7084371 - DNA, 22 bp, Homo sapiens
ctgcagggttcggagagttccc

SEQ ID NO: 7084372 - DNA, 22 bp, Homo sapiens
ctgcagggtttcgccagttgtg

SEQ ID NO: 7084373 - DNA, 22 bp, Homo sapiens
ctgcagggtttcgccagttgtg

SEQ ID NO: 7084374 - DNA, 20 bp, Homo sapiens
ctgcagggttagaggctcca

SEQ ID NO: 7084375 - DNA, 20 bp, Homo sapiens
ctgcagggttagaggctcca

SEQ ID NO: 7084376 - DNA, 20 bp, Homo sapiens
ctgcagggttagaggctcca

SEQ ID NO: 7084377 - DNA, 20 bp, Homo sapiens
ctgcagggttagaggctcca

SEQ ID NO: 7084378 - DNA, 22 bp, Homo sapiens
ctgcagggttcggagagttccc

SEQ ID NO: 7084379 - DNA, 19 bp, Homo sapiens
ataactacattggctcagt

SEQ ID NO: 7084380 - DNA, 22 bp, Homo sapiens
ataacctggtagtattaaatgt

SEQ ID NO: 7084381 - DNA, 22 bp, Homo sapiens
ataacctggtagtattaaatgt

SEQ ID NO: 7084382 - DNA, 22 bp, Homo sapiens
ataaccttggctagtattgtgc

SEQ ID NO: 7084383 - DNA, 22 bp, Homo sapiens
ataaccttggctagtattgtgc

SEQ ID NO: 7084384 - DNA, 22 bp, Homo sapiens
ataacgaaggctgatgcgggat

SEQ ID NO: 7084385 - DNA, 22 bp, Homo sapiens
ataacctgagattgagctgcct

SEQ ID NO: 7084386 - DNA, 22 bp, Homo sapiens
ataacatgagccagattgaaag

SEQ ID NO: 7084387 - DNA, 22 bp, Homo sapiens
ataacatgacctgtgcttcaca

SEQ ID NO: 7084388 - DNA, 22 bp, Homo sapiens
ataacagatgcttcagcataaa

SEQ ID NO: 7084389 - DNA, 22 bp, Homo sapiens
ataacagatgtgaagtgctaat

SEQ ID NO: 7084390 - DNA, 22 bp, Homo sapiens
ataacagctcttaaacaccata

SEQ ID NO: 7084391 - DNA, 22 bp, Homo sapiens
ataacagatactctctgtgagg

SEQ ID NO: 7084392 - DNA, 22 bp, Homo sapiens
ataaattaggatctggggttcc

SEQ ID NO: 7084393 - DNA, 22 bp, Homo sapiens
ataaattatgaatggccctttt

SEQ ID NO: 7084394 - DNA, 22 bp, Homo sapiens
ataaattaggatctggggttcc

SEQ ID NO: 7084395 - DNA, 23 bp, Homo sapiens
ataaattactatctccctagagc

SEQ ID NO: 7084396 - DNA, 22 bp, Homo sapiens
ataaattaggatctggggttcc

SEQ ID NO: 7084397 - DNA, 22 bp, Homo sapiens
ataaatgtgaaatgagcagtta

SEQ ID NO: 7084398 - DNA, 22 bp, Homo sapiens
ataaatgtgaaatgagcagtta

SEQ ID NO: 7084399 - DNA, 22 bp, Homo sapiens
ataaatgtgaattagagctttg

SEQ ID NO: 7084400 - DNA, 22 bp, Homo sapiens
ataaatgtgaattagagctttg

SEQ ID NO: 7084401 - DNA, 22 bp, Homo sapiens
ataaatgtgaattagagctttg

SEQ ID NO: 7084402 - DNA, 22 bp, Homo sapiens
ataaatgtttgttgaatgaata

SEQ ID NO: 7084403 - DNA, 22 bp, Homo sapiens
ataaatgtttgttgaatgaata

SEQ ID NO: 7084404 - DNA, 23 bp, Homo sapiens
ataaattactatctccctagagc

SEQ ID NO: 7084405 - DNA, 23 bp, Homo sapiens
ataaattactatctccctagagc

SEQ ID NO: 7084406 - DNA, 22 bp, Homo sapiens
ataaatgattcagcaggaaata

SEQ ID NO: 7084407 - DNA, 22 bp, Homo sapiens
ataaatgcctcagaatcatccc

SEQ ID NO: 7084408 - DNA, 22 bp, Homo sapiens
ataaatgcctcagaatcatccc

SEQ ID NO: 7084409 - DNA, 22 bp, Homo sapiens
ataaatgattcagcaggaaata

SEQ ID NO: 7084410 - DNA, 22 bp, Homo sapiens
ataaatgattcagcaggaaata

SEQ ID NO: 7084411 - DNA, 22 bp, Homo sapiens
ataaatgaacattcacagagct

SEQ ID NO: 7084412 - DNA, 22 bp, Homo sapiens
ataaatgaacattcacagagct

SEQ ID NO: 7084413 - DNA, 22 bp, Homo sapiens
ataaatgattcagcaggaaata

SEQ ID NO: 7084414 - DNA, 22 bp, Homo sapiens
ctgcctctgcgtcccacagagt

SEQ ID NO: 7084415 - DNA, 22 bp, Homo sapiens
ctgcctctgcgtcccacagagt

SEQ ID NO: 7084416 - DNA, 22 bp, Homo sapiens
ctgcctctggcctcaggcccag

SEQ ID NO: 7084417 - DNA, 22 bp, Homo sapiens
ctgcctctggcctcaggcccag

SEQ ID NO: 7084418 - DNA, 22 bp, Homo sapiens
ataaatctcttaagactcaaca

SEQ ID NO: 7084419 - DNA, 22 bp, Homo sapiens
ataaatgaacattcacagagct

SEQ ID NO: 7084420 - DNA, 22 bp, Homo sapiens
ataaatgaacattcacagagct

SEQ ID NO: 7084421 - DNA, 22 bp, Homo sapiens
ctgcctctccccagagtggccc

SEQ ID NO: 7084422 - DNA, 22 bp, Homo sapiens
ctgcctctgcgtcccacagagt

SEQ ID NO: 7084423 - DNA, 22 bp, Homo sapiens
ctgcctctcaggtccctgagat

SEQ ID NO: 7084424 - DNA, 22 bp, Homo sapiens
ctgcctctcaggtccctgagat

SEQ ID NO: 7084425 - DNA, 22 bp, Homo sapiens
ctgcctctccccagagtggccc

SEQ ID NO: 7084426 - DNA, 22 bp, Homo sapiens
ctgcctctcagcctgaccgcca

SEQ ID NO: 7084427 - DNA, 22 bp, Homo sapiens
ctgcctctcaggtccctgagat

SEQ ID NO: 7084428 - DNA, 22 bp, Homo sapiens
ctgcctctcagcctgaccgcca

SEQ ID NO: 7084429 - DNA, 22 bp, Homo sapiens
ctgcctctattcactgaggcag

SEQ ID NO: 7084430 - DNA, 22 bp, Homo sapiens
ctgcctctcagcctgaccgcca

SEQ ID NO: 7084431 - DNA, 22 bp, Homo sapiens
ctgcctctcagcctgaccgcca

SEQ ID NO: 7084432 - DNA, 22 bp, Homo sapiens
ctgcatttcacatttaaacttt

SEQ ID NO: 7084433 - DNA, 23 bp, Homo sapiens
ctgcattgtctcctgggagcatg

SEQ ID NO: 7084434 - DNA, 22 bp, Homo sapiens
ctgccctgtttggacagcccgg

SEQ ID NO: 7084435 - DNA, 20 bp, Homo sapiens
ctgccgaccacagccatgga

SEQ ID NO: 7084436 - DNA, 22 bp, Homo sapiens
ataagagctacagccagttctg

SEQ ID NO: 7084437 - DNA, 17 bp, Homo sapiens
ataagacagaagacaat

SEQ ID NO: 7084438 - DNA, 17 bp, Homo sapiens
ataagacagaagacaat

SEQ ID NO: 7084439 - DNA, 17 bp, Homo sapiens
ataagacagaagacaat

SEQ ID NO: 7084440 - DNA, 22 bp, Homo sapiens
ataagaataattaagttagtcc

SEQ ID NO: 7084441 - DNA, 22 bp, Homo sapiens
ataagacacgcaaataggtacg

SEQ ID NO: 7084442 - DNA, 22 bp, Homo sapiens
ataagacacgcaaataggtacg

SEQ ID NO: 7084443 - DNA, 22 bp, Homo sapiens
ataagacacgccccactcactc

SEQ ID NO: 7084444 - DNA, 22 bp, Homo sapiens
ataagaaacattattctttcca

SEQ ID NO: 7084445 - DNA, 22 bp, Homo sapiens
ataagaataattaagttagtcc

SEQ ID NO: 7084446 - DNA, 22 bp, Homo sapiens
ataagaataattaagttagtcc

SEQ ID NO: 7084447 - DNA, 22 bp, Homo sapiens
ataacttaatgggtcatgctct

SEQ ID NO: 7084448 - DNA, 23 bp, Homo sapiens
ataactgagccgaggcttaagaa

SEQ ID NO: 7084449 - DNA, 22 bp, Homo sapiens
ataacttagagtaggcaaaagt

SEQ ID NO: 7084450 - DNA, 22 bp, Homo sapiens
ataacttcagggctgtgacaga

SEQ ID NO: 7084451 - DNA, 22 bp, Homo sapiens
ataacttgatgttatttgtcca

SEQ ID NO: 7084452 - DNA, 23 bp, Homo sapiens
ataagaaaacagtaggctcagag

SEQ ID NO: 7084453 - DNA, 22 bp, Homo sapiens
ataagaggaattacagaagagg

SEQ ID NO: 7084454 - DNA, 22 bp, Homo sapiens
ataagaggaattacagaagagg

SEQ ID NO: 7084455 - DNA, 22 bp, Homo sapiens
ataagagctatggtgggagttg

SEQ ID NO: 7084456 - DNA, 22 bp, Homo sapiens
ataagagtcttgttttcttatt

SEQ ID NO: 7084457 - DNA, 22 bp, Homo sapiens
ataagatataaatccacagagt

SEQ ID NO: 7084458 - DNA, 22 bp, Homo sapiens
ataagatgagatcagctttctg

SEQ ID NO: 7084459 - DNA, 22 bp, Homo sapiens
ataagattgtcatagtatggac

SEQ ID NO: 7084460 - DNA, 21 bp, Homo sapiens
ataagcatgctgattacattt

SEQ ID NO: 7084461 - DNA, 21 bp, Homo sapiens
ataagcatgctgattacattt

SEQ ID NO: 7084462 - DNA, 21 bp, Homo sapiens
ataagcatgctgattacattt

SEQ ID NO: 7084463 - DNA, 22 bp, Homo sapiens
ataatttactaagctctacctt

SEQ ID NO: 7084464 - DNA, 22 bp, Homo sapiens
ataatttactaagctctacctt

SEQ ID NO: 7084465 - DNA, 22 bp, Homo sapiens
ataatttactaagctctacctt

SEQ ID NO: 7084466 - DNA, 22 bp, Homo sapiens
ataatttggcttcctagatgta

SEQ ID NO: 7084467 - DNA, 22 bp, Homo sapiens
ataatttactaagctctacctt

SEQ ID NO: 7084468 - DNA, 22 bp, Homo sapiens
atacaaagctaaatatggtttc

SEQ ID NO: 7084469 - DNA, 22 bp, Homo sapiens
atacaaagctaaatatggtttc

SEQ ID NO: 7084470 - DNA, 17 bp, Homo sapiens
atacaaagccataaacc

SEQ ID NO: 7084471 - DNA, 22 bp, Homo sapiens
atacaaagctttctgtctggta

SEQ ID NO: 7084472 - DNA, 22 bp, Homo sapiens
atacaaagctaaatatggtttc

SEQ ID NO: 7084473 - DNA, 22 bp, Homo sapiens
ctgctgcaactctttagagggt

SEQ ID NO: 7084474 - DNA, 22 bp, Homo sapiens
ctgctgaggtatactatgtgac

SEQ ID NO: 7084475 - DNA, 22 bp, Homo sapiens
ctgctgaggtatactatgtgac

SEQ ID NO: 7084476 - DNA, 22 bp, Homo sapiens
ctgctgaggtggagattgcagt

SEQ ID NO: 7084477 - DNA, 22 bp, Homo sapiens
ctgctgagcctggtgcgggatg

SEQ ID NO: 7084478 - DNA, 22 bp, Homo sapiens
ctgctgaggccttccctgtcct

SEQ ID NO: 7084479 - DNA, 22 bp, Homo sapiens
ctgctgaggctccggaccaagt

SEQ ID NO: 7084480 - DNA, 22 bp, Homo sapiens
ctgctgaggggaggaaagacgg

SEQ ID NO: 7084481 - DNA, 22 bp, Homo sapiens
ctgctgaggggaggaaagacgg

SEQ ID NO: 7084482 - DNA, 22 bp, Homo sapiens
ctgctgaggtatactatgtgac

SEQ ID NO: 7084483 - DNA, 22 bp, Homo sapiens
ctgctgaggtatactatgtgac

SEQ ID NO: 7084484 - DNA, 22 bp, Homo sapiens
atacaactgccttagaaggaaa

SEQ ID NO: 7084485 - DNA, 22 bp, Homo sapiens
atacaactgctctcagataagt

SEQ ID NO: 7084486 - DNA, 22 bp, Homo sapiens
atacaactttacatgcaattcc

SEQ ID NO: 7084487 - DNA, 22 bp, Homo sapiens
atacaactttatctgtaatgag

SEQ ID NO: 7084488 - DNA, 22 bp, Homo sapiens
atacaaatttatagatgcattt

SEQ ID NO: 7084489 - DNA, 22 bp, Homo sapiens
atacaaatttatagatgcattt

SEQ ID NO: 7084490 - DNA, 22 bp, Homo sapiens
atacaaattataggccccatcc

SEQ ID NO: 7084491 - DNA, 22 bp, Homo sapiens
atacaacagaaaatgattattc

SEQ ID NO: 7084492 - DNA, 22 bp, Homo sapiens
atacaactgccttagaaggaaa

SEQ ID NO: 7084493 - DNA, 22 bp, Homo sapiens
atacaacagaaaatgattattc

SEQ ID NO: 7084494 - DNA, 22 bp, Homo sapiens
atacaacagaaaatgattattc

SEQ ID NO: 7084495 - DNA, 22 bp, Homo sapiens
atacaacagaaaatgattattc

SEQ ID NO: 7084496 - DNA, 22 bp, Homo sapiens
atacaacagaaaatgattattc

SEQ ID NO: 7084497 - DNA, 22 bp, Homo sapiens
atacaaagtattaatcctggat

SEQ ID NO: 7084498 - DNA, 22 bp, Homo sapiens
atacaaagtattgatcctgagt

SEQ ID NO: 7084499 - DNA, 22 bp, Homo sapiens
atacaaatcctctgggatggta

SEQ ID NO: 7084500 - DNA, 22 bp, Homo sapiens
atacaaattataggccccatcc

SEQ ID NO: 7084501 - DNA, 22 bp, Homo sapiens
atacaaagtattaatcctggat

SEQ ID NO: 7084502 - DNA, 22 bp, Homo sapiens
atacaaagtattaatcctggat

SEQ ID NO: 7084503 - DNA, 22 bp, Homo sapiens
atacaaaggaacacaggcatgt

SEQ ID NO: 7084504 - DNA, 22 bp, Homo sapiens
atacaaagtattaatcctggat

SEQ ID NO: 7084505 - DNA, 22 bp, Homo sapiens
atacaaaggaacacaggcatgt

SEQ ID NO: 7084506 - DNA, 22 bp, Homo sapiens
atacaaaggaacacaggcatgt

SEQ ID NO: 7084507 - DNA, 22 bp, Homo sapiens
atacaaagctttctgtctggta

SEQ ID NO: 7084508 - DNA, 22 bp, Homo sapiens
atacaaagctttctgtctggta

SEQ ID NO: 7084509 - DNA, 22 bp, Homo sapiens
atacaaaggaacacaggcatgt

SEQ ID NO: 7084510 - DNA, 22 bp, Homo sapiens
ctggctggccatgtagagatga

SEQ ID NO: 7084511 - DNA, 22 bp, Homo sapiens
ctggctggccatgtagagatga

SEQ ID NO: 7084512 - DNA, 22 bp, Homo sapiens
ctggctggccggagcgaggcgg

SEQ ID NO: 7084513 - DNA, 22 bp, Homo sapiens
ctggctggccggagcgaggcgg

SEQ ID NO: 7084514 - DNA, 22 bp, Homo sapiens
ctggctggccggagcgaggcgg

SEQ ID NO: 7084515 - DNA, 22 bp, Homo sapiens
ctggctggcagatgctcttgct

SEQ ID NO: 7084516 - DNA, 22 bp, Homo sapiens
ctggctggcagatgctcttgct

SEQ ID NO: 7084517 - DNA, 22 bp, Homo sapiens
ctggctggccatgcagcgccag

SEQ ID NO: 7084518 - DNA, 22 bp, Homo sapiens
ctggctggccatgcagcgccag

SEQ ID NO: 7084519 - DNA, 22 bp, Homo sapiens
ctggctggccatgcagcgccag

SEQ ID NO: 7084520 - DNA, 19 bp, Homo sapiens
atagcagctatacccagat

SEQ ID NO: 7084521 - DNA, 22 bp, Homo sapiens
atagcagggatgtcagcaagta

SEQ ID NO: 7084522 - DNA, 22 bp, Homo sapiens
atagcagtaacactgacatttt

SEQ ID NO: 7084523 - DNA, 19 bp, Homo sapiens
ctggctgcaatgccagggt

SEQ ID NO: 7084524 - DNA, 22 bp, Homo sapiens
ctggctgcagctccgaggaaga

SEQ ID NO: 7084525 - DNA, 22 bp, Homo sapiens
ctggctgcagctccgaggaaga

SEQ ID NO: 7084526 - DNA, 22 bp, Homo sapiens
ctggctgcaggaaggagtgggc

SEQ ID NO: 7084527 - DNA, 22 bp, Homo sapiens
ctggctgcaggaaggagtgggc

SEQ ID NO: 7084528 - DNA, 22 bp, Homo sapiens
ctggctgcaggaaggagtgggc

SEQ ID NO: 7084529 - DNA, 22 bp, Homo sapiens
ctggctggcaagtagaacacaa

SEQ ID NO: 7084530 - DNA, 22 bp, Homo sapiens
atagcaatggcaacaactaagc

SEQ ID NO: 7084531 - DNA, 22 bp, Homo sapiens
atagcaatcagtgtatttgaaa

SEQ ID NO: 7084532 - DNA, 22 bp, Homo sapiens
atagcaatcagtgtatttgaaa

SEQ ID NO: 7084533 - DNA, 22 bp, Homo sapiens
atagcaatgatcaagacagaca

SEQ ID NO: 7084534 - DNA, 22 bp, Homo sapiens
atagcaaatattttaatgagca

SEQ ID NO: 7084535 - DNA, 22 bp, Homo sapiens
atagcaaattctttaggtgctt

SEQ ID NO: 7084536 - DNA, 22 bp, Homo sapiens
atagcaagcgttcccaagccac

SEQ ID NO: 7084537 - DNA, 22 bp, Homo sapiens
atagcaatttgcccaattacct

SEQ ID NO: 7084538 - DNA, 22 bp, Homo sapiens
atagcacaatattacctttatg

SEQ ID NO: 7084539 - DNA, 22 bp, Homo sapiens
atagcacatcactccagtgagt

SEQ ID NO: 7084540 - DNA, 22 bp, Homo sapiens
atagcaccatgactaaacaatt

SEQ ID NO: 7084541 - DNA, 22 bp, Homo sapiens
atagcactggtttttcttggtt

SEQ ID NO: 7084542 - DNA, 22 bp, Homo sapiens
atagcagaaaccaagcttcttc

SEQ ID NO: 7084543 - DNA, 22 bp, Homo sapiens
atagcagcatttcttccaagga

SEQ ID NO: 7084544 - DNA, 22 bp, Homo sapiens
ctggctccattactcagcatct

SEQ ID NO: 7084545 - DNA, 22 bp, Homo sapiens
ctggctccattactcagcatct

SEQ ID NO: 7084546 - DNA, 22 bp, Homo sapiens
ctggctccatccttgagctctg

SEQ ID NO: 7084547 - DNA, 22 bp, Homo sapiens
ctggctccatccttgagctctg

SEQ ID NO: 7084548 - DNA, 22 bp, Homo sapiens
ctggctccatctttgcttcctg

SEQ ID NO: 7084549 - DNA, 22 bp, Homo sapiens
ctggctcacaggtgagatgcat

SEQ ID NO: 7084550 - DNA, 22 bp, Homo sapiens
ctggctcacaggtgagatgcat

SEQ ID NO: 7084551 - DNA, 22 bp, Homo sapiens
ctggctcacaggtgagatgcat

SEQ ID NO: 7084552 - DNA, 22 bp, Homo sapiens
ctggctcacctccgctccagca

SEQ ID NO: 7084553 - DNA, 22 bp, Homo sapiens
ctggctccatcactgggtgatg

SEQ ID NO: 7084554 - DNA, 22 bp, Homo sapiens
ctggctccatcctaggcaaatg

SEQ ID NO: 7084555 - DNA, 22 bp, Homo sapiens
ctggctcccgtctggtggccat

SEQ ID NO: 7084556 - DNA, 22 bp, Homo sapiens
ctggctcccgtctggtggccat

SEQ ID NO: 7084557 - DNA, 22 bp, Homo sapiens
ctggctcccgaagccctcagtg

SEQ ID NO: 7084558 - DNA, 22 bp, Homo sapiens
ctggctcccgaagccctcagtg

SEQ ID NO: 7084559 - DNA, 22 bp, Homo sapiens
atagcaaatattttaatgagca

SEQ ID NO: 7084560 - DNA, 22 bp, Homo sapiens
ctggctccctcgctgaggtgct

SEQ ID NO: 7084561 - DNA, 22 bp, Homo sapiens
ctggctcccgttgtccttgaag

SEQ ID NO: 7084562 - DNA, 22 bp, Homo sapiens
ctggctccctcgctgaggtgct

SEQ ID NO: 7084563 - DNA, 22 bp, Homo sapiens
ctggctccctcgctgaggtgct

SEQ ID NO: 7084564 - DNA, 22 bp, Homo sapiens
ctggctcccatgagctctcacg

SEQ ID NO: 7084565 - DNA, 22 bp, Homo sapiens
ctggctcccatgagctctcacg

SEQ ID NO: 7084566 - DNA, 22 bp, Homo sapiens
ctggctcccatgagctctcacg

SEQ ID NO: 7084567 - DNA, 22 bp, Homo sapiens
ctggctcccctacttcttattg

SEQ ID NO: 7084568 - DNA, 22 bp, Homo sapiens
ctggctcccgaagccctcagtg

SEQ ID NO: 7084569 - DNA, 22 bp, Homo sapiens
ctggctcccgaagccctcagtg

SEQ ID NO: 7084570 - DNA, 22 bp, Homo sapiens
ctggctcccgaagccctcagtg

SEQ ID NO: 7084571 - DNA, 22 bp, Homo sapiens
atactacatactatgtaaacat

SEQ ID NO: 7084572 - DNA, 22 bp, Homo sapiens
atactacatactatgtaaacat

SEQ ID NO: 7084573 - DNA, 22 bp, Homo sapiens
atactacactatgcatggatgt

SEQ ID NO: 7084574 - DNA, 22 bp, Homo sapiens
atactacacattgactatattt

SEQ ID NO: 7084575 - DNA, 22 bp, Homo sapiens
atactacactatgcatggatgt

SEQ ID NO: 7084576 - DNA, 22 bp, Homo sapiens
atactacatcacagccaagaag

SEQ ID NO: 7084577 - DNA, 21 bp, Homo sapiens
atactacatttctctgacttt

SEQ ID NO: 7084578 - DNA, 22 bp, Homo sapiens
atactacatttgaaaattgcag

SEQ ID NO: 7084579 - DNA, 22 bp, Homo sapiens
atactacacattgactatattt

SEQ ID NO: 7084580 - DNA, 22 bp, Homo sapiens
atactacacattgactatattt

SEQ ID NO: 7084581 - DNA, 22 bp, Homo sapiens
atactacaatcataattgtaca

SEQ ID NO: 7084582 - DNA, 22 bp, Homo sapiens
atactacaatcataattgtaca

SEQ ID NO: 7084583 - DNA, 22 bp, Homo sapiens
atactaaagtatagaacttagt

SEQ ID NO: 7084584 - DNA, 22 bp, Homo sapiens
atagagctataagaattttgtg

SEQ ID NO: 7084585 - DNA, 19 bp, Homo sapiens
atagagacagagtttaatc

SEQ ID NO: 7084586 - DNA, 22 bp, Homo sapiens
atagagactatagagcacttac

SEQ ID NO: 7084587 - DNA, 22 bp, Homo sapiens
atagagatgggtttagttataa

SEQ ID NO: 7084588 - DNA, 22 bp, Homo sapiens
atagagatgggtttagttataa

SEQ ID NO: 7084589 - DNA, 22 bp, Homo sapiens
atagagatgggtttagttataa

SEQ ID NO: 7084590 - DNA, 23 bp, Homo sapiens
atagactgatttggatgtgaaag

SEQ ID NO: 7084591 - DNA, 22 bp, Homo sapiens
atagacttgaggatataatgaa

SEQ ID NO: 7084592 - DNA, 22 bp, Homo sapiens
atagacttggttagtaaatttg

SEQ ID NO: 7084593 - DNA, 22 bp, Homo sapiens
atagattatttgctcattactt

SEQ ID NO: 7084594 - DNA, 22 bp, Homo sapiens
atagattatttgctcattactt

SEQ ID NO: 7084595 - DNA, 22 bp, Homo sapiens
atagattagccctatagtttta

SEQ ID NO: 7084596 - DNA, 22 bp, Homo sapiens
atagcaaaaatgaacaaagctt

SEQ ID NO: 7084597 - DNA, 22 bp, Homo sapiens
atagcaaaaatgaacaaagctt

SEQ ID NO: 7084598 - DNA, 22 bp, Homo sapiens
atagcaaaaatgaacaaagctt

SEQ ID NO: 7084599 - DNA, 22 bp, Homo sapiens
atagatttgaatttaagacttg

SEQ ID NO: 7084600 - DNA, 22 bp, Homo sapiens
atagatttgaatttaagacttg

SEQ ID NO: 7084601 - DNA, 22 bp, Homo sapiens
atagatttgaatttaagacttg

SEQ ID NO: 7084602 - DNA, 22 bp, Homo sapiens
atagatttgaatttaagacttg

SEQ ID NO: 7084603 - DNA, 22 bp, Homo sapiens
ctggcccctgtggctaaaatca

SEQ ID NO: 7084604 - DNA, 22 bp, Homo sapiens
ctggccccggttcctaaaaacc

SEQ ID NO: 7084605 - DNA, 22 bp, Homo sapiens
ctggcccccacacctgtcaggg

SEQ ID NO: 7084606 - DNA, 22 bp, Homo sapiens
ctggcccccacacctgtcaggg

SEQ ID NO: 7084607 - DNA, 22 bp, Homo sapiens
ctggcccccacacctgtcaggg

SEQ ID NO: 7084608 - DNA, 22 bp, Homo sapiens
ctggcccccacacctgtcaggg

SEQ ID NO: 7084609 - DNA, 22 bp, Homo sapiens
ctggcccccacacctgtcaggg

SEQ ID NO: 7084610 - DNA, 22 bp, Homo sapiens
ctggccccatctggagtctgag

SEQ ID NO: 7084611 - DNA, 22 bp, Homo sapiens
ctggccccaggcagcctgctgg

SEQ ID NO: 7084612 - DNA, 22 bp, Homo sapiens
ctggccccaggcagcctgctgg

SEQ ID NO: 7084613 - DNA, 22 bp, Homo sapiens
ctggccccaggcagcctgctgg

SEQ ID NO: 7084614 - DNA, 22 bp, Homo sapiens
ctggccccagagtttcacttgg

SEQ ID NO: 7084615 - DNA, 22 bp, Homo sapiens
ctggcccatggtgagctctggg

SEQ ID NO: 7084616 - DNA, 22 bp, Homo sapiens
ctggcccattgccttctctctc

SEQ ID NO: 7084617 - DNA, 22 bp, Homo sapiens
ctggcccatggtgagctctggg

SEQ ID NO: 7084618 - DNA, 20 bp, Homo sapiens
ctggcccatctaccgctctg

SEQ ID NO: 7084619 - DNA, 22 bp, Homo sapiens
ctggcccatggtgagctctggg

SEQ ID NO: 7084620 - DNA, 22 bp, Homo sapiens
ctggcccatggtgagctctggg

SEQ ID NO: 7084621 - DNA, 22 bp, Homo sapiens
ctggcccatggtgagctctggg

SEQ ID NO: 7084622 - DNA, 22 bp, Homo sapiens
atagcaaaggacaatagtcagt

SEQ ID NO: 7084623 - DNA, 22 bp, Homo sapiens
atagcaaaggacaatagtcagt

SEQ ID NO: 7084624 - DNA, 22 bp, Homo sapiens
atagcaaagcctggcacaatga

SEQ ID NO: 7084625 - DNA, 22 bp, Homo sapiens
atagcaaagcctggcacaatga

SEQ ID NO: 7084626 - DNA, 22 bp, Homo sapiens
atagcaaagcctggcacaatga

SEQ ID NO: 7084627 - DNA, 22 bp, Homo sapiens
atagcaaaggacaatagtcagt

SEQ ID NO: 7084628 - DNA, 22 bp, Homo sapiens
atagcaaaggacaatagtcagt

SEQ ID NO: 7084629 - DNA, 22 bp, Homo sapiens
atagcaaactggcagcttgtgg

SEQ ID NO: 7084630 - DNA, 22 bp, Homo sapiens
atagcaaaaggcaccagagtga

SEQ ID NO: 7084631 - DNA, 22 bp, Homo sapiens
atagcaaactggagcttgcttt

SEQ ID NO: 7084632 - DNA, 22 bp, Homo sapiens
atagcaaaagcatgtgcaatac

SEQ ID NO: 7084633 - DNA, 22 bp, Homo sapiens
atagcaaaacccactgcattac

SEQ ID NO: 7084634 - DNA, 22 bp, Homo sapiens
atagcaaaagcatgtgcaatac

SEQ ID NO: 7084635 - DNA, 22 bp, Homo sapiens
atagcaaaagcatgtgcaatac

SEQ ID NO: 7084636 - DNA, 22 bp, Homo sapiens
atacatacgtacatacgtatgt

SEQ ID NO: 7084637 - DNA, 22 bp, Homo sapiens
atacatacgtacatacgtatgt

SEQ ID NO: 7084638 - DNA, 22 bp, Homo sapiens
atacatacatgtatgcacatac

SEQ ID NO: 7084639 - DNA, 22 bp, Homo sapiens
atacatacatgtatgcacatac

SEQ ID NO: 7084640 - DNA, 22 bp, Homo sapiens
atacagttatagtcagggctaa

SEQ ID NO: 7084641 - DNA, 17 bp, Homo sapiens
atacagtttattttaca

SEQ ID NO: 7084642 - DNA, 23 bp, Homo sapiens
atacatacagtcttactgacttt

SEQ ID NO: 7084643 - DNA, 22 bp, Homo sapiens
atacatacatgtacacataaat

SEQ ID NO: 7084644 - DNA, 22 bp, Homo sapiens
atacatacatgtatgcacatac

SEQ ID NO: 7084645 - DNA, 22 bp, Homo sapiens
atacatacatgtatgcacatac

SEQ ID NO: 7084646 - DNA, 22 bp, Homo sapiens
atacagtattacctgttcagga

SEQ ID NO: 7084647 - DNA, 22 bp, Homo sapiens
atacagtataactaataaaccc

SEQ ID NO: 7084648 - DNA, 22 bp, Homo sapiens
atacagtggctgtgagctgggc

SEQ ID NO: 7084649 - DNA, 22 bp, Homo sapiens
atacagtggctgtgagctgggc

SEQ ID NO: 7084650 - DNA, 22 bp, Homo sapiens
atacagtcagactttagccatt

SEQ ID NO: 7084651 - DNA, 22 bp, Homo sapiens
atacagtcttcatattaagttt

SEQ ID NO: 7084652 - DNA, 21 bp, Homo sapiens
atacattctattaagcattta

SEQ ID NO: 7084653 - DNA, 22 bp, Homo sapiens
atacattcctactgactagcta

SEQ ID NO: 7084654 - DNA, 22 bp, Homo sapiens
atacattcagcagtgctcatga

SEQ ID NO: 7084655 - DNA, 22 bp, Homo sapiens
atacattgagttttgatgttct

SEQ ID NO: 7084656 - DNA, 22 bp, Homo sapiens
atacattgagttttgatgttct

SEQ ID NO: 7084657 - DNA, 17 bp, Homo sapiens
atacattgttaaagtat

SEQ ID NO: 7084658 - DNA, 22 bp, Homo sapiens
ataccaaagcacatactgtttg

SEQ ID NO: 7084659 - DNA, 22 bp, Homo sapiens
ataccaaagcacatactgtttg

SEQ ID NO: 7084660 - DNA, 22 bp, Homo sapiens
ataccaaagcacatactgtttg

SEQ ID NO: 7084661 - DNA, 22 bp, Homo sapiens
ataccaattagagtttgttgca

SEQ ID NO: 7084662 - DNA, 22 bp, Homo sapiens
ataccacaacatggctcagagg

SEQ ID NO: 7084663 - DNA, 22 bp, Homo sapiens
ataccacaacatggctcagagg

SEQ ID NO: 7084664 - DNA, 22 bp, Homo sapiens
atacatgttcgtgtacatgttc

SEQ ID NO: 7084665 - DNA, 22 bp, Homo sapiens
atacatatatggtacttcctgg

SEQ ID NO: 7084666 - DNA, 22 bp, Homo sapiens
atacatatatggtacttcctgg

SEQ ID NO: 7084667 - DNA, 20 bp, Homo sapiens
ataccagagtacagtttatg

SEQ ID NO: 7084668 - DNA, 22 bp, Homo sapiens
ataccacaacatggctcagagg

SEQ ID NO: 7084669 - DNA, 22 bp, Homo sapiens
ataccatttatcaagtacagtg

SEQ ID NO: 7084670 - DNA, 22 bp, Homo sapiens
ataccatttccatgttacatta

SEQ ID NO: 7084671 - DNA, 21 bp, Homo sapiens
ataccatttgccaaaaggatc

SEQ ID NO: 7084672 - DNA, 22 bp, Homo sapiens
ataccctttacaggaacagcaa

SEQ ID NO: 7084673 - DNA, 22 bp, Homo sapiens
atacctctgcttgttttttagt

SEQ ID NO: 7084674 - DNA, 22 bp, Homo sapiens
atacctctggcactcaagactt

SEQ ID NO: 7084675 - DNA, 22 bp, Homo sapiens
ataccttttagacatgtagttg

SEQ ID NO: 7084676 - DNA, 22 bp, Homo sapiens
atacgcataatgtttattcctg

SEQ ID NO: 7084677 - DNA, 22 bp, Homo sapiens
atactaaagtatagaacttagt

SEQ ID NO: 7084678 - DNA, 22 bp, Homo sapiens
atactaaagtatagaacttagt

SEQ ID NO: 7084679 - DNA, 22 bp, Homo sapiens
atacctgtgtatccacaagcgt

SEQ ID NO: 7084680 - DNA, 22 bp, Homo sapiens
ataccttttactcattatccat

SEQ ID NO: 7084681 - DNA, 22 bp, Homo sapiens
ctggaataaacgatcttcagca

SEQ ID NO: 7084682 - DNA, 22 bp, Homo sapiens
ctggaataaacgatcttcagca

SEQ ID NO: 7084683 - DNA, 22 bp, Homo sapiens
ctggaagtggggttggcttgaa

SEQ ID NO: 7084684 - DNA, 22 bp, Homo sapiens
ctggaagttggaactgatatga

SEQ ID NO: 7084685 - DNA, 22 bp, Homo sapiens
ctggaagtggggttggcttgaa

SEQ ID NO: 7084686 - DNA, 22 bp, Homo sapiens
ctggaagagcatttgcataggg

SEQ ID NO: 7084687 - DNA, 22 bp, Homo sapiens
ctggaagactcaatggcctgcc

SEQ ID NO: 7084688 - DNA, 22 bp, Homo sapiens
ctgctgccattagggcacagac

SEQ ID NO: 7084689 - DNA, 22 bp, Homo sapiens
ctgctgcattactcttctcaag

SEQ ID NO: 7084690 - DNA, 22 bp, Homo sapiens
ctgctgcattactcttctcaag

SEQ ID NO: 7084691 - DNA, 22 bp, Homo sapiens
ctgctgcattcctctttatgag

SEQ ID NO: 7084692 - DNA, 22 bp, Homo sapiens
ctgctgcattcctctttatgag

SEQ ID NO: 7084693 - DNA, 22 bp, Homo sapiens
ctgctgccaagggtgccacagg

SEQ ID NO: 7084694 - DNA, 22 bp, Homo sapiens
ctgctgccaagggtgccacagg

SEQ ID NO: 7084695 - DNA, 22 bp, Homo sapiens
ctgctgcagatgacagacccaa

SEQ ID NO: 7084696 - DNA, 22 bp, Homo sapiens
ctgctgcaggatgggcactctg

SEQ ID NO: 7084697 - DNA, 22 bp, Homo sapiens
ctgctgcagatgacagacccaa

SEQ ID NO: 7084698 - DNA, 22 bp, Homo sapiens
ctgctgcaggatgggcactctg

SEQ ID NO: 7084699 - DNA, 22 bp, Homo sapiens
ctgctgcaggatgggcactctg

SEQ ID NO: 7084700 - DNA, 22 bp, Homo sapiens
ctgctgcaggatgggcactctg

SEQ ID NO: 7084701 - DNA, 18 bp, Homo sapiens
ctgctgcaggcactcagg

SEQ ID NO: 7084702 - DNA, 22 bp, Homo sapiens
ctggaatgtatgggaacccaaa

SEQ ID NO: 7084703 - DNA, 22 bp, Homo sapiens
ctggaatgtatgggaacccaaa

SEQ ID NO: 7084704 - DNA, 22 bp, Homo sapiens
ctggaatgggtttcaggcactg

SEQ ID NO: 7084705 - DNA, 22 bp, Homo sapiens
ctggaatgggtttcaggcactg

SEQ ID NO: 7084706 - DNA, 20 bp, Homo sapiens
ctggaatgggtgtgggttag

SEQ ID NO: 7084707 - DNA, 22 bp, Homo sapiens
ctggaatgcggagagttggaga

SEQ ID NO: 7084708 - DNA, 22 bp, Homo sapiens
ctggaatgcggagagttggaga

SEQ ID NO: 7084709 - DNA, 22 bp, Homo sapiens
ctggaatgcggagagttggaga

SEQ ID NO: 7084710 - DNA, 22 bp, Homo sapiens
ctggaatgggagtcagacagag

SEQ ID NO: 7084711 - DNA, 22 bp, Homo sapiens
ctggaatgggccatttgaggcc

SEQ ID NO: 7084712 - DNA, 22 bp, Homo sapiens
ctggaatgagcagggcttatgg

SEQ ID NO: 7084713 - DNA, 19 bp, Homo sapiens
ctggaatgagaacatgccc

SEQ ID NO: 7084714 - DNA, 22 bp, Homo sapiens
ctggaatatttgtaggatgaaa

SEQ ID NO: 7084715 - DNA, 22 bp, Homo sapiens
ctggaatgaagctatgtacatt

SEQ ID NO: 7084716 - DNA, 22 bp, Homo sapiens
ctggaatgcctccctgtcagag

SEQ ID NO: 7084717 - DNA, 22 bp, Homo sapiens
ctggaatgagcagggcttatgg

SEQ ID NO: 7084718 - DNA, 19 bp, Homo sapiens
ctggaatgatagagacctc

SEQ ID NO: 7084719 - DNA, 22 bp, Homo sapiens
atacagtaatttgtaactcatc

SEQ ID NO: 7084720 - DNA, 22 bp, Homo sapiens
atacagtaagtgtccctgaaac

SEQ ID NO: 7084721 - DNA, 22 bp, Homo sapiens
atacagtaatttgtaactcatc

SEQ ID NO: 7084722 - DNA, 22 bp, Homo sapiens
atacagtagacaatctcatgaa

SEQ ID NO: 7084723 - DNA, 22 bp, Homo sapiens
atacagtagggaccatgtctga

SEQ ID NO: 7084724 - DNA, 19 bp, Homo sapiens
atacagatgtatccatgat

SEQ ID NO: 7084725 - DNA, 22 bp, Homo sapiens
ctggagagaatgtggaatgatt

SEQ ID NO: 7084726 - DNA, 22 bp, Homo sapiens
ctggagagaatgttcattgcag

SEQ ID NO: 7084727 - DNA, 22 bp, Homo sapiens
ctggagagaatgttcattgcag

SEQ ID NO: 7084728 - DNA, 22 bp, Homo sapiens
atacagatgttaaagcaatttc

SEQ ID NO: 7084729 - DNA, 22 bp, Homo sapiens
atacagatgttaaagcaatttc

SEQ ID NO: 7084730 - DNA, 22 bp, Homo sapiens
atacagatgttaaagcaatttc

SEQ ID NO: 7084731 - DNA, 22 bp, Homo sapiens
atacagatgttaaagcaatttc

SEQ ID NO: 7084732 - DNA, 22 bp, Homo sapiens
atacagtaaccacattctatag

SEQ ID NO: 7084733 - DNA, 19 bp, Homo sapiens
atacagtaaggtgtttgcc

SEQ ID NO: 7084734 - DNA, 17 bp, Homo sapiens
ctggagaagcctgtgga

SEQ ID NO: 7084735 - DNA, 17 bp, Homo sapiens
ctggagaagcctgtgga

SEQ ID NO: 7084736 - DNA, 22 bp, Homo sapiens
ctggaatgtctgctcaatgttt

SEQ ID NO: 7084737 - DNA, 22 bp, Homo sapiens
ctggagaagccaaactagtcac

SEQ ID NO: 7084738 - DNA, 22 bp, Homo sapiens
ctggagagaatgtggaatgatt

SEQ ID NO: 7084739 - DNA, 22 bp, Homo sapiens
ctggagagaatgtggaatgatt

SEQ ID NO: 7084740 - DNA, 22 bp, Homo sapiens
ctggagagaatgtggaatgatt

SEQ ID NO: 7084741 - DNA, 22 bp, Homo sapiens
ctggagagaaatgacaaagcta

SEQ ID NO: 7084742 - DNA, 22 bp, Homo sapiens
ctggagacctctcctgagagtg

SEQ ID NO: 7084743 - DNA, 22 bp, Homo sapiens
ctggagaattctatgaaatatt

SEQ ID NO: 7084744 - DNA, 22 bp, Homo sapiens
aggtagggggtttgggaactgc

SEQ ID NO: 7084745 - DNA, 22 bp, Homo sapiens
aggtagggggtttgggaactgc

SEQ ID NO: 7084746 - DNA, 22 bp, Homo sapiens
aggtagggttaatggagatata

SEQ ID NO: 7084747 - DNA, 22 bp, Homo sapiens
aggtagggctaggctgcgtctg

SEQ ID NO: 7084748 - DNA, 22 bp, Homo sapiens
aggtagggctaggctgcgtctg

SEQ ID NO: 7084749 - DNA, 22 bp, Homo sapiens
aggtagggggtttgggaactgc

SEQ ID NO: 7084750 - DNA, 22 bp, Homo sapiens
aggtagggggtttgggaactgc

SEQ ID NO: 7084751 - DNA, 22 bp, Homo sapiens
aggtagggttaatggagatata

SEQ ID NO: 7084752 - DNA, 22 bp, Homo sapiens
aggtagggttaatggagatata

SEQ ID NO: 7084753 - DNA, 22 bp, Homo sapiens
aggtagggttaatggagatata

SEQ ID NO: 7084754 - DNA, 23 bp, Homo sapiens
aggtaggttattgctgctacctg

SEQ ID NO: 7084755 - DNA, 23 bp, Homo sapiens
aggtaggttattgctgctacctg

SEQ ID NO: 7084756 - DNA, 23 bp, Homo sapiens
aggtaggttattgctgctacctg

SEQ ID NO: 7084757 - DNA, 22 bp, Homo sapiens
aggtagggaagaaggcatgaaa

SEQ ID NO: 7084758 - DNA, 22 bp, Homo sapiens
aggtagggaagaaggcatgaaa

SEQ ID NO: 7084759 - DNA, 22 bp, Homo sapiens
aggtagggaagaaggcatgaaa

SEQ ID NO: 7084760 - DNA, 22 bp, Homo sapiens
aggtagggaagaaggcatgaaa

SEQ ID NO: 7084761 - DNA, 22 bp, Homo sapiens
aggtaggcctgaaagtgacagc

SEQ ID NO: 7084762 - DNA, 22 bp, Homo sapiens
aggtaggatgggtggagatgat

SEQ ID NO: 7084763 - DNA, 19 bp, Homo sapiens
aggtaggcagtggcatgga

SEQ ID NO: 7084764 - DNA, 22 bp, Homo sapiens
aggtaggatagataggaagacc

SEQ ID NO: 7084765 - DNA, 20 bp, Homo sapiens
aggtaggatcggtgtcataa

SEQ ID NO: 7084766 - DNA, 22 bp, Homo sapiens
aggtaggatagataggaagacc

SEQ ID NO: 7084767 - DNA, 22 bp, Homo sapiens
aggtaggatagataggaagacc

SEQ ID NO: 7084768 - DNA, 22 bp, Homo sapiens
aggtaggatgggtggagatgat

SEQ ID NO: 7084769 - DNA, 22 bp, Homo sapiens
aggtaggatgggtggagatgat

SEQ ID NO: 7084770 - DNA, 22 bp, Homo sapiens
aggtaggatgggtggagatgat

SEQ ID NO: 7084771 - DNA, 22 bp, Homo sapiens
aggtacaggaggttggggctac

SEQ ID NO: 7084772 - DNA, 22 bp, Homo sapiens
aggtacaggaggttggggctac

SEQ ID NO: 7084773 - DNA, 21 bp, Homo sapiens
aggtacaggtcttgtgagtct

SEQ ID NO: 7084774 - DNA, 22 bp, Homo sapiens
aggtaggatagataggaagacc

SEQ ID NO: 7084775 - DNA, 22 bp, Homo sapiens
aggtaggatagataggaagacc

SEQ ID NO: 7084776 - DNA, 21 bp, Homo sapiens
cctgccaggaaactgagtgtc

SEQ ID NO: 7084777 - DNA, 22 bp, Homo sapiens
cctgccagctgtgggccagcct

SEQ ID NO: 7084778 - DNA, 22 bp, Homo sapiens
cctgccagctgtgggccagcct

SEQ ID NO: 7084779 - DNA, 21 bp, Homo sapiens
cctgccaggaaactgagtgtc

SEQ ID NO: 7084780 - DNA, 22 bp, Homo sapiens
cctgccagcgcttatctctcgg

SEQ ID NO: 7084781 - DNA, 22 bp, Homo sapiens
cctgccagctgggtaccttcat

SEQ ID NO: 7084782 - DNA, 22 bp, Homo sapiens
cctgccagctgtgggccagcct

SEQ ID NO: 7084783 - DNA, 22 bp, Homo sapiens
cctgccagctgtgggccagcct

SEQ ID NO: 7084784 - DNA, 22 bp, Homo sapiens
cctgccagcccgcgttcatgcc

SEQ ID NO: 7084785 - DNA, 22 bp, Homo sapiens
cctgccagcccgcgttcatgcc

SEQ ID NO: 7084786 - DNA, 22 bp, Homo sapiens
cctgccagcccgcgttcatgcc

SEQ ID NO: 7084787 - DNA, 22 bp, Homo sapiens
cctgccagccagatcactcgcc

SEQ ID NO: 7084788 - DNA, 22 bp, Homo sapiens
cctgccagcccccatagagaca

SEQ ID NO: 7084789 - DNA, 22 bp, Homo sapiens
cctgccagccagatcactcgcc

SEQ ID NO: 7084790 - DNA, 22 bp, Homo sapiens
cctgccagcatcttcagcccct

SEQ ID NO: 7084791 - DNA, 22 bp, Homo sapiens
cctgccagatcccctgagctga

SEQ ID NO: 7084792 - DNA, 23 bp, Homo sapiens
cctgcagctgctggggctccacc

SEQ ID NO: 7084793 - DNA, 23 bp, Homo sapiens
cctgcagctgccacgccctgctc

SEQ ID NO: 7084794 - DNA, 23 bp, Homo sapiens
cctgcagctgccacgccctgctc

SEQ ID NO: 7084795 - DNA, 23 bp, Homo sapiens
cctgcagctgccacgccctgctc

SEQ ID NO: 7084796 - DNA, 23 bp, Homo sapiens
cctgcagctgctggggctccacc

SEQ ID NO: 7084797 - DNA, 22 bp, Homo sapiens
cctgcagccgtcctgtttgtct

SEQ ID NO: 7084798 - DNA, 22 bp, Homo sapiens
cctgcagcctcttctgaaaatc

SEQ ID NO: 7084799 - DNA, 23 bp, Homo sapiens
cctgcagctgccacgccctgctc

SEQ ID NO: 7084800 - DNA, 18 bp, Homo sapiens
cctgcagcccaggaggcc

SEQ ID NO: 7084801 - DNA, 22 bp, Homo sapiens
cctgcagaggtcaggccagaaa

SEQ ID NO: 7084802 - DNA, 22 bp, Homo sapiens
cctgcagagtccctttgttcag

SEQ ID NO: 7084803 - DNA, 22 bp, Homo sapiens
cctgcagatgtgggacagctgt

SEQ ID NO: 7084804 - DNA, 21 bp, Homo sapiens
cctgcagcaccagaaggagat

SEQ ID NO: 7084805 - DNA, 21 bp, Homo sapiens
cctgcagcaccagaaggagat

SEQ ID NO: 7084806 - DNA, 22 bp, Homo sapiens
cctgcagagcaggagaggcatc

SEQ ID NO: 7084807 - DNA, 22 bp, Homo sapiens
cctgcagagcaggagaggcatc

SEQ ID NO: 7084808 - DNA, 22 bp, Homo sapiens
cctgcagaccacactcagtcct

SEQ ID NO: 7084809 - DNA, 22 bp, Homo sapiens
cctgcagagccacgtgccagcg

SEQ ID NO: 7084810 - DNA, 22 bp, Homo sapiens
cctgcagagccacgtgccagcg

SEQ ID NO: 7084811 - DNA, 22 bp, Homo sapiens
cctgcagagccacgtgccagcg

SEQ ID NO: 7084812 - DNA, 22 bp, Homo sapiens
cctgcagagggactggcaggaa

SEQ ID NO: 7084813 - DNA, 22 bp, Homo sapiens
cctgcagagggactggcaggaa

SEQ ID NO: 7084814 - DNA, 22 bp, Homo sapiens
cctgcagagggagggccttatt

SEQ ID NO: 7084815 - DNA, 22 bp, Homo sapiens
cctgcagaggtcaggccagaaa

SEQ ID NO: 7084816 - DNA, 22 bp, Homo sapiens
aggtagtgtagctgagtgggat

SEQ ID NO: 7084817 - DNA, 22 bp, Homo sapiens
cctggaggtggaggttgcagtg

SEQ ID NO: 7084818 - DNA, 22 bp, Homo sapiens
cctggaggtggaggttgcagtg

SEQ ID NO: 7084819 - DNA, 22 bp, Homo sapiens
cctggaggtggaggttgcagtg

SEQ ID NO: 7084820 - DNA, 22 bp, Homo sapiens
cctggagtaccgtggccatcca

SEQ ID NO: 7084821 - DNA, 23 bp, Homo sapiens
cctggagtactaaggggatggaa

SEQ ID NO: 7084822 - DNA, 22 bp, Homo sapiens
cctggagtgacaggtgtagcct

SEQ ID NO: 7084823 - DNA, 22 bp, Homo sapiens
cctggagtggggtccgtgcatg

SEQ ID NO: 7084824 - DNA, 22 bp, Homo sapiens
cctggatagctactggccaggc

SEQ ID NO: 7084825 - DNA, 22 bp, Homo sapiens
cctggatgatccatgtcatgga

SEQ ID NO: 7084826 - DNA, 22 bp, Homo sapiens
cctggatgatccatgtcatgga

SEQ ID NO: 7084827 - DNA, 22 bp, Homo sapiens
aggtcatgatccattggtgagt

SEQ ID NO: 7084828 - DNA, 22 bp, Homo sapiens
aggtcatgccaggcaggggaca

SEQ ID NO: 7084829 - DNA, 22 bp, Homo sapiens
aggtcatgggctggagcactgc

SEQ ID NO: 7084830 - DNA, 18 bp, Homo sapiens
aggtcatggtcatgggcg

SEQ ID NO: 7084831 - DNA, 18 bp, Homo sapiens
aggtcatggtcatgggcg

SEQ ID NO: 7084832 - DNA, 22 bp, Homo sapiens
aggtcattaaagttaaatgagg

SEQ ID NO: 7084833 - DNA, 22 bp, Homo sapiens
aggtcattacaattatcatttt

SEQ ID NO: 7084834 - DNA, 22 bp, Homo sapiens
aggtcattccagccattcccct

SEQ ID NO: 7084835 - DNA, 22 bp, Homo sapiens
aggtcattccagccattcccct

SEQ ID NO: 7084836 - DNA, 22 bp, Homo sapiens
aggtcattccttgtcttcttgc

SEQ ID NO: 7084837 - DNA, 22 bp, Homo sapiens
aggtcattccttgtcttcttgc

SEQ ID NO: 7084838 - DNA, 22 bp, Homo sapiens
aggtcattgaagttattttctt

SEQ ID NO: 7084839 - DNA, 19 bp, Homo sapiens
aggtcattgatagtgcagg

SEQ ID NO: 7084840 - DNA, 22 bp, Homo sapiens
aggtcattggggactatctccg

SEQ ID NO: 7084841 - DNA, 22 bp, Homo sapiens
aggtcattgaagttattttctt

SEQ ID NO: 7084842 - DNA, 22 bp, Homo sapiens
aggtcattggggactatctccg

SEQ ID NO: 7084843 - DNA, 22 bp, Homo sapiens
aggtcattgttaagtcaccata

SEQ ID NO: 7084844 - DNA, 22 bp, Homo sapiens
aggtccagttttctgacaaggg

SEQ ID NO: 7084845 - DNA, 22 bp, Homo sapiens
cctggcacaagagcagcattgg

SEQ ID NO: 7084846 - DNA, 22 bp, Homo sapiens
cctggcacaagagcagcattgg

SEQ ID NO: 7084847 - DNA, 23 bp, Homo sapiens
cctggcacacaaggggtgctgca

SEQ ID NO: 7084848 - DNA, 23 bp, Homo sapiens
cctggcacacagttgacatggaa

SEQ ID NO: 7084849 - DNA, 22 bp, Homo sapiens
cctggattggctgcccatgctc

SEQ ID NO: 7084850 - DNA, 22 bp, Homo sapiens
cctggcaacatttcaaggtctt

SEQ ID NO: 7084851 - DNA, 22 bp, Homo sapiens
cctggcaagtcagaaccagcac

SEQ ID NO: 7084852 - DNA, 22 bp, Homo sapiens
cctggcaagtgggctcccagat

SEQ ID NO: 7084853 - DNA, 22 bp, Homo sapiens
aggtccatcgtggatgaactgc

SEQ ID NO: 7084854 - DNA, 22 bp, Homo sapiens
aggtccatcttaaatgcactca

SEQ ID NO: 7084855 - DNA, 22 bp, Homo sapiens
aggtccatggcagcgggtactt

SEQ ID NO: 7084856 - DNA, 21 bp, Homo sapiens
aggtcccaggtttgggcagca

SEQ ID NO: 7084857 - DNA, 21 bp, Homo sapiens
aggtcccaggtttgggcagca

SEQ ID NO: 7084858 - DNA, 22 bp, Homo sapiens
aggtcccagtgttagggtgaca

SEQ ID NO: 7084859 - DNA, 22 bp, Homo sapiens
aggtcccagtgttagggtgaca

SEQ ID NO: 7084860 - DNA, 21 bp, Homo sapiens
aggtcctctatccaagttaag

SEQ ID NO: 7084861 - DNA, 22 bp, Homo sapiens
aggtcctctgtgcctgctggcg

SEQ ID NO: 7084862 - DNA, 22 bp, Homo sapiens
aggtcctctgtgcctgctggcg

SEQ ID NO: 7084863 - DNA, 22 bp, Homo sapiens
cctggctctgaggtatgcctgg

SEQ ID NO: 7084864 - DNA, 22 bp, Homo sapiens
cctggctctgcagccactccag

SEQ ID NO: 7084865 - DNA, 22 bp, Homo sapiens
cctggctctgcagccactccag

SEQ ID NO: 7084866 - DNA, 22 bp, Homo sapiens
cctggctctgcagccactccag

SEQ ID NO: 7084867 - DNA, 22 bp, Homo sapiens
cctggctctgccacttactgcc

SEQ ID NO: 7084868 - DNA, 22 bp, Homo sapiens
cctggctctgccgtaaccacca

SEQ ID NO: 7084869 - DNA, 22 bp, Homo sapiens
cctggctctgccgtaaccacca

SEQ ID NO: 7084870 - DNA, 22 bp, Homo sapiens
cctggctctgcgtgcagctccg

SEQ ID NO: 7084871 - DNA, 22 bp, Homo sapiens
cctgtgagtttacattctggcc

SEQ ID NO: 7084872 - DNA, 22 bp, Homo sapiens
cctgtgatccataggcatccag

SEQ ID NO: 7084873 - DNA, 22 bp, Homo sapiens
cctgtgcaatgttgaggtttca

SEQ ID NO: 7084874 - DNA, 19 bp, Homo sapiens
cctgtgcacatgtgtcctt

SEQ ID NO: 7084875 - DNA, 22 bp, Homo sapiens
cctgtgcactatctgcattttt

SEQ ID NO: 7084876 - DNA, 22 bp, Homo sapiens
cctgtgcagcccttgccagttt

SEQ ID NO: 7084877 - DNA, 22 bp, Homo sapiens
cctgtgcagcccttgccagttt

SEQ ID NO: 7084878 - DNA, 22 bp, Homo sapiens
cctgtgcaggctccataataga

SEQ ID NO: 7084879 - DNA, 22 bp, Homo sapiens
cctgtgcatccggtggtcattg

SEQ ID NO: 7084880 - DNA, 22 bp, Homo sapiens
cctgtgcatgccagggtacacc

SEQ ID NO: 7084881 - DNA, 19 bp, Homo sapiens
cctgtgagaggacaggtgt

SEQ ID NO: 7084882 - DNA, 22 bp, Homo sapiens
cctgtgagagggcgagtgtaga

SEQ ID NO: 7084883 - DNA, 22 bp, Homo sapiens
cctgtgacttggcaaacctcca

SEQ ID NO: 7084884 - DNA, 22 bp, Homo sapiens
cctgtgactctgtctgatggtc

SEQ ID NO: 7084885 - DNA, 22 bp, Homo sapiens
cctgtgaggtcatctgtggtaa

SEQ ID NO: 7084886 - DNA, 22 bp, Homo sapiens
cctgtgaggtcatctgtggtaa

SEQ ID NO: 7084887 - DNA, 22 bp, Homo sapiens
cctgtgaggtcatctgtggtaa

SEQ ID NO: 7084888 - DNA, 22 bp, Homo sapiens
cctgtgaggtcttgcatgtgaa

SEQ ID NO: 7084889 - DNA, 22 bp, Homo sapiens
cctgtgacattagaatttcatt

SEQ ID NO: 7084890 - DNA, 22 bp, Homo sapiens
cctgtgaccactctggttctgc

SEQ ID NO: 7084891 - DNA, 22 bp, Homo sapiens
cctgtgacccttccagtctact

SEQ ID NO: 7084892 - DNA, 22 bp, Homo sapiens
cctgtgacgtgtctcctggcac

SEQ ID NO: 7084893 - DNA, 22 bp, Homo sapiens
cctgtgacgtgtctcctggcac

SEQ ID NO: 7084894 - DNA, 19 bp, Homo sapiens
cctgtgactatctttgtaa

SEQ ID NO: 7084895 - DNA, 22 bp, Homo sapiens
cctgtctccctggcatggctca

SEQ ID NO: 7084896 - DNA, 22 bp, Homo sapiens
cctgtcccctcacaatgccact

SEQ ID NO: 7084897 - DNA, 22 bp, Homo sapiens
cctgtcctccggagcgggctgt

SEQ ID NO: 7084898 - DNA, 22 bp, Homo sapiens
cctgtctaccagtcacttagcg

SEQ ID NO: 7084899 - DNA, 22 bp, Homo sapiens
cctgtcccctcacaatgccact

SEQ ID NO: 7084900 - DNA, 22 bp, Homo sapiens
cctgtcccctcacaatgccact

SEQ ID NO: 7084901 - DNA, 22 bp, Homo sapiens
cctgtcccctcacaatgccact

SEQ ID NO: 7084902 - DNA, 22 bp, Homo sapiens
cctgtcccaagcagggctggcc

SEQ ID NO: 7084903 - DNA, 22 bp, Homo sapiens
cctgtcccccaggcctgtacca

SEQ ID NO: 7084904 - DNA, 22 bp, Homo sapiens
cctgtcccccaggcctgtacca

SEQ ID NO: 7084905 - DNA, 20 bp, Homo sapiens
cctgtccaagctccacccca

SEQ ID NO: 7084906 - DNA, 22 bp, Homo sapiens
cctgtcattttctcctgtcagc

SEQ ID NO: 7084907 - DNA, 22 bp, Homo sapiens
cctgtcatttttatcaatgtct

SEQ ID NO: 7084908 - DNA, 20 bp, Homo sapiens
cctgtcatcccagcattttg

SEQ ID NO: 7084909 - DNA, 20 bp, Homo sapiens
cctgtcatcccagcattttg

SEQ ID NO: 7084910 - DNA, 22 bp, Homo sapiens
aggtggggccaaatgctacagt

SEQ ID NO: 7084911 - DNA, 22 bp, Homo sapiens
aggtggggccaaatgctacagt

SEQ ID NO: 7084912 - DNA, 22 bp, Homo sapiens
aggtggggagtatatgtaattg

SEQ ID NO: 7084913 - DNA, 22 bp, Homo sapiens
aggtggggagtatatgtaattg

SEQ ID NO: 7084914 - DNA, 22 bp, Homo sapiens
aggtggggaggagtgtctcttt

SEQ ID NO: 7084915 - DNA, 22 bp, Homo sapiens
aggtggggccaaatgctacagt

SEQ ID NO: 7084916 - DNA, 22 bp, Homo sapiens
aggtggggccaaatgctacagt

SEQ ID NO: 7084917 - DNA, 22 bp, Homo sapiens
aggtggggccaaatgctacagt

SEQ ID NO: 7084918 - DNA, 22 bp, Homo sapiens
aggtggggccaaatgctacagt

SEQ ID NO: 7084919 - DNA, 21 bp, Homo sapiens
aggtggggctgcacctctgct

SEQ ID NO: 7084920 - DNA, 21 bp, Homo sapiens
aggtggggctgcacctctgct

SEQ ID NO: 7084921 - DNA, 22 bp, Homo sapiens
aggtggggcccaccaatttgca

SEQ ID NO: 7084922 - DNA, 22 bp, Homo sapiens
aggtggggcccaccaatttgca

SEQ ID NO: 7084923 - DNA, 22 bp, Homo sapiens
aggtggggccaaatgctacagt

SEQ ID NO: 7084924 - DNA, 22 bp, Homo sapiens
aggtggggcccaccaatttgca

SEQ ID NO: 7084925 - DNA, 21 bp, Homo sapiens
aggtggggctgcacctctgct

SEQ ID NO: 7084926 - DNA, 21 bp, Homo sapiens
aggtggggctgcacctctgct

SEQ ID NO: 7084927 - DNA, 21 bp, Homo sapiens
aggtggggctgcacctctgct

SEQ ID NO: 7084928 - DNA, 18 bp, Homo sapiens
cctgtgtgtgttgcaggc

SEQ ID NO: 7084929 - DNA, 22 bp, Homo sapiens
cctgtgccaaaatctaggcagt

SEQ ID NO: 7084930 - DNA, 22 bp, Homo sapiens
cctgtgccagccccttctgctg

SEQ ID NO: 7084931 - DNA, 22 bp, Homo sapiens
aggtgggcaatgaggcctgagt

SEQ ID NO: 7084932 - DNA, 22 bp, Homo sapiens
cctgtgcattgaccacactctc

SEQ ID NO: 7084933 - DNA, 22 bp, Homo sapiens
cctgtgcattgagtttgcaccc

SEQ ID NO: 7084934 - DNA, 22 bp, Homo sapiens
cctgtgcattgcagggtgttca

SEQ ID NO: 7084935 - DNA, 22 bp, Homo sapiens
cctgtgccaaaaggctgcttat

SEQ ID NO: 7084936 - DNA, 22 bp, Homo sapiens
aggtgggcaatgaggcctgagt

SEQ ID NO: 7084937 - DNA, 22 bp, Homo sapiens
aggtgggcaatgaggcctgagt

SEQ ID NO: 7084938 - DNA, 22 bp, Homo sapiens
aggtgggcacacctcccttctc

SEQ ID NO: 7084939 - DNA, 22 bp, Homo sapiens
aggtgggcacagatggagaagt

SEQ ID NO: 7084940 - DNA, 22 bp, Homo sapiens
aggtgggcacagatggagaagt

SEQ ID NO: 7084941 - DNA, 22 bp, Homo sapiens
aggtgggcacagatggagaagt

SEQ ID NO: 7084942 - DNA, 22 bp, Homo sapiens
aggtgggcacagatggagaagt

SEQ ID NO: 7084943 - DNA, 22 bp, Homo sapiens
aggtggggaggagtgtctcttt

SEQ ID NO: 7084944 - DNA, 22 bp, Homo sapiens
aggtggggaggagtgtctcttt

SEQ ID NO: 7084945 - DNA, 22 bp, Homo sapiens
aggtggggaggagtgtctcttt

SEQ ID NO: 7084946 - DNA, 22 bp, Homo sapiens
aggtggggaggagtgtctcttt

SEQ ID NO: 7084947 - DNA, 22 bp, Homo sapiens
aggtggggaggagtgtctcttt

SEQ ID NO: 7084948 - DNA, 22 bp, Homo sapiens
cctgtcagttgctgtcagggat

SEQ ID NO: 7084949 - DNA, 22 bp, Homo sapiens
cctgtcagttgctgtcagggat

SEQ ID NO: 7084950 - DNA, 22 bp, Homo sapiens
cctgtcagttgctgtcagggat

SEQ ID NO: 7084951 - DNA, 22 bp, Homo sapiens
cctgtcagttgctgtcagggat

SEQ ID NO: 7084952 - DNA, 22 bp, Homo sapiens
cctgtcagggtttgcctcagaa

SEQ ID NO: 7084953 - DNA, 22 bp, Homo sapiens
cctgtcagttgctgtcagggat

SEQ ID NO: 7084954 - DNA, 22 bp, Homo sapiens
cctgtcagttgctgtcagggat

SEQ ID NO: 7084955 - DNA, 22 bp, Homo sapiens
cctggtgcttaccagagctttt

SEQ ID NO: 7084956 - DNA, 22 bp, Homo sapiens
cctggtgcccccaagccagctg

SEQ ID NO: 7084957 - DNA, 22 bp, Homo sapiens
cctggtgccggtagacgcgcag

SEQ ID NO: 7084958 - DNA, 22 bp, Homo sapiens
cctggtgctgctatcaggggta

SEQ ID NO: 7084959 - DNA, 22 bp, Homo sapiens
cctgggctttcaaaaccagcct

SEQ ID NO: 7084960 - DNA, 22 bp, Homo sapiens
cctgggctttgagggcaggatg

SEQ ID NO: 7084961 - DNA, 22 bp, Homo sapiens
cctgggctttgagggcaggatg

SEQ ID NO: 7084962 - DNA, 22 bp, Homo sapiens
cctgggctttgagggcaggatg

SEQ ID NO: 7084963 - DNA, 22 bp, Homo sapiens
cctgggctttcggcggcttcct

SEQ ID NO: 7084964 - DNA, 22 bp, Homo sapiens
cctgggcttgcatctgtgctgg

SEQ ID NO: 7084965 - DNA, 22 bp, Homo sapiens
cctgggcttgcatctgtgctgg

SEQ ID NO: 7084966 - DNA, 22 bp, Homo sapiens
cctgggcttggttgttgagaac

SEQ ID NO: 7084967 - DNA, 22 bp, Homo sapiens
cctgggcttggttgttgagaac

SEQ ID NO: 7084968 - DNA, 22 bp, Homo sapiens
cctgggcttgcatctgtgctgg

SEQ ID NO: 7084969 - DNA, 20 bp, Homo sapiens
cctgggctccaggagccccg

SEQ ID NO: 7084970 - DNA, 22 bp, Homo sapiens
cctggctctgcgtgcagctccg

SEQ ID NO: 7084971 - DNA, 22 bp, Homo sapiens
cctggctctgggatcttcgctt

SEQ ID NO: 7084972 - DNA, 22 bp, Homo sapiens
cctggctctggggcggacagct

SEQ ID NO: 7084973 - DNA, 22 bp, Homo sapiens
cctggctctggggcggacagct

SEQ ID NO: 7084974 - DNA, 22 bp, Homo sapiens
cctggctctggtgaggagaagt

SEQ ID NO: 7084975 - DNA, 22 bp, Homo sapiens
cctggctctggtgaggagaagt

SEQ ID NO: 7084976 - DNA, 22 bp, Homo sapiens
cctggctctggtgaggagaagt

SEQ ID NO: 7084977 - DNA, 22 bp, Homo sapiens
cctggctctggttccctcagct

SEQ ID NO: 7084978 - DNA, 22 bp, Homo sapiens
cctggctctggttccctcagct

SEQ ID NO: 7084979 - DNA, 22 bp, Homo sapiens
cctggctctggttccctcagct

SEQ ID NO: 7084980 - DNA, 22 bp, Homo sapiens
cctggctctgtcctcgcgcaaa

SEQ ID NO: 7084981 - DNA, 22 bp, Homo sapiens
cctgggctcaagtgatggtccc

SEQ ID NO: 7084982 - DNA, 22 bp, Homo sapiens
cctgggctcaagtgatggtccc

SEQ ID NO: 7084983 - DNA, 22 bp, Homo sapiens
cctgggctcaggcttgggcagc

SEQ ID NO: 7084984 - DNA, 22 bp, Homo sapiens
cctgggctcaggcttgggcagc

SEQ ID NO: 7084985 - DNA, 22 bp, Homo sapiens
cctgggctcaggcttgggcagc

SEQ ID NO: 7084986 - DNA, 22 bp, Homo sapiens
cctgggctccactccaagagca

SEQ ID NO: 7084987 - DNA, 20 bp, Homo sapiens
cctgggctccaggagccccg

SEQ ID NO: 7084988 - DNA, 22 bp, Homo sapiens
cctgggctcacagccaaggctc

SEQ ID NO: 7084989 - DNA, 22 bp, Homo sapiens
cctgggctcacagccaaggctc

SEQ ID NO: 7084990 - DNA, 22 bp, Homo sapiens
cctgggctcaagtgatggtccc

SEQ ID NO: 7084991 - DNA, 22 bp, Homo sapiens
ctaggtgatccactgctctctt

SEQ ID NO: 7084992 - DNA, 22 bp, Homo sapiens
ctagggtggatttgtgcagagt

SEQ ID NO: 7084993 - DNA, 22 bp, Homo sapiens
ctagggtggatttgtgcagagt

SEQ ID NO: 7084994 - DNA, 22 bp, Homo sapiens
ctagggtgtgcagattttgcct

SEQ ID NO: 7084995 - DNA, 22 bp, Homo sapiens
ctagggtcaggggcctgcgtcg

SEQ ID NO: 7084996 - DNA, 22 bp, Homo sapiens
ctagggtcaggggcctgcgtcg

SEQ ID NO: 7084997 - DNA, 22 bp, Homo sapiens
ctagggtcaggggcctgcgtcg

SEQ ID NO: 7084998 - DNA, 22 bp, Homo sapiens
ctagggtctgttttccaggtgt

SEQ ID NO: 7084999 - DNA, 22 bp, Homo sapiens
agtccatagtttacattacagc

SEQ ID NO: 7085000 - DNA, 19 bp, Homo sapiens
agtccatgaatggaggatg

SEQ ID NO: 7085001 - DNA, 19 bp, Homo sapiens
agtccatgaatggaggatg

SEQ ID NO: 7085002 - DNA, 22 bp, Homo sapiens
agtccatgctgtctacagaatc

SEQ ID NO: 7085003 - DNA, 22 bp, Homo sapiens
agtccatggttgtagttctctc

SEQ ID NO: 7085004 - DNA, 22 bp, Homo sapiens
agtccattaactgtgttaacag

SEQ ID NO: 7085005 - DNA, 22 bp, Homo sapiens
agtcccaacagcttacaaggaa

SEQ ID NO: 7085006 - DNA, 22 bp, Homo sapiens
agtcccagctactcaagaggct

SEQ ID NO: 7085007 - DNA, 22 bp, Homo sapiens
agtcccagctactcaagaggct

SEQ ID NO: 7085008 - DNA, 22 bp, Homo sapiens
agtcccatgtcattatttctgc

SEQ ID NO: 7085009 - DNA, 22 bp, Homo sapiens
agtcccatgtcattatttctgc

SEQ ID NO: 7085010 - DNA, 16 bp, Homo sapiens
agtcccatgtttgagt

SEQ ID NO: 7085011 - DNA, 22 bp, Homo sapiens
agtcccattgcaagttatgcga

SEQ ID NO: 7085012 - DNA, 16 bp, Homo sapiens
agtcccatgtttgagt

SEQ ID NO: 7085013 - DNA, 22 bp, Homo sapiens
agtcccattgcaagttatgcga

SEQ ID NO: 7085014 - DNA, 22 bp, Homo sapiens
agtcccatttgtgaccttggga

SEQ ID NO: 7085015 - DNA, 22 bp, Homo sapiens
agtcccatttgtgaccttggga

SEQ ID NO: 7085016 - DNA, 22 bp, Homo sapiens
ctagtcacgtctttcagttacc

SEQ ID NO: 7085017 - DNA, 22 bp, Homo sapiens
ctagtcactcagcactgacaaa

SEQ ID NO: 7085018 - DNA, 22 bp, Homo sapiens
ctagtcactcagcactgacaaa

SEQ ID NO: 7085019 - DNA, 22 bp, Homo sapiens
ctagtcactcagcactgacaaa

SEQ ID NO: 7085020 - DNA, 22 bp, Homo sapiens
ctagtcactgtaataatctgct

SEQ ID NO: 7085021 - DNA, 20 bp, Homo sapiens
ctagtctcacatccctggca

SEQ ID NO: 7085022 - DNA, 22 bp, Homo sapiens
ctagtctctggaggtcagggct

SEQ ID NO: 7085023 - DNA, 22 bp, Homo sapiens
agtcccagctactcaagaggct

SEQ ID NO: 7085024 - DNA, 22 bp, Homo sapiens
ctaggtggtggtgggttgacat

SEQ ID NO: 7085025 - DNA, 22 bp, Homo sapiens
ctagtaaatcagaagctgtggg

SEQ ID NO: 7085026 - DNA, 22 bp, Homo sapiens
ctagtaaggaataaattatgat

SEQ ID NO: 7085027 - DNA, 22 bp, Homo sapiens
ctagtacaattttagcaagatg

SEQ ID NO: 7085028 - DNA, 22 bp, Homo sapiens
ctagtataaaatgaccccatca

SEQ ID NO: 7085029 - DNA, 22 bp, Homo sapiens
ctagtattaagtgtgagtaaaa

SEQ ID NO: 7085030 - DNA, 22 bp, Homo sapiens
ctagtcacacagtaaggacggg

SEQ ID NO: 7085031 - DNA, 22 bp, Homo sapiens
ctagtcacgtctttcagttacc

SEQ ID NO: 7085032 - DNA, 22 bp, Homo sapiens
ctagaatatcatatgaagagac

SEQ ID NO: 7085033 - DNA, 22 bp, Homo sapiens
ctagaatatcatatgaagagac

SEQ ID NO: 7085034 - DNA, 22 bp, Homo sapiens
ctagaatcccaaatggactggg

SEQ ID NO: 7085035 - DNA, 22 bp, Homo sapiens
ctagaatctatgtcaggaactc

SEQ ID NO: 7085036 - DNA, 22 bp, Homo sapiens
agtccaaggttcatggcacaga

SEQ ID NO: 7085037 - DNA, 22 bp, Homo sapiens
agtccaaggttcatggcacaga

SEQ ID NO: 7085038 - DNA, 22 bp, Homo sapiens
agtccacagagtctctcctgaa

SEQ ID NO: 7085039 - DNA, 22 bp, Homo sapiens
agtccacagctcatagtttttt

SEQ ID NO: 7085040 - DNA, 22 bp, Homo sapiens
agtccaccggcagagatgctga

SEQ ID NO: 7085041 - DNA, 22 bp, Homo sapiens
agtccaccggcagagatgctga

SEQ ID NO: 7085042 - DNA, 22 bp, Homo sapiens
agtccagaacttcagctagttt

SEQ ID NO: 7085043 - DNA, 22 bp, Homo sapiens
ctagaatactcgtattattccc

SEQ ID NO: 7085044 - DNA, 22 bp, Homo sapiens
ctagaatactcgtattattccc

SEQ ID NO: 7085045 - DNA, 22 bp, Homo sapiens
ctagaagcaatgtaggggagac

SEQ ID NO: 7085046 - DNA, 22 bp, Homo sapiens
ctagaaggtctgggcctgggaa

SEQ ID NO: 7085047 - DNA, 22 bp, Homo sapiens
ctagaagcaactagatctgttt

SEQ ID NO: 7085048 - DNA, 22 bp, Homo sapiens
ctagaacagtcaaagtgagctc

SEQ ID NO: 7085049 - DNA, 22 bp, Homo sapiens
agtccaggctcttcctgaagaa

SEQ ID NO: 7085050 - DNA, 22 bp, Homo sapiens
agtccagggagcccaggctttg

SEQ ID NO: 7085051 - DNA, 22 bp, Homo sapiens
agtccagggctctctgtgggat

SEQ ID NO: 7085052 - DNA, 22 bp, Homo sapiens
agtccagggctctctgtgggat

SEQ ID NO: 7085053 - DNA, 22 bp, Homo sapiens
agtccagggctctctgtgggat

SEQ ID NO: 7085054 - DNA, 22 bp, Homo sapiens
agtccaggtctctgagtcacaa

SEQ ID NO: 7085055 - DNA, 22 bp, Homo sapiens
agtccagtcggcctggagaaat

SEQ ID NO: 7085056 - DNA, 22 bp, Homo sapiens
agtccagtctcactcttggcag

SEQ ID NO: 7085057 - DNA, 22 bp, Homo sapiens
agtccagtctcttctggtgagt

SEQ ID NO: 7085058 - DNA, 22 bp, Homo sapiens
agtccagtcttgttggcacggt

SEQ ID NO: 7085059 - DNA, 22 bp, Homo sapiens
agtccagtgtcaaggtgccatt

SEQ ID NO: 7085060 - DNA, 22 bp, Homo sapiens
agtccagtgtgttctggcagca

SEQ ID NO: 7085061 - DNA, 22 bp, Homo sapiens
agtccataacttcagagtgtca

SEQ ID NO: 7085062 - DNA, 22 bp, Homo sapiens
agtccataattttcatatctga

SEQ ID NO: 7085063 - DNA, 22 bp, Homo sapiens
agtccataattttcatatctga

SEQ ID NO: 7085064 - DNA, 22 bp, Homo sapiens
agtccatacattgagaataaca

SEQ ID NO: 7085065 - DNA, 22 bp, Homo sapiens
agtccatagtttacattacagc

SEQ ID NO: 7085066 - DNA, 22 bp, Homo sapiens
ctagaaatattttacagtcaag

SEQ ID NO: 7085067 - DNA, 22 bp, Homo sapiens
ctagaaatattttacagtcaag

SEQ ID NO: 7085068 - DNA, 22 bp, Homo sapiens
ctagaaatctctgtttacatca

SEQ ID NO: 7085069 - DNA, 22 bp, Homo sapiens
ctacccagatccaggatggcta

SEQ ID NO: 7085070 - DNA, 22 bp, Homo sapiens
ctacatttttcaccgagcctct

SEQ ID NO: 7085071 - DNA, 22 bp, Homo sapiens
ctaccatccttaggctgaagtg

SEQ ID NO: 7085072 - DNA, 22 bp, Homo sapiens
ctacccacaaggctttgggcac

SEQ ID NO: 7085073 - DNA, 22 bp, Homo sapiens
ctagaaatctctgtttacatca

SEQ ID NO: 7085074 - DNA, 22 bp, Homo sapiens
ctagaaatgctcaagagaaagt

SEQ ID NO: 7085075 - DNA, 22 bp, Homo sapiens
ctagaaatgtagattcttagtg

SEQ ID NO: 7085076 - DNA, 22 bp, Homo sapiens
ctagaaatgtagattcttagtg

SEQ ID NO: 7085077 - DNA, 22 bp, Homo sapiens
ctagaaattctgattcagtagg

SEQ ID NO: 7085078 - DNA, 22 bp, Homo sapiens
ctagaaattctgattcagtagg

SEQ ID NO: 7085079 - DNA, 22 bp, Homo sapiens
ctagaacaaattaggaggcata

SEQ ID NO: 7085080 - DNA, 22 bp, Homo sapiens
ctagaacagaaagtacaggaaa

SEQ ID NO: 7085081 - DNA, 22 bp, Homo sapiens
ctagaacagaaagtacaggaaa

SEQ ID NO: 7085082 - DNA, 22 bp, Homo sapiens
ctacatttggagagtataggaa

SEQ ID NO: 7085083 - DNA, 22 bp, Homo sapiens
ctacatttgttcaaataagctg

SEQ ID NO: 7085084 - DNA, 22 bp, Homo sapiens
ctacatttgttcaaataagctg

SEQ ID NO: 7085085 - DNA, 22 bp, Homo sapiens
ctacagaattcaacaaatggtt

SEQ ID NO: 7085086 - DNA, 22 bp, Homo sapiens
ctacagagaactcagctgccct

SEQ ID NO: 7085087 - DNA, 22 bp, Homo sapiens
ctacagagaactcagctgccct

SEQ ID NO: 7085088 - DNA, 22 bp, Homo sapiens
ctacatttcccagctgccttcc

SEQ ID NO: 7085089 - DNA, 22 bp, Homo sapiens
ctacatttgttctatagctttt

SEQ ID NO: 7085090 - DNA, 22 bp, Homo sapiens
ctacatttgttctatagctttt

SEQ ID NO: 7085091 - DNA, 22 bp, Homo sapiens
ctacattttaataagctgctta

SEQ ID NO: 7085092 - DNA, 22 bp, Homo sapiens
ctacattttgtgattatgaaat

SEQ ID NO: 7085093 - DNA, 22 bp, Homo sapiens
agtatttagctgactcgctaca

SEQ ID NO: 7085094 - DNA, 22 bp, Homo sapiens
agtatttagcatagtggttagt

SEQ ID NO: 7085095 - DNA, 22 bp, Homo sapiens
agtatttagctgactcgctaca

SEQ ID NO: 7085096 - DNA, 22 bp, Homo sapiens
agtatttagagacacaagatgg

SEQ ID NO: 7085097 - DNA, 22 bp, Homo sapiens
agtatttagagacacaagatgg

SEQ ID NO: 7085098 - DNA, 22 bp, Homo sapiens
agtatttagcatagtggttagt

SEQ ID NO: 7085099 - DNA, 22 bp, Homo sapiens
agtatttcctggcttatctgct

SEQ ID NO: 7085100 - DNA, 22 bp, Homo sapiens
agtatttcctggcttatctgct

SEQ ID NO: 7085101 - DNA, 22 bp, Homo sapiens
ctacagaatctacctcaagcca

SEQ ID NO: 7085102 - DNA, 22 bp, Homo sapiens
ctacagaatggagggtcagaga

SEQ ID NO: 7085103 - DNA, 22 bp, Homo sapiens
agtatttagagacacaagatgg

SEQ ID NO: 7085104 - DNA, 22 bp, Homo sapiens
agtatttagagacacaagacgg

SEQ ID NO: 7085105 - DNA, 22 bp, Homo sapiens
agtatttagagacacaagatgg

SEQ ID NO: 7085106 - DNA, 22 bp, Homo sapiens
agtatttagagacacaagacgg

SEQ ID NO: 7085107 - DNA, 22 bp, Homo sapiens
agtatttagagacacaagacgg

SEQ ID NO: 7085108 - DNA, 22 bp, Homo sapiens
agtatttagagacacaagacgg

SEQ ID NO: 7085109 - DNA, 22 bp, Homo sapiens
agtatgttgacttattcttgga

SEQ ID NO: 7085110 - DNA, 22 bp, Homo sapiens
agtatgttgacttattcttgga

SEQ ID NO: 7085111 - DNA, 23 bp, Homo sapiens
agtattcaaaaggcaagctatat

SEQ ID NO: 7085112 - DNA, 23 bp, Homo sapiens
agtattcaaaaggcaagctatat

SEQ ID NO: 7085113 - DNA, 22 bp, Homo sapiens
agtatgtcagagtgaaaatggt

SEQ ID NO: 7085114 - DNA, 22 bp, Homo sapiens
agtatgtaattttcaatgtgtt

SEQ ID NO: 7085115 - DNA, 23 bp, Homo sapiens
agtatgggggatcacgtggccct

SEQ ID NO: 7085116 - DNA, 22 bp, Homo sapiens
ctaagcatccatctcttcttca

SEQ ID NO: 7085117 - DNA, 22 bp, Homo sapiens
ctaagccagaactagtgattgg

SEQ ID NO: 7085118 - DNA, 22 bp, Homo sapiens
ctaaggaagtgacagtgggatt

SEQ ID NO: 7085119 - DNA, 22 bp, Homo sapiens
cgcaggcacagagtggacagcg

SEQ ID NO: 7085120 - DNA, 22 bp, Homo sapiens
cgcaggcacagagtggacagcg

SEQ ID NO: 7085121 - DNA, 22 bp, Homo sapiens
cgcaggcacagagtggacagcg

SEQ ID NO: 7085122 - DNA, 22 bp, Homo sapiens
cgcaggctccggggtgccctgg

SEQ ID NO: 7085123 - DNA, 22 bp, Homo sapiens
cgcaggctcggttcacagagca

SEQ ID NO: 7085124 - DNA, 22 bp, Homo sapiens
cgcaggcaagagagtacagtta

SEQ ID NO: 7085125 - DNA, 22 bp, Homo sapiens
cgcaggcaagagagtacagtta

SEQ ID NO: 7085126 - DNA, 22 bp, Homo sapiens
cgcaggcaatgctccgcggggg

SEQ ID NO: 7085127 - DNA, 22 bp, Homo sapiens
cgcaggcaatgctccgcggggg

SEQ ID NO: 7085128 - DNA, 19 bp, Homo sapiens
cgcaggagccgaggtgacc

SEQ ID NO: 7085129 - DNA, 22 bp, Homo sapiens
cgaggccagctctaagccctac

SEQ ID NO: 7085130 - DNA, 22 bp, Homo sapiens
cgaggccatgcatgctgaggac

SEQ ID NO: 7085131 - DNA, 22 bp, Homo sapiens
cgaggccatgcatgctgaggac

SEQ ID NO: 7085132 - DNA, 22 bp, Homo sapiens
cctgttcttgtctcattggcta

SEQ ID NO: 7085133 - DNA, 22 bp, Homo sapiens
cctgttgagagagctcactgag

SEQ ID NO: 7085134 - DNA, 22 bp, Homo sapiens
cctgttgctctgcatgagttta

SEQ ID NO: 7085135 - DNA, 22 bp, Homo sapiens
cctgttggaaggtgtaggcccc

SEQ ID NO: 7085136 - DNA, 20 bp, Homo sapiens
cctgttggatgaggtccaga

SEQ ID NO: 7085137 - DNA, 22 bp, Homo sapiens
cctgttcaccctccatgcacag

SEQ ID NO: 7085138 - DNA, 19 bp, Homo sapiens
cctgtgttgggagtgtgag

SEQ ID NO: 7085139 - DNA, 22 bp, Homo sapiens
cctgtgtttcaccaaaagagtc

SEQ ID NO: 7085140 - DNA, 22 bp, Homo sapiens
cctgtgtttctgttggaattaa

SEQ ID NO: 7085141 - DNA, 19 bp, Homo sapiens
cctgtgttgggagtgtgag

SEQ ID NO: 7085142 - DNA, 22 bp, Homo sapiens
cctgtgttctaatccatctcag

SEQ ID NO: 7085143 - DNA, 22 bp, Homo sapiens
cctgtgttagttatgggtctct

SEQ ID NO: 7085144 - DNA, 22 bp, Homo sapiens
cctgttccattcatatcctatt

SEQ ID NO: 7085145 - DNA, 22 bp, Homo sapiens
aggtttctgctgtcctccttct

SEQ ID NO: 7085146 - DNA, 22 bp, Homo sapiens
aggtttctgcaatgtgtgtaca

SEQ ID NO: 7085147 - DNA, 22 bp, Homo sapiens
aggtttctgcactgtcactggt

SEQ ID NO: 7085148 - DNA, 22 bp, Homo sapiens
cgcaggtgaactgttctgcagt

SEQ ID NO: 7085149 - DNA, 22 bp, Homo sapiens
cgcaggtgaactgttctgcagt

SEQ ID NO: 7085150 - DNA, 22 bp, Homo sapiens
cgcagggccgcgagcgggacca

SEQ ID NO: 7085151 - DNA, 22 bp, Homo sapiens
cgcaggggaggaaggtacacct

SEQ ID NO: 7085152 - DNA, 22 bp, Homo sapiens
cgcaggtgaaagaggctgggca

SEQ ID NO: 7085153 - DNA, 22 bp, Homo sapiens
cgcaggggaggaaggtacacct

SEQ ID NO: 7085154 - DNA, 22 bp, Homo sapiens
cgcaggctcggttcacagagca

SEQ ID NO: 7085155 - DNA, 22 bp, Homo sapiens
cgcaggctgcagccaagaagag

SEQ ID NO: 7085156 - DNA, 22 bp, Homo sapiens
cgcaggctggcgcggagtggca

SEQ ID NO: 7085157 - DNA, 22 bp, Homo sapiens
cgcaggctggcgcggagtggca

SEQ ID NO: 7085158 - DNA, 22 bp, Homo sapiens
cgcaggctggcgcggagtggca

SEQ ID NO: 7085159 - DNA, 19 bp, Homo sapiens
cgcaggcttcgggtcgctc

SEQ ID NO: 7085160 - DNA, 22 bp, Homo sapiens
cgcaggctttagaatctgctac

SEQ ID NO: 7085161 - DNA, 22 bp, Homo sapiens
cgcagggatttcaaggggcctt

SEQ ID NO: 7085162 - DNA, 22 bp, Homo sapiens
cgcagggccgcgagcgggacca

SEQ ID NO: 7085163 - DNA, 22 bp, Homo sapiens
aggtttctttatgctgctagaa

SEQ ID NO: 7085164 - DNA, 22 bp, Homo sapiens
aggtttcttcttaggaatatgt

SEQ ID NO: 7085165 - DNA, 22 bp, Homo sapiens
aggtttctttatgctgctagaa

SEQ ID NO: 7085166 - DNA, 21 bp, Homo sapiens
aggtttctgtgagcagagcag

SEQ ID NO: 7085167 - DNA, 22 bp, Homo sapiens
aggtttctggatttattatggc

SEQ ID NO: 7085168 - DNA, 22 bp, Homo sapiens
aggtttctggaaaggttttgct

SEQ ID NO: 7085169 - DNA, 22 bp, Homo sapiens
aggtttgggagtagaaatcaga

SEQ ID NO: 7085170 - DNA, 23 bp, Homo sapiens
aggtttgtctcagaggcagagtt

SEQ ID NO: 7085171 - DNA, 22 bp, Homo sapiens
aggtttgtgtcttgcttaaggt

SEQ ID NO: 7085172 - DNA, 22 bp, Homo sapiens
aggtttgttaaaccagattgct

SEQ ID NO: 7085173 - DNA, 22 bp, Homo sapiens
aggtttgtttatgtatcattgg

SEQ ID NO: 7085174 - DNA, 22 bp, Homo sapiens
aggtttgttttggaaagatcat

SEQ ID NO: 7085175 - DNA, 20 bp, Homo sapiens
cggctcagcctctccctccc

SEQ ID NO: 7085176 - DNA, 22 bp, Homo sapiens
cggctcagctagcttggcccca

SEQ ID NO: 7085177 - DNA, 22 bp, Homo sapiens
cggctcagctagcttggcccca

SEQ ID NO: 7085178 - DNA, 22 bp, Homo sapiens
cggctcagctagcttggcccca

SEQ ID NO: 7085179 - DNA, 22 bp, Homo sapiens
agtaaaaatatgcttgtggcta

SEQ ID NO: 7085180 - DNA, 22 bp, Homo sapiens
agtaaaaagttcagaatggttg

SEQ ID NO: 7085181 - DNA, 22 bp, Homo sapiens
agtaaaaagttcagaatggttg

SEQ ID NO: 7085182 - DNA, 22 bp, Homo sapiens
cgggcagcggcgtggccatggt

SEQ ID NO: 7085183 - DNA, 22 bp, Homo sapiens
cgggcagcggcgtggccatggt

SEQ ID NO: 7085184 - DNA, 22 bp, Homo sapiens
cgggcagcggcgtggccatggt

SEQ ID NO: 7085185 - DNA, 22 bp, Homo sapiens
cgggcagcggcgtggccatggt

SEQ ID NO: 7085186 - DNA, 22 bp, Homo sapiens
cgggcagatcacacagggcttg

SEQ ID NO: 7085187 - DNA, 22 bp, Homo sapiens
cgggcagattgggaaggttcat

SEQ ID NO: 7085188 - DNA, 22 bp, Homo sapiens
cgggcaccaccctggtgtgtcc

SEQ ID NO: 7085189 - DNA, 22 bp, Homo sapiens
cggctcaggccacaggacggca

SEQ ID NO: 7085190 - DNA, 22 bp, Homo sapiens
cggctcagctagcttggcccca

SEQ ID NO: 7085191 - DNA, 17 bp, Homo sapiens
cgggcatggagggcagg

SEQ ID NO: 7085192 - DNA, 17 bp, Homo sapiens
cgggcatggagggcagg

SEQ ID NO: 7085193 - DNA, 17 bp, Homo sapiens
cgggcatggagggcagg

SEQ ID NO: 7085194 - DNA, 17 bp, Homo sapiens
cgggcatggagggcagg

SEQ ID NO: 7085195 - DNA, 22 bp, Homo sapiens
cgggcccgagcacggcacccac

SEQ ID NO: 7085196 - DNA, 22 bp, Homo sapiens
cgggccctttaaggatgtgtcg

SEQ ID NO: 7085197 - DNA, 22 bp, Homo sapiens
cgggccgttaggaaggtggggc

SEQ ID NO: 7085198 - DNA, 17 bp, Homo sapiens
cgggcatggagggcagg

SEQ ID NO: 7085199 - DNA, 17 bp, Homo sapiens
cgggcatggagggcagg

SEQ ID NO: 7085200 - DNA, 22 bp, Homo sapiens
cgggcagtgtggctccagagtc

SEQ ID NO: 7085201 - DNA, 17 bp, Homo sapiens
cgggcatggagggcagg

SEQ ID NO: 7085202 - DNA, 22 bp, Homo sapiens
agtacaagtagaatgctacaag

SEQ ID NO: 7085203 - DNA, 21 bp, Homo sapiens
cgggctggccgggccctcacc

SEQ ID NO: 7085204 - DNA, 20 bp, Homo sapiens
agtacaatgtatgattcaga

SEQ ID NO: 7085205 - DNA, 22 bp, Homo sapiens
agtacaatgtctgacacagtag

SEQ ID NO: 7085206 - DNA, 22 bp, Homo sapiens
cgggcgcactccgggcagctgt

SEQ ID NO: 7085207 - DNA, 22 bp, Homo sapiens
cgggcgcactccgggcagctgt

SEQ ID NO: 7085208 - DNA, 22 bp, Homo sapiens
cgggcgcactccgggcagctgt

SEQ ID NO: 7085209 - DNA, 18 bp, Homo sapiens
cgggcgggcgcctggccc

SEQ ID NO: 7085210 - DNA, 18 bp, Homo sapiens
cgggcgggcgcctggccc

SEQ ID NO: 7085211 - DNA, 22 bp, Homo sapiens
cgggctgctctggaccgacagc

SEQ ID NO: 7085212 - DNA, 21 bp, Homo sapiens
cgggctggccgggccctcacc

SEQ ID NO: 7085213 - DNA, 21 bp, Homo sapiens
cgggctggccgggccctcacc

SEQ ID NO: 7085214 - DNA, 18 bp, Homo sapiens
ctaagaggtcgtttctca

SEQ ID NO: 7085215 - DNA, 20 bp, Homo sapiens
ctaagaggtccttccacatc

SEQ ID NO: 7085216 - DNA, 20 bp, Homo sapiens
ctaagaggaggactaggttt

SEQ ID NO: 7085217 - DNA, 22 bp, Homo sapiens
ctaagaggaagtactctgttat

SEQ ID NO: 7085218 - DNA, 22 bp, Homo sapiens
ctaagatagattttttcacttt

SEQ ID NO: 7085219 - DNA, 22 bp, Homo sapiens
ctaagcaagaatgagtgcaaca

SEQ ID NO: 7085220 - DNA, 22 bp, Homo sapiens
ctaagcaagttccactctacaa

SEQ ID NO: 7085221 - DNA, 22 bp, Homo sapiens
ctaaactgctctggggttctaa

SEQ ID NO: 7085222 - DNA, 19 bp, Homo sapiens
ctaaacttatgtgaccaca

SEQ ID NO: 7085223 - DNA, 19 bp, Homo sapiens
ctaaacttatgtgaccaca

SEQ ID NO: 7085224 - DNA, 22 bp, Homo sapiens
ctaaacttcatatgttgcttta

SEQ ID NO: 7085225 - DNA, 22 bp, Homo sapiens
ctaaacttcatatgttgcttta

SEQ ID NO: 7085226 - DNA, 22 bp, Homo sapiens
ctaaacttcttggcaattttat

SEQ ID NO: 7085227 - DNA, 22 bp, Homo sapiens
ctaaacttcttggcaattttat

SEQ ID NO: 7085228 - DNA, 22 bp, Homo sapiens
ctaaactttgtttatactctga

SEQ ID NO: 7085229 - DNA, 22 bp, Homo sapiens
ctaaactttgtttatactctga

SEQ ID NO: 7085230 - DNA, 22 bp, Homo sapiens
ctaaacttttataacattgaga

SEQ ID NO: 7085231 - DNA, 22 bp, Homo sapiens
ctaagaaatgttgtgaatgcca

SEQ ID NO: 7085232 - DNA, 22 bp, Homo sapiens
ctaagaacagtctaccctcctt

SEQ ID NO: 7085233 - DNA, 22 bp, Homo sapiens
agtacacagtagactttctcat

SEQ ID NO: 7085234 - DNA, 22 bp, Homo sapiens
agtacacagtagactttctcat

SEQ ID NO: 7085235 - DNA, 22 bp, Homo sapiens
agtacacagagttattttgtgt

SEQ ID NO: 7085236 - DNA, 22 bp, Homo sapiens
agtacacagagttattttgtgt

SEQ ID NO: 7085237 - DNA, 22 bp, Homo sapiens
agtacacacagtagaatagagt

SEQ ID NO: 7085238 - DNA, 22 bp, Homo sapiens
agtacacagaattctacttgtt

SEQ ID NO: 7085239 - DNA, 22 bp, Homo sapiens
agtacacagaattctacttgtt

SEQ ID NO: 7085240 - DNA, 22 bp, Homo sapiens
agtacacaagacacatttaaaa

SEQ ID NO: 7085241 - DNA, 22 bp, Homo sapiens
agtacacaagacacatttaaaa

SEQ ID NO: 7085242 - DNA, 22 bp, Homo sapiens
agtacacaagacacatttaaaa

SEQ ID NO: 7085243 - DNA, 22 bp, Homo sapiens
agtacacaagacacatttaaaa

SEQ ID NO: 7085244 - DNA, 22 bp, Homo sapiens
agtacaattatatttagatggt

SEQ ID NO: 7085245 - DNA, 22 bp, Homo sapiens
agtacaatttaatgaagatagc

SEQ ID NO: 7085246 - DNA, 22 bp, Homo sapiens
agtacactggcaaatgtggtgg

SEQ ID NO: 7085247 - DNA, 22 bp, Homo sapiens
agtacagatttagacacgatag

SEQ ID NO: 7085248 - DNA, 22 bp, Homo sapiens
agtacagcaccatgagcacagg

SEQ ID NO: 7085249 - DNA, 22 bp, Homo sapiens
agtacagcccaggccaggctgg

SEQ ID NO: 7085250 - DNA, 22 bp, Homo sapiens
agtacagggagtttgttgtgtt

SEQ ID NO: 7085251 - DNA, 22 bp, Homo sapiens
agtacagtagatgtaggaatag

SEQ ID NO: 7085252 - DNA, 22 bp, Homo sapiens
agtacagtagatgtaggaatag

SEQ ID NO: 7085253 - DNA, 22 bp, Homo sapiens
agtacagtagggtgctgttagt

SEQ ID NO: 7085254 - DNA, 22 bp, Homo sapiens
agtacagtagggtgctgttagt

SEQ ID NO: 7085255 - DNA, 22 bp, Homo sapiens
agtacagtcaggaagctgctgt

SEQ ID NO: 7085256 - DNA, 22 bp, Homo sapiens
agtacagtcaggaagctgctgt

SEQ ID NO: 7085257 - DNA, 22 bp, Homo sapiens
agtacagtgctcagtaatctaa

SEQ ID NO: 7085258 - DNA, 22 bp, Homo sapiens
agtacagtggtcataatataaa

SEQ ID NO: 7085259 - DNA, 22 bp, Homo sapiens
ctgagcagatgttgcccagaag

SEQ ID NO: 7085260 - DNA, 22 bp, Homo sapiens
ctgagcagatgttgcccagaag

SEQ ID NO: 7085261 - DNA, 22 bp, Homo sapiens
ctgagcagcaacccagagcctc

SEQ ID NO: 7085262 - DNA, 22 bp, Homo sapiens
ctgagcagcaacccagagcctc

SEQ ID NO: 7085263 - DNA, 19 bp, Homo sapiens
ctgagcagagggaggaact

SEQ ID NO: 7085264 - DNA, 19 bp, Homo sapiens
ctgagcagagggaggaact

SEQ ID NO: 7085265 - DNA, 22 bp, Homo sapiens
ctgagcagaggtcaagatactt

SEQ ID NO: 7085266 - DNA, 22 bp, Homo sapiens
ctgagcagatgaccagccccag

SEQ ID NO: 7085267 - DNA, 22 bp, Homo sapiens
ctgagcagatgaccagccccag

SEQ ID NO: 7085268 - DNA, 22 bp, Homo sapiens
ctgagcagcacagggcgccagg

SEQ ID NO: 7085269 - DNA, 22 bp, Homo sapiens
ctgagcagcaattgctggccca

SEQ ID NO: 7085270 - DNA, 22 bp, Homo sapiens
ctgagcagcaattgctggccca

SEQ ID NO: 7085271 - DNA, 22 bp, Homo sapiens
ctgagcagcaacccagagcctc

SEQ ID NO: 7085272 - DNA, 22 bp, Homo sapiens
ctgagcagcaattgctggccca

SEQ ID NO: 7085273 - DNA, 22 bp, Homo sapiens
ctgagcagcaattgctggccca

SEQ ID NO: 7085274 - DNA, 22 bp, Homo sapiens
ctgagcagcaacccagagcctc

SEQ ID NO: 7085275 - DNA, 22 bp, Homo sapiens
ctgagcagcacagggcgccagg

SEQ ID NO: 7085276 - DNA, 22 bp, Homo sapiens
ctgagcagcagggagactggtg

SEQ ID NO: 7085277 - DNA, 22 bp, Homo sapiens
ctgagcagcagggagactggtg

SEQ ID NO: 7085278 - DNA, 22 bp, Homo sapiens
ctgagcagccccaccagccatt

SEQ ID NO: 7085279 - DNA, 22 bp, Homo sapiens
ctgagcagcagggagactggtg

SEQ ID NO: 7085280 - DNA, 22 bp, Homo sapiens
ctgagctgggactcagtagcaa

SEQ ID NO: 7085281 - DNA, 22 bp, Homo sapiens
ctgaggagaacaatgagatcaa

SEQ ID NO: 7085282 - DNA, 22 bp, Homo sapiens
ctgaggagaggtggcctgtgtt

SEQ ID NO: 7085283 - DNA, 22 bp, Homo sapiens
ctgaggagagatcacgtggtgt

SEQ ID NO: 7085284 - DNA, 22 bp, Homo sapiens
ctgaggagaggtggcctgtgtt

SEQ ID NO: 7085285 - DNA, 22 bp, Homo sapiens
ctgaggagagatcacgtggtgt

SEQ ID NO: 7085286 - DNA, 22 bp, Homo sapiens
agttatataactatctagatgc

SEQ ID NO: 7085287 - DNA, 22 bp, Homo sapiens
agttatataactatctagatgc

SEQ ID NO: 7085288 - DNA, 22 bp, Homo sapiens
agttataccttatacacatatg

SEQ ID NO: 7085289 - DNA, 22 bp, Homo sapiens
agttataatctgctactgatat

SEQ ID NO: 7085290 - DNA, 22 bp, Homo sapiens
agttataatctgctactgatat

SEQ ID NO: 7085291 - DNA, 22 bp, Homo sapiens
agttataaaaggagcactgatt

SEQ ID NO: 7085292 - DNA, 22 bp, Homo sapiens
agttagaatataattatgttaa

SEQ ID NO: 7085293 - DNA, 22 bp, Homo sapiens
agttagaatggatgttgagagc

SEQ ID NO: 7085294 - DNA, 20 bp, Homo sapiens
agttagcaggtgctggtgtc

SEQ ID NO: 7085295 - DNA, 20 bp, Homo sapiens
agttaggaatttaagtgtta

SEQ ID NO: 7085296 - DNA, 22 bp, Homo sapiens
agttaggacacttgagggctaa

SEQ ID NO: 7085297 - DNA, 22 bp, Homo sapiens
agttaggacccacacccaccag

SEQ ID NO: 7085298 - DNA, 22 bp, Homo sapiens
agttaggagcaaaataagatag

SEQ ID NO: 7085299 - DNA, 22 bp, Homo sapiens
agttaggagtataggaatgcct

SEQ ID NO: 7085300 - DNA, 22 bp, Homo sapiens
agttaggatttctccggggagg

SEQ ID NO: 7085301 - DNA, 22 bp, Homo sapiens
agttagtagacttttccattta

SEQ ID NO: 7085302 - DNA, 22 bp, Homo sapiens
agttagaagtgtgtcatctgtg

SEQ ID NO: 7085303 - DNA, 22 bp, Homo sapiens
agttagaatagtcagattgtag

SEQ ID NO: 7085304 - DNA, 22 bp, Homo sapiens
agttagaaagtaaatcatttga

SEQ ID NO: 7085305 - DNA, 22 bp, Homo sapiens
agttacttgagacgtttatgaa

SEQ ID NO: 7085306 - DNA, 22 bp, Homo sapiens
agttacttgagacgtttatgaa

SEQ ID NO: 7085307 - DNA, 22 bp, Homo sapiens
agttactcactgagggtttatt

SEQ ID NO: 7085308 - DNA, 22 bp, Homo sapiens
ctgagaaaccaggtgctctgat

SEQ ID NO: 7085309 - DNA, 22 bp, Homo sapiens
ctgagaaaccaggtgctctgat

SEQ ID NO: 7085310 - DNA, 22 bp, Homo sapiens
ctgagaaacatatttccatcta

SEQ ID NO: 7085311 - DNA, 22 bp, Homo sapiens
ctgagaaacaatgaattgtgat

SEQ ID NO: 7085312 - DNA, 22 bp, Homo sapiens
ctgagaaacaatgaattgtgat

SEQ ID NO: 7085313 - DNA, 22 bp, Homo sapiens
ctgagaaagatttgcctccgtg

SEQ ID NO: 7085314 - DNA, 22 bp, Homo sapiens
ctgagaaaggacctcaaacagg

SEQ ID NO: 7085315 - DNA, 22 bp, Homo sapiens
ctgaatgaggaaaagagtgagg

SEQ ID NO: 7085316 - DNA, 22 bp, Homo sapiens
ctgaatgagggattctgagggc

SEQ ID NO: 7085317 - DNA, 22 bp, Homo sapiens
ctgaatgagggattctgagggc

SEQ ID NO: 7085318 - DNA, 22 bp, Homo sapiens
ctgaatgagtggatttttcatt

SEQ ID NO: 7085319 - DNA, 22 bp, Homo sapiens
ctgaatgaaatcaaggactgag

SEQ ID NO: 7085320 - DNA, 22 bp, Homo sapiens
ctgaatgaatggtttgtcttat

SEQ ID NO: 7085321 - DNA, 22 bp, Homo sapiens
ctgaatgactgaagtcacaatt

SEQ ID NO: 7085322 - DNA, 22 bp, Homo sapiens
ctgaatgaggaaaagagtgagg

SEQ ID NO: 7085323 - DNA, 22 bp, Homo sapiens
ctgaaggaagcagaagcgaggt

SEQ ID NO: 7085324 - DNA, 22 bp, Homo sapiens
ctgaaggaagcaggtggcctgt

SEQ ID NO: 7085325 - DNA, 20 bp, Homo sapiens
agtgtctggattttgtaacc

SEQ ID NO: 7085326 - DNA, 20 bp, Homo sapiens
agtgtctggattttgtaacc

SEQ ID NO: 7085327 - DNA, 20 bp, Homo sapiens
agtgtctgggcctcaggccc

SEQ ID NO: 7085328 - DNA, 18 bp, Homo sapiens
agtgtctggatatttggg

SEQ ID NO: 7085329 - DNA, 22 bp, Homo sapiens
agtgtctggaggcattcttggt

SEQ ID NO: 7085330 - DNA, 18 bp, Homo sapiens
agtgtctggatatttggg

SEQ ID NO: 7085331 - DNA, 22 bp, Homo sapiens
agtgtctgctttgagtcaggtg

SEQ ID NO: 7085332 - DNA, 22 bp, Homo sapiens
agtgtctgcttatcagttcttg

SEQ ID NO: 7085333 - DNA, 22 bp, Homo sapiens
agtgtctgctttgagtcaggtg

SEQ ID NO: 7085334 - DNA, 22 bp, Homo sapiens
agtgtctgctttgagtcaggtg

SEQ ID NO: 7085335 - DNA, 22 bp, Homo sapiens
agtgtctgcttatcagttcttg

SEQ ID NO: 7085336 - DNA, 22 bp, Homo sapiens
agtgtctgctcagacagctaca

SEQ ID NO: 7085337 - DNA, 22 bp, Homo sapiens
agtgtctgctcagacagctaca

SEQ ID NO: 7085338 - DNA, 22 bp, Homo sapiens
agtgtctgctaggttcatcaac

SEQ ID NO: 7085339 - DNA, 22 bp, Homo sapiens
agtgtctgcgggcagaggagcg

SEQ ID NO: 7085340 - DNA, 22 bp, Homo sapiens
agtgtctgcgggcagaggagcg

SEQ ID NO: 7085341 - DNA, 22 bp, Homo sapiens
agtgtctgcggcggggaggcgg

SEQ ID NO: 7085342 - DNA, 22 bp, Homo sapiens
agtgtctgcggcggggaggcgg

SEQ ID NO: 7085343 - DNA, 22 bp, Homo sapiens
ctgaaattctgcctctgcacaa

SEQ ID NO: 7085344 - DNA, 23 bp, Homo sapiens
ctgaaattcagatgctaaagata

SEQ ID NO: 7085345 - DNA, 22 bp, Homo sapiens
ctgaaattccatttcagccaca

SEQ ID NO: 7085346 - DNA, 22 bp, Homo sapiens
ctgaaattccatttcagccaca

SEQ ID NO: 7085347 - DNA, 22 bp, Homo sapiens
ctgaaattccatttcagccaca

SEQ ID NO: 7085348 - DNA, 22 bp, Homo sapiens
ctgaaatgttaaatacttggct

SEQ ID NO: 7085349 - DNA, 22 bp, Homo sapiens
ctgaaattactggccctggagc

SEQ ID NO: 7085350 - DNA, 22 bp, Homo sapiens
ctgaaattattgtttaatcaaa

SEQ ID NO: 7085351 - DNA, 22 bp, Homo sapiens
ctgaatggcgagttagttagtt

SEQ ID NO: 7085352 - DNA, 22 bp, Homo sapiens
ctgaatggcgagttagttagtt

SEQ ID NO: 7085353 - DNA, 22 bp, Homo sapiens
ctgaatggaatcatccctgctt

SEQ ID NO: 7085354 - DNA, 22 bp, Homo sapiens
ctgaatgatataagatctttct

SEQ ID NO: 7085355 - DNA, 21 bp, Homo sapiens
ctgaatgccccaaatgacctt

SEQ ID NO: 7085356 - DNA, 22 bp, Homo sapiens
ctgaatgataatcttttgctgg

SEQ ID NO: 7085357 - DNA, 22 bp, Homo sapiens
ctgaatgatataagatctttct

SEQ ID NO: 7085358 - DNA, 22 bp, Homo sapiens
ctgaattctgccttgaggcctt

SEQ ID NO: 7085359 - DNA, 22 bp, Homo sapiens
ctgacaaaccactgctccagct

SEQ ID NO: 7085360 - DNA, 22 bp, Homo sapiens
ctgacaaaccactgctccagct

SEQ ID NO: 7085361 - DNA, 22 bp, Homo sapiens
ctgacaaacttaattttctgaa

SEQ ID NO: 7085362 - DNA, 22 bp, Homo sapiens
ctgacaaacttaattttctgaa

SEQ ID NO: 7085363 - DNA, 22 bp, Homo sapiens
ctgacaaaggcaaggcaggggg

SEQ ID NO: 7085364 - DNA, 22 bp, Homo sapiens
ctgacaaaggcaaggcaggggg

SEQ ID NO: 7085365 - DNA, 20 bp, Homo sapiens
ctgacagaaaatatttcatc

SEQ ID NO: 7085366 - DNA, 22 bp, Homo sapiens
ctgagaaaagctttcttataca

SEQ ID NO: 7085367 - DNA, 22 bp, Homo sapiens
ctgagaaaagctttcttataca

SEQ ID NO: 7085368 - DNA, 22 bp, Homo sapiens
ctgagaaaagacatttctagat

SEQ ID NO: 7085369 - DNA, 22 bp, Homo sapiens
ctgagaaaagacatttctagat

SEQ ID NO: 7085370 - DNA, 22 bp, Homo sapiens
ctgagaaaagacatttctagat

SEQ ID NO: 7085371 - DNA, 22 bp, Homo sapiens
ctgagaaaagtatgagctctgg

SEQ ID NO: 7085372 - DNA, 22 bp, Homo sapiens
ctgagaaaagtatgagctctgg

SEQ ID NO: 7085373 - DNA, 22 bp, Homo sapiens
ctgagaaaagtatgagctctgg

SEQ ID NO: 7085374 - DNA, 22 bp, Homo sapiens
ctgagaaaatttcaggaagtgt

SEQ ID NO: 7085375 - DNA, 20 bp, Homo sapiens
ctgacagaaaatatttcatc

SEQ ID NO: 7085376 - DNA, 22 bp, Homo sapiens
ctgacagaatcattaagaccat

SEQ ID NO: 7085377 - DNA, 22 bp, Homo sapiens
ctgacttttttcagccacagtg

SEQ ID NO: 7085378 - DNA, 22 bp, Homo sapiens
ctctgctcaccagccatgtgat

SEQ ID NO: 7085379 - DNA, 22 bp, Homo sapiens
ctctgctagggctgaggtgttc

SEQ ID NO: 7085380 - DNA, 22 bp, Homo sapiens
ctctgctcaccagccatgtgat

SEQ ID NO: 7085381 - DNA, 22 bp, Homo sapiens
ctctgctcaccagccatgtgat

SEQ ID NO: 7085382 - DNA, 22 bp, Homo sapiens
ctctgctagaaggtcaatctct

SEQ ID NO: 7085383 - DNA, 22 bp, Homo sapiens
ctctgctagggctgaggtgttc

SEQ ID NO: 7085384 - DNA, 22 bp, Homo sapiens
ctctgcctgtgtcgccaccaca

SEQ ID NO: 7085385 - DNA, 22 bp, Homo sapiens
ctctgcgccaccctcgcctgct

SEQ ID NO: 7085386 - DNA, 22 bp, Homo sapiens
ctctgctaagcatgaacaatta

SEQ ID NO: 7085387 - DNA, 22 bp, Homo sapiens
ctctgctcaccagccatgtgat

SEQ ID NO: 7085388 - DNA, 22 bp, Homo sapiens
ctctgctcaccagccatgtgat

SEQ ID NO: 7085389 - DNA, 22 bp, Homo sapiens
ctctgctgagccagagtcccca

SEQ ID NO: 7085390 - DNA, 22 bp, Homo sapiens
ctctgctgagccagagtcccca

SEQ ID NO: 7085391 - DNA, 21 bp, Homo sapiens
ctctgctgagtcctaggattc

SEQ ID NO: 7085392 - DNA, 21 bp, Homo sapiens
ctctgctgagtcctaggattc

SEQ ID NO: 7085393 - DNA, 21 bp, Homo sapiens
ctctgctgagtcctaggattc

SEQ ID NO: 7085394 - DNA, 22 bp, Homo sapiens
ctctgctgatatagcttttcaa

SEQ ID NO: 7085395 - DNA, 22 bp, Homo sapiens
ctctggatggttctgcacattc

SEQ ID NO: 7085396 - DNA, 20 bp, Homo sapiens
ctctggcaaaggatgcctat

SEQ ID NO: 7085397 - DNA, 22 bp, Homo sapiens
ctctggcttctaccttgcagtt

SEQ ID NO: 7085398 - DNA, 22 bp, Homo sapiens
ctctgcctgtgtcgccaccaca

SEQ ID NO: 7085399 - DNA, 22 bp, Homo sapiens
ctctgcctgtctcatcctgcaa

SEQ ID NO: 7085400 - DNA, 22 bp, Homo sapiens
ctctgcctgtgtcgccaccaca

SEQ ID NO: 7085401 - DNA, 22 bp, Homo sapiens
ctctgcctgtgtcgccaccaca

SEQ ID NO: 7085402 - DNA, 22 bp, Homo sapiens
ctctgcctgtgtcgccaccaca

SEQ ID NO: 7085403 - DNA, 22 bp, Homo sapiens
ctctgcctgtgtcgccaccaca

SEQ ID NO: 7085404 - DNA, 22 bp, Homo sapiens
ctctgcctgtctcatcctgcaa

SEQ ID NO: 7085405 - DNA, 22 bp, Homo sapiens
ctctgcctgtctcatcctgcaa

SEQ ID NO: 7085406 - DNA, 22 bp, Homo sapiens
ctctgcctgtctcatcctgcaa

SEQ ID NO: 7085407 - DNA, 22 bp, Homo sapiens
ctctgcctgtctcatcctgcaa

SEQ ID NO: 7085408 - DNA, 22 bp, Homo sapiens
ctctgcctgcccaccgacccat

SEQ ID NO: 7085409 - DNA, 22 bp, Homo sapiens
ctctgcctgcccaccgacccat

SEQ ID NO: 7085410 - DNA, 22 bp, Homo sapiens
ctctgcctgcccaccgacccat

SEQ ID NO: 7085411 - DNA, 22 bp, Homo sapiens
ctctgcctgccactgttcaggc

SEQ ID NO: 7085412 - DNA, 22 bp, Homo sapiens
ctctgcattttaacagatgatt

SEQ ID NO: 7085413 - DNA, 22 bp, Homo sapiens
ctctgcctgccactgttcaggc

SEQ ID NO: 7085414 - DNA, 22 bp, Homo sapiens
ctctgccaagatgacaggtaag

SEQ ID NO: 7085415 - DNA, 22 bp, Homo sapiens
ctctgcatgccttgctcagaca

SEQ ID NO: 7085416 - DNA, 22 bp, Homo sapiens
ctctgcattttaacagatgatt

SEQ ID NO: 7085417 - DNA, 22 bp, Homo sapiens
ctctgcaggcacccagggtggg

SEQ ID NO: 7085418 - DNA, 23 bp, Homo sapiens
ctctgcaggagagtgggcagggc

SEQ ID NO: 7085419 - DNA, 23 bp, Homo sapiens
ctctgcaggagagtgggcagggc

SEQ ID NO: 7085420 - DNA, 23 bp, Homo sapiens
ctctgcaggagagtgggcagggc

SEQ ID NO: 7085421 - DNA, 22 bp, Homo sapiens
ctctgcaggcacccagggtggg

SEQ ID NO: 7085422 - DNA, 22 bp, Homo sapiens
ctctgcaggcacccagggtggg

SEQ ID NO: 7085423 - DNA, 22 bp, Homo sapiens
ctctgcaggcacccagggtggg

SEQ ID NO: 7085424 - DNA, 22 bp, Homo sapiens
ctctgcaggcctgtgaagggtg

SEQ ID NO: 7085425 - DNA, 22 bp, Homo sapiens
ctctgcaggcctgtgaagggtg

SEQ ID NO: 7085426 - DNA, 22 bp, Homo sapiens
ctctgcaggccttgagtgtggt

SEQ ID NO: 7085427 - DNA, 22 bp, Homo sapiens
ctctgcaggccttgagtgtggt

SEQ ID NO: 7085428 - DNA, 22 bp, Homo sapiens
ctctgcaggccttgagtgtggt

SEQ ID NO: 7085429 - DNA, 22 bp, Homo sapiens
ctctgcaggggaggcatgcact

SEQ ID NO: 7085430 - DNA, 22 bp, Homo sapiens
ctctgcaggggaggcatgcact

SEQ ID NO: 7085431 - DNA, 17 bp, Homo sapiens
ctctgcagtgcatggct

SEQ ID NO: 7085432 - DNA, 17 bp, Homo sapiens
ctctgcagtgcatggct

SEQ ID NO: 7085433 - DNA, 22 bp, Homo sapiens
ctctgcaggcacccagggtggg

SEQ ID NO: 7085434 - DNA, 17 bp, Homo sapiens
ctctgcagtgcatggct

SEQ ID NO: 7085435 - DNA, 21 bp, Homo sapiens
ctctgcagtgcccaccttgcc

SEQ ID NO: 7085436 - DNA, 21 bp, Homo sapiens
ctctgcagtgcccaccttgcc

SEQ ID NO: 7085437 - DNA, 22 bp, Homo sapiens
ctctgcagtgtaacagcgcttg

SEQ ID NO: 7085438 - DNA, 19 bp, Homo sapiens
ctctcagcctgtctccttg

SEQ ID NO: 7085439 - DNA, 19 bp, Homo sapiens
ctctcagcctgtctccttg

SEQ ID NO: 7085440 - DNA, 22 bp, Homo sapiens
ctctcagcaggaaagcatgcaa

SEQ ID NO: 7085441 - DNA, 19 bp, Homo sapiens
ctctcagcctgtctccttg

SEQ ID NO: 7085442 - DNA, 19 bp, Homo sapiens
ctctcagcctgtctccttg

SEQ ID NO: 7085443 - DNA, 19 bp, Homo sapiens
ctctcagcctgtctccttg

SEQ ID NO: 7085444 - DNA, 19 bp, Homo sapiens
ctctcagcctgtctccttg

SEQ ID NO: 7085445 - DNA, 22 bp, Homo sapiens
ctctcaggcttgggtcgtggca

SEQ ID NO: 7085446 - DNA, 22 bp, Homo sapiens
ctctcagggacccagccagcct

SEQ ID NO: 7085447 - DNA, 22 bp, Homo sapiens
ctctcagtcctgcgcgcctctg

SEQ ID NO: 7085448 - DNA, 22 bp, Homo sapiens
ctctcatgcaaaatttagttct

SEQ ID NO: 7085449 - DNA, 22 bp, Homo sapiens
ctctcatgtagtatctgtatgg

SEQ ID NO: 7085450 - DNA, 22 bp, Homo sapiens
ctctccaagttatcaagatgaa

SEQ ID NO: 7085451 - DNA, 22 bp, Homo sapiens
ctctgagcagaggccgtggcta

SEQ ID NO: 7085452 - DNA, 22 bp, Homo sapiens
ctctgagcagcggtgccgaagt

SEQ ID NO: 7085453 - DNA, 22 bp, Homo sapiens
ctctgagcccgctgcagcccca

SEQ ID NO: 7085454 - DNA, 20 bp, Homo sapiens
ctctgcagcaaggcctgggt

SEQ ID NO: 7085455 - DNA, 22 bp, Homo sapiens
ctctgggaagtggagacttcag

SEQ ID NO: 7085456 - DNA, 22 bp, Homo sapiens
ctctgggaattctgagcaagca

SEQ ID NO: 7085457 - DNA, 22 bp, Homo sapiens
ctctgggaagtagatttggcct

SEQ ID NO: 7085458 - DNA, 22 bp, Homo sapiens
ctctgggaagtggagacttcag

SEQ ID NO: 7085459 - DNA, 22 bp, Homo sapiens
ctctgggaaagattgtgcaggc

SEQ ID NO: 7085460 - DNA, 22 bp, Homo sapiens
ctctgggaaagattgtgcaggc

SEQ ID NO: 7085461 - DNA, 22 bp, Homo sapiens
ctctgggaagggctgagcactg

SEQ ID NO: 7085462 - DNA, 22 bp, Homo sapiens
ctctggctttgctcatgcatcc

SEQ ID NO: 7085463 - DNA, 22 bp, Homo sapiens
ctctggctttgctcatgcatcc

SEQ ID NO: 7085464 - DNA, 22 bp, Homo sapiens
ctctggctttgctcatgcatcc

SEQ ID NO: 7085465 - DNA, 22 bp, Homo sapiens
ctctggctttgctcatgcatcc

SEQ ID NO: 7085466 - DNA, 22 bp, Homo sapiens
ctctggctttcccagggaggag

SEQ ID NO: 7085467 - DNA, 22 bp, Homo sapiens
ctctggcttgttaatgcatatt

SEQ ID NO: 7085468 - DNA, 22 bp, Homo sapiens
ctctggcttgttaatgcatatt

SEQ ID NO: 7085469 - DNA, 22 bp, Homo sapiens
ctctggctttaaggatgccaca

SEQ ID NO: 7085470 - DNA, 22 bp, Homo sapiens
ctctggctttaaggatgccaca

SEQ ID NO: 7085471 - DNA, 18 bp, Homo sapiens
ctctgggagaggcataca

SEQ ID NO: 7085472 - DNA, 22 bp, Homo sapiens
ctctgggactagaaccccaggg

SEQ ID NO: 7085473 - DNA, 22 bp, Homo sapiens
ctctgggagaggacacttggag

SEQ ID NO: 7085474 - DNA, 22 bp, Homo sapiens
ctctgggagaggacacttggag

SEQ ID NO: 7085475 - DNA, 22 bp, Homo sapiens
ctctgggagaggacacttggag

SEQ ID NO: 7085476 - DNA, 22 bp, Homo sapiens
ctctgggaccatggcaagtgcg

SEQ ID NO: 7085477 - DNA, 22 bp, Homo sapiens
ctctgggactagaaccccaggg

SEQ ID NO: 7085478 - DNA, 22 bp, Homo sapiens
ctctgggaccatggcaagtgcg

SEQ ID NO: 7085479 - DNA, 22 bp, Homo sapiens
ctctgggacatcccttggccta

SEQ ID NO: 7085480 - DNA, 22 bp, Homo sapiens
ctctgggcttcaagtcagattt

SEQ ID NO: 7085481 - DNA, 22 bp, Homo sapiens
ctctgggcttcctttgtgggtt

SEQ ID NO: 7085482 - DNA, 22 bp, Homo sapiens
ctctgggcttgttgacctgcac

SEQ ID NO: 7085483 - DNA, 22 bp, Homo sapiens
ctctgggcttgttgacctgcac

SEQ ID NO: 7085484 - DNA, 22 bp, Homo sapiens
ctctgggcttacctgcttcctg

SEQ ID NO: 7085485 - DNA, 22 bp, Homo sapiens
ctctgggcttacctgcttcctg

SEQ ID NO: 7085486 - DNA, 22 bp, Homo sapiens
ctctgggcttacctgcttcctg

SEQ ID NO: 7085487 - DNA, 18 bp, Homo sapiens
ctctgggagaggcataca

SEQ ID NO: 7085488 - DNA, 19 bp, Homo sapiens
ctctgggctgcatcttggt

SEQ ID NO: 7085489 - DNA, 22 bp, Homo sapiens
ctctgggctgccttttagctct

SEQ ID NO: 7085490 - DNA, 22 bp, Homo sapiens
ctctgggctgccttttagctct

SEQ ID NO: 7085491 - DNA, 20 bp, Homo sapiens
ctctgggctgcgttgcaaac

SEQ ID NO: 7085492 - DNA, 22 bp, Homo sapiens
ctgaaatgggcaaaagtagatt

SEQ ID NO: 7085493 - DNA, 22 bp, Homo sapiens
ctgaaatatatactgggaaaaa

SEQ ID NO: 7085494 - DNA, 17 bp, Homo sapiens
ctgaaatattatgataa

SEQ ID NO: 7085495 - DNA, 22 bp, Homo sapiens
ctgaaatagtttcatagaactt

SEQ ID NO: 7085496 - DNA, 23 bp, Homo sapiens
ctgaaataccagaaaatcagtgt

SEQ ID NO: 7085497 - DNA, 22 bp, Homo sapiens
ctgaaaggtataaataagactt

SEQ ID NO: 7085498 - DNA, 22 bp, Homo sapiens
ctgaaagggttacatagtaagt

SEQ ID NO: 7085499 - DNA, 22 bp, Homo sapiens
ctgaaagggagaacaccaagag

SEQ ID NO: 7085500 - DNA, 22 bp, Homo sapiens
ctctttggttaatcacacagat

SEQ ID NO: 7085501 - DNA, 22 bp, Homo sapiens
ctgaaaggcagtgggtagtgtg

SEQ ID NO: 7085502 - DNA, 22 bp, Homo sapiens
ctgaaaggcagtgggtagtgtg

SEQ ID NO: 7085503 - DNA, 22 bp, Homo sapiens
ctctggggaagcagccagctgg

SEQ ID NO: 7085504 - DNA, 22 bp, Homo sapiens
ctctggggaagcagccagctgg

SEQ ID NO: 7085505 - DNA, 22 bp, Homo sapiens
ctctggggaaatggatatgtac

SEQ ID NO: 7085506 - DNA, 22 bp, Homo sapiens
ctctgggcttgttgacctgcac

SEQ ID NO: 7085507 - DNA, 22 bp, Homo sapiens
ctctgggcttgttgacctgcac

SEQ ID NO: 7085508 - DNA, 22 bp, Homo sapiens
ctctggggaaatggatatgtac

SEQ ID NO: 7085509 - DNA, 22 bp, Homo sapiens
ctctggggaaatggatatgtac

SEQ ID NO: 7085510 - DNA, 22 bp, Homo sapiens
ctctggggaagcagccagctgg

SEQ ID NO: 7085511 - DNA, 22 bp, Homo sapiens
ctctggggaagcagccagctgg

SEQ ID NO: 7085512 - DNA, 17 bp, Homo sapiens
ctctggggacagttcta

SEQ ID NO: 7085513 - DNA, 17 bp, Homo sapiens
ctctggggacagttcta

SEQ ID NO: 7085514 - DNA, 22 bp, Homo sapiens
ctctggggtgcttcgacacttc

SEQ ID NO: 7085515 - DNA, 22 bp, Homo sapiens
ctctggggtgcttcgacacttc

SEQ ID NO: 7085516 - DNA, 22 bp, Homo sapiens
ctctggggtggaggaggctgac

SEQ ID NO: 7085517 - DNA, 22 bp, Homo sapiens
ctctggggtggaggaggctgac

SEQ ID NO: 7085518 - DNA, 22 bp, Homo sapiens
ctctggggttaagcttccatgg

SEQ ID NO: 7085519 - DNA, 22 bp, Homo sapiens
ctctggggttaagcttccatgg

SEQ ID NO: 7085520 - DNA, 22 bp, Homo sapiens
ctctggggttaagcttccatgg

SEQ ID NO: 7085521 - DNA, 22 bp, Homo sapiens
ctctggggttaagcttccatgg

SEQ ID NO: 7085522 - DNA, 22 bp, Homo sapiens
ctctggggtggaggaggctgac

SEQ ID NO: 7085523 - DNA, 22 bp, Homo sapiens
ctctggggtggaggaggctgac

SEQ ID NO: 7085524 - DNA, 22 bp, Homo sapiens
ctctggggtggaggaggctgac

SEQ ID NO: 7085525 - DNA, 22 bp, Homo sapiens
ctctggggtggaggaggctgac

SEQ ID NO: 7085526 - DNA, 22 bp, Homo sapiens
ctctggggtgcttcgacacttc

SEQ ID NO: 7085527 - DNA, 22 bp, Homo sapiens
ctctggggtgcttcgacacttc

SEQ ID NO: 7085528 - DNA, 22 bp, Homo sapiens
ctctggggtggaggaggctgac

SEQ ID NO: 7085529 - DNA, 22 bp, Homo sapiens
ctctggggtggaggaggctgac

SEQ ID NO: 7085530 - DNA, 22 bp, Homo sapiens
ctctggggtggaggaggctgac

SEQ ID NO: 7085531 - DNA, 22 bp, Homo sapiens
ctctggggtggaggaggctgac

SEQ ID NO: 7085532 - DNA, 22 bp, Homo sapiens
agtccctgtactttccactgcc

SEQ ID NO: 7085533 - DNA, 22 bp, Homo sapiens
agtccgcctgctgccgtggcag

SEQ ID NO: 7085534 - DNA, 22 bp, Homo sapiens
agtccggtcagggggctgctgt

SEQ ID NO: 7085535 - DNA, 22 bp, Homo sapiens
agtccgtcctgtcaagcagctg

SEQ ID NO: 7085536 - DNA, 22 bp, Homo sapiens
agtccgtggccagactcaagag

SEQ ID NO: 7085537 - DNA, 22 bp, Homo sapiens
agtccctggattgtctctgtca

SEQ ID NO: 7085538 - DNA, 17 bp, Homo sapiens
agtccctaggtcctggg

SEQ ID NO: 7085539 - DNA, 22 bp, Homo sapiens
agtccctccaacacagtattag

SEQ ID NO: 7085540 - DNA, 23 bp, Homo sapiens
agtcccctacatagttcctgggg

SEQ ID NO: 7085541 - DNA, 22 bp, Homo sapiens
agtcccctctcgcttggctgag

SEQ ID NO: 7085542 - DNA, 22 bp, Homo sapiens
agtcctggacttggagtcaggg

SEQ ID NO: 7085543 - DNA, 22 bp, Homo sapiens
agtcctgatgctctggcaggag

SEQ ID NO: 7085544 - DNA, 22 bp, Homo sapiens
agtcctgatgctctggcaggag

SEQ ID NO: 7085545 - DNA, 22 bp, Homo sapiens
agtcctctggagtatgccttat

SEQ ID NO: 7085546 - DNA, 22 bp, Homo sapiens
agtcctctgctgtgcgtctttg

SEQ ID NO: 7085547 - DNA, 22 bp, Homo sapiens
agtcctcccttggggccacctt

SEQ ID NO: 7085548 - DNA, 22 bp, Homo sapiens
agtcctcccttggggccacctt

SEQ ID NO: 7085549 - DNA, 22 bp, Homo sapiens
agtcctggacttggagtcaggg

SEQ ID NO: 7085550 - DNA, 18 bp, Homo sapiens
agtcctggagatcaccaa

SEQ ID NO: 7085551 - DNA, 22 bp, Homo sapiens
agtcctggcatataggtcctca

SEQ ID NO: 7085552 - DNA, 22 bp, Homo sapiens
agtcctggcatataggtcctca

SEQ ID NO: 7085553 - DNA, 22 bp, Homo sapiens
agtcctggcatataggtcctca

SEQ ID NO: 7085554 - DNA, 22 bp, Homo sapiens
agtcctggcatataggtcctca

SEQ ID NO: 7085555 - DNA, 22 bp, Homo sapiens
agtcctggcatggaattgtccc

SEQ ID NO: 7085556 - DNA, 22 bp, Homo sapiens
agtcctggccccaaggaaggat

SEQ ID NO: 7085557 - DNA, 22 bp, Homo sapiens
agtcctggctctacgggcttca

SEQ ID NO: 7085558 - DNA, 22 bp, Homo sapiens
agtcctgggtccagcaggtcct

SEQ ID NO: 7085559 - DNA, 18 bp, Homo sapiens
agtcctggctctaccacc

SEQ ID NO: 7085560 - DNA, 22 bp, Homo sapiens
agtcctggctctacgggcttca

SEQ ID NO: 7085561 - DNA, 22 bp, Homo sapiens
agtcctggccccaaggaaggat

SEQ ID NO: 7085562 - DNA, 19 bp, Homo sapiens
agtcctggcctgggggacc

SEQ ID NO: 7085563 - DNA, 22 bp, Homo sapiens
agtcctgggtccagcaggtcct

SEQ ID NO: 7085564 - DNA, 22 bp, Homo sapiens
agtcctgggtccagcaggtcct

SEQ ID NO: 7085565 - DNA, 22 bp, Homo sapiens
ctcatggaagacactccttcac

SEQ ID NO: 7085566 - DNA, 22 bp, Homo sapiens
ctcatgcattctttttgtgtgt

SEQ ID NO: 7085567 - DNA, 22 bp, Homo sapiens
ctcatgcccagagccactgttg

SEQ ID NO: 7085568 - DNA, 22 bp, Homo sapiens
ctcatctgtctgggctggtttt

SEQ ID NO: 7085569 - DNA, 22 bp, Homo sapiens
ctcattaaaggaaatcacctgc

SEQ ID NO: 7085570 - DNA, 22 bp, Homo sapiens
ctcattaaaggaaatcacctgc

SEQ ID NO: 7085571 - DNA, 22 bp, Homo sapiens
ctcatgtgtctggtaggagctt

SEQ ID NO: 7085572 - DNA, 22 bp, Homo sapiens
ctcattagacaggtatacttta

SEQ ID NO: 7085573 - DNA, 18 bp, Homo sapiens
ctcatgtgtggtcccagc

SEQ ID NO: 7085574 - DNA, 22 bp, Homo sapiens
ctcatgtgcaaaagtccaaatt

SEQ ID NO: 7085575 - DNA, 20 bp, Homo sapiens
ctcatgtggcaccaggcact

SEQ ID NO: 7085576 - DNA, 22 bp, Homo sapiens
ctcatggagggagtgctcttcc

SEQ ID NO: 7085577 - DNA, 22 bp, Homo sapiens
ctcatggcagagtcacctgtcc

SEQ ID NO: 7085578 - DNA, 22 bp, Homo sapiens
ctcatgtaagagagcattagtt

SEQ ID NO: 7085579 - DNA, 22 bp, Homo sapiens
ctcatgtcaggggtgtcaatgt

SEQ ID NO: 7085580 - DNA, 22 bp, Homo sapiens
ctcatgtcttcacccattctaa

SEQ ID NO: 7085581 - DNA, 22 bp, Homo sapiens
ctcattgcaacctccgcctccc

SEQ ID NO: 7085582 - DNA, 22 bp, Homo sapiens
ctcattgattcagtgctgctct

SEQ ID NO: 7085583 - DNA, 22 bp, Homo sapiens
ctcattccatgtgtattttgag

SEQ ID NO: 7085584 - DNA, 22 bp, Homo sapiens
ctcattctttcacagtctgtgg

SEQ ID NO: 7085585 - DNA, 22 bp, Homo sapiens
ctcattgcagctgcattactgt

SEQ ID NO: 7085586 - DNA, 22 bp, Homo sapiens
ctcattgcagctgcattactgt

SEQ ID NO: 7085587 - DNA, 22 bp, Homo sapiens
ctcattgcagttaatgagatgt

SEQ ID NO: 7085588 - DNA, 22 bp, Homo sapiens
ctccaggacactaacccaggct

SEQ ID NO: 7085589 - DNA, 22 bp, Homo sapiens
ctccaggcgggaggcggttcca

SEQ ID NO: 7085590 - DNA, 22 bp, Homo sapiens
ctccaggcgggaggcggttcca

SEQ ID NO: 7085591 - DNA, 22 bp, Homo sapiens
ctccaggcgggaggcggttcca

SEQ ID NO: 7085592 - DNA, 22 bp, Homo sapiens
ctccaggctcgtccaagatcga

SEQ ID NO: 7085593 - DNA, 22 bp, Homo sapiens
ctccaggctcgtccaagatcga

SEQ ID NO: 7085594 - DNA, 22 bp, Homo sapiens
ctccaggctcgtccaagatcga

SEQ ID NO: 7085595 - DNA, 22 bp, Homo sapiens
ctccaggctggatccaagtcaa

SEQ ID NO: 7085596 - DNA, 22 bp, Homo sapiens
ctccaggctggatccaagtcaa

SEQ ID NO: 7085597 - DNA, 22 bp, Homo sapiens
ctccaggctggatccaagtcaa

SEQ ID NO: 7085598 - DNA, 22 bp, Homo sapiens
ctccaggctggatccaagtcaa

SEQ ID NO: 7085599 - DNA, 22 bp, Homo sapiens
ctccaggctggatccaagtcaa

SEQ ID NO: 7085600 - DNA, 22 bp, Homo sapiens
ctccaggctggggtgcaggttg

SEQ ID NO: 7085601 - DNA, 22 bp, Homo sapiens
ctccaggctggggtgcaggttg

SEQ ID NO: 7085602 - DNA, 22 bp, Homo sapiens
ctccaggctggggtgcaggttg

SEQ ID NO: 7085603 - DNA, 22 bp, Homo sapiens
ctccaggcttcaagggccggcc

SEQ ID NO: 7085604 - DNA, 22 bp, Homo sapiens
ctccaggcttcaagggccggcc

SEQ ID NO: 7085605 - DNA, 22 bp, Homo sapiens
ctccagggaaaggggcgtccgc

SEQ ID NO: 7085606 - DNA, 22 bp, Homo sapiens
ctccagggaaaggggcgtccgc

SEQ ID NO: 7085607 - DNA, 22 bp, Homo sapiens
ctccaggaaagcctgaggcccg

SEQ ID NO: 7085608 - DNA, 22 bp, Homo sapiens
ctccaggaaagcctgaggcccg

SEQ ID NO: 7085609 - DNA, 22 bp, Homo sapiens
ctccaggaaagcctgaggcccg

SEQ ID NO: 7085610 - DNA, 22 bp, Homo sapiens
ctccaggaaaatagggaatgag

SEQ ID NO: 7085611 - DNA, 22 bp, Homo sapiens
ctccagctttttcccagttggc

SEQ ID NO: 7085612 - DNA, 22 bp, Homo sapiens
ctccagctttttcccagttggc

SEQ ID NO: 7085613 - DNA, 22 bp, Homo sapiens
ctccagctttagctctccaggg

SEQ ID NO: 7085614 - DNA, 22 bp, Homo sapiens
ctccagctttagctctccaggg

SEQ ID NO: 7085615 - DNA, 22 bp, Homo sapiens
ctccagctgctggtctgagact

SEQ ID NO: 7085616 - DNA, 22 bp, Homo sapiens
ctccagctgctggtctgagact

SEQ ID NO: 7085617 - DNA, 22 bp, Homo sapiens
ctccagcttccctcagctgtgg

SEQ ID NO: 7085618 - DNA, 22 bp, Homo sapiens
ctccagcttccctcagctgtgg

SEQ ID NO: 7085619 - DNA, 22 bp, Homo sapiens
ctccagcttccctcagctgtgg

SEQ ID NO: 7085620 - DNA, 22 bp, Homo sapiens
ctccagcttccctcagctgtgg

SEQ ID NO: 7085621 - DNA, 22 bp, Homo sapiens
ctccagcttccctcagctgtgg

SEQ ID NO: 7085622 - DNA, 22 bp, Homo sapiens
ctccagctgccaccagatgttt

SEQ ID NO: 7085623 - DNA, 22 bp, Homo sapiens
ctccagctgccaccagatgttt

SEQ ID NO: 7085624 - DNA, 22 bp, Homo sapiens
ctccagctgctggtctgagact

SEQ ID NO: 7085625 - DNA, 22 bp, Homo sapiens
ctccagcttccctcagctgtgg

SEQ ID NO: 7085626 - DNA, 22 bp, Homo sapiens
ctccagcttccctcagctgtgg

SEQ ID NO: 7085627 - DNA, 22 bp, Homo sapiens
ctccagcttctgcccagagact

SEQ ID NO: 7085628 - DNA, 22 bp, Homo sapiens
ctccagcttctgcccagagact

SEQ ID NO: 7085629 - DNA, 22 bp, Homo sapiens
ctccagcttctgcccagagact

SEQ ID NO: 7085630 - DNA, 22 bp, Homo sapiens
ctccagcttctgcccagagact

SEQ ID NO: 7085631 - DNA, 22 bp, Homo sapiens
ctccagctttagctctccaggg

SEQ ID NO: 7085632 - DNA, 22 bp, Homo sapiens
ctccagcctcatctcctggctg

SEQ ID NO: 7085633 - DNA, 22 bp, Homo sapiens
ctccagctagggctggcttact

SEQ ID NO: 7085634 - DNA, 22 bp, Homo sapiens
ctccagctagggctggcttact

SEQ ID NO: 7085635 - DNA, 22 bp, Homo sapiens
ctccagctcgcgagctctgctc

SEQ ID NO: 7085636 - DNA, 22 bp, Homo sapiens
ctccagctcttaactgcggaag

SEQ ID NO: 7085637 - DNA, 22 bp, Homo sapiens
ctccagctcttaactgcggaag

SEQ ID NO: 7085638 - DNA, 22 bp, Homo sapiens
ctccagctgccaccagatgttt

SEQ ID NO: 7085639 - DNA, 22 bp, Homo sapiens
ctccagctgccaccagatgttt

SEQ ID NO: 7085640 - DNA, 22 bp, Homo sapiens
agtcttctcatttcacatgctt

SEQ ID NO: 7085641 - DNA, 22 bp, Homo sapiens
agtcttctgaataagaatcact

SEQ ID NO: 7085642 - DNA, 18 bp, Homo sapiens
agtcttctgatccatttt

SEQ ID NO: 7085643 - DNA, 21 bp, Homo sapiens
agtcttaggcacagctgtgtc

SEQ ID NO: 7085644 - DNA, 22 bp, Homo sapiens
agtcttagaactacagtgccta

SEQ ID NO: 7085645 - DNA, 22 bp, Homo sapiens
agtcttatggttaaatagatgc

SEQ ID NO: 7085646 - DNA, 22 bp, Homo sapiens
agtcttcactcttcactactat

SEQ ID NO: 7085647 - DNA, 22 bp, Homo sapiens
agtcttcactcttcactactat

SEQ ID NO: 7085648 - DNA, 22 bp, Homo sapiens
agtcttcagagaaattaactct

SEQ ID NO: 7085649 - DNA, 22 bp, Homo sapiens
agtcttatgtttgtgaagaact

SEQ ID NO: 7085650 - DNA, 22 bp, Homo sapiens
agtcttcagcagccttctcagg

SEQ ID NO: 7085651 - DNA, 22 bp, Homo sapiens
agtcttcagcagggttaaaccc

SEQ ID NO: 7085652 - DNA, 19 bp, Homo sapiens
agtcttcatctgccaggcc

SEQ ID NO: 7085653 - DNA, 18 bp, Homo sapiens
ctcctggctgatggtgag

SEQ ID NO: 7085654 - DNA, 22 bp, Homo sapiens
ctcctgcccacgtgctacttct

SEQ ID NO: 7085655 - DNA, 22 bp, Homo sapiens
ctcctgcctgtgggactgagga

SEQ ID NO: 7085656 - DNA, 22 bp, Homo sapiens
ctcctgcctgtgggactgagga

SEQ ID NO: 7085657 - DNA, 22 bp, Homo sapiens
ctcctcagaagagggtaacaca

SEQ ID NO: 7085658 - DNA, 22 bp, Homo sapiens
ctcctcagaacagccttggctg

SEQ ID NO: 7085659 - DNA, 22 bp, Homo sapiens
ctcctcagaagagggtaacaca

SEQ ID NO: 7085660 - DNA, 22 bp, Homo sapiens
ctcctcagactttccttgtccg

SEQ ID NO: 7085661 - DNA, 22 bp, Homo sapiens
ctcctcagagagcagcttgggg

SEQ ID NO: 7085662 - DNA, 22 bp, Homo sapiens
ctcctgccaccgcggtgtcctg

SEQ ID NO: 7085663 - DNA, 22 bp, Homo sapiens
ctcctgcccacgtgctacttct

SEQ ID NO: 7085664 - DNA, 22 bp, Homo sapiens
ctcctcacacccactgcaacca

SEQ ID NO: 7085665 - DNA, 22 bp, Homo sapiens
ctcctcactttccagactgggc

SEQ ID NO: 7085666 - DNA, 22 bp, Homo sapiens
ctcctcagaacagccttggctg

SEQ ID NO: 7085667 - DNA, 22 bp, Homo sapiens
ctcctcacacccactgcaacca

SEQ ID NO: 7085668 - DNA, 22 bp, Homo sapiens
ctcctcacacccactgcaacca

SEQ ID NO: 7085669 - DNA, 22 bp, Homo sapiens
ctcctagatgtcttcagagaaa

SEQ ID NO: 7085670 - DNA, 22 bp, Homo sapiens
ctcctaggtgctcactggggtc

SEQ ID NO: 7085671 - DNA, 22 bp, Homo sapiens
ctcctagtgcacacctgtccac

SEQ ID NO: 7085672 - DNA, 22 bp, Homo sapiens
ctcctcaaggtctcaggaataa

SEQ ID NO: 7085673 - DNA, 22 bp, Homo sapiens
ctccctctctaaggcaaagaga

SEQ ID NO: 7085674 - DNA, 22 bp, Homo sapiens
ctccctctctaaggcaaagaga

SEQ ID NO: 7085675 - DNA, 22 bp, Homo sapiens
ctccctctctaaggcaaagaga

SEQ ID NO: 7085676 - DNA, 22 bp, Homo sapiens
ctccctctgaggctttgagcct

SEQ ID NO: 7085677 - DNA, 22 bp, Homo sapiens
ctccctctgtccgaggccggct

SEQ ID NO: 7085678 - DNA, 22 bp, Homo sapiens
ctccggaggggcgctcatgctt

SEQ ID NO: 7085679 - DNA, 21 bp, Homo sapiens
ctccggagtgagctgtgggta

SEQ ID NO: 7085680 - DNA, 22 bp, Homo sapiens
ctccggccgcggtgcccagcgc

SEQ ID NO: 7085681 - DNA, 22 bp, Homo sapiens
ctccgtgctattttagtatcgc

SEQ ID NO: 7085682 - DNA, 22 bp, Homo sapiens
ctcctacagtgtttgagtccag

SEQ ID NO: 7085683 - DNA, 22 bp, Homo sapiens
ctcctacataacccagcgaact

SEQ ID NO: 7085684 - DNA, 22 bp, Homo sapiens
ctcctacattccaccttggact

SEQ ID NO: 7085685 - DNA, 22 bp, Homo sapiens
ctccctcatatacccagcgaga

SEQ ID NO: 7085686 - DNA, 22 bp, Homo sapiens
ctccctcatatacccagcgaga

SEQ ID NO: 7085687 - DNA, 22 bp, Homo sapiens
ctccctccaaataagactcggg

SEQ ID NO: 7085688 - DNA, 22 bp, Homo sapiens
ctccctccctacgtgagctcac

SEQ ID NO: 7085689 - DNA, 22 bp, Homo sapiens
ctccctctcaccggagccctgg

SEQ ID NO: 7085690 - DNA, 22 bp, Homo sapiens
ctccctctcaccggagccctgg

SEQ ID NO: 7085691 - DNA, 22 bp, Homo sapiens
ctccctcctcaaatatctttgt

SEQ ID NO: 7085692 - DNA, 22 bp, Homo sapiens
ctccctcctcaaatatctttgt

SEQ ID NO: 7085693 - DNA, 22 bp, Homo sapiens
ctccctcgagaacgcccctctc

SEQ ID NO: 7085694 - DNA, 22 bp, Homo sapiens
ctccctctcaccggagccctgg

SEQ ID NO: 7085695 - DNA, 22 bp, Homo sapiens
ctccctccctacgtgagctcac

SEQ ID NO: 7085696 - DNA, 22 bp, Homo sapiens
ctccctccctacgtgagctcac

SEQ ID NO: 7085697 - DNA, 22 bp, Homo sapiens
ctccctcctcaaatatctttgt

SEQ ID NO: 7085698 - DNA, 20 bp, Homo sapiens
ctccagggaacagactggag

SEQ ID NO: 7085699 - DNA, 20 bp, Homo sapiens
ctccagggaacagactggag

SEQ ID NO: 7085700 - DNA, 18 bp, Homo sapiens
ctccagggaactcagtca

SEQ ID NO: 7085701 - DNA, 22 bp, Homo sapiens
ctcccaggttgattctttccct

SEQ ID NO: 7085702 - DNA, 22 bp, Homo sapiens
ctcccaggttgattctttccct

SEQ ID NO: 7085703 - DNA, 22 bp, Homo sapiens
ctccctcacacccttgcccaga

SEQ ID NO: 7085704 - DNA, 22 bp, Homo sapiens
ctccctcaccatgacccgctgt

SEQ ID NO: 7085705 - DNA, 22 bp, Homo sapiens
ctccctcaccatgacccgctgt

SEQ ID NO: 7085706 - DNA, 22 bp, Homo sapiens
ctccctcagaggagcacctgtt

SEQ ID NO: 7085707 - DNA, 22 bp, Homo sapiens
ctccctcagaggagcacctgtt

SEQ ID NO: 7085708 - DNA, 22 bp, Homo sapiens
ctccctcagaggagcacctgtt

SEQ ID NO: 7085709 - DNA, 22 bp, Homo sapiens
ctcctgggaatttagttgtgag

SEQ ID NO: 7085710 - DNA, 22 bp, Homo sapiens
ctcctgggaaaggctggacaca

SEQ ID NO: 7085711 - DNA, 22 bp, Homo sapiens
ctcctgggaaatgaaggggcag

SEQ ID NO: 7085712 - DNA, 22 bp, Homo sapiens
ctcctgggaatttagttgtgag

SEQ ID NO: 7085713 - DNA, 20 bp, Homo sapiens
ctcctgggactgctggttat

SEQ ID NO: 7085714 - DNA, 20 bp, Homo sapiens
ctcctgggactgctggttat

SEQ ID NO: 7085715 - DNA, 22 bp, Homo sapiens
ctcctggcttctgaaatcgtgg

SEQ ID NO: 7085716 - DNA, 22 bp, Homo sapiens
ctcctgggaaaggctggacaca

SEQ ID NO: 7085717 - DNA, 22 bp, Homo sapiens
ctcctgggaaaggctggacaca

SEQ ID NO: 7085718 - DNA, 22 bp, Homo sapiens
ctcctgggaaaggctggacaca

SEQ ID NO: 7085719 - DNA, 22 bp, Homo sapiens
ctcctgggaaaggctggacaca

SEQ ID NO: 7085720 - DNA, 20 bp, Homo sapiens
ctcctgggactgctggttat

SEQ ID NO: 7085721 - DNA, 22 bp, Homo sapiens
ctcctgggcttcgaaggctccc

SEQ ID NO: 7085722 - DNA, 22 bp, Homo sapiens
ctcctggggcacttagaagcaa

SEQ ID NO: 7085723 - DNA, 22 bp, Homo sapiens
ctcctggggccatggaaggaac

SEQ ID NO: 7085724 - DNA, 22 bp, Homo sapiens
ctcctggggccatggaaggaac

SEQ ID NO: 7085725 - DNA, 22 bp, Homo sapiens
ctcctggggccatggaaggaac

SEQ ID NO: 7085726 - DNA, 22 bp, Homo sapiens
ctcctgggggacagcggcaggg

SEQ ID NO: 7085727 - DNA, 22 bp, Homo sapiens
ctcctgggtcattgccagcaaa

SEQ ID NO: 7085728 - DNA, 22 bp, Homo sapiens
ctcctgggggacagcggcaggg

SEQ ID NO: 7085729 - DNA, 22 bp, Homo sapiens
ctcctgggggacagcggcaggg

SEQ ID NO: 7085730 - DNA, 22 bp, Homo sapiens
ctcctgggtcattgccagcaaa

SEQ ID NO: 7085731 - DNA, 22 bp, Homo sapiens
ctcctgggtcattgccagcaaa

SEQ ID NO: 7085732 - DNA, 22 bp, Homo sapiens
ctcctgggggacagcggcaggg

SEQ ID NO: 7085733 - DNA, 22 bp, Homo sapiens
ctcctgggggacagcggcaggg

SEQ ID NO: 7085734 - DNA, 22 bp, Homo sapiens
agtggcagaggttgactgcagt

SEQ ID NO: 7085735 - DNA, 22 bp, Homo sapiens
agtggcagaagtcactgggtag

SEQ ID NO: 7085736 - DNA, 22 bp, Homo sapiens
agtggcagaagccaagtctgca

SEQ ID NO: 7085737 - DNA, 22 bp, Homo sapiens
agtggcagaagccaagtctgca

SEQ ID NO: 7085738 - DNA, 22 bp, Homo sapiens
agtggcagaagccaagtctgca

SEQ ID NO: 7085739 - DNA, 22 bp, Homo sapiens
ctcctgggtcattgccagcaaa

SEQ ID NO: 7085740 - DNA, 22 bp, Homo sapiens
ctcctgggtcattgccagcaaa

SEQ ID NO: 7085741 - DNA, 22 bp, Homo sapiens
ctcctgggtcattgccagcaaa

SEQ ID NO: 7085742 - DNA, 20 bp, Homo sapiens
ctcctggtccaggagcctga

SEQ ID NO: 7085743 - DNA, 22 bp, Homo sapiens
ctcctggtgactcccagataaa

SEQ ID NO: 7085744 - DNA, 23 bp, Homo sapiens
ctcctggtgctgctatcaggggt

SEQ ID NO: 7085745 - DNA, 22 bp, Homo sapiens
ctcctggtgctggggctgccgc

SEQ ID NO: 7085746 - DNA, 22 bp, Homo sapiens
ctcctggtgctggggctgccgc

SEQ ID NO: 7085747 - DNA, 22 bp, Homo sapiens
agtggcagagtgcactcaggca

SEQ ID NO: 7085748 - DNA, 22 bp, Homo sapiens
agtggcagagtcagggtttgga

SEQ ID NO: 7085749 - DNA, 22 bp, Homo sapiens
agtggcagagtgcactcaggca

SEQ ID NO: 7085750 - DNA, 22 bp, Homo sapiens
agtggcagagtgcactcaggca

SEQ ID NO: 7085751 - DNA, 22 bp, Homo sapiens
agtggcagaggttgactgcagt

SEQ ID NO: 7085752 - DNA, 22 bp, Homo sapiens
agtggcagaggttgactgcagt

SEQ ID NO: 7085753 - DNA, 22 bp, Homo sapiens
agtggcagaggttgactgcagt

SEQ ID NO: 7085754 - DNA, 22 bp, Homo sapiens
agtggcagaggttgactgcagt

SEQ ID NO: 7085755 - DNA, 19 bp, Homo sapiens
agtggcagatctggaagta

SEQ ID NO: 7085756 - DNA, 19 bp, Homo sapiens
agtggcagatctggaagta

SEQ ID NO: 7085757 - DNA, 19 bp, Homo sapiens
agtggcagatctggaagta

SEQ ID NO: 7085758 - DNA, 19 bp, Homo sapiens
agtggcagatctggaagta

SEQ ID NO: 7085759 - DNA, 22 bp, Homo sapiens
agtggcagatctctggtctgga

SEQ ID NO: 7085760 - DNA, 22 bp, Homo sapiens
agtggcagatctctggtctgga

SEQ ID NO: 7085761 - DNA, 22 bp, Homo sapiens
agtggcagatctctggtctgga

SEQ ID NO: 7085762 - DNA, 22 bp, Homo sapiens
agtggcagatctctggtctgga

SEQ ID NO: 7085763 - DNA, 22 bp, Homo sapiens
caggactgtatccttggagaaa

SEQ ID NO: 7085764 - DNA, 22 bp, Homo sapiens
caggagaaacataattttctgg

SEQ ID NO: 7085765 - DNA, 22 bp, Homo sapiens
caggagaaacataattttctgg

SEQ ID NO: 7085766 - DNA, 22 bp, Homo sapiens
caggagaaggtttggagtgcag

SEQ ID NO: 7085767 - DNA, 22 bp, Homo sapiens
caggagaaatgtggctgctacc

SEQ ID NO: 7085768 - DNA, 22 bp, Homo sapiens
caggagcaaggagcagtgggat

SEQ ID NO: 7085769 - DNA, 22 bp, Homo sapiens
caggactgaagggcacagggaa

SEQ ID NO: 7085770 - DNA, 22 bp, Homo sapiens
caggactgatgttcctccagcc

SEQ ID NO: 7085771 - DNA, 22 bp, Homo sapiens
caggactggaagtctcaagaga

SEQ ID NO: 7085772 - DNA, 22 bp, Homo sapiens
caggactggaagtctcaagaga

SEQ ID NO: 7085773 - DNA, 22 bp, Homo sapiens
caggactggctcgcagtgggtg

SEQ ID NO: 7085774 - DNA, 22 bp, Homo sapiens
caggactggctcgcagtgggtg

SEQ ID NO: 7085775 - DNA, 22 bp, Homo sapiens
caggacagagcccagactgtgt

SEQ ID NO: 7085776 - DNA, 20 bp, Homo sapiens
caggacagcgcaatcggagg

SEQ ID NO: 7085777 - DNA, 20 bp, Homo sapiens
caggacagcgcaatcggagg

SEQ ID NO: 7085778 - DNA, 22 bp, Homo sapiens
cagctgttgtcacctcacatcc

SEQ ID NO: 7085779 - DNA, 22 bp, Homo sapiens
caggacagagcccagactgtgt

SEQ ID NO: 7085780 - DNA, 22 bp, Homo sapiens
caggacagagcccagactgtgt

SEQ ID NO: 7085781 - DNA, 22 bp, Homo sapiens
cagctgttgatctcttaagcct

SEQ ID NO: 7085782 - DNA, 22 bp, Homo sapiens
cagctgttgcagcactgagaga

SEQ ID NO: 7085783 - DNA, 22 bp, Homo sapiens
cagctgttcttgggacagacag

SEQ ID NO: 7085784 - DNA, 22 bp, Homo sapiens
cagctgttcttgggacagacag

SEQ ID NO: 7085785 - DNA, 22 bp, Homo sapiens
cagctgttgactggtacatgaa

SEQ ID NO: 7085786 - DNA, 22 bp, Homo sapiens
cagctgttgactggtacatgaa

SEQ ID NO: 7085787 - DNA, 20 bp, Homo sapiens
caggacagcgcaatcggagg

SEQ ID NO: 7085788 - DNA, 20 bp, Homo sapiens
caggacagcgcaatcggagg

SEQ ID NO: 7085789 - DNA, 22 bp, Homo sapiens
caggacagctcaacacctcctc

SEQ ID NO: 7085790 - DNA, 22 bp, Homo sapiens
caggacctgaagacaggcaggt

SEQ ID NO: 7085791 - DNA, 22 bp, Homo sapiens
caggacctgaagacaggcaggt

SEQ ID NO: 7085792 - DNA, 22 bp, Homo sapiens
caggacgggcaaacaggatggt

SEQ ID NO: 7085793 - DNA, 22 bp, Homo sapiens
caggactcacttctcacatccc

SEQ ID NO: 7085794 - DNA, 22 bp, Homo sapiens
caggactgaagggcacagggaa

SEQ ID NO: 7085795 - DNA, 22 bp, Homo sapiens
caggactgaagggcacagggaa

SEQ ID NO: 7085796 - DNA, 22 bp, Homo sapiens
cagctggttggaagggagctga

SEQ ID NO: 7085797 - DNA, 22 bp, Homo sapiens
cagctggtgtccagggaagtgg

SEQ ID NO: 7085798 - DNA, 22 bp, Homo sapiens
cagctggtgtcaggcactgcag

SEQ ID NO: 7085799 - DNA, 22 bp, Homo sapiens
cagctgggtttagtggggtgtg

SEQ ID NO: 7085800 - DNA, 22 bp, Homo sapiens
cagctgggtttagtggggtgtg

SEQ ID NO: 7085801 - DNA, 22 bp, Homo sapiens
cagctgggtttagtggggtgtg

SEQ ID NO: 7085802 - DNA, 22 bp, Homo sapiens
cagctgtcagccggtgcaggct

SEQ ID NO: 7085803 - DNA, 22 bp, Homo sapiens
cagctgtcacttctaagttttg

SEQ ID NO: 7085804 - DNA, 22 bp, Homo sapiens
cagctgtccttcctggtgggcg

SEQ ID NO: 7085805 - DNA, 22 bp, Homo sapiens
cagctgttactctgagtaaatg

SEQ ID NO: 7085806 - DNA, 22 bp, Homo sapiens
cagctgtgtatgagagcatgct

SEQ ID NO: 7085807 - DNA, 22 bp, Homo sapiens
cagctgtgtatgagagcatgct

SEQ ID NO: 7085808 - DNA, 22 bp, Homo sapiens
cagctgtgtctaattatggctg

SEQ ID NO: 7085809 - DNA, 22 bp, Homo sapiens
cagctgttcctggaaggagacc

SEQ ID NO: 7085810 - DNA, 22 bp, Homo sapiens
cagctgttcagcaactcgcaga

SEQ ID NO: 7085811 - DNA, 22 bp, Homo sapiens
cagctgttcagcaactcgcaga

SEQ ID NO: 7085812 - DNA, 22 bp, Homo sapiens
cagctgttcattgttgccaccc

SEQ ID NO: 7085813 - DNA, 22 bp, Homo sapiens
cagctgttatgaggtgtacatg

SEQ ID NO: 7085814 - DNA, 22 bp, Homo sapiens
cagctgttcacatttccaaaac

SEQ ID NO: 7085815 - DNA, 22 bp, Homo sapiens
cagctgttactctgagtaaatg

SEQ ID NO: 7085816 - DNA, 22 bp, Homo sapiens
cagctgttactgaagtaaaatg

SEQ ID NO: 7085817 - DNA, 22 bp, Homo sapiens
cagctgttactgaagtaaaatg

SEQ ID NO: 7085818 - DNA, 22 bp, Homo sapiens
cagctgttatgaggtgtacatg

SEQ ID NO: 7085819 - DNA, 22 bp, Homo sapiens
caggagtgaaatgaggcccagg

SEQ ID NO: 7085820 - DNA, 22 bp, Homo sapiens
caggatggagagtgaggggtca

SEQ ID NO: 7085821 - DNA, 22 bp, Homo sapiens
caggagtctgttcctcatttgt

SEQ ID NO: 7085822 - DNA, 22 bp, Homo sapiens
caggagccagctgtcccaacca

SEQ ID NO: 7085823 - DNA, 22 bp, Homo sapiens
caggagcccagagtcctcagct

SEQ ID NO: 7085824 - DNA, 22 bp, Homo sapiens
caggatggccccggggctgtgc

SEQ ID NO: 7085825 - DNA, 22 bp, Homo sapiens
caggatggccccggggctgtgc

SEQ ID NO: 7085826 - DNA, 22 bp, Homo sapiens
caggatggccccggggctgtgc

SEQ ID NO: 7085827 - DNA, 22 bp, Homo sapiens
caggatggcagagaaaagggtg

SEQ ID NO: 7085828 - DNA, 22 bp, Homo sapiens
caggatggcagagaaaagggtg

SEQ ID NO: 7085829 - DNA, 22 bp, Homo sapiens
caggatggcagagaaaagggtg

SEQ ID NO: 7085830 - DNA, 22 bp, Homo sapiens
caggatggagggagggctgtta

SEQ ID NO: 7085831 - DNA, 22 bp, Homo sapiens
caggatggagggagggctgtta

SEQ ID NO: 7085832 - DNA, 22 bp, Homo sapiens
caggatggagggagggctgtta

SEQ ID NO: 7085833 - DNA, 22 bp, Homo sapiens
caggatggagagttgttggttg

SEQ ID NO: 7085834 - DNA, 18 bp, Homo sapiens
caggagcaggagttgaac

SEQ ID NO: 7085835 - DNA, 22 bp, Homo sapiens
caggagcaggcccaaggacaca

SEQ ID NO: 7085836 - DNA, 22 bp, Homo sapiens
caggagcagagggtggtcagca

SEQ ID NO: 7085837 - DNA, 22 bp, Homo sapiens
caggagcagagggtggtcagca

SEQ ID NO: 7085838 - DNA, 22 bp, Homo sapiens
caggagcaggcccaaggacaca

SEQ ID NO: 7085839 - DNA, 22 bp, Homo sapiens
caggagcagttagaagcccact

SEQ ID NO: 7085840 - DNA, 22 bp, Homo sapiens
caggagcatgctgatgccagaa

SEQ ID NO: 7085841 - DNA, 22 bp, Homo sapiens
caggagcatgctgatgccagaa

SEQ ID NO: 7085842 - DNA, 22 bp, Homo sapiens
caggagccacattccaccttga

SEQ ID NO: 7085843 - DNA, 22 bp, Homo sapiens
caggagccacattccaccttga

SEQ ID NO: 7085844 - DNA, 22 bp, Homo sapiens
caggagccagaggcggatggag

SEQ ID NO: 7085845 - DNA, 22 bp, Homo sapiens
caggcacaattatttccctttc

SEQ ID NO: 7085846 - DNA, 22 bp, Homo sapiens
caggcacaattatttccctttc

SEQ ID NO: 7085847 - DNA, 22 bp, Homo sapiens
caggcacaattatttccctttc

SEQ ID NO: 7085848 - DNA, 22 bp, Homo sapiens
caggcacaatgagcgccatctt

SEQ ID NO: 7085849 - DNA, 22 bp, Homo sapiens
caggcacacagcacatggcctg

SEQ ID NO: 7085850 - DNA, 22 bp, Homo sapiens
caggcacacagcacatggcctg

SEQ ID NO: 7085851 - DNA, 22 bp, Homo sapiens
caggcacacagcacatggcctg

SEQ ID NO: 7085852 - DNA, 22 bp, Homo sapiens
caggatgggtgtcggccagcac

SEQ ID NO: 7085853 - DNA, 22 bp, Homo sapiens
caggatgggtgtcggccagcac

SEQ ID NO: 7085854 - DNA, 22 bp, Homo sapiens
caggatggtcagatgcattgtc

SEQ ID NO: 7085855 - DNA, 22 bp, Homo sapiens
caggatgggatgtagtgggccc

SEQ ID NO: 7085856 - DNA, 22 bp, Homo sapiens
caggatgggatgtagtgggccc

SEQ ID NO: 7085857 - DNA, 22 bp, Homo sapiens
caggatgggatgtagtgggccc

SEQ ID NO: 7085858 - DNA, 22 bp, Homo sapiens
caggatgggtgtcggccagcac

SEQ ID NO: 7085859 - DNA, 22 bp, Homo sapiens
caggatgggtgtcggccagcac

SEQ ID NO: 7085860 - DNA, 22 bp, Homo sapiens
caggatgggtgtcggccagcac

SEQ ID NO: 7085861 - DNA, 22 bp, Homo sapiens
caggatgggtgtcggccagcac

SEQ ID NO: 7085862 - DNA, 22 bp, Homo sapiens
caggatgggatgtagtgggccc

SEQ ID NO: 7085863 - DNA, 22 bp, Homo sapiens
caggatgggatgtagtgggccc

SEQ ID NO: 7085864 - DNA, 22 bp, Homo sapiens
caggatgggatgtagtgggccc

SEQ ID NO: 7085865 - DNA, 22 bp, Homo sapiens
caggcacacagggaatttggct

SEQ ID NO: 7085866 - DNA, 22 bp, Homo sapiens
caggcacacagcacatggcctg

SEQ ID NO: 7085867 - DNA, 22 bp, Homo sapiens
caggcacacaggctccctgggc

SEQ ID NO: 7085868 - DNA, 22 bp, Homo sapiens
caggcacacaggctccctgggc

SEQ ID NO: 7085869 - DNA, 22 bp, Homo sapiens
caggcacacaggctccctgggc

SEQ ID NO: 7085870 - DNA, 22 bp, Homo sapiens
caggcacacaggctccctgggc

SEQ ID NO: 7085871 - DNA, 22 bp, Homo sapiens
caggcacacaggctccctgggc

SEQ ID NO: 7085872 - DNA, 22 bp, Homo sapiens
caggcacacatccgtgagagat

SEQ ID NO: 7085873 - DNA, 22 bp, Homo sapiens
caggcacacatccgtgagagat

SEQ ID NO: 7085874 - DNA, 22 bp, Homo sapiens
caggcacacatccgtgagagat

SEQ ID NO: 7085875 - DNA, 22 bp, Homo sapiens
caggcacacatccgtgagagat

SEQ ID NO: 7085876 - DNA, 20 bp, Homo sapiens
caggcacactcattcctgct

SEQ ID NO: 7085877 - DNA, 20 bp, Homo sapiens
caggcacactcattcctgct

SEQ ID NO: 7085878 - DNA, 20 bp, Homo sapiens
caggcacactcattcctgct

SEQ ID NO: 7085879 - DNA, 20 bp, Homo sapiens
caggcacactcattcctgct

SEQ ID NO: 7085880 - DNA, 22 bp, Homo sapiens
caggcacacccactggtgcaga

SEQ ID NO: 7085881 - DNA, 22 bp, Homo sapiens
caggcacacatccgtgagagat

SEQ ID NO: 7085882 - DNA, 22 bp, Homo sapiens
caggcacacccactggtgcaga

SEQ ID NO: 7085883 - DNA, 22 bp, Homo sapiens
caggcacacccactggtgcaga

SEQ ID NO: 7085884 - DNA, 22 bp, Homo sapiens
caggcacacccactggtgcaga

SEQ ID NO: 7085885 - DNA, 20 bp, Homo sapiens
caggcacactcattcctgct

SEQ ID NO: 7085886 - DNA, 22 bp, Homo sapiens
caggcagagttagagcaactgg

SEQ ID NO: 7085887 - DNA, 22 bp, Homo sapiens
agctgtcctggctcaggctgtg

SEQ ID NO: 7085888 - DNA, 22 bp, Homo sapiens
agctgtctctctggtgtccata

SEQ ID NO: 7085889 - DNA, 19 bp, Homo sapiens
agctgtctgctgcttttgt

SEQ ID NO: 7085890 - DNA, 19 bp, Homo sapiens
agctgtctgctgcttttgt

SEQ ID NO: 7085891 - DNA, 22 bp, Homo sapiens
agctgtatttgtgaatatttaa

SEQ ID NO: 7085892 - DNA, 22 bp, Homo sapiens
agctgtattctctttgtattaa

SEQ ID NO: 7085893 - DNA, 22 bp, Homo sapiens
agctgtattctctttgtattaa

SEQ ID NO: 7085894 - DNA, 23 bp, Homo sapiens
agctggtttcaatgtgttatttc

SEQ ID NO: 7085895 - DNA, 22 bp, Homo sapiens
agctgtaatataagcaatgaaa

SEQ ID NO: 7085896 - DNA, 22 bp, Homo sapiens
agctggttgcttaacctctctg

SEQ ID NO: 7085897 - DNA, 22 bp, Homo sapiens
agctggttgtcattcagaattg

SEQ ID NO: 7085898 - DNA, 22 bp, Homo sapiens
agctggttgacgttatccagga

SEQ ID NO: 7085899 - DNA, 22 bp, Homo sapiens
agctggttcatggactgcctgg

SEQ ID NO: 7085900 - DNA, 22 bp, Homo sapiens
agctggttcattcattcatggt

SEQ ID NO: 7085901 - DNA, 20 bp, Homo sapiens
caggcagtttgtggttaggg

SEQ ID NO: 7085902 - DNA, 22 bp, Homo sapiens
caggcagtgtcccaggaagcca

SEQ ID NO: 7085903 - DNA, 22 bp, Homo sapiens
caggcagtgtcccaggaagcca

SEQ ID NO: 7085904 - DNA, 22 bp, Homo sapiens
caggcaggtgcagattcctctt

SEQ ID NO: 7085905 - DNA, 22 bp, Homo sapiens
caggcaggtgcagattcctctt

SEQ ID NO: 7085906 - DNA, 22 bp, Homo sapiens
caggcaggtgcagattcctctt

SEQ ID NO: 7085907 - DNA, 22 bp, Homo sapiens
caggcaggtgcagattcctctt

SEQ ID NO: 7085908 - DNA, 22 bp, Homo sapiens
caggcagtggctcacagcaacc

SEQ ID NO: 7085909 - DNA, 22 bp, Homo sapiens
caggcagggagctggaaaggat

SEQ ID NO: 7085910 - DNA, 22 bp, Homo sapiens
caggcagggagctggaaaggat

SEQ ID NO: 7085911 - DNA, 22 bp, Homo sapiens
caggcagggagctggaaaggat

SEQ ID NO: 7085912 - DNA, 22 bp, Homo sapiens
caggcagctcgatgccttgttg

SEQ ID NO: 7085913 - DNA, 22 bp, Homo sapiens
caggcagctcaaccttgggagc

SEQ ID NO: 7085914 - DNA, 22 bp, Homo sapiens
caggcagctagatttataacaa

SEQ ID NO: 7085915 - DNA, 22 bp, Homo sapiens
caggcagctcaaccttgggagc

SEQ ID NO: 7085916 - DNA, 22 bp, Homo sapiens
caggcagggagctggaaaggat

SEQ ID NO: 7085917 - DNA, 22 bp, Homo sapiens
caggcagggagctggaaaggat

SEQ ID NO: 7085918 - DNA, 22 bp, Homo sapiens
caggcagggagctggaaaggat

SEQ ID NO: 7085919 - DNA, 22 bp, Homo sapiens
caggcagggagctggaaaggat

SEQ ID NO: 7085920 - DNA, 22 bp, Homo sapiens
caggcaggtcagtgaagaagga

SEQ ID NO: 7085921 - DNA, 22 bp, Homo sapiens
caggcaggtcagtgaagaagga

SEQ ID NO: 7085922 - DNA, 22 bp, Homo sapiens
caggcaggtcagtgaagaagga

SEQ ID NO: 7085923 - DNA, 22 bp, Homo sapiens
caggcaggtcagtgaagaagga

SEQ ID NO: 7085924 - DNA, 22 bp, Homo sapiens
caggcaggtcagtgaagaagga

SEQ ID NO: 7085925 - DNA, 22 bp, Homo sapiens
caggcaggtcagtgaagaagga

SEQ ID NO: 7085926 - DNA, 22 bp, Homo sapiens
caggcagcgctcgtggcctggc

SEQ ID NO: 7085927 - DNA, 22 bp, Homo sapiens
caggcagcgctcgtggcctggc

SEQ ID NO: 7085928 - DNA, 22 bp, Homo sapiens
caggcagcgtcctgcttcctgt

SEQ ID NO: 7085929 - DNA, 22 bp, Homo sapiens
caggcagcgtcctgcttcctgt

SEQ ID NO: 7085930 - DNA, 22 bp, Homo sapiens
caggcagcgtcctgcttcctgt

SEQ ID NO: 7085931 - DNA, 22 bp, Homo sapiens
caggcagcgctcgtggcctggc

SEQ ID NO: 7085932 - DNA, 22 bp, Homo sapiens
caggcagcgctcgtggcctggc

SEQ ID NO: 7085933 - DNA, 22 bp, Homo sapiens
caggcagcgctcgtggcctggc

SEQ ID NO: 7085934 - DNA, 22 bp, Homo sapiens
caggcagcctgcggtctgcaca

SEQ ID NO: 7085935 - DNA, 22 bp, Homo sapiens
caggcagcctgcggtctgcaca

SEQ ID NO: 7085936 - DNA, 22 bp, Homo sapiens
caggcagcctgcggtctgcaca

SEQ ID NO: 7085937 - DNA, 22 bp, Homo sapiens
caggctctgctgctacagctgt

SEQ ID NO: 7085938 - DNA, 22 bp, Homo sapiens
caggctctgctgctacagctgt

SEQ ID NO: 7085939 - DNA, 21 bp, Homo sapiens
caggctctgctagaggagcct

SEQ ID NO: 7085940 - DNA, 21 bp, Homo sapiens
caggctctgctagaggagcct

SEQ ID NO: 7085941 - DNA, 22 bp, Homo sapiens
caggctctgctgctacagctgt

SEQ ID NO: 7085942 - DNA, 22 bp, Homo sapiens
caggctctgctgctacagctgt

SEQ ID NO: 7085943 - DNA, 22 bp, Homo sapiens
caggctctgctgctacagctgt

SEQ ID NO: 7085944 - DNA, 21 bp, Homo sapiens
caggctctgctgggtgctggg

SEQ ID NO: 7085945 - DNA, 21 bp, Homo sapiens
caggctctgctgggtgctggg

SEQ ID NO: 7085946 - DNA, 22 bp, Homo sapiens
caggctcttccatcctgctgag

SEQ ID NO: 7085947 - DNA, 22 bp, Homo sapiens
caggctcttccatcctgctgag

SEQ ID NO: 7085948 - DNA, 21 bp, Homo sapiens
caggctctgctgggtgctggg

SEQ ID NO: 7085949 - DNA, 21 bp, Homo sapiens
caggctctgctagaggagcct

SEQ ID NO: 7085950 - DNA, 21 bp, Homo sapiens
caggctctgctagaggagcct

SEQ ID NO: 7085951 - DNA, 21 bp, Homo sapiens
caggctctgctagaggagcct

SEQ ID NO: 7085952 - DNA, 21 bp, Homo sapiens
caggctctgctagaggagcct

SEQ ID NO: 7085953 - DNA, 22 bp, Homo sapiens
agcttctagcccatccagcagg

SEQ ID NO: 7085954 - DNA, 22 bp, Homo sapiens
agcttctagcccatccagcagg

SEQ ID NO: 7085955 - DNA, 22 bp, Homo sapiens
agcttctcagatggactgttag

SEQ ID NO: 7085956 - DNA, 22 bp, Homo sapiens
agcttcctcacctcagaggtct

SEQ ID NO: 7085957 - DNA, 22 bp, Homo sapiens
agcttcctacaaccatctcaga

SEQ ID NO: 7085958 - DNA, 22 bp, Homo sapiens
agcttcccggcaggcacgtcct

SEQ ID NO: 7085959 - DNA, 21 bp, Homo sapiens
agcttcctgcagtgggaggtc

SEQ ID NO: 7085960 - DNA, 22 bp, Homo sapiens
agcttcctgtcttctgcacaaa

SEQ ID NO: 7085961 - DNA, 22 bp, Homo sapiens
agcttcctgtcttctgcacaaa

SEQ ID NO: 7085962 - DNA, 22 bp, Homo sapiens
agcttcctgactggtgctctta

SEQ ID NO: 7085963 - DNA, 22 bp, Homo sapiens
agcttccttggcgctgaggcct

SEQ ID NO: 7085964 - DNA, 22 bp, Homo sapiens
agcttccttgaattctgtagaa

SEQ ID NO: 7085965 - DNA, 22 bp, Homo sapiens
caggcccagtgatcagggctct

SEQ ID NO: 7085966 - DNA, 22 bp, Homo sapiens
caggcccagtgatcagggctct

SEQ ID NO: 7085967 - DNA, 22 bp, Homo sapiens
caggcccagtgatcagggctct

SEQ ID NO: 7085968 - DNA, 22 bp, Homo sapiens
caggcccagtgatcagggctct

SEQ ID NO: 7085969 - DNA, 22 bp, Homo sapiens
caggcccagggttattgggaaa

SEQ ID NO: 7085970 - DNA, 22 bp, Homo sapiens
caggcccaggggtctggcccac

SEQ ID NO: 7085971 - DNA, 22 bp, Homo sapiens
caggcccagggttattgggaaa

SEQ ID NO: 7085972 - DNA, 22 bp, Homo sapiens
caggcccaggtgtcgatgttcc

SEQ ID NO: 7085973 - DNA, 22 bp, Homo sapiens
caggcccaggtgtcgatgttcc

SEQ ID NO: 7085974 - DNA, 22 bp, Homo sapiens
caggcccagtgatcagggctct

SEQ ID NO: 7085975 - DNA, 22 bp, Homo sapiens
caggcccagtgatcagggctct

SEQ ID NO: 7085976 - DNA, 22 bp, Homo sapiens
caggcccagtgatcagggctct

SEQ ID NO: 7085977 - DNA, 22 bp, Homo sapiens
caggcccagtgatcagggctct

SEQ ID NO: 7085978 - DNA, 22 bp, Homo sapiens
caggcccataatgcaaatattt

SEQ ID NO: 7085979 - DNA, 22 bp, Homo sapiens
caggcccagtgatcagggctct

SEQ ID NO: 7085980 - DNA, 22 bp, Homo sapiens
caggcccataatgcaaatattt

SEQ ID NO: 7085981 - DNA, 22 bp, Homo sapiens
caggcccatctgctcccaggct

SEQ ID NO: 7085982 - DNA, 22 bp, Homo sapiens
caggcccatctgctcccaggct

SEQ ID NO: 7085983 - DNA, 22 bp, Homo sapiens
agctgtctgtctcctgaggaga

SEQ ID NO: 7085984 - DNA, 22 bp, Homo sapiens
agctgtctggaagttcctcatg

SEQ ID NO: 7085985 - DNA, 22 bp, Homo sapiens
agctgtctgtctcctgaggaga

SEQ ID NO: 7085986 - DNA, 22 bp, Homo sapiens
agctgtctgtgaacacagcatt

SEQ ID NO: 7085987 - DNA, 22 bp, Homo sapiens
agctgtctttaagtgagctttg

SEQ ID NO: 7085988 - DNA, 22 bp, Homo sapiens
agctgtctttaagtgagctttg

SEQ ID NO: 7085989 - DNA, 22 bp, Homo sapiens
agctgtctttcattacctcatt

SEQ ID NO: 7085990 - DNA, 22 bp, Homo sapiens
agctgtctttcattacctcatt

SEQ ID NO: 7085991 - DNA, 22 bp, Homo sapiens
agctgtctttctgcctcctgat

SEQ ID NO: 7085992 - DNA, 22 bp, Homo sapiens
agctgtctttctgcctcctgat

SEQ ID NO: 7085993 - DNA, 22 bp, Homo sapiens
agctgtctttggagagggagag

SEQ ID NO: 7085994 - DNA, 19 bp, Homo sapiens
agcttagaaagcaatttta

SEQ ID NO: 7085995 - DNA, 22 bp, Homo sapiens
agcttccattaactgctacact

SEQ ID NO: 7085996 - DNA, 22 bp, Homo sapiens
agcttactgtaattaaaagact

SEQ ID NO: 7085997 - DNA, 22 bp, Homo sapiens
caggcccatttgtagccacttt

SEQ ID NO: 7085998 - DNA, 22 bp, Homo sapiens
caggcccattctaggcttgcta

SEQ ID NO: 7085999 - DNA, 22 bp, Homo sapiens
caggcccatttgtagccacttt

SEQ ID NO: 7086000 - DNA, 22 bp, Homo sapiens
caggcccatttgtagccacttt

SEQ ID NO: 7086001 - DNA, 22 bp, Homo sapiens
caggcccatttgtagccacttt

SEQ ID NO: 7086002 - DNA, 21 bp, Homo sapiens
agcttacattaccattgttgc

SEQ ID NO: 7086003 - DNA, 22 bp, Homo sapiens
caggcccatgagggcagccaca

SEQ ID NO: 7086004 - DNA, 22 bp, Homo sapiens
caggcccatctgctcccaggct

SEQ ID NO: 7086005 - DNA, 22 bp, Homo sapiens
caggcccatctgctcccaggct

SEQ ID NO: 7086006 - DNA, 22 bp, Homo sapiens
caggcccatctgctcccaggct

SEQ ID NO: 7086007 - DNA, 22 bp, Homo sapiens
caggcccataatgcaaatattt

SEQ ID NO: 7086008 - DNA, 22 bp, Homo sapiens
caggcccatctgctcccaggct

SEQ ID NO: 7086009 - DNA, 22 bp, Homo sapiens
caggcccatctgctcccaggct

SEQ ID NO: 7086010 - DNA, 22 bp, Homo sapiens
caggcccatctgctcccaggct

SEQ ID NO: 7086011 - DNA, 22 bp, Homo sapiens
caggcccatgagggcagccaca

SEQ ID NO: 7086012 - DNA, 22 bp, Homo sapiens
caggcccatgagggcagccaca

SEQ ID NO: 7086013 - DNA, 22 bp, Homo sapiens
caggcccatgagggcagccaca

SEQ ID NO: 7086014 - DNA, 22 bp, Homo sapiens
caggcccatgagggcagccaca

SEQ ID NO: 7086015 - DNA, 22 bp, Homo sapiens
caggcccatgagggcagccaca

SEQ ID NO: 7086016 - DNA, 22 bp, Homo sapiens
caggcccattctaggcttgcta

SEQ ID NO: 7086017 - DNA, 22 bp, Homo sapiens
caggcccatgagggcagccaca

SEQ ID NO: 7086018 - DNA, 22 bp, Homo sapiens
caggcccattctaggcttgcta

SEQ ID NO: 7086019 - DNA, 22 bp, Homo sapiens
caggtggttgagagctgtaggc

SEQ ID NO: 7086020 - DNA, 22 bp, Homo sapiens
caggtggttgtttggattctaa

SEQ ID NO: 7086021 - DNA, 22 bp, Homo sapiens
caggtggtttgataggataact

SEQ ID NO: 7086022 - DNA, 22 bp, Homo sapiens
caggtgtcaaaatactaagtgg

SEQ ID NO: 7086023 - DNA, 22 bp, Homo sapiens
caggtgtcaaaatactaagtgg

SEQ ID NO: 7086024 - DNA, 22 bp, Homo sapiens
caggtgtacacattgtgtttat

SEQ ID NO: 7086025 - DNA, 22 bp, Homo sapiens
caggtgtcagcagcactgtact

SEQ ID NO: 7086026 - DNA, 16 bp, Homo sapiens
caggtgtcagtcacct

SEQ ID NO: 7086027 - DNA, 22 bp, Homo sapiens
aggaagtgaaagggaaggagtt

SEQ ID NO: 7086028 - DNA, 22 bp, Homo sapiens
caggtgtctaattctcaccccc

SEQ ID NO: 7086029 - DNA, 22 bp, Homo sapiens
caggtgtcggtcaggcggtttt

SEQ ID NO: 7086030 - DNA, 22 bp, Homo sapiens
caggtgtctaattctcaccccc

SEQ ID NO: 7086031 - DNA, 21 bp, Homo sapiens
aggaagtggccagattgggaa

SEQ ID NO: 7086032 - DNA, 22 bp, Homo sapiens
aggaagtgctaagagaacatca

SEQ ID NO: 7086033 - DNA, 22 bp, Homo sapiens
aggaagtggataaaatagcttt

SEQ ID NO: 7086034 - DNA, 22 bp, Homo sapiens
aggaagtggataaaatagcttt

SEQ ID NO: 7086035 - DNA, 22 bp, Homo sapiens
cagggcttcgtgtctcagtgct

SEQ ID NO: 7086036 - DNA, 22 bp, Homo sapiens
cagggcttctataccaattcat

SEQ ID NO: 7086037 - DNA, 22 bp, Homo sapiens
cagggcttgaatcaaggaagtc

SEQ ID NO: 7086038 - DNA, 22 bp, Homo sapiens
cagggcttcgctcctggtgcac

SEQ ID NO: 7086039 - DNA, 22 bp, Homo sapiens
cagggcttcactaggaaccctc

SEQ ID NO: 7086040 - DNA, 22 bp, Homo sapiens
cagggctgttagctgctgctct

SEQ ID NO: 7086041 - DNA, 22 bp, Homo sapiens
cagggcttactggaggctgctt

SEQ ID NO: 7086042 - DNA, 22 bp, Homo sapiens
caggtgggattttgctgcttga

SEQ ID NO: 7086043 - DNA, 22 bp, Homo sapiens
caggtgggattttgctgcttga

SEQ ID NO: 7086044 - DNA, 22 bp, Homo sapiens
caggtgggattttgctgcttga

SEQ ID NO: 7086045 - DNA, 22 bp, Homo sapiens
caggtgggattttgctgcttga

SEQ ID NO: 7086046 - DNA, 22 bp, Homo sapiens
caggtgggccatgaaaaatgac

SEQ ID NO: 7086047 - DNA, 22 bp, Homo sapiens
caggtggttatgaggaaggtga

SEQ ID NO: 7086048 - DNA, 22 bp, Homo sapiens
caggtggttatgaggaaggtga

SEQ ID NO: 7086049 - DNA, 22 bp, Homo sapiens
caggtggttccatgtttcatga

SEQ ID NO: 7086050 - DNA, 22 bp, Homo sapiens
caggtggtgcctcctcccttcc

SEQ ID NO: 7086051 - DNA, 22 bp, Homo sapiens
caggtggtgcctcctcccttcc

SEQ ID NO: 7086052 - DNA, 22 bp, Homo sapiens
aggacagagcctgtgcagaccg

SEQ ID NO: 7086053 - DNA, 22 bp, Homo sapiens
aggacagagccctagtttcata

SEQ ID NO: 7086054 - DNA, 22 bp, Homo sapiens
aggacagagccctagtttcata

SEQ ID NO: 7086055 - DNA, 22 bp, Homo sapiens
aggacagagcctgtgcagaccg

SEQ ID NO: 7086056 - DNA, 22 bp, Homo sapiens
aggacagagcctgtgcagaccg

SEQ ID NO: 7086057 - DNA, 22 bp, Homo sapiens
aggacagagcctgtgcagaccg

SEQ ID NO: 7086058 - DNA, 22 bp, Homo sapiens
aggacagagcctgtgcagaccg

SEQ ID NO: 7086059 - DNA, 22 bp, Homo sapiens
aggacagagcctgtgcagaccg

SEQ ID NO: 7086060 - DNA, 22 bp, Homo sapiens
aggacagagcctgtgcagaccg

SEQ ID NO: 7086061 - DNA, 22 bp, Homo sapiens
aggacagagggaccagagccca

SEQ ID NO: 7086062 - DNA, 22 bp, Homo sapiens
aggacagagggaccagagccca

SEQ ID NO: 7086063 - DNA, 22 bp, Homo sapiens
aggacagacctaggactggagc

SEQ ID NO: 7086064 - DNA, 22 bp, Homo sapiens
aggacagacctaggactggagc

SEQ ID NO: 7086065 - DNA, 22 bp, Homo sapiens
aggacagacctaggactggagc

SEQ ID NO: 7086066 - DNA, 22 bp, Homo sapiens
aggacagagccctagtttcata

SEQ ID NO: 7086067 - DNA, 22 bp, Homo sapiens
aggacaagctaaaggacttcct

SEQ ID NO: 7086068 - DNA, 22 bp, Homo sapiens
aggacacatgcacaccctgcgt

SEQ ID NO: 7086069 - DNA, 22 bp, Homo sapiens
aggacacatgcacaccctgcgt

SEQ ID NO: 7086070 - DNA, 18 bp, Homo sapiens
aggacacattcttccctc

SEQ ID NO: 7086071 - DNA, 22 bp, Homo sapiens
aggacacttaggttattcaact

SEQ ID NO: 7086072 - DNA, 22 bp, Homo sapiens
aggacagaatctatattcagtt

SEQ ID NO: 7086073 - DNA, 22 bp, Homo sapiens
aggacagaatctatattcagtt

SEQ ID NO: 7086074 - DNA, 22 bp, Homo sapiens
aggacagaatctatattcagtt

SEQ ID NO: 7086075 - DNA, 22 bp, Homo sapiens
aggacagacctaggactggagc

SEQ ID NO: 7086076 - DNA, 22 bp, Homo sapiens
aggacagacctaggactggagc

SEQ ID NO: 7086077 - DNA, 22 bp, Homo sapiens
aggacagacctaggactggagc

SEQ ID NO: 7086078 - DNA, 22 bp, Homo sapiens
aggaatgaactcgagtgatctg

SEQ ID NO: 7086079 - DNA, 22 bp, Homo sapiens
aggaatgaactcgagtgatctg

SEQ ID NO: 7086080 - DNA, 22 bp, Homo sapiens
aggaatctgggcccaactgtgc

SEQ ID NO: 7086081 - DNA, 22 bp, Homo sapiens
aggaatctgtggttttaacagg

SEQ ID NO: 7086082 - DNA, 22 bp, Homo sapiens
aggacaagacaaggaccagaga

SEQ ID NO: 7086083 - DNA, 22 bp, Homo sapiens
aggacaagacaaggaccagaga

SEQ ID NO: 7086084 - DNA, 22 bp, Homo sapiens
aggacaagacaaggaccagaga

SEQ ID NO: 7086085 - DNA, 22 bp, Homo sapiens
aggaatatggatttgctcagct

SEQ ID NO: 7086086 - DNA, 22 bp, Homo sapiens
aggaatatggatttgctcagct

SEQ ID NO: 7086087 - DNA, 22 bp, Homo sapiens
aggaatattactttgcttttat

SEQ ID NO: 7086088 - DNA, 18 bp, Homo sapiens
aggaatattcaaggtgct

SEQ ID NO: 7086089 - DNA, 18 bp, Homo sapiens
aggaatattcaaggtgct

SEQ ID NO: 7086090 - DNA, 22 bp, Homo sapiens
aggaatattctcaagtggtcgt

SEQ ID NO: 7086091 - DNA, 22 bp, Homo sapiens
aggaatattctcaagtggtcgt

SEQ ID NO: 7086092 - DNA, 22 bp, Homo sapiens
aggaatcagaattcttagaatt

SEQ ID NO: 7086093 - DNA, 22 bp, Homo sapiens
aggaatcaggagatgagcacgg

SEQ ID NO: 7086094 - DNA, 23 bp, Homo sapiens
aggaagttaaggcagacagacag

SEQ ID NO: 7086095 - DNA, 22 bp, Homo sapiens
aggaagtgggaagggtctgcca

SEQ ID NO: 7086096 - DNA, 22 bp, Homo sapiens
aggaagtggggttctctcactg

SEQ ID NO: 7086097 - DNA, 22 bp, Homo sapiens
aggaatagaccacttcactgag

SEQ ID NO: 7086098 - DNA, 22 bp, Homo sapiens
aggaatagaccacttcactgag

SEQ ID NO: 7086099 - DNA, 22 bp, Homo sapiens
aggaatatagttggaatgtagg

SEQ ID NO: 7086100 - DNA, 22 bp, Homo sapiens
aggaatatgagctgctgcagtg

SEQ ID NO: 7086101 - DNA, 22 bp, Homo sapiens
aggaatatggatttgctcagct

SEQ ID NO: 7086102 - DNA, 22 bp, Homo sapiens
aggacagagggaccagagccca

SEQ ID NO: 7086103 - DNA, 22 bp, Homo sapiens
aggacagagggaccagagccca

SEQ ID NO: 7086104 - DNA, 22 bp, Homo sapiens
aggacagagggaccagagccca

SEQ ID NO: 7086105 - DNA, 21 bp, Homo sapiens
aggacagatgtaggaataaag

SEQ ID NO: 7086106 - DNA, 21 bp, Homo sapiens
aggacagatgtaggaataaag

SEQ ID NO: 7086107 - DNA, 22 bp, Homo sapiens
aggacagatttttggccaccag

SEQ ID NO: 7086108 - DNA, 22 bp, Homo sapiens
aggacagatttttggccaccag

SEQ ID NO: 7086109 - DNA, 22 bp, Homo sapiens
aggacagagggaccagagccca

SEQ ID NO: 7086110 - DNA, 22 bp, Homo sapiens
aggacagagggaccagagccca

SEQ ID NO: 7086111 - DNA, 21 bp, Homo sapiens
aggacagatgtaggaataaag

SEQ ID NO: 7086112 - DNA, 22 bp, Homo sapiens
aggacagatttttggccaccag

SEQ ID NO: 7086113 - DNA, 22 bp, Homo sapiens
aggacagatttttggccaccag

SEQ ID NO: 7086114 - DNA, 23 bp, Homo sapiens
aggacagcaaaccccgcctcccc

SEQ ID NO: 7086115 - DNA, 23 bp, Homo sapiens
aggacagcaaaccccgcctcccc

SEQ ID NO: 7086116 - DNA, 22 bp, Homo sapiens
aggacagcaaccgttattcaca

SEQ ID NO: 7086117 - DNA, 22 bp, Homo sapiens
cagtaaacagttactaagaaga

SEQ ID NO: 7086118 - DNA, 22 bp, Homo sapiens
cagtaaagagccttcattaaat

SEQ ID NO: 7086119 - DNA, 22 bp, Homo sapiens
cagtaaagcatgtatgtcttca

SEQ ID NO: 7086120 - DNA, 22 bp, Homo sapiens
cagtaaagcatgtatgtcttca

SEQ ID NO: 7086121 - DNA, 22 bp, Homo sapiens
cagtaaagcatgtatgtcttca

SEQ ID NO: 7086122 - DNA, 22 bp, Homo sapiens
cagtaaatgagaagctagtaat

SEQ ID NO: 7086123 - DNA, 22 bp, Homo sapiens
cagtaaatgatgatagtgcctt

SEQ ID NO: 7086124 - DNA, 22 bp, Homo sapiens
cagtaaatgcagatatagatac

SEQ ID NO: 7086125 - DNA, 22 bp, Homo sapiens
cagtaaatgcagatatagatac

SEQ ID NO: 7086126 - DNA, 22 bp, Homo sapiens
cagtaaatggtacgtatatttt

SEQ ID NO: 7086127 - DNA, 22 bp, Homo sapiens
cagtaaatggtacgtatatttt

SEQ ID NO: 7086128 - DNA, 22 bp, Homo sapiens
cagtaaatggtacgtatatttt

SEQ ID NO: 7086129 - DNA, 22 bp, Homo sapiens
cagtaacacaaccactccgtga

SEQ ID NO: 7086130 - DNA, 22 bp, Homo sapiens
cagtaacaggctctgtggtata

SEQ ID NO: 7086131 - DNA, 22 bp, Homo sapiens
cagtaaatgtgatttttcttgt

SEQ ID NO: 7086132 - DNA, 22 bp, Homo sapiens
cagtaaattatctcatctctgt

SEQ ID NO: 7086133 - DNA, 22 bp, Homo sapiens
cagtaacaggctctgtggtata

SEQ ID NO: 7086134 - DNA, 22 bp, Homo sapiens
cagtaacaggctctgtggtata

SEQ ID NO: 7086135 - DNA, 22 bp, Homo sapiens
cagtaacagtgatcacctgtgg

SEQ ID NO: 7086136 - DNA, 22 bp, Homo sapiens
cagtaacagtgatcacctgtgg

SEQ ID NO: 7086137 - DNA, 22 bp, Homo sapiens
cagtaacatgaagagacatgga

SEQ ID NO: 7086138 - DNA, 22 bp, Homo sapiens
cagtaacatgtctgttaagaaa

SEQ ID NO: 7086139 - DNA, 22 bp, Homo sapiens
cagtaacatgtctgttaagaaa

SEQ ID NO: 7086140 - DNA, 22 bp, Homo sapiens
cagtaacatttcaaggtagagg

SEQ ID NO: 7086141 - DNA, 22 bp, Homo sapiens
cagtaacatttcaaggtagagg

SEQ ID NO: 7086142 - DNA, 22 bp, Homo sapiens
cagtaataacacagaaagtttg

SEQ ID NO: 7086143 - DNA, 22 bp, Homo sapiens
cagtaactgatgtgatcaaacg

SEQ ID NO: 7086144 - DNA, 22 bp, Homo sapiens
cagtaagtattcgagtctccat

SEQ ID NO: 7086145 - DNA, 22 bp, Homo sapiens
cagtatgactacaaacagcttt

SEQ ID NO: 7086146 - DNA, 22 bp, Homo sapiens
cagtatgagagttgaatcaagg

SEQ ID NO: 7086147 - DNA, 22 bp, Homo sapiens
cagtatgagagttgaatcaagg

SEQ ID NO: 7086148 - DNA, 22 bp, Homo sapiens
cagtatgactacaaacagcttt

SEQ ID NO: 7086149 - DNA, 22 bp, Homo sapiens
cagtatctgtcagtaatcaggt

SEQ ID NO: 7086150 - DNA, 22 bp, Homo sapiens
cagtatcttgcttatagacaca

SEQ ID NO: 7086151 - DNA, 22 bp, Homo sapiens
cagtatgtactcttatcatgta

SEQ ID NO: 7086152 - DNA, 22 bp, Homo sapiens
cagtatttgttccctatcaatg

SEQ ID NO: 7086153 - DNA, 22 bp, Homo sapiens
cagtatttgttacagcattagc

SEQ ID NO: 7086154 - DNA, 22 bp, Homo sapiens
cagtatttggtaattggctacc

SEQ ID NO: 7086155 - DNA, 22 bp, Homo sapiens
cagtatttgttacagcattagc

SEQ ID NO: 7086156 - DNA, 22 bp, Homo sapiens
cagtatttgttacagcattagc

SEQ ID NO: 7086157 - DNA, 22 bp, Homo sapiens
cagtatttcctcttcttaactt

SEQ ID NO: 7086158 - DNA, 22 bp, Homo sapiens
cagtatttcctcttcttaactt

SEQ ID NO: 7086159 - DNA, 22 bp, Homo sapiens
cagtatttggaatatagctaag

SEQ ID NO: 7086160 - DNA, 22 bp, Homo sapiens
cagtatttggaatatagctaag

SEQ ID NO: 7086161 - DNA, 22 bp, Homo sapiens
cagtatttcctcttcttaactt

SEQ ID NO: 7086162 - DNA, 22 bp, Homo sapiens
cagtatttatggcttgagtatt

SEQ ID NO: 7086163 - DNA, 22 bp, Homo sapiens
cagtatttatggcttgagtatt

SEQ ID NO: 7086164 - DNA, 22 bp, Homo sapiens
cagtatgtttattagaactgca

SEQ ID NO: 7086165 - DNA, 22 bp, Homo sapiens
cagtatgtttgggagacatgac

SEQ ID NO: 7086166 - DNA, 22 bp, Homo sapiens
cagtatgtttgggagacatgac

SEQ ID NO: 7086167 - DNA, 22 bp, Homo sapiens
cagtatttaggattaggagaga

SEQ ID NO: 7086168 - DNA, 22 bp, Homo sapiens
cagtatttaggattaggagaga

SEQ ID NO: 7086169 - DNA, 22 bp, Homo sapiens
cagtatttaggattaggagaga

SEQ ID NO: 7086170 - DNA, 22 bp, Homo sapiens
cagtatttaggattaggagaga

SEQ ID NO: 7086171 - DNA, 23 bp, Homo sapiens
aggaagaggcaatttctcttaga

SEQ ID NO: 7086172 - DNA, 22 bp, Homo sapiens
aggaagagctggaccagaggac

SEQ ID NO: 7086173 - DNA, 22 bp, Homo sapiens
aggaagagctggaccagaggac

SEQ ID NO: 7086174 - DNA, 22 bp, Homo sapiens
aggaagagggtggcagataatc

SEQ ID NO: 7086175 - DNA, 22 bp, Homo sapiens
aggaagagggtggcagataatc

SEQ ID NO: 7086176 - DNA, 18 bp, Homo sapiens
cagggctgtggggtcact

SEQ ID NO: 7086177 - DNA, 18 bp, Homo sapiens
cagggctgtggggtcact

SEQ ID NO: 7086178 - DNA, 18 bp, Homo sapiens
cagggctgtggggtcact

SEQ ID NO: 7086179 - DNA, 22 bp, Homo sapiens
cagggctgttagctgctgctct

SEQ ID NO: 7086180 - DNA, 22 bp, Homo sapiens
cagggctgttagctgctgctct

SEQ ID NO: 7086181 - DNA, 22 bp, Homo sapiens
cagggctgttagctgctgctct

SEQ ID NO: 7086182 - DNA, 18 bp, Homo sapiens
cagggctgtggggtcact

SEQ ID NO: 7086183 - DNA, 18 bp, Homo sapiens
cagggctgtggggtcact

SEQ ID NO: 7086184 - DNA, 22 bp, Homo sapiens
aggaagagctggaccagaggac

SEQ ID NO: 7086185 - DNA, 22 bp, Homo sapiens
aggaagagctggaccagaggac

SEQ ID NO: 7086186 - DNA, 22 bp, Homo sapiens
aggaagagctggaccagaggac

SEQ ID NO: 7086187 - DNA, 22 bp, Homo sapiens
aggaagagctggaccagaggac

SEQ ID NO: 7086188 - DNA, 22 bp, Homo sapiens
aggaagagctggaccagaggac

SEQ ID NO: 7086189 - DNA, 22 bp, Homo sapiens
aggaagagctggaccagaggac

SEQ ID NO: 7086190 - DNA, 22 bp, Homo sapiens
aggaagagctggaccagaggac

SEQ ID NO: 7086191 - DNA, 22 bp, Homo sapiens
aggaagagctggaccagaggac

SEQ ID NO: 7086192 - DNA, 22 bp, Homo sapiens
aggaagagctggaccagaggac

SEQ ID NO: 7086193 - DNA, 22 bp, Homo sapiens
aggaagagctggaccagaggac

SEQ ID NO: 7086194 - DNA, 22 bp, Homo sapiens
aggaagagctggaccagaggac

SEQ ID NO: 7086195 - DNA, 22 bp, Homo sapiens
aggaagagcccgggtgacataa

SEQ ID NO: 7086196 - DNA, 22 bp, Homo sapiens
aggaagagcccgggtgacataa

SEQ ID NO: 7086197 - DNA, 22 bp, Homo sapiens
aggaagagcccgggtgacataa

SEQ ID NO: 7086198 - DNA, 22 bp, Homo sapiens
aggaagagcccgggtgacataa

SEQ ID NO: 7086199 - DNA, 22 bp, Homo sapiens
aggaagagcccgggtgacataa

SEQ ID NO: 7086200 - DNA, 22 bp, Homo sapiens
aggaagagcattcacatggtag

SEQ ID NO: 7086201 - DNA, 22 bp, Homo sapiens
aggaaaggattggcttctctgt

SEQ ID NO: 7086202 - DNA, 22 bp, Homo sapiens
aggaaaggattggcttctctgt

SEQ ID NO: 7086203 - DNA, 22 bp, Homo sapiens
aggaaaggattggcttctctgt

SEQ ID NO: 7086204 - DNA, 22 bp, Homo sapiens
aggaaaggattggcttctctgt

SEQ ID NO: 7086205 - DNA, 22 bp, Homo sapiens
aggaaaggattggcttctctgt

SEQ ID NO: 7086206 - DNA, 19 bp, Homo sapiens
aggaaaggatcaaaatagc

SEQ ID NO: 7086207 - DNA, 19 bp, Homo sapiens
aggaaaggatcaaaatagc

SEQ ID NO: 7086208 - DNA, 19 bp, Homo sapiens
aggaaaggatcaaaatagc

SEQ ID NO: 7086209 - DNA, 22 bp, Homo sapiens
cagggctgggttaaaagcaggg

SEQ ID NO: 7086210 - DNA, 22 bp, Homo sapiens
cagggctgggttaaaagcaggg

SEQ ID NO: 7086211 - DNA, 22 bp, Homo sapiens
cagggctgggttaaaagcaggg

SEQ ID NO: 7086212 - DNA, 22 bp, Homo sapiens
cagggctgggttaaaagcaggg

SEQ ID NO: 7086213 - DNA, 23 bp, Homo sapiens
cagggctgggcttggtgttaggc

SEQ ID NO: 7086214 - DNA, 23 bp, Homo sapiens
cagggctgggcttggtgttaggc

SEQ ID NO: 7086215 - DNA, 23 bp, Homo sapiens
cagggctgggcttggtgttaggc

SEQ ID NO: 7086216 - DNA, 22 bp, Homo sapiens
cagggctggctgtggcaatctc

SEQ ID NO: 7086217 - DNA, 22 bp, Homo sapiens
cagggctggcttccaagttgtt

SEQ ID NO: 7086218 - DNA, 21 bp, Homo sapiens
aggaaaggccagcacgtaggg

SEQ ID NO: 7086219 - DNA, 22 bp, Homo sapiens
aggaaaggcctcagcagaaacc

SEQ ID NO: 7086220 - DNA, 22 bp, Homo sapiens
aggaaaggcctcagcagaaacc

SEQ ID NO: 7086221 - DNA, 22 bp, Homo sapiens
aggaaaggcctcagcagaaacc

SEQ ID NO: 7086222 - DNA, 22 bp, Homo sapiens
aggaaaggcctcagcagaaacc

SEQ ID NO: 7086223 - DNA, 21 bp, Homo sapiens
aggaaaggccagcacgtaggg

SEQ ID NO: 7086224 - DNA, 21 bp, Homo sapiens
aggaaaggccagcacgtaggg

SEQ ID NO: 7086225 - DNA, 21 bp, Homo sapiens
aggaaaggccagcacgtaggg

SEQ ID NO: 7086226 - DNA, 22 bp, Homo sapiens
aggaaaggcctttgcatttggt

SEQ ID NO: 7086227 - DNA, 22 bp, Homo sapiens
aggaaaggcctcagcagaaacc

SEQ ID NO: 7086228 - DNA, 22 bp, Homo sapiens
aggaaaggcctcagcagaaacc

SEQ ID NO: 7086229 - DNA, 22 bp, Homo sapiens
aggaaaggcctttgcatttggt

SEQ ID NO: 7086230 - DNA, 22 bp, Homo sapiens
aggaagaaacctactagagttt

SEQ ID NO: 7086231 - DNA, 22 bp, Homo sapiens
aggaagaaacctactagagttt

SEQ ID NO: 7086232 - DNA, 22 bp, Homo sapiens
aggaagaaacctactagagttt

SEQ ID NO: 7086233 - DNA, 22 bp, Homo sapiens
aggaagaaaactaattagatgg

SEQ ID NO: 7086234 - DNA, 22 bp, Homo sapiens
cagggctggctgtggcaatctc

SEQ ID NO: 7086235 - DNA, 22 bp, Homo sapiens
cagggctggctgtggcaatctc

SEQ ID NO: 7086236 - DNA, 22 bp, Homo sapiens
cagggctggctgtggcaatctc

SEQ ID NO: 7086237 - DNA, 22 bp, Homo sapiens
cagggctggctcatgaaaagtt

SEQ ID NO: 7086238 - DNA, 22 bp, Homo sapiens
cagggctggctcatgaaaagtt

SEQ ID NO: 7086239 - DNA, 22 bp, Homo sapiens
cagggctggatttcatttctag

SEQ ID NO: 7086240 - DNA, 20 bp, Homo sapiens
cagggctctgggcctggcct

SEQ ID NO: 7086241 - DNA, 20 bp, Homo sapiens
cagggctctgggcctggcct

SEQ ID NO: 7086242 - DNA, 22 bp, Homo sapiens
cagggctggatttcatttctag

SEQ ID NO: 7086243 - DNA, 22 bp, Homo sapiens
agctttgggattcaggcaggaa

SEQ ID NO: 7086244 - DNA, 22 bp, Homo sapiens
cagggctctgccttgagggatg

SEQ ID NO: 7086245 - DNA, 22 bp, Homo sapiens
agctttggatttcttatagccc

SEQ ID NO: 7086246 - DNA, 22 bp, Homo sapiens
cagggcagtaccgccctctggc

SEQ ID NO: 7086247 - DNA, 22 bp, Homo sapiens
agctttgaaaatccaaattaca

SEQ ID NO: 7086248 - DNA, 22 bp, Homo sapiens
agctttgaaattatgtttcaga

SEQ ID NO: 7086249 - DNA, 22 bp, Homo sapiens
agctttgaagtatttggtctcc

SEQ ID NO: 7086250 - DNA, 22 bp, Homo sapiens
agctttgaatcctggctctgtc

SEQ ID NO: 7086251 - DNA, 22 bp, Homo sapiens
agctttgaatctggtgtttgca

SEQ ID NO: 7086252 - DNA, 22 bp, Homo sapiens
agctttgaatgagtgcattgca

SEQ ID NO: 7086253 - DNA, 23 bp, Homo sapiens
agctttgaggactttaaaagata

SEQ ID NO: 7086254 - DNA, 22 bp, Homo sapiens
agctttgcactgagacagctca

SEQ ID NO: 7086255 - DNA, 22 bp, Homo sapiens
agctttgcctgctgacattctg

SEQ ID NO: 7086256 - DNA, 22 bp, Homo sapiens
agctttgctcgggtctcccgcc

SEQ ID NO: 7086257 - DNA, 21 bp, Homo sapiens
agctttgctttgtactcattt

SEQ ID NO: 7086258 - DNA, 19 bp, Homo sapiens
agctttggacttgcatttc

SEQ ID NO: 7086259 - DNA, 22 bp, Homo sapiens
agctttggagctgggtgaaaga

SEQ ID NO: 7086260 - DNA, 22 bp, Homo sapiens
agctttggatgatctttgatac

SEQ ID NO: 7086261 - DNA, 22 bp, Homo sapiens
cagggcagggccacaccccctg

SEQ ID NO: 7086262 - DNA, 22 bp, Homo sapiens
cagggcagggccacaccccctg

SEQ ID NO: 7086263 - DNA, 22 bp, Homo sapiens
cagggcagtaacgggaacatct

SEQ ID NO: 7086264 - DNA, 22 bp, Homo sapiens
cagggcagtaacgggaacatct

SEQ ID NO: 7086265 - DNA, 22 bp, Homo sapiens
cagggcagtaacgggaacatct

SEQ ID NO: 7086266 - DNA, 22 bp, Homo sapiens
cagggcagtaacgggaacatct

SEQ ID NO: 7086267 - DNA, 22 bp, Homo sapiens
cagggcagtaacgggaacatct

SEQ ID NO: 7086268 - DNA, 22 bp, Homo sapiens
cagggcagtaacgggaacatct

SEQ ID NO: 7086269 - DNA, 22 bp, Homo sapiens
cagggcagggagcttagaatga

SEQ ID NO: 7086270 - DNA, 22 bp, Homo sapiens
cagggcagggagcttagaatga

SEQ ID NO: 7086271 - DNA, 22 bp, Homo sapiens
cagggcagggagcttagaatga

SEQ ID NO: 7086272 - DNA, 22 bp, Homo sapiens
cagggcaggatgctgtgattat

SEQ ID NO: 7086273 - DNA, 22 bp, Homo sapiens
cagggcagggatgttgcggcag

SEQ ID NO: 7086274 - DNA, 22 bp, Homo sapiens
cagggcagggatgttgcggcag

SEQ ID NO: 7086275 - DNA, 22 bp, Homo sapiens
cagggcagggatgttgcggcag

SEQ ID NO: 7086276 - DNA, 22 bp, Homo sapiens
cagggcagggatgttgcggcag

SEQ ID NO: 7086277 - DNA, 22 bp, Homo sapiens
cagggcagggatgttgcggcag

SEQ ID NO: 7086278 - DNA, 22 bp, Homo sapiens
cagggcagggccacaccccctg

SEQ ID NO: 7086279 - DNA, 22 bp, Homo sapiens
cagggcaggatgctgtgattat

SEQ ID NO: 7086280 - DNA, 22 bp, Homo sapiens
cagggcaggatgctgtgattat

SEQ ID NO: 7086281 - DNA, 22 bp, Homo sapiens
cagggattcagctgaaggaggc

SEQ ID NO: 7086282 - DNA, 22 bp, Homo sapiens
cagggatgtgatgagctgagcc

SEQ ID NO: 7086283 - DNA, 22 bp, Homo sapiens
cagggatgtgatgagctgagcc

SEQ ID NO: 7086284 - DNA, 22 bp, Homo sapiens
caggctcttttggtggcaagga

SEQ ID NO: 7086285 - DNA, 22 bp, Homo sapiens
caggctgaagtgcagtggtgtg

SEQ ID NO: 7086286 - DNA, 22 bp, Homo sapiens
caggctcttccatcctgctgag

SEQ ID NO: 7086287 - DNA, 22 bp, Homo sapiens
caggctcttccatcctgctgag

SEQ ID NO: 7086288 - DNA, 22 bp, Homo sapiens
caggctcttccatcctgctgag

SEQ ID NO: 7086289 - DNA, 22 bp, Homo sapiens
caggctcttccatcctgctgag

SEQ ID NO: 7086290 - DNA, 22 bp, Homo sapiens
caggctcttttggtggcaagga

SEQ ID NO: 7086291 - DNA, 22 bp, Homo sapiens
aggcaagagtgactacgtgaaa

SEQ ID NO: 7086292 - DNA, 22 bp, Homo sapiens
aggcaagattaggaccagaaga

SEQ ID NO: 7086293 - DNA, 22 bp, Homo sapiens
aggcaagaacagacatgggagt

SEQ ID NO: 7086294 - DNA, 22 bp, Homo sapiens
aggcaagaacagacatgggagt

SEQ ID NO: 7086295 - DNA, 22 bp, Homo sapiens
aggcaagaacagacatgggagt

SEQ ID NO: 7086296 - DNA, 22 bp, Homo sapiens
aggcaagaacagacatgggagt

SEQ ID NO: 7086297 - DNA, 22 bp, Homo sapiens
aggcaagaacagacatgggagt

SEQ ID NO: 7086298 - DNA, 22 bp, Homo sapiens
aggcaactggttaagtaaattg

SEQ ID NO: 7086299 - DNA, 22 bp, Homo sapiens
aggcaagaaactttctgggaga

SEQ ID NO: 7086300 - DNA, 22 bp, Homo sapiens
aggcaagattaggaccagaaga

SEQ ID NO: 7086301 - DNA, 22 bp, Homo sapiens
aggcaagattaggaccagaaga

SEQ ID NO: 7086302 - DNA, 22 bp, Homo sapiens
aggcaagctgcagagagtcctt

SEQ ID NO: 7086303 - DNA, 22 bp, Homo sapiens
aggcaagcattgggaacagggc

SEQ ID NO: 7086304 - DNA, 22 bp, Homo sapiens
aggcaaggtgctacagacagtg

SEQ ID NO: 7086305 - DNA, 22 bp, Homo sapiens
aggcaaggtgctacagacagtg

SEQ ID NO: 7086306 - DNA, 20 bp, Homo sapiens
aggcaaggtagatgtctgct

SEQ ID NO: 7086307 - DNA, 20 bp, Homo sapiens
aggcaaggtagatgtctgct

SEQ ID NO: 7086308 - DNA, 22 bp, Homo sapiens
aggcaaggaagaattctcccct

SEQ ID NO: 7086309 - DNA, 22 bp, Homo sapiens
aggcaagggggcgccaccttcc

SEQ ID NO: 7086310 - DNA, 23 bp, Homo sapiens
aggcaagggtgtaaaggaaatga

SEQ ID NO: 7086311 - DNA, 17 bp, Homo sapiens
aggcaatgactgtggtt

SEQ ID NO: 7086312 - DNA, 22 bp, Homo sapiens
cattccttaacgtggggagtct

SEQ ID NO: 7086313 - DNA, 22 bp, Homo sapiens
aggcaatcagtgtagagtaaca

SEQ ID NO: 7086314 - DNA, 22 bp, Homo sapiens
aggcaatcccctgaggatactt

SEQ ID NO: 7086315 - DNA, 22 bp, Homo sapiens
aggcaatcccctgaggatactt

SEQ ID NO: 7086316 - DNA, 22 bp, Homo sapiens
aggcaaggtgctacagacagtg

SEQ ID NO: 7086317 - DNA, 22 bp, Homo sapiens
aggcaaggtgctacagacagtg

SEQ ID NO: 7086318 - DNA, 22 bp, Homo sapiens
aggcaaggtgctacagacagtg

SEQ ID NO: 7086319 - DNA, 22 bp, Homo sapiens
aggcaaggtgctacagacagtg

SEQ ID NO: 7086320 - DNA, 22 bp, Homo sapiens
aggcaaggtgctcttgctctat

SEQ ID NO: 7086321 - DNA, 22 bp, Homo sapiens
aggcaaggtgctcttgctctat

SEQ ID NO: 7086322 - DNA, 22 bp, Homo sapiens
aggcaaggtgctcttgctctat

SEQ ID NO: 7086323 - DNA, 22 bp, Homo sapiens
aggcaagtgcattagaagagca

SEQ ID NO: 7086324 - DNA, 22 bp, Homo sapiens
cattgcttgatagctgaaaatt

SEQ ID NO: 7086325 - DNA, 22 bp, Homo sapiens
cattgcttgatagctgaaaatt

SEQ ID NO: 7086326 - DNA, 22 bp, Homo sapiens
cattgcttatttcagctaaagt

SEQ ID NO: 7086327 - DNA, 22 bp, Homo sapiens
cattgctgcttccaggcacagg

SEQ ID NO: 7086328 - DNA, 20 bp, Homo sapiens
cattgcatatttcattgagg

SEQ ID NO: 7086329 - DNA, 22 bp, Homo sapiens
cattgcagtaatctggtgaaat

SEQ ID NO: 7086330 - DNA, 22 bp, Homo sapiens
cattgcacttctgcttttcctc

SEQ ID NO: 7086331 - DNA, 22 bp, Homo sapiens
cattgcctcggagcctgttatg

SEQ ID NO: 7086332 - DNA, 22 bp, Homo sapiens
cattgcactctggctggaacgg

SEQ ID NO: 7086333 - DNA, 19 bp, Homo sapiens
cattcctttgtctgccaaa

SEQ ID NO: 7086334 - DNA, 22 bp, Homo sapiens
cattccttaacgtggggagtct

SEQ ID NO: 7086335 - DNA, 19 bp, Homo sapiens
cattcctttgtctgccaaa

SEQ ID NO: 7086336 - DNA, 20 bp, Homo sapiens
aggcactgttgtctgtatcc

SEQ ID NO: 7086337 - DNA, 21 bp, Homo sapiens
aggcactgtttgtggtttggg

SEQ ID NO: 7086338 - DNA, 21 bp, Homo sapiens
aggcactgtttgtggtttggg

SEQ ID NO: 7086339 - DNA, 22 bp, Homo sapiens
aggcactgttcccagttatcct

SEQ ID NO: 7086340 - DNA, 22 bp, Homo sapiens
aggcactgtgggtgtggccgga

SEQ ID NO: 7086341 - DNA, 22 bp, Homo sapiens
aggcactgtgggtgtggccgga

SEQ ID NO: 7086342 - DNA, 22 bp, Homo sapiens
cattgtaagctgttgaatcctc

SEQ ID NO: 7086343 - DNA, 22 bp, Homo sapiens
cattggtttgatattgccatgg

SEQ ID NO: 7086344 - DNA, 22 bp, Homo sapiens
cattggtttgatattgccatgg

SEQ ID NO: 7086345 - DNA, 22 bp, Homo sapiens
cattgggccacaagaagaaaat

SEQ ID NO: 7086346 - DNA, 22 bp, Homo sapiens
cattgggcggggacctcggctg

SEQ ID NO: 7086347 - DNA, 22 bp, Homo sapiens
cattgggcttctcctggaccca

SEQ ID NO: 7086348 - DNA, 22 bp, Homo sapiens
cattggaagacatatcatgcta

SEQ ID NO: 7086349 - DNA, 20 bp, Homo sapiens
cattggacttggcttcatgg

SEQ ID NO: 7086350 - DNA, 22 bp, Homo sapiens
cattggcacaagtagcttcatc

SEQ ID NO: 7086351 - DNA, 22 bp, Homo sapiens
cattggcacctcacaggataga

SEQ ID NO: 7086352 - DNA, 20 bp, Homo sapiens
cattggcattcacagaagct

SEQ ID NO: 7086353 - DNA, 22 bp, Homo sapiens
aggcacttaacctactaactga

SEQ ID NO: 7086354 - DNA, 22 bp, Homo sapiens
aggcacttaataaggattcaat

SEQ ID NO: 7086355 - DNA, 22 bp, Homo sapiens
aggcacttcatgggttcaagga

SEQ ID NO: 7086356 - DNA, 22 bp, Homo sapiens
aggcacttgaattgatgatgtt

SEQ ID NO: 7086357 - DNA, 22 bp, Homo sapiens
aggcacttgcattgatgaggtc

SEQ ID NO: 7086358 - DNA, 22 bp, Homo sapiens
aggcacttgcattgatgaggtc

SEQ ID NO: 7086359 - DNA, 22 bp, Homo sapiens
aggcacttggaggtctctgccc

SEQ ID NO: 7086360 - DNA, 22 bp, Homo sapiens
aggcacttgtaattgcagtcat

SEQ ID NO: 7086361 - DNA, 22 bp, Homo sapiens
aggcactttacaatgtgtgaca

SEQ ID NO: 7086362 - DNA, 22 bp, Homo sapiens
aggcactttacaatgtgtgaca

SEQ ID NO: 7086363 - DNA, 22 bp, Homo sapiens
catttacctttaattaaaacac

SEQ ID NO: 7086364 - DNA, 22 bp, Homo sapiens
catttactgttgaatccctagc

SEQ ID NO: 7086365 - DNA, 22 bp, Homo sapiens
catttattggttaggccagcag

SEQ ID NO: 7086366 - DNA, 22 bp, Homo sapiens
catttattggttaggccagcag

SEQ ID NO: 7086367 - DNA, 22 bp, Homo sapiens
catttattggttaggccagcag

SEQ ID NO: 7086368 - DNA, 22 bp, Homo sapiens
catttcaaaagaattgccagaa

SEQ ID NO: 7086369 - DNA, 22 bp, Homo sapiens
catttcaaacagttacagctgc

SEQ ID NO: 7086370 - DNA, 22 bp, Homo sapiens
catttcaaacagttacagctgc

SEQ ID NO: 7086371 - DNA, 21 bp, Homo sapiens
catttcaaagagctggaaatc

SEQ ID NO: 7086372 - DNA, 22 bp, Homo sapiens
catttcaagtaacagattgctt

SEQ ID NO: 7086373 - DNA, 22 bp, Homo sapiens
catttcaagtaacagattgctt

SEQ ID NO: 7086374 - DNA, 22 bp, Homo sapiens
catttctccgccgagatcactg

SEQ ID NO: 7086375 - DNA, 22 bp, Homo sapiens
catttctccgccgagatcactg

SEQ ID NO: 7086376 - DNA, 22 bp, Homo sapiens
catttctcctgggtgataaatt

SEQ ID NO: 7086377 - DNA, 22 bp, Homo sapiens
catttctcctgggtgataaatt

SEQ ID NO: 7086378 - DNA, 22 bp, Homo sapiens
catttcaatacagtttgtaaat

SEQ ID NO: 7086379 - DNA, 22 bp, Homo sapiens
catttcaatactatctgagaat

SEQ ID NO: 7086380 - DNA, 22 bp, Homo sapiens
catttcaatgccttcaacatag

SEQ ID NO: 7086381 - DNA, 22 bp, Homo sapiens
ccacgagggaaccaggtggggt

SEQ ID NO: 7086382 - DNA, 23 bp, Homo sapiens
ccacgtctgcactgtagctgttg

SEQ ID NO: 7086383 - DNA, 19 bp, Homo sapiens
ccacgaggttagcagccac

SEQ ID NO: 7086384 - DNA, 22 bp, Homo sapiens
ccacggccacccgctcatgggc

SEQ ID NO: 7086385 - DNA, 22 bp, Homo sapiens
ccacggccacccgctcatgggc

SEQ ID NO: 7086386 - DNA, 22 bp, Homo sapiens
ccactcagttgctctctgtttt

SEQ ID NO: 7086387 - DNA, 22 bp, Homo sapiens
ccactcagttgctctctgtttt

SEQ ID NO: 7086388 - DNA, 22 bp, Homo sapiens
ccactcaggcctcctgctctcc

SEQ ID NO: 7086389 - DNA, 17 bp, Homo sapiens
ccactcagtaatttctc

SEQ ID NO: 7086390 - DNA, 22 bp, Homo sapiens
ccactcaggagcttatctatgc

SEQ ID NO: 7086391 - DNA, 22 bp, Homo sapiens
ccactcaggagcttatctatgc

SEQ ID NO: 7086392 - DNA, 22 bp, Homo sapiens
ccactcaggcctcctgctctcc

SEQ ID NO: 7086393 - DNA, 22 bp, Homo sapiens
ccactcaggcctcctgctctcc

SEQ ID NO: 7086394 - DNA, 20 bp, Homo sapiens
ccactcagctgtattctcag

SEQ ID NO: 7086395 - DNA, 20 bp, Homo sapiens
ccactcagctgtattctcag

SEQ ID NO: 7086396 - DNA, 23 bp, Homo sapiens
ccactagcacctgttcaacttct

SEQ ID NO: 7086397 - DNA, 23 bp, Homo sapiens
ccactagcacctgttcaacttct

SEQ ID NO: 7086398 - DNA, 22 bp, Homo sapiens
ccactagtttaataccttcctt

SEQ ID NO: 7086399 - DNA, 22 bp, Homo sapiens
ccactcagaccaacgacccttc

SEQ ID NO: 7086400 - DNA, 22 bp, Homo sapiens
ccactcagaccaacgacccttc

SEQ ID NO: 7086401 - DNA, 22 bp, Homo sapiens
ccactcagcacagtggatgcag

SEQ ID NO: 7086402 - DNA, 22 bp, Homo sapiens
ccactcagcacagtggatgcag

SEQ ID NO: 7086403 - DNA, 22 bp, Homo sapiens
ccactcagcacagtggatgcag

SEQ ID NO: 7086404 - DNA, 22 bp, Homo sapiens
ccacgacgagtcatcagggcga

SEQ ID NO: 7086405 - DNA, 22 bp, Homo sapiens
ccacctggggcctctgagtctc

SEQ ID NO: 7086406 - DNA, 22 bp, Homo sapiens
ccacctggggcctctgagtctc

SEQ ID NO: 7086407 - DNA, 22 bp, Homo sapiens
ccacctggggcctctgagtctc

SEQ ID NO: 7086408 - DNA, 22 bp, Homo sapiens
ccacccagccagatgcaggaag

SEQ ID NO: 7086409 - DNA, 22 bp, Homo sapiens
ccacccagccagatgcaggaag

SEQ ID NO: 7086410 - DNA, 18 bp, Homo sapiens
ccacccagggggagagga

SEQ ID NO: 7086411 - DNA, 22 bp, Homo sapiens
ccacccagccagatgcaggaag

SEQ ID NO: 7086412 - DNA, 20 bp, Homo sapiens
ccacctggccaaggctgtgc

SEQ ID NO: 7086413 - DNA, 22 bp, Homo sapiens
ccacccagcagaggaggcaaga

SEQ ID NO: 7086414 - DNA, 22 bp, Homo sapiens
ccacccagccagatgcaggaag

SEQ ID NO: 7086415 - DNA, 22 bp, Homo sapiens
ccacccagccagatgcaggaag

SEQ ID NO: 7086416 - DNA, 22 bp, Homo sapiens
ccacccagccagatgcaggaag

SEQ ID NO: 7086417 - DNA, 22 bp, Homo sapiens
ccacccagcagaggaggcaaga

SEQ ID NO: 7086418 - DNA, 22 bp, Homo sapiens
ccacccagaccagggatctggg

SEQ ID NO: 7086419 - DNA, 22 bp, Homo sapiens
ccacccagaccagggatctggg

SEQ ID NO: 7086420 - DNA, 22 bp, Homo sapiens
ccacccagaccagggatctggg

SEQ ID NO: 7086421 - DNA, 22 bp, Homo sapiens
ccacccagaccagggatctggg

SEQ ID NO: 7086422 - DNA, 22 bp, Homo sapiens
ccacccagcagaggaggcaaga

SEQ ID NO: 7086423 - DNA, 20 bp, Homo sapiens
ccacagtggagactggagac

SEQ ID NO: 7086424 - DNA, 22 bp, Homo sapiens
ccacagtgggcacagcaggact

SEQ ID NO: 7086425 - DNA, 22 bp, Homo sapiens
ccacagtttgccaacacctact

SEQ ID NO: 7086426 - DNA, 22 bp, Homo sapiens
ccacagtttgccagccaggaat

SEQ ID NO: 7086427 - DNA, 22 bp, Homo sapiens
ccacatacaaatggggtgctgt

SEQ ID NO: 7086428 - DNA, 22 bp, Homo sapiens
ccacagtttcttcatctataaa

SEQ ID NO: 7086429 - DNA, 22 bp, Homo sapiens
ccacagtttgccaacacctact

SEQ ID NO: 7086430 - DNA, 21 bp, Homo sapiens
ccacagttctggcaagggctg

SEQ ID NO: 7086431 - DNA, 22 bp, Homo sapiens
ccacagttgctgaaatcgctta

SEQ ID NO: 7086432 - DNA, 22 bp, Homo sapiens
ccacagtttaggaagtcactct

SEQ ID NO: 7086433 - DNA, 22 bp, Homo sapiens
ccacagtttaggaagtcactct

SEQ ID NO: 7086434 - DNA, 21 bp, Homo sapiens
ccacagttctggcaagggctg

SEQ ID NO: 7086435 - DNA, 22 bp, Homo sapiens
ccacagttattcatttgtgaca

SEQ ID NO: 7086436 - DNA, 23 bp, Homo sapiens
ccacagttcatcgttcactcacc

SEQ ID NO: 7086437 - DNA, 23 bp, Homo sapiens
ccacagttcatcgttcactcacc

SEQ ID NO: 7086438 - DNA, 22 bp, Homo sapiens
ccacagttcatgcactggggct

SEQ ID NO: 7086439 - DNA, 21 bp, Homo sapiens
ccaccaggtcttctgctcggg

SEQ ID NO: 7086440 - DNA, 22 bp, Homo sapiens
ccaccaggctctgtccgagcgg

SEQ ID NO: 7086441 - DNA, 22 bp, Homo sapiens
ccaccaggcactcacagggaag

SEQ ID NO: 7086442 - DNA, 22 bp, Homo sapiens
ccacatctcggtcccctctttg

SEQ ID NO: 7086443 - DNA, 22 bp, Homo sapiens
ccacatctccctattgctcttt

SEQ ID NO: 7086444 - DNA, 22 bp, Homo sapiens
ccacatcagaaatgtttactca

SEQ ID NO: 7086445 - DNA, 22 bp, Homo sapiens
ccacatcagaaatgtttactca

SEQ ID NO: 7086446 - DNA, 22 bp, Homo sapiens
ccacatcatggatacagttatg

SEQ ID NO: 7086447 - DNA, 22 bp, Homo sapiens
ccacatctaagccttcatgata

SEQ ID NO: 7086448 - DNA, 22 bp, Homo sapiens
ccacatctaagccttcatgata

SEQ ID NO: 7086449 - DNA, 22 bp, Homo sapiens
ccacatctccctattgctcttt

SEQ ID NO: 7086450 - DNA, 22 bp, Homo sapiens
ccacccacaaccagctggctgt

SEQ ID NO: 7086451 - DNA, 22 bp, Homo sapiens
ccacccacaaccagctggctgt

SEQ ID NO: 7086452 - DNA, 20 bp, Homo sapiens
ccacccacgcgggctctgcc

SEQ ID NO: 7086453 - DNA, 22 bp, Homo sapiens
ccaccatgggaagagagactaa

SEQ ID NO: 7086454 - DNA, 21 bp, Homo sapiens
ccaccaggtcttctgctcggg

SEQ ID NO: 7086455 - DNA, 21 bp, Homo sapiens
ccaccaggtcttctgctcggg

SEQ ID NO: 7086456 - DNA, 22 bp, Homo sapiens
ccacagagagtgtcagcctttg

SEQ ID NO: 7086457 - DNA, 22 bp, Homo sapiens
ccacagagagtgtcagcctttg

SEQ ID NO: 7086458 - DNA, 19 bp, Homo sapiens
ccacagagcatgctgaggc

SEQ ID NO: 7086459 - DNA, 19 bp, Homo sapiens
ccacagagcatgctgaggc

SEQ ID NO: 7086460 - DNA, 19 bp, Homo sapiens
ccacagagcatgctgaggc

SEQ ID NO: 7086461 - DNA, 22 bp, Homo sapiens
ccacagagactctgcaggactg

SEQ ID NO: 7086462 - DNA, 19 bp, Homo sapiens
ccacagagactagaagaca

SEQ ID NO: 7086463 - DNA, 19 bp, Homo sapiens
ccacagagactagaagaca

SEQ ID NO: 7086464 - DNA, 19 bp, Homo sapiens
ccacagagactagaagaca

SEQ ID NO: 7086465 - DNA, 19 bp, Homo sapiens
ccacagagactagaagaca

SEQ ID NO: 7086466 - DNA, 22 bp, Homo sapiens
ccacagagactctgcaggactg

SEQ ID NO: 7086467 - DNA, 22 bp, Homo sapiens
ccacagaattctgtctccagga

SEQ ID NO: 7086468 - DNA, 22 bp, Homo sapiens
ccacagaccttggcttccacct

SEQ ID NO: 7086469 - DNA, 22 bp, Homo sapiens
ccacagaccttggcttccacct

SEQ ID NO: 7086470 - DNA, 22 bp, Homo sapiens
ccacagagacagagcccagggt

SEQ ID NO: 7086471 - DNA, 22 bp, Homo sapiens
ccacagagacagagcccagggt

SEQ ID NO: 7086472 - DNA, 22 bp, Homo sapiens
ccacagagacagagcccagggt

SEQ ID NO: 7086473 - DNA, 22 bp, Homo sapiens
ccacagagacagggtccttgct

SEQ ID NO: 7086474 - DNA, 22 bp, Homo sapiens
ccacagagacagggtccttgct

SEQ ID NO: 7086475 - DNA, 22 bp, Homo sapiens
catttctgggagacatgctaga

SEQ ID NO: 7086476 - DNA, 22 bp, Homo sapiens
catttctgggagacatgctaga

SEQ ID NO: 7086477 - DNA, 22 bp, Homo sapiens
catttgaaaatactcttttcca

SEQ ID NO: 7086478 - DNA, 22 bp, Homo sapiens
catttgaaacctggaatctacc

SEQ ID NO: 7086479 - DNA, 22 bp, Homo sapiens
catttgaaacctggaatctacc

SEQ ID NO: 7086480 - DNA, 22 bp, Homo sapiens
catttgaaatagttcattcttg

SEQ ID NO: 7086481 - DNA, 22 bp, Homo sapiens
ccaatgatggtgcccacgatga

SEQ ID NO: 7086482 - DNA, 22 bp, Homo sapiens
ccaatgcagataagacaaacac

SEQ ID NO: 7086483 - DNA, 22 bp, Homo sapiens
ccacagagcattagatttcaga

SEQ ID NO: 7086484 - DNA, 23 bp, Homo sapiens
ccacagagctgccaattcctgtg

SEQ ID NO: 7086485 - DNA, 22 bp, Homo sapiens
ccacagagcattagatttcaga

SEQ ID NO: 7086486 - DNA, 22 bp, Homo sapiens
aggcaggaaccctgtgtgcgcc

SEQ ID NO: 7086487 - DNA, 22 bp, Homo sapiens
aggcaggaaccctgtgtgcgcc

SEQ ID NO: 7086488 - DNA, 22 bp, Homo sapiens
aggcaggaaccctgtgtgcgcc

SEQ ID NO: 7086489 - DNA, 22 bp, Homo sapiens
aggcaggaaaatcgcttgaacc

SEQ ID NO: 7086490 - DNA, 22 bp, Homo sapiens
aggcaggagcaagccctacaag

SEQ ID NO: 7086491 - DNA, 17 bp, Homo sapiens
aggcaggagattggaga

SEQ ID NO: 7086492 - DNA, 17 bp, Homo sapiens
aggcaggagattggaga

SEQ ID NO: 7086493 - DNA, 22 bp, Homo sapiens
aggcaggagtgaccctgacagg

SEQ ID NO: 7086494 - DNA, 22 bp, Homo sapiens
aggcaggagtgaccctgacagg

SEQ ID NO: 7086495 - DNA, 22 bp, Homo sapiens
aggcaggagtgaccctgacagg

SEQ ID NO: 7086496 - DNA, 22 bp, Homo sapiens
aggcaggagtgaccctgacagg

SEQ ID NO: 7086497 - DNA, 22 bp, Homo sapiens
aggcaggagtgaccctgacagg

SEQ ID NO: 7086498 - DNA, 22 bp, Homo sapiens
aggcaggagtgaccctgacagg

SEQ ID NO: 7086499 - DNA, 22 bp, Homo sapiens
aggcaggaggatcatggatgca

SEQ ID NO: 7086500 - DNA, 23 bp, Homo sapiens
ccacaggcacagaggcttgcatc

SEQ ID NO: 7086501 - DNA, 23 bp, Homo sapiens
ccacaggcacagaggcttgcatc

SEQ ID NO: 7086502 - DNA, 23 bp, Homo sapiens
ccacaggcacagaggcttgcatc

SEQ ID NO: 7086503 - DNA, 22 bp, Homo sapiens
ccacaggcggagtggcgggcag

SEQ ID NO: 7086504 - DNA, 18 bp, Homo sapiens
aggcaggatcctggcctc

SEQ ID NO: 7086505 - DNA, 18 bp, Homo sapiens
aggcaggatcctggcctc

SEQ ID NO: 7086506 - DNA, 23 bp, Homo sapiens
ccacaggcacagaggcttgcatc

SEQ ID NO: 7086507 - DNA, 18 bp, Homo sapiens
aggcaggatcctggcctc

SEQ ID NO: 7086508 - DNA, 22 bp, Homo sapiens
catgaggatgggcagctgggga

SEQ ID NO: 7086509 - DNA, 22 bp, Homo sapiens
catgagggttggggtggagctt

SEQ ID NO: 7086510 - DNA, 22 bp, Homo sapiens
catgaggtcagggggagccggt

SEQ ID NO: 7086511 - DNA, 22 bp, Homo sapiens
aggatttgcactggtgtttgag

SEQ ID NO: 7086512 - DNA, 22 bp, Homo sapiens
aggattttagataagacagcaa

SEQ ID NO: 7086513 - DNA, 22 bp, Homo sapiens
catgaggatccaggtgacaggc

SEQ ID NO: 7086514 - DNA, 22 bp, Homo sapiens
catgaggatccaggtgacaggc

SEQ ID NO: 7086515 - DNA, 22 bp, Homo sapiens
catgagcataaatcagtcacga

SEQ ID NO: 7086516 - DNA, 22 bp, Homo sapiens
catgagatttgggaggggccag

SEQ ID NO: 7086517 - DNA, 22 bp, Homo sapiens
catgagataatttttctccagt

SEQ ID NO: 7086518 - DNA, 22 bp, Homo sapiens
catgagataatttttctccagt

SEQ ID NO: 7086519 - DNA, 22 bp, Homo sapiens
aggatgtgccaccagctttgca

SEQ ID NO: 7086520 - DNA, 22 bp, Homo sapiens
aggatgtggctgagacttctgg

SEQ ID NO: 7086521 - DNA, 22 bp, Homo sapiens
catgagaatgaagaagacttaa

SEQ ID NO: 7086522 - DNA, 22 bp, Homo sapiens
catgagactgccttttcaaacc

SEQ ID NO: 7086523 - DNA, 22 bp, Homo sapiens
catgagactgccttttcaaacc

SEQ ID NO: 7086524 - DNA, 22 bp, Homo sapiens
catgagagacattctgtgtgaa

SEQ ID NO: 7086525 - DNA, 22 bp, Homo sapiens
aggatgtccacccagaccttgc

SEQ ID NO: 7086526 - DNA, 20 bp, Homo sapiens
aggatgtccccgagggcctg

SEQ ID NO: 7086527 - DNA, 20 bp, Homo sapiens
aggatgtccccgagggcctg

SEQ ID NO: 7086528 - DNA, 22 bp, Homo sapiens
aggatgtcagcattggctagag

SEQ ID NO: 7086529 - DNA, 22 bp, Homo sapiens
aggatgtcagcattggctagag

SEQ ID NO: 7086530 - DNA, 22 bp, Homo sapiens
aggatgtcagtcagcttggatt

SEQ ID NO: 7086531 - DNA, 23 bp, Homo sapiens
aggatgtaggatgtatggcagag

SEQ ID NO: 7086532 - DNA, 23 bp, Homo sapiens
aggatgtaggatgtatggcagag

SEQ ID NO: 7086533 - DNA, 23 bp, Homo sapiens
aggatgtcgaatgttagagtgag

SEQ ID NO: 7086534 - DNA, 22 bp, Homo sapiens
aggatgtctctccagcctggag

SEQ ID NO: 7086535 - DNA, 22 bp, Homo sapiens
aggatgtctctccagcctggag

SEQ ID NO: 7086536 - DNA, 22 bp, Homo sapiens
aggatgtctctggaccaggatg

SEQ ID NO: 7086537 - DNA, 22 bp, Homo sapiens
aggatgtctgctgctgtgggct

SEQ ID NO: 7086538 - DNA, 22 bp, Homo sapiens
aggatgtctgctgctgtgggct

SEQ ID NO: 7086539 - DNA, 22 bp, Homo sapiens
aggatgtgagccagcctggcct

SEQ ID NO: 7086540 - DNA, 22 bp, Homo sapiens
aggatgtgagccagcctggcct

SEQ ID NO: 7086541 - DNA, 22 bp, Homo sapiens
aggatgtgccaccagctttgca

SEQ ID NO: 7086542 - DNA, 17 bp, Homo sapiens
catctttaaaatcctga

SEQ ID NO: 7086543 - DNA, 22 bp, Homo sapiens
aggatgagagatacatggagca

SEQ ID NO: 7086544 - DNA, 22 bp, Homo sapiens
aggatgagagatacatggagca

SEQ ID NO: 7086545 - DNA, 22 bp, Homo sapiens
aggatgagagatacatggagca

SEQ ID NO: 7086546 - DNA, 22 bp, Homo sapiens
aggatgggcctgggatatgctt

SEQ ID NO: 7086547 - DNA, 23 bp, Homo sapiens
aggatgggtggcaatagaaagac

SEQ ID NO: 7086548 - DNA, 23 bp, Homo sapiens
aggatgggtggcaatagaaagac

SEQ ID NO: 7086549 - DNA, 22 bp, Homo sapiens
aggatgggtcagctagagtcca

SEQ ID NO: 7086550 - DNA, 23 bp, Homo sapiens
aggatgggtggcaatagaaagac

SEQ ID NO: 7086551 - DNA, 23 bp, Homo sapiens
aggatgtaggatgtatggcagag

SEQ ID NO: 7086552 - DNA, 22 bp, Homo sapiens
aggatggggtctgcagcctggt

SEQ ID NO: 7086553 - DNA, 22 bp, Homo sapiens
aggatggggtctgcagcctggt

SEQ ID NO: 7086554 - DNA, 22 bp, Homo sapiens
aggatggggtctgcagcctggt

SEQ ID NO: 7086555 - DNA, 22 bp, Homo sapiens
aggatggggtctgcagcctggt

SEQ ID NO: 7086556 - DNA, 22 bp, Homo sapiens
aggatggggtctgcagcctggt

SEQ ID NO: 7086557 - DNA, 22 bp, Homo sapiens
aggatgggtcagctagagtcca

SEQ ID NO: 7086558 - DNA, 22 bp, Homo sapiens
aggatgggtcagctagagtcca

SEQ ID NO: 7086559 - DNA, 22 bp, Homo sapiens
catcttcaggtgttttccatca

SEQ ID NO: 7086560 - DNA, 22 bp, Homo sapiens
catcttcaggttcatggtcata

SEQ ID NO: 7086561 - DNA, 22 bp, Homo sapiens
catcttcataaaggaactgcat

SEQ ID NO: 7086562 - DNA, 22 bp, Homo sapiens
catcttcattttgtccagtact

SEQ ID NO: 7086563 - DNA, 22 bp, Homo sapiens
catcttctgggacttctcagtt

SEQ ID NO: 7086564 - DNA, 20 bp, Homo sapiens
catcttgaaggtcttccaca

SEQ ID NO: 7086565 - DNA, 22 bp, Homo sapiens
catcttgaaggtttctttagct

SEQ ID NO: 7086566 - DNA, 22 bp, Homo sapiens
catcttgactgggataagggat

SEQ ID NO: 7086567 - DNA, 22 bp, Homo sapiens
catcttgagacatgaaaggtgt

SEQ ID NO: 7086568 - DNA, 22 bp, Homo sapiens
catcttgagacatgaaaggtgt

SEQ ID NO: 7086569 - DNA, 22 bp, Homo sapiens
catcttgatgctttgacaggtt

SEQ ID NO: 7086570 - DNA, 22 bp, Homo sapiens
catcttgatgctttgacaggtt

SEQ ID NO: 7086571 - DNA, 22 bp, Homo sapiens
catcttgctgggttttatcata

SEQ ID NO: 7086572 - DNA, 19 bp, Homo sapiens
catcttggagtactccttt

SEQ ID NO: 7086573 - DNA, 22 bp, Homo sapiens
catcttgggtaagcagttgctt

SEQ ID NO: 7086574 - DNA, 22 bp, Homo sapiens
catctcttcattagcattattg

SEQ ID NO: 7086575 - DNA, 22 bp, Homo sapiens
catcttaatttctaacaggcac

SEQ ID NO: 7086576 - DNA, 22 bp, Homo sapiens
catctctgtgtccccagagctt

SEQ ID NO: 7086577 - DNA, 21 bp, Homo sapiens
catcttaggttgtacatatat

SEQ ID NO: 7086578 - DNA, 22 bp, Homo sapiens
catcttataggcagagttcagt

SEQ ID NO: 7086579 - DNA, 22 bp, Homo sapiens
catcttcaccagagacaagcaa

SEQ ID NO: 7086580 - DNA, 22 bp, Homo sapiens
catcttcaccagagacaagcaa

SEQ ID NO: 7086581 - DNA, 22 bp, Homo sapiens
catctctgtgtccccagagctt

SEQ ID NO: 7086582 - DNA, 22 bp, Homo sapiens
catctctgtgtccccagagctt

SEQ ID NO: 7086583 - DNA, 22 bp, Homo sapiens
catctctgtgtccccagagctt

SEQ ID NO: 7086584 - DNA, 19 bp, Homo sapiens
catctctgcaaggagctgc

SEQ ID NO: 7086585 - DNA, 19 bp, Homo sapiens
catctctgcaaggagctgc

SEQ ID NO: 7086586 - DNA, 22 bp, Homo sapiens
catctctggttcagtctctgtg

SEQ ID NO: 7086587 - DNA, 22 bp, Homo sapiens
catctctccacggcagctctcg

SEQ ID NO: 7086588 - DNA, 22 bp, Homo sapiens
catctctccacggcagctctcg

SEQ ID NO: 7086589 - DNA, 22 bp, Homo sapiens
catctctgagacctcagctggg

SEQ ID NO: 7086590 - DNA, 22 bp, Homo sapiens
catctctgagacctcagctggg

SEQ ID NO: 7086591 - DNA, 22 bp, Homo sapiens
catctctgagacctcagctggg

SEQ ID NO: 7086592 - DNA, 22 bp, Homo sapiens
catctctgagacctcagctggg

SEQ ID NO: 7086593 - DNA, 19 bp, Homo sapiens
catctctgcaaggagctgc

SEQ ID NO: 7086594 - DNA, 22 bp, Homo sapiens
catctcctttggtctacttcca

SEQ ID NO: 7086595 - DNA, 22 bp, Homo sapiens
catctcctttggtctacttcca

SEQ ID NO: 7086596 - DNA, 20 bp, Homo sapiens
catctcctgcctccatgttc

SEQ ID NO: 7086597 - DNA, 22 bp, Homo sapiens
catctcctggcagctgttagga

SEQ ID NO: 7086598 - DNA, 22 bp, Homo sapiens
catctcctggcagctgttagga

SEQ ID NO: 7086599 - DNA, 20 bp, Homo sapiens
catctcctgcctccatgttc

SEQ ID NO: 7086600 - DNA, 22 bp, Homo sapiens
catctccaggagttctactcat

SEQ ID NO: 7086601 - DNA, 20 bp, Homo sapiens
catctcctgcctccatgttc

SEQ ID NO: 7086602 - DNA, 20 bp, Homo sapiens
catctcctgcctccatgttc

SEQ ID NO: 7086603 - DNA, 22 bp, Homo sapiens
catacatatgtggatgtcatat

SEQ ID NO: 7086604 - DNA, 22 bp, Homo sapiens
catacatatgtggatgtcatat

SEQ ID NO: 7086605 - DNA, 22 bp, Homo sapiens
catccaaactctcattatctgt

SEQ ID NO: 7086606 - DNA, 22 bp, Homo sapiens
catacatatgtggatgtcatat

SEQ ID NO: 7086607 - DNA, 22 bp, Homo sapiens
catccaaagcaaatatcttaaa

SEQ ID NO: 7086608 - DNA, 22 bp, Homo sapiens
catccaaagcaaatatcttaaa

SEQ ID NO: 7086609 - DNA, 22 bp, Homo sapiens
catctcatagtgcagtgctgta

SEQ ID NO: 7086610 - DNA, 22 bp, Homo sapiens
catctcatagtgcagtgctgta

SEQ ID NO: 7086611 - DNA, 22 bp, Homo sapiens
catctcatcagtgagagtcagc

SEQ ID NO: 7086612 - DNA, 22 bp, Homo sapiens
catctcatcagtgagagtcagc

SEQ ID NO: 7086613 - DNA, 22 bp, Homo sapiens
catacaaatgtgtccaggctct

SEQ ID NO: 7086614 - DNA, 22 bp, Homo sapiens
catacaatcaagttctttatta

SEQ ID NO: 7086615 - DNA, 22 bp, Homo sapiens
catacaatcaagttctttatta

SEQ ID NO: 7086616 - DNA, 22 bp, Homo sapiens
catacaatcaagttctttatta

SEQ ID NO: 7086617 - DNA, 22 bp, Homo sapiens
catacaatcaagttctttatta

SEQ ID NO: 7086618 - DNA, 19 bp, Homo sapiens
catacaattaccataggat

SEQ ID NO: 7086619 - DNA, 22 bp, Homo sapiens
catacagaaaatatattttgat

SEQ ID NO: 7086620 - DNA, 22 bp, Homo sapiens
catacagagaaggataataaag

SEQ ID NO: 7086621 - DNA, 22 bp, Homo sapiens
catacagagaaggataataaag

SEQ ID NO: 7086622 - DNA, 22 bp, Homo sapiens
catacagatggccaggcctcac

SEQ ID NO: 7086623 - DNA, 22 bp, Homo sapiens
catacagtgtggcatgtagtct

SEQ ID NO: 7086624 - DNA, 22 bp, Homo sapiens
catacagttttccctagatgtg

SEQ ID NO: 7086625 - DNA, 22 bp, Homo sapiens
catacataccactgctgtcttt

SEQ ID NO: 7086626 - DNA, 22 bp, Homo sapiens
catacataccactgctgtcttt

SEQ ID NO: 7086627 - DNA, 22 bp, Homo sapiens
catacatactgagtggactgat

SEQ ID NO: 7086628 - DNA, 22 bp, Homo sapiens
catacatatgcatgtgtgtata

SEQ ID NO: 7086629 - DNA, 22 bp, Homo sapiens
catacatatgcatgtgtgtata

SEQ ID NO: 7086630 - DNA, 22 bp, Homo sapiens
aggaggctctcaggtcctcccc

SEQ ID NO: 7086631 - DNA, 22 bp, Homo sapiens
aggaggctctcaggtcctcccc

SEQ ID NO: 7086632 - DNA, 22 bp, Homo sapiens
aggaggctctcaggtcctcccc

SEQ ID NO: 7086633 - DNA, 22 bp, Homo sapiens
aggaggctctcaggtcctcccc

SEQ ID NO: 7086634 - DNA, 22 bp, Homo sapiens
aggaggcctgtgtttgtctgta

SEQ ID NO: 7086635 - DNA, 22 bp, Homo sapiens
aggaggccttggggcttagagc

SEQ ID NO: 7086636 - DNA, 22 bp, Homo sapiens
aggaggcctgcagctgccattc

SEQ ID NO: 7086637 - DNA, 23 bp, Homo sapiens
aggaggcctgaaactgaggctga

SEQ ID NO: 7086638 - DNA, 20 bp, Homo sapiens
aggaggcctgcagatagttc

SEQ ID NO: 7086639 - DNA, 20 bp, Homo sapiens
aggaggcctgcagatagttc

SEQ ID NO: 7086640 - DNA, 22 bp, Homo sapiens
aggaggcctgcagctgccattc

SEQ ID NO: 7086641 - DNA, 22 bp, Homo sapiens
aggaggcctgcagctgccattc

SEQ ID NO: 7086642 - DNA, 22 bp, Homo sapiens
aggaggctgaactagggtctgg

SEQ ID NO: 7086643 - DNA, 22 bp, Homo sapiens
aggaggctctcaggtcctcccc

SEQ ID NO: 7086644 - DNA, 22 bp, Homo sapiens
aggaggctgaactagggtctgg

SEQ ID NO: 7086645 - DNA, 22 bp, Homo sapiens
aggaggctgcaaccctgaggcc

SEQ ID NO: 7086646 - DNA, 22 bp, Homo sapiens
catacaaatgtgtccaggctct

SEQ ID NO: 7086647 - DNA, 22 bp, Homo sapiens
catacaaatgtgtccaggctct

SEQ ID NO: 7086648 - DNA, 22 bp, Homo sapiens
aggagctgtcagagtgccagag

SEQ ID NO: 7086649 - DNA, 22 bp, Homo sapiens
aggagctgtcagagtgccagag

SEQ ID NO: 7086650 - DNA, 22 bp, Homo sapiens
aggagctgtcagagtgccagag

SEQ ID NO: 7086651 - DNA, 22 bp, Homo sapiens
aggagctgtgaatgggaggggt

SEQ ID NO: 7086652 - DNA, 22 bp, Homo sapiens
aggagctgtgaatgggaggggt

SEQ ID NO: 7086653 - DNA, 22 bp, Homo sapiens
aggagctgtcagagtgccagag

SEQ ID NO: 7086654 - DNA, 22 bp, Homo sapiens
aggagctggtagtctcattggg

SEQ ID NO: 7086655 - DNA, 22 bp, Homo sapiens
aggagctggtagtctcattggg

SEQ ID NO: 7086656 - DNA, 17 bp, Homo sapiens
aggagctgggggtggtg

SEQ ID NO: 7086657 - DNA, 16 bp, Homo sapiens
aggagctgggtaggag

SEQ ID NO: 7086658 - DNA, 16 bp, Homo sapiens
aggagctgggtaggag

SEQ ID NO: 7086659 - DNA, 22 bp, Homo sapiens
aggagctgtgaatgggaggggt

SEQ ID NO: 7086660 - DNA, 22 bp, Homo sapiens
aggagctgtgaatgggaggggt

SEQ ID NO: 7086661 - DNA, 22 bp, Homo sapiens
aggagctgtgaatgggaggggt

SEQ ID NO: 7086662 - DNA, 22 bp, Homo sapiens
aggagctgtgaatgggaggggt

SEQ ID NO: 7086663 - DNA, 22 bp, Homo sapiens
aggagctgtgaatgggaggggt

SEQ ID NO: 7086664 - DNA, 22 bp, Homo sapiens
aggagctgtgaatgggaggggt

SEQ ID NO: 7086665 - DNA, 22 bp, Homo sapiens
aggaggcagatgcttggctgta

SEQ ID NO: 7086666 - DNA, 22 bp, Homo sapiens
aggaggcagatgcttggctgta

SEQ ID NO: 7086667 - DNA, 22 bp, Homo sapiens
aggaggcagatgcttggctgta

SEQ ID NO: 7086668 - DNA, 22 bp, Homo sapiens
aggaggcagatgcttggctgta

SEQ ID NO: 7086669 - DNA, 22 bp, Homo sapiens
aggaggcaggaagtctatggga

SEQ ID NO: 7086670 - DNA, 22 bp, Homo sapiens
aggaggccgctgatgggctccc

SEQ ID NO: 7086671 - DNA, 22 bp, Homo sapiens
aggaggccgggattctggagat

SEQ ID NO: 7086672 - DNA, 22 bp, Homo sapiens
aggaggcctctatccagagaga

SEQ ID NO: 7086673 - DNA, 22 bp, Homo sapiens
aggaggcctctatccagagaga

SEQ ID NO: 7086674 - DNA, 23 bp, Homo sapiens
aggaggcctgaaactgaggctga

SEQ ID NO: 7086675 - DNA, 23 bp, Homo sapiens
aggaggcctgaaactgaggctga

SEQ ID NO: 7086676 - DNA, 22 bp, Homo sapiens
cataacatgtacatataaatgc

SEQ ID NO: 7086677 - DNA, 22 bp, Homo sapiens
cataacatgtacatataaatgc

SEQ ID NO: 7086678 - DNA, 22 bp, Homo sapiens
cataacattaagcctctatttc

SEQ ID NO: 7086679 - DNA, 22 bp, Homo sapiens
cataacatgtacatataaatgc

SEQ ID NO: 7086680 - DNA, 22 bp, Homo sapiens
cataacatgtacatataaatgc

SEQ ID NO: 7086681 - DNA, 22 bp, Homo sapiens
cataacatctgtgaagcaggaa

SEQ ID NO: 7086682 - DNA, 22 bp, Homo sapiens
cataacatctgtgaagcaggaa

SEQ ID NO: 7086683 - DNA, 22 bp, Homo sapiens
cagttttatgtcgaatgtatac

SEQ ID NO: 7086684 - DNA, 22 bp, Homo sapiens
aggagccatccccatgagaggt

SEQ ID NO: 7086685 - DNA, 22 bp, Homo sapiens
aggagccatccccatgagaggt

SEQ ID NO: 7086686 - DNA, 22 bp, Homo sapiens
cagttttattggttgaaatctg

SEQ ID NO: 7086687 - DNA, 22 bp, Homo sapiens
cagttttatgtcgaatgtatac

SEQ ID NO: 7086688 - DNA, 22 bp, Homo sapiens
cagttttattggttgaaatctg

SEQ ID NO: 7086689 - DNA, 22 bp, Homo sapiens
aggagccagttccaccccagga

SEQ ID NO: 7086690 - DNA, 22 bp, Homo sapiens
aggagccagttccaccccagga

SEQ ID NO: 7086691 - DNA, 22 bp, Homo sapiens
aggagccagtggagttcctgcc

SEQ ID NO: 7086692 - DNA, 22 bp, Homo sapiens
aggagccatccccatgagaggt

SEQ ID NO: 7086693 - DNA, 22 bp, Homo sapiens
aggagccatccccatgagaggt

SEQ ID NO: 7086694 - DNA, 22 bp, Homo sapiens
aggagccatccccatgagaggt

SEQ ID NO: 7086695 - DNA, 22 bp, Homo sapiens
aggagccatccccatgagaggt

SEQ ID NO: 7086696 - DNA, 22 bp, Homo sapiens
cataatatctccgattacttgc

SEQ ID NO: 7086697 - DNA, 22 bp, Homo sapiens
cataatatctccgattacttgc

SEQ ID NO: 7086698 - DNA, 22 bp, Homo sapiens
cataatatactacattgatgaa

SEQ ID NO: 7086699 - DNA, 22 bp, Homo sapiens
cataatatactacattgatgaa

SEQ ID NO: 7086700 - DNA, 22 bp, Homo sapiens
cataagaatcttccagggcatg

SEQ ID NO: 7086701 - DNA, 22 bp, Homo sapiens
cataagttgcagagggtgcatt

SEQ ID NO: 7086702 - DNA, 22 bp, Homo sapiens
cataactgggagatccaagggt

SEQ ID NO: 7086703 - DNA, 22 bp, Homo sapiens
cataactggggacacttctcta

SEQ ID NO: 7086704 - DNA, 22 bp, Homo sapiens
cataactggggacacttctcta

SEQ ID NO: 7086705 - DNA, 22 bp, Homo sapiens
cataactgttaagataattttt

SEQ ID NO: 7086706 - DNA, 22 bp, Homo sapiens
cataacttgctttggagcccgg

SEQ ID NO: 7086707 - DNA, 22 bp, Homo sapiens
cataacttggtgttggaaactg

SEQ ID NO: 7086708 - DNA, 22 bp, Homo sapiens
cataactttaaagacagtgtgg

SEQ ID NO: 7086709 - DNA, 22 bp, Homo sapiens
cagtgtggctgagacagaggct

SEQ ID NO: 7086710 - DNA, 22 bp, Homo sapiens
cagtgtggctgagacagaggct

SEQ ID NO: 7086711 - DNA, 22 bp, Homo sapiens
cagtgtggctgagacagaggct

SEQ ID NO: 7086712 - DNA, 22 bp, Homo sapiens
cagtgtggagggagagagcctg

SEQ ID NO: 7086713 - DNA, 22 bp, Homo sapiens
cagtgtggcttagggaataggc

SEQ ID NO: 7086714 - DNA, 22 bp, Homo sapiens
cagtgtggcttagggaataggc

SEQ ID NO: 7086715 - DNA, 22 bp, Homo sapiens
cagtgtgggtgaaatacaaagt

SEQ ID NO: 7086716 - DNA, 22 bp, Homo sapiens
cagtgtgggtttgggaggagta

SEQ ID NO: 7086717 - DNA, 22 bp, Homo sapiens
cagtgtgggtttgggaggagta

SEQ ID NO: 7086718 - DNA, 22 bp, Homo sapiens
cagtgtgggtttgggaggagta

SEQ ID NO: 7086719 - DNA, 21 bp, Homo sapiens
cagtgtggtgaccagggtctc

SEQ ID NO: 7086720 - DNA, 20 bp, Homo sapiens
cagtccaggctgcagcatct

SEQ ID NO: 7086721 - DNA, 20 bp, Homo sapiens
cagtccaggctgcagcatct

SEQ ID NO: 7086722 - DNA, 22 bp, Homo sapiens
cagtccaggttctttctctaaa

SEQ ID NO: 7086723 - DNA, 22 bp, Homo sapiens
cagtccaggttctttctctaaa

SEQ ID NO: 7086724 - DNA, 22 bp, Homo sapiens
cagtccagtccaatcctcaatg

SEQ ID NO: 7086725 - DNA, 22 bp, Homo sapiens
cagtggttcctgttcttctggg

SEQ ID NO: 7086726 - DNA, 22 bp, Homo sapiens
cagtggttctcaatcaggaatg

SEQ ID NO: 7086727 - DNA, 22 bp, Homo sapiens
cagtggttctcaatcaggaatg

SEQ ID NO: 7086728 - DNA, 21 bp, Homo sapiens
cagtggttgctgaattagtgg

SEQ ID NO: 7086729 - DNA, 22 bp, Homo sapiens
cagtgtgctgcagagaacattt

SEQ ID NO: 7086730 - DNA, 22 bp, Homo sapiens
cagtccaggcctggaggagcca

SEQ ID NO: 7086731 - DNA, 22 bp, Homo sapiens
cagtccagctcatcagtggcac

SEQ ID NO: 7086732 - DNA, 22 bp, Homo sapiens
cagtccagctcatcagtggcac

SEQ ID NO: 7086733 - DNA, 22 bp, Homo sapiens
cagtccaggcctggaggagcca

SEQ ID NO: 7086734 - DNA, 22 bp, Homo sapiens
cagtccaggcctggaggagcca

SEQ ID NO: 7086735 - DNA, 22 bp, Homo sapiens
cagtccaggcctggaggagcca

SEQ ID NO: 7086736 - DNA, 22 bp, Homo sapiens
cagtccaggcctggaggagcca

SEQ ID NO: 7086737 - DNA, 22 bp, Homo sapiens
cagtatttgttccctatcaatg

SEQ ID NO: 7086738 - DNA, 21 bp, Homo sapiens
cagtattttaagcagtgagtt

SEQ ID NO: 7086739 - DNA, 22 bp, Homo sapiens
cagtccagagcccaccagagga

SEQ ID NO: 7086740 - DNA, 22 bp, Homo sapiens
cagtccagagtaccccaagaag

SEQ ID NO: 7086741 - DNA, 22 bp, Homo sapiens
cagtccagcaaagaactttcac

SEQ ID NO: 7086742 - DNA, 22 bp, Homo sapiens
cagtccagccagtagggtgtgg

SEQ ID NO: 7086743 - DNA, 22 bp, Homo sapiens
cagtccagccagtagggtgtgg

SEQ ID NO: 7086744 - DNA, 22 bp, Homo sapiens
cagtccagccccctgctaaaag

SEQ ID NO: 7086745 - DNA, 22 bp, Homo sapiens
aggagccacttaggtgagataa

SEQ ID NO: 7086746 - DNA, 22 bp, Homo sapiens
aggagccagaatccagactcgg

SEQ ID NO: 7086747 - DNA, 22 bp, Homo sapiens
aggagccagattctctcacttt

SEQ ID NO: 7086748 - DNA, 22 bp, Homo sapiens
aggagccagcgttcctcaggat

SEQ ID NO: 7086749 - DNA, 22 bp, Homo sapiens
aggagccagcgttcctcaggat

SEQ ID NO: 7086750 - DNA, 23 bp, Homo sapiens
aggagccaggaaccagcttcccc

SEQ ID NO: 7086751 - DNA, 23 bp, Homo sapiens
aggagccaggtgcagcccttgtg

SEQ ID NO: 7086752 - DNA, 22 bp, Homo sapiens
aggagccacttaggtgagataa

SEQ ID NO: 7086753 - DNA, 22 bp, Homo sapiens
aggagccacttaggtgagataa

SEQ ID NO: 7086754 - DNA, 22 bp, Homo sapiens
cagtgtttaatcattgtgaatt

SEQ ID NO: 7086755 - DNA, 22 bp, Homo sapiens
cagtgtttagatcaagaaggcc

SEQ ID NO: 7086756 - DNA, 22 bp, Homo sapiens
cagtgtttaatcattgtgaatt

SEQ ID NO: 7086757 - DNA, 22 bp, Homo sapiens
cagtgtgggtttgggaggagta

SEQ ID NO: 7086758 - DNA, 21 bp, Homo sapiens
cagtgtggtgaccagggtctc

SEQ ID NO: 7086759 - DNA, 21 bp, Homo sapiens
cagtgtggtgaccagggtctc

SEQ ID NO: 7086760 - DNA, 21 bp, Homo sapiens
cagtgtggtgaccagggtctc

SEQ ID NO: 7086761 - DNA, 22 bp, Homo sapiens
cagtgtggtgagattccaggtg

SEQ ID NO: 7086762 - DNA, 22 bp, Homo sapiens
cagtgtggtgagattccaggtg

SEQ ID NO: 7086763 - DNA, 22 bp, Homo sapiens
cagtgtggtgtgcacagcttag

SEQ ID NO: 7086764 - DNA, 22 bp, Homo sapiens
cagtgtgtctcttgtcctggct

SEQ ID NO: 7086765 - DNA, 22 bp, Homo sapiens
cagtgtgtgactctgggggtac

SEQ ID NO: 7086766 - DNA, 22 bp, Homo sapiens
cctactccctttctagagtatg

SEQ ID NO: 7086767 - DNA, 22 bp, Homo sapiens
cctactccctttctagagtatg

SEQ ID NO: 7086768 - DNA, 22 bp, Homo sapiens
cctaccagtaggaggccagaga

SEQ ID NO: 7086769 - DNA, 22 bp, Homo sapiens
cctactctgagcgcctccgcat

SEQ ID NO: 7086770 - DNA, 22 bp, Homo sapiens
cctactctgagcgcctccgcat

SEQ ID NO: 7086771 - DNA, 22 bp, Homo sapiens
cctactctgagcgcctccgcat

SEQ ID NO: 7086772 - DNA, 18 bp, Homo sapiens
cctacatcattgtgagag

SEQ ID NO: 7086773 - DNA, 19 bp, Homo sapiens
cctacatgagtaagcttgg

SEQ ID NO: 7086774 - DNA, 22 bp, Homo sapiens
cctactctgagcgcctccgcat

SEQ ID NO: 7086775 - DNA, 22 bp, Homo sapiens
cctactctgagcgcctccgcat

SEQ ID NO: 7086776 - DNA, 22 bp, Homo sapiens
cctactctgtgagccactttgc

SEQ ID NO: 7086777 - DNA, 22 bp, Homo sapiens
cctactctgtgagccactttgc

SEQ ID NO: 7086778 - DNA, 19 bp, Homo sapiens
cctacttgtttgagggaag

SEQ ID NO: 7086779 - DNA, 22 bp, Homo sapiens
cctagaacacaacctatattag

SEQ ID NO: 7086780 - DNA, 22 bp, Homo sapiens
agggctgacctaagctccactt

SEQ ID NO: 7086781 - DNA, 22 bp, Homo sapiens
agggctgaaacataatccttct

SEQ ID NO: 7086782 - DNA, 22 bp, Homo sapiens
agggctgacagtggcgtggcgt

SEQ ID NO: 7086783 - DNA, 22 bp, Homo sapiens
agggctgacagtggcgtggcgt

SEQ ID NO: 7086784 - DNA, 22 bp, Homo sapiens
agggctgacctaagctccactt

SEQ ID NO: 7086785 - DNA, 20 bp, Homo sapiens
agggctgagaagggactagc

SEQ ID NO: 7086786 - DNA, 22 bp, Homo sapiens
agggctgagaatgacagggccg

SEQ ID NO: 7086787 - DNA, 22 bp, Homo sapiens
agggctgagactaaggccagat

SEQ ID NO: 7086788 - DNA, 22 bp, Homo sapiens
agggctgagaatgacagggccg

SEQ ID NO: 7086789 - DNA, 22 bp, Homo sapiens
agggctgagcccaggcatgtag

SEQ ID NO: 7086790 - DNA, 22 bp, Homo sapiens
agggctgagcccaggcatgtag

SEQ ID NO: 7086791 - DNA, 22 bp, Homo sapiens
agggctgagcccaggcatgtag

SEQ ID NO: 7086792 - DNA, 22 bp, Homo sapiens
agggctgagtgggagagagttg

SEQ ID NO: 7086793 - DNA, 18 bp, Homo sapiens
cctcagggagatccagtg

SEQ ID NO: 7086794 - DNA, 22 bp, Homo sapiens
cctcagggaggcctctgtggct

SEQ ID NO: 7086795 - DNA, 22 bp, Homo sapiens
agggctttgatgtccatgagga

SEQ ID NO: 7086796 - DNA, 22 bp, Homo sapiens
agggctgggctgcttgttgtca

SEQ ID NO: 7086797 - DNA, 22 bp, Homo sapiens
agggctgggctgcttgttgtca

SEQ ID NO: 7086798 - DNA, 22 bp, Homo sapiens
agggctgggctgcttgttgtca

SEQ ID NO: 7086799 - DNA, 22 bp, Homo sapiens
cctcagtctatttccagcaggt

SEQ ID NO: 7086800 - DNA, 22 bp, Homo sapiens
cctcaggtgtgggccagctgtc

SEQ ID NO: 7086801 - DNA, 22 bp, Homo sapiens
cctcaggtgtgggccagctgtc

SEQ ID NO: 7086802 - DNA, 22 bp, Homo sapiens
cctcaggtgtgggccagctgtc

SEQ ID NO: 7086803 - DNA, 22 bp, Homo sapiens
cctcagtcattggcctacactt

SEQ ID NO: 7086804 - DNA, 22 bp, Homo sapiens
aggggaaaagtgttgtctctag

SEQ ID NO: 7086805 - DNA, 22 bp, Homo sapiens
cctcagggttcggatgagaaca

SEQ ID NO: 7086806 - DNA, 22 bp, Homo sapiens
cctcagggtctgaggagaccgt

SEQ ID NO: 7086807 - DNA, 22 bp, Homo sapiens
cctcagggtggcatcagatctt

SEQ ID NO: 7086808 - DNA, 22 bp, Homo sapiens
cctcagggtggcatcagatctt

SEQ ID NO: 7086809 - DNA, 22 bp, Homo sapiens
cctcagggtctctcacagcacc

SEQ ID NO: 7086810 - DNA, 22 bp, Homo sapiens
cctcagggtctgaggagaccgt

SEQ ID NO: 7086811 - DNA, 22 bp, Homo sapiens
cctcagggtcatcctagtaata

SEQ ID NO: 7086812 - DNA, 22 bp, Homo sapiens
cctcagggtcatcctagtaata

SEQ ID NO: 7086813 - DNA, 23 bp, Homo sapiens
cctcagggtctagcagagagaag

SEQ ID NO: 7086814 - DNA, 22 bp, Homo sapiens
cctcagggtctctcacagcacc

SEQ ID NO: 7086815 - DNA, 22 bp, Homo sapiens
cctcagggtctctcacagcacc

SEQ ID NO: 7086816 - DNA, 22 bp, Homo sapiens
cctcaggggtgcccacagctgc

SEQ ID NO: 7086817 - DNA, 22 bp, Homo sapiens
cctcaggggtgcccacagctgc

SEQ ID NO: 7086818 - DNA, 22 bp, Homo sapiens
cctcaggggtgcccacagctgc

SEQ ID NO: 7086819 - DNA, 22 bp, Homo sapiens
cctcaggggcttttcgttgttg

SEQ ID NO: 7086820 - DNA, 22 bp, Homo sapiens
cctcaggggtcactgtgaggag

SEQ ID NO: 7086821 - DNA, 22 bp, Homo sapiens
cctcaggggtcactgtgaggag

SEQ ID NO: 7086822 - DNA, 18 bp, Homo sapiens
cctcaggggacctggcag

SEQ ID NO: 7086823 - DNA, 22 bp, Homo sapiens
cctcagggccatctctgtccct

SEQ ID NO: 7086824 - DNA, 23 bp, Homo sapiens
cctcaggggacctgtgagcctga

SEQ ID NO: 7086825 - DNA, 20 bp, Homo sapiens
agggcctgttgcaagcgttt

SEQ ID NO: 7086826 - DNA, 22 bp, Homo sapiens
agggcctgtgcttcctgagata

SEQ ID NO: 7086827 - DNA, 22 bp, Homo sapiens
agggcctgtgctgagtagacga

SEQ ID NO: 7086828 - DNA, 22 bp, Homo sapiens
agggcctgtgctgagtagacga

SEQ ID NO: 7086829 - DNA, 22 bp, Homo sapiens
agggcctgtgcttcctgagata

SEQ ID NO: 7086830 - DNA, 22 bp, Homo sapiens
agggcctgtgcttcctgagata

SEQ ID NO: 7086831 - DNA, 22 bp, Homo sapiens
agggcctgtgcttcctgagata

SEQ ID NO: 7086832 - DNA, 22 bp, Homo sapiens
cctacaggaaattgtatcaaaa

SEQ ID NO: 7086833 - DNA, 22 bp, Homo sapiens
cctacaggaaattgtatcaaaa

SEQ ID NO: 7086834 - DNA, 21 bp, Homo sapiens
cctacagatggatatatattc

SEQ ID NO: 7086835 - DNA, 22 bp, Homo sapiens
cctacagacaaaccagtgacta

SEQ ID NO: 7086836 - DNA, 22 bp, Homo sapiens
cctacagttatattcttgattg

SEQ ID NO: 7086837 - DNA, 22 bp, Homo sapiens
cctacagttatattcttgattg

SEQ ID NO: 7086838 - DNA, 22 bp, Homo sapiens
cctaagtttatcatagttttac

SEQ ID NO: 7086839 - DNA, 22 bp, Homo sapiens
cctaattatctcccaaagatcc

SEQ ID NO: 7086840 - DNA, 22 bp, Homo sapiens
cctaatttgattttaaatagcc

SEQ ID NO: 7086841 - DNA, 22 bp, Homo sapiens
cctaatttgattttaaatagcc

SEQ ID NO: 7086842 - DNA, 22 bp, Homo sapiens
agggcctgggaagaggaaccct

SEQ ID NO: 7086843 - DNA, 22 bp, Homo sapiens
agggcctgtccgctcccgcccg

SEQ ID NO: 7086844 - DNA, 22 bp, Homo sapiens
agggcctgtctgtagaactgaa

SEQ ID NO: 7086845 - DNA, 22 bp, Homo sapiens
agggcctgtctgtagaactgaa

SEQ ID NO: 7086846 - DNA, 22 bp, Homo sapiens
agggcctgtctgtagaactgaa

SEQ ID NO: 7086847 - DNA, 21 bp, Homo sapiens
agggcctgtgctctccaggtc

SEQ ID NO: 7086848 - DNA, 21 bp, Homo sapiens
agggcctgtgctctccaggtc

SEQ ID NO: 7086849 - DNA, 22 bp, Homo sapiens
ccctggccagctcatgtctgag

SEQ ID NO: 7086850 - DNA, 22 bp, Homo sapiens
ccctggcatgcatgtccctggc

SEQ ID NO: 7086851 - DNA, 22 bp, Homo sapiens
ccctggcatgcatgtccctggc

SEQ ID NO: 7086852 - DNA, 22 bp, Homo sapiens
ccctggccagggcacagggagg

SEQ ID NO: 7086853 - DNA, 22 bp, Homo sapiens
ccctggcagcaatcactggtgt

SEQ ID NO: 7086854 - DNA, 19 bp, Homo sapiens
ccctggcaggcaagcctgg

SEQ ID NO: 7086855 - DNA, 22 bp, Homo sapiens
ccctggcagagggggcaggtgc

SEQ ID NO: 7086856 - DNA, 22 bp, Homo sapiens
ccctggcagagggggcaggtgc

SEQ ID NO: 7086857 - DNA, 22 bp, Homo sapiens
ccctggcagaatgtctctgggc

SEQ ID NO: 7086858 - DNA, 22 bp, Homo sapiens
ccctggcagaatgtctctgggc

SEQ ID NO: 7086859 - DNA, 22 bp, Homo sapiens
agggcccatgtgggagcacttg

SEQ ID NO: 7086860 - DNA, 22 bp, Homo sapiens
agggcccatgtgggagcacttg

SEQ ID NO: 7086861 - DNA, 22 bp, Homo sapiens
agggccccagtaagattacatg

SEQ ID NO: 7086862 - DNA, 22 bp, Homo sapiens
ccctggcacatgcgctgtgtgg

SEQ ID NO: 7086863 - DNA, 22 bp, Homo sapiens
ccctggcacatgcgctgtgtgg

SEQ ID NO: 7086864 - DNA, 22 bp, Homo sapiens
ccctggcactagcgacggccat

SEQ ID NO: 7086865 - DNA, 22 bp, Homo sapiens
ccctggcactagcgacggccat

SEQ ID NO: 7086866 - DNA, 22 bp, Homo sapiens
ccctggcagaatgtctctgggc

SEQ ID NO: 7086867 - DNA, 22 bp, Homo sapiens
ccctggcagaatgtctctgggc

SEQ ID NO: 7086868 - DNA, 22 bp, Homo sapiens
agggcccagtggagagctgagc

SEQ ID NO: 7086869 - DNA, 22 bp, Homo sapiens
agggcccatagatcgtcagctt

SEQ ID NO: 7086870 - DNA, 22 bp, Homo sapiens
agggcccagtggagagctgagc

SEQ ID NO: 7086871 - DNA, 22 bp, Homo sapiens
agggcccagtggagagctgagc

SEQ ID NO: 7086872 - DNA, 22 bp, Homo sapiens
agggcccagtggagagctgagc

SEQ ID NO: 7086873 - DNA, 22 bp, Homo sapiens
agggcccagtggagagctgagc

SEQ ID NO: 7086874 - DNA, 22 bp, Homo sapiens
agggcccagtggagagctgagc

SEQ ID NO: 7086875 - DNA, 22 bp, Homo sapiens
agggcccagtggagagctgagc

SEQ ID NO: 7086876 - DNA, 22 bp, Homo sapiens
agggcccagtggagagctgagc

SEQ ID NO: 7086877 - DNA, 22 bp, Homo sapiens
agggcccagtggagagctgagc

SEQ ID NO: 7086878 - DNA, 22 bp, Homo sapiens
agggcccaggacagcatcaggg

SEQ ID NO: 7086879 - DNA, 22 bp, Homo sapiens
agggcccaggacagcatcaggg

SEQ ID NO: 7086880 - DNA, 22 bp, Homo sapiens
agggcccatagatcgtcagctt

SEQ ID NO: 7086881 - DNA, 22 bp, Homo sapiens
agggcccatagatcgtcagctt

SEQ ID NO: 7086882 - DNA, 22 bp, Homo sapiens
agggcccatagatcgtcagctt

SEQ ID NO: 7086883 - DNA, 22 bp, Homo sapiens
agggcccatgtcgggcgctctg

SEQ ID NO: 7086884 - DNA, 22 bp, Homo sapiens
agggcccatgtgggagcacttg

SEQ ID NO: 7086885 - DNA, 22 bp, Homo sapiens
agggcccatgtgggagcacttg

SEQ ID NO: 7086886 - DNA, 22 bp, Homo sapiens
agggcccatgtgggagcacttg

SEQ ID NO: 7086887 - DNA, 22 bp, Homo sapiens
agggcccatgtgggagcacttg

SEQ ID NO: 7086888 - DNA, 22 bp, Homo sapiens
aggggctgactggaaagtgcca

SEQ ID NO: 7086889 - DNA, 22 bp, Homo sapiens
aggggctgactggaaagtgcca

SEQ ID NO: 7086890 - DNA, 22 bp, Homo sapiens
aggggctctgagtgggccagga

SEQ ID NO: 7086891 - DNA, 22 bp, Homo sapiens
aggggctctgagtgggccagga

SEQ ID NO: 7086892 - DNA, 22 bp, Homo sapiens
aggggctctgagtgggccagga

SEQ ID NO: 7086893 - DNA, 22 bp, Homo sapiens
aggggctgactggaaagtgcca

SEQ ID NO: 7086894 - DNA, 22 bp, Homo sapiens
aggggctgcctggcttggcact

SEQ ID NO: 7086895 - DNA, 22 bp, Homo sapiens
aggggctgcctggcttggcact

SEQ ID NO: 7086896 - DNA, 22 bp, Homo sapiens
cctctgtgggccgggcctgctg

SEQ ID NO: 7086897 - DNA, 22 bp, Homo sapiens
cctctgtgggccgggcctgctg

SEQ ID NO: 7086898 - DNA, 22 bp, Homo sapiens
cctctgtgggccgggcctgctg

SEQ ID NO: 7086899 - DNA, 22 bp, Homo sapiens
aggggctctgagtgggccagga

SEQ ID NO: 7086900 - DNA, 22 bp, Homo sapiens
aggggctctaaagatcatggaa

SEQ ID NO: 7086901 - DNA, 22 bp, Homo sapiens
aggggctcctttgtgctgcgtc

SEQ ID NO: 7086902 - DNA, 22 bp, Homo sapiens
aggggctcctttgtgctgcgtc

SEQ ID NO: 7086903 - DNA, 22 bp, Homo sapiens
aggggctcctttgtgctgcgtc

SEQ ID NO: 7086904 - DNA, 22 bp, Homo sapiens
aggggctcctctctgagagtag

SEQ ID NO: 7086905 - DNA, 22 bp, Homo sapiens
aggggctcctctctgagagtag

SEQ ID NO: 7086906 - DNA, 22 bp, Homo sapiens
aggggctcctctctgagagtag

SEQ ID NO: 7086907 - DNA, 22 bp, Homo sapiens
aggggctcctggcctggagagc

SEQ ID NO: 7086908 - DNA, 22 bp, Homo sapiens
aggggctcctggcctggagagc

SEQ ID NO: 7086909 - DNA, 22 bp, Homo sapiens
aggggctcctggcctggagagc

SEQ ID NO: 7086910 - DNA, 22 bp, Homo sapiens
aggggctcctggcctggagagc

SEQ ID NO: 7086911 - DNA, 22 bp, Homo sapiens
aggggctcaaagtgtgcaggga

SEQ ID NO: 7086912 - DNA, 22 bp, Homo sapiens
aggggctcaaagtgtgcaggga

SEQ ID NO: 7086913 - DNA, 22 bp, Homo sapiens
aggggctcaaagtgtgcaggga

SEQ ID NO: 7086914 - DNA, 22 bp, Homo sapiens
aggggctcaaagtgtgcaggga

SEQ ID NO: 7086915 - DNA, 22 bp, Homo sapiens
aggggcgtctgtaggcagtggg

SEQ ID NO: 7086916 - DNA, 22 bp, Homo sapiens
aggggcgtctgtaggcagtggg

SEQ ID NO: 7086917 - DNA, 22 bp, Homo sapiens
aggggcgtgctcttccccgacg

SEQ ID NO: 7086918 - DNA, 22 bp, Homo sapiens
aggggctcaaagtgtgcaggga

SEQ ID NO: 7086919 - DNA, 22 bp, Homo sapiens
aggggctcaaagtgtgcaggga

SEQ ID NO: 7086920 - DNA, 22 bp, Homo sapiens
aggggctcaagcagtgtggtct

SEQ ID NO: 7086921 - DNA, 22 bp, Homo sapiens
aggggctcaagcagtgtggtct

SEQ ID NO: 7086922 - DNA, 22 bp, Homo sapiens
aggggctcaagcagtgtggtct

SEQ ID NO: 7086923 - DNA, 22 bp, Homo sapiens
aggggctcagttactttggcag

SEQ ID NO: 7086924 - DNA, 22 bp, Homo sapiens
aggggctcagttactttggcag

SEQ ID NO: 7086925 - DNA, 22 bp, Homo sapiens
aggggctccaaggaagtttggg

SEQ ID NO: 7086926 - DNA, 18 bp, Homo sapiens
aggggcagcttgtgtgga

SEQ ID NO: 7086927 - DNA, 18 bp, Homo sapiens
aggggcagcttgtgtgga

SEQ ID NO: 7086928 - DNA, 18 bp, Homo sapiens
aggggcagcttgtgtgga

SEQ ID NO: 7086929 - DNA, 22 bp, Homo sapiens
aggggcctggttggcctctgtt

SEQ ID NO: 7086930 - DNA, 22 bp, Homo sapiens
aggggcctggttggcctctgtt

SEQ ID NO: 7086931 - DNA, 22 bp, Homo sapiens
aggggcctggttggcctctgtt

SEQ ID NO: 7086932 - DNA, 22 bp, Homo sapiens
aggggcgctgcggtcctcagcc

SEQ ID NO: 7086933 - DNA, 22 bp, Homo sapiens
aggggcggcctgcctgaagcag

SEQ ID NO: 7086934 - DNA, 22 bp, Homo sapiens
aggggcgtctgtaggcagtggg

SEQ ID NO: 7086935 - DNA, 22 bp, Homo sapiens
cctccttcctgggacagagctg

SEQ ID NO: 7086936 - DNA, 22 bp, Homo sapiens
cctccttctctttttgcagagc

SEQ ID NO: 7086937 - DNA, 22 bp, Homo sapiens
cctccttctggggccttctgct

SEQ ID NO: 7086938 - DNA, 22 bp, Homo sapiens
cctccttcctgggacagagctg

SEQ ID NO: 7086939 - DNA, 22 bp, Homo sapiens
cctccttcctgggacagagctg

SEQ ID NO: 7086940 - DNA, 22 bp, Homo sapiens
cctccttcctgggacagagctg

SEQ ID NO: 7086941 - DNA, 22 bp, Homo sapiens
cctcgacctccccaggctcagg

SEQ ID NO: 7086942 - DNA, 22 bp, Homo sapiens
cctccttctggggccttctgct

SEQ ID NO: 7086943 - DNA, 22 bp, Homo sapiens
cctccttctggggccttctgct

SEQ ID NO: 7086944 - DNA, 22 bp, Homo sapiens
cctcctggtgggcgcttctggc

SEQ ID NO: 7086945 - DNA, 22 bp, Homo sapiens
cctcctgtctccttcctatatt

SEQ ID NO: 7086946 - DNA, 22 bp, Homo sapiens
cctcctgttgtcctgctggggc

SEQ ID NO: 7086947 - DNA, 22 bp, Homo sapiens
cctcctggtgggcgcttctggc

SEQ ID NO: 7086948 - DNA, 22 bp, Homo sapiens
cctcctggtgggcgcttctggc

SEQ ID NO: 7086949 - DNA, 22 bp, Homo sapiens
aggggaaggccagcctgtagag

SEQ ID NO: 7086950 - DNA, 22 bp, Homo sapiens
aggggaagattatacttttgaa

SEQ ID NO: 7086951 - DNA, 22 bp, Homo sapiens
aggggaagattatacttttgaa

SEQ ID NO: 7086952 - DNA, 22 bp, Homo sapiens
aggggaaggccagcctgtagag

SEQ ID NO: 7086953 - DNA, 22 bp, Homo sapiens
aggggaaggccagcctgtagag

SEQ ID NO: 7086954 - DNA, 22 bp, Homo sapiens
aggggaaatgccttggtggtac

SEQ ID NO: 7086955 - DNA, 22 bp, Homo sapiens
aggggaagagccctttacatgg

SEQ ID NO: 7086956 - DNA, 22 bp, Homo sapiens
aggggaagagccctttacatgg

SEQ ID NO: 7086957 - DNA, 22 bp, Homo sapiens
aggggaagagccctttacatgg

SEQ ID NO: 7086958 - DNA, 22 bp, Homo sapiens
aggggaagattatacttttgaa

SEQ ID NO: 7086959 - DNA, 22 bp, Homo sapiens
aggggaatgggtagactgttga

SEQ ID NO: 7086960 - DNA, 22 bp, Homo sapiens
aggggaatgggtagactgttga

SEQ ID NO: 7086961 - DNA, 22 bp, Homo sapiens
aggggaatgggtagactgttga

SEQ ID NO: 7086962 - DNA, 22 bp, Homo sapiens
aggggaaggccagcctgtagag

SEQ ID NO: 7086963 - DNA, 21 bp, Homo sapiens
aggggaagtagagttttgatt

SEQ ID NO: 7086964 - DNA, 21 bp, Homo sapiens
aggggaagtagagttttgatt

SEQ ID NO: 7086965 - DNA, 22 bp, Homo sapiens
aggggaatgggtagactgttga

SEQ ID NO: 7086966 - DNA, 22 bp, Homo sapiens
cctcctggtgacaaggcaaagc

SEQ ID NO: 7086967 - DNA, 22 bp, Homo sapiens
cctcctggtgacaaggcaaagc

SEQ ID NO: 7086968 - DNA, 22 bp, Homo sapiens
cctcctggtgacaaggcaaagc

SEQ ID NO: 7086969 - DNA, 22 bp, Homo sapiens
cctcctggtgggcgcttctggc

SEQ ID NO: 7086970 - DNA, 22 bp, Homo sapiens
cctcctggtgggcgcttctggc

SEQ ID NO: 7086971 - DNA, 22 bp, Homo sapiens
agggggtctcctatcatggaag

SEQ ID NO: 7086972 - DNA, 22 bp, Homo sapiens
aggggggtggatcacctgaggt

SEQ ID NO: 7086973 - DNA, 22 bp, Homo sapiens
agggggtgaatgtctgtctaca

SEQ ID NO: 7086974 - DNA, 22 bp, Homo sapiens
agggggtgaatgtctgtctaca

SEQ ID NO: 7086975 - DNA, 22 bp, Homo sapiens
agggggtgaatgtctgtctaca

SEQ ID NO: 7086976 - DNA, 22 bp, Homo sapiens
agggggtgaatgtctgtctaca

SEQ ID NO: 7086977 - DNA, 22 bp, Homo sapiens
agggggtgatcaaggtgcggcg

SEQ ID NO: 7086978 - DNA, 22 bp, Homo sapiens
agggggtgatcaaggtgcggcg

SEQ ID NO: 7086979 - DNA, 22 bp, Homo sapiens
agggggtgatcaaggtgcggcg

SEQ ID NO: 7086980 - DNA, 22 bp, Homo sapiens
agggggtgatcaaggtgcggcg

SEQ ID NO: 7086981 - DNA, 22 bp, Homo sapiens
agggggtgatcaaggtgcggcg

SEQ ID NO: 7086982 - DNA, 22 bp, Homo sapiens
agggggagcttggctactcctg

SEQ ID NO: 7086983 - DNA, 22 bp, Homo sapiens
agggggagacatgtgtgtgttt

SEQ ID NO: 7086984 - DNA, 22 bp, Homo sapiens
agggggagacatgtgtgtgttt

SEQ ID NO: 7086985 - DNA, 22 bp, Homo sapiens
cctcttcacctcgggcacactg

SEQ ID NO: 7086986 - DNA, 22 bp, Homo sapiens
agggggctggagacacctcctc

SEQ ID NO: 7086987 - DNA, 22 bp, Homo sapiens
agggggctgccaaggaatgtaa

SEQ ID NO: 7086988 - DNA, 22 bp, Homo sapiens
agggggctcctccggtgcttcc

SEQ ID NO: 7086989 - DNA, 22 bp, Homo sapiens
agggggctccttggtgtgcaga

SEQ ID NO: 7086990 - DNA, 22 bp, Homo sapiens
cctctgtgtgtgcatgcatgcg

SEQ ID NO: 7086991 - DNA, 22 bp, Homo sapiens
cctctgtgtgtgcatgcatgcg

SEQ ID NO: 7086992 - DNA, 22 bp, Homo sapiens
cctctgtgtgtgcatgcatgcg

SEQ ID NO: 7086993 - DNA, 22 bp, Homo sapiens
cctctgtgtctccaagaggcct

SEQ ID NO: 7086994 - DNA, 22 bp, Homo sapiens
cctctgtgtctccaagaggcct

SEQ ID NO: 7086995 - DNA, 22 bp, Homo sapiens
cctctgtgtcttggtttcaaga

SEQ ID NO: 7086996 - DNA, 20 bp, Homo sapiens
cctctgtgtcctgtgtcata

SEQ ID NO: 7086997 - DNA, 22 bp, Homo sapiens
cctctgtgtcagggaagagact

SEQ ID NO: 7086998 - DNA, 22 bp, Homo sapiens
cctctgtggtctgtctaatgca

SEQ ID NO: 7086999 - DNA, 22 bp, Homo sapiens
cctctgtgggccgggcctgctg

SEQ ID NO: 7087000 - DNA, 22 bp, Homo sapiens
agggggtgcatttgtgaatgaa

SEQ ID NO: 7087001 - DNA, 22 bp, Homo sapiens
agggggtgcatttgtgaatgaa

SEQ ID NO: 7087002 - DNA, 22 bp, Homo sapiens
agggggtgcatttgtgaatgaa

SEQ ID NO: 7087003 - DNA, 22 bp, Homo sapiens
agggggtgcccagatgaaggat

SEQ ID NO: 7087004 - DNA, 22 bp, Homo sapiens
agggggtgcccagatgaaggat

SEQ ID NO: 7087005 - DNA, 22 bp, Homo sapiens
agggggtgcccagatgaaggat

SEQ ID NO: 7087006 - DNA, 22 bp, Homo sapiens
agggggtgcatttgtgaatgaa

SEQ ID NO: 7087007 - DNA, 22 bp, Homo sapiens
agggggtgatcaaggtgcggcg

SEQ ID NO: 7087008 - DNA, 22 bp, Homo sapiens
agggggtgcatttgtgaatgaa

SEQ ID NO: 7087009 - DNA, 22 bp, Homo sapiens
agggggtgcatttgtgaatgaa

SEQ ID NO: 7087010 - DNA, 22 bp, Homo sapiens
agggggtgcatttgtgaatgaa

SEQ ID NO: 7087011 - DNA, 22 bp, Homo sapiens
agggggtgatcaaggtgcggcg

SEQ ID NO: 7087012 - DNA, 22 bp, Homo sapiens
agggggtgatcaaggtgcggcg

SEQ ID NO: 7087013 - DNA, 22 bp, Homo sapiens
agggggtgtctctgattgggtt

SEQ ID NO: 7087014 - DNA, 22 bp, Homo sapiens
agggggtgtctctgattgggtt

SEQ ID NO: 7087015 - DNA, 22 bp, Homo sapiens
agggggtgtctctgattgggtt

SEQ ID NO: 7087016 - DNA, 22 bp, Homo sapiens
agggggtgtctctgattgggtt

SEQ ID NO: 7087017 - DNA, 22 bp, Homo sapiens
agggggtgtctctgattgggtt

SEQ ID NO: 7087018 - DNA, 22 bp, Homo sapiens
agggggtgtctctgattgggtt

SEQ ID NO: 7087019 - DNA, 22 bp, Homo sapiens
agggggtgtctctgattgggtt

SEQ ID NO: 7087020 - DNA, 22 bp, Homo sapiens
aggggtagagattgctggtgta

SEQ ID NO: 7087021 - DNA, 22 bp, Homo sapiens
agggggtgggaagtctagaatc

SEQ ID NO: 7087022 - DNA, 22 bp, Homo sapiens
agggggtgggaagtctagaatc

SEQ ID NO: 7087023 - DNA, 22 bp, Homo sapiens
agggggtgggaagtctagaatc

SEQ ID NO: 7087024 - DNA, 22 bp, Homo sapiens
agggggtgggaagtctagaatc

SEQ ID NO: 7087025 - DNA, 22 bp, Homo sapiens
agggggtgcccagatgaaggat

SEQ ID NO: 7087026 - DNA, 22 bp, Homo sapiens
agggggtgctacttccagagtt

SEQ ID NO: 7087027 - DNA, 22 bp, Homo sapiens
agggggtgctacttccagagtt

SEQ ID NO: 7087028 - DNA, 22 bp, Homo sapiens
agggggtgctacttccagagtt

SEQ ID NO: 7087029 - DNA, 22 bp, Homo sapiens
aggggtctatcctgagatggtc

SEQ ID NO: 7087030 - DNA, 22 bp, Homo sapiens
aggggtctatcctgagatggtc

SEQ ID NO: 7087031 - DNA, 20 bp, Homo sapiens
aggggtctagcagcagtgct

SEQ ID NO: 7087032 - DNA, 20 bp, Homo sapiens
aggggtctagcagcagtgct

SEQ ID NO: 7087033 - DNA, 22 bp, Homo sapiens
aggggtctatcctgagatggtc

SEQ ID NO: 7087034 - DNA, 22 bp, Homo sapiens
aggggtctatcctgagatggtc

SEQ ID NO: 7087035 - DNA, 22 bp, Homo sapiens
aggggtctatcctgagatggtc

SEQ ID NO: 7087036 - DNA, 22 bp, Homo sapiens
aggggtagagattgctggtgta

SEQ ID NO: 7087037 - DNA, 22 bp, Homo sapiens
aggggtagagattgctggtgta

SEQ ID NO: 7087038 - DNA, 22 bp, Homo sapiens
aggggtcagtgaccattgagga

SEQ ID NO: 7087039 - DNA, 22 bp, Homo sapiens
aggggtcagtgaccattgagga

SEQ ID NO: 7087040 - DNA, 20 bp, Homo sapiens
aggggtctagcagcagtgct

SEQ ID NO: 7087041 - DNA, 22 bp, Homo sapiens
aggggtgaaggcccgataggag

SEQ ID NO: 7087042 - DNA, 22 bp, Homo sapiens
cctgcagaccacactcagtcct

SEQ ID NO: 7087043 - DNA, 22 bp, Homo sapiens
aggggtcttgaggactccagca

SEQ ID NO: 7087044 - DNA, 22 bp, Homo sapiens
aggggtcttgaggactccagca

SEQ ID NO: 7087045 - DNA, 22 bp, Homo sapiens
aggggtcttgggagtcctggct

SEQ ID NO: 7087046 - DNA, 22 bp, Homo sapiens
aggggtcttgggagtcctggct

SEQ ID NO: 7087047 - DNA, 22 bp, Homo sapiens
aggggtcttgggagtcctggct

SEQ ID NO: 7087048 - DNA, 22 bp, Homo sapiens
aggggtctttaggaacgtcggg

SEQ ID NO: 7087049 - DNA, 22 bp, Homo sapiens
agggatgggtctaacccagaac

SEQ ID NO: 7087050 - DNA, 20 bp, Homo sapiens
agggcacttttgctggagca

SEQ ID NO: 7087051 - DNA, 22 bp, Homo sapiens
agggcactttacccatagcttg

SEQ ID NO: 7087052 - DNA, 18 bp, Homo sapiens
agggatgtatgctggtgg

SEQ ID NO: 7087053 - DNA, 22 bp, Homo sapiens
agggcagaaaccaccttgatgg

SEQ ID NO: 7087054 - DNA, 22 bp, Homo sapiens
agggcagaaaccaccttgatgg

SEQ ID NO: 7087055 - DNA, 20 bp, Homo sapiens
agggcacttttgctggagca

SEQ ID NO: 7087056 - DNA, 20 bp, Homo sapiens
agggcacttttgctggagca

SEQ ID NO: 7087057 - DNA, 20 bp, Homo sapiens
agggcacttttgctggagca

SEQ ID NO: 7087058 - DNA, 22 bp, Homo sapiens
cccaggtgtttgtggcagaggt

SEQ ID NO: 7087059 - DNA, 19 bp, Homo sapiens
cccaggtgtttgaggctgc

SEQ ID NO: 7087060 - DNA, 19 bp, Homo sapiens
cccaggtgtttgaggctgc

SEQ ID NO: 7087061 - DNA, 22 bp, Homo sapiens
cccaggtgtttgtggcagaggt

SEQ ID NO: 7087062 - DNA, 19 bp, Homo sapiens
cccaggtgtttgaggctgc

SEQ ID NO: 7087063 - DNA, 23 bp, Homo sapiens
cccaggtgtggaggcggtggcag

SEQ ID NO: 7087064 - DNA, 23 bp, Homo sapiens
cccaggtgtggaggcggtggcag

SEQ ID NO: 7087065 - DNA, 20 bp, Homo sapiens
cccaggtgtctgaagctctg

SEQ ID NO: 7087066 - DNA, 20 bp, Homo sapiens
cccaggtgtctgaagctctg

SEQ ID NO: 7087067 - DNA, 20 bp, Homo sapiens
cccaggtgtctgaagctctg

SEQ ID NO: 7087068 - DNA, 22 bp, Homo sapiens
cccaggtgggttggcctctgtc

SEQ ID NO: 7087069 - DNA, 22 bp, Homo sapiens
cccaggtgggcacctcgaggaa

SEQ ID NO: 7087070 - DNA, 22 bp, Homo sapiens
cccaggtgggcacctcgaggaa

SEQ ID NO: 7087071 - DNA, 22 bp, Homo sapiens
cccaggtgggcacctcgaggaa

SEQ ID NO: 7087072 - DNA, 21 bp, Homo sapiens
cccaggtgggatggttgcctc

SEQ ID NO: 7087073 - DNA, 22 bp, Homo sapiens
cccaggtggcagaagctgcagt

SEQ ID NO: 7087074 - DNA, 22 bp, Homo sapiens
cccaggtggcagaagctgcagt

SEQ ID NO: 7087075 - DNA, 21 bp, Homo sapiens
cccaggtgggatggttgcctc

SEQ ID NO: 7087076 - DNA, 21 bp, Homo sapiens
cccaggtgggatggttgcctc

SEQ ID NO: 7087077 - DNA, 22 bp, Homo sapiens
cccaggtgctgcgtgaagcctc

SEQ ID NO: 7087078 - DNA, 22 bp, Homo sapiens
cccaggtggcagaagctgcagt

SEQ ID NO: 7087079 - DNA, 22 bp, Homo sapiens
cccaggtgctgcgtgaagcctc

SEQ ID NO: 7087080 - DNA, 22 bp, Homo sapiens
cccaggtggcagaagctgcagt

SEQ ID NO: 7087081 - DNA, 22 bp, Homo sapiens
cccaggtggcagaagctgcagt

SEQ ID NO: 7087082 - DNA, 22 bp, Homo sapiens
agggagcttgtgtttcttttag

SEQ ID NO: 7087083 - DNA, 22 bp, Homo sapiens
agggagctttaccccagatcac

SEQ ID NO: 7087084 - DNA, 22 bp, Homo sapiens
agggagctttaccccagatcac

SEQ ID NO: 7087085 - DNA, 21 bp, Homo sapiens
agggagctttaggtagaagtt

SEQ ID NO: 7087086 - DNA, 21 bp, Homo sapiens
agggagctttaggtagaagtt

SEQ ID NO: 7087087 - DNA, 22 bp, Homo sapiens
agggagctttcaggtagcttaa

SEQ ID NO: 7087088 - DNA, 22 bp, Homo sapiens
agggagctttcaggtagcttaa

SEQ ID NO: 7087089 - DNA, 22 bp, Homo sapiens
cccaggtgctgaaggaggccgc

SEQ ID NO: 7087090 - DNA, 22 bp, Homo sapiens
cccaggtgctgaaggaggccgc

SEQ ID NO: 7087091 - DNA, 22 bp, Homo sapiens
cccaggtgctgaaggaggccgc

SEQ ID NO: 7087092 - DNA, 22 bp, Homo sapiens
cccaggtgctgcgtgaagcctc

SEQ ID NO: 7087093 - DNA, 22 bp, Homo sapiens
cccaggtgctgcgtgaagcctc

SEQ ID NO: 7087094 - DNA, 21 bp, Homo sapiens
cccctgggagccctgtcagta

SEQ ID NO: 7087095 - DNA, 22 bp, Homo sapiens
cccctgctggtcgaaacaattt

SEQ ID NO: 7087096 - DNA, 22 bp, Homo sapiens
cccctgctggcctgctggtttc

SEQ ID NO: 7087097 - DNA, 22 bp, Homo sapiens
cccctgccatagtcaaatctaa

SEQ ID NO: 7087098 - DNA, 22 bp, Homo sapiens
cccctgccagctatccctgaac

SEQ ID NO: 7087099 - DNA, 22 bp, Homo sapiens
cccctgagattctggcttggga

SEQ ID NO: 7087100 - DNA, 22 bp, Homo sapiens
cccctgccagctatccctgaac

SEQ ID NO: 7087101 - DNA, 22 bp, Homo sapiens
cccctgccagctatccctgaac

SEQ ID NO: 7087102 - DNA, 22 bp, Homo sapiens
cccctgccagctatccctgaac

SEQ ID NO: 7087103 - DNA, 22 bp, Homo sapiens
cccctcttgtgggctcaggtca

SEQ ID NO: 7087104 - DNA, 22 bp, Homo sapiens
cccctgaagacaatggagaggt

SEQ ID NO: 7087105 - DNA, 22 bp, Homo sapiens
agggcagaccacgtgcaaggat

SEQ ID NO: 7087106 - DNA, 22 bp, Homo sapiens
agggcagactaggatggaagtg

SEQ ID NO: 7087107 - DNA, 22 bp, Homo sapiens
agggcagaccacgtgcaaggat

SEQ ID NO: 7087108 - DNA, 22 bp, Homo sapiens
agggcagaccacgtgcaaggat

SEQ ID NO: 7087109 - DNA, 22 bp, Homo sapiens
agggcagactaggatggaagtg

SEQ ID NO: 7087110 - DNA, 22 bp, Homo sapiens
agggcagactaggatggaagtg

SEQ ID NO: 7087111 - DNA, 22 bp, Homo sapiens
agggcagactaggatggaagtg

SEQ ID NO: 7087112 - DNA, 22 bp, Homo sapiens
agggcagactaggatggaagtg

SEQ ID NO: 7087113 - DNA, 22 bp, Homo sapiens
agggcagactaggatggaagtg

SEQ ID NO: 7087114 - DNA, 22 bp, Homo sapiens
agggcagaaatattgatactgt

SEQ ID NO: 7087115 - DNA, 22 bp, Homo sapiens
agggcagaaatattgatactgt

SEQ ID NO: 7087116 - DNA, 22 bp, Homo sapiens
agggcagaaatcgattacacct

SEQ ID NO: 7087117 - DNA, 22 bp, Homo sapiens
agggcagaaatcgattacacct

SEQ ID NO: 7087118 - DNA, 22 bp, Homo sapiens
agggcagaagtacagacactta

SEQ ID NO: 7087119 - DNA, 22 bp, Homo sapiens
agggcagaagtacagacactta

SEQ ID NO: 7087120 - DNA, 22 bp, Homo sapiens
agggcagaagtacagacactta

SEQ ID NO: 7087121 - DNA, 22 bp, Homo sapiens
agggcagaagtacagacactta

SEQ ID NO: 7087122 - DNA, 22 bp, Homo sapiens
agggcagaccacgtgcaaggat

SEQ ID NO: 7087123 - DNA, 22 bp, Homo sapiens
cccctgtgttgttcaagggtca

SEQ ID NO: 7087124 - DNA, 19 bp, Homo sapiens
ccccttaggggttaagcct

SEQ ID NO: 7087125 - DNA, 22 bp, Homo sapiens
agggcagctgtgagccactgtg

SEQ ID NO: 7087126 - DNA, 21 bp, Homo sapiens
cccctgggagccctgtcagta

SEQ ID NO: 7087127 - DNA, 22 bp, Homo sapiens
cccctggggatcagctggaatt

SEQ ID NO: 7087128 - DNA, 22 bp, Homo sapiens
cccctgggtccaggcttctctg

SEQ ID NO: 7087129 - DNA, 22 bp, Homo sapiens
agggcatgtgggagaggagcct

SEQ ID NO: 7087130 - DNA, 22 bp, Homo sapiens
agggcatgtgggagaggagcct

SEQ ID NO: 7087131 - DNA, 22 bp, Homo sapiens
agggcatgtgggagaggagcct

SEQ ID NO: 7087132 - DNA, 22 bp, Homo sapiens
agggcatgtgggagaggagcct

SEQ ID NO: 7087133 - DNA, 22 bp, Homo sapiens
agggcagcttccatagtctggc

SEQ ID NO: 7087134 - DNA, 22 bp, Homo sapiens
agggcagcttccatagtctggc

SEQ ID NO: 7087135 - DNA, 22 bp, Homo sapiens
agggcagcttccatagtctggc

SEQ ID NO: 7087136 - DNA, 22 bp, Homo sapiens
agggcatgctggaggagagaca

SEQ ID NO: 7087137 - DNA, 23 bp, Homo sapiens
agggccactgggaaggattactg

SEQ ID NO: 7087138 - DNA, 22 bp, Homo sapiens
agggccactggctgacggctgc

SEQ ID NO: 7087139 - DNA, 19 bp, Homo sapiens
agggccacggggaggtatt

SEQ ID NO: 7087140 - DNA, 22 bp, Homo sapiens
agggccacctctctgggttccc

SEQ ID NO: 7087141 - DNA, 22 bp, Homo sapiens
agggccacctctctgggttccc

SEQ ID NO: 7087142 - DNA, 22 bp, Homo sapiens
ccctgaggatagggcaggaccc

SEQ ID NO: 7087143 - DNA, 22 bp, Homo sapiens
agggccacagtggggcctgaga

SEQ ID NO: 7087144 - DNA, 22 bp, Homo sapiens
agggccacagtggggcctgaga

SEQ ID NO: 7087145 - DNA, 22 bp, Homo sapiens
agggccacagctcaattaaaag

SEQ ID NO: 7087146 - DNA, 22 bp, Homo sapiens
agggcattggcacagatctgct

SEQ ID NO: 7087147 - DNA, 22 bp, Homo sapiens
agggccaagtccaggacctcgg

SEQ ID NO: 7087148 - DNA, 22 bp, Homo sapiens
agggccacagtaatgctgagta

SEQ ID NO: 7087149 - DNA, 22 bp, Homo sapiens
agggccaccagagcagggcagt

SEQ ID NO: 7087150 - DNA, 22 bp, Homo sapiens
agggccaccagagcagggcagt

SEQ ID NO: 7087151 - DNA, 22 bp, Homo sapiens
agggccaccagagcagggcagt

SEQ ID NO: 7087152 - DNA, 22 bp, Homo sapiens
agggccaccagggagtctcagg

SEQ ID NO: 7087153 - DNA, 22 bp, Homo sapiens
agggccaccagggagtctcagg

SEQ ID NO: 7087154 - DNA, 22 bp, Homo sapiens
ccctgaggggagtggtgaggtg

SEQ ID NO: 7087155 - DNA, 22 bp, Homo sapiens
ccctgaggctgaggataggtgg

SEQ ID NO: 7087156 - DNA, 22 bp, Homo sapiens
ccctgaggggagtggtgaggtg

SEQ ID NO: 7087157 - DNA, 22 bp, Homo sapiens
ccctgaggatgtctccttcctg

SEQ ID NO: 7087158 - DNA, 22 bp, Homo sapiens
ccctgaggcaaaggctagagtt

SEQ ID NO: 7087159 - DNA, 19 bp, Homo sapiens
ccctgaggcaaaagccttt

SEQ ID NO: 7087160 - DNA, 22 bp, Homo sapiens
ccctgaggcaaaggctagagtt

SEQ ID NO: 7087161 - DNA, 22 bp, Homo sapiens
ccctgaggcaaaggctagagtt

SEQ ID NO: 7087162 - DNA, 22 bp, Homo sapiens
ccctgaggcagtaggagctttt

SEQ ID NO: 7087163 - DNA, 18 bp, Homo sapiens
ccctgaggctagcatgct

SEQ ID NO: 7087164 - DNA, 22 bp, Homo sapiens
ccctgatggcacagtggcaggc

SEQ ID NO: 7087165 - DNA, 22 bp, Homo sapiens
ccctgatgacacgggcatcagg

SEQ ID NO: 7087166 - DNA, 23 bp, Homo sapiens
agggccaggtgcggaaacagctc

SEQ ID NO: 7087167 - DNA, 23 bp, Homo sapiens
agggccaggtgcggaaacagctc

SEQ ID NO: 7087168 - DNA, 23 bp, Homo sapiens
agggcccaagcctggacagcagg

SEQ ID NO: 7087169 - DNA, 23 bp, Homo sapiens
agggcccaagcctggacagcagg

SEQ ID NO: 7087170 - DNA, 22 bp, Homo sapiens
agggcccacagttcctatggcc

SEQ ID NO: 7087171 - DNA, 23 bp, Homo sapiens
agggccaggtgcggaaacagctc

SEQ ID NO: 7087172 - DNA, 23 bp, Homo sapiens
agggccaggtgcggaaacagctc

SEQ ID NO: 7087173 - DNA, 23 bp, Homo sapiens
agggcccaagcctggacagcagg

SEQ ID NO: 7087174 - DNA, 22 bp, Homo sapiens
agggcccaggacagcatcaggg

SEQ ID NO: 7087175 - DNA, 22 bp, Homo sapiens
agggcccaggacagcatcaggg

SEQ ID NO: 7087176 - DNA, 20 bp, Homo sapiens
agggcccaggaagagagtta

SEQ ID NO: 7087177 - DNA, 22 bp, Homo sapiens
agggcccaggacagcatcaggg

SEQ ID NO: 7087178 - DNA, 22 bp, Homo sapiens
agggcccaggacagcatcaggg

SEQ ID NO: 7087179 - DNA, 20 bp, Homo sapiens
agggcccaggaagagagtta

SEQ ID NO: 7087180 - DNA, 20 bp, Homo sapiens
agggcccaggaagagagtta

SEQ ID NO: 7087181 - DNA, 22 bp, Homo sapiens
agggcccagcccttgctggtct

SEQ ID NO: 7087182 - DNA, 20 bp, Homo sapiens
agggcccaggaagagagtta

SEQ ID NO: 7087183 - DNA, 20 bp, Homo sapiens
agggcccaggaagagagtta

SEQ ID NO: 7087184 - DNA, 22 bp, Homo sapiens
agggcccagcagcatttcagtg

SEQ ID NO: 7087185 - DNA, 22 bp, Homo sapiens
agggcccagcccttgctggtct

SEQ ID NO: 7087186 - DNA, 22 bp, Homo sapiens
agggcccaccttggtgctgagg

SEQ ID NO: 7087187 - DNA, 22 bp, Homo sapiens
agggcccaccttggtgctgagg

SEQ ID NO: 7087188 - DNA, 22 bp, Homo sapiens
agggcccacagttcctatggcc

SEQ ID NO: 7087189 - DNA, 22 bp, Homo sapiens
agggcccaccttggtgctgagg

SEQ ID NO: 7087190 - DNA, 22 bp, Homo sapiens
agggcccacagttcctatggcc

SEQ ID NO: 7087191 - DNA, 22 bp, Homo sapiens
agggcccacagttcctatggcc

SEQ ID NO: 7087192 - DNA, 22 bp, Homo sapiens
aggctttgtacctggggtctta

SEQ ID NO: 7087193 - DNA, 22 bp, Homo sapiens
aggcttttagaatcttatttct

SEQ ID NO: 7087194 - DNA, 22 bp, Homo sapiens
aggcttttatacattgctgacc

SEQ ID NO: 7087195 - DNA, 22 bp, Homo sapiens
aggcttttctccagaatgtact

SEQ ID NO: 7087196 - DNA, 22 bp, Homo sapiens
aggcttttgtggtgtggaatgg

SEQ ID NO: 7087197 - DNA, 21 bp, Homo sapiens
agggaaaaggctgagtgaggg

SEQ ID NO: 7087198 - DNA, 21 bp, Homo sapiens
agggaaaaggctgagtgaggg

SEQ ID NO: 7087199 - DNA, 21 bp, Homo sapiens
agggaaaaggctgagtgaggg

SEQ ID NO: 7087200 - DNA, 22 bp, Homo sapiens
agggaaactagactgcctttct

SEQ ID NO: 7087201 - DNA, 22 bp, Homo sapiens
agggaaactagactgcctttct

SEQ ID NO: 7087202 - DNA, 21 bp, Homo sapiens
agggaaagaaaatgagctaat

SEQ ID NO: 7087203 - DNA, 21 bp, Homo sapiens
agggaaagaaaatgagctaat

SEQ ID NO: 7087204 - DNA, 22 bp, Homo sapiens
agggaaaggctgatgctgtggg

SEQ ID NO: 7087205 - DNA, 22 bp, Homo sapiens
agggaaaggctgatgctgtggg

SEQ ID NO: 7087206 - DNA, 22 bp, Homo sapiens
agggaaaggtagtgaggtcaca

SEQ ID NO: 7087207 - DNA, 22 bp, Homo sapiens
agggaaaggtagtgaggtcaca

SEQ ID NO: 7087208 - DNA, 22 bp, Homo sapiens
agggaaaggtagtgaggtcaca

SEQ ID NO: 7087209 - DNA, 22 bp, Homo sapiens
agggaaaggtagtgaggtcaca

SEQ ID NO: 7087210 - DNA, 23 bp, Homo sapiens
cccagagtcatctgtagctgtgg

SEQ ID NO: 7087211 - DNA, 22 bp, Homo sapiens
cccagagtggagggtgcagaat

SEQ ID NO: 7087212 - DNA, 22 bp, Homo sapiens
cccagcaaggccagctcagggc

SEQ ID NO: 7087213 - DNA, 22 bp, Homo sapiens
aggctttggggcattctgtgtt

SEQ ID NO: 7087214 - DNA, 22 bp, Homo sapiens
agggaaaggtagtgaggtcaca

SEQ ID NO: 7087215 - DNA, 22 bp, Homo sapiens
agggaaagtaagcatttcatta

SEQ ID NO: 7087216 - DNA, 22 bp, Homo sapiens
agggaaagtaagcatttcatta

SEQ ID NO: 7087217 - DNA, 23 bp, Homo sapiens
agggaaagtagtaatggcctttg

SEQ ID NO: 7087218 - DNA, 23 bp, Homo sapiens
agggaaagtagtaatggcctttg

SEQ ID NO: 7087219 - DNA, 22 bp, Homo sapiens
cccaggaaatatgtttcttaac

SEQ ID NO: 7087220 - DNA, 22 bp, Homo sapiens
cccaggaaatcaggctttctag

SEQ ID NO: 7087221 - DNA, 22 bp, Homo sapiens
cccaggaaatgaacttctgatt

SEQ ID NO: 7087222 - DNA, 22 bp, Homo sapiens
cccaggaaatgggctcttgcct

SEQ ID NO: 7087223 - DNA, 22 bp, Homo sapiens
cccaggaaatgggctcttgcct

SEQ ID NO: 7087224 - DNA, 22 bp, Homo sapiens
cccaggaaatgggctcttgcct

SEQ ID NO: 7087225 - DNA, 22 bp, Homo sapiens
cccaggaacagcacagaacagc

SEQ ID NO: 7087226 - DNA, 22 bp, Homo sapiens
cccaggaacagcacagaacagc

SEQ ID NO: 7087227 - DNA, 22 bp, Homo sapiens
cccaggaacagcacagaacagc

SEQ ID NO: 7087228 - DNA, 22 bp, Homo sapiens
cccaggaacagggctcagaccc

SEQ ID NO: 7087229 - DNA, 22 bp, Homo sapiens
cccaggaacagggctcagaccc

SEQ ID NO: 7087230 - DNA, 22 bp, Homo sapiens
cccaggaacctaccagctcgag

SEQ ID NO: 7087231 - DNA, 22 bp, Homo sapiens
cccaggaactccagagctcctc

SEQ ID NO: 7087232 - DNA, 22 bp, Homo sapiens
cccaggaactccagagctcctc

SEQ ID NO: 7087233 - DNA, 22 bp, Homo sapiens
cccaggaactccagagctcctc

SEQ ID NO: 7087234 - DNA, 22 bp, Homo sapiens
cccaggaactccagagctcctc

SEQ ID NO: 7087235 - DNA, 22 bp, Homo sapiens
cccaggaagaaattctgatttg

SEQ ID NO: 7087236 - DNA, 22 bp, Homo sapiens
cccaggaagaggggtcaggtgt

SEQ ID NO: 7087237 - DNA, 22 bp, Homo sapiens
cccaggaagaggggtcaggtgt

SEQ ID NO: 7087238 - DNA, 22 bp, Homo sapiens
cccaggaagagtgagtggcatt

SEQ ID NO: 7087239 - DNA, 22 bp, Homo sapiens
cccaggaagagtgagtggcatt

SEQ ID NO: 7087240 - DNA, 22 bp, Homo sapiens
cccaggaagagtgagtggcatt

SEQ ID NO: 7087241 - DNA, 22 bp, Homo sapiens
cccaggaagcggagattgcaga

SEQ ID NO: 7087242 - DNA, 22 bp, Homo sapiens
cccaggaagcggagattgcaga

SEQ ID NO: 7087243 - DNA, 22 bp, Homo sapiens
cccaggaagcggagattgcaga

SEQ ID NO: 7087244 - DNA, 19 bp, Homo sapiens
cccaggaagcggaggttgc

SEQ ID NO: 7087245 - DNA, 22 bp, Homo sapiens
cccaggaaggagctgtgtattt

SEQ ID NO: 7087246 - DNA, 22 bp, Homo sapiens
cccaggaagggatgccaaggaa

SEQ ID NO: 7087247 - DNA, 22 bp, Homo sapiens
cccaggaaggtggtctgtggct

SEQ ID NO: 7087248 - DNA, 22 bp, Homo sapiens
cccaggaaggtggtctgtggct

SEQ ID NO: 7087249 - DNA, 22 bp, Homo sapiens
cccaggaaggtggtctgtggct

SEQ ID NO: 7087250 - DNA, 22 bp, Homo sapiens
cccaggaagtggaggttgcagt

SEQ ID NO: 7087251 - DNA, 22 bp, Homo sapiens
cccaggaagtggaggttgcagt

SEQ ID NO: 7087252 - DNA, 22 bp, Homo sapiens
cccaggaagttgagactgcagt

SEQ ID NO: 7087253 - DNA, 22 bp, Homo sapiens
cccaggaagttgagactgcagt

SEQ ID NO: 7087254 - DNA, 22 bp, Homo sapiens
cccaggaagttgagactgcagt

SEQ ID NO: 7087255 - DNA, 22 bp, Homo sapiens
cccaggaagttgagactgcagt

SEQ ID NO: 7087256 - DNA, 22 bp, Homo sapiens
cccaggaagttgatgcagagga

SEQ ID NO: 7087257 - DNA, 22 bp, Homo sapiens
cccaggaagttgatgcagagga

SEQ ID NO: 7087258 - DNA, 22 bp, Homo sapiens
cccaggaagttgatgcagagga

SEQ ID NO: 7087259 - DNA, 22 bp, Homo sapiens
cccaggaagttgatgcagagga

SEQ ID NO: 7087260 - DNA, 22 bp, Homo sapiens
cccaggaatgagcaggcagggg

SEQ ID NO: 7087261 - DNA, 22 bp, Homo sapiens
cccaggaatgagcaggcagggg

SEQ ID NO: 7087262 - DNA, 22 bp, Homo sapiens
cccaggaatgagcaggcagggg

SEQ ID NO: 7087263 - DNA, 22 bp, Homo sapiens
cccaggcctggtctgggccagt

SEQ ID NO: 7087264 - DNA, 22 bp, Homo sapiens
cccaggcctggtctgggccagt

SEQ ID NO: 7087265 - DNA, 22 bp, Homo sapiens
cccaggcctggtctgggccagt

SEQ ID NO: 7087266 - DNA, 22 bp, Homo sapiens
cccaggcctggtctgggccagt

SEQ ID NO: 7087267 - DNA, 22 bp, Homo sapiens
agggagccttcctggctgtggt

SEQ ID NO: 7087268 - DNA, 22 bp, Homo sapiens
agggagccttcctggctgtggt

SEQ ID NO: 7087269 - DNA, 22 bp, Homo sapiens
agggagctgagctgtgagcagc

SEQ ID NO: 7087270 - DNA, 22 bp, Homo sapiens
agggagctgagctgtgagcagc

SEQ ID NO: 7087271 - DNA, 22 bp, Homo sapiens
agggagctgagagctactattt

SEQ ID NO: 7087272 - DNA, 22 bp, Homo sapiens
agggagctgagctgtgagcagc

SEQ ID NO: 7087273 - DNA, 22 bp, Homo sapiens
agggagctgagagctactattt

SEQ ID NO: 7087274 - DNA, 22 bp, Homo sapiens
cccaggccccagggcttgtcag

SEQ ID NO: 7087275 - DNA, 22 bp, Homo sapiens
cccaggccccagggcttgtcag

SEQ ID NO: 7087276 - DNA, 22 bp, Homo sapiens
cccaggccctggcagagcttgt

SEQ ID NO: 7087277 - DNA, 22 bp, Homo sapiens
cccaggccctggcagagcttgt

SEQ ID NO: 7087278 - DNA, 22 bp, Homo sapiens
cccaggccctggcagagcttgt

SEQ ID NO: 7087279 - DNA, 22 bp, Homo sapiens
cccaggccctggcagagcttgt

SEQ ID NO: 7087280 - DNA, 17 bp, Homo sapiens
cccaggccgccgggagc

SEQ ID NO: 7087281 - DNA, 17 bp, Homo sapiens
cccaggccgccgggagc

SEQ ID NO: 7087282 - DNA, 17 bp, Homo sapiens
cccaggccgccgggagc

SEQ ID NO: 7087283 - DNA, 17 bp, Homo sapiens
cccaggccgccgggagc

SEQ ID NO: 7087284 - DNA, 22 bp, Homo sapiens
cccaggcctggtctgggccagt

SEQ ID NO: 7087285 - DNA, 22 bp, Homo sapiens
cccaggcctggtctgggccagt

SEQ ID NO: 7087286 - DNA, 22 bp, Homo sapiens
agggagctgagctgtgagcagc

SEQ ID NO: 7087287 - DNA, 22 bp, Homo sapiens
agggagctgagctgtgagcagc

SEQ ID NO: 7087288 - DNA, 22 bp, Homo sapiens
agggagctgagctgtgagcagc

SEQ ID NO: 7087289 - DNA, 21 bp, Homo sapiens
agggagctgcgtcttgaaaga

SEQ ID NO: 7087290 - DNA, 22 bp, Homo sapiens
agggagctgctctgcttccgtg

SEQ ID NO: 7087291 - DNA, 22 bp, Homo sapiens
agggagctgctctgcttccgtg

SEQ ID NO: 7087292 - DNA, 21 bp, Homo sapiens
agggagctggccacacagcct

SEQ ID NO: 7087293 - DNA, 21 bp, Homo sapiens
agggagctggccacacagcct

SEQ ID NO: 7087294 - DNA, 21 bp, Homo sapiens
agggagctggccacacagcct

SEQ ID NO: 7087295 - DNA, 22 bp, Homo sapiens
agggagctgctctgcttccgtg

SEQ ID NO: 7087296 - DNA, 21 bp, Homo sapiens
agggagctggccacacagcct

SEQ ID NO: 7087297 - DNA, 22 bp, Homo sapiens
agggagctgggccacactgatc

SEQ ID NO: 7087298 - DNA, 22 bp, Homo sapiens
agggagctgggccacactgatc

SEQ ID NO: 7087299 - DNA, 22 bp, Homo sapiens
agggagctgggccacactgatc

SEQ ID NO: 7087300 - DNA, 22 bp, Homo sapiens
agggagctggtatttataatga

SEQ ID NO: 7087301 - DNA, 22 bp, Homo sapiens
agggagctgtggtcagctcagt

SEQ ID NO: 7087302 - DNA, 22 bp, Homo sapiens
agggagctgtggtcagctcagt

SEQ ID NO: 7087303 - DNA, 22 bp, Homo sapiens
agggagctgtggtcagctcagt

SEQ ID NO: 7087304 - DNA, 22 bp, Homo sapiens
agggagctgtggtcagctcagt

SEQ ID NO: 7087305 - DNA, 22 bp, Homo sapiens
agggagctgtggtcagctcagt

SEQ ID NO: 7087306 - DNA, 22 bp, Homo sapiens
agggagctgtggtcagctcagt

SEQ ID NO: 7087307 - DNA, 22 bp, Homo sapiens
agggagcttccgaactacagct

SEQ ID NO: 7087308 - DNA, 22 bp, Homo sapiens
agggagcttccgaactacagct

SEQ ID NO: 7087309 - DNA, 22 bp, Homo sapiens
agggagcttccgaactacagct

SEQ ID NO: 7087310 - DNA, 22 bp, Homo sapiens
agggagcttccgaactacagct

SEQ ID NO: 7087311 - DNA, 22 bp, Homo sapiens
agggagcttctacttcaaggca

SEQ ID NO: 7087312 - DNA, 22 bp, Homo sapiens
agggagcttctggcctcagcct

SEQ ID NO: 7087313 - DNA, 22 bp, Homo sapiens
agggagcttctggcctcagcct

SEQ ID NO: 7087314 - DNA, 22 bp, Homo sapiens
agggagcttctggcctcagcct

SEQ ID NO: 7087315 - DNA, 22 bp, Homo sapiens
agggagcttctggcctcagcct

SEQ ID NO: 7087316 - DNA, 22 bp, Homo sapiens
agggacagtctactgttcactg

SEQ ID NO: 7087317 - DNA, 22 bp, Homo sapiens
agggacagtctactgttcactg

SEQ ID NO: 7087318 - DNA, 22 bp, Homo sapiens
agggacagttacatcatcagac

SEQ ID NO: 7087319 - DNA, 22 bp, Homo sapiens
agggacagttacatcatcagac

SEQ ID NO: 7087320 - DNA, 22 bp, Homo sapiens
agggacagtctactgttcactg

SEQ ID NO: 7087321 - DNA, 22 bp, Homo sapiens
agggacagtctactgttcactg

SEQ ID NO: 7087322 - DNA, 22 bp, Homo sapiens
agggacagtctactgttcactg

SEQ ID NO: 7087323 - DNA, 22 bp, Homo sapiens
agggaatggatgatggcaggtt

SEQ ID NO: 7087324 - DNA, 22 bp, Homo sapiens
agggacagttacatcatcagac

SEQ ID NO: 7087325 - DNA, 22 bp, Homo sapiens
agggacagttacatcatcagac

SEQ ID NO: 7087326 - DNA, 22 bp, Homo sapiens
agggacagttacatcatcagac

SEQ ID NO: 7087327 - DNA, 22 bp, Homo sapiens
agggacatctcacaaacaactt

SEQ ID NO: 7087328 - DNA, 22 bp, Homo sapiens
agggacatctcacaaacaactt

SEQ ID NO: 7087329 - DNA, 22 bp, Homo sapiens
agggacagttacatcatcagac

SEQ ID NO: 7087330 - DNA, 22 bp, Homo sapiens
agggacagttacatcatcagac

SEQ ID NO: 7087331 - DNA, 22 bp, Homo sapiens
agggaccacatcccctctgtgg

SEQ ID NO: 7087332 - DNA, 22 bp, Homo sapiens
agggaccacatcccctctgtgg

SEQ ID NO: 7087333 - DNA, 22 bp, Homo sapiens
cccaggccagaacttggttgct

SEQ ID NO: 7087334 - DNA, 22 bp, Homo sapiens
cccaggccagaacttggttgct

SEQ ID NO: 7087335 - DNA, 22 bp, Homo sapiens
cccaggccccagggcttgtcag

SEQ ID NO: 7087336 - DNA, 22 bp, Homo sapiens
cccaggccccagggcttgtcag

SEQ ID NO: 7087337 - DNA, 22 bp, Homo sapiens
agggactatttacccatctcac

SEQ ID NO: 7087338 - DNA, 22 bp, Homo sapiens
agggactccctgggccgacacg

SEQ ID NO: 7087339 - DNA, 22 bp, Homo sapiens
agggactccctgggccgacacg

SEQ ID NO: 7087340 - DNA, 22 bp, Homo sapiens
agggactccgtgcacagtggtt

SEQ ID NO: 7087341 - DNA, 22 bp, Homo sapiens
cccaggccagaacttggttgct

SEQ ID NO: 7087342 - DNA, 22 bp, Homo sapiens
cccaggccagaacttggttgct

SEQ ID NO: 7087343 - DNA, 22 bp, Homo sapiens
agggaccaggggtagctgagat

SEQ ID NO: 7087344 - DNA, 22 bp, Homo sapiens
agggaccctgatgactgaggag

SEQ ID NO: 7087345 - DNA, 22 bp, Homo sapiens
agggaccctgatgactgaggag

SEQ ID NO: 7087346 - DNA, 22 bp, Homo sapiens
agggactatttacccatctcac

SEQ ID NO: 7087347 - DNA, 22 bp, Homo sapiens
agggacctgctcactgcctggc

SEQ ID NO: 7087348 - DNA, 22 bp, Homo sapiens
agggaccctgatgactgaggag

SEQ ID NO: 7087349 - DNA, 22 bp, Homo sapiens
ccaggaggtggaggttgcggtg

SEQ ID NO: 7087350 - DNA, 22 bp, Homo sapiens
ccaggaggtggaggttgcggtg

SEQ ID NO: 7087351 - DNA, 22 bp, Homo sapiens
ccaggaggtggaggttgcggtg

SEQ ID NO: 7087352 - DNA, 22 bp, Homo sapiens
ccaggaggtggagattgcagtg

SEQ ID NO: 7087353 - DNA, 22 bp, Homo sapiens
ccaggaggtggagattgcagtg

SEQ ID NO: 7087354 - DNA, 22 bp, Homo sapiens
ccaggaggtggagattgcagtg

SEQ ID NO: 7087355 - DNA, 22 bp, Homo sapiens
ccaggaggtgctggaagaaagc

SEQ ID NO: 7087356 - DNA, 22 bp, Homo sapiens
ccaggaggtgctggaagaaagc

SEQ ID NO: 7087357 - DNA, 22 bp, Homo sapiens
ccaggaggtggagattgcagtg

SEQ ID NO: 7087358 - DNA, 22 bp, Homo sapiens
ccaggaggtggagattgcagtg

SEQ ID NO: 7087359 - DNA, 22 bp, Homo sapiens
ccaggaggtggagattgcagtg

SEQ ID NO: 7087360 - DNA, 22 bp, Homo sapiens
aggcctgggcaagaaggggcgt

SEQ ID NO: 7087361 - DNA, 22 bp, Homo sapiens
aggcctgggcaagaaggggcgt

SEQ ID NO: 7087362 - DNA, 22 bp, Homo sapiens
ccaggaggttgaggctgcagtg

SEQ ID NO: 7087363 - DNA, 22 bp, Homo sapiens
ccaggaggtggcaggacttgcc

SEQ ID NO: 7087364 - DNA, 22 bp, Homo sapiens
ccaggaggtggcaggacttgcc

SEQ ID NO: 7087365 - DNA, 22 bp, Homo sapiens
ccaggaggtggcaggacttgcc

SEQ ID NO: 7087366 - DNA, 22 bp, Homo sapiens
ccaggaggggtctctgtctccc

SEQ ID NO: 7087367 - DNA, 22 bp, Homo sapiens
ccaggagggtggttactcaatc

SEQ ID NO: 7087368 - DNA, 22 bp, Homo sapiens
ccaggaggtctgagtgtggaca

SEQ ID NO: 7087369 - DNA, 22 bp, Homo sapiens
ccaggaggtctgagtgtggaca

SEQ ID NO: 7087370 - DNA, 22 bp, Homo sapiens
ccaggaggtgaaacttcaccag

SEQ ID NO: 7087371 - DNA, 22 bp, Homo sapiens
ccaggaggtgaaacttcaccag

SEQ ID NO: 7087372 - DNA, 22 bp, Homo sapiens
ccaggagggaggagttcctgag

SEQ ID NO: 7087373 - DNA, 22 bp, Homo sapiens
ccaggaggggtctctgtctccc

SEQ ID NO: 7087374 - DNA, 22 bp, Homo sapiens
ccagctccgggagttgctgctg

SEQ ID NO: 7087375 - DNA, 22 bp, Homo sapiens
ccagctccgggagttgctgctg

SEQ ID NO: 7087376 - DNA, 22 bp, Homo sapiens
ccagctccggtgtgcttatttc

SEQ ID NO: 7087377 - DNA, 22 bp, Homo sapiens
ccaggaggatcatcctgttttc

SEQ ID NO: 7087378 - DNA, 22 bp, Homo sapiens
ccaggaggatgaggggcataga

SEQ ID NO: 7087379 - DNA, 21 bp, Homo sapiens
aggccctggaggtcagagaaa

SEQ ID NO: 7087380 - DNA, 22 bp, Homo sapiens
aggccctggcactgcctgggag

SEQ ID NO: 7087381 - DNA, 22 bp, Homo sapiens
aggccctggcactgcctgggag

SEQ ID NO: 7087382 - DNA, 22 bp, Homo sapiens
ccagctccaggtagatgggcag

SEQ ID NO: 7087383 - DNA, 21 bp, Homo sapiens
aggccctggaggtcagagaaa

SEQ ID NO: 7087384 - DNA, 22 bp, Homo sapiens
ccagctccaggtagatgggcag

SEQ ID NO: 7087385 - DNA, 22 bp, Homo sapiens
ccagctccaggtagatgggcag

SEQ ID NO: 7087386 - DNA, 22 bp, Homo sapiens
ccagctccaggtagatgggcag

SEQ ID NO: 7087387 - DNA, 22 bp, Homo sapiens
ccagctccattgcttagtgtaa

SEQ ID NO: 7087388 - DNA, 22 bp, Homo sapiens
ccagctccattgcttagtgtaa

SEQ ID NO: 7087389 - DNA, 22 bp, Homo sapiens
ccagctccattgcttagtgtaa

SEQ ID NO: 7087390 - DNA, 23 bp, Homo sapiens
ccagctcccaggtctgaggactg

SEQ ID NO: 7087391 - DNA, 22 bp, Homo sapiens
aggccctggacactcaagccgg

SEQ ID NO: 7087392 - DNA, 22 bp, Homo sapiens
aggccctggacactcaagccgg

SEQ ID NO: 7087393 - DNA, 21 bp, Homo sapiens
aggccctggaggtcagagaaa

SEQ ID NO: 7087394 - DNA, 22 bp, Homo sapiens
aggccctgctttccagagctca

SEQ ID NO: 7087395 - DNA, 22 bp, Homo sapiens
aggccctgctttccagagctca

SEQ ID NO: 7087396 - DNA, 22 bp, Homo sapiens
aggccctgctttccagagctca

SEQ ID NO: 7087397 - DNA, 22 bp, Homo sapiens
aggccctgctttccagagctca

SEQ ID NO: 7087398 - DNA, 22 bp, Homo sapiens
aggccctgctttccagagctca

SEQ ID NO: 7087399 - DNA, 22 bp, Homo sapiens
aggccctgctttccagagctca

SEQ ID NO: 7087400 - DNA, 22 bp, Homo sapiens
aggccctgctttccagagctca

SEQ ID NO: 7087401 - DNA, 22 bp, Homo sapiens
aggccctgctgaggcctccctc

SEQ ID NO: 7087402 - DNA, 22 bp, Homo sapiens
aggccctgctttccagagctca

SEQ ID NO: 7087403 - DNA, 22 bp, Homo sapiens
ccagctcccgcaggctgcacag

SEQ ID NO: 7087404 - DNA, 22 bp, Homo sapiens
ccagctcccgcaggctgcacag

SEQ ID NO: 7087405 - DNA, 22 bp, Homo sapiens
ccagctcccgcaggctgcacag

SEQ ID NO: 7087406 - DNA, 22 bp, Homo sapiens
ccagctcccgcaggctgcacag

SEQ ID NO: 7087407 - DNA, 22 bp, Homo sapiens
ccagctccctgaagcctggtct

SEQ ID NO: 7087408 - DNA, 22 bp, Homo sapiens
ccagctccctgaagcctggtct

SEQ ID NO: 7087409 - DNA, 22 bp, Homo sapiens
ccagctccctgaagcctggtct

SEQ ID NO: 7087410 - DNA, 22 bp, Homo sapiens
ccagctccctgaagcctggtct

SEQ ID NO: 7087411 - DNA, 22 bp, Homo sapiens
ccagctccctgaagcctggtct

SEQ ID NO: 7087412 - DNA, 22 bp, Homo sapiens
ccagctccctgaagcctggtct

SEQ ID NO: 7087413 - DNA, 22 bp, Homo sapiens
ccagctccctgaagcctggtct

SEQ ID NO: 7087414 - DNA, 22 bp, Homo sapiens
ccagctccgggagttgctgctg

SEQ ID NO: 7087415 - DNA, 22 bp, Homo sapiens
ccagctccgggagttgctgctg

SEQ ID NO: 7087416 - DNA, 22 bp, Homo sapiens
ccagctcccattcttcacctgt

SEQ ID NO: 7087417 - DNA, 22 bp, Homo sapiens
ccagctcccattcttcacctgt

SEQ ID NO: 7087418 - DNA, 22 bp, Homo sapiens
ccagctcccctcagcaggtaat

SEQ ID NO: 7087419 - DNA, 22 bp, Homo sapiens
ccagctcccctcagcaggtaat

SEQ ID NO: 7087420 - DNA, 22 bp, Homo sapiens
ccagctcccctcagcaggtaat

SEQ ID NO: 7087421 - DNA, 22 bp, Homo sapiens
ccagctcccgcaggctgcacag

SEQ ID NO: 7087422 - DNA, 22 bp, Homo sapiens
ccagctcccgcaggctgcacag

SEQ ID NO: 7087423 - DNA, 22 bp, Homo sapiens
ccagctcccgcaggctgcacag

SEQ ID NO: 7087424 - DNA, 22 bp, Homo sapiens
ccagctcccgcaggctgcacag

SEQ ID NO: 7087425 - DNA, 22 bp, Homo sapiens
ccagctcccctcagcaggtaat

SEQ ID NO: 7087426 - DNA, 23 bp, Homo sapiens
ccagctcccaggtctgaggactg

SEQ ID NO: 7087427 - DNA, 23 bp, Homo sapiens
ccagctcccaggtctgaggactg

SEQ ID NO: 7087428 - DNA, 23 bp, Homo sapiens
ccagctcccaggtctgaggactg

SEQ ID NO: 7087429 - DNA, 23 bp, Homo sapiens
ccagctcccaggtctgaggactg

SEQ ID NO: 7087430 - DNA, 22 bp, Homo sapiens
ccagctcccattcttcacctgt

SEQ ID NO: 7087431 - DNA, 22 bp, Homo sapiens
aggcctggtgtgccggatgcag

SEQ ID NO: 7087432 - DNA, 22 bp, Homo sapiens
aggcctggtgaatgaagtatct

SEQ ID NO: 7087433 - DNA, 22 bp, Homo sapiens
aggcctggtgaatgaagtatct

SEQ ID NO: 7087434 - DNA, 22 bp, Homo sapiens
aggcctgggtgttcaccagaag

SEQ ID NO: 7087435 - DNA, 22 bp, Homo sapiens
aggcctgggtgttcaccagaag

SEQ ID NO: 7087436 - DNA, 22 bp, Homo sapiens
aggcctgggtgttcaccagaag

SEQ ID NO: 7087437 - DNA, 22 bp, Homo sapiens
aggcctgggtgttcaccagaag

SEQ ID NO: 7087438 - DNA, 19 bp, Homo sapiens
aggcctggggttttgcact

SEQ ID NO: 7087439 - DNA, 19 bp, Homo sapiens
aggcctggggttttgcact

SEQ ID NO: 7087440 - DNA, 22 bp, Homo sapiens
aggcctgggtctcgtgcctacc

SEQ ID NO: 7087441 - DNA, 21 bp, Homo sapiens
aggctcagagagaaactcttg

SEQ ID NO: 7087442 - DNA, 21 bp, Homo sapiens
aggctcagagagaaactcttg

SEQ ID NO: 7087443 - DNA, 21 bp, Homo sapiens
aggctcagagagaaactcttg

SEQ ID NO: 7087444 - DNA, 21 bp, Homo sapiens
aggctcagagagaaactcttg

SEQ ID NO: 7087445 - DNA, 22 bp, Homo sapiens
aggctcagagagctgtgtccat

SEQ ID NO: 7087446 - DNA, 22 bp, Homo sapiens
aggctcagagagctgtgtccat

SEQ ID NO: 7087447 - DNA, 22 bp, Homo sapiens
aggctcagagagctgtgtccat

SEQ ID NO: 7087448 - DNA, 22 bp, Homo sapiens
aggctcagagagctgtgtccat

SEQ ID NO: 7087449 - DNA, 22 bp, Homo sapiens
aggcctggtgaatgaagtatct

SEQ ID NO: 7087450 - DNA, 22 bp, Homo sapiens
aggcctggtgtgccggatgcag

SEQ ID NO: 7087451 - DNA, 22 bp, Homo sapiens
aggctagaggcttctggcttca

SEQ ID NO: 7087452 - DNA, 22 bp, Homo sapiens
aggctcagagagctgtgtccat

SEQ ID NO: 7087453 - DNA, 22 bp, Homo sapiens
aggctcagagagctgtgtccat

SEQ ID NO: 7087454 - DNA, 21 bp, Homo sapiens
aggctcagagatcaaacagta

SEQ ID NO: 7087455 - DNA, 21 bp, Homo sapiens
aggctcagagatcaaacagta

SEQ ID NO: 7087456 - DNA, 21 bp, Homo sapiens
aggctcagagatcaaacagta

SEQ ID NO: 7087457 - DNA, 21 bp, Homo sapiens
aggctcagagatcaaacagta

SEQ ID NO: 7087458 - DNA, 21 bp, Homo sapiens
aggctcagagatcaaacagta

SEQ ID NO: 7087459 - DNA, 22 bp, Homo sapiens
aggctcagagatgagtaagcac

SEQ ID NO: 7087460 - DNA, 22 bp, Homo sapiens
aggctcagagatgagtaagcac

SEQ ID NO: 7087461 - DNA, 22 bp, Homo sapiens
aggctcagagatgagtaagcac

SEQ ID NO: 7087462 - DNA, 22 bp, Homo sapiens
aggctcagagatgagtaagcac

SEQ ID NO: 7087463 - DNA, 22 bp, Homo sapiens
aggctcagagatgagtaagcac

SEQ ID NO: 7087464 - DNA, 22 bp, Homo sapiens
aggctcagagatgagtaagcac

SEQ ID NO: 7087465 - DNA, 22 bp, Homo sapiens
aggctcagagatgagtaagcac

SEQ ID NO: 7087466 - DNA, 20 bp, Homo sapiens
ccaggcactgtcccatgcag

SEQ ID NO: 7087467 - DNA, 20 bp, Homo sapiens
ccaggcactgtcccatgcag

SEQ ID NO: 7087468 - DNA, 20 bp, Homo sapiens
ccaggcactgtcccatgcag

SEQ ID NO: 7087469 - DNA, 22 bp, Homo sapiens
ccaggcactcagagactgggac

SEQ ID NO: 7087470 - DNA, 22 bp, Homo sapiens
ccaggcactcagagactgggac

SEQ ID NO: 7087471 - DNA, 22 bp, Homo sapiens
ccaggcactgctcgaggtgcta

SEQ ID NO: 7087472 - DNA, 22 bp, Homo sapiens
ccaggcactgctcgaggtgcta

SEQ ID NO: 7087473 - DNA, 22 bp, Homo sapiens
ccaggcacggtggctcatgcct

SEQ ID NO: 7087474 - DNA, 22 bp, Homo sapiens
ccaggcacggtggctcatgcct

SEQ ID NO: 7087475 - DNA, 22 bp, Homo sapiens
ccaggcacggtggctcatgcct

SEQ ID NO: 7087476 - DNA, 22 bp, Homo sapiens
ccaggcactcacggggcactgg

SEQ ID NO: 7087477 - DNA, 22 bp, Homo sapiens
ccaggcactcacggggcactgg

SEQ ID NO: 7087478 - DNA, 22 bp, Homo sapiens
ccaggcaccatgttcttaggac

SEQ ID NO: 7087479 - DNA, 22 bp, Homo sapiens
ccaggcaccaaagtatgcttta

SEQ ID NO: 7087480 - DNA, 22 bp, Homo sapiens
ccaggcaccatgttcttaggac

SEQ ID NO: 7087481 - DNA, 22 bp, Homo sapiens
ccaggcacggtggctcatgcct

SEQ ID NO: 7087482 - DNA, 22 bp, Homo sapiens
ccaggcacggtggctcatgcct

SEQ ID NO: 7087483 - DNA, 22 bp, Homo sapiens
ccaggcacggtggctcatgcct

SEQ ID NO: 7087484 - DNA, 22 bp, Homo sapiens
ccaggcacggtggctcatgcct

SEQ ID NO: 7087485 - DNA, 16 bp, Homo sapiens
aggctcagaggctgga

SEQ ID NO: 7087486 - DNA, 22 bp, Homo sapiens
aggctcagaggtgagcatctgc

SEQ ID NO: 7087487 - DNA, 22 bp, Homo sapiens
aggctcagaggtgagcatctgc

SEQ ID NO: 7087488 - DNA, 22 bp, Homo sapiens
aggctcagaggtgagcatctgc

SEQ ID NO: 7087489 - DNA, 22 bp, Homo sapiens
aggctcagaggtgagcatctgc

SEQ ID NO: 7087490 - DNA, 16 bp, Homo sapiens
aggctcagaggctgga

SEQ ID NO: 7087491 - DNA, 16 bp, Homo sapiens
aggctcagaggctgga

SEQ ID NO: 7087492 - DNA, 16 bp, Homo sapiens
aggctcagaggctgga

SEQ ID NO: 7087493 - DNA, 20 bp, Homo sapiens
aggctcagagcagtagtaca

SEQ ID NO: 7087494 - DNA, 20 bp, Homo sapiens
aggctcagagcagtagtaca

SEQ ID NO: 7087495 - DNA, 20 bp, Homo sapiens
aggctcagagcagtagtaca

SEQ ID NO: 7087496 - DNA, 20 bp, Homo sapiens
aggctcagagcagtagtaca

SEQ ID NO: 7087497 - DNA, 20 bp, Homo sapiens
aggctcagagcagtagtaca

SEQ ID NO: 7087498 - DNA, 20 bp, Homo sapiens
aggctcagagcagtagtaca

SEQ ID NO: 7087499 - DNA, 20 bp, Homo sapiens
aggctcagagcagtagtaca

SEQ ID NO: 7087500 - DNA, 16 bp, Homo sapiens
aggctcagaggctgga

SEQ ID NO: 7087501 - DNA, 16 bp, Homo sapiens
aggctcagaggctgga

SEQ ID NO: 7087502 - DNA, 22 bp, Homo sapiens
aggctcagaggtgagcatctgc

SEQ ID NO: 7087503 - DNA, 20 bp, Homo sapiens
aggctcagatacccagggaa

SEQ ID NO: 7087504 - DNA, 20 bp, Homo sapiens
aggctcagatacccagggaa

SEQ ID NO: 7087505 - DNA, 22 bp, Homo sapiens
aggctcagaggtgagcatctgc

SEQ ID NO: 7087506 - DNA, 20 bp, Homo sapiens
aggctcagatacccagggaa

SEQ ID NO: 7087507 - DNA, 20 bp, Homo sapiens
aggctcagatacccagggaa

SEQ ID NO: 7087508 - DNA, 22 bp, Homo sapiens
ccaggcacaggtgggcctcaga

SEQ ID NO: 7087509 - DNA, 22 bp, Homo sapiens
ccaggcacaggtgggcctcaga

SEQ ID NO: 7087510 - DNA, 22 bp, Homo sapiens
ccaggcacaggtgggcctcaga

SEQ ID NO: 7087511 - DNA, 22 bp, Homo sapiens
ccaggcaccaaagtatgcttta

SEQ ID NO: 7087512 - DNA, 22 bp, Homo sapiens
aggccctgcccagagctcctcg

SEQ ID NO: 7087513 - DNA, 22 bp, Homo sapiens
aggccctgagaaaatccctgca

SEQ ID NO: 7087514 - DNA, 22 bp, Homo sapiens
aggccctgagaaaatccctgca

SEQ ID NO: 7087515 - DNA, 22 bp, Homo sapiens
aggccctgagaaaatccctgca

SEQ ID NO: 7087516 - DNA, 22 bp, Homo sapiens
aggccctgacctgggagatcta

SEQ ID NO: 7087517 - DNA, 22 bp, Homo sapiens
aggccctgacctgggagatcta

SEQ ID NO: 7087518 - DNA, 18 bp, Homo sapiens
ccagccctgcagcacctg

SEQ ID NO: 7087519 - DNA, 18 bp, Homo sapiens
ccagccctgcagcacctg

SEQ ID NO: 7087520 - DNA, 18 bp, Homo sapiens
ccagccctgcagcacctg

SEQ ID NO: 7087521 - DNA, 18 bp, Homo sapiens
ccagccctgcagcacctg

SEQ ID NO: 7087522 - DNA, 22 bp, Homo sapiens
ccagccctgccagagagagctg

SEQ ID NO: 7087523 - DNA, 22 bp, Homo sapiens
aggccctgacctgggagatcta

SEQ ID NO: 7087524 - DNA, 22 bp, Homo sapiens
aggccctgcccagtgccacaag

SEQ ID NO: 7087525 - DNA, 22 bp, Homo sapiens
aggccctgcccagagctcctcg

SEQ ID NO: 7087526 - DNA, 22 bp, Homo sapiens
aggccctgcccagagctcctcg

SEQ ID NO: 7087527 - DNA, 22 bp, Homo sapiens
aggccctgcccagtgccacaag

SEQ ID NO: 7087528 - DNA, 22 bp, Homo sapiens
aggccctgcccagtgccacaag

SEQ ID NO: 7087529 - DNA, 22 bp, Homo sapiens
aggccctgcggaaatgatcatt

SEQ ID NO: 7087530 - DNA, 22 bp, Homo sapiens
aggccctgctgaggcctccctc

SEQ ID NO: 7087531 - DNA, 22 bp, Homo sapiens
aggccctgcggaaatgatcatt

SEQ ID NO: 7087532 - DNA, 22 bp, Homo sapiens
aggccctgcggaaatgatcatt

SEQ ID NO: 7087533 - DNA, 22 bp, Homo sapiens
aggccctgcccagtgccacaag

SEQ ID NO: 7087534 - DNA, 23 bp, Homo sapiens
aggccctgcctgtccctcttttt

SEQ ID NO: 7087535 - DNA, 22 bp, Homo sapiens
ccagccctcggtagtcccatag

SEQ ID NO: 7087536 - DNA, 17 bp, Homo sapiens
ccagccctcgcgctttt

SEQ ID NO: 7087537 - DNA, 22 bp, Homo sapiens
ccagccctcctccatcagagga

SEQ ID NO: 7087538 - DNA, 22 bp, Homo sapiens
ccagccctcctccatcagagga

SEQ ID NO: 7087539 - DNA, 23 bp, Homo sapiens
ccagccctccaccagctctaggc

SEQ ID NO: 7087540 - DNA, 23 bp, Homo sapiens
ccagccctccaccagctctaggc

SEQ ID NO: 7087541 - DNA, 23 bp, Homo sapiens
ccagccctccaccagctctaggc

SEQ ID NO: 7087542 - DNA, 23 bp, Homo sapiens
ccagccctccaccagctctaggc

SEQ ID NO: 7087543 - DNA, 22 bp, Homo sapiens
ccagccctcggtagtcccatag

SEQ ID NO: 7087544 - DNA, 22 bp, Homo sapiens
ccagccctgaaccctgctgcat

SEQ ID NO: 7087545 - DNA, 22 bp, Homo sapiens
ccagccctgaaccctgctgcat

SEQ ID NO: 7087546 - DNA, 22 bp, Homo sapiens
ccagccctcggtagtcccatag

SEQ ID NO: 7087547 - DNA, 22 bp, Homo sapiens
ccagccctcggtagtcccatag

SEQ ID NO: 7087548 - DNA, 22 bp, Homo sapiens
ccagccctgattagagaatgtc

SEQ ID NO: 7087549 - DNA, 22 bp, Homo sapiens
ccagccagatgataagctctat

SEQ ID NO: 7087550 - DNA, 22 bp, Homo sapiens
ccagccagatgataagctctat

SEQ ID NO: 7087551 - DNA, 22 bp, Homo sapiens
ccagccagcaagctcccagttc

SEQ ID NO: 7087552 - DNA, 22 bp, Homo sapiens
ccagccagcaagctcccagttc

SEQ ID NO: 7087553 - DNA, 22 bp, Homo sapiens
ccagccagcaagctcccagttc

SEQ ID NO: 7087554 - DNA, 22 bp, Homo sapiens
ccagccactgggccactgccag

SEQ ID NO: 7087555 - DNA, 22 bp, Homo sapiens
ccagccagaagtccgggcttct

SEQ ID NO: 7087556 - DNA, 22 bp, Homo sapiens
ccagccagatgataagctctat

SEQ ID NO: 7087557 - DNA, 22 bp, Homo sapiens
ccagcaggcagtcatatccttt

SEQ ID NO: 7087558 - DNA, 22 bp, Homo sapiens
ccagcaggcagtcatatccttt

SEQ ID NO: 7087559 - DNA, 22 bp, Homo sapiens
ccagcagggaaaaacccaccaa

SEQ ID NO: 7087560 - DNA, 22 bp, Homo sapiens
ccagagtccctgttctcggcct

SEQ ID NO: 7087561 - DNA, 22 bp, Homo sapiens
ccagagtcccttgcagctcagt

SEQ ID NO: 7087562 - DNA, 22 bp, Homo sapiens
ccagagtcccttgcagctcagt

SEQ ID NO: 7087563 - DNA, 22 bp, Homo sapiens
ccagagtcccttgcagctcagt

SEQ ID NO: 7087564 - DNA, 22 bp, Homo sapiens
ccagagtctatgagtcctcatt

SEQ ID NO: 7087565 - DNA, 22 bp, Homo sapiens
ccagccagccttgatctgagta

SEQ ID NO: 7087566 - DNA, 22 bp, Homo sapiens
ccagccagccttgatctgagta

SEQ ID NO: 7087567 - DNA, 22 bp, Homo sapiens
ccagccagccttgatctgagta

SEQ ID NO: 7087568 - DNA, 22 bp, Homo sapiens
ccagccagctgcccttggggcc

SEQ ID NO: 7087569 - DNA, 22 bp, Homo sapiens
ccagccagctgcccttggggcc

SEQ ID NO: 7087570 - DNA, 22 bp, Homo sapiens
ccagccagctgcccttggggcc

SEQ ID NO: 7087571 - DNA, 22 bp, Homo sapiens
ccagccagctggttggacgcct

SEQ ID NO: 7087572 - DNA, 22 bp, Homo sapiens
ccagccagctggttggacgcct

SEQ ID NO: 7087573 - DNA, 22 bp, Homo sapiens
ccagccagctggttggacgcct

SEQ ID NO: 7087574 - DNA, 22 bp, Homo sapiens
ccagccagctggttggacgcct

SEQ ID NO: 7087575 - DNA, 22 bp, Homo sapiens
ccagccagctggttggacgcct

SEQ ID NO: 7087576 - DNA, 22 bp, Homo sapiens
ccagccagctggttggacgcct

SEQ ID NO: 7087577 - DNA, 22 bp, Homo sapiens
ccagccaggcattgcaaactga

SEQ ID NO: 7087578 - DNA, 22 bp, Homo sapiens
ccagccaggctggctgtggagg

SEQ ID NO: 7087579 - DNA, 22 bp, Homo sapiens
ccagccaggctggctgtggagg

SEQ ID NO: 7087580 - DNA, 22 bp, Homo sapiens
ccagccaggctggctgtggagg

SEQ ID NO: 7087581 - DNA, 22 bp, Homo sapiens
ccagccagggaaactttttctt

SEQ ID NO: 7087582 - DNA, 22 bp, Homo sapiens
ccagccagtatattccaaagcc

SEQ ID NO: 7087583 - DNA, 22 bp, Homo sapiens
ccagccagtatattccaaagcc

SEQ ID NO: 7087584 - DNA, 22 bp, Homo sapiens
ccagccagtatattccaaagcc

SEQ ID NO: 7087585 - DNA, 22 bp, Homo sapiens
ccagccagtatattccaaagcc

SEQ ID NO: 7087586 - DNA, 22 bp, Homo sapiens
aggcaggtcccctggaaggcac

SEQ ID NO: 7087587 - DNA, 22 bp, Homo sapiens
aggcaggtcccctggaaggcac

SEQ ID NO: 7087588 - DNA, 22 bp, Homo sapiens
aggcaggtcccctggaaggcac

SEQ ID NO: 7087589 - DNA, 22 bp, Homo sapiens
aggcaggtcccctggaaggcac

SEQ ID NO: 7087590 - DNA, 22 bp, Homo sapiens
aggcaggtctgtatctagtctc

SEQ ID NO: 7087591 - DNA, 22 bp, Homo sapiens
aggcaggtcccctggaaggcac

SEQ ID NO: 7087592 - DNA, 22 bp, Homo sapiens
aggcaggtctgtatctagtctc

SEQ ID NO: 7087593 - DNA, 22 bp, Homo sapiens
aggcaggtgagtcaaaacagac

SEQ ID NO: 7087594 - DNA, 22 bp, Homo sapiens
ccactcccttccggtccagggc

SEQ ID NO: 7087595 - DNA, 22 bp, Homo sapiens
ccactcccttccggtccagggc

SEQ ID NO: 7087596 - DNA, 21 bp, Homo sapiens
ccactcatgactccactcacc

SEQ ID NO: 7087597 - DNA, 20 bp, Homo sapiens
ccactccaggtgattctgat

SEQ ID NO: 7087598 - DNA, 20 bp, Homo sapiens
ccactccaggtgattctgat

SEQ ID NO: 7087599 - DNA, 22 bp, Homo sapiens
ccactccccacgtgctgtcaga

SEQ ID NO: 7087600 - DNA, 20 bp, Homo sapiens
ccactccgcccccagagggc

SEQ ID NO: 7087601 - DNA, 22 bp, Homo sapiens
aggcaggtagaaggatctttat

SEQ ID NO: 7087602 - DNA, 22 bp, Homo sapiens
aggcaggtagaaggatctttat

SEQ ID NO: 7087603 - DNA, 22 bp, Homo sapiens
aggcaggtcacatgcttggcga

SEQ ID NO: 7087604 - DNA, 18 bp, Homo sapiens
ccagaggcccgggcaggc

SEQ ID NO: 7087605 - DNA, 19 bp, Homo sapiens
ccagaggcagcttctgtaa

SEQ ID NO: 7087606 - DNA, 22 bp, Homo sapiens
ccagaggcatgttcaaagcaat

SEQ ID NO: 7087607 - DNA, 22 bp, Homo sapiens
ccagaggcatgttcaaagcaat

SEQ ID NO: 7087608 - DNA, 22 bp, Homo sapiens
ccagaggatgctggtcagcctc

SEQ ID NO: 7087609 - DNA, 22 bp, Homo sapiens
ccagaggatgctggtcagcctc

SEQ ID NO: 7087610 - DNA, 19 bp, Homo sapiens
aggcaggtgcagaggtccc

SEQ ID NO: 7087611 - DNA, 18 bp, Homo sapiens
aggcaggtgctaatattt

SEQ ID NO: 7087612 - DNA, 22 bp, Homo sapiens
ccagaggatgctggtcagcctc

SEQ ID NO: 7087613 - DNA, 22 bp, Homo sapiens
ccagaggatgctggtcagcctc

SEQ ID NO: 7087614 - DNA, 16 bp, Homo sapiens
ccagaggcctggcctc

SEQ ID NO: 7087615 - DNA, 22 bp, Homo sapiens
ccagaggcggaggtttgcagtg

SEQ ID NO: 7087616 - DNA, 21 bp, Homo sapiens
ccagaggcctctcttggccac

SEQ ID NO: 7087617 - DNA, 21 bp, Homo sapiens
ccagaggcctctcttggccac

SEQ ID NO: 7087618 - DNA, 18 bp, Homo sapiens
ccagaggcccgggcaggc

SEQ ID NO: 7087619 - DNA, 20 bp, Homo sapiens
ccagaggctgacagactttg

SEQ ID NO: 7087620 - DNA, 22 bp, Homo sapiens
ccagaggctggcaagggctcct

SEQ ID NO: 7087621 - DNA, 20 bp, Homo sapiens
ccagaggctgacagactttg

SEQ ID NO: 7087622 - DNA, 22 bp, Homo sapiens
ccagaggctggcaagggctcct

SEQ ID NO: 7087623 - DNA, 22 bp, Homo sapiens
ccagaggtgggagtgatctggt

SEQ ID NO: 7087624 - DNA, 22 bp, Homo sapiens
ccagaggtggtgggtgctacag

SEQ ID NO: 7087625 - DNA, 22 bp, Homo sapiens
ccagaggtggtggtgtctagaa

SEQ ID NO: 7087626 - DNA, 22 bp, Homo sapiens
ccagaggtggtggtgtctagaa

SEQ ID NO: 7087627 - DNA, 22 bp, Homo sapiens
ccagaggttacaccctcagccc

SEQ ID NO: 7087628 - DNA, 22 bp, Homo sapiens
ccagaggttccaggctagggag

SEQ ID NO: 7087629 - DNA, 21 bp, Homo sapiens
ccagaggttctgggcctccct

SEQ ID NO: 7087630 - DNA, 19 bp, Homo sapiens
ccagaggtttgctgggcct

SEQ ID NO: 7087631 - DNA, 19 bp, Homo sapiens
ccagagtcatgtctccccc

SEQ ID NO: 7087632 - DNA, 19 bp, Homo sapiens
ccagagtcatgtctccccc

SEQ ID NO: 7087633 - DNA, 22 bp, Homo sapiens
ccagagtcattttgagtcataa

SEQ ID NO: 7087634 - DNA, 22 bp, Homo sapiens
ccagtgggtaggccatggtgag

SEQ ID NO: 7087635 - DNA, 20 bp, Homo sapiens
aggctgcctaaggctctgca

SEQ ID NO: 7087636 - DNA, 20 bp, Homo sapiens
ccagtgggaagtgattaggt

SEQ ID NO: 7087637 - DNA, 22 bp, Homo sapiens
ccagtgggtgctgggctctgcc

SEQ ID NO: 7087638 - DNA, 22 bp, Homo sapiens
ccagtgggtgctgggctctgcc

SEQ ID NO: 7087639 - DNA, 22 bp, Homo sapiens
ccagtggtgaatccagggatgt

SEQ ID NO: 7087640 - DNA, 20 bp, Homo sapiens
aggctgccaggtctcacatc

SEQ ID NO: 7087641 - DNA, 20 bp, Homo sapiens
aggctgccaggtctcacatc

SEQ ID NO: 7087642 - DNA, 22 bp, Homo sapiens
aggctgccatagggaactgcat

SEQ ID NO: 7087643 - DNA, 22 bp, Homo sapiens
aggctgccatagggaactgcat

SEQ ID NO: 7087644 - DNA, 19 bp, Homo sapiens
aggctgcccagtctctgcc

SEQ ID NO: 7087645 - DNA, 19 bp, Homo sapiens
aggctgcccagtctctgcc

SEQ ID NO: 7087646 - DNA, 19 bp, Homo sapiens
aggctgcccagtctctgcc

SEQ ID NO: 7087647 - DNA, 19 bp, Homo sapiens
aggctgcccagtctctgcc

SEQ ID NO: 7087648 - DNA, 22 bp, Homo sapiens
aggctgccctgccgccagtggg

SEQ ID NO: 7087649 - DNA, 22 bp, Homo sapiens
aggctgccctgccgccagtggg

SEQ ID NO: 7087650 - DNA, 22 bp, Homo sapiens
aggctgccctgccgccagtggg

SEQ ID NO: 7087651 - DNA, 22 bp, Homo sapiens
aggctgccgcagccaatggttg

SEQ ID NO: 7087652 - DNA, 22 bp, Homo sapiens
aggctgccgcagccaatggttg

SEQ ID NO: 7087653 - DNA, 22 bp, Homo sapiens
aggctgccgcagccaatggttg

SEQ ID NO: 7087654 - DNA, 23 bp, Homo sapiens
aggctgcagaagaatagggtcat

SEQ ID NO: 7087655 - DNA, 22 bp, Homo sapiens
aggctgcagcttgtctcgtggg

SEQ ID NO: 7087656 - DNA, 22 bp, Homo sapiens
aggctgcagaggtgctgccaga

SEQ ID NO: 7087657 - DNA, 22 bp, Homo sapiens
aggctgcagaggtgctgccaga

SEQ ID NO: 7087658 - DNA, 22 bp, Homo sapiens
aggctgcagaggtgctgccaga

SEQ ID NO: 7087659 - DNA, 22 bp, Homo sapiens
aggctgcagaggtgctgccaga

SEQ ID NO: 7087660 - DNA, 22 bp, Homo sapiens
aggctgcaggtctgggtcatgt

SEQ ID NO: 7087661 - DNA, 22 bp, Homo sapiens
aggctgcaggtctgggtcatgt

SEQ ID NO: 7087662 - DNA, 22 bp, Homo sapiens
aggctgcagtgcaggtaggatt

SEQ ID NO: 7087663 - DNA, 22 bp, Homo sapiens
aggctgcagtgcaggtaggatt

SEQ ID NO: 7087664 - DNA, 22 bp, Homo sapiens
aggctgcagtgcaggtaggatt

SEQ ID NO: 7087665 - DNA, 22 bp, Homo sapiens
aggctgcatcccactttgtgta

SEQ ID NO: 7087666 - DNA, 21 bp, Homo sapiens
aggctgcatgcatgagtgtgg

SEQ ID NO: 7087667 - DNA, 21 bp, Homo sapiens
aggctgcatgcatgagtgtgg

SEQ ID NO: 7087668 - DNA, 21 bp, Homo sapiens
aggctgcatttatatggtgtg

SEQ ID NO: 7087669 - DNA, 21 bp, Homo sapiens
aggctgcatttatatggtgtg

SEQ ID NO: 7087670 - DNA, 23 bp, Homo sapiens
aggctgccagaaattgggtaagg

SEQ ID NO: 7087671 - DNA, 22 bp, Homo sapiens
aggctgccagaagccttcagga

SEQ ID NO: 7087672 - DNA, 22 bp, Homo sapiens
aggctgccagaagccttcagga

SEQ ID NO: 7087673 - DNA, 22 bp, Homo sapiens
aggctgccagaagccttcagga

SEQ ID NO: 7087674 - DNA, 20 bp, Homo sapiens
aggctgccaggtctcacatc

SEQ ID NO: 7087675 - DNA, 20 bp, Homo sapiens
aggctgccaggtctcacatc

SEQ ID NO: 7087676 - DNA, 20 bp, Homo sapiens
aggctgccaggtctcacatc

SEQ ID NO: 7087677 - DNA, 20 bp, Homo sapiens
aggctgccaggtctcacatc

SEQ ID NO: 7087678 - DNA, 22 bp, Homo sapiens
cccacacatttttcacttaccg

SEQ ID NO: 7087679 - DNA, 22 bp, Homo sapiens
cccacacatttttcacttaccg

SEQ ID NO: 7087680 - DNA, 20 bp, Homo sapiens
cccacacccttcccacttgg

SEQ ID NO: 7087681 - DNA, 18 bp, Homo sapiens
cccacacagcagtagctc

SEQ ID NO: 7087682 - DNA, 18 bp, Homo sapiens
cccacacagcagtagctc

SEQ ID NO: 7087683 - DNA, 18 bp, Homo sapiens
cccacacagcagtagctc

SEQ ID NO: 7087684 - DNA, 22 bp, Homo sapiens
cccacacatttttcacttaccg

SEQ ID NO: 7087685 - DNA, 22 bp, Homo sapiens
cccaataaaattcattttcatt

SEQ ID NO: 7087686 - DNA, 22 bp, Homo sapiens
cccaatttcttcctcatttgcc

SEQ ID NO: 7087687 - DNA, 22 bp, Homo sapiens
cccaattttgggcacaacgaaa

SEQ ID NO: 7087688 - DNA, 22 bp, Homo sapiens
cccacacaaatcatggggagaa

SEQ ID NO: 7087689 - DNA, 22 bp, Homo sapiens
cccacacaaatcatggggagaa

SEQ ID NO: 7087690 - DNA, 22 bp, Homo sapiens
cccacacacatttatgatagga

SEQ ID NO: 7087691 - DNA, 22 bp, Homo sapiens
cccacacacatttatgatagga

SEQ ID NO: 7087692 - DNA, 22 bp, Homo sapiens
cccacacacatttatgatagga

SEQ ID NO: 7087693 - DNA, 22 bp, Homo sapiens
cccacacactggctgctgccaa

SEQ ID NO: 7087694 - DNA, 22 bp, Homo sapiens
cccacacactggctgctgccaa

SEQ ID NO: 7087695 - DNA, 22 bp, Homo sapiens
cccacacactggctgctgccaa

SEQ ID NO: 7087696 - DNA, 22 bp, Homo sapiens
cccacacactggctgctgccaa

SEQ ID NO: 7087697 - DNA, 18 bp, Homo sapiens
cccacacagcagtagctc

SEQ ID NO: 7087698 - DNA, 22 bp, Homo sapiens
ccagtgtctactgtggcatatc

SEQ ID NO: 7087699 - DNA, 19 bp, Homo sapiens
ccagtgtctagcgcacagc

SEQ ID NO: 7087700 - DNA, 22 bp, Homo sapiens
ccagtgtgaacctcaccaccct

SEQ ID NO: 7087701 - DNA, 22 bp, Homo sapiens
ccattttgtctcctgaaatcta

SEQ ID NO: 7087702 - DNA, 22 bp, Homo sapiens
cccaagttaatttgtagctgaa

SEQ ID NO: 7087703 - DNA, 22 bp, Homo sapiens
cccaagttaaaattcagtgctc

SEQ ID NO: 7087704 - DNA, 22 bp, Homo sapiens
cccaccctgggaagctaggcag

SEQ ID NO: 7087705 - DNA, 22 bp, Homo sapiens
cccaccctgggaagctaggcag

SEQ ID NO: 7087706 - DNA, 22 bp, Homo sapiens
cccacctctcagagagccttgc

SEQ ID NO: 7087707 - DNA, 22 bp, Homo sapiens
cccacctctcagagagccttgc

SEQ ID NO: 7087708 - DNA, 22 bp, Homo sapiens
cccacctctcagagagccttgc

SEQ ID NO: 7087709 - DNA, 21 bp, Homo sapiens
cccacggaatgatgaggcact

SEQ ID NO: 7087710 - DNA, 22 bp, Homo sapiens
cccacgtcgaacttgctccaga

SEQ ID NO: 7087711 - DNA, 18 bp, Homo sapiens
cccacggtgctgtagggc

SEQ ID NO: 7087712 - DNA, 22 bp, Homo sapiens
cccacgtcgaacttgctccaga

SEQ ID NO: 7087713 - DNA, 22 bp, Homo sapiens
cccacgtcgaacttgctccaga

SEQ ID NO: 7087714 - DNA, 22 bp, Homo sapiens
cccacgtcgaacttgctccaga

SEQ ID NO: 7087715 - DNA, 22 bp, Homo sapiens
cccacgttgaaccgcttacaga

SEQ ID NO: 7087716 - DNA, 22 bp, Homo sapiens
cccactccctacgacacgctcc

SEQ ID NO: 7087717 - DNA, 22 bp, Homo sapiens
cccactccctacgacacgctcc

SEQ ID NO: 7087718 - DNA, 22 bp, Homo sapiens
cccactccctacgacacgctcc

SEQ ID NO: 7087719 - DNA, 22 bp, Homo sapiens
cccactgcatgagttggtatta

SEQ ID NO: 7087720 - DNA, 22 bp, Homo sapiens
cccactgctgctctccatggca

SEQ ID NO: 7087721 - DNA, 22 bp, Homo sapiens
cccactgctgctctccatggca

SEQ ID NO: 7087722 - DNA, 22 bp, Homo sapiens
aggctgtgacagggtcatggag

SEQ ID NO: 7087723 - DNA, 22 bp, Homo sapiens
cccactctggctcccttctagt

SEQ ID NO: 7087724 - DNA, 22 bp, Homo sapiens
cccactgagcctatacaaacag

SEQ ID NO: 7087725 - DNA, 22 bp, Homo sapiens
cccactccctgcacgcctgccg

SEQ ID NO: 7087726 - DNA, 22 bp, Homo sapiens
cccactcctggagctagggctc

SEQ ID NO: 7087727 - DNA, 22 bp, Homo sapiens
cccactcctggagctagggctc

SEQ ID NO: 7087728 - DNA, 22 bp, Homo sapiens
cccactcctggagctagggctc

SEQ ID NO: 7087729 - DNA, 22 bp, Homo sapiens
cccactctggctcccttctagt

SEQ ID NO: 7087730 - DNA, 22 bp, Homo sapiens
aggctgtgcacagggcacctgc

SEQ ID NO: 7087731 - DNA, 21 bp, Homo sapiens
aggctgtgacttacactatct

SEQ ID NO: 7087732 - DNA, 22 bp, Homo sapiens
aggctgtgacagggtcatggag

SEQ ID NO: 7087733 - DNA, 22 bp, Homo sapiens
aggctgtgactacgcagggaag

SEQ ID NO: 7087734 - DNA, 22 bp, Homo sapiens
aggctgtgactacgcagggaag

SEQ ID NO: 7087735 - DNA, 22 bp, Homo sapiens
aggctgtgcattttggagggcc

SEQ ID NO: 7087736 - DNA, 22 bp, Homo sapiens
aggctgtgcattttggagggcc

SEQ ID NO: 7087737 - DNA, 22 bp, Homo sapiens
aggctgtgcattttggagggcc

SEQ ID NO: 7087738 - DNA, 22 bp, Homo sapiens
aggctgtgcattttggagggcc

SEQ ID NO: 7087739 - DNA, 22 bp, Homo sapiens
aggctgtgcacagggcacctgc

SEQ ID NO: 7087740 - DNA, 22 bp, Homo sapiens
aggctgtgcacagggcacctgc

SEQ ID NO: 7087741 - DNA, 22 bp, Homo sapiens
aggctgtgcacagggcacctgc

SEQ ID NO: 7087742 - DNA, 22 bp, Homo sapiens
aggctgtgcacagggcacctgc

SEQ ID NO: 7087743 - DNA, 22 bp, Homo sapiens
aggctgtggtgctgaaggaggg

SEQ ID NO: 7087744 - DNA, 22 bp, Homo sapiens
aggctgtggtgctgaaggaggg

SEQ ID NO: 7087745 - DNA, 22 bp, Homo sapiens
aggctgtggtgctgaaggaggg

SEQ ID NO: 7087746 - DNA, 22 bp, Homo sapiens
aggctgtgggtgatttactgtg

SEQ ID NO: 7087747 - DNA, 22 bp, Homo sapiens
aggctgtggtgatgattgggtc

SEQ ID NO: 7087748 - DNA, 22 bp, Homo sapiens
cccagaggtgacatcccattct

SEQ ID NO: 7087749 - DNA, 22 bp, Homo sapiens
cccagaggtgcttcagaggtgc

SEQ ID NO: 7087750 - DNA, 22 bp, Homo sapiens
cccagaggtgacatcccattct

SEQ ID NO: 7087751 - DNA, 22 bp, Homo sapiens
cccagaggtgaaggaggtggga

SEQ ID NO: 7087752 - DNA, 22 bp, Homo sapiens
cccagaggtgaaggaggtggga

SEQ ID NO: 7087753 - DNA, 22 bp, Homo sapiens
cccagaggttccttagggacca

SEQ ID NO: 7087754 - DNA, 22 bp, Homo sapiens
cccagaggttccttagggacca

SEQ ID NO: 7087755 - DNA, 22 bp, Homo sapiens
cccagaggtgcttcagaggtgc

SEQ ID NO: 7087756 - DNA, 20 bp, Homo sapiens
cccagaggttgcggcaggag

SEQ ID NO: 7087757 - DNA, 20 bp, Homo sapiens
cccagaggttgcggcaggag

SEQ ID NO: 7087758 - DNA, 22 bp, Homo sapiens
cccagaggttccttagggacca

SEQ ID NO: 7087759 - DNA, 22 bp, Homo sapiens
cccagaggttccttagggacca

SEQ ID NO: 7087760 - DNA, 22 bp, Homo sapiens
cccagaggttccttagggacca

SEQ ID NO: 7087761 - DNA, 22 bp, Homo sapiens
aggctgtggcattaaacgtttg

SEQ ID NO: 7087762 - DNA, 22 bp, Homo sapiens
aggctgtggcattaaacgtttg

SEQ ID NO: 7087763 - DNA, 22 bp, Homo sapiens
aggctgtggccctggtctagca

SEQ ID NO: 7087764 - DNA, 22 bp, Homo sapiens
aggctgtggccctggtctagca

SEQ ID NO: 7087765 - DNA, 22 bp, Homo sapiens
aggctgtggcatcacatcagga

SEQ ID NO: 7087766 - DNA, 22 bp, Homo sapiens
aggctgtgcgaggtctcagagt

SEQ ID NO: 7087767 - DNA, 22 bp, Homo sapiens
aggctgtgcgaggtctcagagt

SEQ ID NO: 7087768 - DNA, 22 bp, Homo sapiens
aggctgtgctcagccaatggga

SEQ ID NO: 7087769 - DNA, 22 bp, Homo sapiens
aggctgtgctcagccaatggga

SEQ ID NO: 7087770 - DNA, 22 bp, Homo sapiens
aggctgtggatgcttaacaaat

SEQ ID NO: 7087771 - DNA, 22 bp, Homo sapiens
aggctgtgggaatggctgcttg

SEQ ID NO: 7087772 - DNA, 22 bp, Homo sapiens
aggctgtgggaatggctgcttg

SEQ ID NO: 7087773 - DNA, 22 bp, Homo sapiens
aggctgtgggagttgagagtct

SEQ ID NO: 7087774 - DNA, 22 bp, Homo sapiens
aggctgtggggttctgctttca

SEQ ID NO: 7087775 - DNA, 22 bp, Homo sapiens
aggctgtgggacagttaggaga

SEQ ID NO: 7087776 - DNA, 22 bp, Homo sapiens
aggctgtgggaatggctgcttg

SEQ ID NO: 7087777 - DNA, 22 bp, Homo sapiens
aggctgtgggaatggctgcttg

SEQ ID NO: 7087778 - DNA, 22 bp, Homo sapiens
aggctgtgggacagttaggaga

SEQ ID NO: 7087779 - DNA, 22 bp, Homo sapiens
aggctgtgggacagttaggaga

SEQ ID NO: 7087780 - DNA, 22 bp, Homo sapiens
aggctgtgggagttgagagtct

SEQ ID NO: 7087781 - DNA, 22 bp, Homo sapiens
aggctgtgggagttgagagtct

SEQ ID NO: 7087782 - DNA, 22 bp, Homo sapiens
aggctctgtatgaaggtttggg

SEQ ID NO: 7087783 - DNA, 19 bp, Homo sapiens
aggctctgtaggagagggc

SEQ ID NO: 7087784 - DNA, 19 bp, Homo sapiens
aggctctgtaggagagggc

SEQ ID NO: 7087785 - DNA, 19 bp, Homo sapiens
aggctctgtaggagagggc

SEQ ID NO: 7087786 - DNA, 19 bp, Homo sapiens
aggctctgtaggagagggc

SEQ ID NO: 7087787 - DNA, 19 bp, Homo sapiens
aggctctgtaggagagggc

SEQ ID NO: 7087788 - DNA, 19 bp, Homo sapiens
aggctctgtaggagagggc

SEQ ID NO: 7087789 - DNA, 22 bp, Homo sapiens
aggctctgtcaggcggagcagc

SEQ ID NO: 7087790 - DNA, 22 bp, Homo sapiens
aggctctgtcaggcggagcagc

SEQ ID NO: 7087791 - DNA, 22 bp, Homo sapiens
aggctctgtcaggcggagcagc

SEQ ID NO: 7087792 - DNA, 22 bp, Homo sapiens
ccagggcacttaggcccagccc

SEQ ID NO: 7087793 - DNA, 22 bp, Homo sapiens
ccagggcacttaggcccagccc

SEQ ID NO: 7087794 - DNA, 22 bp, Homo sapiens
ccagggcacttaggcccagccc

SEQ ID NO: 7087795 - DNA, 22 bp, Homo sapiens
ccagggcagaaaaagagggaat

SEQ ID NO: 7087796 - DNA, 22 bp, Homo sapiens
ccagggcagaaaaagagggaat

SEQ ID NO: 7087797 - DNA, 22 bp, Homo sapiens
ccagggcagaaaaagagggaat

SEQ ID NO: 7087798 - DNA, 22 bp, Homo sapiens
ccagggcacttaggcccagccc

SEQ ID NO: 7087799 - DNA, 22 bp, Homo sapiens
ccagggcagaaaaagagggaat

SEQ ID NO: 7087800 - DNA, 22 bp, Homo sapiens
ccagggcagcagaattggggca

SEQ ID NO: 7087801 - DNA, 22 bp, Homo sapiens
ccagggcagcagaattggggca

SEQ ID NO: 7087802 - DNA, 16 bp, Homo sapiens
ccaggtggggctgtga

SEQ ID NO: 7087803 - DNA, 22 bp, Homo sapiens
ccaggtggtgaaagtgggccct

SEQ ID NO: 7087804 - DNA, 22 bp, Homo sapiens
ccaggtgcactcaagacctgct

SEQ ID NO: 7087805 - DNA, 22 bp, Homo sapiens
ccaggtgcactcaagacctgct

SEQ ID NO: 7087806 - DNA, 22 bp, Homo sapiens
ccaggtgcaaactcccagcagg

SEQ ID NO: 7087807 - DNA, 22 bp, Homo sapiens
ccaggtgcctccagtcacagtg

SEQ ID NO: 7087808 - DNA, 22 bp, Homo sapiens
ccaggtgctagcaatcactgtc

SEQ ID NO: 7087809 - DNA, 22 bp, Homo sapiens
ccaggtgggcgtgtcttcacct

SEQ ID NO: 7087810 - DNA, 22 bp, Homo sapiens
ccagggcagcagaattggggca

SEQ ID NO: 7087811 - DNA, 22 bp, Homo sapiens
ccagggcagcagaattggggca

SEQ ID NO: 7087812 - DNA, 22 bp, Homo sapiens
ccagggcagccaacccagatgc

SEQ ID NO: 7087813 - DNA, 22 bp, Homo sapiens
ccagggcagccaacccagatgc

SEQ ID NO: 7087814 - DNA, 22 bp, Homo sapiens
ccagggcagccaacccagatgc

SEQ ID NO: 7087815 - DNA, 22 bp, Homo sapiens
ccagggcagccaacccagatgc

SEQ ID NO: 7087816 - DNA, 22 bp, Homo sapiens
ccagggcagcgcccctccacgc

SEQ ID NO: 7087817 - DNA, 22 bp, Homo sapiens
ccagggcagcgcccctccacgc

SEQ ID NO: 7087818 - DNA, 22 bp, Homo sapiens
aggctgagtgctcccctagatg

SEQ ID NO: 7087819 - DNA, 22 bp, Homo sapiens
ccagtcacaggtgtgtttatat

SEQ ID NO: 7087820 - DNA, 17 bp, Homo sapiens
ccagtcacaccaccctt

SEQ ID NO: 7087821 - DNA, 21 bp, Homo sapiens
ccagtattatttctctatgta

SEQ ID NO: 7087822 - DNA, 22 bp, Homo sapiens
ccagtattgtgaaattgatgtc

SEQ ID NO: 7087823 - DNA, 17 bp, Homo sapiens
ccagtagcctgagatgt

SEQ ID NO: 7087824 - DNA, 17 bp, Homo sapiens
ccagtagcctgagatgt

SEQ ID NO: 7087825 - DNA, 22 bp, Homo sapiens
ccagtagtagctctttgtgctc

SEQ ID NO: 7087826 - DNA, 22 bp, Homo sapiens
ccagtagtagtttgttctttaa

SEQ ID NO: 7087827 - DNA, 19 bp, Homo sapiens
ccagtagtatagcacagtc

SEQ ID NO: 7087828 - DNA, 22 bp, Homo sapiens
ccagtagttccaggaacctcct

SEQ ID NO: 7087829 - DNA, 22 bp, Homo sapiens
ccagtagttggacaaatagatt

SEQ ID NO: 7087830 - DNA, 22 bp, Homo sapiens
ccaggtgtttggcctgcatgat

SEQ ID NO: 7087831 - DNA, 22 bp, Homo sapiens
ccaggtgtttggcctgcatgat

SEQ ID NO: 7087832 - DNA, 22 bp, Homo sapiens
ccagtaaaaagcgacaggaagt

SEQ ID NO: 7087833 - DNA, 22 bp, Homo sapiens
ccagtaaaccaagtgtttacta

SEQ ID NO: 7087834 - DNA, 22 bp, Homo sapiens
ccagtaaaccaagtgtttacta

SEQ ID NO: 7087835 - DNA, 22 bp, Homo sapiens
ccagtaaaaagcgacaggaagt

SEQ ID NO: 7087836 - DNA, 22 bp, Homo sapiens
ccagtaaaccaagtgtttacta

SEQ ID NO: 7087837 - DNA, 23 bp, Homo sapiens
ccagtaaacccttcctcagtgtc

SEQ ID NO: 7087838 - DNA, 22 bp, Homo sapiens
ccagtaaattacttgatgtcat

SEQ ID NO: 7087839 - DNA, 22 bp, Homo sapiens
ccagtaaattacttgatgtcat

SEQ ID NO: 7087840 - DNA, 23 bp, Homo sapiens
ccagtaaacccttcctcagtgtc

SEQ ID NO: 7087841 - DNA, 22 bp, Homo sapiens
ccagtaaattacttgatgtcat

SEQ ID NO: 7087842 - DNA, 22 bp, Homo sapiens
ccagtacacctcacttcccttt

SEQ ID NO: 7087843 - DNA, 22 bp, Homo sapiens
ccagtacacctcacttcccttt

SEQ ID NO: 7087844 - DNA, 22 bp, Homo sapiens
ccagtacatcgcatggtgacca

SEQ ID NO: 7087845 - DNA, 18 bp, Homo sapiens
ccagtacctcctcctctc

SEQ ID NO: 7087846 - DNA, 22 bp, Homo sapiens
ccaggtgttctttgtccctgtt

SEQ ID NO: 7087847 - DNA, 22 bp, Homo sapiens
ccaggtgttacacgagtgttaa

SEQ ID NO: 7087848 - DNA, 22 bp, Homo sapiens
ccaggtgtgtctggccccgaag

SEQ ID NO: 7087849 - DNA, 22 bp, Homo sapiens
ccaggtgttacacgagtgttaa

SEQ ID NO: 7087850 - DNA, 22 bp, Homo sapiens
ccaggtgttctttgtccctgtt

SEQ ID NO: 7087851 - DNA, 22 bp, Homo sapiens
ccaggtgtttggcctgcatgat

SEQ ID NO: 7087852 - DNA, 22 bp, Homo sapiens
ccaggtgtttggcctgcatgat

SEQ ID NO: 7087853 - DNA, 22 bp, Homo sapiens
ccaggtgtttggcctgcatgat

SEQ ID NO: 7087854 - DNA, 22 bp, Homo sapiens
ccaggtggttcaggtcaccata

SEQ ID NO: 7087855 - DNA, 22 bp, Homo sapiens
ccaggtggttcaggtcaccata

SEQ ID NO: 7087856 - DNA, 20 bp, Homo sapiens
ccaggtggtgcctggagagg

SEQ ID NO: 7087857 - DNA, 22 bp, Homo sapiens
ccaggtggttcaggtcaccata

SEQ ID NO: 7087858 - DNA, 20 bp, Homo sapiens
ccaggtggtgcctggagagg

SEQ ID NO: 7087859 - DNA, 20 bp, Homo sapiens
ccaggtggtgcctggagagg

SEQ ID NO: 7087860 - DNA, 20 bp, Homo sapiens
ccaggtggtgcctggagagg

SEQ ID NO: 7087861 - DNA, 20 bp, Homo sapiens
ccaggtggtgcctggagagg

SEQ ID NO: 7087862 - DNA, 22 bp, Homo sapiens
ccaggtggtgcctctgttcgca

SEQ ID NO: 7087863 - DNA, 22 bp, Homo sapiens
ccaggtggtgcctctgttcgca

SEQ ID NO: 7087864 - DNA, 18 bp, Homo sapiens
ccaggtggtgacagagat

SEQ ID NO: 7087865 - DNA, 22 bp, Homo sapiens
ccaggtggtgaaagtgggccct

SEQ ID NO: 7087866 - DNA, 18 bp, Homo sapiens
ccaggtggtgacagagat

SEQ ID NO: 7087867 - DNA, 18 bp, Homo sapiens
ccaggtggtgacagagat

SEQ ID NO: 7087868 - DNA, 22 bp, Homo sapiens
aggctctggttcatcatgatgg

SEQ ID NO: 7087869 - DNA, 22 bp, Homo sapiens
aggctctggttggcaagtaaag

SEQ ID NO: 7087870 - DNA, 22 bp, Homo sapiens
aggctctggttggcaagtaaag

SEQ ID NO: 7087871 - DNA, 22 bp, Homo sapiens
aggctctggttggcaagtaaag

SEQ ID NO: 7087872 - DNA, 22 bp, Homo sapiens
aggctctggttggcaagtaaag

SEQ ID NO: 7087873 - DNA, 22 bp, Homo sapiens
aggctctggttggcaagtaaag

SEQ ID NO: 7087874 - DNA, 19 bp, Homo sapiens
aggctctgtaggagagggc

SEQ ID NO: 7087875 - DNA, 22 bp, Homo sapiens
aggctctgggctctagattttg

SEQ ID NO: 7087876 - DNA, 22 bp, Homo sapiens
aggctctggtgcagctgtaact

SEQ ID NO: 7087877 - DNA, 22 bp, Homo sapiens
aggctctggtgcagctgtaact

SEQ ID NO: 7087878 - DNA, 22 bp, Homo sapiens
aggctctgggaagcagtgagtt

SEQ ID NO: 7087879 - DNA, 22 bp, Homo sapiens
aggctctgggaagcagtgagtt

SEQ ID NO: 7087880 - DNA, 22 bp, Homo sapiens
aggctctgggaacagacgggtg

SEQ ID NO: 7087881 - DNA, 22 bp, Homo sapiens
aggctctgggaacagacgggtg

SEQ ID NO: 7087882 - DNA, 22 bp, Homo sapiens
aggctctgggaacagacgggtg

SEQ ID NO: 7087883 - DNA, 22 bp, Homo sapiens
aggctctgggaacagacgggtg

SEQ ID NO: 7087884 - DNA, 22 bp, Homo sapiens
aggctctgggaacagacgggtg

SEQ ID NO: 7087885 - DNA, 22 bp, Homo sapiens
aggctctgggaacagacgggtg

SEQ ID NO: 7087886 - DNA, 22 bp, Homo sapiens
aggctctgggaacagacgggtg

SEQ ID NO: 7087887 - DNA, 22 bp, Homo sapiens
aggctctgggaagcagtgagtt

SEQ ID NO: 7087888 - DNA, 22 bp, Homo sapiens
aggctctgggaagcagtgagtt

SEQ ID NO: 7087889 - DNA, 22 bp, Homo sapiens
aggctctgggaagcagtgagtt

SEQ ID NO: 7087890 - DNA, 22 bp, Homo sapiens
aggctctgggaagcagtgagtt

SEQ ID NO: 7087891 - DNA, 22 bp, Homo sapiens
aggctctgggaagcagtgagtt

SEQ ID NO: 7087892 - DNA, 21 bp, Homo sapiens
aggctcagcaggtgtataaag

SEQ ID NO: 7087893 - DNA, 21 bp, Homo sapiens
aggctcagcaggtgtataaag

SEQ ID NO: 7087894 - DNA, 21 bp, Homo sapiens
aggctcagcaggtgtataaag

SEQ ID NO: 7087895 - DNA, 21 bp, Homo sapiens
aggctcagcaggtgtataaag

SEQ ID NO: 7087896 - DNA, 22 bp, Homo sapiens
aggctcagcatctgattcatat

SEQ ID NO: 7087897 - DNA, 22 bp, Homo sapiens
aggctcagcatctgattcatat

SEQ ID NO: 7087898 - DNA, 22 bp, Homo sapiens
aggctcagcatctgattcatat

SEQ ID NO: 7087899 - DNA, 22 bp, Homo sapiens
aggctcagcatctgattcatat

SEQ ID NO: 7087900 - DNA, 22 bp, Homo sapiens
aggctcagcccaaggtggagag

SEQ ID NO: 7087901 - DNA, 22 bp, Homo sapiens
aggctcagcccaaggtggagag

SEQ ID NO: 7087902 - DNA, 22 bp, Homo sapiens
aggctcagcccaaggtggagag

SEQ ID NO: 7087903 - DNA, 22 bp, Homo sapiens
aggctcagcccaaggtggagag

SEQ ID NO: 7087904 - DNA, 22 bp, Homo sapiens
aggctcagcccaaggtggagag

SEQ ID NO: 7087905 - DNA, 22 bp, Homo sapiens
aggctcagcccaaggtggagag

SEQ ID NO: 7087906 - DNA, 22 bp, Homo sapiens
aggctcagcccctgggaggaga

SEQ ID NO: 7087907 - DNA, 22 bp, Homo sapiens
aggctcagcccctgggaggaga

SEQ ID NO: 7087908 - DNA, 22 bp, Homo sapiens
aggctcagcccctgggaggaga

SEQ ID NO: 7087909 - DNA, 22 bp, Homo sapiens
aggctcagcccctgggaggaga

SEQ ID NO: 7087910 - DNA, 22 bp, Homo sapiens
aggctcagcccctgggaggaga

SEQ ID NO: 7087911 - DNA, 22 bp, Homo sapiens
aggctcagcccctgggaggaga

SEQ ID NO: 7087912 - DNA, 22 bp, Homo sapiens
aggctcagcctgggcctagagc

SEQ ID NO: 7087913 - DNA, 22 bp, Homo sapiens
aggctcagcctgggcctagagc

SEQ ID NO: 7087914 - DNA, 22 bp, Homo sapiens
aggctcagcctgggcctagagc

SEQ ID NO: 7087915 - DNA, 20 bp, Homo sapiens
aggctctgcctgcaggccca

SEQ ID NO: 7087916 - DNA, 20 bp, Homo sapiens
aggctcagatacccagggaa

SEQ ID NO: 7087917 - DNA, 22 bp, Homo sapiens
aggctcagatccttgtgtcctg

SEQ ID NO: 7087918 - DNA, 22 bp, Homo sapiens
aggctcagatccttgtgtcctg

SEQ ID NO: 7087919 - DNA, 22 bp, Homo sapiens
aggctcagatccttgtgtcctg

SEQ ID NO: 7087920 - DNA, 22 bp, Homo sapiens
aggctcagatccttgtgtcctg

SEQ ID NO: 7087921 - DNA, 22 bp, Homo sapiens
aggctcagatccttgtgtcctg

SEQ ID NO: 7087922 - DNA, 22 bp, Homo sapiens
aggctcagatccttgtgtcctg

SEQ ID NO: 7087923 - DNA, 22 bp, Homo sapiens
aggctcagattcacatttggtt

SEQ ID NO: 7087924 - DNA, 22 bp, Homo sapiens
aggctcagattcacatttggtt

SEQ ID NO: 7087925 - DNA, 22 bp, Homo sapiens
aggctcagattcacatttggtt

SEQ ID NO: 7087926 - DNA, 22 bp, Homo sapiens
ccaggccttctgaggacactct

SEQ ID NO: 7087927 - DNA, 22 bp, Homo sapiens
ccaggccttctgaggacactct

SEQ ID NO: 7087928 - DNA, 22 bp, Homo sapiens
ccaggccttctgaggacactct

SEQ ID NO: 7087929 - DNA, 22 bp, Homo sapiens
ccaggccttccagtacgcagaa

SEQ ID NO: 7087930 - DNA, 22 bp, Homo sapiens
ccaggccttccagtacgcagaa

SEQ ID NO: 7087931 - DNA, 22 bp, Homo sapiens
ccaggccttctgaggacactct

SEQ ID NO: 7087932 - DNA, 22 bp, Homo sapiens
ccaggcctttcttcttggtctg

SEQ ID NO: 7087933 - DNA, 22 bp, Homo sapiens
ccaggcctttcttcttggtctg

SEQ ID NO: 7087934 - DNA, 22 bp, Homo sapiens
ccaggcctttcttcttggtctg

SEQ ID NO: 7087935 - DNA, 20 bp, Homo sapiens
ccaggcctgggcctgctcta

SEQ ID NO: 7087936 - DNA, 22 bp, Homo sapiens
ccaggcctcccttttccagcca

SEQ ID NO: 7087937 - DNA, 22 bp, Homo sapiens
ccaggcctcccttttccagcca

SEQ ID NO: 7087938 - DNA, 22 bp, Homo sapiens
ccaggcctcccttttccagcca

SEQ ID NO: 7087939 - DNA, 19 bp, Homo sapiens
ccaggcctggcgtctccgc

SEQ ID NO: 7087940 - DNA, 20 bp, Homo sapiens
ccaggcctgggcctgctcta

SEQ ID NO: 7087941 - DNA, 20 bp, Homo sapiens
ccaggcctgggcctgctcta

SEQ ID NO: 7087942 - DNA, 20 bp, Homo sapiens
ccaggcctgggcctgctcta

SEQ ID NO: 7087943 - DNA, 20 bp, Homo sapiens
ccaggcctgggcctgctcta

SEQ ID NO: 7087944 - DNA, 22 bp, Homo sapiens
ccaggcctgtgcaaggagggag

SEQ ID NO: 7087945 - DNA, 22 bp, Homo sapiens
ccaggcctgtgcaaggagggag

SEQ ID NO: 7087946 - DNA, 22 bp, Homo sapiens
ccaggcctgtgcaaggagggag

SEQ ID NO: 7087947 - DNA, 22 bp, Homo sapiens
ccaggcctgtgttgtgtggagg

SEQ ID NO: 7087948 - DNA, 22 bp, Homo sapiens
ccaggcctgtgttgtgtggagg

SEQ ID NO: 7087949 - DNA, 22 bp, Homo sapiens
ccaggccttccagtacgcagaa

SEQ ID NO: 7087950 - DNA, 22 bp, Homo sapiens
ccaggccttccagtacgcagaa

SEQ ID NO: 7087951 - DNA, 22 bp, Homo sapiens
aggacaggtgtagtgggctctg

SEQ ID NO: 7087952 - DNA, 22 bp, Homo sapiens
aggacagggattcaaactccca

SEQ ID NO: 7087953 - DNA, 22 bp, Homo sapiens
aggacagggattcaaactccca

SEQ ID NO: 7087954 - DNA, 22 bp, Homo sapiens
aggacaggattgagctgaactg

SEQ ID NO: 7087955 - DNA, 22 bp, Homo sapiens
aggacacagtggtggggaaaag

SEQ ID NO: 7087956 - DNA, 22 bp, Homo sapiens
aggacaggattgagctgaactg

SEQ ID NO: 7087957 - DNA, 22 bp, Homo sapiens
aggacaggattgagctgaactg

SEQ ID NO: 7087958 - DNA, 22 bp, Homo sapiens
acagggctatattcctcagagc

SEQ ID NO: 7087959 - DNA, 22 bp, Homo sapiens
aggacacaggtaagccagtgga

SEQ ID NO: 7087960 - DNA, 23 bp, Homo sapiens
acagggctagctgacagtggtat

SEQ ID NO: 7087961 - DNA, 22 bp, Homo sapiens
acagggccttatatccagaagg

SEQ ID NO: 7087962 - DNA, 22 bp, Homo sapiens
acagggcctttgatggattata

SEQ ID NO: 7087963 - DNA, 23 bp, Homo sapiens
acagggctagctgacagtggtat

SEQ ID NO: 7087964 - DNA, 23 bp, Homo sapiens
acagggctagctgacagtggtat

SEQ ID NO: 7087965 - DNA, 22 bp, Homo sapiens
acagggcctggctccaaaagat

SEQ ID NO: 7087966 - DNA, 22 bp, Homo sapiens
acagggccattggaggattata

SEQ ID NO: 7087967 - DNA, 22 bp, Homo sapiens
acagggccattatctgttctag

SEQ ID NO: 7087968 - DNA, 22 bp, Homo sapiens
acagggccagcctgggacctgg

SEQ ID NO: 7087969 - DNA, 22 bp, Homo sapiens
acagggccaggtgagaggtgct

SEQ ID NO: 7087970 - DNA, 22 bp, Homo sapiens
acagggcctcagccagggcaga

SEQ ID NO: 7087971 - DNA, 22 bp, Homo sapiens
acagggcccttgccagcacaag

SEQ ID NO: 7087972 - DNA, 22 bp, Homo sapiens
acagggccctgtgggccccact

SEQ ID NO: 7087973 - DNA, 22 bp, Homo sapiens
acagggcccttagatcctttta

SEQ ID NO: 7087974 - DNA, 22 bp, Homo sapiens
acagggcccttgccagcacaag

SEQ ID NO: 7087975 - DNA, 22 bp, Homo sapiens
acagggcctcagccagggcaga

SEQ ID NO: 7087976 - DNA, 22 bp, Homo sapiens
acagggcctcagctgattctgg

SEQ ID NO: 7087977 - DNA, 22 bp, Homo sapiens
aggactggtgccagacaaggta

SEQ ID NO: 7087978 - DNA, 22 bp, Homo sapiens
aggactggtgtgtgatcagcat

SEQ ID NO: 7087979 - DNA, 22 bp, Homo sapiens
aggactgggtgcagagggcatc

SEQ ID NO: 7087980 - DNA, 22 bp, Homo sapiens
aggactggcggtcggtggggat

SEQ ID NO: 7087981 - DNA, 22 bp, Homo sapiens
aggactggccctgaggggaggc

SEQ ID NO: 7087982 - DNA, 22 bp, Homo sapiens
aggactggccctgaggggaggc

SEQ ID NO: 7087983 - DNA, 22 bp, Homo sapiens
aggactggcagtgtgaggggtc

SEQ ID NO: 7087984 - DNA, 22 bp, Homo sapiens
aggactggccctgaggggaggc

SEQ ID NO: 7087985 - DNA, 22 bp, Homo sapiens
aggactggcagtgtgaggggtc

SEQ ID NO: 7087986 - DNA, 22 bp, Homo sapiens
aggacatgtaaatggagaggga

SEQ ID NO: 7087987 - DNA, 22 bp, Homo sapiens
aggacatgtaaatggagaggga

SEQ ID NO: 7087988 - DNA, 22 bp, Homo sapiens
aggacagttagttaggaagttt

SEQ ID NO: 7087989 - DNA, 22 bp, Homo sapiens
aggacatgaagaaagggcaagg

SEQ ID NO: 7087990 - DNA, 22 bp, Homo sapiens
aggacagttagttaggaagttt

SEQ ID NO: 7087991 - DNA, 22 bp, Homo sapiens
aggacagtgtggaagagggtgc

SEQ ID NO: 7087992 - DNA, 22 bp, Homo sapiens
aggacagtggcaaggcaggaca

SEQ ID NO: 7087993 - DNA, 22 bp, Homo sapiens
aggacagtggcaaggcaggaca

SEQ ID NO: 7087994 - DNA, 22 bp, Homo sapiens
aggacagtggcaaggcaggaca

SEQ ID NO: 7087995 - DNA, 22 bp, Homo sapiens
aggacagtggcagggtgacaga

SEQ ID NO: 7087996 - DNA, 22 bp, Homo sapiens
aggacagtggcagggtgacaga

SEQ ID NO: 7087997 - DNA, 22 bp, Homo sapiens
aggacagtggtgttctggagtg

SEQ ID NO: 7087998 - DNA, 22 bp, Homo sapiens
aggacagtggtgttctggagtg

SEQ ID NO: 7087999 - DNA, 22 bp, Homo sapiens
aggacagtggtgttctggagtg

SEQ ID NO: 7088000 - DNA, 22 bp, Homo sapiens
aggacagtggtgttctggagtg

SEQ ID NO: 7088001 - DNA, 23 bp, Homo sapiens
aggacagtggaatttagggattg

SEQ ID NO: 7088002 - DNA, 22 bp, Homo sapiens
aggacagtataggctttaggag

SEQ ID NO: 7088003 - DNA, 22 bp, Homo sapiens
aggacaggtgtagtgggctctg

SEQ ID NO: 7088004 - DNA, 22 bp, Homo sapiens
aggacaggtgtagtgggctctg

SEQ ID NO: 7088005 - DNA, 22 bp, Homo sapiens
aggacaggtgtagtgggctctg

SEQ ID NO: 7088006 - DNA, 22 bp, Homo sapiens
aggacaggtgtagtgggctctg

SEQ ID NO: 7088007 - DNA, 22 bp, Homo sapiens
acaggcctgtgtgcacacgagg

SEQ ID NO: 7088008 - DNA, 22 bp, Homo sapiens
aggaaataggaccagacaaagc

SEQ ID NO: 7088009 - DNA, 22 bp, Homo sapiens
aggaaataggaccagacaaagc

SEQ ID NO: 7088010 - DNA, 22 bp, Homo sapiens
aggaaataagggcacttcagat

SEQ ID NO: 7088011 - DNA, 22 bp, Homo sapiens
aggaaataggaccagacaaagc

SEQ ID NO: 7088012 - DNA, 22 bp, Homo sapiens
aggaaataagggacaagacaaa

SEQ ID NO: 7088013 - DNA, 22 bp, Homo sapiens
aggaaataagggacaagacaaa

SEQ ID NO: 7088014 - DNA, 22 bp, Homo sapiens
aggaaataagggacaagacaaa

SEQ ID NO: 7088015 - DNA, 22 bp, Homo sapiens
aggaaataagggcacttcagat

SEQ ID NO: 7088016 - DNA, 22 bp, Homo sapiens
acaggcctgtgtgcacacgagg

SEQ ID NO: 7088017 - DNA, 22 bp, Homo sapiens
acaggccttaggagagatgggg

SEQ ID NO: 7088018 - DNA, 22 bp, Homo sapiens
acaggccttaggagagatgggg

SEQ ID NO: 7088019 - DNA, 22 bp, Homo sapiens
acaggccttaggagagatgggg

SEQ ID NO: 7088020 - DNA, 22 bp, Homo sapiens
acaggccttggcaggcatgtga

SEQ ID NO: 7088021 - DNA, 22 bp, Homo sapiens
acaggccttggcaggcatgtga

SEQ ID NO: 7088022 - DNA, 22 bp, Homo sapiens
acaggccttggcaggcatgtga

SEQ ID NO: 7088023 - DNA, 22 bp, Homo sapiens
acaggccttggtcctgacctaa

SEQ ID NO: 7088024 - DNA, 18 bp, Homo sapiens
acaggctattgcaggaga

SEQ ID NO: 7088025 - DNA, 22 bp, Homo sapiens
acaggctcacagtcatttcatt

SEQ ID NO: 7088026 - DNA, 22 bp, Homo sapiens
acaggctcacagtcatttcatt

SEQ ID NO: 7088027 - DNA, 22 bp, Homo sapiens
aggaaaggttcagtgattgaaa

SEQ ID NO: 7088028 - DNA, 22 bp, Homo sapiens
aggaaaggttcagtgattgaaa

SEQ ID NO: 7088029 - DNA, 17 bp, Homo sapiens
aggaaagtctgctgtcc

SEQ ID NO: 7088030 - DNA, 17 bp, Homo sapiens
aggaaagtctgctgtcc

SEQ ID NO: 7088031 - DNA, 19 bp, Homo sapiens
aggaaaggtggccttagca

SEQ ID NO: 7088032 - DNA, 22 bp, Homo sapiens
aggaaaggtgagagcggccgcg

SEQ ID NO: 7088033 - DNA, 19 bp, Homo sapiens
aggaaaggtggccttagca

SEQ ID NO: 7088034 - DNA, 19 bp, Homo sapiens
aggaaaggtggccttagca

SEQ ID NO: 7088035 - DNA, 22 bp, Homo sapiens
aggaaaggtgagagcggccgcg

SEQ ID NO: 7088036 - DNA, 22 bp, Homo sapiens
aggaaaggtgagagcggccgcg

SEQ ID NO: 7088037 - DNA, 22 bp, Homo sapiens
aggaaaggtagcgtgccagcag

SEQ ID NO: 7088038 - DNA, 22 bp, Homo sapiens
aggaaaggtagcgtgccagcag

SEQ ID NO: 7088039 - DNA, 22 bp, Homo sapiens
aggaaaggggtaggtgtggacg

SEQ ID NO: 7088040 - DNA, 22 bp, Homo sapiens
aggaaaggtagcgtgccagcag

SEQ ID NO: 7088041 - DNA, 22 bp, Homo sapiens
aggaaaggtagcgtgccagcag

SEQ ID NO: 7088042 - DNA, 22 bp, Homo sapiens
aggaaaggggtaggtgtggacg

SEQ ID NO: 7088043 - DNA, 22 bp, Homo sapiens
aggaaaggggtaggtgtggacg

SEQ ID NO: 7088044 - DNA, 22 bp, Homo sapiens
acagggcatttcctctatgtgt

SEQ ID NO: 7088045 - DNA, 23 bp, Homo sapiens
acagggcattgctggcctcgagg

SEQ ID NO: 7088046 - DNA, 23 bp, Homo sapiens
acagggcattgctggcctcgagg

SEQ ID NO: 7088047 - DNA, 23 bp, Homo sapiens
acagggcattgctggcctcgagg

SEQ ID NO: 7088048 - DNA, 22 bp, Homo sapiens
acagggcatttcctctatgtgt

SEQ ID NO: 7088049 - DNA, 22 bp, Homo sapiens
acagggcatttcctctatgtgt

SEQ ID NO: 7088050 - DNA, 22 bp, Homo sapiens
acagggccaagtaaaccctacc

SEQ ID NO: 7088051 - DNA, 22 bp, Homo sapiens
acagggccaagtaaaccctacc

SEQ ID NO: 7088052 - DNA, 22 bp, Homo sapiens
acagggccaatgttagcattga

SEQ ID NO: 7088053 - DNA, 22 bp, Homo sapiens
acagggccacatgtaaacagat

SEQ ID NO: 7088054 - DNA, 21 bp, Homo sapiens
acagggcatgcagctggctgt

SEQ ID NO: 7088055 - DNA, 21 bp, Homo sapiens
acagggcatgcagctggctgt

SEQ ID NO: 7088056 - DNA, 22 bp, Homo sapiens
acagggcagtgtcttgaaaaat

SEQ ID NO: 7088057 - DNA, 22 bp, Homo sapiens
acagggcagtgtcttgaaaaat

SEQ ID NO: 7088058 - DNA, 21 bp, Homo sapiens
acagggcatgcagctggctgt

SEQ ID NO: 7088059 - DNA, 21 bp, Homo sapiens
acagggcatgcagctggctgt

SEQ ID NO: 7088060 - DNA, 21 bp, Homo sapiens
acagggcatgcagctggctgt

SEQ ID NO: 7088061 - DNA, 21 bp, Homo sapiens
acagggcatgcagctggctgt

SEQ ID NO: 7088062 - DNA, 22 bp, Homo sapiens
acagggcatgtgcaagagacat

SEQ ID NO: 7088063 - DNA, 22 bp, Homo sapiens
acagggcatgtgcaagagacat

SEQ ID NO: 7088064 - DNA, 22 bp, Homo sapiens
acagggcatgtgcaagagacat

SEQ ID NO: 7088065 - DNA, 22 bp, Homo sapiens
acagggcatgtgcaagagacat

SEQ ID NO: 7088066 - DNA, 21 bp, Homo sapiens
acaggctctggggatgctggg

SEQ ID NO: 7088067 - DNA, 22 bp, Homo sapiens
acagggcacctgaggtaggaag

SEQ ID NO: 7088068 - DNA, 21 bp, Homo sapiens
acaggctctggggatgctggg

SEQ ID NO: 7088069 - DNA, 22 bp, Homo sapiens
acagggcacctgaggtaggaag

SEQ ID NO: 7088070 - DNA, 17 bp, Homo sapiens
acagggcagaaacagct

SEQ ID NO: 7088071 - DNA, 17 bp, Homo sapiens
acagggcagaaacagct

SEQ ID NO: 7088072 - DNA, 19 bp, Homo sapiens
acagggcagcaataggata

SEQ ID NO: 7088073 - DNA, 22 bp, Homo sapiens
acagggcaggtggctactggtc

SEQ ID NO: 7088074 - DNA, 19 bp, Homo sapiens
acagggcagcaataggata

SEQ ID NO: 7088075 - DNA, 22 bp, Homo sapiens
acagggcaggtggctactggtc

SEQ ID NO: 7088076 - DNA, 22 bp, Homo sapiens
acagggcaggtggctactggtc

SEQ ID NO: 7088077 - DNA, 22 bp, Homo sapiens
acagggcagtgtcttgaaaaat

SEQ ID NO: 7088078 - DNA, 22 bp, Homo sapiens
acaggctctctattgagtgcag

SEQ ID NO: 7088079 - DNA, 22 bp, Homo sapiens
acaggctctctattgagtgcag

SEQ ID NO: 7088080 - DNA, 22 bp, Homo sapiens
acaggctctctattgagtgcag

SEQ ID NO: 7088081 - DNA, 22 bp, Homo sapiens
acaggctctctattgagtgcag

SEQ ID NO: 7088082 - DNA, 22 bp, Homo sapiens
acaggctctctattgagtgcag

SEQ ID NO: 7088083 - DNA, 21 bp, Homo sapiens
acaggctctggggatgctggg

SEQ ID NO: 7088084 - DNA, 21 bp, Homo sapiens
acaggctcacgatccatttct

SEQ ID NO: 7088085 - DNA, 22 bp, Homo sapiens
acaggctcagttcactggattt

SEQ ID NO: 7088086 - DNA, 22 bp, Homo sapiens
acaggctcagttcactggattt

SEQ ID NO: 7088087 - DNA, 22 bp, Homo sapiens
acaggctcagttcactggattt

SEQ ID NO: 7088088 - DNA, 22 bp, Homo sapiens
acaggctcgtgcgcgcacgtgt

SEQ ID NO: 7088089 - DNA, 22 bp, Homo sapiens
acaggctcgtgcgcgcacgtgt

SEQ ID NO: 7088090 - DNA, 22 bp, Homo sapiens
acaggctcgtgcgcgcacgtgt

SEQ ID NO: 7088091 - DNA, 22 bp, Homo sapiens
acaggctcgtgcgcgcacgtgt

SEQ ID NO: 7088092 - DNA, 22 bp, Homo sapiens
acaggctctcagccagttggca

SEQ ID NO: 7088093 - DNA, 22 bp, Homo sapiens
acaggctctcagccagttggca

SEQ ID NO: 7088094 - DNA, 22 bp, Homo sapiens
acaggcacaccttcctgcaggc

SEQ ID NO: 7088095 - DNA, 22 bp, Homo sapiens
acaggcacaccttcctgcaggc

SEQ ID NO: 7088096 - DNA, 22 bp, Homo sapiens
aggaaagaagtacattctcatg

SEQ ID NO: 7088097 - DNA, 22 bp, Homo sapiens
acaggcacaactgagtagactc

SEQ ID NO: 7088098 - DNA, 22 bp, Homo sapiens
acaggcacaactgagtagactc

SEQ ID NO: 7088099 - DNA, 22 bp, Homo sapiens
acaggcacaccttcctgcaggc

SEQ ID NO: 7088100 - DNA, 22 bp, Homo sapiens
acaggcaaagggtcagtagcag

SEQ ID NO: 7088101 - DNA, 21 bp, Homo sapiens
acaggcaaattttagacaatg

SEQ ID NO: 7088102 - DNA, 21 bp, Homo sapiens
acaggcaaattttagacaatg

SEQ ID NO: 7088103 - DNA, 22 bp, Homo sapiens
acaggcaacttcaaatctcact

SEQ ID NO: 7088104 - DNA, 22 bp, Homo sapiens
acaggcaagaggaaagcaagta

SEQ ID NO: 7088105 - DNA, 22 bp, Homo sapiens
acaggcaagaggaaagcaagta

SEQ ID NO: 7088106 - DNA, 22 bp, Homo sapiens
acaggcaaggccagtgagaaat

SEQ ID NO: 7088107 - DNA, 22 bp, Homo sapiens
acaggcaagtacacaggctcat

SEQ ID NO: 7088108 - DNA, 22 bp, Homo sapiens
agcttctttgtgggctccagaa

SEQ ID NO: 7088109 - DNA, 22 bp, Homo sapiens
agcttcttttacagctcatgct

SEQ ID NO: 7088110 - DNA, 22 bp, Homo sapiens
acaggatgagaatatcatattt

SEQ ID NO: 7088111 - DNA, 22 bp, Homo sapiens
agcttcttgtatgaagttagag

SEQ ID NO: 7088112 - DNA, 22 bp, Homo sapiens
agcttcttgtagaactcaaaag

SEQ ID NO: 7088113 - DNA, 22 bp, Homo sapiens
agcttctttaattcagcatgat

SEQ ID NO: 7088114 - DNA, 19 bp, Homo sapiens
agcttctttggaaacattt

SEQ ID NO: 7088115 - DNA, 22 bp, Homo sapiens
acaggatgataaaggatggcca

SEQ ID NO: 7088116 - DNA, 22 bp, Homo sapiens
acaggatggagataatagaaaa

SEQ ID NO: 7088117 - DNA, 22 bp, Homo sapiens
acaggatggccagctgatattg

SEQ ID NO: 7088118 - DNA, 22 bp, Homo sapiens
acaggatgggcgcacagagcta

SEQ ID NO: 7088119 - DNA, 22 bp, Homo sapiens
acaggatggccagctgatattg

SEQ ID NO: 7088120 - DNA, 22 bp, Homo sapiens
acaggatgggcgcacagagcta

SEQ ID NO: 7088121 - DNA, 22 bp, Homo sapiens
acaggatgggcgcacagagcta

SEQ ID NO: 7088122 - DNA, 22 bp, Homo sapiens
agcttcttcttggtctttccca

SEQ ID NO: 7088123 - DNA, 22 bp, Homo sapiens
agcttcttgaccaagcctgtaa

SEQ ID NO: 7088124 - DNA, 20 bp, Homo sapiens
agcttcttctgtctaatttt

SEQ ID NO: 7088125 - DNA, 22 bp, Homo sapiens
agcttcttctgatttgtcagtc

SEQ ID NO: 7088126 - DNA, 22 bp, Homo sapiens
agcttcttctgatttgtcagtc

SEQ ID NO: 7088127 - DNA, 22 bp, Homo sapiens
agcttcttgacggatgttctgg

SEQ ID NO: 7088128 - DNA, 22 bp, Homo sapiens
agcttcttggctcagcacttgg

SEQ ID NO: 7088129 - DNA, 22 bp, Homo sapiens
agcttcttgggctttacacaaa

SEQ ID NO: 7088130 - DNA, 22 bp, Homo sapiens
acaggagaaatctggtcaaaag

SEQ ID NO: 7088131 - DNA, 22 bp, Homo sapiens
acaggagaaatctggtcaaaag

SEQ ID NO: 7088132 - DNA, 22 bp, Homo sapiens
acaggagaaatctggtcaaaag

SEQ ID NO: 7088133 - DNA, 22 bp, Homo sapiens
agcttccatactaagacaaaag

SEQ ID NO: 7088134 - DNA, 22 bp, Homo sapiens
agcttcttcaaagcaggaggcc

SEQ ID NO: 7088135 - DNA, 22 bp, Homo sapiens
agcttcttccaggcagtgactc

SEQ ID NO: 7088136 - DNA, 22 bp, Homo sapiens
agcttcttcccagcctcacccg

SEQ ID NO: 7088137 - DNA, 22 bp, Homo sapiens
agcttcttctattttggggcca

SEQ ID NO: 7088138 - DNA, 22 bp, Homo sapiens
agcttcttctattttggggcca

SEQ ID NO: 7088139 - DNA, 22 bp, Homo sapiens
acaggacatggcttctgtgacg

SEQ ID NO: 7088140 - DNA, 22 bp, Homo sapiens
acaggacatggcttctgtgacg

SEQ ID NO: 7088141 - DNA, 22 bp, Homo sapiens
acaggacagtctagtaacagta

SEQ ID NO: 7088142 - DNA, 22 bp, Homo sapiens
acaggacagtctagtaacagta

SEQ ID NO: 7088143 - DNA, 22 bp, Homo sapiens
acaggacagtctagtaacagta

SEQ ID NO: 7088144 - DNA, 22 bp, Homo sapiens
acaggacagtctagtaacagta

SEQ ID NO: 7088145 - DNA, 22 bp, Homo sapiens
acaggacagtctagtaacagta

SEQ ID NO: 7088146 - DNA, 22 bp, Homo sapiens
acaggacaggctgggctagact

SEQ ID NO: 7088147 - DNA, 22 bp, Homo sapiens
acaggacaggctgggctagact

SEQ ID NO: 7088148 - DNA, 22 bp, Homo sapiens
acaggacatggcttctgtgacg

SEQ ID NO: 7088149 - DNA, 22 bp, Homo sapiens
acaggacatgtaccaggtggtc

SEQ ID NO: 7088150 - DNA, 22 bp, Homo sapiens
acaggacatgtaccaggtggtc

SEQ ID NO: 7088151 - DNA, 22 bp, Homo sapiens
acaggacatggcttctgtgacg

SEQ ID NO: 7088152 - DNA, 22 bp, Homo sapiens
acaggacatgtaccaggtggtc

SEQ ID NO: 7088153 - DNA, 22 bp, Homo sapiens
acaggacatgtaccaggtggtc

SEQ ID NO: 7088154 - DNA, 22 bp, Homo sapiens
acaggacatgtaccaggtggtc

SEQ ID NO: 7088155 - DNA, 22 bp, Homo sapiens
acaggactagatgataaaatgt

SEQ ID NO: 7088156 - DNA, 22 bp, Homo sapiens
acaggactctctgaaaatgtac

SEQ ID NO: 7088157 - DNA, 22 bp, Homo sapiens
acaggacttaagtcatttataa

SEQ ID NO: 7088158 - DNA, 22 bp, Homo sapiens
acaggagaaatctggtcaaaag

SEQ ID NO: 7088159 - DNA, 22 bp, Homo sapiens
acaggacaggctgggctagact

SEQ ID NO: 7088160 - DNA, 22 bp, Homo sapiens
acaggacaggctgggctagact

SEQ ID NO: 7088161 - DNA, 22 bp, Homo sapiens
acaggacaatttataatgggca

SEQ ID NO: 7088162 - DNA, 22 bp, Homo sapiens
acaggacaatttataatgggca

SEQ ID NO: 7088163 - DNA, 22 bp, Homo sapiens
acaggacaggctgggctagact

SEQ ID NO: 7088164 - DNA, 22 bp, Homo sapiens
acaggacaaggggaagaagata

SEQ ID NO: 7088165 - DNA, 22 bp, Homo sapiens
acaggacaaggggaagaagata

SEQ ID NO: 7088166 - DNA, 22 bp, Homo sapiens
acaggacaactcagcagccagc

SEQ ID NO: 7088167 - DNA, 22 bp, Homo sapiens
acaggacaaaaatctggatggc

SEQ ID NO: 7088168 - DNA, 22 bp, Homo sapiens
acaggacaactcagcagccagc

SEQ ID NO: 7088169 - DNA, 22 bp, Homo sapiens
acaggacaactcagcagccagc

SEQ ID NO: 7088170 - DNA, 22 bp, Homo sapiens
acaggacaaaaatctggatggc

SEQ ID NO: 7088171 - DNA, 22 bp, Homo sapiens
acaggacaaaaatctggatggc

SEQ ID NO: 7088172 - DNA, 22 bp, Homo sapiens
acaggaagtgggaagaaacagg

SEQ ID NO: 7088173 - DNA, 22 bp, Homo sapiens
acaggaagtgggaagaaacagg

SEQ ID NO: 7088174 - DNA, 22 bp, Homo sapiens
acaggaagtgggaagaaacagg

SEQ ID NO: 7088175 - DNA, 20 bp, Homo sapiens
acagccagaggaggcagaca

SEQ ID NO: 7088176 - DNA, 20 bp, Homo sapiens
acagccagaggaggcagaca

SEQ ID NO: 7088177 - DNA, 22 bp, Homo sapiens
acagcttctatttctctgtact

SEQ ID NO: 7088178 - DNA, 22 bp, Homo sapiens
acagcttcttgtttcccaggag

SEQ ID NO: 7088179 - DNA, 22 bp, Homo sapiens
acaggaactgttatctcagatg

SEQ ID NO: 7088180 - DNA, 22 bp, Homo sapiens
acaggaactgttatctcagatg

SEQ ID NO: 7088181 - DNA, 22 bp, Homo sapiens
acaggaactgttatctcagatg

SEQ ID NO: 7088182 - DNA, 22 bp, Homo sapiens
acaggaagaaagtgcagtagat

SEQ ID NO: 7088183 - DNA, 22 bp, Homo sapiens
acaggaagaaagtgcagtagat

SEQ ID NO: 7088184 - DNA, 22 bp, Homo sapiens
acaggaagtgggaagaaacagg

SEQ ID NO: 7088185 - DNA, 22 bp, Homo sapiens
acagccactcaaagggccgaag

SEQ ID NO: 7088186 - DNA, 22 bp, Homo sapiens
acagccactcaaagggccgaag

SEQ ID NO: 7088187 - DNA, 22 bp, Homo sapiens
acagccactcaaagggccgaag

SEQ ID NO: 7088188 - DNA, 22 bp, Homo sapiens
acagccagaagtcagggtggga

SEQ ID NO: 7088189 - DNA, 22 bp, Homo sapiens
acagccaaggaattaggaaggg

SEQ ID NO: 7088190 - DNA, 22 bp, Homo sapiens
acagccaaggaattaggaaggg

SEQ ID NO: 7088191 - DNA, 22 bp, Homo sapiens
acagccagaggagccaggctgg

SEQ ID NO: 7088192 - DNA, 22 bp, Homo sapiens
acagccagaggagccaggctgg

SEQ ID NO: 7088193 - DNA, 22 bp, Homo sapiens
acagccagaggagccaggctgg

SEQ ID NO: 7088194 - DNA, 20 bp, Homo sapiens
acagccagaggaggcagaca

SEQ ID NO: 7088195 - DNA, 22 bp, Homo sapiens
acagcattgagagctaaattta

SEQ ID NO: 7088196 - DNA, 21 bp, Homo sapiens
acagcatgtttgtgtgtttgc

SEQ ID NO: 7088197 - DNA, 22 bp, Homo sapiens
acagcattgctccatctcaaga

SEQ ID NO: 7088198 - DNA, 22 bp, Homo sapiens
acagcagtgggttgccagtggg

SEQ ID NO: 7088199 - DNA, 22 bp, Homo sapiens
acagcagtggtgcactgagcca

SEQ ID NO: 7088200 - DNA, 22 bp, Homo sapiens
acagcagtgtctggtactgagt

SEQ ID NO: 7088201 - DNA, 22 bp, Homo sapiens
acagcagttactgaaataaagt

SEQ ID NO: 7088202 - DNA, 22 bp, Homo sapiens
acagcagtttagaggacagcca

SEQ ID NO: 7088203 - DNA, 22 bp, Homo sapiens
acagcatccctgaagataacca

SEQ ID NO: 7088204 - DNA, 22 bp, Homo sapiens
acagcatccctgaagataacca

SEQ ID NO: 7088205 - DNA, 22 bp, Homo sapiens
acagcatccttctaaagtagct

SEQ ID NO: 7088206 - DNA, 22 bp, Homo sapiens
acagcatccttctaaagtagct

SEQ ID NO: 7088207 - DNA, 22 bp, Homo sapiens
acagcatctagtacagtctagt

SEQ ID NO: 7088208 - DNA, 22 bp, Homo sapiens
acagcatctagtacagtctagt

SEQ ID NO: 7088209 - DNA, 22 bp, Homo sapiens
acagcatcatatagtggaagaa

SEQ ID NO: 7088210 - DNA, 22 bp, Homo sapiens
acagcatctagtacagtctagt

SEQ ID NO: 7088211 - DNA, 22 bp, Homo sapiens
acagcatggataacaaggcact

SEQ ID NO: 7088212 - DNA, 22 bp, Homo sapiens
acagcatgtctagttaaatact

SEQ ID NO: 7088213 - DNA, 21 bp, Homo sapiens
acagcatgtttgtgtgtttgc

SEQ ID NO: 7088214 - DNA, 20 bp, Homo sapiens
aggaggcatagtctggaaag

SEQ ID NO: 7088215 - DNA, 20 bp, Homo sapiens
aggaggcatagtctggaaag

SEQ ID NO: 7088216 - DNA, 20 bp, Homo sapiens
aggaggcatgaggggattta

SEQ ID NO: 7088217 - DNA, 20 bp, Homo sapiens
aggaggcatgaggggattta

SEQ ID NO: 7088218 - DNA, 22 bp, Homo sapiens
aggaggcagtctgtcccttagc

SEQ ID NO: 7088219 - DNA, 20 bp, Homo sapiens
aggaggcatagtctggaaag

SEQ ID NO: 7088220 - DNA, 20 bp, Homo sapiens
aggaggcatgaggggattta

SEQ ID NO: 7088221 - DNA, 21 bp, Homo sapiens
aggaggccagtactgctgaac

SEQ ID NO: 7088222 - DNA, 22 bp, Homo sapiens
aggaggcccctcctgggttgct

SEQ ID NO: 7088223 - DNA, 22 bp, Homo sapiens
aggaggccctagagctctagag

SEQ ID NO: 7088224 - DNA, 22 bp, Homo sapiens
aggaggccctagagctctagag

SEQ ID NO: 7088225 - DNA, 22 bp, Homo sapiens
aggaggccctagagctctagag

SEQ ID NO: 7088226 - DNA, 22 bp, Homo sapiens
acagtggaaagaacatggattt

SEQ ID NO: 7088227 - DNA, 22 bp, Homo sapiens
acagtggaaagaaacgaattag

SEQ ID NO: 7088228 - DNA, 22 bp, Homo sapiens
acagtggaaagaacatggattt

SEQ ID NO: 7088229 - DNA, 22 bp, Homo sapiens
acagtgcttttgttcctctcct

SEQ ID NO: 7088230 - DNA, 22 bp, Homo sapiens
acagtgcttagcacagagtaga

SEQ ID NO: 7088231 - DNA, 19 bp, Homo sapiens
acagtgcttctgagtgagg

SEQ ID NO: 7088232 - DNA, 19 bp, Homo sapiens
acagtgcttctgagtgagg

SEQ ID NO: 7088233 - DNA, 22 bp, Homo sapiens
acagtgcttagcacagagtaga

SEQ ID NO: 7088234 - DNA, 17 bp, Homo sapiens
aggaggccctggcgttt

SEQ ID NO: 7088235 - DNA, 22 bp, Homo sapiens
aggaggccgatttcagaggtcg

SEQ ID NO: 7088236 - DNA, 22 bp, Homo sapiens
acagtgcagggtgggaagaagg

SEQ ID NO: 7088237 - DNA, 22 bp, Homo sapiens
acagtgcagggtgggaagaagg

SEQ ID NO: 7088238 - DNA, 22 bp, Homo sapiens
acagtctgtcccccaggtgcta

SEQ ID NO: 7088239 - DNA, 22 bp, Homo sapiens
acagtctgtcccccaggtgcta

SEQ ID NO: 7088240 - DNA, 22 bp, Homo sapiens
acagtgaaaagaatattagaat

SEQ ID NO: 7088241 - DNA, 22 bp, Homo sapiens
acagtgaaaagaatattagaat

SEQ ID NO: 7088242 - DNA, 22 bp, Homo sapiens
acagtctggaagcagggggcaa

SEQ ID NO: 7088243 - DNA, 22 bp, Homo sapiens
aggacttcaaatggaaacaaaa

SEQ ID NO: 7088244 - DNA, 22 bp, Homo sapiens
aggacttcatcacctgtataaa

SEQ ID NO: 7088245 - DNA, 22 bp, Homo sapiens
aggacttagaacattatgtact

SEQ ID NO: 7088246 - DNA, 22 bp, Homo sapiens
aggacttagaacattatgtact

SEQ ID NO: 7088247 - DNA, 22 bp, Homo sapiens
aggacttagaacattatgtact

SEQ ID NO: 7088248 - DNA, 22 bp, Homo sapiens
aggacttagaacattatgtact

SEQ ID NO: 7088249 - DNA, 22 bp, Homo sapiens
acagtgaaaagtagctaacaca

SEQ ID NO: 7088250 - DNA, 22 bp, Homo sapiens
acagtgaaaagtagctaacaca

SEQ ID NO: 7088251 - DNA, 22 bp, Homo sapiens
acagtgaaaattctattgattt

SEQ ID NO: 7088252 - DNA, 22 bp, Homo sapiens
acagtgaaaattctattgattt

SEQ ID NO: 7088253 - DNA, 23 bp, Homo sapiens
acagtgaaacacgcagtaagagt

SEQ ID NO: 7088254 - DNA, 22 bp, Homo sapiens
acagtgaataagacatgtgctt

SEQ ID NO: 7088255 - DNA, 22 bp, Homo sapiens
acagtgaatccaaattcctacc

SEQ ID NO: 7088256 - DNA, 21 bp, Homo sapiens
acagtgagaaataaatggaaa

SEQ ID NO: 7088257 - DNA, 22 bp, Homo sapiens
acagtgaatgcccaagaaaagt

SEQ ID NO: 7088258 - DNA, 22 bp, Homo sapiens
acagtgaatgcccaagaaaagt

SEQ ID NO: 7088259 - DNA, 22 bp, Homo sapiens
acagtgagcccactccaggaga

SEQ ID NO: 7088260 - DNA, 22 bp, Homo sapiens
acagtgagcccactccaggaga

SEQ ID NO: 7088261 - DNA, 22 bp, Homo sapiens
acagtgagcggtagtgattgct

SEQ ID NO: 7088262 - DNA, 22 bp, Homo sapiens
acagtgagatccaagggcaggc

SEQ ID NO: 7088263 - DNA, 22 bp, Homo sapiens
acagtgagatccaagggcaggc

SEQ ID NO: 7088264 - DNA, 22 bp, Homo sapiens
acagtgagatccaagggcaggc

SEQ ID NO: 7088265 - DNA, 22 bp, Homo sapiens
acagtgaggaagcagctgtgct

SEQ ID NO: 7088266 - DNA, 22 bp, Homo sapiens
acagtgagcggtagtgattgct

SEQ ID NO: 7088267 - DNA, 22 bp, Homo sapiens
aggaggcagtctgtcccttagc

SEQ ID NO: 7088268 - DNA, 22 bp, Homo sapiens
aggaggcaggaagtctatggga

SEQ ID NO: 7088269 - DNA, 22 bp, Homo sapiens
aggaggcaggaagtctatggga

SEQ ID NO: 7088270 - DNA, 22 bp, Homo sapiens
aggcagaaaatagtcatccaaa

SEQ ID NO: 7088271 - DNA, 21 bp, Homo sapiens
aggcagaaagagcccaggctg

SEQ ID NO: 7088272 - DNA, 22 bp, Homo sapiens
aggcactggtccattttctgca

SEQ ID NO: 7088273 - DNA, 22 bp, Homo sapiens
acagtgttcctttgttgtgact

SEQ ID NO: 7088274 - DNA, 22 bp, Homo sapiens
acagtgttcactaaggttagct

SEQ ID NO: 7088275 - DNA, 22 bp, Homo sapiens
aggcaccttgcggtccagtgaa

SEQ ID NO: 7088276 - DNA, 22 bp, Homo sapiens
aggcaccttgcggtccagtgaa

SEQ ID NO: 7088277 - DNA, 22 bp, Homo sapiens
aggcaccttgagagcaggagct

SEQ ID NO: 7088278 - DNA, 22 bp, Homo sapiens
aggcaccttgagagcaggagct

SEQ ID NO: 7088279 - DNA, 22 bp, Homo sapiens
aggcaccttgagagcaggagct

SEQ ID NO: 7088280 - DNA, 22 bp, Homo sapiens
aggcacctgaggtggccagcct

SEQ ID NO: 7088281 - DNA, 22 bp, Homo sapiens
aggcacctggatcttggaattc

SEQ ID NO: 7088282 - DNA, 20 bp, Homo sapiens
aggcacctgtcacaggtgag

SEQ ID NO: 7088283 - DNA, 23 bp, Homo sapiens
aggcactcgacagaaatattgga

SEQ ID NO: 7088284 - DNA, 22 bp, Homo sapiens
aggcactaatccctactatgag

SEQ ID NO: 7088285 - DNA, 22 bp, Homo sapiens
aggcactctgggtttaaattct

SEQ ID NO: 7088286 - DNA, 22 bp, Homo sapiens
aggcactaatggtagtggactg

SEQ ID NO: 7088287 - DNA, 22 bp, Homo sapiens
aggcactgaaaggtggccagag

SEQ ID NO: 7088288 - DNA, 22 bp, Homo sapiens
aggcactgaaaggtggccagag

SEQ ID NO: 7088289 - DNA, 20 bp, Homo sapiens
acagtgttaggtttttcctt

SEQ ID NO: 7088290 - DNA, 22 bp, Homo sapiens
aggcactgaaaggtggccagag

SEQ ID NO: 7088291 - DNA, 22 bp, Homo sapiens
acagtgttacttgatagtgtat

SEQ ID NO: 7088292 - DNA, 22 bp, Homo sapiens
acagtggatgtgatgtccaggt

SEQ ID NO: 7088293 - DNA, 22 bp, Homo sapiens
acagtggatgtgatgtccaggt

SEQ ID NO: 7088294 - DNA, 22 bp, Homo sapiens
acagtggcagtattagggcaga

SEQ ID NO: 7088295 - DNA, 22 bp, Homo sapiens
acagtggatgtgatgtccaggt

SEQ ID NO: 7088296 - DNA, 22 bp, Homo sapiens
acagtggatgacatccttttgc

SEQ ID NO: 7088297 - DNA, 22 bp, Homo sapiens
acagtggatatattaaatgaga

SEQ ID NO: 7088298 - DNA, 22 bp, Homo sapiens
acagtggatatattaaatgaga

SEQ ID NO: 7088299 - DNA, 22 bp, Homo sapiens
acagtggagttggggtagccct

SEQ ID NO: 7088300 - DNA, 22 bp, Homo sapiens
acagtggagttggggtagccct

SEQ ID NO: 7088301 - DNA, 22 bp, Homo sapiens
acagtggaggccatatggtcct

SEQ ID NO: 7088302 - DNA, 22 bp, Homo sapiens
acagtggagctcagatgaaaat

SEQ ID NO: 7088303 - DNA, 22 bp, Homo sapiens
acagtggagaaggcatgaggct

SEQ ID NO: 7088304 - DNA, 22 bp, Homo sapiens
acagtggagaaggcatgaggct

SEQ ID NO: 7088305 - DNA, 22 bp, Homo sapiens
acagtggagaaggcatgaggct

SEQ ID NO: 7088306 - DNA, 22 bp, Homo sapiens
acagtggagaagcaaatgcagt

SEQ ID NO: 7088307 - DNA, 22 bp, Homo sapiens
acagtggaatttgtagatgtgt

SEQ ID NO: 7088308 - DNA, 22 bp, Homo sapiens
acagtggaatggtgggcctgca

SEQ ID NO: 7088309 - DNA, 22 bp, Homo sapiens
acagtggaatggtgggcctgca

SEQ ID NO: 7088310 - DNA, 22 bp, Homo sapiens
acagtggaagcatgatgctatc

SEQ ID NO: 7088311 - DNA, 22 bp, Homo sapiens
acagtggaagcatgatgctatc

SEQ ID NO: 7088312 - DNA, 22 bp, Homo sapiens
acagtggaagaagcactgaact

SEQ ID NO: 7088313 - DNA, 20 bp, Homo sapiens
acagtggaaattgatgtctg

SEQ ID NO: 7088314 - DNA, 20 bp, Homo sapiens
acagtggaaattgatgtctg

SEQ ID NO: 7088315 - DNA, 22 bp, Homo sapiens
acagtggaaatgtgggagggga

SEQ ID NO: 7088316 - DNA, 22 bp, Homo sapiens
aggcacctcagctgagcctggg

SEQ ID NO: 7088317 - DNA, 22 bp, Homo sapiens
aggcacctcagctgagcctggg

SEQ ID NO: 7088318 - DNA, 19 bp, Homo sapiens
aggcaccgagggccactct

SEQ ID NO: 7088319 - DNA, 22 bp, Homo sapiens
aggcaccagtaagagtagaact

SEQ ID NO: 7088320 - DNA, 22 bp, Homo sapiens
aggcaccagtaagagtagaact

SEQ ID NO: 7088321 - DNA, 22 bp, Homo sapiens
acagtgggacagtgacggggga

SEQ ID NO: 7088322 - DNA, 22 bp, Homo sapiens
acagtggctcatgcctgtcatc

SEQ ID NO: 7088323 - DNA, 22 bp, Homo sapiens
acagtggcctcaaagaaagaga

SEQ ID NO: 7088324 - DNA, 22 bp, Homo sapiens
aggcacagcacacctggccccc

SEQ ID NO: 7088325 - DNA, 21 bp, Homo sapiens
aggcaccacatctccctcccc

SEQ ID NO: 7088326 - DNA, 22 bp, Homo sapiens
aggcaccaggatcagttagaga

SEQ ID NO: 7088327 - DNA, 22 bp, Homo sapiens
aggcagaaccagctgggacttt

SEQ ID NO: 7088328 - DNA, 21 bp, Homo sapiens
aggcagaaagagcccaggctg

SEQ ID NO: 7088329 - DNA, 22 bp, Homo sapiens
aggcagaaccagctgggacttt

SEQ ID NO: 7088330 - DNA, 22 bp, Homo sapiens
aggcagaagccagccagggtcc

SEQ ID NO: 7088331 - DNA, 22 bp, Homo sapiens
aggcagaatgttggaaaggaag

SEQ ID NO: 7088332 - DNA, 22 bp, Homo sapiens
aggcagaatgttggaaaggaag

SEQ ID NO: 7088333 - DNA, 22 bp, Homo sapiens
aggcagacttcctgcttggatc

SEQ ID NO: 7088334 - DNA, 22 bp, Homo sapiens
aggcagagaaaaaccagatatg

SEQ ID NO: 7088335 - DNA, 22 bp, Homo sapiens
aggcagatggtaactgtgatat

SEQ ID NO: 7088336 - DNA, 22 bp, Homo sapiens
aggcagattacttgaggccagg

SEQ ID NO: 7088337 - DNA, 22 bp, Homo sapiens
aggcagatttaggagaaaagaa

SEQ ID NO: 7088338 - DNA, 22 bp, Homo sapiens
aggcagatgggagctggaagtt

SEQ ID NO: 7088339 - DNA, 22 bp, Homo sapiens
aggcagatggatgggcatttgt

SEQ ID NO: 7088340 - DNA, 22 bp, Homo sapiens
aggcagatgaacctgggttgag

SEQ ID NO: 7088341 - DNA, 22 bp, Homo sapiens
aggcagatgggagctggaagtt

SEQ ID NO: 7088342 - DNA, 22 bp, Homo sapiens
aggcagatgggagctggaagtt

SEQ ID NO: 7088343 - DNA, 22 bp, Homo sapiens
aggcagagaaaaaccagatatg

SEQ ID NO: 7088344 - DNA, 22 bp, Homo sapiens
aggcagagaaaaaccagatatg

SEQ ID NO: 7088345 - DNA, 22 bp, Homo sapiens
aggcagagaaaaaccagatatg

SEQ ID NO: 7088346 - DNA, 22 bp, Homo sapiens
aggcagatattggggtgatgtg

SEQ ID NO: 7088347 - DNA, 22 bp, Homo sapiens
aggcagatcacttgaggccagg

SEQ ID NO: 7088348 - DNA, 22 bp, Homo sapiens
aggcagcaagattatttaatcc

SEQ ID NO: 7088349 - DNA, 22 bp, Homo sapiens
aggcagcaaatgtctggaacag

SEQ ID NO: 7088350 - DNA, 22 bp, Homo sapiens
aggcagcaaagaaatgatgctg

SEQ ID NO: 7088351 - DNA, 22 bp, Homo sapiens
aggcagcaaagaaatgatgctg

SEQ ID NO: 7088352 - DNA, 22 bp, Homo sapiens
aggcagcaaagaaatgatgctg

SEQ ID NO: 7088353 - DNA, 22 bp, Homo sapiens
aggcagcaatgaatgaaatgga

SEQ ID NO: 7088354 - DNA, 22 bp, Homo sapiens
aggcaggggagctggaagggta

SEQ ID NO: 7088355 - DNA, 22 bp, Homo sapiens
aggcaggggagctggaagggta

SEQ ID NO: 7088356 - DNA, 18 bp, Homo sapiens
aggcaggtgctggaagtc

SEQ ID NO: 7088357 - DNA, 18 bp, Homo sapiens
aggcaggtgctggaagtc

SEQ ID NO: 7088358 - DNA, 22 bp, Homo sapiens
aggcaggttggtgagaagactg

SEQ ID NO: 7088359 - DNA, 22 bp, Homo sapiens
aggcaggttacaaaaactttat

SEQ ID NO: 7088360 - DNA, 22 bp, Homo sapiens
aggcaggtgttgggagacacca

SEQ ID NO: 7088361 - DNA, 22 bp, Homo sapiens
aggcaggttacaaaaactttat

SEQ ID NO: 7088362 - DNA, 22 bp, Homo sapiens
aggcaggttggggaaaagcact

SEQ ID NO: 7088363 - DNA, 22 bp, Homo sapiens
aggcaggtgttgggagacacca

SEQ ID NO: 7088364 - DNA, 22 bp, Homo sapiens
aggcaggtgttacctctggttt

SEQ ID NO: 7088365 - DNA, 22 bp, Homo sapiens
aggcaggtgttacctctggttt

SEQ ID NO: 7088366 - DNA, 22 bp, Homo sapiens
aggcaggtgttacctctggttt

SEQ ID NO: 7088367 - DNA, 22 bp, Homo sapiens
aggcaggtgttacctctggttt

SEQ ID NO: 7088368 - DNA, 22 bp, Homo sapiens
aggcaggtgttgggagacacca

SEQ ID NO: 7088369 - DNA, 22 bp, Homo sapiens
aggcaggtgttgggagacacca

SEQ ID NO: 7088370 - DNA, 22 bp, Homo sapiens
aggcaggtgggtcacttgagtc

SEQ ID NO: 7088371 - DNA, 22 bp, Homo sapiens
aggcaggtgggagtgattcctt

SEQ ID NO: 7088372 - DNA, 22 bp, Homo sapiens
aggcaggtgggagtgattcctt

SEQ ID NO: 7088373 - DNA, 22 bp, Homo sapiens
aggcaggtgggagtgattcctt

SEQ ID NO: 7088374 - DNA, 22 bp, Homo sapiens
aggcaggtgcttatgacttgct

SEQ ID NO: 7088375 - DNA, 22 bp, Homo sapiens
aggcaggtgcttatgacttgct

SEQ ID NO: 7088376 - DNA, 22 bp, Homo sapiens
aggcaggtgggtcacttgagtc

SEQ ID NO: 7088377 - DNA, 22 bp, Homo sapiens
aggcaggtgggtcacttgagtc

SEQ ID NO: 7088378 - DNA, 22 bp, Homo sapiens
aggcaggtgttaaccctctgag

SEQ ID NO: 7088379 - DNA, 22 bp, Homo sapiens
aggcaggtgttaaccctctgag

SEQ ID NO: 7088380 - DNA, 20 bp, Homo sapiens
aggcagtgtagagatgagta

SEQ ID NO: 7088381 - DNA, 22 bp, Homo sapiens
aggcagtggtgtttgctggtgg

SEQ ID NO: 7088382 - DNA, 22 bp, Homo sapiens
acatctttatactagtccttga

SEQ ID NO: 7088383 - DNA, 22 bp, Homo sapiens
acatctttatactagtccttga

SEQ ID NO: 7088384 - DNA, 22 bp, Homo sapiens
acatctttgctcttatagagct

SEQ ID NO: 7088385 - DNA, 22 bp, Homo sapiens
acatctttgctcttatagagct

SEQ ID NO: 7088386 - DNA, 22 bp, Homo sapiens
acatctttgctcttatagagct

SEQ ID NO: 7088387 - DNA, 22 bp, Homo sapiens
acatctttgctcttatagagct

SEQ ID NO: 7088388 - DNA, 22 bp, Homo sapiens
acatctggagactacagtttgg

SEQ ID NO: 7088389 - DNA, 22 bp, Homo sapiens
acatctgggcctaaggctatat

SEQ ID NO: 7088390 - DNA, 22 bp, Homo sapiens
acatctgggcctaaggctatat

SEQ ID NO: 7088391 - DNA, 22 bp, Homo sapiens
acatctgtaatctagtcaaccc

SEQ ID NO: 7088392 - DNA, 22 bp, Homo sapiens
acatctgtcctctgcagagctc

SEQ ID NO: 7088393 - DNA, 22 bp, Homo sapiens
acatctgttcaaatatgcattt

SEQ ID NO: 7088394 - DNA, 22 bp, Homo sapiens
acatctgttcttctcttgtccc

SEQ ID NO: 7088395 - DNA, 22 bp, Homo sapiens
acatctgtttaacgaaggcatt

SEQ ID NO: 7088396 - DNA, 22 bp, Homo sapiens
acatctgtttgagaaaaagaag

SEQ ID NO: 7088397 - DNA, 22 bp, Homo sapiens
aggcagtgtgtagctggaagag

SEQ ID NO: 7088398 - DNA, 22 bp, Homo sapiens
aggcagtgtgtagctggaagag

SEQ ID NO: 7088399 - DNA, 22 bp, Homo sapiens
aggcagtgtgtagctggaagag

SEQ ID NO: 7088400 - DNA, 22 bp, Homo sapiens
aggcagtgtgtagctggaagag

SEQ ID NO: 7088401 - DNA, 22 bp, Homo sapiens
aggcagtgtgtagctggaagag

SEQ ID NO: 7088402 - DNA, 22 bp, Homo sapiens
aggcagtgtgggccaagcttcc

SEQ ID NO: 7088403 - DNA, 20 bp, Homo sapiens
aggcagtgtagagatgagta

SEQ ID NO: 7088404 - DNA, 20 bp, Homo sapiens
aggcagtgtagagatgagta

SEQ ID NO: 7088405 - DNA, 20 bp, Homo sapiens
aggcagtgtagagatgagta

SEQ ID NO: 7088406 - DNA, 22 bp, Homo sapiens
aggcagtgtattgctagcggct

SEQ ID NO: 7088407 - DNA, 22 bp, Homo sapiens
aggcagtgtattgctagcggct

SEQ ID NO: 7088408 - DNA, 23 bp, Homo sapiens
aggcagtgtctcttatcctgtcc

SEQ ID NO: 7088409 - DNA, 22 bp, Homo sapiens
acatatatgcgtgggctcatgg

SEQ ID NO: 7088410 - DNA, 22 bp, Homo sapiens
acatatatgcgtgggctcatgg

SEQ ID NO: 7088411 - DNA, 22 bp, Homo sapiens
acatatatgcgtgggctcatgg

SEQ ID NO: 7088412 - DNA, 22 bp, Homo sapiens
acatataagggatcagtgacag

SEQ ID NO: 7088413 - DNA, 22 bp, Homo sapiens
acatataagggatcagtgacag

SEQ ID NO: 7088414 - DNA, 22 bp, Homo sapiens
acatataagggatcagtgacag

SEQ ID NO: 7088415 - DNA, 22 bp, Homo sapiens
acatataagggatcagtgacag

SEQ ID NO: 7088416 - DNA, 22 bp, Homo sapiens
acatatatgctgggactgtgac

SEQ ID NO: 7088417 - DNA, 22 bp, Homo sapiens
acatatatgctgggactgtgac

SEQ ID NO: 7088418 - DNA, 22 bp, Homo sapiens
acatatatgctgggactgtgac

SEQ ID NO: 7088419 - DNA, 22 bp, Homo sapiens
acatatatgtaaagtactttgt

SEQ ID NO: 7088420 - DNA, 22 bp, Homo sapiens
acatatatgtaaagtactttgt

SEQ ID NO: 7088421 - DNA, 22 bp, Homo sapiens
acatatatgtaaagtactttgt

SEQ ID NO: 7088422 - DNA, 22 bp, Homo sapiens
acatatatgtaaagtactttgt

SEQ ID NO: 7088423 - DNA, 22 bp, Homo sapiens
acatatatgtaaagtactttgt

SEQ ID NO: 7088424 - DNA, 22 bp, Homo sapiens
acatatatgtaaagtactttgt

SEQ ID NO: 7088425 - DNA, 22 bp, Homo sapiens
acatatatgtgcacatgtgcag

SEQ ID NO: 7088426 - DNA, 22 bp, Homo sapiens
acatatatgtgcacatgtgcag

SEQ ID NO: 7088427 - DNA, 22 bp, Homo sapiens
acatatatgtgcacatgtgcag

SEQ ID NO: 7088428 - DNA, 22 bp, Homo sapiens
acatatattactagtaaagaca

SEQ ID NO: 7088429 - DNA, 22 bp, Homo sapiens
acatatattactagtaaagaca

SEQ ID NO: 7088430 - DNA, 22 bp, Homo sapiens
acatatattactagtaaagaca

SEQ ID NO: 7088431 - DNA, 22 bp, Homo sapiens
acatatattactagtaaagaca

SEQ ID NO: 7088432 - DNA, 22 bp, Homo sapiens
acatatattactagtaaagaca

SEQ ID NO: 7088433 - DNA, 22 bp, Homo sapiens
acatatatgtgcacatgtgcag

SEQ ID NO: 7088434 - DNA, 22 bp, Homo sapiens
acatatattactagtaaagaca

SEQ ID NO: 7088435 - DNA, 22 bp, Homo sapiens
acatatattactagtaaagaca

SEQ ID NO: 7088436 - DNA, 22 bp, Homo sapiens
acatatattttcacacatggtt

SEQ ID NO: 7088437 - DNA, 22 bp, Homo sapiens
acatatattttcacacatggtt

SEQ ID NO: 7088438 - DNA, 22 bp, Homo sapiens
acatctctgggtcctccatgca

SEQ ID NO: 7088439 - DNA, 22 bp, Homo sapiens
acatctctgggtcctccatgca

SEQ ID NO: 7088440 - DNA, 22 bp, Homo sapiens
acatctcttataaactctctga

SEQ ID NO: 7088441 - DNA, 22 bp, Homo sapiens
acatctcttataaactctctga

SEQ ID NO: 7088442 - DNA, 22 bp, Homo sapiens
acatctgaaagggattgcagaa

SEQ ID NO: 7088443 - DNA, 22 bp, Homo sapiens
acatctgacatgatcttcagta

SEQ ID NO: 7088444 - DNA, 22 bp, Homo sapiens
acatctgaccattacaagacat

SEQ ID NO: 7088445 - DNA, 22 bp, Homo sapiens
acatctgaccattacaagacat

SEQ ID NO: 7088446 - DNA, 22 bp, Homo sapiens
acatctgaggagaccagcctct

SEQ ID NO: 7088447 - DNA, 22 bp, Homo sapiens
acatctgattacatgagaatat

SEQ ID NO: 7088448 - DNA, 22 bp, Homo sapiens
acatctggaaagttacttgaga

SEQ ID NO: 7088449 - DNA, 22 bp, Homo sapiens
aggggaggagcttttcttgcct

SEQ ID NO: 7088450 - DNA, 22 bp, Homo sapiens
aggggagcttgcctggtcaccc

SEQ ID NO: 7088451 - DNA, 22 bp, Homo sapiens
aggggagctaacaccagagccc

SEQ ID NO: 7088452 - DNA, 22 bp, Homo sapiens
aggggagcttgaggcatggcct

SEQ ID NO: 7088453 - DNA, 22 bp, Homo sapiens
aggggagctaacaccagagccc

SEQ ID NO: 7088454 - DNA, 22 bp, Homo sapiens
aggggagcgacattccgtgccg

SEQ ID NO: 7088455 - DNA, 22 bp, Homo sapiens
aggggagcgacattccgtgccg

SEQ ID NO: 7088456 - DNA, 22 bp, Homo sapiens
aggggagctaacaccagagccc

SEQ ID NO: 7088457 - DNA, 22 bp, Homo sapiens
aggggagctaacaccagagccc

SEQ ID NO: 7088458 - DNA, 22 bp, Homo sapiens
aggggaggagcttttcttgcct

SEQ ID NO: 7088459 - DNA, 22 bp, Homo sapiens
aggggcaggtgctgcacttaga

SEQ ID NO: 7088460 - DNA, 22 bp, Homo sapiens
aggggcaggtgctgcacttaga

SEQ ID NO: 7088461 - DNA, 22 bp, Homo sapiens
aggggcaggtgctgcacttaga

SEQ ID NO: 7088462 - DNA, 22 bp, Homo sapiens
aggggcaggtgctgcacttaga

SEQ ID NO: 7088463 - DNA, 22 bp, Homo sapiens
aggggcaggtgctgcacttaga

SEQ ID NO: 7088464 - DNA, 22 bp, Homo sapiens
aggggcagttccaagttttgtg

SEQ ID NO: 7088465 - DNA, 22 bp, Homo sapiens
aggggcagttccaagttttgtg

SEQ ID NO: 7088466 - DNA, 22 bp, Homo sapiens
aggggcagttccaagttttgtg

SEQ ID NO: 7088467 - DNA, 22 bp, Homo sapiens
aggggcagttccaagttttgtg

SEQ ID NO: 7088468 - DNA, 22 bp, Homo sapiens
aggggcatcagttgcacatttt

SEQ ID NO: 7088469 - DNA, 22 bp, Homo sapiens
aggggagccgaggggcatctgt

SEQ ID NO: 7088470 - DNA, 22 bp, Homo sapiens
aggggagccgaggggcatctgt

SEQ ID NO: 7088471 - DNA, 22 bp, Homo sapiens
aggggagccgaggggcatctgt

SEQ ID NO: 7088472 - DNA, 22 bp, Homo sapiens
aggggagccgaggggcatctgt

SEQ ID NO: 7088473 - DNA, 22 bp, Homo sapiens
aggggagccgaggggcatctgt

SEQ ID NO: 7088474 - DNA, 22 bp, Homo sapiens
aggggagccgaggggcatctgt

SEQ ID NO: 7088475 - DNA, 22 bp, Homo sapiens
aggggagccagggctgcgagtt

SEQ ID NO: 7088476 - DNA, 22 bp, Homo sapiens
aggggagccagggctgcgagtt

SEQ ID NO: 7088477 - DNA, 22 bp, Homo sapiens
aggggagccagggctgcgagtt

SEQ ID NO: 7088478 - DNA, 22 bp, Homo sapiens
aggggagcccctggtcctggtg

SEQ ID NO: 7088479 - DNA, 22 bp, Homo sapiens
aggggagcaaggccgtggtgta

SEQ ID NO: 7088480 - DNA, 22 bp, Homo sapiens
aggggagcaaggccgtggtgta

SEQ ID NO: 7088481 - DNA, 22 bp, Homo sapiens
aggggagcaacatagtcactct

SEQ ID NO: 7088482 - DNA, 22 bp, Homo sapiens
aggggagcaaggccgtggtgta

SEQ ID NO: 7088483 - DNA, 22 bp, Homo sapiens
aggggagcatctgtgatggtta

SEQ ID NO: 7088484 - DNA, 22 bp, Homo sapiens
aggggagcatctgtgatggtta

SEQ ID NO: 7088485 - DNA, 22 bp, Homo sapiens
aggggagcaacatagtcactct

SEQ ID NO: 7088486 - DNA, 22 bp, Homo sapiens
aggggagcaacatagtcactct

SEQ ID NO: 7088487 - DNA, 22 bp, Homo sapiens
aggggagcaaggccgtggtgta

SEQ ID NO: 7088488 - DNA, 22 bp, Homo sapiens
agggctcactgggaggctataa

SEQ ID NO: 7088489 - DNA, 22 bp, Homo sapiens
agggctcagaaatgtctacggg

SEQ ID NO: 7088490 - DNA, 22 bp, Homo sapiens
agggctcactgggaggctataa

SEQ ID NO: 7088491 - DNA, 22 bp, Homo sapiens
agggctcagaacaatgagtgta

SEQ ID NO: 7088492 - DNA, 22 bp, Homo sapiens
agggctcagaacaatgagtgta

SEQ ID NO: 7088493 - DNA, 22 bp, Homo sapiens
agggctcagaacaatgagtgta

SEQ ID NO: 7088494 - DNA, 22 bp, Homo sapiens
agggctcagagcaaaagggcac

SEQ ID NO: 7088495 - DNA, 22 bp, Homo sapiens
agggctcagcctcctcctcagc

SEQ ID NO: 7088496 - DNA, 22 bp, Homo sapiens
agggctcagcctcctcctcagc

SEQ ID NO: 7088497 - DNA, 22 bp, Homo sapiens
agggctcagccagcctgtgtgc

SEQ ID NO: 7088498 - DNA, 22 bp, Homo sapiens
agggctcagcatctcattctgt

SEQ ID NO: 7088499 - DNA, 22 bp, Homo sapiens
agggctcagggcacgtcatcca

SEQ ID NO: 7088500 - DNA, 22 bp, Homo sapiens
agggctcagggcacgtcatcca

SEQ ID NO: 7088501 - DNA, 22 bp, Homo sapiens
agggctcagggtcaccatctgt

SEQ ID NO: 7088502 - DNA, 22 bp, Homo sapiens
agggctcagtaaacggtggatt

SEQ ID NO: 7088503 - DNA, 22 bp, Homo sapiens
agggctcagttgcctggagccc

SEQ ID NO: 7088504 - DNA, 22 bp, Homo sapiens
agggctcagttgcctggagccc

SEQ ID NO: 7088505 - DNA, 22 bp, Homo sapiens
agggctgaagggaggtgctcat

SEQ ID NO: 7088506 - DNA, 22 bp, Homo sapiens
agggctgaagttatggctgagc

SEQ ID NO: 7088507 - DNA, 22 bp, Homo sapiens
agggctgacaaatggcagtgac

SEQ ID NO: 7088508 - DNA, 22 bp, Homo sapiens
agggctgacaaatggcagtgac

SEQ ID NO: 7088509 - DNA, 23 bp, Homo sapiens
agggctgaatgcagagaagcaga

SEQ ID NO: 7088510 - DNA, 23 bp, Homo sapiens
agggctgaatgcagagaagcaga

SEQ ID NO: 7088511 - DNA, 22 bp, Homo sapiens
agggctgacacaccttatcctc

SEQ ID NO: 7088512 - DNA, 22 bp, Homo sapiens
agggctgacaaatggcagtgac

SEQ ID NO: 7088513 - DNA, 22 bp, Homo sapiens
agggctgacaaatggcagtgac

SEQ ID NO: 7088514 - DNA, 22 bp, Homo sapiens
agggctgacagtgaggagtcaa

SEQ ID NO: 7088515 - DNA, 22 bp, Homo sapiens
agggctttctttgtaaaagaag

SEQ ID NO: 7088516 - DNA, 22 bp, Homo sapiens
agggctgacagtaaaagtatga

SEQ ID NO: 7088517 - DNA, 20 bp, Homo sapiens
aggggcctggaacaggcctt

SEQ ID NO: 7088518 - DNA, 22 bp, Homo sapiens
aggggcctggacatggacgcgc

SEQ ID NO: 7088519 - DNA, 18 bp, Homo sapiens
accctttccaaactgcag

SEQ ID NO: 7088520 - DNA, 18 bp, Homo sapiens
accctttattggtagaga

SEQ ID NO: 7088521 - DNA, 22 bp, Homo sapiens
accctttcttactcacacgctc

SEQ ID NO: 7088522 - DNA, 22 bp, Homo sapiens
aggggcctcagcctcctggtca

SEQ ID NO: 7088523 - DNA, 22 bp, Homo sapiens
aggggcctcctcattggagtgt

SEQ ID NO: 7088524 - DNA, 21 bp, Homo sapiens
aggggcccttgccaggacgcc

SEQ ID NO: 7088525 - DNA, 22 bp, Homo sapiens
aggggcctcgcaggaccgctcc

SEQ ID NO: 7088526 - DNA, 20 bp, Homo sapiens
aggggcctggaacaggcctt

SEQ ID NO: 7088527 - DNA, 20 bp, Homo sapiens
aggggcctggaacaggcctt

SEQ ID NO: 7088528 - DNA, 22 bp, Homo sapiens
aggggcctcgcaggaccgctcc

SEQ ID NO: 7088529 - DNA, 22 bp, Homo sapiens
aggggccatgtaagtgtatcac

SEQ ID NO: 7088530 - DNA, 22 bp, Homo sapiens
aggggccatgtaagtgtatcac

SEQ ID NO: 7088531 - DNA, 22 bp, Homo sapiens
aggggccatgtaagtgtatcac

SEQ ID NO: 7088532 - DNA, 22 bp, Homo sapiens
aggggccattgttctgcccgct

SEQ ID NO: 7088533 - DNA, 22 bp, Homo sapiens
aggggccattgttctgcccgct

SEQ ID NO: 7088534 - DNA, 22 bp, Homo sapiens
aggggccattgttctgcccgct

SEQ ID NO: 7088535 - DNA, 21 bp, Homo sapiens
aggggcccttgccaggacgcc

SEQ ID NO: 7088536 - DNA, 21 bp, Homo sapiens
aggggcccttgccaggacgcc

SEQ ID NO: 7088537 - DNA, 21 bp, Homo sapiens
aggggcccttgccaggacgcc

SEQ ID NO: 7088538 - DNA, 22 bp, Homo sapiens
aggggcctcagcctcctggtca

SEQ ID NO: 7088539 - DNA, 22 bp, Homo sapiens
aggggccaccaccaaggaaggt

SEQ ID NO: 7088540 - DNA, 22 bp, Homo sapiens
aggggccaccaccaaggaaggt

SEQ ID NO: 7088541 - DNA, 22 bp, Homo sapiens
aggggccaccaccaaggaaggt

SEQ ID NO: 7088542 - DNA, 22 bp, Homo sapiens
aggggccacctgtggcaccctg

SEQ ID NO: 7088543 - DNA, 22 bp, Homo sapiens
aggggccaccaccaaggaaggt

SEQ ID NO: 7088544 - DNA, 22 bp, Homo sapiens
aggggccaccaccaaggaaggt

SEQ ID NO: 7088545 - DNA, 22 bp, Homo sapiens
aggggccacctgtggcaccctg

SEQ ID NO: 7088546 - DNA, 22 bp, Homo sapiens
aggggccacctgtggcaccctg

SEQ ID NO: 7088547 - DNA, 22 bp, Homo sapiens
aggggccacctgtggcaccctg

SEQ ID NO: 7088548 - DNA, 22 bp, Homo sapiens
acctcagctatttcaaaacaga

SEQ ID NO: 7088549 - DNA, 22 bp, Homo sapiens
acctcaggatgtggacacagaa

SEQ ID NO: 7088550 - DNA, 22 bp, Homo sapiens
acctcagaggccagggatctag

SEQ ID NO: 7088551 - DNA, 22 bp, Homo sapiens
acctcatctggtttgtaaggca

SEQ ID NO: 7088552 - DNA, 22 bp, Homo sapiens
acctccagctttttagagacat

SEQ ID NO: 7088553 - DNA, 22 bp, Homo sapiens
acctccaggaagctcttggtac

SEQ ID NO: 7088554 - DNA, 22 bp, Homo sapiens
acctcaagtgatccactcacct

SEQ ID NO: 7088555 - DNA, 22 bp, Homo sapiens
acctcaaggaaaatctagacag

SEQ ID NO: 7088556 - DNA, 21 bp, Homo sapiens
acctcaagcaacaaccaaggt

SEQ ID NO: 7088557 - DNA, 22 bp, Homo sapiens
acctcacaagtctctgtcagct

SEQ ID NO: 7088558 - DNA, 22 bp, Homo sapiens
acctcacaagtctctgtcagct

SEQ ID NO: 7088559 - DNA, 22 bp, Homo sapiens
acctcacaagtctctgtcagct

SEQ ID NO: 7088560 - DNA, 22 bp, Homo sapiens
acctcagagatacaaaccatgg

SEQ ID NO: 7088561 - DNA, 20 bp, Homo sapiens
aggggtgatcgggtgacact

SEQ ID NO: 7088562 - DNA, 20 bp, Homo sapiens
aggggtgatcgggtgacact

SEQ ID NO: 7088563 - DNA, 22 bp, Homo sapiens
aggggtgacacatatcagtgca

SEQ ID NO: 7088564 - DNA, 22 bp, Homo sapiens
acctcccagctctgagcttggg

SEQ ID NO: 7088565 - DNA, 20 bp, Homo sapiens
aggggtgatcgggtgacact

SEQ ID NO: 7088566 - DNA, 22 bp, Homo sapiens
aggggtgatttgggacaggaca

SEQ ID NO: 7088567 - DNA, 22 bp, Homo sapiens
aggggtgatttgggacaggaca

SEQ ID NO: 7088568 - DNA, 22 bp, Homo sapiens
aggggtgatttgggacaggaca

SEQ ID NO: 7088569 - DNA, 22 bp, Homo sapiens
acctcccagaaagttttgcagg

SEQ ID NO: 7088570 - DNA, 16 bp, Homo sapiens
acctccagtcaagggt

SEQ ID NO: 7088571 - DNA, 22 bp, Homo sapiens
acctccaggaagctcttggtac

SEQ ID NO: 7088572 - DNA, 22 bp, Homo sapiens
acctccagctttttagagacat

SEQ ID NO: 7088573 - DNA, 22 bp, Homo sapiens
acctcccagaaagttttgcagg

SEQ ID NO: 7088574 - DNA, 22 bp, Homo sapiens
aggggtggagagtgttgccagt

SEQ ID NO: 7088575 - DNA, 22 bp, Homo sapiens
aggggtggagagtgttgccagt

SEQ ID NO: 7088576 - DNA, 22 bp, Homo sapiens
aggggtggagagtgttgccagt

SEQ ID NO: 7088577 - DNA, 22 bp, Homo sapiens
aggggtggagagtgttgccagt

SEQ ID NO: 7088578 - DNA, 22 bp, Homo sapiens
aggggtggagagtgttgccagt

SEQ ID NO: 7088579 - DNA, 22 bp, Homo sapiens
aggggtggagagtgttgccagt

SEQ ID NO: 7088580 - DNA, 22 bp, Homo sapiens
aggggtggcctgccttactccc

SEQ ID NO: 7088581 - DNA, 22 bp, Homo sapiens
aggggtggcctgccttactccc

SEQ ID NO: 7088582 - DNA, 22 bp, Homo sapiens
aggggtggcctgccttactccc

SEQ ID NO: 7088583 - DNA, 22 bp, Homo sapiens
aggggtggcctgccttactccc

SEQ ID NO: 7088584 - DNA, 22 bp, Homo sapiens
aggggtggcctgccttactccc

SEQ ID NO: 7088585 - DNA, 22 bp, Homo sapiens
aggggtggcctgccttactccc

SEQ ID NO: 7088586 - DNA, 22 bp, Homo sapiens
agggtcagtgatgagggagccc

SEQ ID NO: 7088587 - DNA, 22 bp, Homo sapiens
agggtcagtgatgagggagccc

SEQ ID NO: 7088588 - DNA, 22 bp, Homo sapiens
agggtcagtgatgagggagccc

SEQ ID NO: 7088589 - DNA, 22 bp, Homo sapiens
aggggttggatttggcctagag

SEQ ID NO: 7088590 - DNA, 19 bp, Homo sapiens
agggtacacgagagaagag

SEQ ID NO: 7088591 - DNA, 22 bp, Homo sapiens
agggtcagtagtgatgcgtgaa

SEQ ID NO: 7088592 - DNA, 22 bp, Homo sapiens
aggggtgtgcatcctggaggat

SEQ ID NO: 7088593 - DNA, 22 bp, Homo sapiens
aggggtgtgcatcctggaggat

SEQ ID NO: 7088594 - DNA, 22 bp, Homo sapiens
aggggtgtgcatcctggaggat

SEQ ID NO: 7088595 - DNA, 22 bp, Homo sapiens
aggggtgtgcatcctggaggat

SEQ ID NO: 7088596 - DNA, 22 bp, Homo sapiens
aggggttggatttggcctagag

SEQ ID NO: 7088597 - DNA, 22 bp, Homo sapiens
aggggttggatttggcctagag

SEQ ID NO: 7088598 - DNA, 22 bp, Homo sapiens
aggggttggatttggcctagag

SEQ ID NO: 7088599 - DNA, 23 bp, Homo sapiens
aggggtggtcagtacccgcagtg

SEQ ID NO: 7088600 - DNA, 23 bp, Homo sapiens
aggggtggtcagtacccgcagtg

SEQ ID NO: 7088601 - DNA, 23 bp, Homo sapiens
aggggtggtcagtacccgcagtg

SEQ ID NO: 7088602 - DNA, 23 bp, Homo sapiens
aggggtggtcagtacccgcagtg

SEQ ID NO: 7088603 - DNA, 23 bp, Homo sapiens
aggggtggtcagtacccgcagtg

SEQ ID NO: 7088604 - DNA, 23 bp, Homo sapiens
aggggtggtcagtacccgcagtg

SEQ ID NO: 7088605 - DNA, 23 bp, Homo sapiens
aggggtggtcagtacccgcagtg

SEQ ID NO: 7088606 - DNA, 22 bp, Homo sapiens
agggcaatccagccagctgatc

SEQ ID NO: 7088607 - DNA, 22 bp, Homo sapiens
agggcaagttgagtgtgcgtgg

SEQ ID NO: 7088608 - DNA, 22 bp, Homo sapiens
agggcaatccagccagctgatc

SEQ ID NO: 7088609 - DNA, 22 bp, Homo sapiens
agggcaatgttgctgttcagaa

SEQ ID NO: 7088610 - DNA, 22 bp, Homo sapiens
agggcacaagactctgagcccc

SEQ ID NO: 7088611 - DNA, 22 bp, Homo sapiens
agggatgtgggaactgcaggtt

SEQ ID NO: 7088612 - DNA, 22 bp, Homo sapiens
agggatgtgggaactgcaggtt

SEQ ID NO: 7088613 - DNA, 22 bp, Homo sapiens
agggatgtgggaactgcaggtt

SEQ ID NO: 7088614 - DNA, 22 bp, Homo sapiens
agggatgtggtgggagagaaag

SEQ ID NO: 7088615 - DNA, 22 bp, Homo sapiens
agggatgttagttgtgagctca

SEQ ID NO: 7088616 - DNA, 22 bp, Homo sapiens
agggatgttcattttgtggctg

SEQ ID NO: 7088617 - DNA, 22 bp, Homo sapiens
agggatgttcattttgtggctg

SEQ ID NO: 7088618 - DNA, 22 bp, Homo sapiens
agggatgttgtcaaggatgtgg

SEQ ID NO: 7088619 - DNA, 19 bp, Homo sapiens
agggcacagggacagaagg

SEQ ID NO: 7088620 - DNA, 19 bp, Homo sapiens
agggcacagggacagaagg

SEQ ID NO: 7088621 - DNA, 21 bp, Homo sapiens
agggcacccccgctgcctacc

SEQ ID NO: 7088622 - DNA, 22 bp, Homo sapiens
agggcaccctctctgcagtacc

SEQ ID NO: 7088623 - DNA, 22 bp, Homo sapiens
agggcacctgttttagcttggt

SEQ ID NO: 7088624 - DNA, 22 bp, Homo sapiens
agggcacagcctaaagcctatg

SEQ ID NO: 7088625 - DNA, 22 bp, Homo sapiens
agggcacagcctaaagcctatg

SEQ ID NO: 7088626 - DNA, 19 bp, Homo sapiens
agggcacagggacagaagg

SEQ ID NO: 7088627 - DNA, 19 bp, Homo sapiens
agggcacagggacagaagg

SEQ ID NO: 7088628 - DNA, 22 bp, Homo sapiens
agggaggcattagctactgcga

SEQ ID NO: 7088629 - DNA, 22 bp, Homo sapiens
agggaggcattagctactgcga

SEQ ID NO: 7088630 - DNA, 22 bp, Homo sapiens
agggaggcattagctactgcga

SEQ ID NO: 7088631 - DNA, 22 bp, Homo sapiens
agggaggcattagctactgcga

SEQ ID NO: 7088632 - DNA, 22 bp, Homo sapiens
agggaggcattagctactgcga

SEQ ID NO: 7088633 - DNA, 22 bp, Homo sapiens
agggaggcattagctactgcga

SEQ ID NO: 7088634 - DNA, 19 bp, Homo sapiens
agggaggtagcattggaaa

SEQ ID NO: 7088635 - DNA, 19 bp, Homo sapiens
agggaggtagcattggaaa

SEQ ID NO: 7088636 - DNA, 22 bp, Homo sapiens
agggaggtccatccctgcagag

SEQ ID NO: 7088637 - DNA, 22 bp, Homo sapiens
agggaggtaggagcttctagct

SEQ ID NO: 7088638 - DNA, 17 bp, Homo sapiens
agggagtcagaggatcg

SEQ ID NO: 7088639 - DNA, 22 bp, Homo sapiens
agggaggtggttccccagtgga

SEQ ID NO: 7088640 - DNA, 22 bp, Homo sapiens
agggagtcaacacagtaatgtt

SEQ ID NO: 7088641 - DNA, 20 bp, Homo sapiens
agggaggtgctgggcctgag

SEQ ID NO: 7088642 - DNA, 22 bp, Homo sapiens
agggaggtctggctgccctgag

SEQ ID NO: 7088643 - DNA, 22 bp, Homo sapiens
agggaggtctttgaggggctta

SEQ ID NO: 7088644 - DNA, 22 bp, Homo sapiens
agggaggatctgctccttgtct

SEQ ID NO: 7088645 - DNA, 22 bp, Homo sapiens
agggaggatctgctccttgtct

SEQ ID NO: 7088646 - DNA, 22 bp, Homo sapiens
agggaggatctgctccttgtct

SEQ ID NO: 7088647 - DNA, 22 bp, Homo sapiens
agggaggcaggaaagttgtctg

SEQ ID NO: 7088648 - DNA, 22 bp, Homo sapiens
agggaggatctgctccttgtct

SEQ ID NO: 7088649 - DNA, 22 bp, Homo sapiens
agggagctgactggctgccatt

SEQ ID NO: 7088650 - DNA, 22 bp, Homo sapiens
agggagctgactggctgccatt

SEQ ID NO: 7088651 - DNA, 22 bp, Homo sapiens
agggaggatagtagtcagttta

SEQ ID NO: 7088652 - DNA, 22 bp, Homo sapiens
agggaggatagtagtcagttta

SEQ ID NO: 7088653 - DNA, 22 bp, Homo sapiens
agggaggatagtagtcagttta

SEQ ID NO: 7088654 - DNA, 22 bp, Homo sapiens
accagagctcttcagcacagga

SEQ ID NO: 7088655 - DNA, 20 bp, Homo sapiens
accagagctctcagtatgtg

SEQ ID NO: 7088656 - DNA, 20 bp, Homo sapiens
accagagctctcagtatgtg

SEQ ID NO: 7088657 - DNA, 22 bp, Homo sapiens
agggagctgactggctgccatt

SEQ ID NO: 7088658 - DNA, 22 bp, Homo sapiens
agggagctgactggctgccatt

SEQ ID NO: 7088659 - DNA, 22 bp, Homo sapiens
accagagcccatctgctcctag

SEQ ID NO: 7088660 - DNA, 22 bp, Homo sapiens
accagagcccatctgctcctag

SEQ ID NO: 7088661 - DNA, 18 bp, Homo sapiens
accagagccctgttctgg

SEQ ID NO: 7088662 - DNA, 18 bp, Homo sapiens
accagagccctgttctgg

SEQ ID NO: 7088663 - DNA, 22 bp, Homo sapiens
accagagcgctcaagccttccc

SEQ ID NO: 7088664 - DNA, 22 bp, Homo sapiens
accagagaaaacacagcaggct

SEQ ID NO: 7088665 - DNA, 22 bp, Homo sapiens
accagagaatgtgcatctctaa

SEQ ID NO: 7088666 - DNA, 20 bp, Homo sapiens
accagagactggggacaagt

SEQ ID NO: 7088667 - DNA, 22 bp, Homo sapiens
accagagagagacagggttgtg

SEQ ID NO: 7088668 - DNA, 22 bp, Homo sapiens
accagagagcctaggctgggca

SEQ ID NO: 7088669 - DNA, 22 bp, Homo sapiens
accagagagcctaggctgggca

SEQ ID NO: 7088670 - DNA, 22 bp, Homo sapiens
accagagaggctgcagtgtgtg

SEQ ID NO: 7088671 - DNA, 20 bp, Homo sapiens
accagagatagcaatagtgc

SEQ ID NO: 7088672 - DNA, 22 bp, Homo sapiens
accagagatggggcttctctgt

SEQ ID NO: 7088673 - DNA, 22 bp, Homo sapiens
accagagcagactactggaggt

SEQ ID NO: 7088674 - DNA, 22 bp, Homo sapiens
agggccagttcagaggacatgg

SEQ ID NO: 7088675 - DNA, 22 bp, Homo sapiens
agggccagttctacctctgaat

SEQ ID NO: 7088676 - DNA, 22 bp, Homo sapiens
agggccagttctacctctgaat

SEQ ID NO: 7088677 - DNA, 22 bp, Homo sapiens
agggccagttctacctctgaat

SEQ ID NO: 7088678 - DNA, 22 bp, Homo sapiens
agggccagttcagaggacatgg

SEQ ID NO: 7088679 - DNA, 22 bp, Homo sapiens
agggccagttcagaggacatgg

SEQ ID NO: 7088680 - DNA, 22 bp, Homo sapiens
agggctcaccactgtgcactcc

SEQ ID NO: 7088681 - DNA, 22 bp, Homo sapiens
agggctcaccactgtgcactcc

SEQ ID NO: 7088682 - DNA, 22 bp, Homo sapiens
agggctcaccactgtgcactcc

SEQ ID NO: 7088683 - DNA, 22 bp, Homo sapiens
agggctcaatggtgggcatgta

SEQ ID NO: 7088684 - DNA, 22 bp, Homo sapiens
agggctcaatggtgggcatgta

SEQ ID NO: 7088685 - DNA, 22 bp, Homo sapiens
agggctcaatggtgggcatgta

SEQ ID NO: 7088686 - DNA, 22 bp, Homo sapiens
agggctcaatggtgggcatgta

SEQ ID NO: 7088687 - DNA, 22 bp, Homo sapiens
agggctcaatggtgggcatgta

SEQ ID NO: 7088688 - DNA, 22 bp, Homo sapiens
agggctcaagggcatgctacgt

SEQ ID NO: 7088689 - DNA, 22 bp, Homo sapiens
agggctcaagggcatgctacgt

SEQ ID NO: 7088690 - DNA, 22 bp, Homo sapiens
agggccagtaaatgtttcctca

SEQ ID NO: 7088691 - DNA, 22 bp, Homo sapiens
agggccagtaccaggtgggtgg

SEQ ID NO: 7088692 - DNA, 22 bp, Homo sapiens
agggccagtaccaggtgggtgg

SEQ ID NO: 7088693 - DNA, 22 bp, Homo sapiens
agggccagtaccaggtgggtgg

SEQ ID NO: 7088694 - DNA, 22 bp, Homo sapiens
agggccagtaaatgtttcctca

SEQ ID NO: 7088695 - DNA, 22 bp, Homo sapiens
agggccagtaaatgtttcctca

SEQ ID NO: 7088696 - DNA, 22 bp, Homo sapiens
agggccagtattaaggtaatta

SEQ ID NO: 7088697 - DNA, 22 bp, Homo sapiens
agggccagtaccaggtgggtgg

SEQ ID NO: 7088698 - DNA, 22 bp, Homo sapiens
agggccagtaccaggtgggtgg

SEQ ID NO: 7088699 - DNA, 22 bp, Homo sapiens
agggccagtaccaggtgggtgg

SEQ ID NO: 7088700 - DNA, 22 bp, Homo sapiens
agggccagtattaaggtaatta

SEQ ID NO: 7088701 - DNA, 22 bp, Homo sapiens
agggccagtaccaggtgggtgg

SEQ ID NO: 7088702 - DNA, 22 bp, Homo sapiens
agggccagttcagaggacatgg

SEQ ID NO: 7088703 - DNA, 22 bp, Homo sapiens
agggccagttcagaggacatgg

SEQ ID NO: 7088704 - DNA, 22 bp, Homo sapiens
agggccagttcagaggacatgg

SEQ ID NO: 7088705 - DNA, 22 bp, Homo sapiens
agggccagtgggttgaaaggca

SEQ ID NO: 7088706 - DNA, 22 bp, Homo sapiens
agggccagtgggttgaaaggca

SEQ ID NO: 7088707 - DNA, 22 bp, Homo sapiens
agggccagtgggttgaaaggca

SEQ ID NO: 7088708 - DNA, 22 bp, Homo sapiens
agggccagtgggttgaaaggca

SEQ ID NO: 7088709 - DNA, 22 bp, Homo sapiens
agggccagttcagaggacatgg

SEQ ID NO: 7088710 - DNA, 22 bp, Homo sapiens
agggccagttcagaggacatgg

SEQ ID NO: 7088711 - DNA, 22 bp, Homo sapiens
agggccagtattaaggtaatta

SEQ ID NO: 7088712 - DNA, 22 bp, Homo sapiens
agggccagtattaaggtaatta

SEQ ID NO: 7088713 - DNA, 22 bp, Homo sapiens
agggccagtattaaggtaatta

SEQ ID NO: 7088714 - DNA, 22 bp, Homo sapiens
agggccagtcgtgtattactgt

SEQ ID NO: 7088715 - DNA, 22 bp, Homo sapiens
agggccagtgggttgaaaggca

SEQ ID NO: 7088716 - DNA, 22 bp, Homo sapiens
agggccagtgggttgaaaggca

SEQ ID NO: 7088717 - DNA, 22 bp, Homo sapiens
agggccagtcgtgtattactgt

SEQ ID NO: 7088718 - DNA, 22 bp, Homo sapiens
agggccagtgggttgaaaggca

SEQ ID NO: 7088719 - DNA, 22 bp, Homo sapiens
agggccagtgggttgaaaggca

SEQ ID NO: 7088720 - DNA, 22 bp, Homo sapiens
agggccagcactcctggcagga

SEQ ID NO: 7088721 - DNA, 22 bp, Homo sapiens
agggccagcactcctggcagga

SEQ ID NO: 7088722 - DNA, 22 bp, Homo sapiens
agggccagcactcctggcagga

SEQ ID NO: 7088723 - DNA, 22 bp, Homo sapiens
agggccagcagcttggccaacc

SEQ ID NO: 7088724 - DNA, 22 bp, Homo sapiens
agggccagcactcctggcagga

SEQ ID NO: 7088725 - DNA, 22 bp, Homo sapiens
agggccagcactcctggcagga

SEQ ID NO: 7088726 - DNA, 22 bp, Homo sapiens
agggccagcccataatgccaaa

SEQ ID NO: 7088727 - DNA, 22 bp, Homo sapiens
agggccagccaggccctacaaa

SEQ ID NO: 7088728 - DNA, 22 bp, Homo sapiens
agggccagcagcttggccaacc

SEQ ID NO: 7088729 - DNA, 22 bp, Homo sapiens
agggccagcagcttggccaacc

SEQ ID NO: 7088730 - DNA, 22 bp, Homo sapiens
agggccagccaggccctacaaa

SEQ ID NO: 7088731 - DNA, 22 bp, Homo sapiens
agggccagcccataatgccaaa

SEQ ID NO: 7088732 - DNA, 22 bp, Homo sapiens
agggccagcccataatgccaaa

SEQ ID NO: 7088733 - DNA, 22 bp, Homo sapiens
agggccagcccataatgccaaa

SEQ ID NO: 7088734 - DNA, 22 bp, Homo sapiens
agggccagcccataatgccaaa

SEQ ID NO: 7088735 - DNA, 22 bp, Homo sapiens
agggccagcactcctggcagga

SEQ ID NO: 7088736 - DNA, 22 bp, Homo sapiens
agggccagcactcctggcagga

SEQ ID NO: 7088737 - DNA, 22 bp, Homo sapiens
agggccagcactcctggcagga

SEQ ID NO: 7088738 - DNA, 22 bp, Homo sapiens
agggccagcactcctggcagga

SEQ ID NO: 7088739 - DNA, 21 bp, Homo sapiens
agggccagatcaccaaggagc

SEQ ID NO: 7088740 - DNA, 22 bp, Homo sapiens
agggcatgctggaggagagaca

SEQ ID NO: 7088741 - DNA, 21 bp, Homo sapiens
agggccagatcaccaaggagc

SEQ ID NO: 7088742 - DNA, 22 bp, Homo sapiens
agggcatgctggaggagagaca

SEQ ID NO: 7088743 - DNA, 22 bp, Homo sapiens
agggcatgctggaggagagaca

SEQ ID NO: 7088744 - DNA, 23 bp, Homo sapiens
agggcactgttgggtgttgagga

SEQ ID NO: 7088745 - DNA, 23 bp, Homo sapiens
agggcactgttgggtgttgagga

SEQ ID NO: 7088746 - DNA, 22 bp, Homo sapiens
agggcactgcaagggttgaagg

SEQ ID NO: 7088747 - DNA, 22 bp, Homo sapiens
agggcactgcaagggttgaagg

SEQ ID NO: 7088748 - DNA, 23 bp, Homo sapiens
agggcactgaagctggaattggg

SEQ ID NO: 7088749 - DNA, 23 bp, Homo sapiens
agggcactgaagctggaattggg

SEQ ID NO: 7088750 - DNA, 22 bp, Homo sapiens
agggcactgaacagctgtagca

SEQ ID NO: 7088751 - DNA, 18 bp, Homo sapiens
agggcacggtgccagcct

SEQ ID NO: 7088752 - DNA, 18 bp, Homo sapiens
agggcacggtgccagcct

SEQ ID NO: 7088753 - DNA, 22 bp, Homo sapiens
agggcactccttggcagctctg

SEQ ID NO: 7088754 - DNA, 22 bp, Homo sapiens
agggcactccttggcagctctg

SEQ ID NO: 7088755 - DNA, 22 bp, Homo sapiens
aggctctccagagagctgcttt

SEQ ID NO: 7088756 - DNA, 22 bp, Homo sapiens
aggctctccagagagctgcttt

SEQ ID NO: 7088757 - DNA, 22 bp, Homo sapiens
aggctctcctccccaggaccat

SEQ ID NO: 7088758 - DNA, 22 bp, Homo sapiens
aggctctcctccccaggaccat

SEQ ID NO: 7088759 - DNA, 22 bp, Homo sapiens
aggctctataccgctgggagtt

SEQ ID NO: 7088760 - DNA, 22 bp, Homo sapiens
aggctctcaatatgatccagtc

SEQ ID NO: 7088761 - DNA, 22 bp, Homo sapiens
aggctctcaatatgatccagtc

SEQ ID NO: 7088762 - DNA, 22 bp, Homo sapiens
aggctctcaccctctgaccaga

SEQ ID NO: 7088763 - DNA, 22 bp, Homo sapiens
aggctctcaccctctgaccaga

SEQ ID NO: 7088764 - DNA, 22 bp, Homo sapiens
aggctctcaccctctgaccaga

SEQ ID NO: 7088765 - DNA, 22 bp, Homo sapiens
aggctctcactatcctcctagc

SEQ ID NO: 7088766 - DNA, 22 bp, Homo sapiens
aggctctcagatcagccacatt

SEQ ID NO: 7088767 - DNA, 22 bp, Homo sapiens
aggctctcctccccaggaccat

SEQ ID NO: 7088768 - DNA, 22 bp, Homo sapiens
aggctctctagaaactgtgcct

SEQ ID NO: 7088769 - DNA, 22 bp, Homo sapiens
aggctctctagaaactgtgcct

SEQ ID NO: 7088770 - DNA, 22 bp, Homo sapiens
aggctctctagaaactgtgcct

SEQ ID NO: 7088771 - DNA, 22 bp, Homo sapiens
aggctctctctgccagccgtgc

SEQ ID NO: 7088772 - DNA, 22 bp, Homo sapiens
aggctctctctgccagccgtgc

SEQ ID NO: 7088773 - DNA, 22 bp, Homo sapiens
aggctctctctgccagccgtgc

SEQ ID NO: 7088774 - DNA, 22 bp, Homo sapiens
aggctctctctgccagccgtgc

SEQ ID NO: 7088775 - DNA, 22 bp, Homo sapiens
aggctctctctgcccctgggac

SEQ ID NO: 7088776 - DNA, 22 bp, Homo sapiens
aggctctgaagcaaccctttga

SEQ ID NO: 7088777 - DNA, 22 bp, Homo sapiens
aggctctgaaggagaacctgtt

SEQ ID NO: 7088778 - DNA, 22 bp, Homo sapiens
aggctctgaaggagaacctgtt

SEQ ID NO: 7088779 - DNA, 22 bp, Homo sapiens
aggctctgacccatgggaccca

SEQ ID NO: 7088780 - DNA, 22 bp, Homo sapiens
aggctctggagtgtggtgctgg

SEQ ID NO: 7088781 - DNA, 22 bp, Homo sapiens
aggctctggagttagccaggca

SEQ ID NO: 7088782 - DNA, 22 bp, Homo sapiens
aggctctggagttagccaggca

SEQ ID NO: 7088783 - DNA, 22 bp, Homo sapiens
aggctctggagttagccaggca

SEQ ID NO: 7088784 - DNA, 22 bp, Homo sapiens
aggctctggacagtgaggagtt

SEQ ID NO: 7088785 - DNA, 22 bp, Homo sapiens
aggctctggagaagaatccgct

SEQ ID NO: 7088786 - DNA, 22 bp, Homo sapiens
aggctctggagtgtggtgctgg

SEQ ID NO: 7088787 - DNA, 22 bp, Homo sapiens
aggctctgacgtcacacgtggc

SEQ ID NO: 7088788 - DNA, 22 bp, Homo sapiens
aggctctgacgtcacacgtggc

SEQ ID NO: 7088789 - DNA, 22 bp, Homo sapiens
aggctctgacgtcacacgtggc

SEQ ID NO: 7088790 - DNA, 22 bp, Homo sapiens
aggctctgacccatgggaccca

SEQ ID NO: 7088791 - DNA, 22 bp, Homo sapiens
aggctctgacccatgggaccca

SEQ ID NO: 7088792 - DNA, 22 bp, Homo sapiens
aggctctgacccatgggaccca

SEQ ID NO: 7088793 - DNA, 22 bp, Homo sapiens
aggctctgacccatgggaccca

SEQ ID NO: 7088794 - DNA, 19 bp, Homo sapiens
aggctctgagctcctggag

SEQ ID NO: 7088795 - DNA, 22 bp, Homo sapiens
aggctctgcttttctggatata

SEQ ID NO: 7088796 - DNA, 22 bp, Homo sapiens
aggctctggacagtgaggagtt

SEQ ID NO: 7088797 - DNA, 22 bp, Homo sapiens
aggctctggacagtgaggagtt

SEQ ID NO: 7088798 - DNA, 22 bp, Homo sapiens
aggctctggacagtgaggagtt

SEQ ID NO: 7088799 - DNA, 22 bp, Homo sapiens
acattaaatttcatagtgatta

SEQ ID NO: 7088800 - DNA, 22 bp, Homo sapiens
acattaaagagtaaggttagtt

SEQ ID NO: 7088801 - DNA, 22 bp, Homo sapiens
acattaaatttcatagtgatta

SEQ ID NO: 7088802 - DNA, 22 bp, Homo sapiens
acattaaatttcatagtgatta

SEQ ID NO: 7088803 - DNA, 22 bp, Homo sapiens
acattaacaccataagtgtgtt

SEQ ID NO: 7088804 - DNA, 22 bp, Homo sapiens
aggctctaaggagggctgtcta

SEQ ID NO: 7088805 - DNA, 22 bp, Homo sapiens
aggctcagggactccctccctc

SEQ ID NO: 7088806 - DNA, 20 bp, Homo sapiens
aggctcagggtgtttaggaa

SEQ ID NO: 7088807 - DNA, 20 bp, Homo sapiens
aggctcagggtgtttaggaa

SEQ ID NO: 7088808 - DNA, 20 bp, Homo sapiens
aggctcagggtgtttaggaa

SEQ ID NO: 7088809 - DNA, 20 bp, Homo sapiens
aggctcagggtgtttaggaa

SEQ ID NO: 7088810 - DNA, 22 bp, Homo sapiens
aggctcaggtctcaggtctggc

SEQ ID NO: 7088811 - DNA, 22 bp, Homo sapiens
aggctcaggtctcaggtctggc

SEQ ID NO: 7088812 - DNA, 22 bp, Homo sapiens
aggctcaggtctcaggtctggc

SEQ ID NO: 7088813 - DNA, 22 bp, Homo sapiens
aggctcaggtctcaggtctggc

SEQ ID NO: 7088814 - DNA, 22 bp, Homo sapiens
aggctcaggtctcaggtctggc

SEQ ID NO: 7088815 - DNA, 22 bp, Homo sapiens
aggctcaggtctcaggtctggc

SEQ ID NO: 7088816 - DNA, 22 bp, Homo sapiens
aggctcaggtctcaggtctggc

SEQ ID NO: 7088817 - DNA, 22 bp, Homo sapiens
acatgttttgtgccttgactag

SEQ ID NO: 7088818 - DNA, 22 bp, Homo sapiens
acattaaaaaatgttgcatgaa

SEQ ID NO: 7088819 - DNA, 22 bp, Homo sapiens
acattaaaatggagaattttga

SEQ ID NO: 7088820 - DNA, 22 bp, Homo sapiens
acattaaaatggagaattttga

SEQ ID NO: 7088821 - DNA, 22 bp, Homo sapiens
acatgtatgtgtgcaaacacat

SEQ ID NO: 7088822 - DNA, 22 bp, Homo sapiens
acatgtatgtgtgcaaacacat

SEQ ID NO: 7088823 - DNA, 22 bp, Homo sapiens
acatgtattgacattatattct

SEQ ID NO: 7088824 - DNA, 19 bp, Homo sapiens
acatgtagtagagagagaa

SEQ ID NO: 7088825 - DNA, 22 bp, Homo sapiens
acatgtatctgatctgcaattg

SEQ ID NO: 7088826 - DNA, 20 bp, Homo sapiens
acatgtactaatgaatacag

SEQ ID NO: 7088827 - DNA, 22 bp, Homo sapiens
acatgtactgttggtgaagagg

SEQ ID NO: 7088828 - DNA, 20 bp, Homo sapiens
acatgtactaatgaatacag

SEQ ID NO: 7088829 - DNA, 22 bp, Homo sapiens
acatgtaggagagtcacaatgc

SEQ ID NO: 7088830 - DNA, 20 bp, Homo sapiens
acatgtactaatgaatacag

SEQ ID NO: 7088831 - DNA, 22 bp, Homo sapiens
acatgtacatacacatatgtaa

SEQ ID NO: 7088832 - DNA, 22 bp, Homo sapiens
acatgtacatacacatatgtaa

SEQ ID NO: 7088833 - DNA, 21 bp, Homo sapiens
acatgtaagagagtttcaaga

SEQ ID NO: 7088834 - DNA, 21 bp, Homo sapiens
acatgtaagagagtttcaaga

SEQ ID NO: 7088835 - DNA, 22 bp, Homo sapiens
acatgtaagactagcttaaagt

SEQ ID NO: 7088836 - DNA, 22 bp, Homo sapiens
acatgtaacatatatgtagcat

SEQ ID NO: 7088837 - DNA, 22 bp, Homo sapiens
acatgtaacatatatgtagcat

SEQ ID NO: 7088838 - DNA, 22 bp, Homo sapiens
acatgtaaacatttacagtatt

SEQ ID NO: 7088839 - DNA, 22 bp, Homo sapiens
acatgtaaaaggaacatgcatg

SEQ ID NO: 7088840 - DNA, 22 bp, Homo sapiens
acatgtaaaagataaattaaca

SEQ ID NO: 7088841 - DNA, 22 bp, Homo sapiens
acatgtaaaaggaacatgcatg

SEQ ID NO: 7088842 - DNA, 22 bp, Homo sapiens
acatggctcagtctcatgacag

SEQ ID NO: 7088843 - DNA, 22 bp, Homo sapiens
aggcagtgtgtagctggaagag

SEQ ID NO: 7088844 - DNA, 20 bp, Homo sapiens
acatggcattcccacgtggt

SEQ ID NO: 7088845 - DNA, 22 bp, Homo sapiens
acatggcgggagtttcagatac

SEQ ID NO: 7088846 - DNA, 22 bp, Homo sapiens
acatggctaaagcaagtctaga

SEQ ID NO: 7088847 - DNA, 22 bp, Homo sapiens
acatggctaaagcaagtctaga

SEQ ID NO: 7088848 - DNA, 20 bp, Homo sapiens
aggctcagctgagctcttgg

SEQ ID NO: 7088849 - DNA, 22 bp, Homo sapiens
aggctcagctggtggtgatcgc

SEQ ID NO: 7088850 - DNA, 22 bp, Homo sapiens
aggctcagctggtggtgatcgc

SEQ ID NO: 7088851 - DNA, 22 bp, Homo sapiens
aggctcagctggtggtgatcgc

SEQ ID NO: 7088852 - DNA, 22 bp, Homo sapiens
aggctcagctggtggtgatcgc

SEQ ID NO: 7088853 - DNA, 22 bp, Homo sapiens
aggctcagctggtggtgatcgc

SEQ ID NO: 7088854 - DNA, 22 bp, Homo sapiens
aggctcaggaggagctgccgga

SEQ ID NO: 7088855 - DNA, 22 bp, Homo sapiens
aggctcagacaggaaaagtaac

SEQ ID NO: 7088856 - DNA, 22 bp, Homo sapiens
aggctcagacaggaaaagtaac

SEQ ID NO: 7088857 - DNA, 22 bp, Homo sapiens
aggctcagacaggaaaagtaac

SEQ ID NO: 7088858 - DNA, 20 bp, Homo sapiens
aggctcagctgagctcttgg

SEQ ID NO: 7088859 - DNA, 20 bp, Homo sapiens
aggctcagctgagctcttgg

SEQ ID NO: 7088860 - DNA, 20 bp, Homo sapiens
aggctcagctgagctcttgg

SEQ ID NO: 7088861 - DNA, 22 bp, Homo sapiens
aggctcaggaggagctgccgga

SEQ ID NO: 7088862 - DNA, 22 bp, Homo sapiens
aggctcaggaggagctgccgga

SEQ ID NO: 7088863 - DNA, 22 bp, Homo sapiens
aggctcaggaggagctgccgga

SEQ ID NO: 7088864 - DNA, 22 bp, Homo sapiens
aggctcaggaggagctgccgga

SEQ ID NO: 7088865 - DNA, 22 bp, Homo sapiens
aggctcaggcaggaatggcgga

SEQ ID NO: 7088866 - DNA, 22 bp, Homo sapiens
aggctcaggcaggaatggcgga

SEQ ID NO: 7088867 - DNA, 22 bp, Homo sapiens
aggctcaggcaggaatggcgga

SEQ ID NO: 7088868 - DNA, 22 bp, Homo sapiens
aggctcaggcaggaatggcgga

SEQ ID NO: 7088869 - DNA, 22 bp, Homo sapiens
aggctcagggacggggcccctt

SEQ ID NO: 7088870 - DNA, 22 bp, Homo sapiens
aggctcagggacggggcccctt

SEQ ID NO: 7088871 - DNA, 22 bp, Homo sapiens
aggctcagggacggggcccctt

SEQ ID NO: 7088872 - DNA, 22 bp, Homo sapiens
aggctcagggacggggcccctt

SEQ ID NO: 7088873 - DNA, 22 bp, Homo sapiens
aggctcagggacggggcccctt

SEQ ID NO: 7088874 - DNA, 22 bp, Homo sapiens
aggctcagggactccctccctc

SEQ ID NO: 7088875 - DNA, 22 bp, Homo sapiens
aggctcagggactccctccctc

SEQ ID NO: 7088876 - DNA, 22 bp, Homo sapiens
aggctcagggactccctccctc

SEQ ID NO: 7088877 - DNA, 22 bp, Homo sapiens
acatgtgcagacagcaagcagg

SEQ ID NO: 7088878 - DNA, 22 bp, Homo sapiens
acatgtgctcttgctgtacagc

SEQ ID NO: 7088879 - DNA, 23 bp, Homo sapiens
acatgtggagagaacagatatct

SEQ ID NO: 7088880 - DNA, 22 bp, Homo sapiens
acatgtggaggaggcgagggta

SEQ ID NO: 7088881 - DNA, 23 bp, Homo sapiens
acatgtggagagaacagatatct

SEQ ID NO: 7088882 - DNA, 21 bp, Homo sapiens
acatgtgggcctgctgctcct

SEQ ID NO: 7088883 - DNA, 22 bp, Homo sapiens
acatgtggtcaatctgtgtagg

SEQ ID NO: 7088884 - DNA, 22 bp, Homo sapiens
acatgtgtaaaagtggataaaa

SEQ ID NO: 7088885 - DNA, 22 bp, Homo sapiens
acatgtgtaagatgtgatatat

SEQ ID NO: 7088886 - DNA, 22 bp, Homo sapiens
acatgtgtaagatgtgatatat

SEQ ID NO: 7088887 - DNA, 22 bp, Homo sapiens
aggctcagacaggaaaagtaac

SEQ ID NO: 7088888 - DNA, 22 bp, Homo sapiens
acatgtcttttaaagtctaata

SEQ ID NO: 7088889 - DNA, 22 bp, Homo sapiens
acatgtcttttaaagtctaata

SEQ ID NO: 7088890 - DNA, 22 bp, Homo sapiens
aggctctggcaacagctggtgt

SEQ ID NO: 7088891 - DNA, 22 bp, Homo sapiens
aggctctggcaacagctggtgt

SEQ ID NO: 7088892 - DNA, 22 bp, Homo sapiens
aggctctggcaacagctggtgt

SEQ ID NO: 7088893 - DNA, 22 bp, Homo sapiens
aggctctggcaacagctggtgt

SEQ ID NO: 7088894 - DNA, 22 bp, Homo sapiens
aggctctggctactacagagct

SEQ ID NO: 7088895 - DNA, 22 bp, Homo sapiens
aggctctggctactacagagct

SEQ ID NO: 7088896 - DNA, 22 bp, Homo sapiens
aggctctggagttagccaggca

SEQ ID NO: 7088897 - DNA, 22 bp, Homo sapiens
aggctctggagttagccaggca

SEQ ID NO: 7088898 - DNA, 22 bp, Homo sapiens
aggctctggcaacagctggtgt

SEQ ID NO: 7088899 - DNA, 22 bp, Homo sapiens
aggctctggagttagccaggca

SEQ ID NO: 7088900 - DNA, 22 bp, Homo sapiens
aggctctggcaacagctggtgt

SEQ ID NO: 7088901 - DNA, 22 bp, Homo sapiens
aggctctggcaacagctggtgt

SEQ ID NO: 7088902 - DNA, 23 bp, Homo sapiens
aggctgcagaagaatagggtcat

SEQ ID NO: 7088903 - DNA, 22 bp, Homo sapiens
aggctgctctgcgaagtcagct

SEQ ID NO: 7088904 - DNA, 21 bp, Homo sapiens
aggctgctctttcttgtggta

SEQ ID NO: 7088905 - DNA, 21 bp, Homo sapiens
aggctgctctttcttgtggta

SEQ ID NO: 7088906 - DNA, 21 bp, Homo sapiens
aggctgctctttcttgtggta

SEQ ID NO: 7088907 - DNA, 21 bp, Homo sapiens
aggctgctctttcttgtggta

SEQ ID NO: 7088908 - DNA, 23 bp, Homo sapiens
aggctgctgagatgggtgtgtca

SEQ ID NO: 7088909 - DNA, 23 bp, Homo sapiens
aggctgctgagatgggtgtgtca

SEQ ID NO: 7088910 - DNA, 22 bp, Homo sapiens
aggctgctgccttggagagtgt

SEQ ID NO: 7088911 - DNA, 22 bp, Homo sapiens
aggctgctgccttggagagtgt

SEQ ID NO: 7088912 - DNA, 22 bp, Homo sapiens
aggctgctgccttggagagtgt

SEQ ID NO: 7088913 - DNA, 22 bp, Homo sapiens
aggctgctgctctacagttgct

SEQ ID NO: 7088914 - DNA, 22 bp, Homo sapiens
aggctgctgctctacagttgct

SEQ ID NO: 7088915 - DNA, 22 bp, Homo sapiens
aggctgctggcaggcgtggacg

SEQ ID NO: 7088916 - DNA, 22 bp, Homo sapiens
aggctgctggcaggcgtggacg

SEQ ID NO: 7088917 - DNA, 22 bp, Homo sapiens
aggctgctggcaggcgtggacg

SEQ ID NO: 7088918 - DNA, 22 bp, Homo sapiens
aggctgctggctaagaataaga

SEQ ID NO: 7088919 - DNA, 21 bp, Homo sapiens
aggctgctggctcagggtcct

SEQ ID NO: 7088920 - DNA, 22 bp, Homo sapiens
aggctgcttcagctgcagggag

SEQ ID NO: 7088921 - DNA, 22 bp, Homo sapiens
aggctgcttcaatggataagat

SEQ ID NO: 7088922 - DNA, 22 bp, Homo sapiens
aggctgcttcagctgcagggag

SEQ ID NO: 7088923 - DNA, 23 bp, Homo sapiens
aggctgcttactggtatcagagc

SEQ ID NO: 7088924 - DNA, 22 bp, Homo sapiens
aggctgcttcaatggataagat

SEQ ID NO: 7088925 - DNA, 17 bp, Homo sapiens
aggctgctgggccaggg

SEQ ID NO: 7088926 - DNA, 17 bp, Homo sapiens
aggctgctgggccaggg

SEQ ID NO: 7088927 - DNA, 17 bp, Homo sapiens
aggctgctgggccaggg

SEQ ID NO: 7088928 - DNA, 23 bp, Homo sapiens
aggctgcttactggtatcagagc

SEQ ID NO: 7088929 - DNA, 23 bp, Homo sapiens
aggctgcttactggtatcagagc

SEQ ID NO: 7088930 - DNA, 21 bp, Homo sapiens
aggctgctggctcagggtcct

SEQ ID NO: 7088931 - DNA, 17 bp, Homo sapiens
aggctgctgggccaggg

SEQ ID NO: 7088932 - DNA, 22 bp, Homo sapiens
aggctggcttcccaagcgtcct

SEQ ID NO: 7088933 - DNA, 22 bp, Homo sapiens
aggctggcttcccaagcgtcct

SEQ ID NO: 7088934 - DNA, 22 bp, Homo sapiens
aggctggcttggctctcctgtg

SEQ ID NO: 7088935 - DNA, 23 bp, Homo sapiens
aggctggcttcaggagcctctcc

SEQ ID NO: 7088936 - DNA, 23 bp, Homo sapiens
aggctggcttcaggagcctctcc

SEQ ID NO: 7088937 - DNA, 22 bp, Homo sapiens
aggctggccagtgctgcagtgg

SEQ ID NO: 7088938 - DNA, 22 bp, Homo sapiens
aggctggctggggatgcgtctt

SEQ ID NO: 7088939 - DNA, 23 bp, Homo sapiens
aggctggcttcaggagcctctcc

SEQ ID NO: 7088940 - DNA, 23 bp, Homo sapiens
aggctggcttcaggagcctctcc

SEQ ID NO: 7088941 - DNA, 22 bp, Homo sapiens
acatttctcaggtaagtcattt

SEQ ID NO: 7088942 - DNA, 22 bp, Homo sapiens
aggctgggaaatgtattccagc

SEQ ID NO: 7088943 - DNA, 22 bp, Homo sapiens
aggctgggaaggtaaagttgta

SEQ ID NO: 7088944 - DNA, 22 bp, Homo sapiens
aggctgggaaatgtattccagc

SEQ ID NO: 7088945 - DNA, 22 bp, Homo sapiens
aggctgggaaatgtattccagc

SEQ ID NO: 7088946 - DNA, 22 bp, Homo sapiens
aggctgggaaatgtattccagc

SEQ ID NO: 7088947 - DNA, 22 bp, Homo sapiens
aggctgggaaatgtattccagc

SEQ ID NO: 7088948 - DNA, 22 bp, Homo sapiens
aggctgggaaatgtattccagc

SEQ ID NO: 7088949 - DNA, 22 bp, Homo sapiens
aggctgggaaatgtagtcttcc

SEQ ID NO: 7088950 - DNA, 22 bp, Homo sapiens
aggctgggaaatgtagtcttcc

SEQ ID NO: 7088951 - DNA, 22 bp, Homo sapiens
aggctgggaaatgtagtcttcc

SEQ ID NO: 7088952 - DNA, 22 bp, Homo sapiens
aggctgggaaatgtagtcttcc

SEQ ID NO: 7088953 - DNA, 22 bp, Homo sapiens
aggctgggaaatgtagtcttcc

SEQ ID NO: 7088954 - DNA, 22 bp, Homo sapiens
aggctgggaaatgtagtcttcc

SEQ ID NO: 7088955 - DNA, 22 bp, Homo sapiens
aggctgggaaatgtagtcttcc

SEQ ID NO: 7088956 - DNA, 22 bp, Homo sapiens
aggctggctttggtagcatggt

SEQ ID NO: 7088957 - DNA, 22 bp, Homo sapiens
aggctggctttggtagcatggt

SEQ ID NO: 7088958 - DNA, 22 bp, Homo sapiens
aggctggcttggctctcctgtg

SEQ ID NO: 7088959 - DNA, 22 bp, Homo sapiens
aggctggcttggctctcctgtg

SEQ ID NO: 7088960 - DNA, 22 bp, Homo sapiens
aggctggctttggtagcatggt

SEQ ID NO: 7088961 - DNA, 22 bp, Homo sapiens
aggctgggaaacctgaagttgt

SEQ ID NO: 7088962 - DNA, 22 bp, Homo sapiens
aggctgggaaacctgaagttgt

SEQ ID NO: 7088963 - DNA, 22 bp, Homo sapiens
aggctgggaaacctgaagttgt

SEQ ID NO: 7088964 - DNA, 22 bp, Homo sapiens
aggctgggaaacctgaagttgt

SEQ ID NO: 7088965 - DNA, 22 bp, Homo sapiens
aggctgggaaacctgaagttgt

SEQ ID NO: 7088966 - DNA, 22 bp, Homo sapiens
aggctgggaaacctgaagttgt

SEQ ID NO: 7088967 - DNA, 22 bp, Homo sapiens
aggctgtgatctcatgatttgt

SEQ ID NO: 7088968 - DNA, 22 bp, Homo sapiens
aggctgtgatctcatgatttgt

SEQ ID NO: 7088969 - DNA, 19 bp, Homo sapiens
aggctgtgaggggaaggaa

SEQ ID NO: 7088970 - DNA, 22 bp, Homo sapiens
aggctgtgaggggcccgcatgc

SEQ ID NO: 7088971 - DNA, 22 bp, Homo sapiens
aggctgtgaggggcccgcatgc

SEQ ID NO: 7088972 - DNA, 22 bp, Homo sapiens
aggctgtgagtagttcttgttg

SEQ ID NO: 7088973 - DNA, 22 bp, Homo sapiens
aggctgtgagttttgtctcaga

SEQ ID NO: 7088974 - DNA, 19 bp, Homo sapiens
aggctgtgagggaggactc

SEQ ID NO: 7088975 - DNA, 19 bp, Homo sapiens
aggctgtgaggggaaggaa

SEQ ID NO: 7088976 - DNA, 19 bp, Homo sapiens
aggctgtgaggggaaggaa

SEQ ID NO: 7088977 - DNA, 19 bp, Homo sapiens
aggctgtgaggggaaggaa

SEQ ID NO: 7088978 - DNA, 19 bp, Homo sapiens
aggctgtgaggggaaggaa

SEQ ID NO: 7088979 - DNA, 19 bp, Homo sapiens
aggctgtgagggaggactc

SEQ ID NO: 7088980 - DNA, 19 bp, Homo sapiens
aggctgtgagggaggactc

SEQ ID NO: 7088981 - DNA, 22 bp, Homo sapiens
aggctgtgagaagtccttcagt

SEQ ID NO: 7088982 - DNA, 22 bp, Homo sapiens
aggctgtgagaagtccttcagt

SEQ ID NO: 7088983 - DNA, 22 bp, Homo sapiens
aggctgtgagaagtccttcagt

SEQ ID NO: 7088984 - DNA, 22 bp, Homo sapiens
aggctgtgagaggtggctccca

SEQ ID NO: 7088985 - DNA, 22 bp, Homo sapiens
aggctgtgagaggtggctccca

SEQ ID NO: 7088986 - DNA, 19 bp, Homo sapiens
aggctgtgagggaggactc

SEQ ID NO: 7088987 - DNA, 19 bp, Homo sapiens
aggctgtgagggaggactc

SEQ ID NO: 7088988 - DNA, 19 bp, Homo sapiens
aggctgtgagggaggactc

SEQ ID NO: 7088989 - DNA, 19 bp, Homo sapiens
aggctgtgagggaggactc

SEQ ID NO: 7088990 - DNA, 19 bp, Homo sapiens
aggctgtgagggaggactc

SEQ ID NO: 7088991 - DNA, 22 bp, Homo sapiens
aggctgtgagcaagaacaccta

SEQ ID NO: 7088992 - DNA, 19 bp, Homo sapiens
aggctgtgagggaggactc

SEQ ID NO: 7088993 - DNA, 22 bp, Homo sapiens
aggctgtgagcaagaacaccta

SEQ ID NO: 7088994 - DNA, 22 bp, Homo sapiens
accactgcccatggtgaaaact

SEQ ID NO: 7088995 - DNA, 22 bp, Homo sapiens
accactgcccatggtgaaaact

SEQ ID NO: 7088996 - DNA, 22 bp, Homo sapiens
accactggatatcagagatgta

SEQ ID NO: 7088997 - DNA, 22 bp, Homo sapiens
accactggatatcagagatgta

SEQ ID NO: 7088998 - DNA, 19 bp, Homo sapiens
accactggccacacactcc

SEQ ID NO: 7088999 - DNA, 22 bp, Homo sapiens
accactggcctggtggggacca

SEQ ID NO: 7089000 - DNA, 22 bp, Homo sapiens
accactggcctggtggggacca

SEQ ID NO: 7089001 - DNA, 22 bp, Homo sapiens
accactggctcaggagctggga

SEQ ID NO: 7089002 - DNA, 22 bp, Homo sapiens
accactggctcaggagctggga

SEQ ID NO: 7089003 - DNA, 22 bp, Homo sapiens
accactggcctggtggggacca

SEQ ID NO: 7089004 - DNA, 22 bp, Homo sapiens
accactggctcaggagctggga

SEQ ID NO: 7089005 - DNA, 22 bp, Homo sapiens
accactggctcaggagctggga

SEQ ID NO: 7089006 - DNA, 22 bp, Homo sapiens
accactgggcgggcagcctgct

SEQ ID NO: 7089007 - DNA, 22 bp, Homo sapiens
accacaggaattgctctgtggt

SEQ ID NO: 7089008 - DNA, 22 bp, Homo sapiens
accacaggacccatgagtcagt

SEQ ID NO: 7089009 - DNA, 22 bp, Homo sapiens
accacaggacccatgagtcagt

SEQ ID NO: 7089010 - DNA, 22 bp, Homo sapiens
aggctgtgatgagcctcatgga

SEQ ID NO: 7089011 - DNA, 22 bp, Homo sapiens
aggctgtgatgagcctcatgga

SEQ ID NO: 7089012 - DNA, 22 bp, Homo sapiens
aggctgtgatggatgtaaagga

SEQ ID NO: 7089013 - DNA, 22 bp, Homo sapiens
aggctgtgattccaccactctc

SEQ ID NO: 7089014 - DNA, 22 bp, Homo sapiens
aggctgtgatgagcctcatgga

SEQ ID NO: 7089015 - DNA, 22 bp, Homo sapiens
aggctgtgatgagcctcatgga

SEQ ID NO: 7089016 - DNA, 22 bp, Homo sapiens
accactggttttgcagaggcgc

SEQ ID NO: 7089017 - DNA, 22 bp, Homo sapiens
accactgtactatttgagtggc

SEQ ID NO: 7089018 - DNA, 22 bp, Homo sapiens
accactgtacagcagatatagt

SEQ ID NO: 7089019 - DNA, 22 bp, Homo sapiens
accactgtatctccagcacatt

SEQ ID NO: 7089020 - DNA, 22 bp, Homo sapiens
accactgtctacacattgactc

SEQ ID NO: 7089021 - DNA, 22 bp, Homo sapiens
accacttatcatcactatctca

SEQ ID NO: 7089022 - DNA, 22 bp, Homo sapiens
accacttcctttaggaccttgt

SEQ ID NO: 7089023 - DNA, 17 bp, Homo sapiens
accactttgccaagttg

SEQ ID NO: 7089024 - DNA, 22 bp, Homo sapiens
accactttggtatttcaatttt

SEQ ID NO: 7089025 - DNA, 22 bp, Homo sapiens
accagaaaggaataatagaatt

SEQ ID NO: 7089026 - DNA, 22 bp, Homo sapiens
accagaaaggatgcctccttcc

SEQ ID NO: 7089027 - DNA, 22 bp, Homo sapiens
accagaagacagaaatattatt

SEQ ID NO: 7089028 - DNA, 22 bp, Homo sapiens
accagaagacagaaatattatt

SEQ ID NO: 7089029 - DNA, 22 bp, Homo sapiens
accagaaaggaataatagaatt

SEQ ID NO: 7089030 - DNA, 22 bp, Homo sapiens
accagaaaggaataatagaatt

SEQ ID NO: 7089031 - DNA, 22 bp, Homo sapiens
accagaagctggagcacaagga

SEQ ID NO: 7089032 - DNA, 22 bp, Homo sapiens
accagaagctggagcacaagga

SEQ ID NO: 7089033 - DNA, 22 bp, Homo sapiens
accagaaggaccagaggcaagg

SEQ ID NO: 7089034 - DNA, 22 bp, Homo sapiens
accagaagttctccaaaaagat

SEQ ID NO: 7089035 - DNA, 22 bp, Homo sapiens
accagacactgtgaagacaggc

SEQ ID NO: 7089036 - DNA, 22 bp, Homo sapiens
agaagccatggggtcaccagag

SEQ ID NO: 7089037 - DNA, 22 bp, Homo sapiens
agaagccatagtctgggaggca

SEQ ID NO: 7089038 - DNA, 21 bp, Homo sapiens
agaagccatgtggtggagaac

SEQ ID NO: 7089039 - DNA, 21 bp, Homo sapiens
agaagccatgtggtggagaac

SEQ ID NO: 7089040 - DNA, 22 bp, Homo sapiens
agaagccatggtatgcaactac

SEQ ID NO: 7089041 - DNA, 22 bp, Homo sapiens
agaagccatggggtcaccagag

SEQ ID NO: 7089042 - DNA, 22 bp, Homo sapiens
agaagccatggtatgcaactac

SEQ ID NO: 7089043 - DNA, 22 bp, Homo sapiens
agaagccatagtctgggaggca

SEQ ID NO: 7089044 - DNA, 22 bp, Homo sapiens
agaagccatagtatctcagggt

SEQ ID NO: 7089045 - DNA, 22 bp, Homo sapiens
agaagccaccagctgaggaaga

SEQ ID NO: 7089046 - DNA, 22 bp, Homo sapiens
agaagccaccagctgaggaaga

SEQ ID NO: 7089047 - DNA, 22 bp, Homo sapiens
agaagccaccagctgaggaaga

SEQ ID NO: 7089048 - DNA, 22 bp, Homo sapiens
atcctgggaagctgacattgaa

SEQ ID NO: 7089049 - DNA, 22 bp, Homo sapiens
atcctgggaagtggcctcctcc

SEQ ID NO: 7089050 - DNA, 22 bp, Homo sapiens
atcctgggaatgggagggtcat

SEQ ID NO: 7089051 - DNA, 22 bp, Homo sapiens
atcctgggaatgggagggtcat

SEQ ID NO: 7089052 - DNA, 22 bp, Homo sapiens
atcctgctgctgtggacttctc

SEQ ID NO: 7089053 - DNA, 22 bp, Homo sapiens
atcctgcagggggttttattca

SEQ ID NO: 7089054 - DNA, 22 bp, Homo sapiens
atcctgagttctcagagtctcc

SEQ ID NO: 7089055 - DNA, 22 bp, Homo sapiens
atcctgagttctcagagtctcc

SEQ ID NO: 7089056 - DNA, 22 bp, Homo sapiens
atcctgagttctcagagtctcc

SEQ ID NO: 7089057 - DNA, 22 bp, Homo sapiens
atcctgaggaaggtgcagagat

SEQ ID NO: 7089058 - DNA, 22 bp, Homo sapiens
atcctgaggaaggtgcagagat

SEQ ID NO: 7089059 - DNA, 22 bp, Homo sapiens
atcctggaggctggaggcttgc

SEQ ID NO: 7089060 - DNA, 22 bp, Homo sapiens
agaagccattctcagttcctga

SEQ ID NO: 7089061 - DNA, 22 bp, Homo sapiens
agaagccattctcagttcctga

SEQ ID NO: 7089062 - DNA, 22 bp, Homo sapiens
agaagccattccctgtaggctc

SEQ ID NO: 7089063 - DNA, 22 bp, Homo sapiens
agaagccatgtttagtaggatg

SEQ ID NO: 7089064 - DNA, 21 bp, Homo sapiens
agaagcctgggtggaggtggg

SEQ ID NO: 7089065 - DNA, 21 bp, Homo sapiens
agaagcctgatgaggtctgct

SEQ ID NO: 7089066 - DNA, 21 bp, Homo sapiens
agaagccatttgttaggactt

SEQ ID NO: 7089067 - DNA, 19 bp, Homo sapiens
agaagcccagatcccagcc

SEQ ID NO: 7089068 - DNA, 22 bp, Homo sapiens
agaagcccagcatggaaccagc

SEQ ID NO: 7089069 - DNA, 22 bp, Homo sapiens
atctgcttttgagaatttactt

SEQ ID NO: 7089070 - DNA, 22 bp, Homo sapiens
atctgcttttgagaatttactt

SEQ ID NO: 7089071 - DNA, 20 bp, Homo sapiens
atctgcttgcctgtcctcgg

SEQ ID NO: 7089072 - DNA, 22 bp, Homo sapiens
agaagctgcgtttatttaaatc

SEQ ID NO: 7089073 - DNA, 20 bp, Homo sapiens
agaagctgatactgatggaa

SEQ ID NO: 7089074 - DNA, 22 bp, Homo sapiens
agaagctactgggatattaatt

SEQ ID NO: 7089075 - DNA, 22 bp, Homo sapiens
agaagctactgggatattaatt

SEQ ID NO: 7089076 - DNA, 22 bp, Homo sapiens
agaagctataacaacaattata

SEQ ID NO: 7089077 - DNA, 22 bp, Homo sapiens
agaagctctgagagtggggccc

SEQ ID NO: 7089078 - DNA, 20 bp, Homo sapiens
agaagctgagactgggtttt

SEQ ID NO: 7089079 - DNA, 20 bp, Homo sapiens
agaagctgagactgggtttt

SEQ ID NO: 7089080 - DNA, 22 bp, Homo sapiens
agaagccaacagggcaggagag

SEQ ID NO: 7089081 - DNA, 22 bp, Homo sapiens
agaagccaaatgccagtgacct

SEQ ID NO: 7089082 - DNA, 22 bp, Homo sapiens
agaagccaaatgccagtgacct

SEQ ID NO: 7089083 - DNA, 22 bp, Homo sapiens
agaagccaaatgccagtgacct

SEQ ID NO: 7089084 - DNA, 22 bp, Homo sapiens
agaagccaaatgccagtgacct

SEQ ID NO: 7089085 - DNA, 22 bp, Homo sapiens
agaagccaaatgccagtgacct

SEQ ID NO: 7089086 - DNA, 22 bp, Homo sapiens
agaagcattggaccaggggccc

SEQ ID NO: 7089087 - DNA, 22 bp, Homo sapiens
agaagccaaaggggccagatat

SEQ ID NO: 7089088 - DNA, 20 bp, Homo sapiens
agaagcattcaaagaaaact

SEQ ID NO: 7089089 - DNA, 20 bp, Homo sapiens
agaagcattcaaagaaaact

SEQ ID NO: 7089090 - DNA, 22 bp, Homo sapiens
agaagcattatttaattttact

SEQ ID NO: 7089091 - DNA, 22 bp, Homo sapiens
agaagcattataacatgcaagg

SEQ ID NO: 7089092 - DNA, 20 bp, Homo sapiens
agaagcatcattctgatgtc

SEQ ID NO: 7089093 - DNA, 22 bp, Homo sapiens
agaagcattataacatgcaagg

SEQ ID NO: 7089094 - DNA, 22 bp, Homo sapiens
agaagcattataacatgcaagg

SEQ ID NO: 7089095 - DNA, 22 bp, Homo sapiens
agaagcagttattttttgcaca

SEQ ID NO: 7089096 - DNA, 22 bp, Homo sapiens
agaagcagttattttttgcaca

SEQ ID NO: 7089097 - DNA, 22 bp, Homo sapiens
agaagcagttattttttgcaca

SEQ ID NO: 7089098 - DNA, 22 bp, Homo sapiens
agaaatgttgaatacatcagga

SEQ ID NO: 7089099 - DNA, 22 bp, Homo sapiens
agaaatgttgaatacatcagga

SEQ ID NO: 7089100 - DNA, 22 bp, Homo sapiens
agaaatgttgaatacatcagga

SEQ ID NO: 7089101 - DNA, 22 bp, Homo sapiens
agaaatgttgtgggttttgtta

SEQ ID NO: 7089102 - DNA, 22 bp, Homo sapiens
agaaatgtttactcaccccctt

SEQ ID NO: 7089103 - DNA, 22 bp, Homo sapiens
agaaatgtttactcaccccctt

SEQ ID NO: 7089104 - DNA, 22 bp, Homo sapiens
agaaatgtttatggctgcctat

SEQ ID NO: 7089105 - DNA, 22 bp, Homo sapiens
agaaattaggaaagtaacactt

SEQ ID NO: 7089106 - DNA, 22 bp, Homo sapiens
agaaattaggaaagtaacactt

SEQ ID NO: 7089107 - DNA, 22 bp, Homo sapiens
agaagcacctgtcagctacatg

SEQ ID NO: 7089108 - DNA, 22 bp, Homo sapiens
agaagcacctgtcagctacatg

SEQ ID NO: 7089109 - DNA, 22 bp, Homo sapiens
agaagcagaaaagggcactttt

SEQ ID NO: 7089110 - DNA, 22 bp, Homo sapiens
agaagcaggcagatttcagctc

SEQ ID NO: 7089111 - DNA, 22 bp, Homo sapiens
agaagcaggcagatttcagctc

SEQ ID NO: 7089112 - DNA, 22 bp, Homo sapiens
agaagcaggcctcacagatctg

SEQ ID NO: 7089113 - DNA, 22 bp, Homo sapiens
agaagcagggcagggaaaagca

SEQ ID NO: 7089114 - DNA, 22 bp, Homo sapiens
agaagcagggcagggaaaagca

SEQ ID NO: 7089115 - DNA, 22 bp, Homo sapiens
agaagcagggcagggaaaagca

SEQ ID NO: 7089116 - DNA, 18 bp, Homo sapiens
agaagcaggtaaaattct

SEQ ID NO: 7089117 - DNA, 22 bp, Homo sapiens
agaaatgttacagttgttattt

SEQ ID NO: 7089118 - DNA, 22 bp, Homo sapiens
agaaatgttacagttgttattt

SEQ ID NO: 7089119 - DNA, 22 bp, Homo sapiens
agaaatgttgaatacacaaaat

SEQ ID NO: 7089120 - DNA, 22 bp, Homo sapiens
agaaatgtgagccccttatcaa

SEQ ID NO: 7089121 - DNA, 22 bp, Homo sapiens
agaaatgtggaggaacagggct

SEQ ID NO: 7089122 - DNA, 22 bp, Homo sapiens
agaaatgtccagggctaggatc

SEQ ID NO: 7089123 - DNA, 20 bp, Homo sapiens
agaaatgtgaaaggctgagt

SEQ ID NO: 7089124 - DNA, 20 bp, Homo sapiens
agaaatgtgaaaggctgagt

SEQ ID NO: 7089125 - DNA, 20 bp, Homo sapiens
agaaatgtgaaaggctgagt

SEQ ID NO: 7089126 - DNA, 20 bp, Homo sapiens
agaaatgtgaaaggctgagt

SEQ ID NO: 7089127 - DNA, 22 bp, Homo sapiens
agaaatgtgaatttcatttcct

SEQ ID NO: 7089128 - DNA, 22 bp, Homo sapiens
agaaatgtgaatttcatttcct

SEQ ID NO: 7089129 - DNA, 21 bp, Homo sapiens
agaaatgtatcattcttttcc

SEQ ID NO: 7089130 - DNA, 22 bp, Homo sapiens
agaaatgtcaggaaagaagtcc

SEQ ID NO: 7089131 - DNA, 22 bp, Homo sapiens
agaaatgtcaggaaagaagtcc

SEQ ID NO: 7089132 - DNA, 22 bp, Homo sapiens
agaaatgtcaggaaagaagtcc

SEQ ID NO: 7089133 - DNA, 22 bp, Homo sapiens
agaaatgtcaggaaagaagtcc

SEQ ID NO: 7089134 - DNA, 22 bp, Homo sapiens
agaaatgtcaggaaagaagtcc

SEQ ID NO: 7089135 - DNA, 22 bp, Homo sapiens
agaaatgtccagggctaggatc

SEQ ID NO: 7089136 - DNA, 22 bp, Homo sapiens
agaaatgggccttgggacacaa

SEQ ID NO: 7089137 - DNA, 22 bp, Homo sapiens
agaaatgtacacgacacccaga

SEQ ID NO: 7089138 - DNA, 22 bp, Homo sapiens
agaaatgtacacgacacccaga

SEQ ID NO: 7089139 - DNA, 22 bp, Homo sapiens
agaaatgtaggcatataaggaa

SEQ ID NO: 7089140 - DNA, 22 bp, Homo sapiens
agaaactgtgttactagaatgt

SEQ ID NO: 7089141 - DNA, 22 bp, Homo sapiens
agaaacttcagctattcttttg

SEQ ID NO: 7089142 - DNA, 22 bp, Homo sapiens
agaaactttctagggcttcagg

SEQ ID NO: 7089143 - DNA, 22 bp, Homo sapiens
agaaagaacgcacttgtgctgc

SEQ ID NO: 7089144 - DNA, 22 bp, Homo sapiens
agaaagaacgcacttgtgctgc

SEQ ID NO: 7089145 - DNA, 17 bp, Homo sapiens
agaaactgaggctcagt

SEQ ID NO: 7089146 - DNA, 22 bp, Homo sapiens
agaaactgcagctcagagaagt

SEQ ID NO: 7089147 - DNA, 22 bp, Homo sapiens
agaaactgcagctcagagaagt

SEQ ID NO: 7089148 - DNA, 22 bp, Homo sapiens
atatagttgggtttcattctac

SEQ ID NO: 7089149 - DNA, 22 bp, Homo sapiens
atatagtcaaacatatatgtgt

SEQ ID NO: 7089150 - DNA, 22 bp, Homo sapiens
atatagtcaaacatatatgtgt

SEQ ID NO: 7089151 - DNA, 22 bp, Homo sapiens
atatagtgagagattacagaag

SEQ ID NO: 7089152 - DNA, 22 bp, Homo sapiens
atatataacctggataaggctt

SEQ ID NO: 7089153 - DNA, 22 bp, Homo sapiens
atatataacctggataaggctt

SEQ ID NO: 7089154 - DNA, 20 bp, Homo sapiens
agaaacatttcttgagaact

SEQ ID NO: 7089155 - DNA, 20 bp, Homo sapiens
agaaacatttcttgagaact

SEQ ID NO: 7089156 - DNA, 22 bp, Homo sapiens
atatagaaggtgctatttacat

SEQ ID NO: 7089157 - DNA, 22 bp, Homo sapiens
atatagaaggtgctatttacat

SEQ ID NO: 7089158 - DNA, 22 bp, Homo sapiens
atatagaaggtgctatttacat

SEQ ID NO: 7089159 - DNA, 22 bp, Homo sapiens
atatagaatacacagggaaagt

SEQ ID NO: 7089160 - DNA, 22 bp, Homo sapiens
atatagaatacacagggaaagt

SEQ ID NO: 7089161 - DNA, 22 bp, Homo sapiens
atatagaaggtgctatttacat

SEQ ID NO: 7089162 - DNA, 22 bp, Homo sapiens
atatagaaggtgctatttacat

SEQ ID NO: 7089163 - DNA, 22 bp, Homo sapiens
atatagtaagcagtctgtaaat

SEQ ID NO: 7089164 - DNA, 22 bp, Homo sapiens
atataggcttcatgacagaggg

SEQ ID NO: 7089165 - DNA, 22 bp, Homo sapiens
atatagtatgtcctccagaatt

SEQ ID NO: 7089166 - DNA, 22 bp, Homo sapiens
atatagtaagcagtctgtaaat

SEQ ID NO: 7089167 - DNA, 22 bp, Homo sapiens
atataggttatcatatttgccc

SEQ ID NO: 7089168 - DNA, 19 bp, Homo sapiens
atatagcattattcaattt

SEQ ID NO: 7089169 - DNA, 22 bp, Homo sapiens
atatagcacttgttttgcatgt

SEQ ID NO: 7089170 - DNA, 19 bp, Homo sapiens
atatagcattattcaattt

SEQ ID NO: 7089171 - DNA, 19 bp, Homo sapiens
atatagcattattcaattt

SEQ ID NO: 7089172 - DNA, 22 bp, Homo sapiens
atattaatgggatttagtcagg

SEQ ID NO: 7089173 - DNA, 22 bp, Homo sapiens
atattaattatttacacatgag

SEQ ID NO: 7089174 - DNA, 22 bp, Homo sapiens
atattaatgggatttagtcagg

SEQ ID NO: 7089175 - DNA, 22 bp, Homo sapiens
atattaatgggatttagtcagg

SEQ ID NO: 7089176 - DNA, 22 bp, Homo sapiens
atattaatgggatttagtcagg

SEQ ID NO: 7089177 - DNA, 22 bp, Homo sapiens
atattaatgagcaagtaagtga

SEQ ID NO: 7089178 - DNA, 22 bp, Homo sapiens
atattaaatggattttgggagc

SEQ ID NO: 7089179 - DNA, 22 bp, Homo sapiens
agaaagaggatgcagatctcat

SEQ ID NO: 7089180 - DNA, 22 bp, Homo sapiens
agaaagaggatgcagatctcat

SEQ ID NO: 7089181 - DNA, 22 bp, Homo sapiens
atattaaaactatggttttcag

SEQ ID NO: 7089182 - DNA, 22 bp, Homo sapiens
atattaaatggattttgggagc

SEQ ID NO: 7089183 - DNA, 22 bp, Homo sapiens
atattaaatggattttgggagc

SEQ ID NO: 7089184 - DNA, 22 bp, Homo sapiens
atattaagatgctattggtttt

SEQ ID NO: 7089185 - DNA, 22 bp, Homo sapiens
agaaagaacgttggttatctta

SEQ ID NO: 7089186 - DNA, 22 bp, Homo sapiens
agaaagaacgcacttgtgctgc

SEQ ID NO: 7089187 - DNA, 22 bp, Homo sapiens
agaaagaacgttggttatctta

SEQ ID NO: 7089188 - DNA, 22 bp, Homo sapiens
agaaagaacgttggttatctta

SEQ ID NO: 7089189 - DNA, 22 bp, Homo sapiens
agaaagaacgttggttatctta

SEQ ID NO: 7089190 - DNA, 22 bp, Homo sapiens
agaaagacgtgatgaagaagta

SEQ ID NO: 7089191 - DNA, 22 bp, Homo sapiens
agaaagacgtgatgaagaagta

SEQ ID NO: 7089192 - DNA, 22 bp, Homo sapiens
agaaagacgtgatgaagaagta

SEQ ID NO: 7089193 - DNA, 22 bp, Homo sapiens
agaaagagatgaatgctttaag

SEQ ID NO: 7089194 - DNA, 22 bp, Homo sapiens
agaaagagctcgggattaacag

SEQ ID NO: 7089195 - DNA, 22 bp, Homo sapiens
agaaagagctcgggattaacag

SEQ ID NO: 7089196 - DNA, 22 bp, Homo sapiens
agaaagagctcgggattaacag

SEQ ID NO: 7089197 - DNA, 17 bp, Homo sapiens
agaaagaggatccacag

SEQ ID NO: 7089198 - DNA, 17 bp, Homo sapiens
agaaagaggatccacag

SEQ ID NO: 7089199 - DNA, 22 bp, Homo sapiens
agaaagaggatgcagatctcat

SEQ ID NO: 7089200 - DNA, 22 bp, Homo sapiens
agaaagaggatgcagatctcat

SEQ ID NO: 7089201 - DNA, 22 bp, Homo sapiens
atcaattttgaggatacaagaa

SEQ ID NO: 7089202 - DNA, 22 bp, Homo sapiens
atcaattttgaggatacaagaa

SEQ ID NO: 7089203 - DNA, 22 bp, Homo sapiens
atcaattttgaggatacaagaa

SEQ ID NO: 7089204 - DNA, 22 bp, Homo sapiens
atcaatgttgggccaaagcaaa

SEQ ID NO: 7089205 - DNA, 22 bp, Homo sapiens
atcaatgttgggccaaagcaaa

SEQ ID NO: 7089206 - DNA, 22 bp, Homo sapiens
atcaatgttttgatagcccaga

SEQ ID NO: 7089207 - DNA, 22 bp, Homo sapiens
agaaatcttggagtctgtggta

SEQ ID NO: 7089208 - DNA, 22 bp, Homo sapiens
agaaatctttcctgaagtgttt

SEQ ID NO: 7089209 - DNA, 22 bp, Homo sapiens
agaaatctttgaagtgtaatgt

SEQ ID NO: 7089210 - DNA, 22 bp, Homo sapiens
agaaatgcagtctcgtcaaaag

SEQ ID NO: 7089211 - DNA, 22 bp, Homo sapiens
agaaatgcagtttcaagacaaa

SEQ ID NO: 7089212 - DNA, 22 bp, Homo sapiens
agaaatgcattagcacatatag

SEQ ID NO: 7089213 - DNA, 22 bp, Homo sapiens
agaaatgcctacgagataggga

SEQ ID NO: 7089214 - DNA, 22 bp, Homo sapiens
agaaatgctcttcctgaccaga

SEQ ID NO: 7089215 - DNA, 21 bp, Homo sapiens
atcaatgacctggcatgaggg

SEQ ID NO: 7089216 - DNA, 21 bp, Homo sapiens
atcaatgacctggcatgaggg

SEQ ID NO: 7089217 - DNA, 22 bp, Homo sapiens
atcaatatcagatcagacagga

SEQ ID NO: 7089218 - DNA, 22 bp, Homo sapiens
atcaatatcagatcagacagga

SEQ ID NO: 7089219 - DNA, 22 bp, Homo sapiens
atcaagtctgcctgtctggagg

SEQ ID NO: 7089220 - DNA, 23 bp, Homo sapiens
atcaagtcatcagcaaaatacat

SEQ ID NO: 7089221 - DNA, 18 bp, Homo sapiens
atcaaggaggggaaggtc

SEQ ID NO: 7089222 - DNA, 22 bp, Homo sapiens
atcaagaattgggagctattga

SEQ ID NO: 7089223 - DNA, 22 bp, Homo sapiens
atcaagagaaggggaagatgaa

SEQ ID NO: 7089224 - DNA, 22 bp, Homo sapiens
atcaagagtattgacaagacca

SEQ ID NO: 7089225 - DNA, 22 bp, Homo sapiens
atcaagagttatatttcatagt

SEQ ID NO: 7089226 - DNA, 23 bp, Homo sapiens
atcaagataatccagatgaccta

SEQ ID NO: 7089227 - DNA, 22 bp, Homo sapiens
atcaagctacaccctttggaaa

SEQ ID NO: 7089228 - DNA, 22 bp, Homo sapiens
atcaagctacttgtcttcgttt

SEQ ID NO: 7089229 - DNA, 22 bp, Homo sapiens
atcaagctggcatatgtagttc

SEQ ID NO: 7089230 - DNA, 20 bp, Homo sapiens
agaaatcagcatgtcctctg

SEQ ID NO: 7089231 - DNA, 20 bp, Homo sapiens
agaaatcagaccacacacta

SEQ ID NO: 7089232 - DNA, 22 bp, Homo sapiens
agaaatcacttagaggaagtga

SEQ ID NO: 7089233 - DNA, 22 bp, Homo sapiens
agaaatcacaggaggcagaagg

SEQ ID NO: 7089234 - DNA, 22 bp, Homo sapiens
agaaatcacttaatgaacgtag

SEQ ID NO: 7089235 - DNA, 22 bp, Homo sapiens
agaaatcacttaatgaacgtag

SEQ ID NO: 7089236 - DNA, 22 bp, Homo sapiens
agaaatcacttagaggaagtga

SEQ ID NO: 7089237 - DNA, 22 bp, Homo sapiens
agaaatcacttagaggaagtga

SEQ ID NO: 7089238 - DNA, 22 bp, Homo sapiens
agaaatatgctgattagatgaa

SEQ ID NO: 7089239 - DNA, 20 bp, Homo sapiens
agaaatattgagttcagagg

SEQ ID NO: 7089240 - DNA, 20 bp, Homo sapiens
agaaatattgagttcagagg

SEQ ID NO: 7089241 - DNA, 20 bp, Homo sapiens
agaaatattgagttcagagg

SEQ ID NO: 7089242 - DNA, 20 bp, Homo sapiens
agaaatattgagttcagagg

SEQ ID NO: 7089243 - DNA, 22 bp, Homo sapiens
agaaatcaatatctatatgttg

SEQ ID NO: 7089244 - DNA, 22 bp, Homo sapiens
agaaatcaatatctatatgttg

SEQ ID NO: 7089245 - DNA, 22 bp, Homo sapiens
agaaatcaatatctatatgttg

SEQ ID NO: 7089246 - DNA, 22 bp, Homo sapiens
agaaatcaatatctatatgttg

SEQ ID NO: 7089247 - DNA, 22 bp, Homo sapiens
agaaatcaatatctatatgttg

SEQ ID NO: 7089248 - DNA, 22 bp, Homo sapiens
agaaatatgctgattagatgaa

SEQ ID NO: 7089249 - DNA, 22 bp, Homo sapiens
agaaatatgctgattagatgaa

SEQ ID NO: 7089250 - DNA, 22 bp, Homo sapiens
agaaatatgctgattagatgaa

SEQ ID NO: 7089251 - DNA, 22 bp, Homo sapiens
agaaatatgctgattagatgaa

SEQ ID NO: 7089252 - DNA, 22 bp, Homo sapiens
atattacacacggtatcacggg

SEQ ID NO: 7089253 - DNA, 22 bp, Homo sapiens
atattacacacggtatcacggg

SEQ ID NO: 7089254 - DNA, 22 bp, Homo sapiens
atattaattatttacacatgag

SEQ ID NO: 7089255 - DNA, 22 bp, Homo sapiens
atattacacacggtatcacggg

SEQ ID NO: 7089256 - DNA, 22 bp, Homo sapiens
atattaattatttacacatgag

SEQ ID NO: 7089257 - DNA, 22 bp, Homo sapiens
agaaagttttgtgctatatatg

SEQ ID NO: 7089258 - DNA, 22 bp, Homo sapiens
agaaagtttgtttttatccata

SEQ ID NO: 7089259 - DNA, 22 bp, Homo sapiens
atacacgtgccatgttggtgtg

SEQ ID NO: 7089260 - DNA, 22 bp, Homo sapiens
atacacgtgccatgttggtgtg

SEQ ID NO: 7089261 - DNA, 22 bp, Homo sapiens
atacacgtgccatgttggtgtg

SEQ ID NO: 7089262 - DNA, 19 bp, Homo sapiens
atacactaatataaaccac

SEQ ID NO: 7089263 - DNA, 22 bp, Homo sapiens
atacactactaagcacagattg

SEQ ID NO: 7089264 - DNA, 22 bp, Homo sapiens
atacactgagtccttttctcat

SEQ ID NO: 7089265 - DNA, 22 bp, Homo sapiens
atacactgatctttttatgggg

SEQ ID NO: 7089266 - DNA, 22 bp, Homo sapiens
atacacagcgatgagaggaggc

SEQ ID NO: 7089267 - DNA, 22 bp, Homo sapiens
atacacatttgctagagatggg

SEQ ID NO: 7089268 - DNA, 22 bp, Homo sapiens
atacacatttgctagagatggg

SEQ ID NO: 7089269 - DNA, 22 bp, Homo sapiens
atacacatttgctagagatggg

SEQ ID NO: 7089270 - DNA, 22 bp, Homo sapiens
atacacatttgctagagatggg

SEQ ID NO: 7089271 - DNA, 22 bp, Homo sapiens
atacacatttgctagagatggg

SEQ ID NO: 7089272 - DNA, 22 bp, Homo sapiens
atacaatagtgtttgttttgag

SEQ ID NO: 7089273 - DNA, 22 bp, Homo sapiens
atacaatagtgtttgttttgag

SEQ ID NO: 7089274 - DNA, 22 bp, Homo sapiens
atacaatagtgtttgttttgag

SEQ ID NO: 7089275 - DNA, 22 bp, Homo sapiens
atacaatagtgtttgttttgag

SEQ ID NO: 7089276 - DNA, 22 bp, Homo sapiens
atacaatagtgtttgttttgag

SEQ ID NO: 7089277 - DNA, 22 bp, Homo sapiens
atacaatcaaccacttgcgagc

SEQ ID NO: 7089278 - DNA, 22 bp, Homo sapiens
atacaatgaagtatagatgaaa

SEQ ID NO: 7089279 - DNA, 22 bp, Homo sapiens
atacaatgaagtatagatgaaa

SEQ ID NO: 7089280 - DNA, 22 bp, Homo sapiens
atacaatgaagtatagatgaaa

SEQ ID NO: 7089281 - DNA, 22 bp, Homo sapiens
atacaatgagtgagtgaatggg

SEQ ID NO: 7089282 - DNA, 22 bp, Homo sapiens
atacaatgataatagtacttta

SEQ ID NO: 7089283 - DNA, 22 bp, Homo sapiens
atacaatgattggttctcaccc

SEQ ID NO: 7089284 - DNA, 22 bp, Homo sapiens
atacaatgggtgcaaagatgtg

SEQ ID NO: 7089285 - DNA, 22 bp, Homo sapiens
atacaatgggtgcaaagatgtg

SEQ ID NO: 7089286 - DNA, 22 bp, Homo sapiens
atacaattattctgcagatatt

SEQ ID NO: 7089287 - DNA, 22 bp, Homo sapiens
atacaattattctgcagatatt

SEQ ID NO: 7089288 - DNA, 22 bp, Homo sapiens
atacaattattctgcagatatt

SEQ ID NO: 7089289 - DNA, 22 bp, Homo sapiens
atacacaattgtgtttttatga

SEQ ID NO: 7089290 - DNA, 22 bp, Homo sapiens
atacacaattgtgtttttatga

SEQ ID NO: 7089291 - DNA, 22 bp, Homo sapiens
atacacaattgtgtttttatga

SEQ ID NO: 7089292 - DNA, 22 bp, Homo sapiens
atacacacgtgcacgtgggaaa

SEQ ID NO: 7089293 - DNA, 22 bp, Homo sapiens
ataaggaatgatgtatcagttt

SEQ ID NO: 7089294 - DNA, 22 bp, Homo sapiens
ataaggacttgaattagacatt

SEQ ID NO: 7089295 - DNA, 22 bp, Homo sapiens
ataaggcaagctgtcagtttgt

SEQ ID NO: 7089296 - DNA, 22 bp, Homo sapiens
ataaggcacacatagatagggt

SEQ ID NO: 7089297 - DNA, 22 bp, Homo sapiens
ataacagagagctactgaactg

SEQ ID NO: 7089298 - DNA, 22 bp, Homo sapiens
ataagcttcctgttagaaaccg

SEQ ID NO: 7089299 - DNA, 22 bp, Homo sapiens
ataagcttgatgtaactaacca

SEQ ID NO: 7089300 - DNA, 22 bp, Homo sapiens
ataagctttgctggagagacct

SEQ ID NO: 7089301 - DNA, 22 bp, Homo sapiens
ataagcttttaaagctactttg

SEQ ID NO: 7089302 - DNA, 22 bp, Homo sapiens
ataagcttttgattcacttcag

SEQ ID NO: 7089303 - DNA, 22 bp, Homo sapiens
ataaggaacctgggcttaagag

SEQ ID NO: 7089304 - DNA, 22 bp, Homo sapiens
atacaagttgtgataatgtaaa

SEQ ID NO: 7089305 - DNA, 20 bp, Homo sapiens
atacaaagagattgatgtat

SEQ ID NO: 7089306 - DNA, 17 bp, Homo sapiens
atacaaagccataaacc

SEQ ID NO: 7089307 - DNA, 22 bp, Homo sapiens
atacaagttgtgataatgtaaa

SEQ ID NO: 7089308 - DNA, 22 bp, Homo sapiens
atacaaagacaaatctcaatct

SEQ ID NO: 7089309 - DNA, 20 bp, Homo sapiens
atacaaagagattgatgtat

SEQ ID NO: 7089310 - DNA, 20 bp, Homo sapiens
atacaaagagattgatgtat

SEQ ID NO: 7089311 - DNA, 22 bp, Homo sapiens
ataaggcagtcactggaatgtt

SEQ ID NO: 7089312 - DNA, 23 bp, Homo sapiens
ataaggcataaaggtacattgga

SEQ ID NO: 7089313 - DNA, 22 bp, Homo sapiens
ataaggcatatagtcacttttt

SEQ ID NO: 7089314 - DNA, 22 bp, Homo sapiens
ataaggcatatagtcacttttt

SEQ ID NO: 7089315 - DNA, 22 bp, Homo sapiens
ataaggcttaaaccttgttgcc

SEQ ID NO: 7089316 - DNA, 22 bp, Homo sapiens
ataaggcttctggctgctttct

SEQ ID NO: 7089317 - DNA, 22 bp, Homo sapiens
ataaggtaagggtattgtcaga

SEQ ID NO: 7089318 - DNA, 22 bp, Homo sapiens
agttcacatatctgttttattt

SEQ ID NO: 7089319 - DNA, 20 bp, Homo sapiens
agttcacaggccaaatttct

SEQ ID NO: 7089320 - DNA, 22 bp, Homo sapiens
agttcacaatagaagaggtggc

SEQ ID NO: 7089321 - DNA, 22 bp, Homo sapiens
agttcacagaatggccagaact

SEQ ID NO: 7089322 - DNA, 22 bp, Homo sapiens
agttcagcttcaagctatgagg

SEQ ID NO: 7089323 - DNA, 22 bp, Homo sapiens
agttcagcttcccaggtcactg

SEQ ID NO: 7089324 - DNA, 22 bp, Homo sapiens
agttcagcttcccaggtcactg

SEQ ID NO: 7089325 - DNA, 22 bp, Homo sapiens
agttcaggcataaggcatgaac

SEQ ID NO: 7089326 - DNA, 22 bp, Homo sapiens
agttcagccatttgttaactat

SEQ ID NO: 7089327 - DNA, 22 bp, Homo sapiens
agttcagccatttgttaactat

SEQ ID NO: 7089328 - DNA, 22 bp, Homo sapiens
agttcagcaaataaaacatagt

SEQ ID NO: 7089329 - DNA, 23 bp, Homo sapiens
agttcagctcagttcagtgagca

SEQ ID NO: 7089330 - DNA, 22 bp, Homo sapiens
agttcagaggcaggagaaggct

SEQ ID NO: 7089331 - DNA, 22 bp, Homo sapiens
agttgaaggttggctgatccat

SEQ ID NO: 7089332 - DNA, 22 bp, Homo sapiens
agttgaacagtatttgcttctg

SEQ ID NO: 7089333 - DNA, 22 bp, Homo sapiens
agttgaaggttggctgatccat

SEQ ID NO: 7089334 - DNA, 22 bp, Homo sapiens
agttgaagtcctcatcaaatat

SEQ ID NO: 7089335 - DNA, 22 bp, Homo sapiens
agttgaagtcttcaataagctt

SEQ ID NO: 7089336 - DNA, 22 bp, Homo sapiens
agttgaaagccttatttctctg

SEQ ID NO: 7089337 - DNA, 22 bp, Homo sapiens
agttgaaattaagagagagttt

SEQ ID NO: 7089338 - DNA, 22 bp, Homo sapiens
agttgaatatacttgctgttgc

SEQ ID NO: 7089339 - DNA, 22 bp, Homo sapiens
agttgaatatacttgctgttgc

SEQ ID NO: 7089340 - DNA, 22 bp, Homo sapiens
agttgaatgttacagttctaaa

SEQ ID NO: 7089341 - DNA, 19 bp, Homo sapiens
agttgaattaacttgtcac

SEQ ID NO: 7089342 - DNA, 22 bp, Homo sapiens
agttgaattatgagtgtctttg

SEQ ID NO: 7089343 - DNA, 22 bp, Homo sapiens
agttgaattatgagtgtctttg

SEQ ID NO: 7089344 - DNA, 22 bp, Homo sapiens
agttgacatccagagacattct

SEQ ID NO: 7089345 - DNA, 22 bp, Homo sapiens
agttcttttctagattctggat

SEQ ID NO: 7089346 - DNA, 22 bp, Homo sapiens
agttctttgtcatctctggagt

SEQ ID NO: 7089347 - DNA, 22 bp, Homo sapiens
agttctttgtgagtaatacaga

SEQ ID NO: 7089348 - DNA, 22 bp, Homo sapiens
agttctttgtaaaaggtctcta

SEQ ID NO: 7089349 - DNA, 21 bp, Homo sapiens
ataaattctgagaggctctgc

SEQ ID NO: 7089350 - DNA, 22 bp, Homo sapiens
ataaattctctgatgtatagta

SEQ ID NO: 7089351 - DNA, 22 bp, Homo sapiens
ataaattatgaatggccctttt

SEQ ID NO: 7089352 - DNA, 19 bp, Homo sapiens
ataaataaaaagtgggaga

SEQ ID NO: 7089353 - DNA, 19 bp, Homo sapiens
ataaataaaaagtgggaga

SEQ ID NO: 7089354 - DNA, 22 bp, Homo sapiens
ataaattatgaatggccctttt

SEQ ID NO: 7089355 - DNA, 22 bp, Homo sapiens
ataaattcaaagcatttaggac

SEQ ID NO: 7089356 - DNA, 22 bp, Homo sapiens
ataaattcaaagcatttaggac

SEQ ID NO: 7089357 - DNA, 19 bp, Homo sapiens
ataaataaaaagtgggaga

SEQ ID NO: 7089358 - DNA, 19 bp, Homo sapiens
ataaataaaaagtgggaga

SEQ ID NO: 7089359 - DNA, 19 bp, Homo sapiens
ataaataaaaagtgggaga

SEQ ID NO: 7089360 - DNA, 22 bp, Homo sapiens
agttgcagacgcagagatgttg

SEQ ID NO: 7089361 - DNA, 22 bp, Homo sapiens
agttgagggtgggagagaaatg

SEQ ID NO: 7089362 - DNA, 22 bp, Homo sapiens
agttgatttttctggctcagcc

SEQ ID NO: 7089363 - DNA, 22 bp, Homo sapiens
agttgcagacgcagagatgttg

SEQ ID NO: 7089364 - DNA, 22 bp, Homo sapiens
agttgcagacgcagagatgttg

SEQ ID NO: 7089365 - DNA, 22 bp, Homo sapiens
agttgcagacgcagagatgttg

SEQ ID NO: 7089366 - DNA, 22 bp, Homo sapiens
ataacaatagtggtagtgctgg

SEQ ID NO: 7089367 - DNA, 22 bp, Homo sapiens
ataaatttataattgtttcctg

SEQ ID NO: 7089368 - DNA, 22 bp, Homo sapiens
ataaattttcttgctgtactta

SEQ ID NO: 7089369 - DNA, 22 bp, Homo sapiens
ataacagacttagagttacaag

SEQ ID NO: 7089370 - DNA, 22 bp, Homo sapiens
ataacagactgatttttaaatg

SEQ ID NO: 7089371 - DNA, 22 bp, Homo sapiens
ataacagacttagagttacaag

SEQ ID NO: 7089372 - DNA, 22 bp, Homo sapiens
ataacagacttagagttacaag

SEQ ID NO: 7089373 - DNA, 22 bp, Homo sapiens
ataacactaaatgtatgtaaca

SEQ ID NO: 7089374 - DNA, 22 bp, Homo sapiens
ataacactaaatgtatgtaaca

SEQ ID NO: 7089375 - DNA, 22 bp, Homo sapiens
ataacagaataagtcattaccg

SEQ ID NO: 7089376 - DNA, 22 bp, Homo sapiens
ataacagactgatttttaaatg

SEQ ID NO: 7089377 - DNA, 22 bp, Homo sapiens
atagttataagaaaacgttgaa

SEQ ID NO: 7089378 - DNA, 22 bp, Homo sapiens
atagttatgctctagacaagaa

SEQ ID NO: 7089379 - DNA, 22 bp, Homo sapiens
atagtgtgtggtataggtagag

SEQ ID NO: 7089380 - DNA, 22 bp, Homo sapiens
atagtgtgttagtgacataggc

SEQ ID NO: 7089381 - DNA, 22 bp, Homo sapiens
atagtgttacccttcttaaagt

SEQ ID NO: 7089382 - DNA, 22 bp, Homo sapiens
ataggaaatcgctattaaccta

SEQ ID NO: 7089383 - DNA, 22 bp, Homo sapiens
ataggacaagactgaccctggt

SEQ ID NO: 7089384 - DNA, 22 bp, Homo sapiens
ataggagactgttcttggcttc

SEQ ID NO: 7089385 - DNA, 22 bp, Homo sapiens
ataggagccataaataaaatct

SEQ ID NO: 7089386 - DNA, 22 bp, Homo sapiens
atagtgtctttcttcacaggca

SEQ ID NO: 7089387 - DNA, 22 bp, Homo sapiens
atagtgtgactgaggagttgaa

SEQ ID NO: 7089388 - DNA, 22 bp, Homo sapiens
atagtgtgtaaagtgcagtgat

SEQ ID NO: 7089389 - DNA, 22 bp, Homo sapiens
atagctgttgccaatttccatg

SEQ ID NO: 7089390 - DNA, 22 bp, Homo sapiens
atagcttacaggtgatatcagc

SEQ ID NO: 7089391 - DNA, 22 bp, Homo sapiens
atagcttacaggtgatatcagc

SEQ ID NO: 7089392 - DNA, 22 bp, Homo sapiens
atagcttcagaattgagatatc

SEQ ID NO: 7089393 - DNA, 22 bp, Homo sapiens
atagccagcatatagcagggag

SEQ ID NO: 7089394 - DNA, 22 bp, Homo sapiens
atagccactctaattctcttgt

SEQ ID NO: 7089395 - DNA, 22 bp, Homo sapiens
atagccaggagatgatggggga

SEQ ID NO: 7089396 - DNA, 22 bp, Homo sapiens
atagctaccatgttggacagta

SEQ ID NO: 7089397 - DNA, 22 bp, Homo sapiens
atagctactgatgacacacaca

SEQ ID NO: 7089398 - DNA, 22 bp, Homo sapiens
atagctgtagaatgtatacaca

SEQ ID NO: 7089399 - DNA, 22 bp, Homo sapiens
atagctttttgtcatagagtct

SEQ ID NO: 7089400 - DNA, 22 bp, Homo sapiens
atagctttcttaaatatataaa

SEQ ID NO: 7089401 - DNA, 22 bp, Homo sapiens
atagctttcttaaatatataaa

SEQ ID NO: 7089402 - DNA, 22 bp, Homo sapiens
ataggaaagaaaattatgtagg

SEQ ID NO: 7089403 - DNA, 22 bp, Homo sapiens
ataggaaagaatggagggtggg

SEQ ID NO: 7089404 - DNA, 20 bp, Homo sapiens
ataggaaagggaggggcttt

SEQ ID NO: 7089405 - DNA, 22 bp, Homo sapiens
agaaaacttgtcacagctctca

SEQ ID NO: 7089406 - DNA, 22 bp, Homo sapiens
agaaaacttgctcgagcctgtt

SEQ ID NO: 7089407 - DNA, 20 bp, Homo sapiens
agaaaaagtgtggaaatttc

SEQ ID NO: 7089408 - DNA, 22 bp, Homo sapiens
atagttctagacctatagttct

SEQ ID NO: 7089409 - DNA, 22 bp, Homo sapiens
atagttattagagaagctggta

SEQ ID NO: 7089410 - DNA, 23 bp, Homo sapiens
atagttatgctgcatgcatgtac

SEQ ID NO: 7089411 - DNA, 22 bp, Homo sapiens
atagttggtccatgaaaaaagt

SEQ ID NO: 7089412 - DNA, 20 bp, Homo sapiens
agaaaaagtgtggaaatttc

SEQ ID NO: 7089413 - DNA, 22 bp, Homo sapiens
atagttctcactcagaatttga

SEQ ID NO: 7089414 - DNA, 22 bp, Homo sapiens
agaaaagaggctttctaagcat

SEQ ID NO: 7089415 - DNA, 22 bp, Homo sapiens
agaaaagcggtcaggaccctca

SEQ ID NO: 7089416 - DNA, 23 bp, Homo sapiens
agaaaagcttggacacatggcct

SEQ ID NO: 7089417 - DNA, 23 bp, Homo sapiens
agaaaagcttggacacatggcct

SEQ ID NO: 7089418 - DNA, 23 bp, Homo sapiens
agaaaagcttggacacatggcct

SEQ ID NO: 7089419 - DNA, 22 bp, Homo sapiens
agaaaagaggctttctaagcat

SEQ ID NO: 7089420 - DNA, 22 bp, Homo sapiens
agaaaagaggctttctaagcat

SEQ ID NO: 7089421 - DNA, 22 bp, Homo sapiens
agaaaagaggctttctaagcat

SEQ ID NO: 7089422 - DNA, 23 bp, Homo sapiens
agaaaagcttggacacatggcct

SEQ ID NO: 7089423 - DNA, 23 bp, Homo sapiens
agaaaagcttggacacatggcct

SEQ ID NO: 7089424 - DNA, 22 bp, Homo sapiens
agaaaaggattgatggatcaga

SEQ ID NO: 7089425 - DNA, 22 bp, Homo sapiens
agaaaaggattgatggatcaga

SEQ ID NO: 7089426 - DNA, 22 bp, Homo sapiens
agaaaaggattgatggatcaga

SEQ ID NO: 7089427 - DNA, 22 bp, Homo sapiens
agaaaaggcttgaagaggtttt

SEQ ID NO: 7089428 - DNA, 22 bp, Homo sapiens
agaaaagggcaggagggataca

SEQ ID NO: 7089429 - DNA, 22 bp, Homo sapiens
agaaaagggcaggagggataca

SEQ ID NO: 7089430 - DNA, 22 bp, Homo sapiens
agaaaagggcaggagggataca

SEQ ID NO: 7089431 - DNA, 22 bp, Homo sapiens
agaaaagggcaggagggataca

SEQ ID NO: 7089432 - DNA, 22 bp, Homo sapiens
atactgttttgtgacttatctt

SEQ ID NO: 7089433 - DNA, 22 bp, Homo sapiens
atacttaactgtggagtcattg

SEQ ID NO: 7089434 - DNA, 22 bp, Homo sapiens
atacttacttttcttcagacta

SEQ ID NO: 7089435 - DNA, 22 bp, Homo sapiens
atagaacaaggtagacagcttt

SEQ ID NO: 7089436 - DNA, 22 bp, Homo sapiens
atactgtttctcttctacatga

SEQ ID NO: 7089437 - DNA, 22 bp, Homo sapiens
atactgttggcagcagaccaga

SEQ ID NO: 7089438 - DNA, 22 bp, Homo sapiens
atacacttgacctggagtgaag

SEQ ID NO: 7089439 - DNA, 22 bp, Homo sapiens
atacacttgacctggagtgaag

SEQ ID NO: 7089440 - DNA, 20 bp, Homo sapiens
atacacttgcccagcttgtg

SEQ ID NO: 7089441 - DNA, 22 bp, Homo sapiens
atacactgttcactagatcttc

SEQ ID NO: 7089442 - DNA, 22 bp, Homo sapiens
atacacttcatgttttcatctg

SEQ ID NO: 7089443 - DNA, 22 bp, Homo sapiens
atacacttccaaatattgatta

SEQ ID NO: 7089444 - DNA, 22 bp, Homo sapiens
atacactggcctttgcagagcc

SEQ ID NO: 7089445 - DNA, 22 bp, Homo sapiens
atacactggcctttgcagagcc

SEQ ID NO: 7089446 - DNA, 22 bp, Homo sapiens
atacactggtttatgatattgt

SEQ ID NO: 7089447 - DNA, 22 bp, Homo sapiens
atacactgttcactagatcttc

SEQ ID NO: 7089448 - DNA, 21 bp, Homo sapiens
atagaacaccaggcatatata

SEQ ID NO: 7089449 - DNA, 22 bp, Homo sapiens
atagaacagaaacagatgcaca

SEQ ID NO: 7089450 - DNA, 22 bp, Homo sapiens
atagaacagaaacagatgcaca

SEQ ID NO: 7089451 - DNA, 22 bp, Homo sapiens
atagaactccatccctctgacc

SEQ ID NO: 7089452 - DNA, 22 bp, Homo sapiens
atagaagatagcttttgtttct

SEQ ID NO: 7089453 - DNA, 23 bp, Homo sapiens
atagaagattattgcaacagtcc

SEQ ID NO: 7089454 - DNA, 22 bp, Homo sapiens
atagaagcaagaacagaatgga

SEQ ID NO: 7089455 - DNA, 22 bp, Homo sapiens
atagaagctgataaactacttc

SEQ ID NO: 7089456 - DNA, 20 bp, Homo sapiens
atagaagtattatgtaatgt

SEQ ID NO: 7089457 - DNA, 22 bp, Homo sapiens
atagcatggcctgtgacacttt

SEQ ID NO: 7089458 - DNA, 22 bp, Homo sapiens
atagcattatttacaattagta

SEQ ID NO: 7089459 - DNA, 22 bp, Homo sapiens
atagcatttacttttcagaaat

SEQ ID NO: 7089460 - DNA, 22 bp, Homo sapiens
atagccacagttatattgagac

SEQ ID NO: 7089461 - DNA, 23 bp, Homo sapiens
actttagataaattatgtgcaca

SEQ ID NO: 7089462 - DNA, 22 bp, Homo sapiens
actttagatattcctctgtaca

SEQ ID NO: 7089463 - DNA, 22 bp, Homo sapiens
actttagaaaagcatccataga

SEQ ID NO: 7089464 - DNA, 22 bp, Homo sapiens
actttagaaaaggaacagagga

SEQ ID NO: 7089465 - DNA, 22 bp, Homo sapiens
actttagaagtaaggatgagtt

SEQ ID NO: 7089466 - DNA, 22 bp, Homo sapiens
actttagaccatcttccacagt

SEQ ID NO: 7089467 - DNA, 22 bp, Homo sapiens
actttagagaaatgtagaagta

SEQ ID NO: 7089468 - DNA, 22 bp, Homo sapiens
atagaatacatttcatggagat

SEQ ID NO: 7089469 - DNA, 22 bp, Homo sapiens
atagaataatggttgtcaggag

SEQ ID NO: 7089470 - DNA, 22 bp, Homo sapiens
atagaataaggcacagattctt

SEQ ID NO: 7089471 - DNA, 22 bp, Homo sapiens
atagaataaggcacagattctt

SEQ ID NO: 7089472 - DNA, 22 bp, Homo sapiens
atagaatagcatagaaaattga

SEQ ID NO: 7089473 - DNA, 22 bp, Homo sapiens
atagaatagcatagaaaattga

SEQ ID NO: 7089474 - DNA, 22 bp, Homo sapiens
atagaatagcatagaaaattga

SEQ ID NO: 7089475 - DNA, 22 bp, Homo sapiens
actttacccgcactcagacaca

SEQ ID NO: 7089476 - DNA, 22 bp, Homo sapiens
actttactacatccacagatgg

SEQ ID NO: 7089477 - DNA, 22 bp, Homo sapiens
actttactccccaacataaatg

SEQ ID NO: 7089478 - DNA, 22 bp, Homo sapiens
actttactccccaacataaatg

SEQ ID NO: 7089479 - DNA, 22 bp, Homo sapiens
actttacagatggtttcctgac

SEQ ID NO: 7089480 - DNA, 22 bp, Homo sapiens
actttacaggcacttcaagtat

SEQ ID NO: 7089481 - DNA, 22 bp, Homo sapiens
actttacaggcacttcaagtat

SEQ ID NO: 7089482 - DNA, 22 bp, Homo sapiens
actttacaggcacttcaagtat

SEQ ID NO: 7089483 - DNA, 22 bp, Homo sapiens
agtgggaggaagtggtgatatt

SEQ ID NO: 7089484 - DNA, 22 bp, Homo sapiens
agtgggagcggcagtcggggac

SEQ ID NO: 7089485 - DNA, 22 bp, Homo sapiens
agtgggagcggcagtcggggac

SEQ ID NO: 7089486 - DNA, 22 bp, Homo sapiens
agtgggagcggcagtcggggac

SEQ ID NO: 7089487 - DNA, 22 bp, Homo sapiens
agtgggagccagcagcttgggg

SEQ ID NO: 7089488 - DNA, 22 bp, Homo sapiens
agtgggagcggcagtcggggac

SEQ ID NO: 7089489 - DNA, 22 bp, Homo sapiens
agtgggagccagcagcttgggg

SEQ ID NO: 7089490 - DNA, 22 bp, Homo sapiens
agtgggagccagcagcttgggg

SEQ ID NO: 7089491 - DNA, 22 bp, Homo sapiens
agtgggagcggcagtcggggac

SEQ ID NO: 7089492 - DNA, 22 bp, Homo sapiens
agtgggagcggcagtcggggac

SEQ ID NO: 7089493 - DNA, 22 bp, Homo sapiens
agtgggaggcggctgacgggcg

SEQ ID NO: 7089494 - DNA, 22 bp, Homo sapiens
agtgggaggcggctgacgggcg

SEQ ID NO: 7089495 - DNA, 22 bp, Homo sapiens
agtgggaggaagtggtgatatt

SEQ ID NO: 7089496 - DNA, 22 bp, Homo sapiens
agtgggaggaagtggtgatatt

SEQ ID NO: 7089497 - DNA, 22 bp, Homo sapiens
agtgggaggaagtggtgatatt

SEQ ID NO: 7089498 - DNA, 22 bp, Homo sapiens
agtggggccgcggtcctgccct

SEQ ID NO: 7089499 - DNA, 22 bp, Homo sapiens
agtgggagggccatatggtgaa

SEQ ID NO: 7089500 - DNA, 22 bp, Homo sapiens
agtgggagggccatatggtgaa

SEQ ID NO: 7089501 - DNA, 22 bp, Homo sapiens
agtgggaggcggctgacgggcg

SEQ ID NO: 7089502 - DNA, 22 bp, Homo sapiens
agtgggaggcggctgacgggcg

SEQ ID NO: 7089503 - DNA, 22 bp, Homo sapiens
agtgggaggcggctgacgggcg

SEQ ID NO: 7089504 - DNA, 22 bp, Homo sapiens
agtggcagagccagggttggga

SEQ ID NO: 7089505 - DNA, 22 bp, Homo sapiens
agtggcagagccaagtagagcc

SEQ ID NO: 7089506 - DNA, 22 bp, Homo sapiens
agtggcagagccaagtagagcc

SEQ ID NO: 7089507 - DNA, 22 bp, Homo sapiens
agtggcagagccaagtagagcc

SEQ ID NO: 7089508 - DNA, 22 bp, Homo sapiens
agtggcagagccaagatatgat

SEQ ID NO: 7089509 - DNA, 22 bp, Homo sapiens
agtggcagagccaagtagagcc

SEQ ID NO: 7089510 - DNA, 22 bp, Homo sapiens
agtggcagagccaagatatgat

SEQ ID NO: 7089511 - DNA, 20 bp, Homo sapiens
agtgggagagggcagactgc

SEQ ID NO: 7089512 - DNA, 22 bp, Homo sapiens
agtgggagccagcagcttgggg

SEQ ID NO: 7089513 - DNA, 22 bp, Homo sapiens
agtgggagccagcagcttgggg

SEQ ID NO: 7089514 - DNA, 20 bp, Homo sapiens
agtgggagagggcagactgc

SEQ ID NO: 7089515 - DNA, 22 bp, Homo sapiens
agtggcagagcaggtgctggaa

SEQ ID NO: 7089516 - DNA, 22 bp, Homo sapiens
agtggcagagcaggtgctggaa

SEQ ID NO: 7089517 - DNA, 22 bp, Homo sapiens
agtggcagagcaggtgctggaa

SEQ ID NO: 7089518 - DNA, 22 bp, Homo sapiens
agtggcagagcaggtgctggaa

SEQ ID NO: 7089519 - DNA, 22 bp, Homo sapiens
agtggcagagcaggtgctggaa

SEQ ID NO: 7089520 - DNA, 22 bp, Homo sapiens
agtggcagacagagacagtacc

SEQ ID NO: 7089521 - DNA, 22 bp, Homo sapiens
agtggcagagaccccagccagc

SEQ ID NO: 7089522 - DNA, 22 bp, Homo sapiens
agtggcagacacaatgtgggca

SEQ ID NO: 7089523 - DNA, 22 bp, Homo sapiens
agtggcagacacaatgtgggca

SEQ ID NO: 7089524 - DNA, 22 bp, Homo sapiens
agtggcagacacaatgtgggca

SEQ ID NO: 7089525 - DNA, 22 bp, Homo sapiens
agtggcagacacaatgtgggca

SEQ ID NO: 7089526 - DNA, 22 bp, Homo sapiens
agtggcagaagtcactgggtag

SEQ ID NO: 7089527 - DNA, 22 bp, Homo sapiens
agtgctttgagcgtttgaaaag

SEQ ID NO: 7089528 - DNA, 22 bp, Homo sapiens
agtgctttgaacgaaaggctga

SEQ ID NO: 7089529 - DNA, 22 bp, Homo sapiens
agtgctttccttcttgtgacat

SEQ ID NO: 7089530 - DNA, 22 bp, Homo sapiens
agtgctttccctgaaaccttcc

SEQ ID NO: 7089531 - DNA, 22 bp, Homo sapiens
agtgctttccctgaaaccttcc

SEQ ID NO: 7089532 - DNA, 22 bp, Homo sapiens
agtgctttatgttgttgtgcaa

SEQ ID NO: 7089533 - DNA, 22 bp, Homo sapiens
agtgctttcagtgtgctctttt

SEQ ID NO: 7089534 - DNA, 22 bp, Homo sapiens
agtgctttatgttgttgtgcaa

SEQ ID NO: 7089535 - DNA, 22 bp, Homo sapiens
agtgctttagaccttttggggt

SEQ ID NO: 7089536 - DNA, 20 bp, Homo sapiens
agtgcttattttcatggctg

SEQ ID NO: 7089537 - DNA, 22 bp, Homo sapiens
agtgcttaggatttgagaggcg

SEQ ID NO: 7089538 - DNA, 22 bp, Homo sapiens
agtgcttataccaaagactctt

SEQ ID NO: 7089539 - DNA, 22 bp, Homo sapiens
agtgcttaatagatgtccagca

SEQ ID NO: 7089540 - DNA, 22 bp, Homo sapiens
agtgcttagttccatgctggaa

SEQ ID NO: 7089541 - DNA, 22 bp, Homo sapiens
agtgcttaatagatgtccagca

SEQ ID NO: 7089542 - DNA, 22 bp, Homo sapiens
agtgcttaaaaccctgcactag

SEQ ID NO: 7089543 - DNA, 22 bp, Homo sapiens
agtgctgttggataatgctgtc

SEQ ID NO: 7089544 - DNA, 22 bp, Homo sapiens
agtgctgttaggttaatatagt

SEQ ID NO: 7089545 - DNA, 22 bp, Homo sapiens
agtgaatgtccccgcgggtcag

SEQ ID NO: 7089546 - DNA, 22 bp, Homo sapiens
agtgaatgtccccgcgggtcag

SEQ ID NO: 7089547 - DNA, 22 bp, Homo sapiens
agtgaatgtccccgcgggtcag

SEQ ID NO: 7089548 - DNA, 22 bp, Homo sapiens
agtgaattagcctatttgtaaa

SEQ ID NO: 7089549 - DNA, 22 bp, Homo sapiens
agtgaatgagaggtgagtattg

SEQ ID NO: 7089550 - DNA, 22 bp, Homo sapiens
agtgaatgtccccgcgggtcag

SEQ ID NO: 7089551 - DNA, 21 bp, Homo sapiens
agtccttgaaactctttcttg

SEQ ID NO: 7089552 - DNA, 21 bp, Homo sapiens
agtccttgaaactctttcttg

SEQ ID NO: 7089553 - DNA, 21 bp, Homo sapiens
agtccttgaaactctttcttg

SEQ ID NO: 7089554 - DNA, 22 bp, Homo sapiens
agtccttgaatgttttgaaatc

SEQ ID NO: 7089555 - DNA, 22 bp, Homo sapiens
agtccttgaattaatttgactc

SEQ ID NO: 7089556 - DNA, 22 bp, Homo sapiens
agtgaattctaaatgctaaaga

SEQ ID NO: 7089557 - DNA, 17 bp, Homo sapiens
agtgagaatgtcatgta

SEQ ID NO: 7089558 - DNA, 17 bp, Homo sapiens
agtgagaatgtcatgta

SEQ ID NO: 7089559 - DNA, 22 bp, Homo sapiens
agtgagacagtatactgagcag

SEQ ID NO: 7089560 - DNA, 22 bp, Homo sapiens
agtgagacagtggactctgcat

SEQ ID NO: 7089561 - DNA, 22 bp, Homo sapiens
agtgagagtattaatgtgaact

SEQ ID NO: 7089562 - DNA, 22 bp, Homo sapiens
agtgagagtattaatgtgaact

SEQ ID NO: 7089563 - DNA, 22 bp, Homo sapiens
agtgagagtattaatgtgaact

SEQ ID NO: 7089564 - DNA, 22 bp, Homo sapiens
agtgagagtattaatgtgaact

SEQ ID NO: 7089565 - DNA, 22 bp, Homo sapiens
agtgagagtattaatgtgaact

SEQ ID NO: 7089566 - DNA, 22 bp, Homo sapiens
agtgagatactgagaacatctc

SEQ ID NO: 7089567 - DNA, 22 bp, Homo sapiens
agtgagatactgagaacatctc

SEQ ID NO: 7089568 - DNA, 20 bp, Homo sapiens
agtgaggcagttcagtgggc

SEQ ID NO: 7089569 - DNA, 22 bp, Homo sapiens
agtgaggcaaagtgagaggcag

SEQ ID NO: 7089570 - DNA, 20 bp, Homo sapiens
agtgaggcagttcagtgggc

SEQ ID NO: 7089571 - DNA, 22 bp, Homo sapiens
agtgaggctaataggcaatggt

SEQ ID NO: 7089572 - DNA, 22 bp, Homo sapiens
agtgaggataccaatgtgtaga

SEQ ID NO: 7089573 - DNA, 17 bp, Homo sapiens
agtgaggagattggaag

SEQ ID NO: 7089574 - DNA, 22 bp, Homo sapiens
agtgaggaaatccattatcaag

SEQ ID NO: 7089575 - DNA, 22 bp, Homo sapiens
agtgagcattcgtttggaaccc

SEQ ID NO: 7089576 - DNA, 22 bp, Homo sapiens
agtgagccataagggctgccac

SEQ ID NO: 7089577 - DNA, 22 bp, Homo sapiens
agtgagcattcgtttggaaccc

SEQ ID NO: 7089578 - DNA, 22 bp, Homo sapiens
agtgagcatcttcaggagccaa

SEQ ID NO: 7089579 - DNA, 22 bp, Homo sapiens
agtgagcagtacttactcctgc

SEQ ID NO: 7089580 - DNA, 19 bp, Homo sapiens
agtgagcatccagagaggt

SEQ ID NO: 7089581 - DNA, 19 bp, Homo sapiens
agtgagcatccagagaggt

SEQ ID NO: 7089582 - DNA, 19 bp, Homo sapiens
agtgagcatccagagaggt

SEQ ID NO: 7089583 - DNA, 21 bp, Homo sapiens
agtgagcatccagagaggtgg

SEQ ID NO: 7089584 - DNA, 22 bp, Homo sapiens
agtgagcatccagagaggtggg

SEQ ID NO: 7089585 - DNA, 23 bp, Homo sapiens
agtgagcagctgtagggcaagga

SEQ ID NO: 7089586 - DNA, 22 bp, Homo sapiens
agtgagcaagacttcgttgtcc

SEQ ID NO: 7089587 - DNA, 22 bp, Homo sapiens
agtgagcaagacttcgttgtcc

SEQ ID NO: 7089588 - DNA, 22 bp, Homo sapiens
agtgagcactgttgttggttcc

SEQ ID NO: 7089589 - DNA, 23 bp, Homo sapiens
agtgagcagctgtagggcaagga

SEQ ID NO: 7089590 - DNA, 23 bp, Homo sapiens
agtgagcagctgtagggcaagga

SEQ ID NO: 7089591 - DNA, 22 bp, Homo sapiens
agtgagcagtacttactcctgc

SEQ ID NO: 7089592 - DNA, 20 bp, Homo sapiens
agtgagattgctgctctagc

SEQ ID NO: 7089593 - DNA, 22 bp, Homo sapiens
agtgagcaacagaagcgtgggt

SEQ ID NO: 7089594 - DNA, 22 bp, Homo sapiens
agtgagcaacagaagcgtgggt

SEQ ID NO: 7089595 - DNA, 23 bp, Homo sapiens
agtgctgaattgaaagctccagg

SEQ ID NO: 7089596 - DNA, 23 bp, Homo sapiens
agtgctgaattgaaagctccagg

SEQ ID NO: 7089597 - DNA, 20 bp, Homo sapiens
agtgctgtggctgaataaga

SEQ ID NO: 7089598 - DNA, 20 bp, Homo sapiens
agtgcaagaaagcacagctg

SEQ ID NO: 7089599 - DNA, 20 bp, Homo sapiens
agtgcaagaaagcacagctg

SEQ ID NO: 7089600 - DNA, 22 bp, Homo sapiens
agtgcaaagggctgttgagaag

SEQ ID NO: 7089601 - DNA, 22 bp, Homo sapiens
agtgcaaagggctgttgagaag

SEQ ID NO: 7089602 - DNA, 22 bp, Homo sapiens
agtgcaaatatctacgcggtga

SEQ ID NO: 7089603 - DNA, 22 bp, Homo sapiens
agtgcaaattatttacctgatt

SEQ ID NO: 7089604 - DNA, 22 bp, Homo sapiens
agtgcaaagaaatcagctttgt

SEQ ID NO: 7089605 - DNA, 22 bp, Homo sapiens
agtgcaaagcagcctgtacacc

SEQ ID NO: 7089606 - DNA, 22 bp, Homo sapiens
agtgcaaagcagcctgtacacc

SEQ ID NO: 7089607 - DNA, 22 bp, Homo sapiens
agtgcaaagcagcctgtacacc

SEQ ID NO: 7089608 - DNA, 22 bp, Homo sapiens
agtgcaaagccgaggtttcttg

SEQ ID NO: 7089609 - DNA, 22 bp, Homo sapiens
agtgcaaagctgctgctgtggt

SEQ ID NO: 7089610 - DNA, 22 bp, Homo sapiens
agtgcaaagggatcagattggg

SEQ ID NO: 7089611 - DNA, 22 bp, Homo sapiens
agtgcaaaattcagaagcaatt

SEQ ID NO: 7089612 - DNA, 22 bp, Homo sapiens
agtgcaaaagtaattggagttt

SEQ ID NO: 7089613 - DNA, 22 bp, Homo sapiens
agtgattttgtcagcttctgca

SEQ ID NO: 7089614 - DNA, 22 bp, Homo sapiens
agtgcaaaaaagtgttgtgaca

SEQ ID NO: 7089615 - DNA, 22 bp, Homo sapiens
agtgcaaaattcagaagcaatt

SEQ ID NO: 7089616 - DNA, 22 bp, Homo sapiens
agtgcaaactttattgtgacct

SEQ ID NO: 7089617 - DNA, 22 bp, Homo sapiens
agtgcaaagaaatcagctttgt

SEQ ID NO: 7089618 - DNA, 22 bp, Homo sapiens
agtgattttgctttgaagtgac

SEQ ID NO: 7089619 - DNA, 22 bp, Homo sapiens
agtgattttcaagtggagcaca

SEQ ID NO: 7089620 - DNA, 22 bp, Homo sapiens
agtgattttctccagctggcag

SEQ ID NO: 7089621 - DNA, 22 bp, Homo sapiens
agtgattttggccgtgccatta

SEQ ID NO: 7089622 - DNA, 22 bp, Homo sapiens
agtgattttggcctggcctttt

SEQ ID NO: 7089623 - DNA, 22 bp, Homo sapiens
agtgattttgtagctatgagat

SEQ ID NO: 7089624 - DNA, 22 bp, Homo sapiens
agtgattttgtagctatgagat

SEQ ID NO: 7089625 - DNA, 22 bp, Homo sapiens
agtgatttggcggcagagttag

SEQ ID NO: 7089626 - DNA, 22 bp, Homo sapiens
agtgatttggcggcagagttag

SEQ ID NO: 7089627 - DNA, 22 bp, Homo sapiens
agtgatttggttcatacttcca

SEQ ID NO: 7089628 - DNA, 22 bp, Homo sapiens
agtgattttaacttccagcaat

SEQ ID NO: 7089629 - DNA, 22 bp, Homo sapiens
agtgattttatcaatttactca

SEQ ID NO: 7089630 - DNA, 22 bp, Homo sapiens
agtgggggccaacgagggcagc

SEQ ID NO: 7089631 - DNA, 22 bp, Homo sapiens
agtgggggccaacgagggcagc

SEQ ID NO: 7089632 - DNA, 22 bp, Homo sapiens
agtgggggccaacgagggcagc

SEQ ID NO: 7089633 - DNA, 22 bp, Homo sapiens
agtgggggcagagcctctctcg

SEQ ID NO: 7089634 - DNA, 22 bp, Homo sapiens
agtgggggcagagcctctctcg

SEQ ID NO: 7089635 - DNA, 22 bp, Homo sapiens
agtggggcggacaggaccagga

SEQ ID NO: 7089636 - DNA, 22 bp, Homo sapiens
agtggggcggacaggaccagga

SEQ ID NO: 7089637 - DNA, 22 bp, Homo sapiens
agtgggggcagagcctctctcg

SEQ ID NO: 7089638 - DNA, 22 bp, Homo sapiens
agtggggccggtgaggccgagg

SEQ ID NO: 7089639 - DNA, 22 bp, Homo sapiens
agtggggccggtgaggccgagg

SEQ ID NO: 7089640 - DNA, 22 bp, Homo sapiens
agtggggccggtgaggccgagg

SEQ ID NO: 7089641 - DNA, 22 bp, Homo sapiens
agtggggccggtgaggccgagg

SEQ ID NO: 7089642 - DNA, 22 bp, Homo sapiens
agtggggcggacaggaccagga

SEQ ID NO: 7089643 - DNA, 22 bp, Homo sapiens
agtggggcggacaggaccagga

SEQ ID NO: 7089644 - DNA, 22 bp, Homo sapiens
agtggggcggacaggaccagga

SEQ ID NO: 7089645 - DNA, 22 bp, Homo sapiens
agtggggtcctcagtatggttc

SEQ ID NO: 7089646 - DNA, 21 bp, Homo sapiens
agtggggtctctgtggaggcc

SEQ ID NO: 7089647 - DNA, 22 bp, Homo sapiens
agtgggggctggctctgtctgt

SEQ ID NO: 7089648 - DNA, 22 bp, Homo sapiens
agtgggggctggctctgtctgt

SEQ ID NO: 7089649 - DNA, 22 bp, Homo sapiens
agtgggggctggctctgtctgt

SEQ ID NO: 7089650 - DNA, 22 bp, Homo sapiens
agtggggtccatcccttccctc

SEQ ID NO: 7089651 - DNA, 22 bp, Homo sapiens
agtgggggccaacgagggcagc

SEQ ID NO: 7089652 - DNA, 22 bp, Homo sapiens
agtgggggccaacgagggcagc

SEQ ID NO: 7089653 - DNA, 22 bp, Homo sapiens
agtgggggccaacgagggcagc

SEQ ID NO: 7089654 - DNA, 22 bp, Homo sapiens
agtgggggccaacgagggcagc

SEQ ID NO: 7089655 - DNA, 22 bp, Homo sapiens
agtgtctgttgagtttcaaaag

SEQ ID NO: 7089656 - DNA, 22 bp, Homo sapiens
agtgtctgttacgcttgcagaa

SEQ ID NO: 7089657 - DNA, 22 bp, Homo sapiens
agtgtctgtgttttctattgct

SEQ ID NO: 7089658 - DNA, 22 bp, Homo sapiens
agtgtctgtgctttgcagcaaa

SEQ ID NO: 7089659 - DNA, 22 bp, Homo sapiens
agtgtctgtgctttgcagcaaa

SEQ ID NO: 7089660 - DNA, 22 bp, Homo sapiens
agtgtctgtgatgaggtcagga

SEQ ID NO: 7089661 - DNA, 20 bp, Homo sapiens
agtgtctggtgcagggcctc

SEQ ID NO: 7089662 - DNA, 22 bp, Homo sapiens
agtgtctgtgaggggaattcct

SEQ ID NO: 7089663 - DNA, 22 bp, Homo sapiens
agtgtctgtgaggggaattcct

SEQ ID NO: 7089664 - DNA, 22 bp, Homo sapiens
agtgtctgtgatgaggtcagga

SEQ ID NO: 7089665 - DNA, 22 bp, Homo sapiens
agtgtctgtgatgaggtcagga

SEQ ID NO: 7089666 - DNA, 20 bp, Homo sapiens
agtgtctggtgcagggcctc

SEQ ID NO: 7089667 - DNA, 20 bp, Homo sapiens
agtgtctggtgcagggcctc

SEQ ID NO: 7089668 - DNA, 22 bp, Homo sapiens
agtgtctggtgagggctctctc

SEQ ID NO: 7089669 - DNA, 22 bp, Homo sapiens
agtgtctggtgagggctctctc

SEQ ID NO: 7089670 - DNA, 22 bp, Homo sapiens
agtgtctgaacctgcagtggga

SEQ ID NO: 7089671 - DNA, 22 bp, Homo sapiens
agtgtctgaacctgcagtggga

SEQ ID NO: 7089672 - DNA, 22 bp, Homo sapiens
agtggggtctcctccagccccc

SEQ ID NO: 7089673 - DNA, 22 bp, Homo sapiens
agtgtctgaaccaccggggcat

SEQ ID NO: 7089674 - DNA, 22 bp, Homo sapiens
agtgtcttacatgaattgattt

SEQ ID NO: 7089675 - DNA, 22 bp, Homo sapiens
agtgtcttacatgaattgattt

SEQ ID NO: 7089676 - DNA, 22 bp, Homo sapiens
agtgtctgttgttcagaactct

SEQ ID NO: 7089677 - DNA, 22 bp, Homo sapiens
agtgtctgttgttcagaactct

SEQ ID NO: 7089678 - DNA, 22 bp, Homo sapiens
agtgtctgttgcttttgcagtg

SEQ ID NO: 7089679 - DNA, 22 bp, Homo sapiens
agtgtctgttgcttttgcagtg

SEQ ID NO: 7089680 - DNA, 22 bp, Homo sapiens
agtgtcttcatgatgtggcagc

SEQ ID NO: 7089681 - DNA, 22 bp, Homo sapiens
agtgtctttatagactgacaat

SEQ ID NO: 7089682 - DNA, 22 bp, Homo sapiens
agtgtcttcatgatgtggcagc

SEQ ID NO: 7089683 - DNA, 22 bp, Homo sapiens
agtgtcttagtccatttgggct

SEQ ID NO: 7089684 - DNA, 22 bp, Homo sapiens
agtgtctttagcaagtttagtc

SEQ ID NO: 7089685 - DNA, 22 bp, Homo sapiens
agtgtgggtgagggaggccctc

SEQ ID NO: 7089686 - DNA, 22 bp, Homo sapiens
agtgtgggtgagggaggccctc

SEQ ID NO: 7089687 - DNA, 22 bp, Homo sapiens
agtgtgggttttatggagccct

SEQ ID NO: 7089688 - DNA, 22 bp, Homo sapiens
agtgtgggttttatggagccct

SEQ ID NO: 7089689 - DNA, 22 bp, Homo sapiens
agtgtggtcgggagcgcggggc

SEQ ID NO: 7089690 - DNA, 22 bp, Homo sapiens
agtgtggtcgggagcgcggggc

SEQ ID NO: 7089691 - DNA, 22 bp, Homo sapiens
agtgtgtacataattgtacgcc

SEQ ID NO: 7089692 - DNA, 17 bp, Homo sapiens
agtgtgtgaaatggtgg

SEQ ID NO: 7089693 - DNA, 17 bp, Homo sapiens
agtgtgtgaaatggtgg

SEQ ID NO: 7089694 - DNA, 17 bp, Homo sapiens
agtgtgtgaaatggtgg

SEQ ID NO: 7089695 - DNA, 22 bp, Homo sapiens
agtgtgtcttatcctgggagaa

SEQ ID NO: 7089696 - DNA, 17 bp, Homo sapiens
agtgtgtgaaatggtgg

SEQ ID NO: 7089697 - DNA, 22 bp, Homo sapiens
agtgtgtgaccttttaatttaa

SEQ ID NO: 7089698 - DNA, 22 bp, Homo sapiens
agtgtgtgaccttttaatttaa

SEQ ID NO: 7089699 - DNA, 22 bp, Homo sapiens
agtgtgtgaccttttaatttaa

SEQ ID NO: 7089700 - DNA, 22 bp, Homo sapiens
agtgtgtgaccttttaatttaa

SEQ ID NO: 7089701 - DNA, 23 bp, Homo sapiens
actgggctgaaattaaaggtgtc

SEQ ID NO: 7089702 - DNA, 22 bp, Homo sapiens
agtgtgtacatttggtgcagtt

SEQ ID NO: 7089703 - DNA, 22 bp, Homo sapiens
agtgtgtagcatttggcaggca

SEQ ID NO: 7089704 - DNA, 22 bp, Homo sapiens
agtgtgtcagttgaaagagatt

SEQ ID NO: 7089705 - DNA, 22 bp, Homo sapiens
agtgtgtcagttgaaagagatt

SEQ ID NO: 7089706 - DNA, 22 bp, Homo sapiens
agtgtgtccagaaatctgtatt

SEQ ID NO: 7089707 - DNA, 22 bp, Homo sapiens
agtgtgtccagaaatctgtatt

SEQ ID NO: 7089708 - DNA, 22 bp, Homo sapiens
agtgtgtccaggaagcagatgg

SEQ ID NO: 7089709 - DNA, 22 bp, Homo sapiens
agtgtgtccaggaagcagatgg

SEQ ID NO: 7089710 - DNA, 22 bp, Homo sapiens
agtgtgtcgagggagggtccag

SEQ ID NO: 7089711 - DNA, 23 bp, Homo sapiens
agtgtgtattgctgagggcagct

SEQ ID NO: 7089712 - DNA, 22 bp, Homo sapiens
agtgtgtcgagggagggtccag

SEQ ID NO: 7089713 - DNA, 20 bp, Homo sapiens
agtgtgtctcggaggtaagt

SEQ ID NO: 7089714 - DNA, 22 bp, Homo sapiens
agtgtgtctgatcacttgtgag

SEQ ID NO: 7089715 - DNA, 22 bp, Homo sapiens
agtgtgtctgatcacttgtgag

SEQ ID NO: 7089716 - DNA, 22 bp, Homo sapiens
agttacaaacactatcagttct

SEQ ID NO: 7089717 - DNA, 22 bp, Homo sapiens
agttacaaccatgacacaagca

SEQ ID NO: 7089718 - DNA, 22 bp, Homo sapiens
agttacaaccatgacacaagca

SEQ ID NO: 7089719 - DNA, 22 bp, Homo sapiens
agttacaaccatgacacaagca

SEQ ID NO: 7089720 - DNA, 22 bp, Homo sapiens
agttacaaacactatcagttct

SEQ ID NO: 7089721 - DNA, 22 bp, Homo sapiens
agttacaaacactatcagttct

SEQ ID NO: 7089722 - DNA, 22 bp, Homo sapiens
agttacaaacactatcagttct

SEQ ID NO: 7089723 - DNA, 17 bp, Homo sapiens
agttaaggctctttgct

SEQ ID NO: 7089724 - DNA, 22 bp, Homo sapiens
agttaagggggttcatctgtaa

SEQ ID NO: 7089725 - DNA, 22 bp, Homo sapiens
agttaaggttcaattaaagtta

SEQ ID NO: 7089726 - DNA, 22 bp, Homo sapiens
agttaataatggaaagacacat

SEQ ID NO: 7089727 - DNA, 22 bp, Homo sapiens
agttaatgagcattttggaatg

SEQ ID NO: 7089728 - DNA, 19 bp, Homo sapiens
agttaatgagcttttgatc

SEQ ID NO: 7089729 - DNA, 22 bp, Homo sapiens
actggtggccctcagtgttctc

SEQ ID NO: 7089730 - DNA, 22 bp, Homo sapiens
actggtggctttcagacagaaa

SEQ ID NO: 7089731 - DNA, 22 bp, Homo sapiens
actggtggctttcagacagaaa

SEQ ID NO: 7089732 - DNA, 20 bp, Homo sapiens
actggtggactgttcattga

SEQ ID NO: 7089733 - DNA, 22 bp, Homo sapiens
actggtactcagctggcactca

SEQ ID NO: 7089734 - DNA, 22 bp, Homo sapiens
actggtcagattttacttccca

SEQ ID NO: 7089735 - DNA, 22 bp, Homo sapiens
actggtcagattttacttccca

SEQ ID NO: 7089736 - DNA, 22 bp, Homo sapiens
actggtcctctgccagcagctg

SEQ ID NO: 7089737 - DNA, 22 bp, Homo sapiens
actggtggtttctccccagaga

SEQ ID NO: 7089738 - DNA, 22 bp, Homo sapiens
actggtgtgcttttgttacata

SEQ ID NO: 7089739 - DNA, 22 bp, Homo sapiens
actggtgttgatttggaagggg

SEQ ID NO: 7089740 - DNA, 22 bp, Homo sapiens
actggttgaagaaaagctagta

SEQ ID NO: 7089741 - DNA, 22 bp, Homo sapiens
actggtgttgatttggaagggg

SEQ ID NO: 7089742 - DNA, 22 bp, Homo sapiens
actggtttcctagaataagact

SEQ ID NO: 7089743 - DNA, 22 bp, Homo sapiens
actggggctgatgcgttcgtgt

SEQ ID NO: 7089744 - DNA, 22 bp, Homo sapiens
actggggcctcctccatgctct

SEQ ID NO: 7089745 - DNA, 22 bp, Homo sapiens
actggggcctcctccatgctct

SEQ ID NO: 7089746 - DNA, 22 bp, Homo sapiens
actggggcctcctccatgctct

SEQ ID NO: 7089747 - DNA, 22 bp, Homo sapiens
actggggcctcctccatgctct

SEQ ID NO: 7089748 - DNA, 23 bp, Homo sapiens
actgggtctatctccagagaaga

SEQ ID NO: 7089749 - DNA, 22 bp, Homo sapiens
actgggtggctgcctccttctc

SEQ ID NO: 7089750 - DNA, 22 bp, Homo sapiens
actgggtgtattagtggtgttt

SEQ ID NO: 7089751 - DNA, 22 bp, Homo sapiens
actggggagttgaagcactttc

SEQ ID NO: 7089752 - DNA, 22 bp, Homo sapiens
actggggattagggactcagtg

SEQ ID NO: 7089753 - DNA, 22 bp, Homo sapiens
actggggattagggactcagtg

SEQ ID NO: 7089754 - DNA, 22 bp, Homo sapiens
actggggattagggactcagtg

SEQ ID NO: 7089755 - DNA, 22 bp, Homo sapiens
actggggcaggaaagtatgctg

SEQ ID NO: 7089756 - DNA, 22 bp, Homo sapiens
actggggcaggaaagtatgctg

SEQ ID NO: 7089757 - DNA, 22 bp, Homo sapiens
actggggcaggaaagtatgctg

SEQ ID NO: 7089758 - DNA, 22 bp, Homo sapiens
actggggcagtgggcagtggtt

SEQ ID NO: 7089759 - DNA, 22 bp, Homo sapiens
actggggcagtgggcagtggtt

SEQ ID NO: 7089760 - DNA, 22 bp, Homo sapiens
actggggcagtgggcagtggtt

SEQ ID NO: 7089761 - DNA, 22 bp, Homo sapiens
actggggcagtgggcagtggtt

SEQ ID NO: 7089762 - DNA, 22 bp, Homo sapiens
actggggcagtgggcagtggtt

SEQ ID NO: 7089763 - DNA, 22 bp, Homo sapiens
actggggcagtgggcagtggtt

SEQ ID NO: 7089764 - DNA, 22 bp, Homo sapiens
agttcaatagaaaaatatatta

SEQ ID NO: 7089765 - DNA, 22 bp, Homo sapiens
agttcaagcaatgctggaagaa

SEQ ID NO: 7089766 - DNA, 22 bp, Homo sapiens
agttcaaaaaggtaaagtttat

SEQ ID NO: 7089767 - DNA, 22 bp, Homo sapiens
agttcaaactctataagaactt

SEQ ID NO: 7089768 - DNA, 22 bp, Homo sapiens
agttcaaagctgcagtaatgga

SEQ ID NO: 7089769 - DNA, 22 bp, Homo sapiens
agttattttggaaaatgagtca

SEQ ID NO: 7089770 - DNA, 22 bp, Homo sapiens
agttattttggaaaatgagtca

SEQ ID NO: 7089771 - DNA, 22 bp, Homo sapiens
agttattttggaaaatgagtca

SEQ ID NO: 7089772 - DNA, 22 bp, Homo sapiens
agttattttggaaaatgagtca

SEQ ID NO: 7089773 - DNA, 19 bp, Homo sapiens
agttatttctaaatttacc

SEQ ID NO: 7089774 - DNA, 22 bp, Homo sapiens
agttatttggctatagatggta

SEQ ID NO: 7089775 - DNA, 22 bp, Homo sapiens
agttattttacatggaagtttg

SEQ ID NO: 7089776 - DNA, 22 bp, Homo sapiens
agttaccacccacaagcttgtt

SEQ ID NO: 7089777 - DNA, 22 bp, Homo sapiens
agttacatgtgaatagaaagta

SEQ ID NO: 7089778 - DNA, 22 bp, Homo sapiens
agttacattctgagctgagtag

SEQ ID NO: 7089779 - DNA, 22 bp, Homo sapiens
agttaccctttctggttcatat

SEQ ID NO: 7089780 - DNA, 21 bp, Homo sapiens
agttacaagtttattcagagg

SEQ ID NO: 7089781 - DNA, 22 bp, Homo sapiens
agttacacaacttatcacatct

SEQ ID NO: 7089782 - DNA, 22 bp, Homo sapiens
agttacaagtacaggctttgga

SEQ ID NO: 7089783 - DNA, 22 bp, Homo sapiens
agttacacaacttatcacatct

SEQ ID NO: 7089784 - DNA, 22 bp, Homo sapiens
agttacacaattattgcatgga

SEQ ID NO: 7089785 - DNA, 22 bp, Homo sapiens
agttacaactgtttgaatgtca

SEQ ID NO: 7089786 - DNA, 22 bp, Homo sapiens
agttacaagctattttacttaa

SEQ ID NO: 7089787 - DNA, 22 bp, Homo sapiens
agttacaaccatgacacaagca

SEQ ID NO: 7089788 - DNA, 22 bp, Homo sapiens
agttacaactgtttgaatgtca

SEQ ID NO: 7089789 - DNA, 22 bp, Homo sapiens
agttacaggaaagggccaggaa

SEQ ID NO: 7089790 - DNA, 22 bp, Homo sapiens
agttacagctggcgtggggaaa

SEQ ID NO: 7089791 - DNA, 22 bp, Homo sapiens
agttacagtgaccatttattta

SEQ ID NO: 7089792 - DNA, 22 bp, Homo sapiens
agttacagtgttctattactct

SEQ ID NO: 7089793 - DNA, 21 bp, Homo sapiens
agttacatgtatagataaagt

SEQ ID NO: 7089794 - DNA, 22 bp, Homo sapiens
agttacatgtgaatagaaagta

SEQ ID NO: 7089795 - DNA, 22 bp, Homo sapiens
agttacatgtgaatagaaagta

SEQ ID NO: 7089796 - DNA, 22 bp, Homo sapiens
actcagctcaggagctggctgg

SEQ ID NO: 7089797 - DNA, 22 bp, Homo sapiens
actcagctaaactcagtctatg

SEQ ID NO: 7089798 - DNA, 22 bp, Homo sapiens
actcagcacagcactgggaacc

SEQ ID NO: 7089799 - DNA, 22 bp, Homo sapiens
actcagaggcagctgctcaccc

SEQ ID NO: 7089800 - DNA, 22 bp, Homo sapiens
actcagagtctgagataaatct

SEQ ID NO: 7089801 - DNA, 22 bp, Homo sapiens
actcagaggaaaccctcctagg

SEQ ID NO: 7089802 - DNA, 22 bp, Homo sapiens
actcagagcttggctccttgct

SEQ ID NO: 7089803 - DNA, 23 bp, Homo sapiens
agtaacatgcaaataacagtctg

SEQ ID NO: 7089804 - DNA, 22 bp, Homo sapiens
actcagcttcctacagctagaa

SEQ ID NO: 7089805 - DNA, 22 bp, Homo sapiens
actcagcttcctacagctagaa

SEQ ID NO: 7089806 - DNA, 22 bp, Homo sapiens
actcagcttcctacagctagaa

SEQ ID NO: 7089807 - DNA, 22 bp, Homo sapiens
agtaacatctttgacatttgtt

SEQ ID NO: 7089808 - DNA, 22 bp, Homo sapiens
agtaacatctttgacatttgtt

SEQ ID NO: 7089809 - DNA, 22 bp, Homo sapiens
agtaacttaagcaattgtgtat

SEQ ID NO: 7089810 - DNA, 22 bp, Homo sapiens
agtaacttaggagatacatggg

SEQ ID NO: 7089811 - DNA, 22 bp, Homo sapiens
agtaagacccagtcacttgaga

SEQ ID NO: 7089812 - DNA, 22 bp, Homo sapiens
agtaagcaatagagtgagaatt

SEQ ID NO: 7089813 - DNA, 22 bp, Homo sapiens
agtaagcaccgggatggtcaag

SEQ ID NO: 7089814 - DNA, 20 bp, Homo sapiens
agtaagcaggacttctcctc

SEQ ID NO: 7089815 - DNA, 22 bp, Homo sapiens
agtcagtgaatctgaaggctaa

SEQ ID NO: 7089816 - DNA, 22 bp, Homo sapiens
agtcaggttgcattttaagtaa

SEQ ID NO: 7089817 - DNA, 22 bp, Homo sapiens
agtcagtgaaaactagaatgtt

SEQ ID NO: 7089818 - DNA, 22 bp, Homo sapiens
agtcagtggctccgagcctggt

SEQ ID NO: 7089819 - DNA, 22 bp, Homo sapiens
agtcagtgggagaagtgtgaag

SEQ ID NO: 7089820 - DNA, 22 bp, Homo sapiens
agtcagtgggcttggcacagaa

SEQ ID NO: 7089821 - DNA, 22 bp, Homo sapiens
agtcagtggtatttaggggaat

SEQ ID NO: 7089822 - DNA, 22 bp, Homo sapiens
agtcagtgtagaaagcccaggc

SEQ ID NO: 7089823 - DNA, 22 bp, Homo sapiens
agtccagaccccggcagctggt

SEQ ID NO: 7089824 - DNA, 22 bp, Homo sapiens
agtcaggggttggacggggcca

SEQ ID NO: 7089825 - DNA, 22 bp, Homo sapiens
agtcaggggttggacggggcca

SEQ ID NO: 7089826 - DNA, 22 bp, Homo sapiens
agtcagggttgtaggctcaccc

SEQ ID NO: 7089827 - DNA, 22 bp, Homo sapiens
agtcagggttgtaggctcaccc

SEQ ID NO: 7089828 - DNA, 22 bp, Homo sapiens
agtcaggtaccacattacattg

SEQ ID NO: 7089829 - DNA, 22 bp, Homo sapiens
agtcacttggattagcaattct

SEQ ID NO: 7089830 - DNA, 22 bp, Homo sapiens
agtcacttgggaagcaaagcct

SEQ ID NO: 7089831 - DNA, 22 bp, Homo sapiens
agtcactttatgagagaaccat

SEQ ID NO: 7089832 - DNA, 22 bp, Homo sapiens
agtcactttatgagagaaccat

SEQ ID NO: 7089833 - DNA, 22 bp, Homo sapiens
agtcaggtactccgagggcatg

SEQ ID NO: 7089834 - DNA, 22 bp, Homo sapiens
agtcaggtgaatgttatacaca

SEQ ID NO: 7089835 - DNA, 22 bp, Homo sapiens
agtcaggtgggggctgcagtgg

SEQ ID NO: 7089836 - DNA, 22 bp, Homo sapiens
agtaataatagctgtaaagtgc

SEQ ID NO: 7089837 - DNA, 22 bp, Homo sapiens
agtaataatagctgtaaagtgc

SEQ ID NO: 7089838 - DNA, 22 bp, Homo sapiens
agtaataatagctgtaaagtgc

SEQ ID NO: 7089839 - DNA, 22 bp, Homo sapiens
agtcacttcgtgagcactgact

SEQ ID NO: 7089840 - DNA, 22 bp, Homo sapiens
agtcacttctattctattaagt

SEQ ID NO: 7089841 - DNA, 22 bp, Homo sapiens
agtaagttttgatagcattagg

SEQ ID NO: 7089842 - DNA, 22 bp, Homo sapiens
agtaataaactctttttatctc

SEQ ID NO: 7089843 - DNA, 22 bp, Homo sapiens
agtcctgggtgtgcaaggcaga

SEQ ID NO: 7089844 - DNA, 22 bp, Homo sapiens
agtcctgggttctggtgttttg

SEQ ID NO: 7089845 - DNA, 22 bp, Homo sapiens
agtcctggtgacactcctcttc

SEQ ID NO: 7089846 - DNA, 22 bp, Homo sapiens
agtcctggtgacactcctcttc

SEQ ID NO: 7089847 - DNA, 22 bp, Homo sapiens
agtcctggtgacactcctcttc

SEQ ID NO: 7089848 - DNA, 22 bp, Homo sapiens
agtcctggttctgattctgaca

SEQ ID NO: 7089849 - DNA, 22 bp, Homo sapiens
agtcctggttctgattctgaca

SEQ ID NO: 7089850 - DNA, 22 bp, Homo sapiens
agtcctgtaattgtgagttaac

SEQ ID NO: 7089851 - DNA, 22 bp, Homo sapiens
agtcctgtgaggggtgcagctt

SEQ ID NO: 7089852 - DNA, 22 bp, Homo sapiens
agtccttacacctggaacctat

SEQ ID NO: 7089853 - DNA, 18 bp, Homo sapiens
agtccttacgaggctata

SEQ ID NO: 7089854 - DNA, 22 bp, Homo sapiens
agtccttactcgggggcccaga

SEQ ID NO: 7089855 - DNA, 22 bp, Homo sapiens
agtccttagaacactgtatctg

SEQ ID NO: 7089856 - DNA, 22 bp, Homo sapiens
agtccttagaacagtgcctggg

SEQ ID NO: 7089857 - DNA, 22 bp, Homo sapiens
agtccttatgagatgctgcctt

SEQ ID NO: 7089858 - DNA, 22 bp, Homo sapiens
agtccttatgtggtggagagag

SEQ ID NO: 7089859 - DNA, 22 bp, Homo sapiens
agtccttcaagaaatctggaaa

SEQ ID NO: 7089860 - DNA, 22 bp, Homo sapiens
agtccttcacgtcctgcttatt

SEQ ID NO: 7089861 - DNA, 22 bp, Homo sapiens
actctgggctgttaggagctgt

SEQ ID NO: 7089862 - DNA, 22 bp, Homo sapiens
actctgggctgttaggagctgt

SEQ ID NO: 7089863 - DNA, 22 bp, Homo sapiens
actctgggcccaccctcagagt

SEQ ID NO: 7089864 - DNA, 22 bp, Homo sapiens
actctgggccccaggtggagct

SEQ ID NO: 7089865 - DNA, 22 bp, Homo sapiens
actctgggccccaggtggagct

SEQ ID NO: 7089866 - DNA, 22 bp, Homo sapiens
actctgggctttgatttgttac

SEQ ID NO: 7089867 - DNA, 22 bp, Homo sapiens
actctggggcgctactccaact

SEQ ID NO: 7089868 - DNA, 22 bp, Homo sapiens
actctggggcgctactccaact

SEQ ID NO: 7089869 - DNA, 20 bp, Homo sapiens
actctggggctcattagggg

SEQ ID NO: 7089870 - DNA, 22 bp, Homo sapiens
actctggggtgatgtctctgag

SEQ ID NO: 7089871 - DNA, 22 bp, Homo sapiens
actctggggtgatgtctctgag

SEQ ID NO: 7089872 - DNA, 22 bp, Homo sapiens
actctggggtgatgtctctgag

SEQ ID NO: 7089873 - DNA, 22 bp, Homo sapiens
actctggggtgatgtctctgag

SEQ ID NO: 7089874 - DNA, 22 bp, Homo sapiens
actctgggtcctgccattcact

SEQ ID NO: 7089875 - DNA, 22 bp, Homo sapiens
actctgggttctttcacttgac

SEQ ID NO: 7089876 - DNA, 22 bp, Homo sapiens
actctggtagacaaggagaggt

SEQ ID NO: 7089877 - DNA, 22 bp, Homo sapiens
actctggtctttctgaaagcaa

SEQ ID NO: 7089878 - DNA, 22 bp, Homo sapiens
actctggtctttctgaaagcaa

SEQ ID NO: 7089879 - DNA, 22 bp, Homo sapiens
agtcctgggtgtgcaaggcaga

SEQ ID NO: 7089880 - DNA, 22 bp, Homo sapiens
actctgctctgtatttcactgt

SEQ ID NO: 7089881 - DNA, 18 bp, Homo sapiens
actctgggacctgttatt

SEQ ID NO: 7089882 - DNA, 22 bp, Homo sapiens
actctgggagaggacaaacaaa

SEQ ID NO: 7089883 - DNA, 22 bp, Homo sapiens
actctgggatcttgaaaagagt

SEQ ID NO: 7089884 - DNA, 22 bp, Homo sapiens
actctgggatgagaaaagggtt

SEQ ID NO: 7089885 - DNA, 22 bp, Homo sapiens
actctgggattgtttctggtat

SEQ ID NO: 7089886 - DNA, 22 bp, Homo sapiens
actctgggcccaccctcagagt

SEQ ID NO: 7089887 - DNA, 22 bp, Homo sapiens
actctgctatcttagcaaaagg

SEQ ID NO: 7089888 - DNA, 22 bp, Homo sapiens
actctgctattgcagtgcaaaa

SEQ ID NO: 7089889 - DNA, 22 bp, Homo sapiens
actctgctcaaagtcctgaggc

SEQ ID NO: 7089890 - DNA, 22 bp, Homo sapiens
actctgctcaaagtcctgaggc

SEQ ID NO: 7089891 - DNA, 22 bp, Homo sapiens
actctgctccctaagccatgat

SEQ ID NO: 7089892 - DNA, 22 bp, Homo sapiens
agtccaggcctcctcttttcct

SEQ ID NO: 7089893 - DNA, 22 bp, Homo sapiens
agtccaggcattccagccattc

SEQ ID NO: 7089894 - DNA, 22 bp, Homo sapiens
agtccaggcctccctctcctgc

SEQ ID NO: 7089895 - DNA, 22 bp, Homo sapiens
agtccaggcctccctctcctgc

SEQ ID NO: 7089896 - DNA, 22 bp, Homo sapiens
agtccaggcattccagccattc

SEQ ID NO: 7089897 - DNA, 22 bp, Homo sapiens
agtccaggcattccagccattc

SEQ ID NO: 7089898 - DNA, 22 bp, Homo sapiens
agtccaggagttgggtgacatt

SEQ ID NO: 7089899 - DNA, 21 bp, Homo sapiens
agtccaggaggaggccaggtt

SEQ ID NO: 7089900 - DNA, 21 bp, Homo sapiens
agtccaggagtcacccaagcc

SEQ ID NO: 7089901 - DNA, 22 bp, Homo sapiens
agtccaggaaaataagctaggt

SEQ ID NO: 7089902 - DNA, 22 bp, Homo sapiens
agtccaggaaaataagctaggt

SEQ ID NO: 7089903 - DNA, 22 bp, Homo sapiens
agtccagatcatgcagcaaacc

SEQ ID NO: 7089904 - DNA, 22 bp, Homo sapiens
agtccagagaggaggctgtgtg

SEQ ID NO: 7089905 - DNA, 22 bp, Homo sapiens
agtccagagaggaggctgtgtg

SEQ ID NO: 7089906 - DNA, 22 bp, Homo sapiens
agtccagaccccggcagctggt

SEQ ID NO: 7089907 - DNA, 22 bp, Homo sapiens
agtcagtgtagaaagcccaggc

SEQ ID NO: 7089908 - DNA, 22 bp, Homo sapiens
agtccagaccccggcagctggt

SEQ ID NO: 7089909 - DNA, 22 bp, Homo sapiens
agggtgcatgtttgcaagagtg

SEQ ID NO: 7089910 - DNA, 22 bp, Homo sapiens
agggtgcccaccgcttctgccc

SEQ ID NO: 7089911 - DNA, 22 bp, Homo sapiens
agggtgccctggagccagttcc

SEQ ID NO: 7089912 - DNA, 22 bp, Homo sapiens
aggtgaggataggtggccaagg

SEQ ID NO: 7089913 - DNA, 22 bp, Homo sapiens
aggtgaggataggtggccaagg

SEQ ID NO: 7089914 - DNA, 22 bp, Homo sapiens
aggtgaggataggtggccaagg

SEQ ID NO: 7089915 - DNA, 19 bp, Homo sapiens
aggtgaggggcaccatgtc

SEQ ID NO: 7089916 - DNA, 22 bp, Homo sapiens
aggtgaggataggtggccaagg

SEQ ID NO: 7089917 - DNA, 22 bp, Homo sapiens
aggtgaggataggtggccaagg

SEQ ID NO: 7089918 - DNA, 19 bp, Homo sapiens
aggtgaggggcaccatgtc

SEQ ID NO: 7089919 - DNA, 22 bp, Homo sapiens
aggtgcaggagctgtgcaggga

SEQ ID NO: 7089920 - DNA, 22 bp, Homo sapiens
aggtgcaggagctgtgcaggga

SEQ ID NO: 7089921 - DNA, 22 bp, Homo sapiens
aggtgcaggagctgtgcaggga

SEQ ID NO: 7089922 - DNA, 21 bp, Homo sapiens
aggtgcaggcctcaagcccca

SEQ ID NO: 7089923 - DNA, 21 bp, Homo sapiens
aggtgcaggcctcaagcccca

SEQ ID NO: 7089924 - DNA, 19 bp, Homo sapiens
aggtgcaggtcacagggga

SEQ ID NO: 7089925 - DNA, 19 bp, Homo sapiens
aggtgcaggtcacagggga

SEQ ID NO: 7089926 - DNA, 22 bp, Homo sapiens
aggtgcagtgaaggaaaaggaa

SEQ ID NO: 7089927 - DNA, 22 bp, Homo sapiens
aggtgcagtgaaggaaaaggaa

SEQ ID NO: 7089928 - DNA, 21 bp, Homo sapiens
aggtgcaggcctcaagcccca

SEQ ID NO: 7089929 - DNA, 19 bp, Homo sapiens
aggtgcaggtcacagggga

SEQ ID NO: 7089930 - DNA, 19 bp, Homo sapiens
aggtgcaggtcacagggga

SEQ ID NO: 7089931 - DNA, 19 bp, Homo sapiens
aggtgcaggtcacagggga

SEQ ID NO: 7089932 - DNA, 22 bp, Homo sapiens
aggtgcagtgtttaaaagtagc

SEQ ID NO: 7089933 - DNA, 22 bp, Homo sapiens
aggtgcagtggctcatgcctgt

SEQ ID NO: 7089934 - DNA, 22 bp, Homo sapiens
aggtgcagtggctcatgcctgt

SEQ ID NO: 7089935 - DNA, 22 bp, Homo sapiens
aggtgcatctcgtagctcttct

SEQ ID NO: 7089936 - DNA, 22 bp, Homo sapiens
aggtgcatgatgcagagtgcag

SEQ ID NO: 7089937 - DNA, 22 bp, Homo sapiens
aggtgcatgatgcagagtgcag

SEQ ID NO: 7089938 - DNA, 23 bp, Homo sapiens
aggtgccaactgagagctgagag

SEQ ID NO: 7089939 - DNA, 23 bp, Homo sapiens
aggtgccaactgagagctgagag

SEQ ID NO: 7089940 - DNA, 22 bp, Homo sapiens
aggtgccaagatgtcacagaca

SEQ ID NO: 7089941 - DNA, 21 bp, Homo sapiens
aggtgccaaggagaagcaggc

SEQ ID NO: 7089942 - DNA, 21 bp, Homo sapiens
aggtgccaaggagaagcaggc

SEQ ID NO: 7089943 - DNA, 22 bp, Homo sapiens
aggtgccacctctggtgctgtc

SEQ ID NO: 7089944 - DNA, 22 bp, Homo sapiens
aggtgccacctctggtgctgtc

SEQ ID NO: 7089945 - DNA, 22 bp, Homo sapiens
aggtgccactctcatgggctac

SEQ ID NO: 7089946 - DNA, 22 bp, Homo sapiens
aggtgccactctcatgggctac

SEQ ID NO: 7089947 - DNA, 22 bp, Homo sapiens
aggtgccagatgcacagctgaa

SEQ ID NO: 7089948 - DNA, 22 bp, Homo sapiens
aggtgccagatgcacagctgaa

SEQ ID NO: 7089949 - DNA, 22 bp, Homo sapiens
aggtgccagctctcaggcagga

SEQ ID NO: 7089950 - DNA, 22 bp, Homo sapiens
aggtggaaatggctttcctagg

SEQ ID NO: 7089951 - DNA, 22 bp, Homo sapiens
aggtggaaatggctttcctagg

SEQ ID NO: 7089952 - DNA, 22 bp, Homo sapiens
agggtgcagggacaggtgtgca

SEQ ID NO: 7089953 - DNA, 22 bp, Homo sapiens
agggtgcagggacaggtgtgca

SEQ ID NO: 7089954 - DNA, 22 bp, Homo sapiens
agggtgcaggggaagctgccct

SEQ ID NO: 7089955 - DNA, 22 bp, Homo sapiens
agggtgcaggtgtggagtctag

SEQ ID NO: 7089956 - DNA, 22 bp, Homo sapiens
agggtgcaggggaagctgccct

SEQ ID NO: 7089957 - DNA, 22 bp, Homo sapiens
agggtgcagaaggagcctagga

SEQ ID NO: 7089958 - DNA, 22 bp, Homo sapiens
agggtgagggtctggccttgag

SEQ ID NO: 7089959 - DNA, 22 bp, Homo sapiens
agggtgcaaaagcaaggacagt

SEQ ID NO: 7089960 - DNA, 23 bp, Homo sapiens
agggtgagcaagctatggagacc

SEQ ID NO: 7089961 - DNA, 23 bp, Homo sapiens
agggtgagcaagctatggagacc

SEQ ID NO: 7089962 - DNA, 22 bp, Homo sapiens
agggtcctaagcctcagataag

SEQ ID NO: 7089963 - DNA, 21 bp, Homo sapiens
agggtcctacagggctcagga

SEQ ID NO: 7089964 - DNA, 21 bp, Homo sapiens
agggtcctacagggctcagga

SEQ ID NO: 7089965 - DNA, 21 bp, Homo sapiens
agggtcctacagggctcagga

SEQ ID NO: 7089966 - DNA, 21 bp, Homo sapiens
agggtcctacagggctcagga

SEQ ID NO: 7089967 - DNA, 22 bp, Homo sapiens
agggtcccgaaggagacagcaa

SEQ ID NO: 7089968 - DNA, 22 bp, Homo sapiens
agggtcccgtccctctgcaccc

SEQ ID NO: 7089969 - DNA, 22 bp, Homo sapiens
agggtccagtaacagatgccag

SEQ ID NO: 7089970 - DNA, 23 bp, Homo sapiens
agggtccagggatcaccaggtgt

SEQ ID NO: 7089971 - DNA, 19 bp, Homo sapiens
agggtccagggagcggctc

SEQ ID NO: 7089972 - DNA, 23 bp, Homo sapiens
agggtccagggatcaccaggtgt

SEQ ID NO: 7089973 - DNA, 18 bp, Homo sapiens
agggtcagtgtcactggc

SEQ ID NO: 7089974 - DNA, 18 bp, Homo sapiens
agggtcagtgtcactggc

SEQ ID NO: 7089975 - DNA, 22 bp, Homo sapiens
agggtcagtgatgagggagccc

SEQ ID NO: 7089976 - DNA, 22 bp, Homo sapiens
agggtcagtgatgagggagccc

SEQ ID NO: 7089977 - DNA, 22 bp, Homo sapiens
agggtcagttctgtgaggtgtt

SEQ ID NO: 7089978 - DNA, 22 bp, Homo sapiens
agggtcagttctgtgaggtgtt

SEQ ID NO: 7089979 - DNA, 22 bp, Homo sapiens
agggtcagttctgtgaggtgtt

SEQ ID NO: 7089980 - DNA, 22 bp, Homo sapiens
agggtcagttctgtgaggtgtt

SEQ ID NO: 7089981 - DNA, 22 bp, Homo sapiens
agggtccacttggacattgatc

SEQ ID NO: 7089982 - DNA, 19 bp, Homo sapiens
agggtccaggccctgtgga

SEQ ID NO: 7089983 - DNA, 22 bp, Homo sapiens
actcacatttcatcaggccaag

SEQ ID NO: 7089984 - DNA, 22 bp, Homo sapiens
aggttcttggtgtccagatttc

SEQ ID NO: 7089985 - DNA, 22 bp, Homo sapiens
actcacagtccctgtaggagtg

SEQ ID NO: 7089986 - DNA, 23 bp, Homo sapiens
aggttctcttatcatctctgccc

SEQ ID NO: 7089987 - DNA, 22 bp, Homo sapiens
aggttctccttatcaatgaaga

SEQ ID NO: 7089988 - DNA, 22 bp, Homo sapiens
aggttccttatggggatggcta

SEQ ID NO: 7089989 - DNA, 20 bp, Homo sapiens
aggttcctttgtggagaatt

SEQ ID NO: 7089990 - DNA, 21 bp, Homo sapiens
aggttcctgagtcatgcctta

SEQ ID NO: 7089991 - DNA, 22 bp, Homo sapiens
aggttcctcttcctctggcctg

SEQ ID NO: 7089992 - DNA, 22 bp, Homo sapiens
aggtggtgatgacagaagacag

SEQ ID NO: 7089993 - DNA, 22 bp, Homo sapiens
aggtgtccaatcctggttggat

SEQ ID NO: 7089994 - DNA, 22 bp, Homo sapiens
aggtgtccaggaagatgctggc

SEQ ID NO: 7089995 - DNA, 20 bp, Homo sapiens
aggtgtcctgtagcttgagt

SEQ ID NO: 7089996 - DNA, 22 bp, Homo sapiens
aggtgtctggacttgtgaagca

SEQ ID NO: 7089997 - DNA, 22 bp, Homo sapiens
aggtggagacccagagaaggcg

SEQ ID NO: 7089998 - DNA, 22 bp, Homo sapiens
aggtggagacccagagaaggcg

SEQ ID NO: 7089999 - DNA, 22 bp, Homo sapiens
aggtggagacccagagaaggcg

SEQ ID NO: 7090000 - DNA, 22 bp, Homo sapiens
aggtggagacccagagaaggcg

SEQ ID NO: 7090001 - DNA, 22 bp, Homo sapiens
aggtggagacccagagaaggcg

SEQ ID NO: 7090002 - DNA, 22 bp, Homo sapiens
aggtggagacccagagaaggcg

SEQ ID NO: 7090003 - DNA, 22 bp, Homo sapiens
aggtggagacccagagaaggcg

SEQ ID NO: 7090004 - DNA, 22 bp, Homo sapiens
aggtggagacccagagaaggcg

SEQ ID NO: 7090005 - DNA, 16 bp, Homo sapiens
aggtggagaagttcac

SEQ ID NO: 7090006 - DNA, 22 bp, Homo sapiens
aggtggagaagagatgggcagt

SEQ ID NO: 7090007 - DNA, 22 bp, Homo sapiens
aggtggagaagagatgggcagt

SEQ ID NO: 7090008 - DNA, 16 bp, Homo sapiens
aggtggagaagttcac

SEQ ID NO: 7090009 - DNA, 16 bp, Homo sapiens
aggtggagaagttcac

SEQ ID NO: 7090010 - DNA, 22 bp, Homo sapiens
aggtggagaagagatgggcagt

SEQ ID NO: 7090011 - DNA, 22 bp, Homo sapiens
aggtggagaagagatgggcagt

SEQ ID NO: 7090012 - DNA, 22 bp, Homo sapiens
aggtggagaagagatgggcagt

SEQ ID NO: 7090013 - DNA, 22 bp, Homo sapiens
aggtggaaatggctttcctagg

SEQ ID NO: 7090014 - DNA, 22 bp, Homo sapiens
aggtggagaagagatgggcagt

SEQ ID NO: 7090015 - DNA, 22 bp, Homo sapiens
aggtggagaagagatgggcagt

SEQ ID NO: 7090016 - DNA, 22 bp, Homo sapiens
aggtggagaagagatgggcagt

SEQ ID NO: 7090017 - DNA, 22 bp, Homo sapiens
aggtggagaagagatgggcagt

SEQ ID NO: 7090018 - DNA, 22 bp, Homo sapiens
aggtggagaagagatgggcagt

SEQ ID NO: 7090019 - DNA, 22 bp, Homo sapiens
aggtggggaggagtgtctcttt

SEQ ID NO: 7090020 - DNA, 22 bp, Homo sapiens
aggtggggaaaccagcgatccc

SEQ ID NO: 7090021 - DNA, 22 bp, Homo sapiens
aggtggggaaaccagcgatccc

SEQ ID NO: 7090022 - DNA, 22 bp, Homo sapiens
aggtggggttcagtctcagccg

SEQ ID NO: 7090023 - DNA, 19 bp, Homo sapiens
aggtgggtaagcagttctc

SEQ ID NO: 7090024 - DNA, 22 bp, Homo sapiens
aggtggggaggagtgtctcttt

SEQ ID NO: 7090025 - DNA, 22 bp, Homo sapiens
aggtggggttcagtctcagccg

SEQ ID NO: 7090026 - DNA, 22 bp, Homo sapiens
aggtgggtatcatgagagatta

SEQ ID NO: 7090027 - DNA, 22 bp, Homo sapiens
aggtgggtatcatgagagatta

SEQ ID NO: 7090028 - DNA, 22 bp, Homo sapiens
aggtgggtcctggctctgccat

SEQ ID NO: 7090029 - DNA, 22 bp, Homo sapiens
aggtgggtgccgtctgtcctct

SEQ ID NO: 7090030 - DNA, 22 bp, Homo sapiens
aggtgggtgccgtctgtcctct

SEQ ID NO: 7090031 - DNA, 22 bp, Homo sapiens
aggtgggttcccgactctggct

SEQ ID NO: 7090032 - DNA, 17 bp, Homo sapiens
aggtgggtggatcacct

SEQ ID NO: 7090033 - DNA, 22 bp, Homo sapiens
aggtgggttccgcggcggcccg

SEQ ID NO: 7090034 - DNA, 19 bp, Homo sapiens
aggtggtctaggctggaga

SEQ ID NO: 7090035 - DNA, 21 bp, Homo sapiens
aggtggtctgcagcagctgaa

SEQ ID NO: 7090036 - DNA, 21 bp, Homo sapiens
aggtggtctgcagcagctgaa

SEQ ID NO: 7090037 - DNA, 22 bp, Homo sapiens
aggtggtcttaaactgctctgg

SEQ ID NO: 7090038 - DNA, 22 bp, Homo sapiens
aggtggtcttggcccacccagg

SEQ ID NO: 7090039 - DNA, 23 bp, Homo sapiens
aggtggtcttgtggatgctgcaa

SEQ ID NO: 7090040 - DNA, 23 bp, Homo sapiens
cactgggggctgctacagagagg

SEQ ID NO: 7090041 - DNA, 23 bp, Homo sapiens
cactgggggctgctacagagagg

SEQ ID NO: 7090042 - DNA, 22 bp, Homo sapiens
cactggggaaaacaggcttctt

SEQ ID NO: 7090043 - DNA, 22 bp, Homo sapiens
cactggggtgggcctggtagag

SEQ ID NO: 7090044 - DNA, 22 bp, Homo sapiens
cactggggtgggcctggtagag

SEQ ID NO: 7090045 - DNA, 22 bp, Homo sapiens
cactggtctttggctaggtgtg

SEQ ID NO: 7090046 - DNA, 19 bp, Homo sapiens
cactggtcttctatttagg

SEQ ID NO: 7090047 - DNA, 19 bp, Homo sapiens
cactggtcttctatttagg

SEQ ID NO: 7090048 - DNA, 22 bp, Homo sapiens
cactggtgaaagtttaattgtt

SEQ ID NO: 7090049 - DNA, 22 bp, Homo sapiens
cactttgatttgtgatgtgaga

SEQ ID NO: 7090050 - DNA, 20 bp, Homo sapiens
cactttggacctgatgtatc

SEQ ID NO: 7090051 - DNA, 20 bp, Homo sapiens
cactttggacctgatgtatc

SEQ ID NO: 7090052 - DNA, 22 bp, Homo sapiens
cactggtcagcatggtagacca

SEQ ID NO: 7090053 - DNA, 22 bp, Homo sapiens
cactggtcagagaaaaacgtta

SEQ ID NO: 7090054 - DNA, 22 bp, Homo sapiens
cactggtcagtcggtcagtctc

SEQ ID NO: 7090055 - DNA, 22 bp, Homo sapiens
cactggtcagcatggtagacca

SEQ ID NO: 7090056 - DNA, 22 bp, Homo sapiens
cactggtcagtgaaacagtatt

SEQ ID NO: 7090057 - DNA, 22 bp, Homo sapiens
cactgggctgataccaggcttc

SEQ ID NO: 7090058 - DNA, 20 bp, Homo sapiens
cactgggctggagtcagggc

SEQ ID NO: 7090059 - DNA, 22 bp, Homo sapiens
cactgggcgtgtcctgggtgag

SEQ ID NO: 7090060 - DNA, 22 bp, Homo sapiens
cactgggcgccagctgctgagc

SEQ ID NO: 7090061 - DNA, 22 bp, Homo sapiens
agcattttctgagagtatagat

SEQ ID NO: 7090062 - DNA, 22 bp, Homo sapiens
agcattttctgagagtatagat

SEQ ID NO: 7090063 - DNA, 22 bp, Homo sapiens
agccaaaacatgtgagttttga

SEQ ID NO: 7090064 - DNA, 22 bp, Homo sapiens
agccaaagagaccccatatcca

SEQ ID NO: 7090065 - DNA, 20 bp, Homo sapiens
agcattttatggtaggaaac

SEQ ID NO: 7090066 - DNA, 22 bp, Homo sapiens
agcattttctgagagtatagat

SEQ ID NO: 7090067 - DNA, 22 bp, Homo sapiens
cagaaactatgtaagaaagtga

SEQ ID NO: 7090068 - DNA, 22 bp, Homo sapiens
cagaaactatgtaagaaagtga

SEQ ID NO: 7090069 - DNA, 22 bp, Homo sapiens
cagaaacctgtctggagtggga

SEQ ID NO: 7090070 - DNA, 22 bp, Homo sapiens
cagaaaccaaatgggatgggga

SEQ ID NO: 7090071 - DNA, 22 bp, Homo sapiens
cagaaacctccctgaatatttt

SEQ ID NO: 7090072 - DNA, 22 bp, Homo sapiens
cagaaacatgtataaagttgta

SEQ ID NO: 7090073 - DNA, 22 bp, Homo sapiens
cagaaactgtttgttaatattt

SEQ ID NO: 7090074 - DNA, 22 bp, Homo sapiens
cagaaacttctggtgtcaaata

SEQ ID NO: 7090075 - DNA, 22 bp, Homo sapiens
cagaaacttttgatgagtgtat

SEQ ID NO: 7090076 - DNA, 20 bp, Homo sapiens
cagaaagaaggtagattttt

SEQ ID NO: 7090077 - DNA, 20 bp, Homo sapiens
cagaaagaaggtagattttt

SEQ ID NO: 7090078 - DNA, 20 bp, Homo sapiens
cagaaagaaggtagattttt

SEQ ID NO: 7090079 - DNA, 22 bp, Homo sapiens
cagaaagacctgattggcagtt

SEQ ID NO: 7090080 - DNA, 22 bp, Homo sapiens
cagaaagacctgattggcagtt

SEQ ID NO: 7090081 - DNA, 22 bp, Homo sapiens
cagaaagacctgggctcaagag

SEQ ID NO: 7090082 - DNA, 22 bp, Homo sapiens
cagaaagacctgggctcaagag

SEQ ID NO: 7090083 - DNA, 22 bp, Homo sapiens
cagaaagacctgggctcaagag

SEQ ID NO: 7090084 - DNA, 22 bp, Homo sapiens
cagaaagacctgggctcaagag

SEQ ID NO: 7090085 - DNA, 20 bp, Homo sapiens
agccaaaggagaacagtgct

SEQ ID NO: 7090086 - DNA, 22 bp, Homo sapiens
agccaaagtccaaatgcagtgt

SEQ ID NO: 7090087 - DNA, 22 bp, Homo sapiens
agccaacacatgtaaatgcacc

SEQ ID NO: 7090088 - DNA, 22 bp, Homo sapiens
agccaacacatgtaaatgcacc

SEQ ID NO: 7090089 - DNA, 22 bp, Homo sapiens
cactgcactccatcctgggaaa

SEQ ID NO: 7090090 - DNA, 22 bp, Homo sapiens
cactgcactccatcctgggaaa

SEQ ID NO: 7090091 - DNA, 22 bp, Homo sapiens
cactgcactccatcctgggaaa

SEQ ID NO: 7090092 - DNA, 22 bp, Homo sapiens
cactgcactccatcctgggaaa

SEQ ID NO: 7090093 - DNA, 22 bp, Homo sapiens
cactgcactccatcctgggaaa

SEQ ID NO: 7090094 - DNA, 22 bp, Homo sapiens
cactgcactccatcctgggaaa

SEQ ID NO: 7090095 - DNA, 22 bp, Homo sapiens
cactgcactccagcccgggcaa

SEQ ID NO: 7090096 - DNA, 22 bp, Homo sapiens
cactgcactccagcccgggcaa

SEQ ID NO: 7090097 - DNA, 22 bp, Homo sapiens
cactgcactccagcccgggcaa

SEQ ID NO: 7090098 - DNA, 22 bp, Homo sapiens
cactgcactccagcccgggcaa

SEQ ID NO: 7090099 - DNA, 22 bp, Homo sapiens
cactgcactccagcccgggcaa

SEQ ID NO: 7090100 - DNA, 22 bp, Homo sapiens
cactgcactccagcccgggcaa

SEQ ID NO: 7090101 - DNA, 22 bp, Homo sapiens
cactgcactccagcccgggcaa

SEQ ID NO: 7090102 - DNA, 22 bp, Homo sapiens
cactgcactccagcccgggcaa

SEQ ID NO: 7090103 - DNA, 22 bp, Homo sapiens
cactgcactccagcccgggcaa

SEQ ID NO: 7090104 - DNA, 22 bp, Homo sapiens
cactgcactccagcccgggcaa

SEQ ID NO: 7090105 - DNA, 22 bp, Homo sapiens
cactgcactccagcactccagc

SEQ ID NO: 7090106 - DNA, 22 bp, Homo sapiens
cactgcactccagcactccagc

SEQ ID NO: 7090107 - DNA, 22 bp, Homo sapiens
cactgcactccagcccgggcaa

SEQ ID NO: 7090108 - DNA, 22 bp, Homo sapiens
cactgcactccagcccgggcaa

SEQ ID NO: 7090109 - DNA, 22 bp, Homo sapiens
cactgcactccagcccgggcaa

SEQ ID NO: 7090110 - DNA, 22 bp, Homo sapiens
cactgcacaggtgagatgtggg

SEQ ID NO: 7090111 - DNA, 22 bp, Homo sapiens
cactgcacaggtgagatgtggg

SEQ ID NO: 7090112 - DNA, 22 bp, Homo sapiens
cactgcaccctcaaactcctgg

SEQ ID NO: 7090113 - DNA, 22 bp, Homo sapiens
cactgcaacctccacctcctgg

SEQ ID NO: 7090114 - DNA, 22 bp, Homo sapiens
cactgcacttcagcctgggtga

SEQ ID NO: 7090115 - DNA, 22 bp, Homo sapiens
cactgcacttcagcctgggtga

SEQ ID NO: 7090116 - DNA, 22 bp, Homo sapiens
cactgcacttcagcctgggcga

SEQ ID NO: 7090117 - DNA, 22 bp, Homo sapiens
cactgcacttcagcctgggtga

SEQ ID NO: 7090118 - DNA, 22 bp, Homo sapiens
cactgcacttcagcctgggtga

SEQ ID NO: 7090119 - DNA, 22 bp, Homo sapiens
cactgcacttcagcctgggtga

SEQ ID NO: 7090120 - DNA, 22 bp, Homo sapiens
cactgcactccatcctgggaaa

SEQ ID NO: 7090121 - DNA, 22 bp, Homo sapiens
cactgcactccatcctgggaaa

SEQ ID NO: 7090122 - DNA, 22 bp, Homo sapiens
cactgcacttcagcctgggcaa

SEQ ID NO: 7090123 - DNA, 22 bp, Homo sapiens
cactgcacttcagcctgggtga

SEQ ID NO: 7090124 - DNA, 22 bp, Homo sapiens
cactgcacttcagcctgggtga

SEQ ID NO: 7090125 - DNA, 22 bp, Homo sapiens
cactgcacttcagcctgggtga

SEQ ID NO: 7090126 - DNA, 22 bp, Homo sapiens
cactgcacttcagcctgggtga

SEQ ID NO: 7090127 - DNA, 22 bp, Homo sapiens
agcattaggtgtgtttcagagg

SEQ ID NO: 7090128 - DNA, 22 bp, Homo sapiens
agcatttaggagaatttgagaa

SEQ ID NO: 7090129 - DNA, 22 bp, Homo sapiens
agcatttagtctttattgcagc

SEQ ID NO: 7090130 - DNA, 22 bp, Homo sapiens
agcatttatttcttagaaattg

SEQ ID NO: 7090131 - DNA, 22 bp, Homo sapiens
agcatttccgccctcttctgcc

SEQ ID NO: 7090132 - DNA, 22 bp, Homo sapiens
agcatttcttggcccattgtag

SEQ ID NO: 7090133 - DNA, 17 bp, Homo sapiens
cacatgtctacatggat

SEQ ID NO: 7090134 - DNA, 22 bp, Homo sapiens
cacatgtcctgggaaaataact

SEQ ID NO: 7090135 - DNA, 17 bp, Homo sapiens
cacatgtctacatggat

SEQ ID NO: 7090136 - DNA, 21 bp, Homo sapiens
cacatgtgaattactgaactg

SEQ ID NO: 7090137 - DNA, 22 bp, Homo sapiens
cacatgtcctggcgctgagccc

SEQ ID NO: 7090138 - DNA, 22 bp, Homo sapiens
cacatgtcctggcgctgagccc

SEQ ID NO: 7090139 - DNA, 22 bp, Homo sapiens
cacatgtcctgggaaaataact

SEQ ID NO: 7090140 - DNA, 22 bp, Homo sapiens
cacatgtacagaagcaggctgg

SEQ ID NO: 7090141 - DNA, 22 bp, Homo sapiens
cacatgtacagaagcaggctgg

SEQ ID NO: 7090142 - DNA, 22 bp, Homo sapiens
cacatggcagaatcatgcatct

SEQ ID NO: 7090143 - DNA, 22 bp, Homo sapiens
cacatggcctgtgtggccagac

SEQ ID NO: 7090144 - DNA, 22 bp, Homo sapiens
cacatggcctgtgtggccagac

SEQ ID NO: 7090145 - DNA, 22 bp, Homo sapiens
cacatgggcacagagaacttgg

SEQ ID NO: 7090146 - DNA, 22 bp, Homo sapiens
cacatgggcgtaatgtccatgg

SEQ ID NO: 7090147 - DNA, 22 bp, Homo sapiens
cacatgggcttagcaggcaggg

SEQ ID NO: 7090148 - DNA, 22 bp, Homo sapiens
cacatggaagagatacagtgag

SEQ ID NO: 7090149 - DNA, 22 bp, Homo sapiens
cacatgcttcttttgattatga

SEQ ID NO: 7090150 - DNA, 22 bp, Homo sapiens
cacatgcttagatttcagtgga

SEQ ID NO: 7090151 - DNA, 22 bp, Homo sapiens
cacatgcttcttttgattatga

SEQ ID NO: 7090152 - DNA, 22 bp, Homo sapiens
cacatgcttcttttgattatga

SEQ ID NO: 7090153 - DNA, 22 bp, Homo sapiens
cacatgaagagagtctagtaat

SEQ ID NO: 7090154 - DNA, 22 bp, Homo sapiens
cacatgaagagagtctagtaat

SEQ ID NO: 7090155 - DNA, 23 bp, Homo sapiens
cacatggattaaatgagaccaca

SEQ ID NO: 7090156 - DNA, 23 bp, Homo sapiens
cacatggattaaatgagaccaca

SEQ ID NO: 7090157 - DNA, 22 bp, Homo sapiens
cacatggcagaatcatgcatct

SEQ ID NO: 7090158 - DNA, 22 bp, Homo sapiens
cacatggcagaatcatgcatct

SEQ ID NO: 7090159 - DNA, 22 bp, Homo sapiens
cacaggctgcccgcagctggga

SEQ ID NO: 7090160 - DNA, 22 bp, Homo sapiens
cacaggctgcccgcagctggga

SEQ ID NO: 7090161 - DNA, 22 bp, Homo sapiens
cacaggctctccagggcctgga

SEQ ID NO: 7090162 - DNA, 22 bp, Homo sapiens
cacaggctctccagggcctgga

SEQ ID NO: 7090163 - DNA, 22 bp, Homo sapiens
cacaggctccggccttgcagcc

SEQ ID NO: 7090164 - DNA, 22 bp, Homo sapiens
cacaggctctccagggcctgga

SEQ ID NO: 7090165 - DNA, 18 bp, Homo sapiens
cacaggctcccagtgagg

SEQ ID NO: 7090166 - DNA, 22 bp, Homo sapiens
cacaggctccggccttgcagcc

SEQ ID NO: 7090167 - DNA, 18 bp, Homo sapiens
cacaggctcccagtgagg

SEQ ID NO: 7090168 - DNA, 22 bp, Homo sapiens
cacaggctccggccttgcagcc

SEQ ID NO: 7090169 - DNA, 22 bp, Homo sapiens
cacaggctccggccttgcagcc

SEQ ID NO: 7090170 - DNA, 18 bp, Homo sapiens
cacaggctcccagtgagg

SEQ ID NO: 7090171 - DNA, 18 bp, Homo sapiens
cacaggctcccagtgagg

SEQ ID NO: 7090172 - DNA, 18 bp, Homo sapiens
cacaggctcccagtgagg

SEQ ID NO: 7090173 - DNA, 18 bp, Homo sapiens
cacaggctcccagtgagg

SEQ ID NO: 7090174 - DNA, 20 bp, Homo sapiens
cacaggctatatgagagcca

SEQ ID NO: 7090175 - DNA, 20 bp, Homo sapiens
cacaggctatatgagagcca

SEQ ID NO: 7090176 - DNA, 20 bp, Homo sapiens
cacaggctatatgagagcca

SEQ ID NO: 7090177 - DNA, 19 bp, Homo sapiens
agcaggctaggctgcctct

SEQ ID NO: 7090178 - DNA, 19 bp, Homo sapiens
agcaggctaggctgcctct

SEQ ID NO: 7090179 - DNA, 22 bp, Homo sapiens
agcaggctccaggctggccatc

SEQ ID NO: 7090180 - DNA, 22 bp, Homo sapiens
agcaggctaggaacctcactgc

SEQ ID NO: 7090181 - DNA, 22 bp, Homo sapiens
agcaggctaggaacctcactgc

SEQ ID NO: 7090182 - DNA, 22 bp, Homo sapiens
agcaggctaggaacctcactgc

SEQ ID NO: 7090183 - DNA, 19 bp, Homo sapiens
agcaggctaggctgcctct

SEQ ID NO: 7090184 - DNA, 19 bp, Homo sapiens
agcaggctaggctgcctct

SEQ ID NO: 7090185 - DNA, 22 bp, Homo sapiens
agcaggccactgcagctggagc

SEQ ID NO: 7090186 - DNA, 19 bp, Homo sapiens
agcaggccaggcaggtggc

SEQ ID NO: 7090187 - DNA, 19 bp, Homo sapiens
agcaggccaggcaggtggc

SEQ ID NO: 7090188 - DNA, 19 bp, Homo sapiens
agcaggccaggcaggtggc

SEQ ID NO: 7090189 - DNA, 19 bp, Homo sapiens
agcaggccaggcaggtggc

SEQ ID NO: 7090190 - DNA, 22 bp, Homo sapiens
agcaggcccaagctggggggaa

SEQ ID NO: 7090191 - DNA, 22 bp, Homo sapiens
agcaggcccaagctggggggaa

SEQ ID NO: 7090192 - DNA, 22 bp, Homo sapiens
agcaggcccaagctggggggaa

SEQ ID NO: 7090193 - DNA, 21 bp, Homo sapiens
agcaggcccaatggagggggc

SEQ ID NO: 7090194 - DNA, 21 bp, Homo sapiens
agcaggcccaatggagggggc

SEQ ID NO: 7090195 - DNA, 21 bp, Homo sapiens
agcaggcccaatggagggggc

SEQ ID NO: 7090196 - DNA, 22 bp, Homo sapiens
agcaggcccagggcttctcagc

SEQ ID NO: 7090197 - DNA, 21 bp, Homo sapiens
agcaggcccaatggagggggc

SEQ ID NO: 7090198 - DNA, 22 bp, Homo sapiens
agcaggcccagggcttctcagc

SEQ ID NO: 7090199 - DNA, 22 bp, Homo sapiens
agcaggcctcatgcaccagcta

SEQ ID NO: 7090200 - DNA, 22 bp, Homo sapiens
agcaggcctcatgcaccagcta

SEQ ID NO: 7090201 - DNA, 22 bp, Homo sapiens
agcaggcctcatgcaccagcta

SEQ ID NO: 7090202 - DNA, 22 bp, Homo sapiens
agcaggcctcatgcaccagcta

SEQ ID NO: 7090203 - DNA, 22 bp, Homo sapiens
agcaggcctgccacctcggggt

SEQ ID NO: 7090204 - DNA, 22 bp, Homo sapiens
agcaggcctgccacctcggggt

SEQ ID NO: 7090205 - DNA, 20 bp, Homo sapiens
agcaggccttggggagagga

SEQ ID NO: 7090206 - DNA, 20 bp, Homo sapiens
agcaggccttggggagagga

SEQ ID NO: 7090207 - DNA, 20 bp, Homo sapiens
agcaggccttggggagagga

SEQ ID NO: 7090208 - DNA, 18 bp, Homo sapiens
agcaggcgttgcctggga

SEQ ID NO: 7090209 - DNA, 22 bp, Homo sapiens
agcaggctaatcttgctgaaca

SEQ ID NO: 7090210 - DNA, 22 bp, Homo sapiens
agcaggctaatcttgctgaaca

SEQ ID NO: 7090211 - DNA, 22 bp, Homo sapiens
agcaggctactcctgtgttcgt

SEQ ID NO: 7090212 - DNA, 22 bp, Homo sapiens
cacctgccaaatggggatgctg

SEQ ID NO: 7090213 - DNA, 22 bp, Homo sapiens
cacatttaagtgcttgttcaga

SEQ ID NO: 7090214 - DNA, 22 bp, Homo sapiens
cacgggagacgtgatcttggac

SEQ ID NO: 7090215 - DNA, 22 bp, Homo sapiens
cacggtcacccatcagagtcca

SEQ ID NO: 7090216 - DNA, 22 bp, Homo sapiens
cacggtggcccacaggtgcaag

SEQ ID NO: 7090217 - DNA, 22 bp, Homo sapiens
cacgtccacccaggctgcccag

SEQ ID NO: 7090218 - DNA, 22 bp, Homo sapiens
cacgtgcaggtcttaggagaca

SEQ ID NO: 7090219 - DNA, 22 bp, Homo sapiens
cacgtgttccaggcatggttct

SEQ ID NO: 7090220 - DNA, 22 bp, Homo sapiens
cacgttttatgacagaagaagc

SEQ ID NO: 7090221 - DNA, 22 bp, Homo sapiens
cactaaatgtttcaatgtggga

SEQ ID NO: 7090222 - DNA, 22 bp, Homo sapiens
cacattgaaatgacccaataat

SEQ ID NO: 7090223 - DNA, 21 bp, Homo sapiens
cacattgaatacagagatgga

SEQ ID NO: 7090224 - DNA, 22 bp, Homo sapiens
cacattgataattaaggcctcc

SEQ ID NO: 7090225 - DNA, 22 bp, Homo sapiens
cacattgataattaaggcctcc

SEQ ID NO: 7090226 - DNA, 22 bp, Homo sapiens
cacattgattcagtcctgtgtg

SEQ ID NO: 7090227 - DNA, 22 bp, Homo sapiens
cacattgctcatggctggatgc

SEQ ID NO: 7090228 - DNA, 22 bp, Homo sapiens
cacattgtaggtctcagctctt

SEQ ID NO: 7090229 - DNA, 21 bp, Homo sapiens
cacattgttccaggtttgggt

SEQ ID NO: 7090230 - DNA, 22 bp, Homo sapiens
cacatttaaaaaatccacgatc

SEQ ID NO: 7090231 - DNA, 22 bp, Homo sapiens
cacatttaaaggttgaagctga

SEQ ID NO: 7090232 - DNA, 22 bp, Homo sapiens
cacatttaagcagatgtggacc

SEQ ID NO: 7090233 - DNA, 22 bp, Homo sapiens
cacatttaagcagatgtggacc

SEQ ID NO: 7090234 - DNA, 22 bp, Homo sapiens
agcaggtgggcatgaaagctga

SEQ ID NO: 7090235 - DNA, 22 bp, Homo sapiens
agcaggtgggcatgaaagctga

SEQ ID NO: 7090236 - DNA, 22 bp, Homo sapiens
agcaggtgggatcaagctggca

SEQ ID NO: 7090237 - DNA, 22 bp, Homo sapiens
agcaggtgggatcaagctggca

SEQ ID NO: 7090238 - DNA, 22 bp, Homo sapiens
agcaggtgggatcaagctggca

SEQ ID NO: 7090239 - DNA, 22 bp, Homo sapiens
agcaggtgggatcaagctggca

SEQ ID NO: 7090240 - DNA, 22 bp, Homo sapiens
agcaggtgggatcaagctggca

SEQ ID NO: 7090241 - DNA, 22 bp, Homo sapiens
agcaggtggcctcctgtctgtc

SEQ ID NO: 7090242 - DNA, 18 bp, Homo sapiens
agcaggtggcgtctgcag

SEQ ID NO: 7090243 - DNA, 22 bp, Homo sapiens
agcaggtggcctcctgtctgtc

SEQ ID NO: 7090244 - DNA, 22 bp, Homo sapiens
agcaggtggcctcctgtctgtc

SEQ ID NO: 7090245 - DNA, 22 bp, Homo sapiens
agcaggtggccacgaggaggag

SEQ ID NO: 7090246 - DNA, 22 bp, Homo sapiens
agcaggtggccacgaggaggag

SEQ ID NO: 7090247 - DNA, 22 bp, Homo sapiens
agcaggtggatttagacgggag

SEQ ID NO: 7090248 - DNA, 22 bp, Homo sapiens
agcaggtggatttagacgggag

SEQ ID NO: 7090249 - DNA, 18 bp, Homo sapiens
agcaggtggatttattgg

SEQ ID NO: 7090250 - DNA, 22 bp, Homo sapiens
agcaggtggccacgaggaggag

SEQ ID NO: 7090251 - DNA, 22 bp, Homo sapiens
agcaggtggccacgaggaggag

SEQ ID NO: 7090252 - DNA, 22 bp, Homo sapiens
agcaggtggccacgaggaggag

SEQ ID NO: 7090253 - DNA, 22 bp, Homo sapiens
agcaggtggccacgaggaggag

SEQ ID NO: 7090254 - DNA, 22 bp, Homo sapiens
agcaggtggacagaggaagaaa

SEQ ID NO: 7090255 - DNA, 22 bp, Homo sapiens
cactaggagacaaggcaaacca

SEQ ID NO: 7090256 - DNA, 22 bp, Homo sapiens
cactaggcatctgtgagggtag

SEQ ID NO: 7090257 - DNA, 22 bp, Homo sapiens
cactaggcgccgggtggctgtg

SEQ ID NO: 7090258 - DNA, 22 bp, Homo sapiens
cactagaaaggtacagattatg

SEQ ID NO: 7090259 - DNA, 22 bp, Homo sapiens
cactagaaaggtacagattatg

SEQ ID NO: 7090260 - DNA, 22 bp, Homo sapiens
cactagaaccaatgacatttct

SEQ ID NO: 7090261 - DNA, 22 bp, Homo sapiens
cactacaggggtccacagctga

SEQ ID NO: 7090262 - DNA, 22 bp, Homo sapiens
cactacaggggtccacagctga

SEQ ID NO: 7090263 - DNA, 22 bp, Homo sapiens
cactacttgaaagaattacaga

SEQ ID NO: 7090264 - DNA, 22 bp, Homo sapiens
cactacaggggtccacagctga

SEQ ID NO: 7090265 - DNA, 22 bp, Homo sapiens
cactacagaatcaaatacgggc

SEQ ID NO: 7090266 - DNA, 22 bp, Homo sapiens
cactaattccatctccttttcc

SEQ ID NO: 7090267 - DNA, 22 bp, Homo sapiens
cactaagtcaacagcctctctt

SEQ ID NO: 7090268 - DNA, 22 bp, Homo sapiens
cactaagtaagctcctctacaa

SEQ ID NO: 7090269 - DNA, 22 bp, Homo sapiens
caagggggagatttagggtaat

SEQ ID NO: 7090270 - DNA, 20 bp, Homo sapiens
caaggggagtagtatgggcc

SEQ ID NO: 7090271 - DNA, 22 bp, Homo sapiens
caagggctcttttgaggaatgt

SEQ ID NO: 7090272 - DNA, 22 bp, Homo sapiens
caagggctcttttgaggaatgt

SEQ ID NO: 7090273 - DNA, 22 bp, Homo sapiens
caagggctgaacacaggtttca

SEQ ID NO: 7090274 - DNA, 22 bp, Homo sapiens
caagggctgctatcagctactg

SEQ ID NO: 7090275 - DNA, 22 bp, Homo sapiens
caagggctgctatcagctactg

SEQ ID NO: 7090276 - DNA, 22 bp, Homo sapiens
caagggcttcaagtggccaaga

SEQ ID NO: 7090277 - DNA, 22 bp, Homo sapiens
caagggcttcaagtggccaaga

SEQ ID NO: 7090278 - DNA, 22 bp, Homo sapiens
caagtccaacagtttttcagac

SEQ ID NO: 7090279 - DNA, 22 bp, Homo sapiens
caagtccaacagtttttcagac

SEQ ID NO: 7090280 - DNA, 22 bp, Homo sapiens
caagtccaacagtttttcagac

SEQ ID NO: 7090281 - DNA, 22 bp, Homo sapiens
caagtccaagatcaagaagcca

SEQ ID NO: 7090282 - DNA, 22 bp, Homo sapiens
caagtccaggtcaatttaaagc

SEQ ID NO: 7090283 - DNA, 22 bp, Homo sapiens
caagtccaggtgggcaaataaa

SEQ ID NO: 7090284 - DNA, 22 bp, Homo sapiens
caagtccatataagtctgtttc

SEQ ID NO: 7090285 - DNA, 22 bp, Homo sapiens
caagtccatcagataagcaaga

SEQ ID NO: 7090286 - DNA, 22 bp, Homo sapiens
caagtccatcctactgccttct

SEQ ID NO: 7090287 - DNA, 22 bp, Homo sapiens
caagtccatgttagatgctggc

SEQ ID NO: 7090288 - DNA, 22 bp, Homo sapiens
caagtccatgttagatgctggc

SEQ ID NO: 7090289 - DNA, 22 bp, Homo sapiens
caagtcccccaagaacagaacc

SEQ ID NO: 7090290 - DNA, 22 bp, Homo sapiens
caagggcaggagaggatggatg

SEQ ID NO: 7090291 - DNA, 22 bp, Homo sapiens
caagggcattgcttgggacctt

SEQ ID NO: 7090292 - DNA, 22 bp, Homo sapiens
caagggccatctgagggcactg

SEQ ID NO: 7090293 - DNA, 21 bp, Homo sapiens
caagggccagtgagatgggat

SEQ ID NO: 7090294 - DNA, 22 bp, Homo sapiens
caagggccatctgagggcactg

SEQ ID NO: 7090295 - DNA, 22 bp, Homo sapiens
caagggcctccaccttgctcgt

SEQ ID NO: 7090296 - DNA, 22 bp, Homo sapiens
caagggccctcggatgatgatg

SEQ ID NO: 7090297 - DNA, 22 bp, Homo sapiens
caagggagttgctgcatgcagg

SEQ ID NO: 7090298 - DNA, 22 bp, Homo sapiens
caagggcagaggcagggccccg

SEQ ID NO: 7090299 - DNA, 22 bp, Homo sapiens
caagggagttactgagggcggg

SEQ ID NO: 7090300 - DNA, 22 bp, Homo sapiens
caagggagttactgagggcggg

SEQ ID NO: 7090301 - DNA, 22 bp, Homo sapiens
caagggagttgctgcatgcagg

SEQ ID NO: 7090302 - DNA, 22 bp, Homo sapiens
caagggagttgctgcatgcagg

SEQ ID NO: 7090303 - DNA, 22 bp, Homo sapiens
caagggagttactgagggcggg

SEQ ID NO: 7090304 - DNA, 22 bp, Homo sapiens
caagggaattgtgtgtgagagg

SEQ ID NO: 7090305 - DNA, 22 bp, Homo sapiens
caagggaattgtgtgtgagagg

SEQ ID NO: 7090306 - DNA, 22 bp, Homo sapiens
caagtctgacctctgggtgaag

SEQ ID NO: 7090307 - DNA, 22 bp, Homo sapiens
caagtccttttcttggctcagg

SEQ ID NO: 7090308 - DNA, 22 bp, Homo sapiens
caagtccttttcttggctcagg

SEQ ID NO: 7090309 - DNA, 22 bp, Homo sapiens
caagtctagcttggtcacttgg

SEQ ID NO: 7090310 - DNA, 22 bp, Homo sapiens
caagtcctctggtttcaaatag

SEQ ID NO: 7090311 - DNA, 22 bp, Homo sapiens
caagtcctctggtttcaaatag

SEQ ID NO: 7090312 - DNA, 22 bp, Homo sapiens
caagtccttttcttggctcagg

SEQ ID NO: 7090313 - DNA, 22 bp, Homo sapiens
caatgatatctaggaatgggac

SEQ ID NO: 7090314 - DNA, 22 bp, Homo sapiens
caatgttttgttgaatgaatag

SEQ ID NO: 7090315 - DNA, 22 bp, Homo sapiens
caatgatagattttacaaatta

SEQ ID NO: 7090316 - DNA, 22 bp, Homo sapiens
caagtgaagatatacagaaaat

SEQ ID NO: 7090317 - DNA, 22 bp, Homo sapiens
caagtctgtctgctcctgtgtg

SEQ ID NO: 7090318 - DNA, 22 bp, Homo sapiens
caagtgaagatatacagaaaat

SEQ ID NO: 7090319 - DNA, 21 bp, Homo sapiens
caattactatgaaccagttga

SEQ ID NO: 7090320 - DNA, 22 bp, Homo sapiens
caattactggtccacagaaatt

SEQ ID NO: 7090321 - DNA, 21 bp, Homo sapiens
caattacagatggctcagggg

SEQ ID NO: 7090322 - DNA, 22 bp, Homo sapiens
caattacatttattgagcattc

SEQ ID NO: 7090323 - DNA, 22 bp, Homo sapiens
caatgtttttccttccttaata

SEQ ID NO: 7090324 - DNA, 22 bp, Homo sapiens
caatgtttttccttccttaata

SEQ ID NO: 7090325 - DNA, 22 bp, Homo sapiens
caattaaagaagacctgcctca

SEQ ID NO: 7090326 - DNA, 22 bp, Homo sapiens
caattatatttagaatgataca

SEQ ID NO: 7090327 - DNA, 22 bp, Homo sapiens
caattatatttagaatgataca

SEQ ID NO: 7090328 - DNA, 22 bp, Homo sapiens
caattattcagtgacttaagag

SEQ ID NO: 7090329 - DNA, 22 bp, Homo sapiens
caaggaaggagagatgatgggt

SEQ ID NO: 7090330 - DNA, 22 bp, Homo sapiens
caaggaagacccacgcagatat

SEQ ID NO: 7090331 - DNA, 22 bp, Homo sapiens
caaggaaggagagatgatgggt

SEQ ID NO: 7090332 - DNA, 21 bp, Homo sapiens
agcagacagatgcacgcacac

SEQ ID NO: 7090333 - DNA, 22 bp, Homo sapiens
caaggaaggagagatgatgggt

SEQ ID NO: 7090334 - DNA, 22 bp, Homo sapiens
caaggaagttttaggagaggaa

SEQ ID NO: 7090335 - DNA, 22 bp, Homo sapiens
caaggaagttttaggagaggaa

SEQ ID NO: 7090336 - DNA, 22 bp, Homo sapiens
caaggaagttttaggagaggaa

SEQ ID NO: 7090337 - DNA, 22 bp, Homo sapiens
agcagacatatctcatgtcaca

SEQ ID NO: 7090338 - DNA, 22 bp, Homo sapiens
agcagacatggcttggatgtgg

SEQ ID NO: 7090339 - DNA, 22 bp, Homo sapiens
agcagacatatctcatgtcaca

SEQ ID NO: 7090340 - DNA, 22 bp, Homo sapiens
agcagacaggtaggaggataaa

SEQ ID NO: 7090341 - DNA, 22 bp, Homo sapiens
agcagacatatctcatgtcaca

SEQ ID NO: 7090342 - DNA, 22 bp, Homo sapiens
agcagacatatctcatgtcaca

SEQ ID NO: 7090343 - DNA, 21 bp, Homo sapiens
agcagacagatgcacgcacac

SEQ ID NO: 7090344 - DNA, 21 bp, Homo sapiens
agcagacagcccaagaaaatc

SEQ ID NO: 7090345 - DNA, 22 bp, Homo sapiens
agcagacaggctgccacagtgc

SEQ ID NO: 7090346 - DNA, 22 bp, Homo sapiens
caagggaaggctaagggcaaca

SEQ ID NO: 7090347 - DNA, 22 bp, Homo sapiens
caaggcatttcgcttagagaga

SEQ ID NO: 7090348 - DNA, 22 bp, Homo sapiens
caaggccaaagggccactgtca

SEQ ID NO: 7090349 - DNA, 22 bp, Homo sapiens
caaggccaaagggccactgtca

SEQ ID NO: 7090350 - DNA, 22 bp, Homo sapiens
agcagagaccatatagcccaga

SEQ ID NO: 7090351 - DNA, 22 bp, Homo sapiens
agcagagaccatatagcccaga

SEQ ID NO: 7090352 - DNA, 22 bp, Homo sapiens
caaggcattcttgcaggtaggg

SEQ ID NO: 7090353 - DNA, 22 bp, Homo sapiens
agcagagacatgaaatatgctt

SEQ ID NO: 7090354 - DNA, 22 bp, Homo sapiens
agcagagacatgaaatatgctt

SEQ ID NO: 7090355 - DNA, 22 bp, Homo sapiens
agcagagacatgaaatatgctt

SEQ ID NO: 7090356 - DNA, 22 bp, Homo sapiens
agcagagaagacacaggcttca

SEQ ID NO: 7090357 - DNA, 22 bp, Homo sapiens
agcagagaagacacaggcttca

SEQ ID NO: 7090358 - DNA, 22 bp, Homo sapiens
agcagagaagacacaggcttca

SEQ ID NO: 7090359 - DNA, 22 bp, Homo sapiens
agcagaccaggagtgcacaggt

SEQ ID NO: 7090360 - DNA, 22 bp, Homo sapiens
agcagagaagacacaggcttca

SEQ ID NO: 7090361 - DNA, 22 bp, Homo sapiens
caaggaaaagaagtatttcaga

SEQ ID NO: 7090362 - DNA, 22 bp, Homo sapiens
caaggaaacatgaaatgcattg

SEQ ID NO: 7090363 - DNA, 22 bp, Homo sapiens
caagctgggtgcgggcagtata

SEQ ID NO: 7090364 - DNA, 22 bp, Homo sapiens
caagctggtatcagctagagcg

SEQ ID NO: 7090365 - DNA, 22 bp, Homo sapiens
caagctggtatcagctagagcg

SEQ ID NO: 7090366 - DNA, 22 bp, Homo sapiens
caagctggtatcagctagagcg

SEQ ID NO: 7090367 - DNA, 22 bp, Homo sapiens
caagcttaagacagaagaggca

SEQ ID NO: 7090368 - DNA, 22 bp, Homo sapiens
caagcttgtttctcctgggggt

SEQ ID NO: 7090369 - DNA, 22 bp, Homo sapiens
caagcttgtttctcctgggggt

SEQ ID NO: 7090370 - DNA, 22 bp, Homo sapiens
caagcttgtttctcctgggggt

SEQ ID NO: 7090371 - DNA, 22 bp, Homo sapiens
caagcttgtttctcctgggggt

SEQ ID NO: 7090372 - DNA, 22 bp, Homo sapiens
caagctttccattacacacatt

SEQ ID NO: 7090373 - DNA, 22 bp, Homo sapiens
caaggaaaaagcgagctcgggg

SEQ ID NO: 7090374 - DNA, 22 bp, Homo sapiens
caaggaaaacagatgatcaaca

SEQ ID NO: 7090375 - DNA, 22 bp, Homo sapiens
caaggaaaacagatgatcaaca

SEQ ID NO: 7090376 - DNA, 22 bp, Homo sapiens
agcaattggaatttagacaaga

SEQ ID NO: 7090377 - DNA, 20 bp, Homo sapiens
agcaattgtgaacttattca

SEQ ID NO: 7090378 - DNA, 20 bp, Homo sapiens
agcaattgtgaacttattca

SEQ ID NO: 7090379 - DNA, 22 bp, Homo sapiens
agcaattggaatttagacaaga

SEQ ID NO: 7090380 - DNA, 22 bp, Homo sapiens
agcaatttcccatctcttctgc

SEQ ID NO: 7090381 - DNA, 22 bp, Homo sapiens
agcaattttcccttagtctttg

SEQ ID NO: 7090382 - DNA, 22 bp, Homo sapiens
agcaattttctaagcaaaatac

SEQ ID NO: 7090383 - DNA, 22 bp, Homo sapiens
caagctggctgggagaggcacg

SEQ ID NO: 7090384 - DNA, 22 bp, Homo sapiens
caagctggaggttggagctact

SEQ ID NO: 7090385 - DNA, 22 bp, Homo sapiens
caagctggagttcctcagagtg

SEQ ID NO: 7090386 - DNA, 22 bp, Homo sapiens
caagctgggtgcgggcagtata

SEQ ID NO: 7090387 - DNA, 22 bp, Homo sapiens
caagcagagaggttagaacaca

SEQ ID NO: 7090388 - DNA, 22 bp, Homo sapiens
caagcagaggtttatgtattag

SEQ ID NO: 7090389 - DNA, 22 bp, Homo sapiens
caagcagatattttagtcaaga

SEQ ID NO: 7090390 - DNA, 22 bp, Homo sapiens
cacacagacagctctctgaaga

SEQ ID NO: 7090391 - DNA, 22 bp, Homo sapiens
cacacatcttatcccagttatt

SEQ ID NO: 7090392 - DNA, 22 bp, Homo sapiens
cacacatcttatcccagttatt

SEQ ID NO: 7090393 - DNA, 22 bp, Homo sapiens
caatttttgtacttatagtact

SEQ ID NO: 7090394 - DNA, 22 bp, Homo sapiens
caatttttgtacttatagtact

SEQ ID NO: 7090395 - DNA, 22 bp, Homo sapiens
caatttttgtacttatagtact

SEQ ID NO: 7090396 - DNA, 22 bp, Homo sapiens
caattttattggtccaaataca

SEQ ID NO: 7090397 - DNA, 22 bp, Homo sapiens
caatttttaaactatgaagttg

SEQ ID NO: 7090398 - DNA, 22 bp, Homo sapiens
caatttttaaactatgaagttg

SEQ ID NO: 7090399 - DNA, 22 bp, Homo sapiens
caatttctggaactaattctga

SEQ ID NO: 7090400 - DNA, 22 bp, Homo sapiens
caattcaatggcaaagtattgt

SEQ ID NO: 7090401 - DNA, 22 bp, Homo sapiens
caatttcttgttaattctcagg

SEQ ID NO: 7090402 - DNA, 22 bp, Homo sapiens
caatttcttgttaattctcagg

SEQ ID NO: 7090403 - DNA, 22 bp, Homo sapiens
caatttctggaactaattctga

SEQ ID NO: 7090404 - DNA, 22 bp, Homo sapiens
caatttctgggcctcacacaag

SEQ ID NO: 7090405 - DNA, 22 bp, Homo sapiens
caatttcttgttaattctcagg

SEQ ID NO: 7090406 - DNA, 22 bp, Homo sapiens
caatttgattaataccatactt

SEQ ID NO: 7090407 - DNA, 22 bp, Homo sapiens
cacagaaaaaggcttgaaaatc

SEQ ID NO: 7090408 - DNA, 22 bp, Homo sapiens
cacagaaaaaggcttgaaaatc

SEQ ID NO: 7090409 - DNA, 22 bp, Homo sapiens
cacagaaaaaggcttgaaaatc

SEQ ID NO: 7090410 - DNA, 22 bp, Homo sapiens
cacagaaaggctcaaatcccaa

SEQ ID NO: 7090411 - DNA, 22 bp, Homo sapiens
cacagaaaggctcaaatcccaa

SEQ ID NO: 7090412 - DNA, 22 bp, Homo sapiens
cacacttttctggctcaggctc

SEQ ID NO: 7090413 - DNA, 22 bp, Homo sapiens
cacagaaaaaggcttgaaaatc

SEQ ID NO: 7090414 - DNA, 22 bp, Homo sapiens
cacagaaaaaggcttgaaaatc

SEQ ID NO: 7090415 - DNA, 22 bp, Homo sapiens
cacagaaaaaggcttgaaaatc

SEQ ID NO: 7090416 - DNA, 22 bp, Homo sapiens
cacacttgtgaccgatataatg

SEQ ID NO: 7090417 - DNA, 22 bp, Homo sapiens
cacactttcaggtcctctttgc

SEQ ID NO: 7090418 - DNA, 22 bp, Homo sapiens
cacactttgtgctaatctattt

SEQ ID NO: 7090419 - DNA, 22 bp, Homo sapiens
cacactttgtgctaatctattt

SEQ ID NO: 7090420 - DNA, 22 bp, Homo sapiens
cacactttgtgctaatctattt

SEQ ID NO: 7090421 - DNA, 22 bp, Homo sapiens
cacacttgtgaccgatataatg

SEQ ID NO: 7090422 - DNA, 22 bp, Homo sapiens
cacacttgcttcagagtcaagt

SEQ ID NO: 7090423 - DNA, 22 bp, Homo sapiens
cacacattaatatcaaaggctc

SEQ ID NO: 7090424 - DNA, 22 bp, Homo sapiens
cacactgttgaggacgagatgt

SEQ ID NO: 7090425 - DNA, 22 bp, Homo sapiens
cacactgttgaggacgagatgt

SEQ ID NO: 7090426 - DNA, 22 bp, Homo sapiens
cacacatgtgtgcagcttagaa

SEQ ID NO: 7090427 - DNA, 22 bp, Homo sapiens
cacacatgtctctccatgctct

SEQ ID NO: 7090428 - DNA, 22 bp, Homo sapiens
cacacatgtgagcagagaggcg

SEQ ID NO: 7090429 - DNA, 22 bp, Homo sapiens
cacacatgtgagcagagaggcg

SEQ ID NO: 7090430 - DNA, 22 bp, Homo sapiens
cacacatgtgggatccgcaggg

SEQ ID NO: 7090431 - DNA, 22 bp, Homo sapiens
cacacatgtgtgcagcttagaa

SEQ ID NO: 7090432 - DNA, 22 bp, Homo sapiens
cacacatgtctctccatgctct

SEQ ID NO: 7090433 - DNA, 22 bp, Homo sapiens
cacacatggttccgcaggatgc

SEQ ID NO: 7090434 - DNA, 22 bp, Homo sapiens
cacacatggttccgcaggatgc

SEQ ID NO: 7090435 - DNA, 22 bp, Homo sapiens
cacacatgtctctccatgctct

SEQ ID NO: 7090436 - DNA, 22 bp, Homo sapiens
cacacatgtctctccatgctct

SEQ ID NO: 7090437 - DNA, 22 bp, Homo sapiens
cacacatggtagcaggtacaag

SEQ ID NO: 7090438 - DNA, 22 bp, Homo sapiens
cacacatggtagcaggtacaag

SEQ ID NO: 7090439 - DNA, 22 bp, Homo sapiens
cacacatggtagcaggtacaag

SEQ ID NO: 7090440 - DNA, 22 bp, Homo sapiens
cacacatggtcagtggctactc

SEQ ID NO: 7090441 - DNA, 22 bp, Homo sapiens
cacacatggctgccagggaggt

SEQ ID NO: 7090442 - DNA, 22 bp, Homo sapiens
cacacatggctgccagggaggt

SEQ ID NO: 7090443 - DNA, 22 bp, Homo sapiens
cacacatgcatgtaagacctct

SEQ ID NO: 7090444 - DNA, 22 bp, Homo sapiens
cacacatgagtctccccattgg

SEQ ID NO: 7090445 - DNA, 22 bp, Homo sapiens
cacacatgcatgtaagacctct

SEQ ID NO: 7090446 - DNA, 22 bp, Homo sapiens
cacacatgcatgtaagacctct

SEQ ID NO: 7090447 - DNA, 22 bp, Homo sapiens
cacacatgacccacttttaccg

SEQ ID NO: 7090448 - DNA, 22 bp, Homo sapiens
cacacatgacccacttttaccg

SEQ ID NO: 7090449 - DNA, 22 bp, Homo sapiens
cacacatgagtctccccattgg

SEQ ID NO: 7090450 - DNA, 22 bp, Homo sapiens
cacacatgagtctccccattgg

SEQ ID NO: 7090451 - DNA, 22 bp, Homo sapiens
cacacatgaatccctagtacct

SEQ ID NO: 7090452 - DNA, 22 bp, Homo sapiens
cacacatgaatccctagtacct

SEQ ID NO: 7090453 - DNA, 22 bp, Homo sapiens
cacacatgaatccctagtacct

SEQ ID NO: 7090454 - DNA, 22 bp, Homo sapiens
cacacatgaatccctagtacct

SEQ ID NO: 7090455 - DNA, 22 bp, Homo sapiens
cacacatgaagttgctgagcta

SEQ ID NO: 7090456 - DNA, 22 bp, Homo sapiens
cacacatgaagttgctgagcta

SEQ ID NO: 7090457 - DNA, 22 bp, Homo sapiens
cacacatgaatccctagtacct

SEQ ID NO: 7090458 - DNA, 22 bp, Homo sapiens
cacagctgccctaactgtactc

SEQ ID NO: 7090459 - DNA, 22 bp, Homo sapiens
cacagctgccctaactgtactc

SEQ ID NO: 7090460 - DNA, 22 bp, Homo sapiens
cacagctgccccctctctaact

SEQ ID NO: 7090461 - DNA, 22 bp, Homo sapiens
cacagctgccccctctctaact

SEQ ID NO: 7090462 - DNA, 22 bp, Homo sapiens
cacagctgccctactccatgtg

SEQ ID NO: 7090463 - DNA, 22 bp, Homo sapiens
cacagctggaatggggtacctg

SEQ ID NO: 7090464 - DNA, 22 bp, Homo sapiens
cacagctgccatggctgcactt

SEQ ID NO: 7090465 - DNA, 22 bp, Homo sapiens
cacagctgccatggctgcactt

SEQ ID NO: 7090466 - DNA, 22 bp, Homo sapiens
cacagctgccatggctgcactt

SEQ ID NO: 7090467 - DNA, 22 bp, Homo sapiens
cacagctgcacagaggaggtgc

SEQ ID NO: 7090468 - DNA, 22 bp, Homo sapiens
cacagctgccatgcagtcagtg

SEQ ID NO: 7090469 - DNA, 22 bp, Homo sapiens
cacagctgccatgcagtcagtg

SEQ ID NO: 7090470 - DNA, 22 bp, Homo sapiens
cacagctgccatgcagtcagtg

SEQ ID NO: 7090471 - DNA, 22 bp, Homo sapiens
cacagcaggcactatacagggc

SEQ ID NO: 7090472 - DNA, 22 bp, Homo sapiens
cacagcagcgttcctccgtgtg

SEQ ID NO: 7090473 - DNA, 22 bp, Homo sapiens
cacagcagcgttcctccgtgtg

SEQ ID NO: 7090474 - DNA, 22 bp, Homo sapiens
cacagcagcgttcctccgtgtg

SEQ ID NO: 7090475 - DNA, 22 bp, Homo sapiens
cacagcagcgttcctccgtgtg

SEQ ID NO: 7090476 - DNA, 22 bp, Homo sapiens
cacagcagcgttcctccgtgtg

SEQ ID NO: 7090477 - DNA, 22 bp, Homo sapiens
cacagcagccagaacatttttg

SEQ ID NO: 7090478 - DNA, 22 bp, Homo sapiens
cacagcagccagaacatttttg

SEQ ID NO: 7090479 - DNA, 22 bp, Homo sapiens
cacagcagccagaacatttttg

SEQ ID NO: 7090480 - DNA, 22 bp, Homo sapiens
cacagaaattattaggatgctt

SEQ ID NO: 7090481 - DNA, 22 bp, Homo sapiens
cacagaaattattaggatgctt

SEQ ID NO: 7090482 - DNA, 22 bp, Homo sapiens
cacagaaattattaggatgctt

SEQ ID NO: 7090483 - DNA, 22 bp, Homo sapiens
cacagaaattattaggatgctt

SEQ ID NO: 7090484 - DNA, 22 bp, Homo sapiens
cacagaaattattaggatgctt

SEQ ID NO: 7090485 - DNA, 22 bp, Homo sapiens
cacagaaattattaggatgctt

SEQ ID NO: 7090486 - DNA, 22 bp, Homo sapiens
cacagaaatattgtgtcccttg

SEQ ID NO: 7090487 - DNA, 22 bp, Homo sapiens
cacagaaatattgtgtcccttg

SEQ ID NO: 7090488 - DNA, 22 bp, Homo sapiens
cacagaaaggctcaaatcccaa

SEQ ID NO: 7090489 - DNA, 22 bp, Homo sapiens
cacagaaatattgtgtcccttg

SEQ ID NO: 7090490 - DNA, 22 bp, Homo sapiens
cacagaaatattgtgtcccttg

SEQ ID NO: 7090491 - DNA, 22 bp, Homo sapiens
cacagaaatattgtgtcccttg

SEQ ID NO: 7090492 - DNA, 22 bp, Homo sapiens
cacagaaatattgtgtcccttg

SEQ ID NO: 7090493 - DNA, 22 bp, Homo sapiens
cacagaaatattgtgtcccttg

SEQ ID NO: 7090494 - DNA, 20 bp, Homo sapiens
cacaggaaagctactcagtt

SEQ ID NO: 7090495 - DNA, 20 bp, Homo sapiens
cacaggaaagctactcagtt

SEQ ID NO: 7090496 - DNA, 22 bp, Homo sapiens
cacaggaaaataaaagatctaa

SEQ ID NO: 7090497 - DNA, 22 bp, Homo sapiens
cacaggaaagtcagccagaaga

SEQ ID NO: 7090498 - DNA, 22 bp, Homo sapiens
cacaggaaagtcagccagaaga

SEQ ID NO: 7090499 - DNA, 22 bp, Homo sapiens
cacaggaaagtcagccagaaga

SEQ ID NO: 7090500 - DNA, 22 bp, Homo sapiens
cacaggaaatattaggagggat

SEQ ID NO: 7090501 - DNA, 22 bp, Homo sapiens
cacagctgggaaaatttgtaca

SEQ ID NO: 7090502 - DNA, 22 bp, Homo sapiens
cacagctggggaagctgaggcc

SEQ ID NO: 7090503 - DNA, 22 bp, Homo sapiens
cacagctggggaagctgaggcc

SEQ ID NO: 7090504 - DNA, 22 bp, Homo sapiens
cacagctggggaagctgaggcc

SEQ ID NO: 7090505 - DNA, 22 bp, Homo sapiens
cacaggaaaaatgggtccttta

SEQ ID NO: 7090506 - DNA, 22 bp, Homo sapiens
agcaggcaggctgccagtgaat

SEQ ID NO: 7090507 - DNA, 22 bp, Homo sapiens
agcaggcaggctgccagtgaat

SEQ ID NO: 7090508 - DNA, 22 bp, Homo sapiens
agcaggccactgcagctggagc

SEQ ID NO: 7090509 - DNA, 22 bp, Homo sapiens
cacaggaagcaagcctggggcc

SEQ ID NO: 7090510 - DNA, 22 bp, Homo sapiens
agcaggcaggcccagcggctgg

SEQ ID NO: 7090511 - DNA, 22 bp, Homo sapiens
agcaggcaggcccagcggctgg

SEQ ID NO: 7090512 - DNA, 22 bp, Homo sapiens
agcaggcaggcccagcggctgg

SEQ ID NO: 7090513 - DNA, 22 bp, Homo sapiens
cacaggaagaggtatacaattc

SEQ ID NO: 7090514 - DNA, 22 bp, Homo sapiens
cacaggaagatctcccagaggt

SEQ ID NO: 7090515 - DNA, 22 bp, Homo sapiens
cacaggaagatctcccagaggt

SEQ ID NO: 7090516 - DNA, 22 bp, Homo sapiens
cacaggaagatctcccagaggt

SEQ ID NO: 7090517 - DNA, 22 bp, Homo sapiens
cacaggaagatctcccagaggt

SEQ ID NO: 7090518 - DNA, 22 bp, Homo sapiens
cacaggaaatgattctgcagca

SEQ ID NO: 7090519 - DNA, 22 bp, Homo sapiens
cacaggaaatattaggagggat

SEQ ID NO: 7090520 - DNA, 22 bp, Homo sapiens
cacaggaacaaagaagacaatt

SEQ ID NO: 7090521 - DNA, 22 bp, Homo sapiens
cacaggaacaaagaagacaatt

SEQ ID NO: 7090522 - DNA, 22 bp, Homo sapiens
cacaggaacaaagaagacaatt

SEQ ID NO: 7090523 - DNA, 22 bp, Homo sapiens
cacaggaacttactggccactt

SEQ ID NO: 7090524 - DNA, 22 bp, Homo sapiens
cacaggaacttactggccactt

SEQ ID NO: 7090525 - DNA, 22 bp, Homo sapiens
cacaggaacttactggccactt

SEQ ID NO: 7090526 - DNA, 22 bp, Homo sapiens
cacaggaagaggtatacaattc

SEQ ID NO: 7090527 - DNA, 22 bp, Homo sapiens
cagaggagaattgcgggatcat

SEQ ID NO: 7090528 - DNA, 22 bp, Homo sapiens
cagaggagaattgcgggatcat

SEQ ID NO: 7090529 - DNA, 18 bp, Homo sapiens
cagaggagagacattcag

SEQ ID NO: 7090530 - DNA, 17 bp, Homo sapiens
cagaggagctttggggg

SEQ ID NO: 7090531 - DNA, 17 bp, Homo sapiens
cagaggagctttggggg

SEQ ID NO: 7090532 - DNA, 18 bp, Homo sapiens
cagaggagagacattcag

SEQ ID NO: 7090533 - DNA, 18 bp, Homo sapiens
cagaggagagacattcag

SEQ ID NO: 7090534 - DNA, 22 bp, Homo sapiens
cagaggaggcggtatacactgc

SEQ ID NO: 7090535 - DNA, 22 bp, Homo sapiens
cagaggaggcggtatacactgc

SEQ ID NO: 7090536 - DNA, 22 bp, Homo sapiens
cagaggaggcggtatacactgc

SEQ ID NO: 7090537 - DNA, 22 bp, Homo sapiens
cagaggaggcggtatacactgc

SEQ ID NO: 7090538 - DNA, 22 bp, Homo sapiens
cagaggaggccaccgcataggc

SEQ ID NO: 7090539 - DNA, 22 bp, Homo sapiens
cagaggaggccaccgcataggc

SEQ ID NO: 7090540 - DNA, 22 bp, Homo sapiens
cagaggaggccaccgcataggc

SEQ ID NO: 7090541 - DNA, 17 bp, Homo sapiens
cagaggagctttggggg

SEQ ID NO: 7090542 - DNA, 22 bp, Homo sapiens
cagagtgataaatatagaaatt

SEQ ID NO: 7090543 - DNA, 22 bp, Homo sapiens
cagagtgattatggaggattgc

SEQ ID NO: 7090544 - DNA, 22 bp, Homo sapiens
cagagtgaacagtgggatgtgc

SEQ ID NO: 7090545 - DNA, 22 bp, Homo sapiens
cagagtgaaataggggatcaag

SEQ ID NO: 7090546 - DNA, 22 bp, Homo sapiens
cagagtgagggcctgcacctgc

SEQ ID NO: 7090547 - DNA, 22 bp, Homo sapiens
cagagtgagggcctgcacctgc

SEQ ID NO: 7090548 - DNA, 22 bp, Homo sapiens
cagagtgaaataggggatcaag

SEQ ID NO: 7090549 - DNA, 21 bp, Homo sapiens
cagaggtggcctgacctctga

SEQ ID NO: 7090550 - DNA, 22 bp, Homo sapiens
cagaggtgctggagtgagtcct

SEQ ID NO: 7090551 - DNA, 22 bp, Homo sapiens
cagaggtgctggagtgagtcct

SEQ ID NO: 7090552 - DNA, 22 bp, Homo sapiens
cagaggagttcagtacacagcc

SEQ ID NO: 7090553 - DNA, 20 bp, Homo sapiens
cagaggagtacatatgttca

SEQ ID NO: 7090554 - DNA, 20 bp, Homo sapiens
cagaggagtacatatgttca

SEQ ID NO: 7090555 - DNA, 20 bp, Homo sapiens
cagaggagtacatatgttca

SEQ ID NO: 7090556 - DNA, 22 bp, Homo sapiens
cagaggagtgggccgttatggt

SEQ ID NO: 7090557 - DNA, 22 bp, Homo sapiens
cagaggagtgggccgttatggt

SEQ ID NO: 7090558 - DNA, 22 bp, Homo sapiens
agccctgggctgtagataagca

SEQ ID NO: 7090559 - DNA, 22 bp, Homo sapiens
agccctgagccagcctggtcag

SEQ ID NO: 7090560 - DNA, 22 bp, Homo sapiens
agccctgggctgtagataagca

SEQ ID NO: 7090561 - DNA, 22 bp, Homo sapiens
agccctgggctgtagataagca

SEQ ID NO: 7090562 - DNA, 20 bp, Homo sapiens
agccctgtttcctggagaga

SEQ ID NO: 7090563 - DNA, 21 bp, Homo sapiens
agcccttaggacataagagag

SEQ ID NO: 7090564 - DNA, 22 bp, Homo sapiens
agcccttagtacatttctcaag

SEQ ID NO: 7090565 - DNA, 22 bp, Homo sapiens
agccctcttccagccagcacag

SEQ ID NO: 7090566 - DNA, 22 bp, Homo sapiens
agccctgaagctggccatgtcc

SEQ ID NO: 7090567 - DNA, 22 bp, Homo sapiens
agccctgacctgtcctgttctg

SEQ ID NO: 7090568 - DNA, 22 bp, Homo sapiens
agccctgagccagcctggtcag

SEQ ID NO: 7090569 - DNA, 22 bp, Homo sapiens
agccctctctatggccctcttg

SEQ ID NO: 7090570 - DNA, 22 bp, Homo sapiens
agccctctctttagagatctga

SEQ ID NO: 7090571 - DNA, 22 bp, Homo sapiens
agccctctctttagagatctga

SEQ ID NO: 7090572 - DNA, 22 bp, Homo sapiens
agccctctgagctagtcaccat

SEQ ID NO: 7090573 - DNA, 22 bp, Homo sapiens
agccctcctttgttcatgctgc

SEQ ID NO: 7090574 - DNA, 22 bp, Homo sapiens
agccctcctggggccacgctgg

SEQ ID NO: 7090575 - DNA, 22 bp, Homo sapiens
agccctcctttgttcatgctgc

SEQ ID NO: 7090576 - DNA, 22 bp, Homo sapiens
agccctcctggggccacgctgg

SEQ ID NO: 7090577 - DNA, 22 bp, Homo sapiens
cagagtggcgaccccctcagct

SEQ ID NO: 7090578 - DNA, 22 bp, Homo sapiens
agccctcctggggccacgctgg

SEQ ID NO: 7090579 - DNA, 22 bp, Homo sapiens
cagagtggcactctgctggatg

SEQ ID NO: 7090580 - DNA, 22 bp, Homo sapiens
cagagtggagtttttcagcggg

SEQ ID NO: 7090581 - DNA, 22 bp, Homo sapiens
cagagtggagatgtgtgtggaa

SEQ ID NO: 7090582 - DNA, 22 bp, Homo sapiens
cagagtggagatgtgtgtggaa

SEQ ID NO: 7090583 - DNA, 22 bp, Homo sapiens
cagagtggagatgtgtgtggaa

SEQ ID NO: 7090584 - DNA, 22 bp, Homo sapiens
cagagtggcatgaatgaagcct

SEQ ID NO: 7090585 - DNA, 22 bp, Homo sapiens
cagagtggcagtcccaggccca

SEQ ID NO: 7090586 - DNA, 22 bp, Homo sapiens
cagagtggcagtcccaggccca

SEQ ID NO: 7090587 - DNA, 22 bp, Homo sapiens
cagagtggcactctgctggatg

SEQ ID NO: 7090588 - DNA, 22 bp, Homo sapiens
cagagtggcagtcccaggccca

SEQ ID NO: 7090589 - DNA, 22 bp, Homo sapiens
cagagtggcagtcccaggccca

SEQ ID NO: 7090590 - DNA, 22 bp, Homo sapiens
cagatgaactgtgactgaaaat

SEQ ID NO: 7090591 - DNA, 22 bp, Homo sapiens
cagatgaactgtgactgaaaat

SEQ ID NO: 7090592 - DNA, 22 bp, Homo sapiens
cagatctgtttgccagatcagc

SEQ ID NO: 7090593 - DNA, 22 bp, Homo sapiens
cagatcttgtactcattattga

SEQ ID NO: 7090594 - DNA, 22 bp, Homo sapiens
cagatctgctcctctgtccatg

SEQ ID NO: 7090595 - DNA, 21 bp, Homo sapiens
cagatctgtaggtactaccat

SEQ ID NO: 7090596 - DNA, 22 bp, Homo sapiens
cagatctgctcctctgtccatg

SEQ ID NO: 7090597 - DNA, 22 bp, Homo sapiens
cagatgaagatcatagaatagt

SEQ ID NO: 7090598 - DNA, 22 bp, Homo sapiens
agcctgagtgcttaggactgtt

SEQ ID NO: 7090599 - DNA, 22 bp, Homo sapiens
agcctgagtgcttaggactgtt

SEQ ID NO: 7090600 - DNA, 22 bp, Homo sapiens
cagatgaactgtgactgaaaat

SEQ ID NO: 7090601 - DNA, 22 bp, Homo sapiens
cagatgaagatcatagaatagt

SEQ ID NO: 7090602 - DNA, 22 bp, Homo sapiens
cagatgaagatcatagaatagt

SEQ ID NO: 7090603 - DNA, 22 bp, Homo sapiens
agcctgagtgcttaggactgtt

SEQ ID NO: 7090604 - DNA, 22 bp, Homo sapiens
agcctgcttgagagtcctggct

SEQ ID NO: 7090605 - DNA, 22 bp, Homo sapiens
agcctgcttggcagccctccca

SEQ ID NO: 7090606 - DNA, 22 bp, Homo sapiens
agcctgcttcctcagggaacaa

SEQ ID NO: 7090607 - DNA, 22 bp, Homo sapiens
agcctggaagaacctgaagtct

SEQ ID NO: 7090608 - DNA, 22 bp, Homo sapiens
agcctggaagaacctgaagtct

SEQ ID NO: 7090609 - DNA, 22 bp, Homo sapiens
agcctggaattaaggaaatgca

SEQ ID NO: 7090610 - DNA, 22 bp, Homo sapiens
agcctggaattaaggaaatgca

SEQ ID NO: 7090611 - DNA, 22 bp, Homo sapiens
agcctggacagctacggagaac

SEQ ID NO: 7090612 - DNA, 22 bp, Homo sapiens
agcctggaccaggggcctcaga

SEQ ID NO: 7090613 - DNA, 22 bp, Homo sapiens
agcctggaccaggggcctcaga

SEQ ID NO: 7090614 - DNA, 22 bp, Homo sapiens
agcctggaccaggggcctcaga

SEQ ID NO: 7090615 - DNA, 22 bp, Homo sapiens
agcctggagaagatgtgtattg

SEQ ID NO: 7090616 - DNA, 22 bp, Homo sapiens
agcctggagaggcgccatacac

SEQ ID NO: 7090617 - DNA, 22 bp, Homo sapiens
agcctggagaggcgccatacac

SEQ ID NO: 7090618 - DNA, 22 bp, Homo sapiens
agcctggagcttgagttatgag

SEQ ID NO: 7090619 - DNA, 22 bp, Homo sapiens
agcctggagcttgagttatgag

SEQ ID NO: 7090620 - DNA, 22 bp, Homo sapiens
agcctggaggaggagttgagca

SEQ ID NO: 7090621 - DNA, 22 bp, Homo sapiens
agcctggaggaggagttgagca

SEQ ID NO: 7090622 - DNA, 22 bp, Homo sapiens
agcctggaggaggagttgagca

SEQ ID NO: 7090623 - DNA, 22 bp, Homo sapiens
agcctggaggccaggagacagt

SEQ ID NO: 7090624 - DNA, 22 bp, Homo sapiens
agcctggaggccaggagacagt

SEQ ID NO: 7090625 - DNA, 19 bp, Homo sapiens
agcctggagggctggtcac

SEQ ID NO: 7090626 - DNA, 19 bp, Homo sapiens
agcctggagggctggtcac

SEQ ID NO: 7090627 - DNA, 19 bp, Homo sapiens
agcctggagggctggtcac

SEQ ID NO: 7090628 - DNA, 19 bp, Homo sapiens
agcctggagggctggtcac

SEQ ID NO: 7090629 - DNA, 18 bp, Homo sapiens
agcctggagggttgaagt

SEQ ID NO: 7090630 - DNA, 18 bp, Homo sapiens
agcctggagggttgaagt

SEQ ID NO: 7090631 - DNA, 22 bp, Homo sapiens
agcctggaggtaatgaggaaac

SEQ ID NO: 7090632 - DNA, 22 bp, Homo sapiens
cagcactgctgctgtacacaca

SEQ ID NO: 7090633 - DNA, 22 bp, Homo sapiens
cagcactgcttcgcagccaggg

SEQ ID NO: 7090634 - DNA, 22 bp, Homo sapiens
cagcactgcttcgcagccaggg

SEQ ID NO: 7090635 - DNA, 22 bp, Homo sapiens
agcctaggtttccgattctctt

SEQ ID NO: 7090636 - DNA, 22 bp, Homo sapiens
agcctaggtttccgattctctt

SEQ ID NO: 7090637 - DNA, 22 bp, Homo sapiens
agcctagggttctgatgtcact

SEQ ID NO: 7090638 - DNA, 22 bp, Homo sapiens
agcctagggttctgatgtcact

SEQ ID NO: 7090639 - DNA, 22 bp, Homo sapiens
agcctaggtctgggtctagcag

SEQ ID NO: 7090640 - DNA, 22 bp, Homo sapiens
cagatattaggagctcaataat

SEQ ID NO: 7090641 - DNA, 22 bp, Homo sapiens
cagatcaaacaaaatgggttag

SEQ ID NO: 7090642 - DNA, 22 bp, Homo sapiens
cagatcaagctgtatggtcaga

SEQ ID NO: 7090643 - DNA, 22 bp, Homo sapiens
agcctattccaggatgagctca

SEQ ID NO: 7090644 - DNA, 22 bp, Homo sapiens
cagatcataacagatacataga

SEQ ID NO: 7090645 - DNA, 21 bp, Homo sapiens
cagatcaatttacttgtccct

SEQ ID NO: 7090646 - DNA, 22 bp, Homo sapiens
cagatcacttgaagccaggagt

SEQ ID NO: 7090647 - DNA, 23 bp, Homo sapiens
cagatcatatatccagctgtaag

SEQ ID NO: 7090648 - DNA, 22 bp, Homo sapiens
cagatcataacagatacataga

SEQ ID NO: 7090649 - DNA, 22 bp, Homo sapiens
cagatcatgaatgactgacaga

SEQ ID NO: 7090650 - DNA, 22 bp, Homo sapiens
cagatccacccttgtagtgaca

SEQ ID NO: 7090651 - DNA, 23 bp, Homo sapiens
cagatcatatatccagctgtaag

SEQ ID NO: 7090652 - DNA, 22 bp, Homo sapiens
cagatcatgggactgtctcagc

SEQ ID NO: 7090653 - DNA, 22 bp, Homo sapiens
cagatcatgggactgtctcagc

SEQ ID NO: 7090654 - DNA, 18 bp, Homo sapiens
cagatccaggcagctatt

SEQ ID NO: 7090655 - DNA, 22 bp, Homo sapiens
cagatcctgccaggctgagttg

SEQ ID NO: 7090656 - DNA, 22 bp, Homo sapiens
cagatcctttatagcagtgtcc

SEQ ID NO: 7090657 - DNA, 22 bp, Homo sapiens
cagatccttaggacaaccatcc

SEQ ID NO: 7090658 - DNA, 22 bp, Homo sapiens
agcccttagtacatttctcaag

SEQ ID NO: 7090659 - DNA, 22 bp, Homo sapiens
agcccttagtacatttctcaag

SEQ ID NO: 7090660 - DNA, 22 bp, Homo sapiens
agcccttagtacatttctcaag

SEQ ID NO: 7090661 - DNA, 22 bp, Homo sapiens
agcccttgcagactgtcagcat

SEQ ID NO: 7090662 - DNA, 22 bp, Homo sapiens
agcccttggtattttccgatcc

SEQ ID NO: 7090663 - DNA, 22 bp, Homo sapiens
agcccttggtattttccgatcc

SEQ ID NO: 7090664 - DNA, 22 bp, Homo sapiens
agcccttggtattttccgatcc

SEQ ID NO: 7090665 - DNA, 22 bp, Homo sapiens
agccgagctctgagcagggcct

SEQ ID NO: 7090666 - DNA, 22 bp, Homo sapiens
agccgagctctgagcagggcct

SEQ ID NO: 7090667 - DNA, 22 bp, Homo sapiens
agccgagctctgagcagggcct

SEQ ID NO: 7090668 - DNA, 22 bp, Homo sapiens
agccgctgtctcttgggccgcg

SEQ ID NO: 7090669 - DNA, 22 bp, Homo sapiens
agccgctgtctcttgggccgcg

SEQ ID NO: 7090670 - DNA, 22 bp, Homo sapiens
agccggccatgtggtcttgtgc

SEQ ID NO: 7090671 - DNA, 22 bp, Homo sapiens
agcctacagagggcaggtggag

SEQ ID NO: 7090672 - DNA, 22 bp, Homo sapiens
agcctagctgtgtgaggccatc

SEQ ID NO: 7090673 - DNA, 22 bp, Homo sapiens
agcctaggaggttggggctgca

SEQ ID NO: 7090674 - DNA, 22 bp, Homo sapiens
cagagccatcccagcctgtggt

SEQ ID NO: 7090675 - DNA, 22 bp, Homo sapiens
cagagccatcccagcctgtggt

SEQ ID NO: 7090676 - DNA, 22 bp, Homo sapiens
cagagccagtcagtcagaaact

SEQ ID NO: 7090677 - DNA, 22 bp, Homo sapiens
cagagccatcatgatatggagt

SEQ ID NO: 7090678 - DNA, 22 bp, Homo sapiens
cagagccatccaggtgcctgtt

SEQ ID NO: 7090679 - DNA, 22 bp, Homo sapiens
cagagccatccaggtgcctgtt

SEQ ID NO: 7090680 - DNA, 23 bp, Homo sapiens
cagagctggctcagagctgcctg

SEQ ID NO: 7090681 - DNA, 21 bp, Homo sapiens
cagagctgtccaaaccctgac

SEQ ID NO: 7090682 - DNA, 22 bp, Homo sapiens
cagagctgtcatttgccagtga

SEQ ID NO: 7090683 - DNA, 21 bp, Homo sapiens
cagagctgtccaaaccctgac

SEQ ID NO: 7090684 - DNA, 22 bp, Homo sapiens
cagagctgttgcggggcttggc

SEQ ID NO: 7090685 - DNA, 22 bp, Homo sapiens
cagagctgttgcggggcttggc

SEQ ID NO: 7090686 - DNA, 20 bp, Homo sapiens
cagagctgttatggatgatg

SEQ ID NO: 7090687 - DNA, 20 bp, Homo sapiens
cagagctgttatggatgatg

SEQ ID NO: 7090688 - DNA, 20 bp, Homo sapiens
cagagctgttatggatgatg

SEQ ID NO: 7090689 - DNA, 22 bp, Homo sapiens
cagagctgtccaaaccctgaca

SEQ ID NO: 7090690 - DNA, 22 bp, Homo sapiens
cagagctgtgataaatagatat

SEQ ID NO: 7090691 - DNA, 22 bp, Homo sapiens
cagagctgttactattcatgaa

SEQ ID NO: 7090692 - DNA, 22 bp, Homo sapiens
cagagcagtctggagatccagc

SEQ ID NO: 7090693 - DNA, 22 bp, Homo sapiens
cagagcagtctggagatccagc

SEQ ID NO: 7090694 - DNA, 22 bp, Homo sapiens
cagagcagtctggagatccagc

SEQ ID NO: 7090695 - DNA, 22 bp, Homo sapiens
cagagcagtccttgtcaatcag

SEQ ID NO: 7090696 - DNA, 18 bp, Homo sapiens
cagagcagtatgaatgtt

SEQ ID NO: 7090697 - DNA, 18 bp, Homo sapiens
cagagcagtatgaatgtt

SEQ ID NO: 7090698 - DNA, 18 bp, Homo sapiens
cagagcagtatgaatgtt

SEQ ID NO: 7090699 - DNA, 22 bp, Homo sapiens
cagagcagtaaatctggggcac

SEQ ID NO: 7090700 - DNA, 22 bp, Homo sapiens
cagagcagtaaatctggggcac

SEQ ID NO: 7090701 - DNA, 22 bp, Homo sapiens
cagagcagtaaatctggggcac

SEQ ID NO: 7090702 - DNA, 22 bp, Homo sapiens
cagagcagtaaatctggggcac

SEQ ID NO: 7090703 - DNA, 22 bp, Homo sapiens
cagagcagtaaatctggggcac

SEQ ID NO: 7090704 - DNA, 22 bp, Homo sapiens
cagagcagtaaatctggggcac

SEQ ID NO: 7090705 - DNA, 22 bp, Homo sapiens
cagagcagtagaaaacagcctt

SEQ ID NO: 7090706 - DNA, 22 bp, Homo sapiens
cagagccaggcctgccctcttt

SEQ ID NO: 7090707 - DNA, 22 bp, Homo sapiens
cagagccaggcctgccctcttt

SEQ ID NO: 7090708 - DNA, 22 bp, Homo sapiens
cagagccaggcctgccctcttt

SEQ ID NO: 7090709 - DNA, 22 bp, Homo sapiens
cagagcagtctggagatccagc

SEQ ID NO: 7090710 - DNA, 22 bp, Homo sapiens
cagagcagtctggagatccagc

SEQ ID NO: 7090711 - DNA, 22 bp, Homo sapiens
cagagcagtctggagatccagc

SEQ ID NO: 7090712 - DNA, 22 bp, Homo sapiens
cagagcagtctggagatccagc

SEQ ID NO: 7090713 - DNA, 22 bp, Homo sapiens
cagagccagtcagtcagaaact

SEQ ID NO: 7090714 - DNA, 22 bp, Homo sapiens
cagagccagtcagtcagaaact

SEQ ID NO: 7090715 - DNA, 22 bp, Homo sapiens
cagagccaggtcttgaactcag

SEQ ID NO: 7090716 - DNA, 22 bp, Homo sapiens
cagagccagggttgcacccctg

SEQ ID NO: 7090717 - DNA, 22 bp, Homo sapiens
cagagccaggtctaggagtctc

SEQ ID NO: 7090718 - DNA, 22 bp, Homo sapiens
agccaggcgcagtggcttatgc

SEQ ID NO: 7090719 - DNA, 22 bp, Homo sapiens
agccaggctcaaggcctgctcc

SEQ ID NO: 7090720 - DNA, 22 bp, Homo sapiens
agccaggctcaaggcctgctcc

SEQ ID NO: 7090721 - DNA, 22 bp, Homo sapiens
agccaggccttttctcaaggtt

SEQ ID NO: 7090722 - DNA, 22 bp, Homo sapiens
agccaggccttttctcaaggtt

SEQ ID NO: 7090723 - DNA, 22 bp, Homo sapiens
agccaggccttttctcaaggtt

SEQ ID NO: 7090724 - DNA, 22 bp, Homo sapiens
agccaggccttttctcaaggtt

SEQ ID NO: 7090725 - DNA, 22 bp, Homo sapiens
agccaggccttttctcaaggtt

SEQ ID NO: 7090726 - DNA, 22 bp, Homo sapiens
agccaagaggagcctaaagcga

SEQ ID NO: 7090727 - DNA, 22 bp, Homo sapiens
agccaagcaccactggcactcg

SEQ ID NO: 7090728 - DNA, 22 bp, Homo sapiens
agccaagcaccactggcactcg

SEQ ID NO: 7090729 - DNA, 22 bp, Homo sapiens
agccaagcactcaactcctgga

SEQ ID NO: 7090730 - DNA, 22 bp, Homo sapiens
agccaagcactcaactcctgga

SEQ ID NO: 7090731 - DNA, 22 bp, Homo sapiens
agccaagcactcaactcctgga

SEQ ID NO: 7090732 - DNA, 20 bp, Homo sapiens
agccaagaacaggcagaacc

SEQ ID NO: 7090733 - DNA, 20 bp, Homo sapiens
agccaagaacaggcagaacc

SEQ ID NO: 7090734 - DNA, 22 bp, Homo sapiens
agccaagaagtgagtaatagta

SEQ ID NO: 7090735 - DNA, 22 bp, Homo sapiens
agccaagaagtgagtaatagta

SEQ ID NO: 7090736 - DNA, 22 bp, Homo sapiens
agccaagagatgaggctgcagg

SEQ ID NO: 7090737 - DNA, 22 bp, Homo sapiens
agccaagagatgaggctgcagg

SEQ ID NO: 7090738 - DNA, 22 bp, Homo sapiens
agccaagagatgaggctgcagg

SEQ ID NO: 7090739 - DNA, 16 bp, Homo sapiens
agccaggctgcctcgg

SEQ ID NO: 7090740 - DNA, 22 bp, Homo sapiens
agccaggctgcagttggctggc

SEQ ID NO: 7090741 - DNA, 16 bp, Homo sapiens
agccaggctgcctcgg

SEQ ID NO: 7090742 - DNA, 16 bp, Homo sapiens
agccaggctgcctcgg

SEQ ID NO: 7090743 - DNA, 16 bp, Homo sapiens
agccaggctgcctcgg

SEQ ID NO: 7090744 - DNA, 22 bp, Homo sapiens
agccagggaagaggcctacctc

SEQ ID NO: 7090745 - DNA, 22 bp, Homo sapiens
agccagggaagaggcctacctc

SEQ ID NO: 7090746 - DNA, 22 bp, Homo sapiens
agccagggaagaggcctacctc

SEQ ID NO: 7090747 - DNA, 22 bp, Homo sapiens
agccaggctgcagttggctggc

SEQ ID NO: 7090748 - DNA, 22 bp, Homo sapiens
agccaggctgcagttggctggc

SEQ ID NO: 7090749 - DNA, 22 bp, Homo sapiens
agccaggctgcagttggctggc

SEQ ID NO: 7090750 - DNA, 22 bp, Homo sapiens
agccaggctcaaggcctgctcc

SEQ ID NO: 7090751 - DNA, 22 bp, Homo sapiens
agccaggctcaaggcctgctcc

SEQ ID NO: 7090752 - DNA, 22 bp, Homo sapiens
agccagggacgctgcaggctac

SEQ ID NO: 7090753 - DNA, 22 bp, Homo sapiens
agccagggacgctgcaggctac

SEQ ID NO: 7090754 - DNA, 22 bp, Homo sapiens
agccagggacgctgcaggctac

SEQ ID NO: 7090755 - DNA, 22 bp, Homo sapiens
agccagggacgctgcaggctac

SEQ ID NO: 7090756 - DNA, 22 bp, Homo sapiens
agccagggacgctgcaggctac

SEQ ID NO: 7090757 - DNA, 22 bp, Homo sapiens
agccagggacgctgcaggctac

SEQ ID NO: 7090758 - DNA, 22 bp, Homo sapiens
agccagggacgctgcaggctac

SEQ ID NO: 7090759 - DNA, 22 bp, Homo sapiens
agccagggaagaggcctacctc

SEQ ID NO: 7090760 - DNA, 22 bp, Homo sapiens
agccagggaagaggcctacctc

SEQ ID NO: 7090761 - DNA, 22 bp, Homo sapiens
agccagggaagaggcctacctc

SEQ ID NO: 7090762 - DNA, 22 bp, Homo sapiens
agccagggaaggataacaagaa

SEQ ID NO: 7090763 - DNA, 22 bp, Homo sapiens
agccagggatgcagcacagtga

SEQ ID NO: 7090764 - DNA, 22 bp, Homo sapiens
agccagggaggtggaggttgca

SEQ ID NO: 7090765 - DNA, 22 bp, Homo sapiens
agccagggaggattacacccca

SEQ ID NO: 7090766 - DNA, 22 bp, Homo sapiens
agccagggaggattacacccca

SEQ ID NO: 7090767 - DNA, 22 bp, Homo sapiens
agccagggaggtggaggttgca

SEQ ID NO: 7090768 - DNA, 22 bp, Homo sapiens
agccagggacgctgcaggctac

SEQ ID NO: 7090769 - DNA, 22 bp, Homo sapiens
agccagggctctccttcgcgtg

SEQ ID NO: 7090770 - DNA, 23 bp, Homo sapiens
agccagggcactggtggagattg

SEQ ID NO: 7090771 - DNA, 23 bp, Homo sapiens
agccagggcactggtggagattg

SEQ ID NO: 7090772 - DNA, 23 bp, Homo sapiens
agccagggcactggtggagattg

SEQ ID NO: 7090773 - DNA, 22 bp, Homo sapiens
agccagggatgcagcacagtga

SEQ ID NO: 7090774 - DNA, 22 bp, Homo sapiens
agccagggatggcagtgcccag

SEQ ID NO: 7090775 - DNA, 22 bp, Homo sapiens
agccagggatggcagtgcccag

SEQ ID NO: 7090776 - DNA, 22 bp, Homo sapiens
agccagggatggcagtgcccag

SEQ ID NO: 7090777 - DNA, 22 bp, Homo sapiens
cagagcagggtgcaccttgggc

SEQ ID NO: 7090778 - DNA, 22 bp, Homo sapiens
cagagcagggtgcaccttgggc

SEQ ID NO: 7090779 - DNA, 22 bp, Homo sapiens
cagagcagggtgcaccttgggc

SEQ ID NO: 7090780 - DNA, 22 bp, Homo sapiens
cagagcagggtgcaccttgggc

SEQ ID NO: 7090781 - DNA, 22 bp, Homo sapiens
agccaggggagtcagctgctgg

SEQ ID NO: 7090782 - DNA, 22 bp, Homo sapiens
agccaggggagtcagctgctgg

SEQ ID NO: 7090783 - DNA, 22 bp, Homo sapiens
agccagggctgcaggttccttg

SEQ ID NO: 7090784 - DNA, 22 bp, Homo sapiens
agccagggctgcaggttccttg

SEQ ID NO: 7090785 - DNA, 22 bp, Homo sapiens
agccagggctgcgagcagacag

SEQ ID NO: 7090786 - DNA, 22 bp, Homo sapiens
agccagggctgcgagcagacag

SEQ ID NO: 7090787 - DNA, 22 bp, Homo sapiens
agccagggctgcgagcagacag

SEQ ID NO: 7090788 - DNA, 22 bp, Homo sapiens
agccaggggagtcagctgctgg

SEQ ID NO: 7090789 - DNA, 22 bp, Homo sapiens
agccaggggagtcagctgctgg

SEQ ID NO: 7090790 - DNA, 22 bp, Homo sapiens
agccaggggagtcagctgctgg

SEQ ID NO: 7090791 - DNA, 22 bp, Homo sapiens
agccaggggagtcagctgctgg

SEQ ID NO: 7090792 - DNA, 22 bp, Homo sapiens
agcgccttggcatcgccagact

SEQ ID NO: 7090793 - DNA, 22 bp, Homo sapiens
agcgctgtgggcgtgcgaggag

SEQ ID NO: 7090794 - DNA, 22 bp, Homo sapiens
agcgctggctggcgctccttcc

SEQ ID NO: 7090795 - DNA, 22 bp, Homo sapiens
agcgcctgcaccactctgcggc

SEQ ID NO: 7090796 - DNA, 22 bp, Homo sapiens
agcgcctgcggtgtgagcctgc

SEQ ID NO: 7090797 - DNA, 22 bp, Homo sapiens
agcgccactgcactccagcctg

SEQ ID NO: 7090798 - DNA, 22 bp, Homo sapiens
agcgccactgcactccagcctg

SEQ ID NO: 7090799 - DNA, 22 bp, Homo sapiens
agcgccactgcactccagcctg

SEQ ID NO: 7090800 - DNA, 22 bp, Homo sapiens
agcgagtgggtcagcgttgcag

SEQ ID NO: 7090801 - DNA, 22 bp, Homo sapiens
agcgcaggaacacgtctgcctt

SEQ ID NO: 7090802 - DNA, 22 bp, Homo sapiens
agcgagtgggtcagcgttgcag

SEQ ID NO: 7090803 - DNA, 22 bp, Homo sapiens
agcgaggttttgcagatacagc

SEQ ID NO: 7090804 - DNA, 22 bp, Homo sapiens
agcgagggaggtctgaggacag

SEQ ID NO: 7090805 - DNA, 22 bp, Homo sapiens
agcgaggttttgcagatacagc

SEQ ID NO: 7090806 - DNA, 22 bp, Homo sapiens
agcgccactgcactccagcctg

SEQ ID NO: 7090807 - DNA, 22 bp, Homo sapiens
agcgcaggaacacgtctgcctt

SEQ ID NO: 7090808 - DNA, 22 bp, Homo sapiens
agcgccactgcactccagcctg

SEQ ID NO: 7090809 - DNA, 22 bp, Homo sapiens
agcgccactgcactccagcctg

SEQ ID NO: 7090810 - DNA, 22 bp, Homo sapiens
agcgccactgcactccagcctg

SEQ ID NO: 7090811 - DNA, 22 bp, Homo sapiens
agcgccactgcactccagcctg

SEQ ID NO: 7090812 - DNA, 22 bp, Homo sapiens
agcgccactgcactccagcctg

SEQ ID NO: 7090813 - DNA, 22 bp, Homo sapiens
agcgagggaggtctgaggacag

SEQ ID NO: 7090814 - DNA, 22 bp, Homo sapiens
agcgagggaggtctgaggacag

SEQ ID NO: 7090815 - DNA, 22 bp, Homo sapiens
agcgagggaggtctgaggacag

SEQ ID NO: 7090816 - DNA, 22 bp, Homo sapiens
agcgacagaaaccaaggacaag

SEQ ID NO: 7090817 - DNA, 22 bp, Homo sapiens
agcgacagaaaccaaggacaag

SEQ ID NO: 7090818 - DNA, 22 bp, Homo sapiens
agcgagcacattgagtgaagaa

SEQ ID NO: 7090819 - DNA, 22 bp, Homo sapiens
cagcatgtaagccactgccctg

SEQ ID NO: 7090820 - DNA, 22 bp, Homo sapiens
cagcatgtatctttcaggtgtg

SEQ ID NO: 7090821 - DNA, 22 bp, Homo sapiens
cagcatgtggattcctcccact

SEQ ID NO: 7090822 - DNA, 22 bp, Homo sapiens
cagcatgttcttgtctcactgg

SEQ ID NO: 7090823 - DNA, 22 bp, Homo sapiens
agcgacaccgcctgcaggccat

SEQ ID NO: 7090824 - DNA, 22 bp, Homo sapiens
cagcatggtggagctgctcttt

SEQ ID NO: 7090825 - DNA, 22 bp, Homo sapiens
cagcatggttgggttctgggga

SEQ ID NO: 7090826 - DNA, 22 bp, Homo sapiens
cagcatgtaagccactgccctg

SEQ ID NO: 7090827 - DNA, 22 bp, Homo sapiens
cagcatgtatctttcaggtgtg

SEQ ID NO: 7090828 - DNA, 22 bp, Homo sapiens
cagcatggtgccagtgagtcca

SEQ ID NO: 7090829 - DNA, 22 bp, Homo sapiens
cagcatggtgccagtgagtcca

SEQ ID NO: 7090830 - DNA, 22 bp, Homo sapiens
cagcatgggttccgggggcctg

SEQ ID NO: 7090831 - DNA, 22 bp, Homo sapiens
cagcatgggttccgggggcctg

SEQ ID NO: 7090832 - DNA, 22 bp, Homo sapiens
cagcatgggttccgggggcctg

SEQ ID NO: 7090833 - DNA, 22 bp, Homo sapiens
cagcatggggcttggagtcagc

SEQ ID NO: 7090834 - DNA, 22 bp, Homo sapiens
cagcatggggcttggagtcagc

SEQ ID NO: 7090835 - DNA, 22 bp, Homo sapiens
cagcatggggcttggagtcagc

SEQ ID NO: 7090836 - DNA, 22 bp, Homo sapiens
cagcatgggggcaattcaggtg

SEQ ID NO: 7090837 - DNA, 22 bp, Homo sapiens
cagcactggggccactggagtt

SEQ ID NO: 7090838 - DNA, 22 bp, Homo sapiens
cagcactggggccactggagtt

SEQ ID NO: 7090839 - DNA, 22 bp, Homo sapiens
cagcactggggccactggagtt

SEQ ID NO: 7090840 - DNA, 22 bp, Homo sapiens
cagcactgggaccactagaaca

SEQ ID NO: 7090841 - DNA, 22 bp, Homo sapiens
cagcactgggaccactagaaca

SEQ ID NO: 7090842 - DNA, 22 bp, Homo sapiens
cagcactgcttcgcagccaggg

SEQ ID NO: 7090843 - DNA, 22 bp, Homo sapiens
cagcactgcttcgcagccaggg

SEQ ID NO: 7090844 - DNA, 22 bp, Homo sapiens
cagcactgcttcgcagccaggg

SEQ ID NO: 7090845 - DNA, 22 bp, Homo sapiens
cagcactggggggattcggagc

SEQ ID NO: 7090846 - DNA, 22 bp, Homo sapiens
cagcactgtgataactgagcca

SEQ ID NO: 7090847 - DNA, 22 bp, Homo sapiens
cagcactgttcccagaccactg

SEQ ID NO: 7090848 - DNA, 22 bp, Homo sapiens
cagcactgttcccagaccactg

SEQ ID NO: 7090849 - DNA, 22 bp, Homo sapiens
cagcactgttcccagaccactg

SEQ ID NO: 7090850 - DNA, 22 bp, Homo sapiens
cagcactgttcccagaccactg

SEQ ID NO: 7090851 - DNA, 22 bp, Homo sapiens
cagcactttagcggaggcatca

SEQ ID NO: 7090852 - DNA, 22 bp, Homo sapiens
cagcacttggtgccattgagtg

SEQ ID NO: 7090853 - DNA, 22 bp, Homo sapiens
cagcactttagcggaggcatca

SEQ ID NO: 7090854 - DNA, 22 bp, Homo sapiens
cagcagaaaatacctgtaactc

SEQ ID NO: 7090855 - DNA, 22 bp, Homo sapiens
cagcagaaaatacctgtaactc

SEQ ID NO: 7090856 - DNA, 22 bp, Homo sapiens
cagcagaaaatgtgggtgattt

SEQ ID NO: 7090857 - DNA, 22 bp, Homo sapiens
cagcagaaaatgtgggtgattt

SEQ ID NO: 7090858 - DNA, 22 bp, Homo sapiens
cagcatcaccaacttgagcaat

SEQ ID NO: 7090859 - DNA, 22 bp, Homo sapiens
cagcatggacaggggtggcgtt

SEQ ID NO: 7090860 - DNA, 22 bp, Homo sapiens
cagcatggacccatcgctgagt

SEQ ID NO: 7090861 - DNA, 22 bp, Homo sapiens
cagcatggagacaaagtgggca

SEQ ID NO: 7090862 - DNA, 22 bp, Homo sapiens
cagcatggccatttctcgctgc

SEQ ID NO: 7090863 - DNA, 22 bp, Homo sapiens
cagcatggcttgagtgtttcct

SEQ ID NO: 7090864 - DNA, 22 bp, Homo sapiens
cagcatggcttgagtgtttcct

SEQ ID NO: 7090865 - DNA, 22 bp, Homo sapiens
cagcatggggatcactgtaggc

SEQ ID NO: 7090866 - DNA, 20 bp, Homo sapiens
cagcctccactcactcagct

SEQ ID NO: 7090867 - DNA, 22 bp, Homo sapiens
cagcctcctgggacactcaccg

SEQ ID NO: 7090868 - DNA, 22 bp, Homo sapiens
cagcctcctgggacactcaccg

SEQ ID NO: 7090869 - DNA, 22 bp, Homo sapiens
cagccctggtgaggttggctat

SEQ ID NO: 7090870 - DNA, 22 bp, Homo sapiens
cagccctggtgaggttggctat

SEQ ID NO: 7090871 - DNA, 22 bp, Homo sapiens
cagccctggtgaggttggctat

SEQ ID NO: 7090872 - DNA, 22 bp, Homo sapiens
cagccctggtgaggttggctat

SEQ ID NO: 7090873 - DNA, 22 bp, Homo sapiens
cagcccattcctgccatgccgc

SEQ ID NO: 7090874 - DNA, 22 bp, Homo sapiens
cagcccatttctgggacctgag

SEQ ID NO: 7090875 - DNA, 22 bp, Homo sapiens
cagccccacacggtctagctct

SEQ ID NO: 7090876 - DNA, 22 bp, Homo sapiens
cagccccacacggtctagctct

SEQ ID NO: 7090877 - DNA, 22 bp, Homo sapiens
cagccccacacggtctagctct

SEQ ID NO: 7090878 - DNA, 22 bp, Homo sapiens
cagccctgggtccctgccctgg

SEQ ID NO: 7090879 - DNA, 22 bp, Homo sapiens
cagcctcctgggacactcaccg

SEQ ID NO: 7090880 - DNA, 22 bp, Homo sapiens
cagcctcctgggacactcaccg

SEQ ID NO: 7090881 - DNA, 22 bp, Homo sapiens
cagcctctaagcacagcctctc

SEQ ID NO: 7090882 - DNA, 22 bp, Homo sapiens
cagcctctaagcacagcctctc

SEQ ID NO: 7090883 - DNA, 22 bp, Homo sapiens
cagcctctaagcacagcctctc

SEQ ID NO: 7090884 - DNA, 22 bp, Homo sapiens
cagcctctaagcacagcctctc

SEQ ID NO: 7090885 - DNA, 22 bp, Homo sapiens
cagcctcctgggacactcaccg

SEQ ID NO: 7090886 - DNA, 22 bp, Homo sapiens
cagcctctaagcacagcctctc

SEQ ID NO: 7090887 - DNA, 22 bp, Homo sapiens
cagcctctaagcacagcctctc

SEQ ID NO: 7090888 - DNA, 22 bp, Homo sapiens
cagcctctaagcacagcctctc

SEQ ID NO: 7090889 - DNA, 22 bp, Homo sapiens
cagcctctctgtatctcaggat

SEQ ID NO: 7090890 - DNA, 22 bp, Homo sapiens
cagcctctctgtatctcaggat

SEQ ID NO: 7090891 - DNA, 22 bp, Homo sapiens
cagcctctctgtatctcaggat

SEQ ID NO: 7090892 - DNA, 22 bp, Homo sapiens
cagcctctctgtatctcaggat

SEQ ID NO: 7090893 - DNA, 19 bp, Homo sapiens
cagcccagggtgctaccaa

SEQ ID NO: 7090894 - DNA, 22 bp, Homo sapiens
cagcccaggtctctcttccagt

SEQ ID NO: 7090895 - DNA, 22 bp, Homo sapiens
cagcccaggtctctcttccagt

SEQ ID NO: 7090896 - DNA, 22 bp, Homo sapiens
cagcccaggtctctcttccagt

SEQ ID NO: 7090897 - DNA, 22 bp, Homo sapiens
cagcccaggtctctcttccagt

SEQ ID NO: 7090898 - DNA, 22 bp, Homo sapiens
cagcccaggtctctcttccagt

SEQ ID NO: 7090899 - DNA, 22 bp, Homo sapiens
cagcccaggtctctcttccagt

SEQ ID NO: 7090900 - DNA, 22 bp, Homo sapiens
cagcccaggtctctcttccagt

SEQ ID NO: 7090901 - DNA, 22 bp, Homo sapiens
cagcccaggtggcggaggttgc

SEQ ID NO: 7090902 - DNA, 22 bp, Homo sapiens
cagcccaggtggcggaggttgc

SEQ ID NO: 7090903 - DNA, 22 bp, Homo sapiens
cagcccaggtggcggaggttgc

SEQ ID NO: 7090904 - DNA, 22 bp, Homo sapiens
cagcccagtaccaagcagttgg

SEQ ID NO: 7090905 - DNA, 22 bp, Homo sapiens
cagcccagtaccaagcagttgg

SEQ ID NO: 7090906 - DNA, 22 bp, Homo sapiens
cagcccagtaccaagcagttgg

SEQ ID NO: 7090907 - DNA, 22 bp, Homo sapiens
cagcccagtgcacgcccgtttc

SEQ ID NO: 7090908 - DNA, 22 bp, Homo sapiens
cagcccagtgcacgcccgtttc

SEQ ID NO: 7090909 - DNA, 22 bp, Homo sapiens
cagcccagtgcacgcccgtttc

SEQ ID NO: 7090910 - DNA, 22 bp, Homo sapiens
cagcccagtgcacgcccgtttc

SEQ ID NO: 7090911 - DNA, 22 bp, Homo sapiens
cagcccagtgcacgcccgtttc

SEQ ID NO: 7090912 - DNA, 22 bp, Homo sapiens
cagcccagtgcatttgtgtact

SEQ ID NO: 7090913 - DNA, 22 bp, Homo sapiens
cagcccagtgcatttgtgtact

SEQ ID NO: 7090914 - DNA, 22 bp, Homo sapiens
cagcccagtgcatttgtgtact

SEQ ID NO: 7090915 - DNA, 22 bp, Homo sapiens
cagcccatccaaggcttggcat

SEQ ID NO: 7090916 - DNA, 22 bp, Homo sapiens
cagcccatggtttgtggccagt

SEQ ID NO: 7090917 - DNA, 22 bp, Homo sapiens
cagccatcagtaaagacagctt

SEQ ID NO: 7090918 - DNA, 22 bp, Homo sapiens
cagccatcagtaaagacagctt

SEQ ID NO: 7090919 - DNA, 23 bp, Homo sapiens
cagcccaaagagagagctacttt

SEQ ID NO: 7090920 - DNA, 22 bp, Homo sapiens
cagcccaaagccccaggctaga

SEQ ID NO: 7090921 - DNA, 22 bp, Homo sapiens
cagcccacgtcagggccactca

SEQ ID NO: 7090922 - DNA, 22 bp, Homo sapiens
cagcccacgtcagggccactca

SEQ ID NO: 7090923 - DNA, 22 bp, Homo sapiens
cagcccactgcctctgtggtag

SEQ ID NO: 7090924 - DNA, 22 bp, Homo sapiens
cagcccactgcctctgtggtag

SEQ ID NO: 7090925 - DNA, 22 bp, Homo sapiens
cagcccacgtcagggccactca

SEQ ID NO: 7090926 - DNA, 22 bp, Homo sapiens
cagccagtgtgaccgaggagga

SEQ ID NO: 7090927 - DNA, 22 bp, Homo sapiens
cagccagctggcactgtgagta

SEQ ID NO: 7090928 - DNA, 22 bp, Homo sapiens
cagccagctggcactgtgagta

SEQ ID NO: 7090929 - DNA, 22 bp, Homo sapiens
agcgctgtgggcgtgcgaggag

SEQ ID NO: 7090930 - DNA, 22 bp, Homo sapiens
agcgcttgccgcactccaagca

SEQ ID NO: 7090931 - DNA, 22 bp, Homo sapiens
agcgcttgccgcactccaagca

SEQ ID NO: 7090932 - DNA, 20 bp, Homo sapiens
agcggaccaggccattgttg

SEQ ID NO: 7090933 - DNA, 22 bp, Homo sapiens
agcggaaggcctggctgatccg

SEQ ID NO: 7090934 - DNA, 22 bp, Homo sapiens
cagcccacttcccagcacctac

SEQ ID NO: 7090935 - DNA, 22 bp, Homo sapiens
cagcccacttcccagcacctac

SEQ ID NO: 7090936 - DNA, 22 bp, Homo sapiens
cagcccacttcccagcacctac

SEQ ID NO: 7090937 - DNA, 22 bp, Homo sapiens
cagcccagaactcacgtctcca

SEQ ID NO: 7090938 - DNA, 22 bp, Homo sapiens
cagcccagaactcacgtctcca

SEQ ID NO: 7090939 - DNA, 22 bp, Homo sapiens
cagcccagaactcacgtctcca

SEQ ID NO: 7090940 - DNA, 22 bp, Homo sapiens
cagcccagacaccatcattcta

SEQ ID NO: 7090941 - DNA, 22 bp, Homo sapiens
cagcccagacaccatcattcta

SEQ ID NO: 7090942 - DNA, 22 bp, Homo sapiens
cagcccagagaaggggcccgtg

SEQ ID NO: 7090943 - DNA, 22 bp, Homo sapiens
cagcccagagaaggggcccgtg

SEQ ID NO: 7090944 - DNA, 22 bp, Homo sapiens
cagcccagagaaggggcccgtg

SEQ ID NO: 7090945 - DNA, 22 bp, Homo sapiens
cagcccagagaaggggcccgtg

SEQ ID NO: 7090946 - DNA, 22 bp, Homo sapiens
cagcccagagaaggggcccgtg

SEQ ID NO: 7090947 - DNA, 22 bp, Homo sapiens
cagcccagagatgttatctagt

SEQ ID NO: 7090948 - DNA, 21 bp, Homo sapiens
cagcccagagcagtggggcca

SEQ ID NO: 7090949 - DNA, 21 bp, Homo sapiens
cagcccagagcagtggggcca

SEQ ID NO: 7090950 - DNA, 21 bp, Homo sapiens
cagcccagagcagtggggcca

SEQ ID NO: 7090951 - DNA, 21 bp, Homo sapiens
cagcccagagcagtggggcca

SEQ ID NO: 7090952 - DNA, 21 bp, Homo sapiens
cagcccagagcagtggggcca

SEQ ID NO: 7090953 - DNA, 21 bp, Homo sapiens
cagcccagagcagtggggcca

SEQ ID NO: 7090954 - DNA, 16 bp, Homo sapiens
cagcccaggggcgggc

SEQ ID NO: 7090955 - DNA, 16 bp, Homo sapiens
cagcccaggggcgggc

SEQ ID NO: 7090956 - DNA, 19 bp, Homo sapiens
cagcccagggtgctaccaa

SEQ ID NO: 7090957 - DNA, 19 bp, Homo sapiens
cagcccagggtgctaccaa

SEQ ID NO: 7090958 - DNA, 22 bp, Homo sapiens
cagcctttgaacttcagaggtt

SEQ ID NO: 7090959 - DNA, 22 bp, Homo sapiens
cagcctttgggtcagaagattc

SEQ ID NO: 7090960 - DNA, 22 bp, Homo sapiens
cagcctttgggtcagaagattc

SEQ ID NO: 7090961 - DNA, 22 bp, Homo sapiens
cagcctttgaacttcagaggtt

SEQ ID NO: 7090962 - DNA, 22 bp, Homo sapiens
cagcgagagacaaagagctgtg

SEQ ID NO: 7090963 - DNA, 22 bp, Homo sapiens
cagcgagagacaaagagctgtg

SEQ ID NO: 7090964 - DNA, 22 bp, Homo sapiens
cagcgaggtgaagggtacaagc

SEQ ID NO: 7090965 - DNA, 22 bp, Homo sapiens
cagcgctggggtaggagcacct

SEQ ID NO: 7090966 - DNA, 22 bp, Homo sapiens
cagcgctggggtaggagcacct

SEQ ID NO: 7090967 - DNA, 22 bp, Homo sapiens
cagctgagagtagaaatggagg

SEQ ID NO: 7090968 - DNA, 22 bp, Homo sapiens
cagcgtctcgttgtgggcctcg

SEQ ID NO: 7090969 - DNA, 22 bp, Homo sapiens
cagcggggcctgtgctggggag

SEQ ID NO: 7090970 - DNA, 22 bp, Homo sapiens
cagcggggcctgtgctggggag

SEQ ID NO: 7090971 - DNA, 22 bp, Homo sapiens
cagcggggcctgtgctggggag

SEQ ID NO: 7090972 - DNA, 22 bp, Homo sapiens
cagcgctggggtaggagcacct

SEQ ID NO: 7090973 - DNA, 22 bp, Homo sapiens
cagcgctgtgggaacagggcta

SEQ ID NO: 7090974 - DNA, 22 bp, Homo sapiens
cagcgctgtgggaacagggcta

SEQ ID NO: 7090975 - DNA, 22 bp, Homo sapiens
cagcggaggacagatgggagct

SEQ ID NO: 7090976 - DNA, 22 bp, Homo sapiens
cagcctttctgtttcctaaggt

SEQ ID NO: 7090977 - DNA, 22 bp, Homo sapiens
cagcctttaagcttggataggt

SEQ ID NO: 7090978 - DNA, 22 bp, Homo sapiens
cagcctttagcattaattccaa

SEQ ID NO: 7090979 - DNA, 22 bp, Homo sapiens
cagccttcgacagttggagtag

SEQ ID NO: 7090980 - DNA, 22 bp, Homo sapiens
cagcctctttccacatcaggca

SEQ ID NO: 7090981 - DNA, 22 bp, Homo sapiens
cagcctctttccacatcaggca

SEQ ID NO: 7090982 - DNA, 22 bp, Homo sapiens
cagccttcgacagttggagtag

SEQ ID NO: 7090983 - DNA, 22 bp, Homo sapiens
cagcctctgtggctgccacacc

SEQ ID NO: 7090984 - DNA, 22 bp, Homo sapiens
cagcctctgtggctgccacacc

SEQ ID NO: 7090985 - DNA, 22 bp, Homo sapiens
cagcctctgtggctgccacacc

SEQ ID NO: 7090986 - DNA, 22 bp, Homo sapiens
cagcctctgagccttggcagat

SEQ ID NO: 7090987 - DNA, 22 bp, Homo sapiens
cagcctctgagccttggcagat

SEQ ID NO: 7090988 - DNA, 22 bp, Homo sapiens
cagcctctctgtatctcaggat

SEQ ID NO: 7090989 - DNA, 22 bp, Homo sapiens
cagcctctgacaccacagtcgt

SEQ ID NO: 7090990 - DNA, 22 bp, Homo sapiens
cagcctctgacaccacagtcgt

SEQ ID NO: 7090991 - DNA, 22 bp, Homo sapiens
cagcctctctgtatctcaggat

SEQ ID NO: 7090992 - DNA, 18 bp, Homo sapiens
cagctgccagctcatgga

SEQ ID NO: 7090993 - DNA, 18 bp, Homo sapiens
cagctgccagctcatgga

SEQ ID NO: 7090994 - DNA, 18 bp, Homo sapiens
cagctgccagctcatgga

SEQ ID NO: 7090995 - DNA, 22 bp, Homo sapiens
cagctgagcatcactagtctgg

SEQ ID NO: 7090996 - DNA, 22 bp, Homo sapiens
cagctgagagtagaaatggagg

SEQ ID NO: 7090997 - DNA, 18 bp, Homo sapiens
cagctgccagctcatgga

SEQ ID NO: 7090998 - DNA, 18 bp, Homo sapiens
cagctgccagctcatgga

SEQ ID NO: 7090999 - DNA, 22 bp, Homo sapiens
cagctgccagcttctctccatc

SEQ ID NO: 7091000 - DNA, 22 bp, Homo sapiens
cagctgccagcttctctccatc

SEQ ID NO: 7091001 - DNA, 22 bp, Homo sapiens
cagctgccagcttctctccatc

SEQ ID NO: 7091002 - DNA, 22 bp, Homo sapiens
cagctgccatgacatgtcctgc

SEQ ID NO: 7091003 - DNA, 22 bp, Homo sapiens
cagctgccatgacatgtcctgc

SEQ ID NO: 7091004 - DNA, 22 bp, Homo sapiens
cagctgccatgacatgtcctgc

SEQ ID NO: 7091005 - DNA, 22 bp, Homo sapiens
cagctgcccaggccacctggag

SEQ ID NO: 7091006 - DNA, 22 bp, Homo sapiens
cagctgcccaggccacctggag

SEQ ID NO: 7091007 - DNA, 22 bp, Homo sapiens
cagctgcccaagccccagatgt

SEQ ID NO: 7091008 - DNA, 22 bp, Homo sapiens
cagctgcccaggccacctggag

SEQ ID NO: 7091009 - DNA, 22 bp, Homo sapiens
cagctgcccatcctgggaaatg

SEQ ID NO: 7091010 - DNA, 22 bp, Homo sapiens
cagctgccccgctggctgacca

SEQ ID NO: 7091011 - DNA, 22 bp, Homo sapiens
cagctgccccgctggctgacca

SEQ ID NO: 7091012 - DNA, 22 bp, Homo sapiens
cagctgccccataaatcacagt

SEQ ID NO: 7091013 - DNA, 22 bp, Homo sapiens
cagctgccccgctggctgacca

SEQ ID NO: 7091014 - DNA, 22 bp, Homo sapiens
cagctgcccctccagggctggg

SEQ ID NO: 7091015 - DNA, 22 bp, Homo sapiens
agctctggaagccctggtagtt

SEQ ID NO: 7091016 - DNA, 22 bp, Homo sapiens
agctctggaataatgatgtgat

SEQ ID NO: 7091017 - DNA, 22 bp, Homo sapiens
cagctgcccctccagggctggg

SEQ ID NO: 7091018 - DNA, 22 bp, Homo sapiens
agctctggacctgacatctggt

SEQ ID NO: 7091019 - DNA, 22 bp, Homo sapiens
agctctggacctgacatctggt

SEQ ID NO: 7091020 - DNA, 22 bp, Homo sapiens
agctctggacctgacatctggt

SEQ ID NO: 7091021 - DNA, 21 bp, Homo sapiens
agctctggagcagcaatcaag

SEQ ID NO: 7091022 - DNA, 21 bp, Homo sapiens
agctctggagcagcaatcaag

SEQ ID NO: 7091023 - DNA, 21 bp, Homo sapiens
agctctggagcagcaatcaag

SEQ ID NO: 7091024 - DNA, 22 bp, Homo sapiens
agctctggagccggaggatttc

SEQ ID NO: 7091025 - DNA, 22 bp, Homo sapiens
agctctggagccggaggatttc

SEQ ID NO: 7091026 - DNA, 22 bp, Homo sapiens
agctctggagccggaggatttc

SEQ ID NO: 7091027 - DNA, 17 bp, Homo sapiens
agctgagctggccaggg

SEQ ID NO: 7091028 - DNA, 17 bp, Homo sapiens
agctgagctggccaggg

SEQ ID NO: 7091029 - DNA, 22 bp, Homo sapiens
agctgagctcaggctgatgtaa

SEQ ID NO: 7091030 - DNA, 22 bp, Homo sapiens
agctgagctcaggctgatgtaa

SEQ ID NO: 7091031 - DNA, 22 bp, Homo sapiens
agctgagccagcagcaacagga

SEQ ID NO: 7091032 - DNA, 21 bp, Homo sapiens
agctgagcccagaagactggt

SEQ ID NO: 7091033 - DNA, 22 bp, Homo sapiens
agctgaggacgtgaagggcggc

SEQ ID NO: 7091034 - DNA, 22 bp, Homo sapiens
agctgaggaataataacaaggt

SEQ ID NO: 7091035 - DNA, 22 bp, Homo sapiens
agctgaggaataataacaaggt

SEQ ID NO: 7091036 - DNA, 22 bp, Homo sapiens
agctgaggacgtgaagggcggc

SEQ ID NO: 7091037 - DNA, 22 bp, Homo sapiens
agctgaggaataataacaaggt

SEQ ID NO: 7091038 - DNA, 22 bp, Homo sapiens
agctgaggaataataacaaggt

SEQ ID NO: 7091039 - DNA, 22 bp, Homo sapiens
agctgaggaggaatgatgggta

SEQ ID NO: 7091040 - DNA, 22 bp, Homo sapiens
agctgaggaggaatgatgggta

SEQ ID NO: 7091041 - DNA, 22 bp, Homo sapiens
agctgaggacgtgaagggcggc

SEQ ID NO: 7091042 - DNA, 22 bp, Homo sapiens
agctgaggaggaatgatgggta

SEQ ID NO: 7091043 - DNA, 22 bp, Homo sapiens
agctgaggaggaatgatgggta

SEQ ID NO: 7091044 - DNA, 22 bp, Homo sapiens
agctgaggaggaatgatgggta

SEQ ID NO: 7091045 - DNA, 22 bp, Homo sapiens
agctgaggaggaatgatgggta

SEQ ID NO: 7091046 - DNA, 20 bp, Homo sapiens
agctgaagatctggatgggg

SEQ ID NO: 7091047 - DNA, 20 bp, Homo sapiens
agctgaagatctggatgggg

SEQ ID NO: 7091048 - DNA, 20 bp, Homo sapiens
agctgaagatctggatgggg

SEQ ID NO: 7091049 - DNA, 20 bp, Homo sapiens
agctgaagatctggatgggg

SEQ ID NO: 7091050 - DNA, 22 bp, Homo sapiens
agctgaagcaacaacaggatgg

SEQ ID NO: 7091051 - DNA, 22 bp, Homo sapiens
agctgaagacctcaagtaagag

SEQ ID NO: 7091052 - DNA, 22 bp, Homo sapiens
agctgaagatccagggttgggg

SEQ ID NO: 7091053 - DNA, 22 bp, Homo sapiens
agctgaagatccagggttgggg

SEQ ID NO: 7091054 - DNA, 22 bp, Homo sapiens
agctctgggagtagttccacct

SEQ ID NO: 7091055 - DNA, 22 bp, Homo sapiens
agctctgggagtagttccacct

SEQ ID NO: 7091056 - DNA, 22 bp, Homo sapiens
agctctgggattctcaggccac

SEQ ID NO: 7091057 - DNA, 22 bp, Homo sapiens
agctctgggattctcaggccac

SEQ ID NO: 7091058 - DNA, 22 bp, Homo sapiens
agctctggagccggaggatttc

SEQ ID NO: 7091059 - DNA, 19 bp, Homo sapiens
agctctggattaaatttct

SEQ ID NO: 7091060 - DNA, 22 bp, Homo sapiens
agctctggcactggcgcgggat

SEQ ID NO: 7091061 - DNA, 22 bp, Homo sapiens
agctctggcactggcgcgggat

SEQ ID NO: 7091062 - DNA, 22 bp, Homo sapiens
agctctggcactggcgcgggat

SEQ ID NO: 7091063 - DNA, 22 bp, Homo sapiens
agctctggcactggcgcgggat

SEQ ID NO: 7091064 - DNA, 22 bp, Homo sapiens
agctctggcactggcgcgggat

SEQ ID NO: 7091065 - DNA, 22 bp, Homo sapiens
agctctggcactggcgcgggat

SEQ ID NO: 7091066 - DNA, 18 bp, Homo sapiens
agctctggcatacttgaa

SEQ ID NO: 7091067 - DNA, 23 bp, Homo sapiens
agctctggcgttggggaggtagt

SEQ ID NO: 7091068 - DNA, 23 bp, Homo sapiens
agctctggcgttggggaggtagt

SEQ ID NO: 7091069 - DNA, 23 bp, Homo sapiens
agctctggcgttggggaggtagt

SEQ ID NO: 7091070 - DNA, 22 bp, Homo sapiens
agctctggctaagctgataaat

SEQ ID NO: 7091071 - DNA, 22 bp, Homo sapiens
agctctgggagtagttccacct

SEQ ID NO: 7091072 - DNA, 22 bp, Homo sapiens
cagctggcagccctggccctgc

SEQ ID NO: 7091073 - DNA, 22 bp, Homo sapiens
cagctggcatacctgggcccgg

SEQ ID NO: 7091074 - DNA, 22 bp, Homo sapiens
cagctggcatacctgggcccgg

SEQ ID NO: 7091075 - DNA, 22 bp, Homo sapiens
cagctgggtgatcttgggcagg

SEQ ID NO: 7091076 - DNA, 22 bp, Homo sapiens
cagctgggtggctcttctgctc

SEQ ID NO: 7091077 - DNA, 22 bp, Homo sapiens
cagctgggtggctcttctgctc

SEQ ID NO: 7091078 - DNA, 22 bp, Homo sapiens
cagctggcagaacctgcatcca

SEQ ID NO: 7091079 - DNA, 22 bp, Homo sapiens
cagctggcaagtggagcagggt

SEQ ID NO: 7091080 - DNA, 22 bp, Homo sapiens
cagctggcaagtggagcagggt

SEQ ID NO: 7091081 - DNA, 22 bp, Homo sapiens
cagctggatgggagaccatgtt

SEQ ID NO: 7091082 - DNA, 22 bp, Homo sapiens
cagctggatgggagaccatgtt

SEQ ID NO: 7091083 - DNA, 22 bp, Homo sapiens
cagctggcaagtggagcagggt

SEQ ID NO: 7091084 - DNA, 22 bp, Homo sapiens
cagctgctttcagcaggaggga

SEQ ID NO: 7091085 - DNA, 22 bp, Homo sapiens
cagctgctttcagcaggaggga

SEQ ID NO: 7091086 - DNA, 23 bp, Homo sapiens
agctgaggcagaggggcattctc

SEQ ID NO: 7091087 - DNA, 22 bp, Homo sapiens
cagctgctttcagcaggaggga

SEQ ID NO: 7091088 - DNA, 20 bp, Homo sapiens
agctgaggcacctgaggtta

SEQ ID NO: 7091089 - DNA, 20 bp, Homo sapiens
agctgaggcacctgaggtta

SEQ ID NO: 7091090 - DNA, 20 bp, Homo sapiens
agctgaggcacctgaggtta

SEQ ID NO: 7091091 - DNA, 20 bp, Homo sapiens
agctgaggcacctgaggtta

SEQ ID NO: 7091092 - DNA, 20 bp, Homo sapiens
agctgaggcacctgaggtta

SEQ ID NO: 7091093 - DNA, 23 bp, Homo sapiens
agctgaggcagaggggcattctc

SEQ ID NO: 7091094 - DNA, 19 bp, Homo sapiens
cagctggaatcatctgagg

SEQ ID NO: 7091095 - DNA, 19 bp, Homo sapiens
cagctggaatcatctgagg

SEQ ID NO: 7091096 - DNA, 22 bp, Homo sapiens
cagctggactgggatgtagcga

SEQ ID NO: 7091097 - DNA, 22 bp, Homo sapiens
cagctggacttttgatagaagt

SEQ ID NO: 7091098 - DNA, 22 bp, Homo sapiens
cagctggatccctgcagaactt

SEQ ID NO: 7091099 - DNA, 22 bp, Homo sapiens
cagctggatccctgcagaactt

SEQ ID NO: 7091100 - DNA, 22 bp, Homo sapiens
cagctggatctgcctcgagcca

SEQ ID NO: 7091101 - DNA, 22 bp, Homo sapiens
attcgcgggcctggagggtggg

SEQ ID NO: 7091102 - DNA, 20 bp, Homo sapiens
attctaaagctctgctcttt

SEQ ID NO: 7091103 - DNA, 22 bp, Homo sapiens
attctaaatgtaatttagaatt

SEQ ID NO: 7091104 - DNA, 22 bp, Homo sapiens
attctaaatgtaatttagaatt

SEQ ID NO: 7091105 - DNA, 22 bp, Homo sapiens
attctaaatgtaatttagaatt

SEQ ID NO: 7091106 - DNA, 22 bp, Homo sapiens
attctacaaaagaactggatct

SEQ ID NO: 7091107 - DNA, 22 bp, Homo sapiens
attctacaacccaataataatt

SEQ ID NO: 7091108 - DNA, 22 bp, Homo sapiens
attctacaacccaataataatt

SEQ ID NO: 7091109 - DNA, 22 bp, Homo sapiens
attctacaacccaataataatt

SEQ ID NO: 7091110 - DNA, 22 bp, Homo sapiens
attctaatgccctggccccagc

SEQ ID NO: 7091111 - DNA, 22 bp, Homo sapiens
attctaatggcagagactcctg

SEQ ID NO: 7091112 - DNA, 22 bp, Homo sapiens
attctaattagttctacatgtt

SEQ ID NO: 7091113 - DNA, 22 bp, Homo sapiens
attctaattagttctacatgtt

SEQ ID NO: 7091114 - DNA, 22 bp, Homo sapiens
attcaaagaacctttagcattg

SEQ ID NO: 7091115 - DNA, 22 bp, Homo sapiens
attcaaagaacctttagcattg

SEQ ID NO: 7091116 - DNA, 22 bp, Homo sapiens
attcccaggtaaaagtagagct

SEQ ID NO: 7091117 - DNA, 22 bp, Homo sapiens
attcccaggtaaaagtagagct

SEQ ID NO: 7091118 - DNA, 22 bp, Homo sapiens
attcccatcgtcaacttcactg

SEQ ID NO: 7091119 - DNA, 22 bp, Homo sapiens
attcaaaagaccatgcagactc

SEQ ID NO: 7091120 - DNA, 22 bp, Homo sapiens
attcaaaagaccatgcagactc

SEQ ID NO: 7091121 - DNA, 22 bp, Homo sapiens
attcaaaagaccatgcagactc

SEQ ID NO: 7091122 - DNA, 22 bp, Homo sapiens
attctctcttctgctgcccgtg

SEQ ID NO: 7091123 - DNA, 22 bp, Homo sapiens
attctctcatttatctgtccta

SEQ ID NO: 7091124 - DNA, 22 bp, Homo sapiens
attctccttattctgaaaaaag

SEQ ID NO: 7091125 - DNA, 22 bp, Homo sapiens
attctccttctattaagttatt

SEQ ID NO: 7091126 - DNA, 22 bp, Homo sapiens
attctctagtctcttccataaa

SEQ ID NO: 7091127 - DNA, 22 bp, Homo sapiens
attctccatcaccactggcact

SEQ ID NO: 7091128 - DNA, 22 bp, Homo sapiens
attctccatcaccactggcact

SEQ ID NO: 7091129 - DNA, 22 bp, Homo sapiens
attctccagtagtcattctatc

SEQ ID NO: 7091130 - DNA, 22 bp, Homo sapiens
attctccagctcactgtccata

SEQ ID NO: 7091131 - DNA, 22 bp, Homo sapiens
attctccagctcactgtccata

SEQ ID NO: 7091132 - DNA, 22 bp, Homo sapiens
attctccagctcactgtccata

SEQ ID NO: 7091133 - DNA, 20 bp, Homo sapiens
attctacaagaataagcatg

SEQ ID NO: 7091134 - DNA, 20 bp, Homo sapiens
attctacaagaataagcatg

SEQ ID NO: 7091135 - DNA, 22 bp, Homo sapiens
attctacaatcatgtagatcct

SEQ ID NO: 7091136 - DNA, 22 bp, Homo sapiens
attctacaatcatgtagatcct

SEQ ID NO: 7091137 - DNA, 22 bp, Homo sapiens
attctacaacccaataataatt

SEQ ID NO: 7091138 - DNA, 20 bp, Homo sapiens
attctacaagaataagcatg

SEQ ID NO: 7091139 - DNA, 20 bp, Homo sapiens
attctacaagaataagcatg

SEQ ID NO: 7091140 - DNA, 22 bp, Homo sapiens
attctctgccattgcggtggat

SEQ ID NO: 7091141 - DNA, 22 bp, Homo sapiens
attctctgaagtcaatggaaat

SEQ ID NO: 7091142 - DNA, 22 bp, Homo sapiens
attctctgggttccagtaaatg

SEQ ID NO: 7091143 - DNA, 22 bp, Homo sapiens
attctctggtcattgagcatat

SEQ ID NO: 7091144 - DNA, 22 bp, Homo sapiens
attctctgtacagaaggtaccg

SEQ ID NO: 7091145 - DNA, 22 bp, Homo sapiens
attctctgtagatggcttgaga

SEQ ID NO: 7091146 - DNA, 22 bp, Homo sapiens
attctctgtctttttgaaaaca

SEQ ID NO: 7091147 - DNA, 22 bp, Homo sapiens
attcttctgcctactttcatcc

SEQ ID NO: 7091148 - DNA, 22 bp, Homo sapiens
attgaaaaatgactattgctta

SEQ ID NO: 7091149 - DNA, 22 bp, Homo sapiens
agaggccggccgagcccatggg

SEQ ID NO: 7091150 - DNA, 22 bp, Homo sapiens
agaggccctgggctggtgtgct

SEQ ID NO: 7091151 - DNA, 22 bp, Homo sapiens
agaggccggccgagcccatggg

SEQ ID NO: 7091152 - DNA, 22 bp, Homo sapiens
agaggccctgggctggtgtgct

SEQ ID NO: 7091153 - DNA, 22 bp, Homo sapiens
agaggccgggtgcctgctcaga

SEQ ID NO: 7091154 - DNA, 22 bp, Homo sapiens
agaggcctccctcccagctggt

SEQ ID NO: 7091155 - DNA, 22 bp, Homo sapiens
agaggcctccgaaaggtgggct

SEQ ID NO: 7091156 - DNA, 22 bp, Homo sapiens
agaggcctccctcccagctggt

SEQ ID NO: 7091157 - DNA, 22 bp, Homo sapiens
agaggcctccctcccagctggt

SEQ ID NO: 7091158 - DNA, 22 bp, Homo sapiens
agaggcctccctcccagctggt

SEQ ID NO: 7091159 - DNA, 22 bp, Homo sapiens
agaggcctaattgctacccttt

SEQ ID NO: 7091160 - DNA, 22 bp, Homo sapiens
agaggcctcaaaccagacctga

SEQ ID NO: 7091161 - DNA, 19 bp, Homo sapiens
agaggcctcagcagctggc

SEQ ID NO: 7091162 - DNA, 19 bp, Homo sapiens
agaggcctcagcagctggc

SEQ ID NO: 7091163 - DNA, 22 bp, Homo sapiens
attcaaaagaccatgcagactc

SEQ ID NO: 7091164 - DNA, 22 bp, Homo sapiens
attcaaaagaccatgcagactc

SEQ ID NO: 7091165 - DNA, 22 bp, Homo sapiens
attattttatgtgcggcctgat

SEQ ID NO: 7091166 - DNA, 22 bp, Homo sapiens
attattttatgtgcggcctgat

SEQ ID NO: 7091167 - DNA, 22 bp, Homo sapiens
attattttatgtgcggcctgat

SEQ ID NO: 7091168 - DNA, 22 bp, Homo sapiens
attatttgagttcctctctacc

SEQ ID NO: 7091169 - DNA, 22 bp, Homo sapiens
attatttgagttcctctctacc

SEQ ID NO: 7091170 - DNA, 22 bp, Homo sapiens
attatttgcttggctcatctaa

SEQ ID NO: 7091171 - DNA, 22 bp, Homo sapiens
attatttgcttggctcatctaa

SEQ ID NO: 7091172 - DNA, 22 bp, Homo sapiens
attatttgcttggctcatctaa

SEQ ID NO: 7091173 - DNA, 22 bp, Homo sapiens
attatttggaataggcattgca

SEQ ID NO: 7091174 - DNA, 15 bp, Homo sapiens
attatttgtgctcag

SEQ ID NO: 7091175 - DNA, 22 bp, Homo sapiens
attatttgtgtccacagaatac

SEQ ID NO: 7091176 - DNA, 22 bp, Homo sapiens
attatttgtgtccacagaatac

SEQ ID NO: 7091177 - DNA, 22 bp, Homo sapiens
agaggcctccgaaaggtgggct

SEQ ID NO: 7091178 - DNA, 22 bp, Homo sapiens
agaggcctctgttgttcagacg

SEQ ID NO: 7091179 - DNA, 22 bp, Homo sapiens
agaggcctctttgcaagtaggt

SEQ ID NO: 7091180 - DNA, 22 bp, Homo sapiens
agaggcctctttgcaagtaggt

SEQ ID NO: 7091181 - DNA, 22 bp, Homo sapiens
attatttctcactcacataata

SEQ ID NO: 7091182 - DNA, 22 bp, Homo sapiens
attatttctcactcacataata

SEQ ID NO: 7091183 - DNA, 22 bp, Homo sapiens
attatttctcactcacataata

SEQ ID NO: 7091184 - DNA, 22 bp, Homo sapiens
attatttctcactcacataata

SEQ ID NO: 7091185 - DNA, 22 bp, Homo sapiens
attatttgacttgagaacaggt

SEQ ID NO: 7091186 - DNA, 22 bp, Homo sapiens
agagcttttctgtaataacatc

SEQ ID NO: 7091187 - DNA, 22 bp, Homo sapiens
agagcttcactggagagcacat

SEQ ID NO: 7091188 - DNA, 22 bp, Homo sapiens
attaatatacactgttagcatg

SEQ ID NO: 7091189 - DNA, 22 bp, Homo sapiens
agagctgtttgtctagagagtg

SEQ ID NO: 7091190 - DNA, 22 bp, Homo sapiens
attaatatacactgttagcatg

SEQ ID NO: 7091191 - DNA, 23 bp, Homo sapiens
agagcttagggaattcacatgag

SEQ ID NO: 7091192 - DNA, 22 bp, Homo sapiens
agagcttcactggagagcacat

SEQ ID NO: 7091193 - DNA, 22 bp, Homo sapiens
agagcttcactggagagcacat

SEQ ID NO: 7091194 - DNA, 22 bp, Homo sapiens
attaataaaataccactttgtt

SEQ ID NO: 7091195 - DNA, 22 bp, Homo sapiens
attaataaaataccactttgtt

SEQ ID NO: 7091196 - DNA, 22 bp, Homo sapiens
attaataaaataccactttgtt

SEQ ID NO: 7091197 - DNA, 22 bp, Homo sapiens
agaggaacccagacagggcttt

SEQ ID NO: 7091198 - DNA, 22 bp, Homo sapiens
agaggaaatggataaagggtga

SEQ ID NO: 7091199 - DNA, 22 bp, Homo sapiens
agaggaaatggataaagggtga

SEQ ID NO: 7091200 - DNA, 22 bp, Homo sapiens
agaggaaaatgagttccagaat

SEQ ID NO: 7091201 - DNA, 22 bp, Homo sapiens
agaggaagccattgcttactga

SEQ ID NO: 7091202 - DNA, 22 bp, Homo sapiens
agaggaagccattgcttactga

SEQ ID NO: 7091203 - DNA, 22 bp, Homo sapiens
agaggaagccattgcttactga

SEQ ID NO: 7091204 - DNA, 22 bp, Homo sapiens
agaggccctggctagagcagct

SEQ ID NO: 7091205 - DNA, 22 bp, Homo sapiens
agaggccaggtccagagtttgt

SEQ ID NO: 7091206 - DNA, 22 bp, Homo sapiens
agaggccagggacactgctcaa

SEQ ID NO: 7091207 - DNA, 22 bp, Homo sapiens
attggtggtgaggacatgccag

SEQ ID NO: 7091208 - DNA, 22 bp, Homo sapiens
attggtgctctggcacattcct

SEQ ID NO: 7091209 - DNA, 22 bp, Homo sapiens
attggtgcaatagtcaggagct

SEQ ID NO: 7091210 - DNA, 22 bp, Homo sapiens
attggtgcatgtaggtgatgct

SEQ ID NO: 7091211 - DNA, 22 bp, Homo sapiens
attggtgcatgtaggtgatgct

SEQ ID NO: 7091212 - DNA, 22 bp, Homo sapiens
attggtgcattttacaaaactc

SEQ ID NO: 7091213 - DNA, 22 bp, Homo sapiens
attgtataacagcatgtatttt

SEQ ID NO: 7091214 - DNA, 22 bp, Homo sapiens
attgtataacagcatgtatttt

SEQ ID NO: 7091215 - DNA, 22 bp, Homo sapiens
attggtggtgaggacatgccag

SEQ ID NO: 7091216 - DNA, 22 bp, Homo sapiens
attggtggtgaggacatgccag

SEQ ID NO: 7091217 - DNA, 22 bp, Homo sapiens
attgtataagtctatttacaat

SEQ ID NO: 7091218 - DNA, 22 bp, Homo sapiens
attgtataagtctatttacaat

SEQ ID NO: 7091219 - DNA, 22 bp, Homo sapiens
attgtataagtctatttacaat

SEQ ID NO: 7091220 - DNA, 22 bp, Homo sapiens
attgtataacagcatgtatttt

SEQ ID NO: 7091221 - DNA, 22 bp, Homo sapiens
attgtataacagcatgtatttt

SEQ ID NO: 7091222 - DNA, 22 bp, Homo sapiens
attgtataagtctatttacaat

SEQ ID NO: 7091223 - DNA, 22 bp, Homo sapiens
attgtataagtctatttacaat

SEQ ID NO: 7091224 - DNA, 22 bp, Homo sapiens
attgtataagtctatttacaat

SEQ ID NO: 7091225 - DNA, 22 bp, Homo sapiens
attgtataattgtattgccaaa

SEQ ID NO: 7091226 - DNA, 22 bp, Homo sapiens
attgtataattgtattgccaaa

SEQ ID NO: 7091227 - DNA, 22 bp, Homo sapiens
attgtatacaagcttaattgtt

SEQ ID NO: 7091228 - DNA, 22 bp, Homo sapiens
attgtatacaagcttaattgtt

SEQ ID NO: 7091229 - DNA, 22 bp, Homo sapiens
attgtatacaagcttaattgtt

SEQ ID NO: 7091230 - DNA, 22 bp, Homo sapiens
attgtattagcacaatacaatt

SEQ ID NO: 7091231 - DNA, 22 bp, Homo sapiens
attgtattagcacaatacaatt

SEQ ID NO: 7091232 - DNA, 23 bp, Homo sapiens
attgagaaggatacattgttctc

SEQ ID NO: 7091233 - DNA, 22 bp, Homo sapiens
attgagaatatgatttagtata

SEQ ID NO: 7091234 - DNA, 22 bp, Homo sapiens
attgagaatatgatttagtata

SEQ ID NO: 7091235 - DNA, 22 bp, Homo sapiens
attgagaatatgatttagtata

SEQ ID NO: 7091236 - DNA, 22 bp, Homo sapiens
attgagaatattgtgacagtgt

SEQ ID NO: 7091237 - DNA, 22 bp, Homo sapiens
attgagaatattgtgacagtgt

SEQ ID NO: 7091238 - DNA, 22 bp, Homo sapiens
attgagaatccatttgagatga

SEQ ID NO: 7091239 - DNA, 22 bp, Homo sapiens
attgagaatccatttgagatga

SEQ ID NO: 7091240 - DNA, 22 bp, Homo sapiens
attgagaatccatttgagatga

SEQ ID NO: 7091241 - DNA, 22 bp, Homo sapiens
attgagaatctgagagcctagg

SEQ ID NO: 7091242 - DNA, 22 bp, Homo sapiens
attgagaatctgagagcctagg

SEQ ID NO: 7091243 - DNA, 22 bp, Homo sapiens
attgagaatgaagggacatttt

SEQ ID NO: 7091244 - DNA, 22 bp, Homo sapiens
attgagaatgaagggacatttt

SEQ ID NO: 7091245 - DNA, 22 bp, Homo sapiens
attgagaatgcaatctactatg

SEQ ID NO: 7091246 - DNA, 22 bp, Homo sapiens
attgagaatgcaatctactatg

SEQ ID NO: 7091247 - DNA, 22 bp, Homo sapiens
attgagaatgcaatctactatg

SEQ ID NO: 7091248 - DNA, 22 bp, Homo sapiens
attgagaattgtgagtttggag

SEQ ID NO: 7091249 - DNA, 22 bp, Homo sapiens
attgagaattgtgagtttggag

SEQ ID NO: 7091250 - DNA, 22 bp, Homo sapiens
attgagagtgtatagctgatct

SEQ ID NO: 7091251 - DNA, 23 bp, Homo sapiens
attgagcaagcttttgcctaagt

SEQ ID NO: 7091252 - DNA, 23 bp, Homo sapiens
attgagcaagcttttgcctaagt

SEQ ID NO: 7091253 - DNA, 22 bp, Homo sapiens
attgagcacaaacgttactaga

SEQ ID NO: 7091254 - DNA, 22 bp, Homo sapiens
attgagcacaaacgttactaga

SEQ ID NO: 7091255 - DNA, 22 bp, Homo sapiens
attgagcacatactgtgggcca

SEQ ID NO: 7091256 - DNA, 22 bp, Homo sapiens
attgagcacatgctatgtgcca

SEQ ID NO: 7091257 - DNA, 22 bp, Homo sapiens
attgagcaatagtgtttgcagc

SEQ ID NO: 7091258 - DNA, 22 bp, Homo sapiens
attgagcacctacagtattacc

SEQ ID NO: 7091259 - DNA, 22 bp, Homo sapiens
attgagcacctacagtattacc

SEQ ID NO: 7091260 - DNA, 22 bp, Homo sapiens
attgagcacctactatgtgcta

SEQ ID NO: 7091261 - DNA, 22 bp, Homo sapiens
attgagcacctactttgtgcca

SEQ ID NO: 7091262 - DNA, 22 bp, Homo sapiens
attgagcacctactttgtgcca

SEQ ID NO: 7091263 - DNA, 18 bp, Homo sapiens
attgagcacttaccatgt

SEQ ID NO: 7091264 - DNA, 18 bp, Homo sapiens
attgagcacttaccatgt

SEQ ID NO: 7091265 - DNA, 22 bp, Homo sapiens
attgagcagacggcactttggc

SEQ ID NO: 7091266 - DNA, 22 bp, Homo sapiens
attgagcagcttctctgccatc

SEQ ID NO: 7091267 - DNA, 22 bp, Homo sapiens
attgagcagcttctctgccatc

SEQ ID NO: 7091268 - DNA, 22 bp, Homo sapiens
attgagcaggcaaagtatcata

SEQ ID NO: 7091269 - DNA, 18 bp, Homo sapiens
attgagcatgacagacct

SEQ ID NO: 7091270 - DNA, 19 bp, Homo sapiens
attgagcattacaaataga

SEQ ID NO: 7091271 - DNA, 19 bp, Homo sapiens
attgagcattacaaataga

SEQ ID NO: 7091272 - DNA, 22 bp, Homo sapiens
attgagctgaaggaagatagtg

SEQ ID NO: 7091273 - DNA, 22 bp, Homo sapiens
attgagctgttttgtaggataa

SEQ ID NO: 7091274 - DNA, 22 bp, Homo sapiens
attgaggactggtggggagagc

SEQ ID NO: 7091275 - DNA, 22 bp, Homo sapiens
attgaggagcagagatggggta

SEQ ID NO: 7091276 - DNA, 22 bp, Homo sapiens
attgaggagcagagatggggta

SEQ ID NO: 7091277 - DNA, 22 bp, Homo sapiens
attggtgcaatagtcaggagct

SEQ ID NO: 7091278 - DNA, 22 bp, Homo sapiens
attggtgcaattatgagggtgt

SEQ ID NO: 7091279 - DNA, 22 bp, Homo sapiens
attggtgcaattatgagggtgt

SEQ ID NO: 7091280 - DNA, 22 bp, Homo sapiens
attgaaaggttttgagcagata

SEQ ID NO: 7091281 - DNA, 22 bp, Homo sapiens
attgaaatacataaaattgcca

SEQ ID NO: 7091282 - DNA, 22 bp, Homo sapiens
attgaaatacataaaattgcca

SEQ ID NO: 7091283 - DNA, 22 bp, Homo sapiens
attgaaagcacaaagaacaagt

SEQ ID NO: 7091284 - DNA, 22 bp, Homo sapiens
attgaaagcatggatttggatt

SEQ ID NO: 7091285 - DNA, 22 bp, Homo sapiens
attgaaatccctacctcagagg

SEQ ID NO: 7091286 - DNA, 22 bp, Homo sapiens
attgaaattgatgaaattcttg

SEQ ID NO: 7091287 - DNA, 22 bp, Homo sapiens
attgagaaaattcgagcaagtt

SEQ ID NO: 7091288 - DNA, 22 bp, Homo sapiens
attgagaaaattcgagcaagtt

SEQ ID NO: 7091289 - DNA, 22 bp, Homo sapiens
attgagaaaattcgagcaagtt

SEQ ID NO: 7091290 - DNA, 22 bp, Homo sapiens
attgagaaaggcttatgtttgc

SEQ ID NO: 7091291 - DNA, 22 bp, Homo sapiens
attgagaaaggcttatgtttgc

SEQ ID NO: 7091292 - DNA, 22 bp, Homo sapiens
attgagaaaggcttatgtttgc

SEQ ID NO: 7091293 - DNA, 22 bp, Homo sapiens
attgagaaatataatctggaaa

SEQ ID NO: 7091294 - DNA, 22 bp, Homo sapiens
attgagaaatataatctggaaa

SEQ ID NO: 7091295 - DNA, 22 bp, Homo sapiens
attgagaagaaaatctaatata

SEQ ID NO: 7091296 - DNA, 22 bp, Homo sapiens
attgagaagaaaatctaatata

SEQ ID NO: 7091297 - DNA, 22 bp, Homo sapiens
attgagaagaaaatctaatata

SEQ ID NO: 7091298 - DNA, 22 bp, Homo sapiens
attgagaagcttgcagattttt

SEQ ID NO: 7091299 - DNA, 22 bp, Homo sapiens
attgagaagcttgcagattttt

SEQ ID NO: 7091300 - DNA, 23 bp, Homo sapiens
attgagaaggatacattgttctc

SEQ ID NO: 7091301 - DNA, 23 bp, Homo sapiens
attgagaaggatacattgttctc

SEQ ID NO: 7091302 - DNA, 22 bp, Homo sapiens
attgagaaggagattggcatct

SEQ ID NO: 7091303 - DNA, 22 bp, Homo sapiens
attgaaagataggctactgtgg

SEQ ID NO: 7091304 - DNA, 22 bp, Homo sapiens
attgaaacaagttgctttctat

SEQ ID NO: 7091305 - DNA, 22 bp, Homo sapiens
attgaaaatataattctaggag

SEQ ID NO: 7091306 - DNA, 22 bp, Homo sapiens
attgaaaataaggccagaaaca

SEQ ID NO: 7091307 - DNA, 22 bp, Homo sapiens
attgaaaataaggccagaaaca

SEQ ID NO: 7091308 - DNA, 22 bp, Homo sapiens
attgaaaaattcacaattctgg

SEQ ID NO: 7091309 - DNA, 22 bp, Homo sapiens
attgaaaaattcacaattctgg

SEQ ID NO: 7091310 - DNA, 22 bp, Homo sapiens
attgttaaagtaataaccatgg

SEQ ID NO: 7091311 - DNA, 22 bp, Homo sapiens
attgttaataactattacattg

SEQ ID NO: 7091312 - DNA, 22 bp, Homo sapiens
attgttaataactattacattg

SEQ ID NO: 7091313 - DNA, 22 bp, Homo sapiens
attgttaataactattacattg

SEQ ID NO: 7091314 - DNA, 22 bp, Homo sapiens
attgttaataactattacattg

SEQ ID NO: 7091315 - DNA, 22 bp, Homo sapiens
attgttaaagtaataaccatgg

SEQ ID NO: 7091316 - DNA, 22 bp, Homo sapiens
attgttaaactgaagcattact

SEQ ID NO: 7091317 - DNA, 22 bp, Homo sapiens
attgttaaactgaagcattact

SEQ ID NO: 7091318 - DNA, 22 bp, Homo sapiens
attgttaaactgaagcattact

SEQ ID NO: 7091319 - DNA, 22 bp, Homo sapiens
attgtgtggtgaatgatcagct

SEQ ID NO: 7091320 - DNA, 22 bp, Homo sapiens
attgtgctttgtatttggctag

SEQ ID NO: 7091321 - DNA, 22 bp, Homo sapiens
attgtggtgtcagttataggca

SEQ ID NO: 7091322 - DNA, 22 bp, Homo sapiens
attgtgtaattttcagctcata

SEQ ID NO: 7091323 - DNA, 19 bp, Homo sapiens
attgtgtcaatggtgttca

SEQ ID NO: 7091324 - DNA, 19 bp, Homo sapiens
attgtgtcaatggtgttca

SEQ ID NO: 7091325 - DNA, 22 bp, Homo sapiens
attgtgtcctcattgaccttca

SEQ ID NO: 7091326 - DNA, 22 bp, Homo sapiens
attgtgtggtgaatgatcagct

SEQ ID NO: 7091327 - DNA, 22 bp, Homo sapiens
attgtatttccagcttgaatgt

SEQ ID NO: 7091328 - DNA, 22 bp, Homo sapiens
attgtattctgcacctttgtta

SEQ ID NO: 7091329 - DNA, 22 bp, Homo sapiens
attgtatttaggagaaaagggt

SEQ ID NO: 7091330 - DNA, 22 bp, Homo sapiens
attgtatttaggagaaaagggt

SEQ ID NO: 7091331 - DNA, 22 bp, Homo sapiens
attgtattctgcacctttgtta

SEQ ID NO: 7091332 - DNA, 22 bp, Homo sapiens
attgtattcagttacaggtctt

SEQ ID NO: 7091333 - DNA, 22 bp, Homo sapiens
attgtattagcacaatacaatt

SEQ ID NO: 7091334 - DNA, 22 bp, Homo sapiens
attgtattagcacaatacaatt

SEQ ID NO: 7091335 - DNA, 22 bp, Homo sapiens
attgtattataattaggccaaa

SEQ ID NO: 7091336 - DNA, 22 bp, Homo sapiens
attgtatttgtacaagacatgt

SEQ ID NO: 7091337 - DNA, 22 bp, Homo sapiens
attgtatttgtacaagacatgt

SEQ ID NO: 7091338 - DNA, 22 bp, Homo sapiens
attgtatttccagcttgaatgt

SEQ ID NO: 7091339 - DNA, 22 bp, Homo sapiens
attgtatttccagcttgaatgt

SEQ ID NO: 7091340 - DNA, 22 bp, Homo sapiens
attgtatttccagcttgaatgt

SEQ ID NO: 7091341 - DNA, 22 bp, Homo sapiens
attgtgctaagcccaggaggga

SEQ ID NO: 7091342 - DNA, 22 bp, Homo sapiens
attgtgctaagcccaggaggga

SEQ ID NO: 7091343 - DNA, 18 bp, Homo sapiens
attgtgctaatggtttcc

SEQ ID NO: 7091344 - DNA, 22 bp, Homo sapiens
attgtgctataagcgtggttct

SEQ ID NO: 7091345 - DNA, 22 bp, Homo sapiens
attgtgctcagaatctgtcgtg

SEQ ID NO: 7091346 - DNA, 22 bp, Homo sapiens
attgtgctcacagcttgtttct

SEQ ID NO: 7091347 - DNA, 22 bp, Homo sapiens
attgtgctgcctcatggaagca

SEQ ID NO: 7091348 - DNA, 22 bp, Homo sapiens
attgtgctgcctcatggaagca

SEQ ID NO: 7091349 - DNA, 22 bp, Homo sapiens
attgtgctgctgctgacgttta

SEQ ID NO: 7091350 - DNA, 22 bp, Homo sapiens
attgtgcttcctgaaatttgat

SEQ ID NO: 7091351 - DNA, 22 bp, Homo sapiens
attgtgctttaattgaactgcc

SEQ ID NO: 7091352 - DNA, 22 bp, Homo sapiens
attgtgctttagatcacagtct

SEQ ID NO: 7091353 - DNA, 22 bp, Homo sapiens
attgtgctttagatcacagtct

SEQ ID NO: 7091354 - DNA, 22 bp, Homo sapiens
attgtgctttgcatcttgttcc

SEQ ID NO: 7091355 - DNA, 22 bp, Homo sapiens
attgtgctttgtatttggctag

SEQ ID NO: 7091356 - DNA, 22 bp, Homo sapiens
agatacaactcagaagtgtggt

SEQ ID NO: 7091357 - DNA, 22 bp, Homo sapiens
agatacaactcagaagtgtggt

SEQ ID NO: 7091358 - DNA, 22 bp, Homo sapiens
agatacaaaggcctacagagca

SEQ ID NO: 7091359 - DNA, 22 bp, Homo sapiens
agatacaactgtttaaacatta

SEQ ID NO: 7091360 - DNA, 22 bp, Homo sapiens
agatacaactgtttaaacatta

SEQ ID NO: 7091361 - DNA, 22 bp, Homo sapiens
agatacaaaaagggagaagatt

SEQ ID NO: 7091362 - DNA, 22 bp, Homo sapiens
agatacaaaggcctacagagca

SEQ ID NO: 7091363 - DNA, 22 bp, Homo sapiens
agatacaaaggcctacagagca

SEQ ID NO: 7091364 - DNA, 22 bp, Homo sapiens
agataattatgtcaatttcttg

SEQ ID NO: 7091365 - DNA, 22 bp, Homo sapiens
agataattatttacttcaaagt

SEQ ID NO: 7091366 - DNA, 22 bp, Homo sapiens
agataattatttacttcaaagt

SEQ ID NO: 7091367 - DNA, 22 bp, Homo sapiens
agataatttgagtaaattaatt

SEQ ID NO: 7091368 - DNA, 22 bp, Homo sapiens
attgttaataactattacattg

SEQ ID NO: 7091369 - DNA, 22 bp, Homo sapiens
agataaattcctaagatttcag

SEQ ID NO: 7091370 - DNA, 22 bp, Homo sapiens
agatacagcctgccaggttctt

SEQ ID NO: 7091371 - DNA, 22 bp, Homo sapiens
agatacagcctgccaggttctt

SEQ ID NO: 7091372 - DNA, 22 bp, Homo sapiens
agatacagcctgccaggttctt

SEQ ID NO: 7091373 - DNA, 22 bp, Homo sapiens
atttacagacgtggattagtgc

SEQ ID NO: 7091374 - DNA, 22 bp, Homo sapiens
atttacagatgatgctatttga

SEQ ID NO: 7091375 - DNA, 22 bp, Homo sapiens
atttacagatgatgctatttga

SEQ ID NO: 7091376 - DNA, 22 bp, Homo sapiens
agatacaccggaacctgaggct

SEQ ID NO: 7091377 - DNA, 22 bp, Homo sapiens
agatacagacctcttattaagg

SEQ ID NO: 7091378 - DNA, 22 bp, Homo sapiens
agatacaactgtttaaacatta

SEQ ID NO: 7091379 - DNA, 22 bp, Homo sapiens
agatacaagaggcctgacgtgt

SEQ ID NO: 7091380 - DNA, 22 bp, Homo sapiens
agatacaactgtttaaacatta

SEQ ID NO: 7091381 - DNA, 22 bp, Homo sapiens
agatacaaggcagagatgtgca

SEQ ID NO: 7091382 - DNA, 22 bp, Homo sapiens
agatacaaggcagagatgtgca

SEQ ID NO: 7091383 - DNA, 22 bp, Homo sapiens
agatacaagttaagagaaagga

SEQ ID NO: 7091384 - DNA, 22 bp, Homo sapiens
agatacacagagcatcttcaga

SEQ ID NO: 7091385 - DNA, 22 bp, Homo sapiens
agcaaggctcttaatgcccaaa

SEQ ID NO: 7091386 - DNA, 22 bp, Homo sapiens
agcaaggcttcagagctgtctg

SEQ ID NO: 7091387 - DNA, 22 bp, Homo sapiens
agcaaggggcagtgaaagtgtg

SEQ ID NO: 7091388 - DNA, 22 bp, Homo sapiens
agcaaggggcagtgaaagtgtg

SEQ ID NO: 7091389 - DNA, 22 bp, Homo sapiens
agcaaggtgacatcatgctgag

SEQ ID NO: 7091390 - DNA, 19 bp, Homo sapiens
agcaaggtgcctcctcccc

SEQ ID NO: 7091391 - DNA, 22 bp, Homo sapiens
agcaaggtggagaaggatgggt

SEQ ID NO: 7091392 - DNA, 22 bp, Homo sapiens
agcaagtagtaccaagtagctc

SEQ ID NO: 7091393 - DNA, 22 bp, Homo sapiens
agcaagtgtaagaatgcagaat

SEQ ID NO: 7091394 - DNA, 22 bp, Homo sapiens
agcaataaatgtaaaggttaag

SEQ ID NO: 7091395 - DNA, 22 bp, Homo sapiens
agcaataaatgtaaaggttaag

SEQ ID NO: 7091396 - DNA, 22 bp, Homo sapiens
agcaataacagaaaactttcct

SEQ ID NO: 7091397 - DNA, 22 bp, Homo sapiens
agcaataaccactctaatttat

SEQ ID NO: 7091398 - DNA, 23 bp, Homo sapiens
agcaataagaagggatacatgtg

SEQ ID NO: 7091399 - DNA, 23 bp, Homo sapiens
agcaataagaagggatacatgtg

SEQ ID NO: 7091400 - DNA, 22 bp, Homo sapiens
agcaaggctcggtcagggtgat

SEQ ID NO: 7091401 - DNA, 20 bp, Homo sapiens
agcaaggctaaatcatgatt

SEQ ID NO: 7091402 - DNA, 20 bp, Homo sapiens
agcaaggctaaatcatgatt

SEQ ID NO: 7091403 - DNA, 20 bp, Homo sapiens
agcaagagtgtacctggcca

SEQ ID NO: 7091404 - DNA, 20 bp, Homo sapiens
agcaagagtgtacctggcca

SEQ ID NO: 7091405 - DNA, 22 bp, Homo sapiens
agcaagatgcattatttcttat

SEQ ID NO: 7091406 - DNA, 23 bp, Homo sapiens
attttttgtctttgtaactagat

SEQ ID NO: 7091407 - DNA, 23 bp, Homo sapiens
attttttgtctttgtaactagat

SEQ ID NO: 7091408 - DNA, 23 bp, Homo sapiens
attttttgtctttgtaactagat

SEQ ID NO: 7091409 - DNA, 22 bp, Homo sapiens
attttttcccagttagccagga

SEQ ID NO: 7091410 - DNA, 22 bp, Homo sapiens
attttttcccagttagccagga

SEQ ID NO: 7091411 - DNA, 22 bp, Homo sapiens
attttttctgtaaactggcctt

SEQ ID NO: 7091412 - DNA, 22 bp, Homo sapiens
attttttctgtaaactggcctt

SEQ ID NO: 7091413 - DNA, 22 bp, Homo sapiens
attttgttatagaactctgtga

SEQ ID NO: 7091414 - DNA, 22 bp, Homo sapiens
attttgttaatgtcaccgtgct

SEQ ID NO: 7091415 - DNA, 22 bp, Homo sapiens
attttgtatcttacggggacta

SEQ ID NO: 7091416 - DNA, 22 bp, Homo sapiens
attttgtatcttacggggacta

SEQ ID NO: 7091417 - DNA, 22 bp, Homo sapiens
attttgtgaaccctcaagcaat

SEQ ID NO: 7091418 - DNA, 22 bp, Homo sapiens
attttgttatagaactctgtga

SEQ ID NO: 7091419 - DNA, 22 bp, Homo sapiens
attttgttatagaactctgtga

SEQ ID NO: 7091420 - DNA, 22 bp, Homo sapiens
attttgttataggagctgaaat

SEQ ID NO: 7091421 - DNA, 22 bp, Homo sapiens
attttgttataggagctgaaat

SEQ ID NO: 7091422 - DNA, 22 bp, Homo sapiens
attttgttatcagggctttgca

SEQ ID NO: 7091423 - DNA, 22 bp, Homo sapiens
attttgttatcagggctttgca

SEQ ID NO: 7091424 - DNA, 22 bp, Homo sapiens
attttgttataggagctgaaat

SEQ ID NO: 7091425 - DNA, 22 bp, Homo sapiens
attttgttatcagggctttgca

SEQ ID NO: 7091426 - DNA, 22 bp, Homo sapiens
attttgttgaggtaattgtcaa

SEQ ID NO: 7091427 - DNA, 22 bp, Homo sapiens
attttgttgaggtaattgtcaa

SEQ ID NO: 7091428 - DNA, 22 bp, Homo sapiens
attttgttgaggtaattgtcaa

SEQ ID NO: 7091429 - DNA, 22 bp, Homo sapiens
attttgttgaggtaattgtcaa

SEQ ID NO: 7091430 - DNA, 22 bp, Homo sapiens
attttgttgatggtggagtagc

SEQ ID NO: 7091431 - DNA, 22 bp, Homo sapiens
attttgttgaggtaattgtcaa

SEQ ID NO: 7091432 - DNA, 22 bp, Homo sapiens
attttgttgatggtggagtagc

SEQ ID NO: 7091433 - DNA, 20 bp, Homo sapiens
attttgtttatgttcctctc

SEQ ID NO: 7091434 - DNA, 22 bp, Homo sapiens
attttttagaacctggcctgat

SEQ ID NO: 7091435 - DNA, 22 bp, Homo sapiens
attttttagccaagactctgca

SEQ ID NO: 7091436 - DNA, 22 bp, Homo sapiens
attttttagccaagactctgca

SEQ ID NO: 7091437 - DNA, 20 bp, Homo sapiens
attttgtttatgttcctctc

SEQ ID NO: 7091438 - DNA, 22 bp, Homo sapiens
attttttagccaagactctgca

SEQ ID NO: 7091439 - DNA, 22 bp, Homo sapiens
attttttagccaagactctgca

SEQ ID NO: 7091440 - DNA, 22 bp, Homo sapiens
attttttagccaagactctgca

SEQ ID NO: 7091441 - DNA, 22 bp, Homo sapiens
attttttagccaagactctgca

SEQ ID NO: 7091442 - DNA, 22 bp, Homo sapiens
attttttcagattgagtgttaa

SEQ ID NO: 7091443 - DNA, 22 bp, Homo sapiens
attttttcagattgagtgttaa

SEQ ID NO: 7091444 - DNA, 22 bp, Homo sapiens
attttttcagattgagtgttaa

SEQ ID NO: 7091445 - DNA, 22 bp, Homo sapiens
attttttatataccaaggtggg

SEQ ID NO: 7091446 - DNA, 22 bp, Homo sapiens
attttttatataccaaggtggg

SEQ ID NO: 7091447 - DNA, 22 bp, Homo sapiens
attttttatataccaaggtggg

SEQ ID NO: 7091448 - DNA, 22 bp, Homo sapiens
attttttatataccaaggtggg

SEQ ID NO: 7091449 - DNA, 22 bp, Homo sapiens
caaagtgctgggattacaggtg

SEQ ID NO: 7091450 - DNA, 22 bp, Homo sapiens
caaagtgctgggattacaggtg

SEQ ID NO: 7091451 - DNA, 22 bp, Homo sapiens
caaagtgctgggattagtgctg

SEQ ID NO: 7091452 - DNA, 22 bp, Homo sapiens
caaagtgctgggattagtgctg

SEQ ID NO: 7091453 - DNA, 22 bp, Homo sapiens
caaagtgctgggattataggca

SEQ ID NO: 7091454 - DNA, 22 bp, Homo sapiens
caaagtgctgggattataggca

SEQ ID NO: 7091455 - DNA, 22 bp, Homo sapiens
caaagtgctgggattacaggct

SEQ ID NO: 7091456 - DNA, 22 bp, Homo sapiens
caaagtgctgggattacaggct

SEQ ID NO: 7091457 - DNA, 22 bp, Homo sapiens
caaaggtaaagatctgctgtgg

SEQ ID NO: 7091458 - DNA, 22 bp, Homo sapiens
caaaggtagtatatatattgtt

SEQ ID NO: 7091459 - DNA, 22 bp, Homo sapiens
caaacattttctacttccagga

SEQ ID NO: 7091460 - DNA, 22 bp, Homo sapiens
caaacattttgagtggtttctg

SEQ ID NO: 7091461 - DNA, 22 bp, Homo sapiens
caaacattttgagtggtttctg

SEQ ID NO: 7091462 - DNA, 22 bp, Homo sapiens
caaacatttgttggaacccctg

SEQ ID NO: 7091463 - DNA, 22 bp, Homo sapiens
caaacattttctacttccagga

SEQ ID NO: 7091464 - DNA, 22 bp, Homo sapiens
caaacatttgacttctctcagg

SEQ ID NO: 7091465 - DNA, 22 bp, Homo sapiens
caaacatttgacttctctcagg

SEQ ID NO: 7091466 - DNA, 22 bp, Homo sapiens
caaacattgctaccagaggttt

SEQ ID NO: 7091467 - DNA, 22 bp, Homo sapiens
caaacattgggggcttcaacac

SEQ ID NO: 7091468 - DNA, 22 bp, Homo sapiens
caaacattgggggcttcaacac

SEQ ID NO: 7091469 - DNA, 22 bp, Homo sapiens
caaacattgggggcttcaacac

SEQ ID NO: 7091470 - DNA, 22 bp, Homo sapiens
caaacattgggggcttcaacac

SEQ ID NO: 7091471 - DNA, 23 bp, Homo sapiens
agcaataagaagggatacatgtg

SEQ ID NO: 7091472 - DNA, 22 bp, Homo sapiens
agcaatagataaaacatttacc

SEQ ID NO: 7091473 - DNA, 22 bp, Homo sapiens
agcaatatgacattgctacatc

SEQ ID NO: 7091474 - DNA, 22 bp, Homo sapiens
caaacattgctaccagaggttt

SEQ ID NO: 7091475 - DNA, 22 bp, Homo sapiens
caaacattgctaccagaggttt

SEQ ID NO: 7091476 - DNA, 22 bp, Homo sapiens
caaagtggaggctctggggcca

SEQ ID NO: 7091477 - DNA, 22 bp, Homo sapiens
caaagtggctggccgggagatc

SEQ ID NO: 7091478 - DNA, 22 bp, Homo sapiens
caaagtggctggccgggagatc

SEQ ID NO: 7091479 - DNA, 22 bp, Homo sapiens
caaagtgggtgccctgatgctc

SEQ ID NO: 7091480 - DNA, 22 bp, Homo sapiens
caaagttatcaactgcaacatt

SEQ ID NO: 7091481 - DNA, 22 bp, Homo sapiens
caaagttatgaatgataagatt

SEQ ID NO: 7091482 - DNA, 22 bp, Homo sapiens
caaagttatgaatgataagatt

SEQ ID NO: 7091483 - DNA, 22 bp, Homo sapiens
caaagtttaaagtagatttcag

SEQ ID NO: 7091484 - DNA, 22 bp, Homo sapiens
caaagtttaaagtagatttcag

SEQ ID NO: 7091485 - DNA, 22 bp, Homo sapiens
caaagtttggctctcatgacat

SEQ ID NO: 7091486 - DNA, 22 bp, Homo sapiens
caaagtttggctctcatgacat

SEQ ID NO: 7091487 - DNA, 22 bp, Homo sapiens
caaagttttagtaaacatatat

SEQ ID NO: 7091488 - DNA, 22 bp, Homo sapiens
caaagttttagtaaacatatat

SEQ ID NO: 7091489 - DNA, 22 bp, Homo sapiens
caaagttttagtaaacatatat

SEQ ID NO: 7091490 - DNA, 22 bp, Homo sapiens
caaagttttagtaaacatatat

SEQ ID NO: 7091491 - DNA, 22 bp, Homo sapiens
caaataagaaccacaggggagt

SEQ ID NO: 7091492 - DNA, 22 bp, Homo sapiens
caaataagcaattccattcttc

SEQ ID NO: 7091493 - DNA, 22 bp, Homo sapiens
caaataattactatcctcactt

SEQ ID NO: 7091494 - DNA, 22 bp, Homo sapiens
agcaatgaaaacaataaggtga

SEQ ID NO: 7091495 - DNA, 22 bp, Homo sapiens
agcaatgaaatgaaatcagtct

SEQ ID NO: 7091496 - DNA, 22 bp, Homo sapiens
agcaatgaccagtgatcttgta

SEQ ID NO: 7091497 - DNA, 22 bp, Homo sapiens
agcaatgactaaggcactttgg

SEQ ID NO: 7091498 - DNA, 22 bp, Homo sapiens
agcaatgactttgaaatcatga

SEQ ID NO: 7091499 - DNA, 22 bp, Homo sapiens
agcaatgactttgaaatcatga

SEQ ID NO: 7091500 - DNA, 22 bp, Homo sapiens
agcaatgatgttttcaagtagg

SEQ ID NO: 7091501 - DNA, 22 bp, Homo sapiens
agcaatgatgttttcaagtagg

SEQ ID NO: 7091502 - DNA, 22 bp, Homo sapiens
agcaatgatgttttcaagtagg

SEQ ID NO: 7091503 - DNA, 22 bp, Homo sapiens
agcaatgcaatcttaaccttga

SEQ ID NO: 7091504 - DNA, 22 bp, Homo sapiens
agcaatgcaatcttaaccttga

SEQ ID NO: 7091505 - DNA, 23 bp, Homo sapiens
agcaatgctgggagactctgtaa

SEQ ID NO: 7091506 - DNA, 22 bp, Homo sapiens
agcaatgcaatcttaaccttga

SEQ ID NO: 7091507 - DNA, 22 bp, Homo sapiens
agcaatgtaaaccctgaagttg

SEQ ID NO: 7091508 - DNA, 22 bp, Homo sapiens
agcaatgtaaaccctgaagttg

SEQ ID NO: 7091509 - DNA, 22 bp, Homo sapiens
agcaatgtctttttggccatct

SEQ ID NO: 7091510 - DNA, 22 bp, Homo sapiens
agcaatgtctttttggccatct

SEQ ID NO: 7091511 - DNA, 22 bp, Homo sapiens
agcaatgtgacccctgacagca

SEQ ID NO: 7091512 - DNA, 22 bp, Homo sapiens
agcaatgtgacccctgacagca

SEQ ID NO: 7091513 - DNA, 22 bp, Homo sapiens
agcaatgtggaccagctcaggg

SEQ ID NO: 7091514 - DNA, 22 bp, Homo sapiens
agcaatgtggaccagctcaggg

SEQ ID NO: 7091515 - DNA, 22 bp, Homo sapiens
agcaatgttggcctatatacct

SEQ ID NO: 7091516 - DNA, 22 bp, Homo sapiens
agcaatgttggggttagaggac

SEQ ID NO: 7091517 - DNA, 22 bp, Homo sapiens
agcaatgtggaccagctcaggg

SEQ ID NO: 7091518 - DNA, 19 bp, Homo sapiens
agcaattaagactgtgggc

SEQ ID NO: 7091519 - DNA, 22 bp, Homo sapiens
agatgattatgatagcactgtt

SEQ ID NO: 7091520 - DNA, 22 bp, Homo sapiens
agatgtttgtaaacacactgct

SEQ ID NO: 7091521 - DNA, 22 bp, Homo sapiens
agatgtttgtaaacacactgct

SEQ ID NO: 7091522 - DNA, 22 bp, Homo sapiens
agattcattatcttctttgtac

SEQ ID NO: 7091523 - DNA, 22 bp, Homo sapiens
agattcattatcttctttgtac

SEQ ID NO: 7091524 - DNA, 22 bp, Homo sapiens
agattcatgggaaagctttagg

SEQ ID NO: 7091525 - DNA, 22 bp, Homo sapiens
agattcatgggtctaaccagtg

SEQ ID NO: 7091526 - DNA, 22 bp, Homo sapiens
agattcattaggagacattcag

SEQ ID NO: 7091527 - DNA, 22 bp, Homo sapiens
agattcattaggagacattcag

SEQ ID NO: 7091528 - DNA, 22 bp, Homo sapiens
agattcattaggagacattcag

SEQ ID NO: 7091529 - DNA, 22 bp, Homo sapiens
agattcattatcttctttgtac

SEQ ID NO: 7091530 - DNA, 22 bp, Homo sapiens
agattcatgggaaagctttagg

SEQ ID NO: 7091531 - DNA, 21 bp, Homo sapiens
agattcataatctgtaaaatg

SEQ ID NO: 7091532 - DNA, 22 bp, Homo sapiens
agattcctgaaactgccattgg

SEQ ID NO: 7091533 - DNA, 22 bp, Homo sapiens
agattccttatctgtccaatgg

SEQ ID NO: 7091534 - DNA, 22 bp, Homo sapiens
agattcgaaacctttaggtctt

SEQ ID NO: 7091535 - DNA, 22 bp, Homo sapiens
agattctaccagagctagtttg

SEQ ID NO: 7091536 - DNA, 22 bp, Homo sapiens
agattgacaaaacagaagattt

SEQ ID NO: 7091537 - DNA, 22 bp, Homo sapiens
agattgggctccagttaaaacg

SEQ ID NO: 7091538 - DNA, 22 bp, Homo sapiens
agattggtgttgcagaaccatg

SEQ ID NO: 7091539 - DNA, 22 bp, Homo sapiens
agattggttccttgctttgaaa

SEQ ID NO: 7091540 - DNA, 19 bp, Homo sapiens
agattggttccttttgagg

SEQ ID NO: 7091541 - DNA, 22 bp, Homo sapiens
agattggttgaactgatttgca

SEQ ID NO: 7091542 - DNA, 20 bp, Homo sapiens
attttggtgaacacagcttc

SEQ ID NO: 7091543 - DNA, 20 bp, Homo sapiens
attttggtgaacacagcttc

SEQ ID NO: 7091544 - DNA, 22 bp, Homo sapiens
attttggctgttgggaattatt

SEQ ID NO: 7091545 - DNA, 22 bp, Homo sapiens
attttggtggtatattaggatt

SEQ ID NO: 7091546 - DNA, 21 bp, Homo sapiens
attttgtacatagaatttgtc

SEQ ID NO: 7091547 - DNA, 21 bp, Homo sapiens
attttgtacatagaatttgtc

SEQ ID NO: 7091548 - DNA, 21 bp, Homo sapiens
attttgtacatagaatttgtc

SEQ ID NO: 7091549 - DNA, 21 bp, Homo sapiens
attttgtacatagaatttgtc

SEQ ID NO: 7091550 - DNA, 22 bp, Homo sapiens
attttctgtaactatttctata

SEQ ID NO: 7091551 - DNA, 22 bp, Homo sapiens
agatttcaatgtgagcattagt

SEQ ID NO: 7091552 - DNA, 22 bp, Homo sapiens
attttctgtgtgcagataaata

SEQ ID NO: 7091553 - DNA, 22 bp, Homo sapiens
attttctgtgtgcagataaata

SEQ ID NO: 7091554 - DNA, 22 bp, Homo sapiens
agatttatgtggtcacactcag

SEQ ID NO: 7091555 - DNA, 22 bp, Homo sapiens
agatttatgtggtcacactcag

SEQ ID NO: 7091556 - DNA, 22 bp, Homo sapiens
agatttatgtggtcacactcag

SEQ ID NO: 7091557 - DNA, 22 bp, Homo sapiens
agatttatgtggtcacactcag

SEQ ID NO: 7091558 - DNA, 22 bp, Homo sapiens
agatttatgtggtcacactcag

SEQ ID NO: 7091559 - DNA, 22 bp, Homo sapiens
agatttatgtggtcacactcag

SEQ ID NO: 7091560 - DNA, 22 bp, Homo sapiens
agatttagctgtgaacagcttg

SEQ ID NO: 7091561 - DNA, 22 bp, Homo sapiens
agatttagtggtggaattttgg

SEQ ID NO: 7091562 - DNA, 19 bp, Homo sapiens
agatttacctcatatagtt

SEQ ID NO: 7091563 - DNA, 22 bp, Homo sapiens
agatttacaaaggatttgcttt

SEQ ID NO: 7091564 - DNA, 22 bp, Homo sapiens
agattgtatcctcggagacttc

SEQ ID NO: 7091565 - DNA, 22 bp, Homo sapiens
agatttaaagcagtattcgcaa

SEQ ID NO: 7091566 - DNA, 22 bp, Homo sapiens
agatttaaatttgctacaattc

SEQ ID NO: 7091567 - DNA, 22 bp, Homo sapiens
agatttaaatttgctacaattc

SEQ ID NO: 7091568 - DNA, 23 bp, Homo sapiens
agatttaatgttatattctgggc

SEQ ID NO: 7091569 - DNA, 22 bp, Homo sapiens
agatgagtaaatggagtcttcc

SEQ ID NO: 7091570 - DNA, 22 bp, Homo sapiens
agatgaggggtagaaaggactt

SEQ ID NO: 7091571 - DNA, 22 bp, Homo sapiens
agatgaggggtagaaaggactt

SEQ ID NO: 7091572 - DNA, 21 bp, Homo sapiens
agatgaggatactgaggccta

SEQ ID NO: 7091573 - DNA, 22 bp, Homo sapiens
agatgagaatttttagagtgct

SEQ ID NO: 7091574 - DNA, 21 bp, Homo sapiens
agatgaggatactgaggccta

SEQ ID NO: 7091575 - DNA, 22 bp, Homo sapiens
agatgacaatgaggttgttatt

SEQ ID NO: 7091576 - DNA, 22 bp, Homo sapiens
agatgacaatgaggttgttatt

SEQ ID NO: 7091577 - DNA, 22 bp, Homo sapiens
agatgacacacacgcacccgga

SEQ ID NO: 7091578 - DNA, 22 bp, Homo sapiens
agatgacacaccatttttactt

SEQ ID NO: 7091579 - DNA, 22 bp, Homo sapiens
agatgacacaccatttttactt

SEQ ID NO: 7091580 - DNA, 22 bp, Homo sapiens
agatgacagccaaggagatgaa

SEQ ID NO: 7091581 - DNA, 22 bp, Homo sapiens
agatgacagctacgggatgaaa

SEQ ID NO: 7091582 - DNA, 22 bp, Homo sapiens
agatgacaggtttttttggctt

SEQ ID NO: 7091583 - DNA, 22 bp, Homo sapiens
agatgacagtagctcccccatt

SEQ ID NO: 7091584 - DNA, 22 bp, Homo sapiens
agatgacatgggagcaagcact

SEQ ID NO: 7091585 - DNA, 22 bp, Homo sapiens
agatgacatggttcaagtttcc

SEQ ID NO: 7091586 - DNA, 22 bp, Homo sapiens
agatgagaatttttagagtgct

SEQ ID NO: 7091587 - DNA, 22 bp, Homo sapiens
atttgaatggcttaacacaacg

SEQ ID NO: 7091588 - DNA, 22 bp, Homo sapiens
agatgacaagagcttgctgcag

SEQ ID NO: 7091589 - DNA, 22 bp, Homo sapiens
agatgacaatgaaggaaaatgt

SEQ ID NO: 7091590 - DNA, 22 bp, Homo sapiens
agatgacaatgaaggaaaatgt

SEQ ID NO: 7091591 - DNA, 22 bp, Homo sapiens
atttgaagtaagtaatgagtat

SEQ ID NO: 7091592 - DNA, 22 bp, Homo sapiens
atttgaagtaagtaatgagtat

SEQ ID NO: 7091593 - DNA, 22 bp, Homo sapiens
atttgaagaaagttttctagat

SEQ ID NO: 7091594 - DNA, 22 bp, Homo sapiens
atttgaagtaagtaatgagtat

SEQ ID NO: 7091595 - DNA, 22 bp, Homo sapiens
atttgaaatcccttctactgta

SEQ ID NO: 7091596 - DNA, 19 bp, Homo sapiens
atttgaaagctgtgcttgc

SEQ ID NO: 7091597 - DNA, 22 bp, Homo sapiens
atttgaaatcccttctactgta

SEQ ID NO: 7091598 - DNA, 22 bp, Homo sapiens
atttgaaatcccttctactgta

SEQ ID NO: 7091599 - DNA, 22 bp, Homo sapiens
atttgaaatctgggttactctg

SEQ ID NO: 7091600 - DNA, 22 bp, Homo sapiens
atttgaaatctgggttactctg

SEQ ID NO: 7091601 - DNA, 22 bp, Homo sapiens
atttgaaatctgggttactctg

SEQ ID NO: 7091602 - DNA, 22 bp, Homo sapiens
atttacaggacagcttggcatt

SEQ ID NO: 7091603 - DNA, 23 bp, Homo sapiens
atttacagctgtgtgagcaagtt

SEQ ID NO: 7091604 - DNA, 23 bp, Homo sapiens
atttacagctgtgtgagcaagtt

SEQ ID NO: 7091605 - DNA, 22 bp, Homo sapiens
atttacaggacagcttggcatt

SEQ ID NO: 7091606 - DNA, 22 bp, Homo sapiens
atttacaggacagcttggcatt

SEQ ID NO: 7091607 - DNA, 22 bp, Homo sapiens
atttacaggacagcttggcatt

SEQ ID NO: 7091608 - DNA, 22 bp, Homo sapiens
atttacaggtagaattttaagt

SEQ ID NO: 7091609 - DNA, 22 bp, Homo sapiens
atttacaggtagaattttaagt

SEQ ID NO: 7091610 - DNA, 22 bp, Homo sapiens
atttacaggtagaattttaagt

SEQ ID NO: 7091611 - DNA, 22 bp, Homo sapiens
atttacaggtagaattttaagt

SEQ ID NO: 7091612 - DNA, 22 bp, Homo sapiens
atttacaggtagaattttaagt

SEQ ID NO: 7091613 - DNA, 22 bp, Homo sapiens
atttacagatgatgctatttga

SEQ ID NO: 7091614 - DNA, 22 bp, Homo sapiens
atttacagccttgaaaacagca

SEQ ID NO: 7091615 - DNA, 22 bp, Homo sapiens
atttacagccttgaaaacagca

SEQ ID NO: 7091616 - DNA, 22 bp, Homo sapiens
atttacagccttgaaaacagca

SEQ ID NO: 7091617 - DNA, 22 bp, Homo sapiens
atttacagccttgaaaacagca

SEQ ID NO: 7091618 - DNA, 22 bp, Homo sapiens
atttacagccttgccatctata

SEQ ID NO: 7091619 - DNA, 22 bp, Homo sapiens
atttacagccttgccatctata

SEQ ID NO: 7091620 - DNA, 22 bp, Homo sapiens
atttacagccttgccatctata

SEQ ID NO: 7091621 - DNA, 23 bp, Homo sapiens
atttacagctgtgtgagcaagtt

SEQ ID NO: 7091622 - DNA, 23 bp, Homo sapiens
atttacagctgtgtgagcaagtt

SEQ ID NO: 7091623 - DNA, 22 bp, Homo sapiens
atttacaggtagaattttaagt

SEQ ID NO: 7091624 - DNA, 22 bp, Homo sapiens
atttacaggtagaattttaagt

SEQ ID NO: 7091625 - DNA, 22 bp, Homo sapiens
atttctgataaacgtaagctgc

SEQ ID NO: 7091626 - DNA, 22 bp, Homo sapiens
atttctcttcctcctagggttg

SEQ ID NO: 7091627 - DNA, 22 bp, Homo sapiens
atttctttctggccacggtttt

SEQ ID NO: 7091628 - DNA, 22 bp, Homo sapiens
atttcttttcaagagggtgctt

SEQ ID NO: 7091629 - DNA, 23 bp, Homo sapiens
atttgaaactttcttgtttccag

SEQ ID NO: 7091630 - DNA, 23 bp, Homo sapiens
atttgaaactttcttgtttccag

SEQ ID NO: 7091631 - DNA, 22 bp, Homo sapiens
atttgaaaacctgagcctcccg

SEQ ID NO: 7091632 - DNA, 22 bp, Homo sapiens
attaaggcgttggcgtgcttat

SEQ ID NO: 7091633 - DNA, 22 bp, Homo sapiens
attaaggctgcactggccttaa

SEQ ID NO: 7091634 - DNA, 22 bp, Homo sapiens
attaaggtgtcaatgtatttgg

SEQ ID NO: 7091635 - DNA, 22 bp, Homo sapiens
attaagtatgcaatggtgcagt

SEQ ID NO: 7091636 - DNA, 22 bp, Homo sapiens
attaagtgactaaagtaatgct

SEQ ID NO: 7091637 - DNA, 22 bp, Homo sapiens
attaagtgactaaagtaatgct

SEQ ID NO: 7091638 - DNA, 22 bp, Homo sapiens
attaagtgactaaagtaatgct

SEQ ID NO: 7091639 - DNA, 22 bp, Homo sapiens
attaagtgactaaagtaatgct

SEQ ID NO: 7091640 - DNA, 22 bp, Homo sapiens
attaagtgactaaagtaatgct

SEQ ID NO: 7091641 - DNA, 22 bp, Homo sapiens
attaagtgactaaagtaatgct

SEQ ID NO: 7091642 - DNA, 22 bp, Homo sapiens
attaagtgactaaagtaatgct

SEQ ID NO: 7091643 - DNA, 22 bp, Homo sapiens
attaagtgactaaagtaatgct

SEQ ID NO: 7091644 - DNA, 22 bp, Homo sapiens
attaagtgactaaagtaatgct

SEQ ID NO: 7091645 - DNA, 22 bp, Homo sapiens
attaaggaagcctattctctcc

SEQ ID NO: 7091646 - DNA, 22 bp, Homo sapiens
attaagctggtccagacaagtt

SEQ ID NO: 7091647 - DNA, 22 bp, Homo sapiens
agagctctgcagctggcctcag

SEQ ID NO: 7091648 - DNA, 22 bp, Homo sapiens
agagctctcctagaccgcagag

SEQ ID NO: 7091649 - DNA, 22 bp, Homo sapiens
agagctctcttcataacggcct

SEQ ID NO: 7091650 - DNA, 22 bp, Homo sapiens
agagctctgcagctggcctcag

SEQ ID NO: 7091651 - DNA, 22 bp, Homo sapiens
agagctctggcctattggggcc

SEQ ID NO: 7091652 - DNA, 22 bp, Homo sapiens
agagctctgtgtctctttgggt

SEQ ID NO: 7091653 - DNA, 22 bp, Homo sapiens
agagctccaagaagtcctgcag

SEQ ID NO: 7091654 - DNA, 22 bp, Homo sapiens
agagctcaagacgctcacagta

SEQ ID NO: 7091655 - DNA, 21 bp, Homo sapiens
agagctcaaggcaaaaataat

SEQ ID NO: 7091656 - DNA, 22 bp, Homo sapiens
agagctatgatcaaggcagggt

SEQ ID NO: 7091657 - DNA, 22 bp, Homo sapiens
agagctccagggttttgtagtg

SEQ ID NO: 7091658 - DNA, 22 bp, Homo sapiens
agagctccgtgcctggctgcca

SEQ ID NO: 7091659 - DNA, 22 bp, Homo sapiens
agagctctcaatggtcaatgct

SEQ ID NO: 7091660 - DNA, 22 bp, Homo sapiens
agagctctcaatggtcaatgct

SEQ ID NO: 7091661 - DNA, 22 bp, Homo sapiens
atgttcaaactttttacacacc

SEQ ID NO: 7091662 - DNA, 22 bp, Homo sapiens
atgttcaaacaagttaatgcca

SEQ ID NO: 7091663 - DNA, 22 bp, Homo sapiens
atgttcaaactttttacacacc

SEQ ID NO: 7091664 - DNA, 22 bp, Homo sapiens
atgttcaaagatcgtgctatcc

SEQ ID NO: 7091665 - DNA, 22 bp, Homo sapiens
atgttcaagtacctttgtgtct

SEQ ID NO: 7091666 - DNA, 22 bp, Homo sapiens
atgttcaagtacctttgtgtct

SEQ ID NO: 7091667 - DNA, 21 bp, Homo sapiens
atgttcactgggtcaattaga

SEQ ID NO: 7091668 - DNA, 21 bp, Homo sapiens
atgttcactgggtcaattaga

SEQ ID NO: 7091669 - DNA, 22 bp, Homo sapiens
atgttcagcattctataaatat

SEQ ID NO: 7091670 - DNA, 22 bp, Homo sapiens
atgttcagcattctataaatat

SEQ ID NO: 7091671 - DNA, 22 bp, Homo sapiens
atgttcagcattctataaatat

SEQ ID NO: 7091672 - DNA, 22 bp, Homo sapiens
atgttcagttagcactgaagtc

SEQ ID NO: 7091673 - DNA, 22 bp, Homo sapiens
atgttcagtgcagtggcctgag

SEQ ID NO: 7091674 - DNA, 22 bp, Homo sapiens
atgttcatcaacacattacaag

SEQ ID NO: 7091675 - DNA, 22 bp, Homo sapiens
atgttcctgatcctcgttctat

SEQ ID NO: 7091676 - DNA, 22 bp, Homo sapiens
atgttcctggtatatcatgacc

SEQ ID NO: 7091677 - DNA, 22 bp, Homo sapiens
atgttcctggtatatcatgacc

SEQ ID NO: 7091678 - DNA, 22 bp, Homo sapiens
atgttccttgctctcaggtaag

SEQ ID NO: 7091679 - DNA, 22 bp, Homo sapiens
atgttctacagatggaaagggg

SEQ ID NO: 7091680 - DNA, 22 bp, Homo sapiens
atgttctatatcattattgtga

SEQ ID NO: 7091681 - DNA, 22 bp, Homo sapiens
agagcgagtctggggctcggat

SEQ ID NO: 7091682 - DNA, 22 bp, Homo sapiens
agagcgcactgtctgcaggcaa

SEQ ID NO: 7091683 - DNA, 22 bp, Homo sapiens
agagcggggatagttaatattc

SEQ ID NO: 7091684 - DNA, 22 bp, Homo sapiens
agagcggggatagttaatattc

SEQ ID NO: 7091685 - DNA, 22 bp, Homo sapiens
agagctaagaaacagaattgct

SEQ ID NO: 7091686 - DNA, 22 bp, Homo sapiens
agagccaggaagtggcgtgggg

SEQ ID NO: 7091687 - DNA, 22 bp, Homo sapiens
agagccaggaagtggcgtgggg

SEQ ID NO: 7091688 - DNA, 22 bp, Homo sapiens
agagccaggaagtggcgtgggg

SEQ ID NO: 7091689 - DNA, 22 bp, Homo sapiens
agagccaggaagtggcgtgggg

SEQ ID NO: 7091690 - DNA, 22 bp, Homo sapiens
agagccaggaagtggcgtgggg

SEQ ID NO: 7091691 - DNA, 22 bp, Homo sapiens
agagccagccttctcagcttac

SEQ ID NO: 7091692 - DNA, 22 bp, Homo sapiens
agagccagccttctcagcttac

SEQ ID NO: 7091693 - DNA, 22 bp, Homo sapiens
agagccagccttctcagcttac

SEQ ID NO: 7091694 - DNA, 22 bp, Homo sapiens
agagccagcatttgggccctgc

SEQ ID NO: 7091695 - DNA, 22 bp, Homo sapiens
agagccagcatttgggccctgc

SEQ ID NO: 7091696 - DNA, 22 bp, Homo sapiens
agagccagcatttgggccctgc

SEQ ID NO: 7091697 - DNA, 22 bp, Homo sapiens
agagccagcatttgacactggc

SEQ ID NO: 7091698 - DNA, 22 bp, Homo sapiens
agagccagcatttgacactggc

SEQ ID NO: 7091699 - DNA, 22 bp, Homo sapiens
agagccagcatttgacactggc

SEQ ID NO: 7091700 - DNA, 22 bp, Homo sapiens
agagccagcatttgacactggc

SEQ ID NO: 7091701 - DNA, 22 bp, Homo sapiens
agagccagcatttgacactggc

SEQ ID NO: 7091702 - DNA, 22 bp, Homo sapiens
agagccaggactgtgtctcact

SEQ ID NO: 7091703 - DNA, 22 bp, Homo sapiens
agagccaggatctgttttgggg

SEQ ID NO: 7091704 - DNA, 22 bp, Homo sapiens
agagccaggatgtcttctgggg

SEQ ID NO: 7091705 - DNA, 22 bp, Homo sapiens
agagccaggaagtggcgtgggg

SEQ ID NO: 7091706 - DNA, 22 bp, Homo sapiens
agagccaggactgtgtctcact

SEQ ID NO: 7091707 - DNA, 22 bp, Homo sapiens
agagccaggactgtgtctcact

SEQ ID NO: 7091708 - DNA, 22 bp, Homo sapiens
agagccaggactgtgtctcact

SEQ ID NO: 7091709 - DNA, 22 bp, Homo sapiens
atgttacactgtttcacgttcc

SEQ ID NO: 7091710 - DNA, 22 bp, Homo sapiens
atgttacagaaagcaaagatga

SEQ ID NO: 7091711 - DNA, 22 bp, Homo sapiens
agagccaggatgtcttctgggg

SEQ ID NO: 7091712 - DNA, 22 bp, Homo sapiens
agagccaggatgtcttctgggg

SEQ ID NO: 7091713 - DNA, 22 bp, Homo sapiens
agagccaggcaggcaatgttga

SEQ ID NO: 7091714 - DNA, 22 bp, Homo sapiens
atgttacagaaagcaaagatga

SEQ ID NO: 7091715 - DNA, 22 bp, Homo sapiens
atgttacagaaagcaaagatga

SEQ ID NO: 7091716 - DNA, 22 bp, Homo sapiens
atgttattttggaaaatacaaa

SEQ ID NO: 7091717 - DNA, 22 bp, Homo sapiens
agagatgtcgccttgcccaggg

SEQ ID NO: 7091718 - DNA, 22 bp, Homo sapiens
agagatgttcattcagcatgtt

SEQ ID NO: 7091719 - DNA, 22 bp, Homo sapiens
agagattaagtcacttggtcag

SEQ ID NO: 7091720 - DNA, 22 bp, Homo sapiens
agagattagcctggattatgca

SEQ ID NO: 7091721 - DNA, 22 bp, Homo sapiens
agagatggtagaacagtcataa

SEQ ID NO: 7091722 - DNA, 22 bp, Homo sapiens
agagatggtagaacagtcataa

SEQ ID NO: 7091723 - DNA, 18 bp, Homo sapiens
agagatggtgtagagttt

SEQ ID NO: 7091724 - DNA, 18 bp, Homo sapiens
agagatggtgtagagttt

SEQ ID NO: 7091725 - DNA, 18 bp, Homo sapiens
agagatggtgtagagttt

SEQ ID NO: 7091726 - DNA, 18 bp, Homo sapiens
agagatggtgtagagttt

SEQ ID NO: 7091727 - DNA, 22 bp, Homo sapiens
agagattgctagctggctttaa

SEQ ID NO: 7091728 - DNA, 22 bp, Homo sapiens
atgtcttgatattttactgttt

SEQ ID NO: 7091729 - DNA, 22 bp, Homo sapiens
atgtctttaaacttgagttgtt

SEQ ID NO: 7091730 - DNA, 22 bp, Homo sapiens
atgtgagtgctatgatagacag

SEQ ID NO: 7091731 - DNA, 22 bp, Homo sapiens
atgtctttaaacttgagttgtt

SEQ ID NO: 7091732 - DNA, 22 bp, Homo sapiens
atgtgatcaagaatgtgggaga

SEQ ID NO: 7091733 - DNA, 21 bp, Homo sapiens
atgtgattatatgacttttac

SEQ ID NO: 7091734 - DNA, 22 bp, Homo sapiens
atgtgattcccactgaatcact

SEQ ID NO: 7091735 - DNA, 22 bp, Homo sapiens
atgtgcaatggtgtcaccacat

SEQ ID NO: 7091736 - DNA, 22 bp, Homo sapiens
atgtgcaattattaagaagaga

SEQ ID NO: 7091737 - DNA, 22 bp, Homo sapiens
atgtgcacacagtgtcatgcaa

SEQ ID NO: 7091738 - DNA, 22 bp, Homo sapiens
atgtgcaaagtaaagtaatttt

SEQ ID NO: 7091739 - DNA, 23 bp, Homo sapiens
atgtgcaaagtgctacagtatag

SEQ ID NO: 7091740 - DNA, 23 bp, Homo sapiens
atgtgcaaagtgctacagtatag

SEQ ID NO: 7091741 - DNA, 22 bp, Homo sapiens
atgtgcagttggtggccaggag

SEQ ID NO: 7091742 - DNA, 22 bp, Homo sapiens
atgtgcataaacatattgttgg

SEQ ID NO: 7091743 - DNA, 22 bp, Homo sapiens
atgtgcatactcttggccagct

SEQ ID NO: 7091744 - DNA, 22 bp, Homo sapiens
atgtgcatgcacctggactgtg

SEQ ID NO: 7091745 - DNA, 22 bp, Homo sapiens
atgtgcacagtgctttttccca

SEQ ID NO: 7091746 - DNA, 23 bp, Homo sapiens
atgtgcacatctccttgtccacc

SEQ ID NO: 7091747 - DNA, 22 bp, Homo sapiens
atgtgcacggtgtcaaacgggg

SEQ ID NO: 7091748 - DNA, 22 bp, Homo sapiens
atgtgcagacctgggttagaac

SEQ ID NO: 7091749 - DNA, 21 bp, Homo sapiens
atgtgcagcaagcagcatgct

SEQ ID NO: 7091750 - DNA, 22 bp, Homo sapiens
atgtgcagcttttctagagaag

SEQ ID NO: 7091751 - DNA, 22 bp, Homo sapiens
atgtgcagcttttctagagaag

SEQ ID NO: 7091752 - DNA, 22 bp, Homo sapiens
agagaagacttacagccacagt

SEQ ID NO: 7091753 - DNA, 22 bp, Homo sapiens
agagaagacttacagccacagt

SEQ ID NO: 7091754 - DNA, 22 bp, Homo sapiens
agagaacatgacgtaatagtgg

SEQ ID NO: 7091755 - DNA, 22 bp, Homo sapiens
agagaacattagcaaaaacagc

SEQ ID NO: 7091756 - DNA, 22 bp, Homo sapiens
agagaacattagcaaaaacagc

SEQ ID NO: 7091757 - DNA, 22 bp, Homo sapiens
agagaacattagcaaaaacagc

SEQ ID NO: 7091758 - DNA, 22 bp, Homo sapiens
agagaacattagcaaaaacagc

SEQ ID NO: 7091759 - DNA, 22 bp, Homo sapiens
agagaacattagcaaaaacagc

SEQ ID NO: 7091760 - DNA, 22 bp, Homo sapiens
agagaacagcctcctagagaaa

SEQ ID NO: 7091761 - DNA, 22 bp, Homo sapiens
agagaacagcctcctagagaaa

SEQ ID NO: 7091762 - DNA, 22 bp, Homo sapiens
agagaacagcctcctagagaaa

SEQ ID NO: 7091763 - DNA, 22 bp, Homo sapiens
agagaacagtgttttgaaggag

SEQ ID NO: 7091764 - DNA, 22 bp, Homo sapiens
agagaacagtgttttgaaggag

SEQ ID NO: 7091765 - DNA, 22 bp, Homo sapiens
agagaacatattttgtatgatt

SEQ ID NO: 7091766 - DNA, 22 bp, Homo sapiens
agagaacatattttgtatgatt

SEQ ID NO: 7091767 - DNA, 22 bp, Homo sapiens
agagaacatattttgtatgatt

SEQ ID NO: 7091768 - DNA, 22 bp, Homo sapiens
agagaacatgacgtaatagtgg

SEQ ID NO: 7091769 - DNA, 22 bp, Homo sapiens
agagaacatgacgtaatagtgg

SEQ ID NO: 7091770 - DNA, 22 bp, Homo sapiens
agagaacatgacgtaatagtgg

SEQ ID NO: 7091771 - DNA, 22 bp, Homo sapiens
agagaacatgacgtaatagtgg

SEQ ID NO: 7091772 - DNA, 22 bp, Homo sapiens
atggacagcaactggaagcttc

SEQ ID NO: 7091773 - DNA, 22 bp, Homo sapiens
atggacagcaactggaagcttc

SEQ ID NO: 7091774 - DNA, 22 bp, Homo sapiens
atggacagctcttatgtgggca

SEQ ID NO: 7091775 - DNA, 22 bp, Homo sapiens
atggacagctcttatgtgggca

SEQ ID NO: 7091776 - DNA, 22 bp, Homo sapiens
atggacagctgacactcacatt

SEQ ID NO: 7091777 - DNA, 22 bp, Homo sapiens
atggacagctgacactcacatt

SEQ ID NO: 7091778 - DNA, 22 bp, Homo sapiens
atggacagctgacactcacatt

SEQ ID NO: 7091779 - DNA, 22 bp, Homo sapiens
atggacagctggcctcaaggga

SEQ ID NO: 7091780 - DNA, 22 bp, Homo sapiens
atggacagaaggtagcacctat

SEQ ID NO: 7091781 - DNA, 23 bp, Homo sapiens
atggacagaatgtttgtgttccc

SEQ ID NO: 7091782 - DNA, 22 bp, Homo sapiens
atggacagacactggccttctg

SEQ ID NO: 7091783 - DNA, 23 bp, Homo sapiens
atggacagaatgtttgtgttccc

SEQ ID NO: 7091784 - DNA, 22 bp, Homo sapiens
atggacagacactggccttctg

SEQ ID NO: 7091785 - DNA, 22 bp, Homo sapiens
atggacagagctgagctccacc

SEQ ID NO: 7091786 - DNA, 22 bp, Homo sapiens
atggacagattaacacagtaga

SEQ ID NO: 7091787 - DNA, 22 bp, Homo sapiens
atggacaatgtgaaactacaag

SEQ ID NO: 7091788 - DNA, 21 bp, Homo sapiens
atggacaattgagtgtctgtc

SEQ ID NO: 7091789 - DNA, 22 bp, Homo sapiens
atggacaatgccaatacagttt

SEQ ID NO: 7091790 - DNA, 22 bp, Homo sapiens
atggacaatgtgaaactacaag

SEQ ID NO: 7091791 - DNA, 22 bp, Homo sapiens
atggaatttggactggaagtcc

SEQ ID NO: 7091792 - DNA, 22 bp, Homo sapiens
atggacaaacagcaggttttgg

SEQ ID NO: 7091793 - DNA, 22 bp, Homo sapiens
atggacaaatgtaaggcataat

SEQ ID NO: 7091794 - DNA, 22 bp, Homo sapiens
agagaagacttacagccacagt

SEQ ID NO: 7091795 - DNA, 22 bp, Homo sapiens
atggaattaataggggaatact

SEQ ID NO: 7091796 - DNA, 18 bp, Homo sapiens
atgggaggggccaagaga

SEQ ID NO: 7091797 - DNA, 22 bp, Homo sapiens
atggacaggtggataggtggat

SEQ ID NO: 7091798 - DNA, 22 bp, Homo sapiens
atggacaggtggataggtggat

SEQ ID NO: 7091799 - DNA, 22 bp, Homo sapiens
atggacaggtggataggtggat

SEQ ID NO: 7091800 - DNA, 18 bp, Homo sapiens
atgggaggggccaagaga

SEQ ID NO: 7091801 - DNA, 18 bp, Homo sapiens
atgggaggggccaagaga

SEQ ID NO: 7091802 - DNA, 22 bp, Homo sapiens
atgggcagtaacagtggcagtc

SEQ ID NO: 7091803 - DNA, 23 bp, Homo sapiens
atggacagggtttcagggtcaca

SEQ ID NO: 7091804 - DNA, 22 bp, Homo sapiens
atggacaggtactgcagtgggt

SEQ ID NO: 7091805 - DNA, 22 bp, Homo sapiens
atggacaggtactgcagtgggt

SEQ ID NO: 7091806 - DNA, 22 bp, Homo sapiens
atggacaggtactgcagtgggt

SEQ ID NO: 7091807 - DNA, 22 bp, Homo sapiens
atggacaggcttataacagcaa

SEQ ID NO: 7091808 - DNA, 22 bp, Homo sapiens
atggacaggctgagcttcctca

SEQ ID NO: 7091809 - DNA, 22 bp, Homo sapiens
atggacaggctgagcttcctca

SEQ ID NO: 7091810 - DNA, 22 bp, Homo sapiens
atggacagctggcctcaaggga

SEQ ID NO: 7091811 - DNA, 22 bp, Homo sapiens
atggacaggaactcccttggca

SEQ ID NO: 7091812 - DNA, 22 bp, Homo sapiens
atggacaggaactcccttggca

SEQ ID NO: 7091813 - DNA, 22 bp, Homo sapiens
atggacaggctgagcttcctca

SEQ ID NO: 7091814 - DNA, 22 bp, Homo sapiens
atggacagggcacaggcgcaga

SEQ ID NO: 7091815 - DNA, 22 bp, Homo sapiens
atggacagggcacaggcgcaga

SEQ ID NO: 7091816 - DNA, 23 bp, Homo sapiens
atggacagggtttcagggtcaca

SEQ ID NO: 7091817 - DNA, 22 bp, Homo sapiens
atgggcagttaggaggccagga

SEQ ID NO: 7091818 - DNA, 22 bp, Homo sapiens
atgggcagttaggaggccagga

SEQ ID NO: 7091819 - DNA, 22 bp, Homo sapiens
atgggcagtgtattggaaggaa

SEQ ID NO: 7091820 - DNA, 22 bp, Homo sapiens
atgggcagtgtattggaaggaa

SEQ ID NO: 7091821 - DNA, 22 bp, Homo sapiens
atgggcagtgtattggaaggaa

SEQ ID NO: 7091822 - DNA, 22 bp, Homo sapiens
atgggcagtaacagtggcagtc

SEQ ID NO: 7091823 - DNA, 22 bp, Homo sapiens
atgggcagtaacagtggcagtc

SEQ ID NO: 7091824 - DNA, 22 bp, Homo sapiens
atgggcagtaacagtggcagtc

SEQ ID NO: 7091825 - DNA, 22 bp, Homo sapiens
atgggcagtaacagtggcagtc

SEQ ID NO: 7091826 - DNA, 16 bp, Homo sapiens
atgggcagtgaggaag

SEQ ID NO: 7091827 - DNA, 16 bp, Homo sapiens
atgggcagtgaggaag

SEQ ID NO: 7091828 - DNA, 23 bp, Homo sapiens
atgggccaagcaagacccatgac

SEQ ID NO: 7091829 - DNA, 22 bp, Homo sapiens
atgggccaagtaaacattctca

SEQ ID NO: 7091830 - DNA, 22 bp, Homo sapiens
atgggcagttaggaggccagga

SEQ ID NO: 7091831 - DNA, 22 bp, Homo sapiens
atgggcagttaggaggccagga

SEQ ID NO: 7091832 - DNA, 22 bp, Homo sapiens
atgggcagttaggaggccagga

SEQ ID NO: 7091833 - DNA, 21 bp, Homo sapiens
atgtagggtttgccttctcta

SEQ ID NO: 7091834 - DNA, 22 bp, Homo sapiens
atgtacatagcatcatctagga

SEQ ID NO: 7091835 - DNA, 22 bp, Homo sapiens
atgtacatagcatcatctagga

SEQ ID NO: 7091836 - DNA, 17 bp, Homo sapiens
agagagaaaagggccat

SEQ ID NO: 7091837 - DNA, 17 bp, Homo sapiens
agagagaaaagggccat

SEQ ID NO: 7091838 - DNA, 17 bp, Homo sapiens
agagagaaaagggccat

SEQ ID NO: 7091839 - DNA, 22 bp, Homo sapiens
agagagaagcaatcagtggcca

SEQ ID NO: 7091840 - DNA, 22 bp, Homo sapiens
agagactttgtctattttgttc

SEQ ID NO: 7091841 - DNA, 17 bp, Homo sapiens
agagagaaaagggccat

SEQ ID NO: 7091842 - DNA, 22 bp, Homo sapiens
agagactgtgtccatcgtgcct

SEQ ID NO: 7091843 - DNA, 22 bp, Homo sapiens
agagacttctgccttagcaaga

SEQ ID NO: 7091844 - DNA, 22 bp, Homo sapiens
agagactgtgccagccccatgc

SEQ ID NO: 7091845 - DNA, 22 bp, Homo sapiens
agagactgtacgtggcaagtat

SEQ ID NO: 7091846 - DNA, 22 bp, Homo sapiens
agagactgtacgtggcaagtat

SEQ ID NO: 7091847 - DNA, 22 bp, Homo sapiens
agagactgtcacataacagagg

SEQ ID NO: 7091848 - DNA, 22 bp, Homo sapiens
agagactgtcacataacagagg

SEQ ID NO: 7091849 - DNA, 21 bp, Homo sapiens
agagactgtcactgcagtacc

SEQ ID NO: 7091850 - DNA, 22 bp, Homo sapiens
agagactggagatgggcagtgt

SEQ ID NO: 7091851 - DNA, 22 bp, Homo sapiens
agagactggagatgggcagtgt

SEQ ID NO: 7091852 - DNA, 19 bp, Homo sapiens
agagactgccaccagctgt

SEQ ID NO: 7091853 - DNA, 22 bp, Homo sapiens
agagactgcgtgtcagcgctgg

SEQ ID NO: 7091854 - DNA, 22 bp, Homo sapiens
agagactggagttacgagttca

SEQ ID NO: 7091855 - DNA, 22 bp, Homo sapiens
agagactggcttctaaaatggc

SEQ ID NO: 7091856 - DNA, 22 bp, Homo sapiens
agagactggagttacgagttca

SEQ ID NO: 7091857 - DNA, 22 bp, Homo sapiens
agagactgtaatgagaggtaca

SEQ ID NO: 7091858 - DNA, 22 bp, Homo sapiens
agagactgtaatgagaggtaca

SEQ ID NO: 7091859 - DNA, 22 bp, Homo sapiens
agagactgtaatgagaggtaca

SEQ ID NO: 7091860 - DNA, 22 bp, Homo sapiens
agagactgtacgtggcaagtat

SEQ ID NO: 7091861 - DNA, 22 bp, Homo sapiens
atgggctcggcgctgctgggat

SEQ ID NO: 7091862 - DNA, 22 bp, Homo sapiens
atgggctcggcgctgctgggat

SEQ ID NO: 7091863 - DNA, 22 bp, Homo sapiens
atgggccttgacacatggagtg

SEQ ID NO: 7091864 - DNA, 22 bp, Homo sapiens
atgggccttgacacatggagtg

SEQ ID NO: 7091865 - DNA, 22 bp, Homo sapiens
agagactgatggatcaccaaat

SEQ ID NO: 7091866 - DNA, 22 bp, Homo sapiens
agagactgcaaatcataagaat

SEQ ID NO: 7091867 - DNA, 22 bp, Homo sapiens
agagactgcaaatcataagaat

SEQ ID NO: 7091868 - DNA, 22 bp, Homo sapiens
agagactgcaatgagtggtagg

SEQ ID NO: 7091869 - DNA, 22 bp, Homo sapiens
agagactgcaatgagtggtagg

SEQ ID NO: 7091870 - DNA, 22 bp, Homo sapiens
agagactgcaatgagtggtagg

SEQ ID NO: 7091871 - DNA, 22 bp, Homo sapiens
agagactgcaatgagtggtagg

SEQ ID NO: 7091872 - DNA, 20 bp, Homo sapiens
atgtatattactggctgtga

SEQ ID NO: 7091873 - DNA, 22 bp, Homo sapiens
atgtatatgcatgcattcaaag

SEQ ID NO: 7091874 - DNA, 22 bp, Homo sapiens
atgtatatgcatgcattcaaag

SEQ ID NO: 7091875 - DNA, 22 bp, Homo sapiens
atgtatatgtgaaagatgttta

SEQ ID NO: 7091876 - DNA, 22 bp, Homo sapiens
agagatggcgtctcagagcctg

SEQ ID NO: 7091877 - DNA, 22 bp, Homo sapiens
agagatgggaaggcagacttca

SEQ ID NO: 7091878 - DNA, 18 bp, Homo sapiens
agagatgggagttggaaa

SEQ ID NO: 7091879 - DNA, 18 bp, Homo sapiens
agagatgggagttggaaa

SEQ ID NO: 7091880 - DNA, 18 bp, Homo sapiens
agagatgggagttggaaa

SEQ ID NO: 7091881 - DNA, 22 bp, Homo sapiens
agagatgggcgggggcttctgc

SEQ ID NO: 7091882 - DNA, 22 bp, Homo sapiens
agagatgggcgggggcttctgc

SEQ ID NO: 7091883 - DNA, 22 bp, Homo sapiens
agagatgggcgggggcttctgc

SEQ ID NO: 7091884 - DNA, 20 bp, Homo sapiens
agagatggggtatcaccgta

SEQ ID NO: 7091885 - DNA, 22 bp, Homo sapiens
agagatggtagaacagtcataa

SEQ ID NO: 7091886 - DNA, 20 bp, Homo sapiens
agagatggggtatcaccgta

SEQ ID NO: 7091887 - DNA, 22 bp, Homo sapiens
atgtagtgtagagattagtctc

SEQ ID NO: 7091888 - DNA, 22 bp, Homo sapiens
atgtagtgccctttgtcatcta

SEQ ID NO: 7091889 - DNA, 22 bp, Homo sapiens
atgtagtgccctttgtcatcta

SEQ ID NO: 7091890 - DNA, 22 bp, Homo sapiens
atgtagtgccctttgtcatcta

SEQ ID NO: 7091891 - DNA, 21 bp, Homo sapiens
atgtagtgacttcattccttc

SEQ ID NO: 7091892 - DNA, 22 bp, Homo sapiens
atgtagtaatcacacccagcaa

SEQ ID NO: 7091893 - DNA, 22 bp, Homo sapiens
atgtagtactgggtatgtttct

SEQ ID NO: 7091894 - DNA, 22 bp, Homo sapiens
atgtagtatctatatttcatgg

SEQ ID NO: 7091895 - DNA, 22 bp, Homo sapiens
atgtagtatctatatttcatgg

SEQ ID NO: 7091896 - DNA, 22 bp, Homo sapiens
atgtagttagaagattcaaaca

SEQ ID NO: 7091897 - DNA, 22 bp, Homo sapiens
atgtagttgaagtgctataaag

SEQ ID NO: 7091898 - DNA, 22 bp, Homo sapiens
atgtagttgaagtgctataaag

SEQ ID NO: 7091899 - DNA, 22 bp, Homo sapiens
atgtataatgctaattagctag

SEQ ID NO: 7091900 - DNA, 22 bp, Homo sapiens
atgtatatgaagctagtatttt

SEQ ID NO: 7091901 - DNA, 22 bp, Homo sapiens
atgtatatacttacatgtgtgg

SEQ ID NO: 7091902 - DNA, 22 bp, Homo sapiens
atgtatatgaagctagtatttt

SEQ ID NO: 7091903 - DNA, 22 bp, Homo sapiens
atgtatatgaagctagtatttt

SEQ ID NO: 7091904 - DNA, 22 bp, Homo sapiens
atgtatatgaagctagtatttt

SEQ ID NO: 7091905 - DNA, 22 bp, Homo sapiens
atgtatacgtgcaagtcacagg

SEQ ID NO: 7091906 - DNA, 22 bp, Homo sapiens
atgtatactaacacatgcagtt

SEQ ID NO: 7091907 - DNA, 22 bp, Homo sapiens
atgtataatgctaattagctag

SEQ ID NO: 7091908 - DNA, 22 bp, Homo sapiens
atgtatacgtgcaagtcacagg

SEQ ID NO: 7091909 - DNA, 22 bp, Homo sapiens
atgtataatgctaattagctag

SEQ ID NO: 7091910 - DNA, 22 bp, Homo sapiens
atgctgaattgatgcgagggag

SEQ ID NO: 7091911 - DNA, 22 bp, Homo sapiens
atgctgaatattagcctcatga

SEQ ID NO: 7091912 - DNA, 22 bp, Homo sapiens
atgctgaatgaaagaaattagt

SEQ ID NO: 7091913 - DNA, 22 bp, Homo sapiens
atgctgaatgaaagaaattagt

SEQ ID NO: 7091914 - DNA, 22 bp, Homo sapiens
atgctgaatagttcactcttct

SEQ ID NO: 7091915 - DNA, 22 bp, Homo sapiens
atgctgaaggtgaattgacaat

SEQ ID NO: 7091916 - DNA, 22 bp, Homo sapiens
atgctgaaggtgaattgacaat

SEQ ID NO: 7091917 - DNA, 22 bp, Homo sapiens
atgctgaagagttcatgattat

SEQ ID NO: 7091918 - DNA, 22 bp, Homo sapiens
atgctgaagagttcatgattat

SEQ ID NO: 7091919 - DNA, 22 bp, Homo sapiens
atgctgaagagtgcacaggcta

SEQ ID NO: 7091920 - DNA, 22 bp, Homo sapiens
atgctgaagagtgcacaggcta

SEQ ID NO: 7091921 - DNA, 22 bp, Homo sapiens
atgctgaagaatcacagggact

SEQ ID NO: 7091922 - DNA, 22 bp, Homo sapiens
atgctgaactgagatgtaactt

SEQ ID NO: 7091923 - DNA, 22 bp, Homo sapiens
atgctgaactgagatgtaactt

SEQ ID NO: 7091924 - DNA, 22 bp, Homo sapiens
atgctaaaaacttgatcattat

SEQ ID NO: 7091925 - DNA, 22 bp, Homo sapiens
atgctaaactatgatcattttc

SEQ ID NO: 7091926 - DNA, 22 bp, Homo sapiens
atgctgaaaattggatttgaat

SEQ ID NO: 7091927 - DNA, 22 bp, Homo sapiens
atgctgaaatttattggtaagg

SEQ ID NO: 7091928 - DNA, 22 bp, Homo sapiens
agacatatattgcaattcactg

SEQ ID NO: 7091929 - DNA, 22 bp, Homo sapiens
atgcgtgcaggggtcctcctgg

SEQ ID NO: 7091930 - DNA, 22 bp, Homo sapiens
atgcgtgtaggaacagtgtcta

SEQ ID NO: 7091931 - DNA, 22 bp, Homo sapiens
atgcgtgtgtgcaaaccattgc

SEQ ID NO: 7091932 - DNA, 22 bp, Homo sapiens
atgcgtgtttgtatacacacaa

SEQ ID NO: 7091933 - DNA, 22 bp, Homo sapiens
atgctaaaaacttgatcattat

SEQ ID NO: 7091934 - DNA, 22 bp, Homo sapiens
atgctgcagtcaggccagattg

SEQ ID NO: 7091935 - DNA, 22 bp, Homo sapiens
atgcttaatgagggtatatatg

SEQ ID NO: 7091936 - DNA, 22 bp, Homo sapiens
atgcttaatgagggtatatatg

SEQ ID NO: 7091937 - DNA, 22 bp, Homo sapiens
atgcttaggttaaatttgtaat

SEQ ID NO: 7091938 - DNA, 22 bp, Homo sapiens
atgctgatctgtaataagattt

SEQ ID NO: 7091939 - DNA, 22 bp, Homo sapiens
atgctgatgaggtcaggaagac

SEQ ID NO: 7091940 - DNA, 22 bp, Homo sapiens
atgctgattcctgggctccacc

SEQ ID NO: 7091941 - DNA, 22 bp, Homo sapiens
atgctgcagctgcaggatcaga

SEQ ID NO: 7091942 - DNA, 22 bp, Homo sapiens
atgctgagtgagtgaaacccag

SEQ ID NO: 7091943 - DNA, 22 bp, Homo sapiens
atgctgaggacaaagagatcaa

SEQ ID NO: 7091944 - DNA, 22 bp, Homo sapiens
agagaaaagccatcccagccaa

SEQ ID NO: 7091945 - DNA, 22 bp, Homo sapiens
agagaaaagccatcccagccaa

SEQ ID NO: 7091946 - DNA, 22 bp, Homo sapiens
agagaaaagccatcccagccaa

SEQ ID NO: 7091947 - DNA, 22 bp, Homo sapiens
agagaaaagccatcccagccaa

SEQ ID NO: 7091948 - DNA, 22 bp, Homo sapiens
agagaacaaattaaaggtggtt

SEQ ID NO: 7091949 - DNA, 22 bp, Homo sapiens
agagaacaaattaaaggtggtt

SEQ ID NO: 7091950 - DNA, 22 bp, Homo sapiens
agagaacacgtgcatctgcaat

SEQ ID NO: 7091951 - DNA, 22 bp, Homo sapiens
agagaacaaattaaaggtggtt

SEQ ID NO: 7091952 - DNA, 22 bp, Homo sapiens
agagaacaaattaaaggtggtt

SEQ ID NO: 7091953 - DNA, 22 bp, Homo sapiens
agagaacaaattaaaggtggtt

SEQ ID NO: 7091954 - DNA, 22 bp, Homo sapiens
agagaacaaattaaaggtggtt

SEQ ID NO: 7091955 - DNA, 22 bp, Homo sapiens
agagaacagacagatgcaatga

SEQ ID NO: 7091956 - DNA, 22 bp, Homo sapiens
agagaacacgtgcatctgcaat

SEQ ID NO: 7091957 - DNA, 22 bp, Homo sapiens
agagaacagacagatgcaatga

SEQ ID NO: 7091958 - DNA, 22 bp, Homo sapiens
agagaacagcattgcagctttg

SEQ ID NO: 7091959 - DNA, 22 bp, Homo sapiens
agagaacagcattgcagctttg

SEQ ID NO: 7091960 - DNA, 22 bp, Homo sapiens
atgcttcagtgctaccttcaaa

SEQ ID NO: 7091961 - DNA, 23 bp, Homo sapiens
atgcttccacagagcttgcagcc

SEQ ID NO: 7091962 - DNA, 20 bp, Homo sapiens
atgcttccagggtgtgtctg

SEQ ID NO: 7091963 - DNA, 22 bp, Homo sapiens
atgcttccctttgctccacatg

SEQ ID NO: 7091964 - DNA, 22 bp, Homo sapiens
atgcttcctaaccatggccgtg

SEQ ID NO: 7091965 - DNA, 22 bp, Homo sapiens
agacataattaattagttctac

SEQ ID NO: 7091966 - DNA, 22 bp, Homo sapiens
agacataagtgctatgacattg

SEQ ID NO: 7091967 - DNA, 22 bp, Homo sapiens
agacataagcgagcatcacagg

SEQ ID NO: 7091968 - DNA, 22 bp, Homo sapiens
agacataagccagtcactcact

SEQ ID NO: 7091969 - DNA, 22 bp, Homo sapiens
agacagttgatatactataaaa

SEQ ID NO: 7091970 - DNA, 22 bp, Homo sapiens
agacagttgatatactataaaa

SEQ ID NO: 7091971 - DNA, 22 bp, Homo sapiens
agacataaacttactgaaatac

SEQ ID NO: 7091972 - DNA, 22 bp, Homo sapiens
agacataaacttactgaaatac

SEQ ID NO: 7091973 - DNA, 22 bp, Homo sapiens
agacagtgtgagttcagggtgg

SEQ ID NO: 7091974 - DNA, 20 bp, Homo sapiens
agacagtgtggagattcctt

SEQ ID NO: 7091975 - DNA, 22 bp, Homo sapiens
agacagtgtggttggtggttcc

SEQ ID NO: 7091976 - DNA, 22 bp, Homo sapiens
agacagtggctcagccccagtc

SEQ ID NO: 7091977 - DNA, 22 bp, Homo sapiens
agacagtgtgagttcagggtgg

SEQ ID NO: 7091978 - DNA, 22 bp, Homo sapiens
atgccaggctgtttggcctcag

SEQ ID NO: 7091979 - DNA, 22 bp, Homo sapiens
atgccagggtcatcccctgggt

SEQ ID NO: 7091980 - DNA, 22 bp, Homo sapiens
atgccaggtacaggggtagggt

SEQ ID NO: 7091981 - DNA, 22 bp, Homo sapiens
atgccaggtacaggggtagggt

SEQ ID NO: 7091982 - DNA, 22 bp, Homo sapiens
atgccagtcaaagaagatgaca

SEQ ID NO: 7091983 - DNA, 22 bp, Homo sapiens
atgccagtgttataaatagata

SEQ ID NO: 7091984 - DNA, 22 bp, Homo sapiens
atgccatcaatgacagagttag

SEQ ID NO: 7091985 - DNA, 22 bp, Homo sapiens
atgccatcacttttccttttgt

SEQ ID NO: 7091986 - DNA, 22 bp, Homo sapiens
atgccatcctaattacgttgaa

SEQ ID NO: 7091987 - DNA, 22 bp, Homo sapiens
atgccatcgtgaagtaagacat

SEQ ID NO: 7091988 - DNA, 22 bp, Homo sapiens
atgccatctcttcattttatag

SEQ ID NO: 7091989 - DNA, 22 bp, Homo sapiens
atgccatctgaaatctgtcata

SEQ ID NO: 7091990 - DNA, 22 bp, Homo sapiens
atgccatcttcattctcacact

SEQ ID NO: 7091991 - DNA, 22 bp, Homo sapiens
atgccatcttcattctcacact

SEQ ID NO: 7091992 - DNA, 22 bp, Homo sapiens
atgccattgctttaaaattaag

SEQ ID NO: 7091993 - DNA, 22 bp, Homo sapiens
atgccatcttttattcttctag

SEQ ID NO: 7091994 - DNA, 22 bp, Homo sapiens
atgccattgtatattcattgat

SEQ ID NO: 7091995 - DNA, 22 bp, Homo sapiens
atgccattattaggactgaatc

SEQ ID NO: 7091996 - DNA, 22 bp, Homo sapiens
atgccattgctttaaaattaag

SEQ ID NO: 7091997 - DNA, 22 bp, Homo sapiens
atgccatttcaaaataagattt

SEQ ID NO: 7091998 - DNA, 22 bp, Homo sapiens
atgccatttgctggaaggaagt

SEQ ID NO: 7091999 - DNA, 22 bp, Homo sapiens
atgccatttgcatcagcggttt

SEQ ID NO: 7092000 - DNA, 22 bp, Homo sapiens
agacagtggatcgggatgcact

SEQ ID NO: 7092001 - DNA, 22 bp, Homo sapiens
agacagtggatcgggatgcact

SEQ ID NO: 7092002 - DNA, 22 bp, Homo sapiens
agacagtggatcgggatgcact

SEQ ID NO: 7092003 - DNA, 23 bp, Homo sapiens
agacagtggccgagaggtactag

SEQ ID NO: 7092004 - DNA, 23 bp, Homo sapiens
agacagtggccgagaggtactag

SEQ ID NO: 7092005 - DNA, 19 bp, Homo sapiens
agacagtggctaggactta

SEQ ID NO: 7092006 - DNA, 22 bp, Homo sapiens
atgccaggaacaaacagtggtg

SEQ ID NO: 7092007 - DNA, 22 bp, Homo sapiens
atgccagcctctaagcacttta

SEQ ID NO: 7092008 - DNA, 22 bp, Homo sapiens
atgccaggaacaaacagtggtg

SEQ ID NO: 7092009 - DNA, 22 bp, Homo sapiens
atgccaggagatggagcagagt

SEQ ID NO: 7092010 - DNA, 23 bp, Homo sapiens
atgccaggctgcctggccagcct

SEQ ID NO: 7092011 - DNA, 22 bp, Homo sapiens
atgccaggctgtttggcctcag

SEQ ID NO: 7092012 - DNA, 22 bp, Homo sapiens
atgccaggctgtttggcctcag

SEQ ID NO: 7092013 - DNA, 22 bp, Homo sapiens
atgccactgcactccagcctag

SEQ ID NO: 7092014 - DNA, 22 bp, Homo sapiens
atgccactgacatggacaattt

SEQ ID NO: 7092015 - DNA, 22 bp, Homo sapiens
atgccactgacatggacaattt

SEQ ID NO: 7092016 - DNA, 22 bp, Homo sapiens
atgccactgcactccagcctag

SEQ ID NO: 7092017 - DNA, 22 bp, Homo sapiens
atgccactgcactccagcctag

SEQ ID NO: 7092018 - DNA, 22 bp, Homo sapiens
atgccactgcactccagcctag

SEQ ID NO: 7092019 - DNA, 22 bp, Homo sapiens
atgccacttcattccagcctcg

SEQ ID NO: 7092020 - DNA, 22 bp, Homo sapiens
atgccacttcattccagcctcg

SEQ ID NO: 7092021 - DNA, 22 bp, Homo sapiens
atgccacttcattccagcctcg

SEQ ID NO: 7092022 - DNA, 22 bp, Homo sapiens
atgccacttctctaagtcatgt

SEQ ID NO: 7092023 - DNA, 22 bp, Homo sapiens
atgcaaattgccataaagtggg

SEQ ID NO: 7092024 - DNA, 22 bp, Homo sapiens
atgcaaattgccataaagtggg

SEQ ID NO: 7092025 - DNA, 19 bp, Homo sapiens
atgcaacaaaagtgtaaga

SEQ ID NO: 7092026 - DNA, 22 bp, Homo sapiens
atgcaaattcttaggctccatc

SEQ ID NO: 7092027 - DNA, 22 bp, Homo sapiens
atgcaaattcttaggctccatc

SEQ ID NO: 7092028 - DNA, 22 bp, Homo sapiens
atgcaaattctttgcttcttct

SEQ ID NO: 7092029 - DNA, 22 bp, Homo sapiens
atgcaaattctttgcttcttct

SEQ ID NO: 7092030 - DNA, 22 bp, Homo sapiens
atgcaaattgccataaagtggg

SEQ ID NO: 7092031 - DNA, 22 bp, Homo sapiens
atgcaaattgccataaagtggg

SEQ ID NO: 7092032 - DNA, 19 bp, Homo sapiens
atgcaacaaaagtgtaaga

SEQ ID NO: 7092033 - DNA, 22 bp, Homo sapiens
atgcaacaaatgctacgaatcg

SEQ ID NO: 7092034 - DNA, 22 bp, Homo sapiens
atgcaacaatgtatttatgtat

SEQ ID NO: 7092035 - DNA, 22 bp, Homo sapiens
atgcaacagctgggaatatgta

SEQ ID NO: 7092036 - DNA, 22 bp, Homo sapiens
atgcaacagtcagtacatccgg

SEQ ID NO: 7092037 - DNA, 22 bp, Homo sapiens
atgcaacagttcatagttttat

SEQ ID NO: 7092038 - DNA, 22 bp, Homo sapiens
atctggggtcagacagccctgg

SEQ ID NO: 7092039 - DNA, 22 bp, Homo sapiens
atctgggggagctgctcatgga

SEQ ID NO: 7092040 - DNA, 22 bp, Homo sapiens
atctggggtcagacagccctgg

SEQ ID NO: 7092041 - DNA, 22 bp, Homo sapiens
atctggggcctgggctagccat

SEQ ID NO: 7092042 - DNA, 22 bp, Homo sapiens
atctggggtcagacagccctgg

SEQ ID NO: 7092043 - DNA, 22 bp, Homo sapiens
atctgggtagtgcaagacatga

SEQ ID NO: 7092044 - DNA, 22 bp, Homo sapiens
atctgggtcacagtggcatcta

SEQ ID NO: 7092045 - DNA, 22 bp, Homo sapiens
atctgggtctgaagataatgat

SEQ ID NO: 7092046 - DNA, 22 bp, Homo sapiens
atctggggaggtatctgtagtc

SEQ ID NO: 7092047 - DNA, 22 bp, Homo sapiens
atctgggctcgaatcctagctc

SEQ ID NO: 7092048 - DNA, 22 bp, Homo sapiens
atctggggaggtatctgtagtc

SEQ ID NO: 7092049 - DNA, 22 bp, Homo sapiens
atctggggccccggaagttcct

SEQ ID NO: 7092050 - DNA, 22 bp, Homo sapiens
atctggggcctgggctagccat

SEQ ID NO: 7092051 - DNA, 22 bp, Homo sapiens
atctgttttgatacagttttat

SEQ ID NO: 7092052 - DNA, 22 bp, Homo sapiens
atcttaaacagaggaatgactt

SEQ ID NO: 7092053 - DNA, 22 bp, Homo sapiens
atctgtttaattcattttcaca

SEQ ID NO: 7092054 - DNA, 22 bp, Homo sapiens
atctggctgactttgtgggaca

SEQ ID NO: 7092055 - DNA, 22 bp, Homo sapiens
atctggctgagcgaggcccaca

SEQ ID NO: 7092056 - DNA, 22 bp, Homo sapiens
atctggcttacgaagcactggt

SEQ ID NO: 7092057 - DNA, 22 bp, Homo sapiens
atctggcttgactttgcgactt

SEQ ID NO: 7092058 - DNA, 22 bp, Homo sapiens
atctggcttgggtgtgggtagc

SEQ ID NO: 7092059 - DNA, 22 bp, Homo sapiens
atctggcttttaccccacggcc

SEQ ID NO: 7092060 - DNA, 22 bp, Homo sapiens
atctgggcagggcagcaaggcg

SEQ ID NO: 7092061 - DNA, 22 bp, Homo sapiens
atctgggcatggaggaaagaga

SEQ ID NO: 7092062 - DNA, 22 bp, Homo sapiens
atctgggcgtataggtgcaagt

SEQ ID NO: 7092063 - DNA, 22 bp, Homo sapiens
atcttagagagtcgtgttttgt

SEQ ID NO: 7092064 - DNA, 22 bp, Homo sapiens
atgacaatacttcaataagctg

SEQ ID NO: 7092065 - DNA, 22 bp, Homo sapiens
atcttagggttctgtttttaag

SEQ ID NO: 7092066 - DNA, 22 bp, Homo sapiens
atgacaatacttcaataagctg

SEQ ID NO: 7092067 - DNA, 22 bp, Homo sapiens
atgacaatatagctttgatttt

SEQ ID NO: 7092068 - DNA, 22 bp, Homo sapiens
atgacaatatagctttgatttt

SEQ ID NO: 7092069 - DNA, 23 bp, Homo sapiens
atcttacatatttagcacctgaa

SEQ ID NO: 7092070 - DNA, 22 bp, Homo sapiens
atcttaccctcaacacatccag

SEQ ID NO: 7092071 - DNA, 22 bp, Homo sapiens
atcttacctcttcctctgcatt

SEQ ID NO: 7092072 - DNA, 22 bp, Homo sapiens
atcttaccttctacaggcactg

SEQ ID NO: 7092073 - DNA, 22 bp, Homo sapiens
atcttaccttgcactggtcata

SEQ ID NO: 7092074 - DNA, 22 bp, Homo sapiens
atcttagaagtttgataaaatc

SEQ ID NO: 7092075 - DNA, 22 bp, Homo sapiens
atcttagacccttggtagaaaa

SEQ ID NO: 7092076 - DNA, 22 bp, Homo sapiens
atcttagagagtcgtgttttgt

SEQ ID NO: 7092077 - DNA, 22 bp, Homo sapiens
atcttaaacagaggaatgactt

SEQ ID NO: 7092078 - DNA, 22 bp, Homo sapiens
atcttaagcttcatcaaccctg

SEQ ID NO: 7092079 - DNA, 22 bp, Homo sapiens
atcttaatcgagtccatgaaaa

SEQ ID NO: 7092080 - DNA, 22 bp, Homo sapiens
atcttacaattacaagacactc

SEQ ID NO: 7092081 - DNA, 22 bp, Homo sapiens
atcttacaattacaagacactc

SEQ ID NO: 7092082 - DNA, 22 bp, Homo sapiens
atcttacacgataactgttagt

SEQ ID NO: 7092083 - DNA, 22 bp, Homo sapiens
atcttacacgataactgttagt

SEQ ID NO: 7092084 - DNA, 22 bp, Homo sapiens
atcttacagcagcaaggaagta

SEQ ID NO: 7092085 - DNA, 22 bp, Homo sapiens
atcttacagcagcaaggaagta

SEQ ID NO: 7092086 - DNA, 22 bp, Homo sapiens
atgaccagccgagataaacaga

SEQ ID NO: 7092087 - DNA, 22 bp, Homo sapiens
atgaccagccgagataaacaga

SEQ ID NO: 7092088 - DNA, 22 bp, Homo sapiens
atgacattgacagacctgctgc

SEQ ID NO: 7092089 - DNA, 22 bp, Homo sapiens
atgacatttatacagtgagctt

SEQ ID NO: 7092090 - DNA, 22 bp, Homo sapiens
atgacatttatacagtgagctt

SEQ ID NO: 7092091 - DNA, 22 bp, Homo sapiens
atgacatttatacagtgagctt

SEQ ID NO: 7092092 - DNA, 22 bp, Homo sapiens
atgacccttactgcatcataca

SEQ ID NO: 7092093 - DNA, 22 bp, Homo sapiens
atgacctgagacagcgctctgt

SEQ ID NO: 7092094 - DNA, 22 bp, Homo sapiens
atgactaatggaaaatacaatg

SEQ ID NO: 7092095 - DNA, 22 bp, Homo sapiens
atgactcagaagatattttcca

SEQ ID NO: 7092096 - DNA, 22 bp, Homo sapiens
atgactgaagggttttaaacag

SEQ ID NO: 7092097 - DNA, 22 bp, Homo sapiens
atgacttaatcatacttgcatt

SEQ ID NO: 7092098 - DNA, 22 bp, Homo sapiens
atgacttaatcatacttgcatt

SEQ ID NO: 7092099 - DNA, 22 bp, Homo sapiens
atgacttattacaagtcatatt

SEQ ID NO: 7092100 - DNA, 22 bp, Homo sapiens
atgaggacaaagtgtagcagcc

SEQ ID NO: 7092101 - DNA, 22 bp, Homo sapiens
atgaggagaccaaggcctgatg

SEQ ID NO: 7092102 - DNA, 22 bp, Homo sapiens
atgagaaagagttgtatctaga

SEQ ID NO: 7092103 - DNA, 22 bp, Homo sapiens
atgagaaagagttgtatctaga

SEQ ID NO: 7092104 - DNA, 22 bp, Homo sapiens
atgaggaagtctgataatggta

SEQ ID NO: 7092105 - DNA, 22 bp, Homo sapiens
atgaggagctgttttaactgct

SEQ ID NO: 7092106 - DNA, 22 bp, Homo sapiens
atgacttctgctttacagagtt

SEQ ID NO: 7092107 - DNA, 22 bp, Homo sapiens
atgacttctgctttacagagtt

SEQ ID NO: 7092108 - DNA, 22 bp, Homo sapiens
atgacttcgttttctctctgca

SEQ ID NO: 7092109 - DNA, 22 bp, Homo sapiens
atgacttattacaagtcatatt

SEQ ID NO: 7092110 - DNA, 22 bp, Homo sapiens
atgactttcctggcaaaagttg

SEQ ID NO: 7092111 - DNA, 22 bp, Homo sapiens
atgacttttaaaagctggtact

SEQ ID NO: 7092112 - DNA, 22 bp, Homo sapiens
atgagaaaattcattccatcca

SEQ ID NO: 7092113 - DNA, 22 bp, Homo sapiens
atgagaaaattgaggcccatag

SEQ ID NO: 7092114 - DNA, 22 bp, Homo sapiens
atgagaaaattgaggcccatag

SEQ ID NO: 7092115 - DNA, 22 bp, Homo sapiens
atgaggcaaggatcaggtaagg

SEQ ID NO: 7092116 - DNA, 22 bp, Homo sapiens
atgaggcaaggctggccgtgtt

SEQ ID NO: 7092117 - DNA, 22 bp, Homo sapiens
atgaggcaaggctggccgtgtt

SEQ ID NO: 7092118 - DNA, 22 bp, Homo sapiens
atgaggcaaaggtggaggtggg

SEQ ID NO: 7092119 - DNA, 22 bp, Homo sapiens
atgaggcaaaggtggaggtggg

SEQ ID NO: 7092120 - DNA, 22 bp, Homo sapiens
atgaggcaaggatcaggtaagg

SEQ ID NO: 7092121 - DNA, 22 bp, Homo sapiens
atgaggcaaaggtggaggtggg

SEQ ID NO: 7092122 - DNA, 22 bp, Homo sapiens
atgaggatgggaagggagccaa

SEQ ID NO: 7092123 - DNA, 22 bp, Homo sapiens
atgatatatgtgttgagcttgc

SEQ ID NO: 7092124 - DNA, 22 bp, Homo sapiens
atgatatagagagtagattaaa

SEQ ID NO: 7092125 - DNA, 22 bp, Homo sapiens
atgaggcacatcacagccaatg

SEQ ID NO: 7092126 - DNA, 22 bp, Homo sapiens
atgaggcaatcatggtccagtt

SEQ ID NO: 7092127 - DNA, 22 bp, Homo sapiens
atgaggcacagagatgttaatg

SEQ ID NO: 7092128 - DNA, 22 bp, Homo sapiens
atgaggcaatagaatattgaat

SEQ ID NO: 7092129 - DNA, 22 bp, Homo sapiens
atgattccttgaagcctcatga

SEQ ID NO: 7092130 - DNA, 20 bp, Homo sapiens
atgattcatgatgatgtctc

SEQ ID NO: 7092131 - DNA, 17 bp, Homo sapiens
atgattccatcaggatt

SEQ ID NO: 7092132 - DNA, 19 bp, Homo sapiens
atgattcccagggaggggg

SEQ ID NO: 7092133 - DNA, 22 bp, Homo sapiens
atgatatatgtgttgagcttgc

SEQ ID NO: 7092134 - DNA, 22 bp, Homo sapiens
atgatatatgtgttgagcttgc

SEQ ID NO: 7092135 - DNA, 20 bp, Homo sapiens
atgattcatgatgatgtctc

SEQ ID NO: 7092136 - DNA, 20 bp, Homo sapiens
atgattcatgatgatgtctc

SEQ ID NO: 7092137 - DNA, 22 bp, Homo sapiens
atgattctcattttactgtgat

SEQ ID NO: 7092138 - DNA, 22 bp, Homo sapiens
atgattctaggcattgaagata

SEQ ID NO: 7092139 - DNA, 22 bp, Homo sapiens
atgattctctgctactctaaat

SEQ ID NO: 7092140 - DNA, 22 bp, Homo sapiens
atgattgaccatctgctgggct

SEQ ID NO: 7092141 - DNA, 22 bp, Homo sapiens
atgattgaaaatgacattgcca

SEQ ID NO: 7092142 - DNA, 22 bp, Homo sapiens
atgattgaaaatgacattgcca

SEQ ID NO: 7092143 - DNA, 22 bp, Homo sapiens
atgattgaaaatgacattgcca

SEQ ID NO: 7092144 - DNA, 22 bp, Homo sapiens
atgattcttttggatagatgat

SEQ ID NO: 7092145 - DNA, 22 bp, Homo sapiens
atgatttaaagtcattgtgaac

SEQ ID NO: 7092146 - DNA, 22 bp, Homo sapiens
atgattgaccatctgctgggct

SEQ ID NO: 7092147 - DNA, 22 bp, Homo sapiens
atgcaaatgtttaagttactat

SEQ ID NO: 7092148 - DNA, 22 bp, Homo sapiens
atgcaaatgtttaagttactat

SEQ ID NO: 7092149 - DNA, 22 bp, Homo sapiens
atgcaaatgtttaagttactat

SEQ ID NO: 7092150 - DNA, 22 bp, Homo sapiens
atgcaaattaacatatagtaga

SEQ ID NO: 7092151 - DNA, 22 bp, Homo sapiens
atgcaaattaacatatagtaga

SEQ ID NO: 7092152 - DNA, 22 bp, Homo sapiens
atgcaaatgtcaccacttctaa

SEQ ID NO: 7092153 - DNA, 22 bp, Homo sapiens
atgcaaatgtcaccacttctaa

SEQ ID NO: 7092154 - DNA, 22 bp, Homo sapiens
atgattttctgataaagaactg

SEQ ID NO: 7092155 - DNA, 22 bp, Homo sapiens
atgcaaatgctagagaatgttg

SEQ ID NO: 7092156 - DNA, 22 bp, Homo sapiens
atgcaaatggcaatgagtgacc

SEQ ID NO: 7092157 - DNA, 22 bp, Homo sapiens
atgcaaatggcaatgagtgacc

SEQ ID NO: 7092158 - DNA, 22 bp, Homo sapiens
atgcaaatggcaatgagtgacc

SEQ ID NO: 7092159 - DNA, 22 bp, Homo sapiens
aaggagggttcccaggtcctgg

SEQ ID NO: 7092160 - DNA, 22 bp, Homo sapiens
aaggagggttcccaggtcctgg

SEQ ID NO: 7092161 - DNA, 22 bp, Homo sapiens
aaggagggttcccaggtcctgg

SEQ ID NO: 7092162 - DNA, 22 bp, Homo sapiens
aaggaggttatcccagtggact

SEQ ID NO: 7092163 - DNA, 22 bp, Homo sapiens
aaggagtctgggccattcagag

SEQ ID NO: 7092164 - DNA, 22 bp, Homo sapiens
aaggagtctgggccattcagag

SEQ ID NO: 7092165 - DNA, 22 bp, Homo sapiens
aaggagtctgggccattcagag

SEQ ID NO: 7092166 - DNA, 22 bp, Homo sapiens
aaggagtctgggccattcagag

SEQ ID NO: 7092167 - DNA, 22 bp, Homo sapiens
aaggagtctgggccattcagag

SEQ ID NO: 7092168 - DNA, 22 bp, Homo sapiens
aaggagtctgggccattcagag

SEQ ID NO: 7092169 - DNA, 22 bp, Homo sapiens
aaggagtctgggccattcagag

SEQ ID NO: 7092170 - DNA, 22 bp, Homo sapiens
aaggagtgatatatgggtgcta

SEQ ID NO: 7092171 - DNA, 22 bp, Homo sapiens
aaggagtgatatatgggtgcta

SEQ ID NO: 7092172 - DNA, 22 bp, Homo sapiens
aaggagtgcatgactcagagta

SEQ ID NO: 7092173 - DNA, 22 bp, Homo sapiens
aaggagtgcatgactcagagta

SEQ ID NO: 7092174 - DNA, 22 bp, Homo sapiens
aaggagtttgggtagtcataca

SEQ ID NO: 7092175 - DNA, 22 bp, Homo sapiens
aaggataagaatggaaggaaca

SEQ ID NO: 7092176 - DNA, 22 bp, Homo sapiens
aaggataagaatggaaggaaca

SEQ ID NO: 7092177 - DNA, 22 bp, Homo sapiens
aaggatacttttagagcctgag

SEQ ID NO: 7092178 - DNA, 22 bp, Homo sapiens
aaggatacttttagagcctgag

SEQ ID NO: 7092179 - DNA, 22 bp, Homo sapiens
aaggatatgggtagtatgatgt

SEQ ID NO: 7092180 - DNA, 22 bp, Homo sapiens
aaggcactgactgtgcagggga

SEQ ID NO: 7092181 - DNA, 22 bp, Homo sapiens
aaggcactgagccagccgtctc

SEQ ID NO: 7092182 - DNA, 22 bp, Homo sapiens
aaggcactgaaaaattgtgtgt

SEQ ID NO: 7092183 - DNA, 22 bp, Homo sapiens
aaggcactgaacttaaattctg

SEQ ID NO: 7092184 - DNA, 22 bp, Homo sapiens
aaggcactgaacttaaattctg

SEQ ID NO: 7092185 - DNA, 22 bp, Homo sapiens
aaggcactgaacttaaattctg

SEQ ID NO: 7092186 - DNA, 22 bp, Homo sapiens
aaggcactgaaaaattgtgtgt

SEQ ID NO: 7092187 - DNA, 22 bp, Homo sapiens
aaggcactgaaaaattgtgtgt

SEQ ID NO: 7092188 - DNA, 22 bp, Homo sapiens
aaggcactcattcaaggagata

SEQ ID NO: 7092189 - DNA, 22 bp, Homo sapiens
aaggatcaagtggattttctta

SEQ ID NO: 7092190 - DNA, 22 bp, Homo sapiens
aaggcactagcaagctgcctgg

SEQ ID NO: 7092191 - DNA, 22 bp, Homo sapiens
aaggatagaataactcttgact

SEQ ID NO: 7092192 - DNA, 22 bp, Homo sapiens
aaggatatgggtagtatgatgt

SEQ ID NO: 7092193 - DNA, 17 bp, Homo sapiens
aaggatattatagttct

SEQ ID NO: 7092194 - DNA, 22 bp, Homo sapiens
aaggcactagcagaattagtga

SEQ ID NO: 7092195 - DNA, 22 bp, Homo sapiens
aaggcactagcagaattagtga

SEQ ID NO: 7092196 - DNA, 20 bp, Homo sapiens
aaggcactatgtctgctagc

SEQ ID NO: 7092197 - DNA, 22 bp, Homo sapiens
aaggcactcagccttgggacag

SEQ ID NO: 7092198 - DNA, 22 bp, Homo sapiens
aaggcactcattcaaggagata

SEQ ID NO: 7092199 - DNA, 16 bp, Homo sapiens
aaggagggaagagaat

SEQ ID NO: 7092200 - DNA, 16 bp, Homo sapiens
aaggagggaagagaat

SEQ ID NO: 7092201 - DNA, 22 bp, Homo sapiens
aaggagggaaagcagtgcttct

SEQ ID NO: 7092202 - DNA, 16 bp, Homo sapiens
aaggagggaagagaat

SEQ ID NO: 7092203 - DNA, 22 bp, Homo sapiens
aaggagggttcccaggtcctgg

SEQ ID NO: 7092204 - DNA, 22 bp, Homo sapiens
aaatggcaacagaagggagttc

SEQ ID NO: 7092205 - DNA, 22 bp, Homo sapiens
aaatggcaatcagcagaagcta

SEQ ID NO: 7092206 - DNA, 22 bp, Homo sapiens
aaatggcaatcagcagaagcta

SEQ ID NO: 7092207 - DNA, 22 bp, Homo sapiens
aaatggcaatcagcagaagcta

SEQ ID NO: 7092208 - DNA, 22 bp, Homo sapiens
aaatggcaatttagtttattta

SEQ ID NO: 7092209 - DNA, 18 bp, Homo sapiens
aaatggcacacagacctg

SEQ ID NO: 7092210 - DNA, 18 bp, Homo sapiens
aaatggcacacagacctg

SEQ ID NO: 7092211 - DNA, 22 bp, Homo sapiens
aaatggatctttttataatgca

SEQ ID NO: 7092212 - DNA, 19 bp, Homo sapiens
aaatggagctaatcttgtc

SEQ ID NO: 7092213 - DNA, 22 bp, Homo sapiens
aaatggaggcaaaattggtttc

SEQ ID NO: 7092214 - DNA, 22 bp, Homo sapiens
aaatggaggcacgcagtggtta

SEQ ID NO: 7092215 - DNA, 22 bp, Homo sapiens
aaatggagttctaagtatagta

SEQ ID NO: 7092216 - DNA, 22 bp, Homo sapiens
aaatggaagaagtgcaatactg

SEQ ID NO: 7092217 - DNA, 22 bp, Homo sapiens
aaatggaagaagtgcaatactg

SEQ ID NO: 7092218 - DNA, 22 bp, Homo sapiens
aaatggaagaagtgcaatactg

SEQ ID NO: 7092219 - DNA, 22 bp, Homo sapiens
aaatggaagctatttatgattc

SEQ ID NO: 7092220 - DNA, 22 bp, Homo sapiens
aaatggaagctatttatgattc

SEQ ID NO: 7092221 - DNA, 22 bp, Homo sapiens
aaatggaatgtgtttataattc

SEQ ID NO: 7092222 - DNA, 23 bp, Homo sapiens
aaatggactattcggcatggaga

SEQ ID NO: 7092223 - DNA, 22 bp, Homo sapiens
aagggcaggcacccaccctcac

SEQ ID NO: 7092224 - DNA, 22 bp, Homo sapiens
aagggcaggcacccaccctcac

SEQ ID NO: 7092225 - DNA, 22 bp, Homo sapiens
aagggcaggagaagacggatat

SEQ ID NO: 7092226 - DNA, 22 bp, Homo sapiens
aagggcaggcacccaccctcac

SEQ ID NO: 7092227 - DNA, 22 bp, Homo sapiens
aagggcaggcacccaccctcac

SEQ ID NO: 7092228 - DNA, 22 bp, Homo sapiens
aagggcaggcacccaccctcac

SEQ ID NO: 7092229 - DNA, 22 bp, Homo sapiens
aagggcaggcagagatcatata

SEQ ID NO: 7092230 - DNA, 22 bp, Homo sapiens
aagggcaggcagagatcatata

SEQ ID NO: 7092231 - DNA, 22 bp, Homo sapiens
aagggcaggcagagatcatata

SEQ ID NO: 7092232 - DNA, 22 bp, Homo sapiens
aagggcaggcagagatcatata

SEQ ID NO: 7092233 - DNA, 22 bp, Homo sapiens
aagggcagggagtttgtgtcta

SEQ ID NO: 7092234 - DNA, 22 bp, Homo sapiens
aagggcaggagaagacggatat

SEQ ID NO: 7092235 - DNA, 22 bp, Homo sapiens
aagggcaggagaagacggatat

SEQ ID NO: 7092236 - DNA, 22 bp, Homo sapiens
aagggcaggagaagacggatat

SEQ ID NO: 7092237 - DNA, 22 bp, Homo sapiens
aagggcaggagaagacggatat

SEQ ID NO: 7092238 - DNA, 22 bp, Homo sapiens
aagggcaggagaagacggatat

SEQ ID NO: 7092239 - DNA, 22 bp, Homo sapiens
aagggcaggaaaagatggatgt

SEQ ID NO: 7092240 - DNA, 22 bp, Homo sapiens
aagggcaggaaaagatggatgt

SEQ ID NO: 7092241 - DNA, 22 bp, Homo sapiens
aagggcaggaaaagatggatgt

SEQ ID NO: 7092242 - DNA, 22 bp, Homo sapiens
aaggctgagacagcacaggtcc

SEQ ID NO: 7092243 - DNA, 22 bp, Homo sapiens
aaggctgagacagcacaggtcc

SEQ ID NO: 7092244 - DNA, 21 bp, Homo sapiens
aaggctgagacaactcaggag

SEQ ID NO: 7092245 - DNA, 22 bp, Homo sapiens
aaggctgagagtcacagtccta

SEQ ID NO: 7092246 - DNA, 22 bp, Homo sapiens
aagggaggccagaggttttgca

SEQ ID NO: 7092247 - DNA, 22 bp, Homo sapiens
aagggaggccagaggttttgca

SEQ ID NO: 7092248 - DNA, 22 bp, Homo sapiens
aagggaggggatgtaagcctgg

SEQ ID NO: 7092249 - DNA, 22 bp, Homo sapiens
aaggctgacgtttgtgtttatt

SEQ ID NO: 7092250 - DNA, 22 bp, Homo sapiens
aaggctgaccagtttacacttt

SEQ ID NO: 7092251 - DNA, 22 bp, Homo sapiens
aaggctgaccagtttacacttt

SEQ ID NO: 7092252 - DNA, 22 bp, Homo sapiens
aaggctgaattcaagggtaggc

SEQ ID NO: 7092253 - DNA, 22 bp, Homo sapiens
aaggcccttccaccagtcctcg

SEQ ID NO: 7092254 - DNA, 22 bp, Homo sapiens
aaggcccttcggcttcctcagc

SEQ ID NO: 7092255 - DNA, 18 bp, Homo sapiens
aaggccctgagcatatgc

SEQ ID NO: 7092256 - DNA, 22 bp, Homo sapiens
aaggccctggcaggaagcagga

SEQ ID NO: 7092257 - DNA, 22 bp, Homo sapiens
aaggccctgtctccaaatacag

SEQ ID NO: 7092258 - DNA, 22 bp, Homo sapiens
aaggcccagcctggagcttgtt

SEQ ID NO: 7092259 - DNA, 22 bp, Homo sapiens
aaggcccagcgtgacctcagtg

SEQ ID NO: 7092260 - DNA, 22 bp, Homo sapiens
aaggcccagcgtgacctcagtg

SEQ ID NO: 7092261 - DNA, 22 bp, Homo sapiens
aaggcccagcgtgacctcagtg

SEQ ID NO: 7092262 - DNA, 22 bp, Homo sapiens
aaggcccaggctgccctgggca

SEQ ID NO: 7092263 - DNA, 22 bp, Homo sapiens
aaggcccaggctgccctgggca

SEQ ID NO: 7092264 - DNA, 22 bp, Homo sapiens
aaggcccagggattggaggtca

SEQ ID NO: 7092265 - DNA, 22 bp, Homo sapiens
aaggcccagggattggaggtca

SEQ ID NO: 7092266 - DNA, 22 bp, Homo sapiens
aaggcccaggggctctagggca

SEQ ID NO: 7092267 - DNA, 22 bp, Homo sapiens
aaggccctaatagagcacatat

SEQ ID NO: 7092268 - DNA, 22 bp, Homo sapiens
aaggccctcatgcgtcagagcc

SEQ ID NO: 7092269 - DNA, 22 bp, Homo sapiens
aaggcactgctttgctgcgccc

SEQ ID NO: 7092270 - DNA, 22 bp, Homo sapiens
aaggcactgtactagttagtta

SEQ ID NO: 7092271 - DNA, 22 bp, Homo sapiens
aaggccagactctggaatgaca

SEQ ID NO: 7092272 - DNA, 22 bp, Homo sapiens
aaggccagactctggaatgaca

SEQ ID NO: 7092273 - DNA, 23 bp, Homo sapiens
aaggccagagagaggctagtgtc

SEQ ID NO: 7092274 - DNA, 22 bp, Homo sapiens
aaggccaggtccctgcagtgca

SEQ ID NO: 7092275 - DNA, 22 bp, Homo sapiens
aaggccaggtccctgcagtgca

SEQ ID NO: 7092276 - DNA, 22 bp, Homo sapiens
aaggccatgaccacttgctgtg

SEQ ID NO: 7092277 - DNA, 22 bp, Homo sapiens
aaggccattattctgatatatt

SEQ ID NO: 7092278 - DNA, 22 bp, Homo sapiens
aaggccattgtaatgtaaatat

SEQ ID NO: 7092279 - DNA, 22 bp, Homo sapiens
aaggcccacagaactgtctcca

SEQ ID NO: 7092280 - DNA, 22 bp, Homo sapiens
aaggcccacagaactgtctcca

SEQ ID NO: 7092281 - DNA, 22 bp, Homo sapiens
aaggcccacagaactgtctcca

SEQ ID NO: 7092282 - DNA, 22 bp, Homo sapiens
aaggcccagccaatgggggcag

SEQ ID NO: 7092283 - DNA, 22 bp, Homo sapiens
aaggcccagcctggagcttgtt

SEQ ID NO: 7092284 - DNA, 22 bp, Homo sapiens
aagtctgatcatttcttctata

SEQ ID NO: 7092285 - DNA, 22 bp, Homo sapiens
aagtctgatcatttcttctata

SEQ ID NO: 7092286 - DNA, 22 bp, Homo sapiens
aagtctgagtgtcagtgcaagt

SEQ ID NO: 7092287 - DNA, 22 bp, Homo sapiens
aagtccagtgaaatagaatgca

SEQ ID NO: 7092288 - DNA, 22 bp, Homo sapiens
aagtctgagagaaactctctca

SEQ ID NO: 7092289 - DNA, 22 bp, Homo sapiens
aagtacaacgcatacagagaaa

SEQ ID NO: 7092290 - DNA, 22 bp, Homo sapiens
aagtacaatctttctgtaaagg

SEQ ID NO: 7092291 - DNA, 22 bp, Homo sapiens
aagtaatataattgttgttgtt

SEQ ID NO: 7092292 - DNA, 22 bp, Homo sapiens
aagtaatataattgttgttgtt

SEQ ID NO: 7092293 - DNA, 22 bp, Homo sapiens
aagtaatatctggcaccaggaa

SEQ ID NO: 7092294 - DNA, 20 bp, Homo sapiens
aagtaatatttgtgtaactg

SEQ ID NO: 7092295 - DNA, 22 bp, Homo sapiens
aagtaatgatgtcatcacagag

SEQ ID NO: 7092296 - DNA, 21 bp, Homo sapiens
aagtaatgtgtctcttctacc

SEQ ID NO: 7092297 - DNA, 22 bp, Homo sapiens
aagtacaaattttgaagagctt

SEQ ID NO: 7092298 - DNA, 22 bp, Homo sapiens
aagtacaaattttgaagagctt

SEQ ID NO: 7092299 - DNA, 22 bp, Homo sapiens
aagtacaaattttgaagagctt

SEQ ID NO: 7092300 - DNA, 22 bp, Homo sapiens
aagtacaacgcatacagagaaa

SEQ ID NO: 7092301 - DNA, 22 bp, Homo sapiens
aagtacaacgcatacagagaaa

SEQ ID NO: 7092302 - DNA, 22 bp, Homo sapiens
aagtacaacgcatacagagaaa

SEQ ID NO: 7092303 - DNA, 22 bp, Homo sapiens
aagtacaacgcatacagagaaa

SEQ ID NO: 7092304 - DNA, 22 bp, Homo sapiens
aagtaacatctgaacatgatgt

SEQ ID NO: 7092305 - DNA, 22 bp, Homo sapiens
aagtaacatctgaacatgatgt

SEQ ID NO: 7092306 - DNA, 22 bp, Homo sapiens
aagtaacatctgaacatgatgt

SEQ ID NO: 7092307 - DNA, 22 bp, Homo sapiens
aagtaacaggtgcttagtttat

SEQ ID NO: 7092308 - DNA, 22 bp, Homo sapiens
aagtaacaggtgcttagtttat

SEQ ID NO: 7092309 - DNA, 22 bp, Homo sapiens
aagtaacatctgaacatgatgt

SEQ ID NO: 7092310 - DNA, 22 bp, Homo sapiens
aagtaacatctgaacatgatgt

SEQ ID NO: 7092311 - DNA, 23 bp, Homo sapiens
aaggtgtttgttttcagaaagca

SEQ ID NO: 7092312 - DNA, 22 bp, Homo sapiens
aaggttactcagaataacttcc

SEQ ID NO: 7092313 - DNA, 22 bp, Homo sapiens
aaggttagtaagtatcttatgt

SEQ ID NO: 7092314 - DNA, 23 bp, Homo sapiens
aaggtgttctgtatttaactcag

SEQ ID NO: 7092315 - DNA, 22 bp, Homo sapiens
aaggtgttcttcagtagaggtc

SEQ ID NO: 7092316 - DNA, 23 bp, Homo sapiens
aaggtgtttgatgggttgaggaa

SEQ ID NO: 7092317 - DNA, 23 bp, Homo sapiens
aaggtgtttgatgggttgaggaa

SEQ ID NO: 7092318 - DNA, 23 bp, Homo sapiens
aaggtgttctgtatttaactcag

SEQ ID NO: 7092319 - DNA, 22 bp, Homo sapiens
aagtaacatctgaacatgatgt

SEQ ID NO: 7092320 - DNA, 22 bp, Homo sapiens
aagtaacatgggaacatctgaa

SEQ ID NO: 7092321 - DNA, 22 bp, Homo sapiens
aagtaacatgggaacatctgaa

SEQ ID NO: 7092322 - DNA, 22 bp, Homo sapiens
aagtaaggcagtgaatgagatt

SEQ ID NO: 7092323 - DNA, 22 bp, Homo sapiens
aagtaaggccttcttgagcatg

SEQ ID NO: 7092324 - DNA, 22 bp, Homo sapiens
aagtaagtcttacattcacatt

SEQ ID NO: 7092325 - DNA, 22 bp, Homo sapiens
aaggtgttcaggttttcccatt

SEQ ID NO: 7092326 - DNA, 22 bp, Homo sapiens
aaggtgttattggaggcatcag

SEQ ID NO: 7092327 - DNA, 22 bp, Homo sapiens
aaggtgtggagtggtgcgactg

SEQ ID NO: 7092328 - DNA, 22 bp, Homo sapiens
aaggtgttatagctgaggaata

SEQ ID NO: 7092329 - DNA, 22 bp, Homo sapiens
aaggtgtgaagagatgggaaga

SEQ ID NO: 7092330 - DNA, 22 bp, Homo sapiens
aaggtgtcgggttagctcagcc

SEQ ID NO: 7092331 - DNA, 22 bp, Homo sapiens
aaggtgtcggcagagccgcttc

SEQ ID NO: 7092332 - DNA, 22 bp, Homo sapiens
aaggtgtcggcagagccgcttc

SEQ ID NO: 7092333 - DNA, 19 bp, Homo sapiens
aaggtgtcccaactgcgtt

SEQ ID NO: 7092334 - DNA, 22 bp, Homo sapiens
aaggtgtcgggttagctcagcc

SEQ ID NO: 7092335 - DNA, 22 bp, Homo sapiens
aaggtgtctctctgcttcttgg

SEQ ID NO: 7092336 - DNA, 22 bp, Homo sapiens
aaggtctggccaatagacagcc

SEQ ID NO: 7092337 - DNA, 22 bp, Homo sapiens
aagggctggaatatctcttaga

SEQ ID NO: 7092338 - DNA, 22 bp, Homo sapiens
aagggctggaatatctcttaga

SEQ ID NO: 7092339 - DNA, 22 bp, Homo sapiens
aaggtgtcaggcttgggaaagt

SEQ ID NO: 7092340 - DNA, 22 bp, Homo sapiens
aaggtgtcatccaggatggtgg

SEQ ID NO: 7092341 - DNA, 23 bp, Homo sapiens
aaggtgtcattgatgggattcta

SEQ ID NO: 7092342 - DNA, 22 bp, Homo sapiens
aaggtgtcattgtttatggaga

SEQ ID NO: 7092343 - DNA, 22 bp, Homo sapiens
aagggctggaatatctcttaga

SEQ ID NO: 7092344 - DNA, 22 bp, Homo sapiens
aagggctgctgtagaagcagag

SEQ ID NO: 7092345 - DNA, 22 bp, Homo sapiens
aagggctgctgtagaagcagag

SEQ ID NO: 7092346 - DNA, 22 bp, Homo sapiens
aagggctgctgtagaagcagag

SEQ ID NO: 7092347 - DNA, 22 bp, Homo sapiens
aagggctgctgtagaagcagag

SEQ ID NO: 7092348 - DNA, 22 bp, Homo sapiens
aagggctgctgtagaagcagag

SEQ ID NO: 7092349 - DNA, 22 bp, Homo sapiens
aagggctgccagggggtgccag

SEQ ID NO: 7092350 - DNA, 22 bp, Homo sapiens
aagggctgccagggggtgccag

SEQ ID NO: 7092351 - DNA, 22 bp, Homo sapiens
aagggctgccagggggtgccag

SEQ ID NO: 7092352 - DNA, 22 bp, Homo sapiens
aagggctgccagggggtgccag

SEQ ID NO: 7092353 - DNA, 22 bp, Homo sapiens
aagggctgcatttgatgtgtca

SEQ ID NO: 7092354 - DNA, 22 bp, Homo sapiens
aagggctgcatttgatgtgtca

SEQ ID NO: 7092355 - DNA, 22 bp, Homo sapiens
aagggctgcatttgatgtgtca

SEQ ID NO: 7092356 - DNA, 22 bp, Homo sapiens
aagggctgcaatccaaaacact

SEQ ID NO: 7092357 - DNA, 22 bp, Homo sapiens
aagggctgcaatccaaaacact

SEQ ID NO: 7092358 - DNA, 22 bp, Homo sapiens
aagggctgcaatccaaaacact

SEQ ID NO: 7092359 - DNA, 22 bp, Homo sapiens
aagggcagggagtttgtgtcta

SEQ ID NO: 7092360 - DNA, 22 bp, Homo sapiens
aagggcaggtgggcatttctgg

SEQ ID NO: 7092361 - DNA, 22 bp, Homo sapiens
aagggcaggtgggcatttctgg

SEQ ID NO: 7092362 - DNA, 22 bp, Homo sapiens
aagtgctgtacagtgtgtaaat

SEQ ID NO: 7092363 - DNA, 22 bp, Homo sapiens
aagtgctgaatgaagacacaaa

SEQ ID NO: 7092364 - DNA, 22 bp, Homo sapiens
aagtgcttaggtcaaaggacat

SEQ ID NO: 7092365 - DNA, 22 bp, Homo sapiens
aagtgcttcaactagtgtggtc

SEQ ID NO: 7092366 - DNA, 22 bp, Homo sapiens
aagtgcttccatgtttgagtgt

SEQ ID NO: 7092367 - DNA, 22 bp, Homo sapiens
aacagtaacgagatgtcctaac

SEQ ID NO: 7092368 - DNA, 22 bp, Homo sapiens
aacagtaagagatgttttatct

SEQ ID NO: 7092369 - DNA, 17 bp, Homo sapiens
aacagtaagccctgttt

SEQ ID NO: 7092370 - DNA, 22 bp, Homo sapiens
aacagtgtgtacacatcatagg

SEQ ID NO: 7092371 - DNA, 22 bp, Homo sapiens
aacagtgttctagggtgtggct

SEQ ID NO: 7092372 - DNA, 22 bp, Homo sapiens
aacagtgcttcattcacacatt

SEQ ID NO: 7092373 - DNA, 22 bp, Homo sapiens
aacagtgttttgctctttgccc

SEQ ID NO: 7092374 - DNA, 22 bp, Homo sapiens
aacagttacccttaagatcttt

SEQ ID NO: 7092375 - DNA, 22 bp, Homo sapiens
aacagttatctcacatatggaa

SEQ ID NO: 7092376 - DNA, 22 bp, Homo sapiens
aacagttattatcacattagtg

SEQ ID NO: 7092377 - DNA, 22 bp, Homo sapiens
aagtgcctgacctagcctggag

SEQ ID NO: 7092378 - DNA, 22 bp, Homo sapiens
aagtgctaaatgttttagttaa

SEQ ID NO: 7092379 - DNA, 22 bp, Homo sapiens
aagtgctaggattacaggtgtg

SEQ ID NO: 7092380 - DNA, 22 bp, Homo sapiens
aagtgcattagatagaatgatg

SEQ ID NO: 7092381 - DNA, 22 bp, Homo sapiens
aagtgccatcatagcatggctg

SEQ ID NO: 7092382 - DNA, 22 bp, Homo sapiens
aagtctttttgaatctataact

SEQ ID NO: 7092383 - DNA, 22 bp, Homo sapiens
aagtgaaacatgtatctcttta

SEQ ID NO: 7092384 - DNA, 22 bp, Homo sapiens
aagtgcatatttttgttgtaga

SEQ ID NO: 7092385 - DNA, 22 bp, Homo sapiens
aagtgcatcactactcattaca

SEQ ID NO: 7092386 - DNA, 22 bp, Homo sapiens
aagtgcatggtatggtctccat

SEQ ID NO: 7092387 - DNA, 22 bp, Homo sapiens
aagtgcattagatagaatgatg

SEQ ID NO: 7092388 - DNA, 22 bp, Homo sapiens
aagtgcattagatagaatgatg

SEQ ID NO: 7092389 - DNA, 22 bp, Homo sapiens
aagtgcattagatagaatgatg

SEQ ID NO: 7092390 - DNA, 18 bp, Homo sapiens
aagtcttggaatttccac

SEQ ID NO: 7092391 - DNA, 22 bp, Homo sapiens
aagtcttacataatagtttgga

SEQ ID NO: 7092392 - DNA, 22 bp, Homo sapiens
aagtcttaggaaatagcaaaga

SEQ ID NO: 7092393 - DNA, 22 bp, Homo sapiens
aagtcttaggaaatagcaaaga

SEQ ID NO: 7092394 - DNA, 22 bp, Homo sapiens
aagtcttaggcattttatttct

SEQ ID NO: 7092395 - DNA, 22 bp, Homo sapiens
aagtcttcagactggagagatt

SEQ ID NO: 7092396 - DNA, 22 bp, Homo sapiens
aagtctggaacctcatgctggc

SEQ ID NO: 7092397 - DNA, 22 bp, Homo sapiens
aagtctggaacctcatgctggc

SEQ ID NO: 7092398 - DNA, 22 bp, Homo sapiens
aagtctgggccagggcacagcc

SEQ ID NO: 7092399 - DNA, 22 bp, Homo sapiens
aagtctgtttgagtgtcacact

SEQ ID NO: 7092400 - DNA, 22 bp, Homo sapiens
aagtcttaaccaaataaatgtt

SEQ ID NO: 7092401 - DNA, 22 bp, Homo sapiens
aagtcttaaccaaataaatgtt

SEQ ID NO: 7092402 - DNA, 22 bp, Homo sapiens
aagtcttaaccaaataaatgtt

SEQ ID NO: 7092403 - DNA, 22 bp, Homo sapiens
aatgcataatggtttgtgacaa

SEQ ID NO: 7092404 - DNA, 22 bp, Homo sapiens
aatgcagtttcatttgtagaat

SEQ ID NO: 7092405 - DNA, 22 bp, Homo sapiens
aatgctgtcttttctacttcat

SEQ ID NO: 7092406 - DNA, 22 bp, Homo sapiens
aatgcagtttcatttgtagaat

SEQ ID NO: 7092407 - DNA, 22 bp, Homo sapiens
aatgcagtttcatttgtagaat

SEQ ID NO: 7092408 - DNA, 22 bp, Homo sapiens
aatgcagtttcatttgtagaat

SEQ ID NO: 7092409 - DNA, 22 bp, Homo sapiens
aatgcagtgagccattaaatgg

SEQ ID NO: 7092410 - DNA, 22 bp, Homo sapiens
aatgcagttgaatttgggtatg

SEQ ID NO: 7092411 - DNA, 22 bp, Homo sapiens
aatgcagtgagccattaaatgg

SEQ ID NO: 7092412 - DNA, 22 bp, Homo sapiens
aatgcagtgagccattaaatgg

SEQ ID NO: 7092413 - DNA, 22 bp, Homo sapiens
aatgcaggttcttgggccacat

SEQ ID NO: 7092414 - DNA, 22 bp, Homo sapiens
aatgcaggttcttgggccacat

SEQ ID NO: 7092415 - DNA, 22 bp, Homo sapiens
aatgcaggcacgtgcaagcaag

SEQ ID NO: 7092416 - DNA, 22 bp, Homo sapiens
aatgcaggcacgtgcaagcaag

SEQ ID NO: 7092417 - DNA, 22 bp, Homo sapiens
aatgcaggcacgtgcaagcaag

SEQ ID NO: 7092418 - DNA, 22 bp, Homo sapiens
aatgctgtcttttctacttcat

SEQ ID NO: 7092419 - DNA, 22 bp, Homo sapiens
aatgctgtgatttattaagtat

SEQ ID NO: 7092420 - DNA, 22 bp, Homo sapiens
aatgcttaattcaatactgtgt

SEQ ID NO: 7092421 - DNA, 22 bp, Homo sapiens
aatgcttaattcaatactgtgt

SEQ ID NO: 7092422 - DNA, 19 bp, Homo sapiens
aatgcttaggacagtgcct

SEQ ID NO: 7092423 - DNA, 22 bp, Homo sapiens
aatgcttataacgttagaatgt

SEQ ID NO: 7092424 - DNA, 22 bp, Homo sapiens
aatgcttatacctaatgatctt

SEQ ID NO: 7092425 - DNA, 22 bp, Homo sapiens
aatgcttatacctaatgatctt

SEQ ID NO: 7092426 - DNA, 22 bp, Homo sapiens
aatgcttatgggttccataata

SEQ ID NO: 7092427 - DNA, 22 bp, Homo sapiens
aatgcttatgggttccataata

SEQ ID NO: 7092428 - DNA, 22 bp, Homo sapiens
aacttcatttataatgtcatta

SEQ ID NO: 7092429 - DNA, 22 bp, Homo sapiens
aatgctttcaaaaatgtgcagt

SEQ ID NO: 7092430 - DNA, 22 bp, Homo sapiens
aatgctttcaaaaatgtgcagt

SEQ ID NO: 7092431 - DNA, 22 bp, Homo sapiens
aatgctttcaaaaatgtgcagt

SEQ ID NO: 7092432 - DNA, 22 bp, Homo sapiens
aacttgtaaaatagagtgtaca

SEQ ID NO: 7092433 - DNA, 22 bp, Homo sapiens
aacttggtaccaccttctgaag

SEQ ID NO: 7092434 - DNA, 22 bp, Homo sapiens
aacttccaacccagaagcctaa

SEQ ID NO: 7092435 - DNA, 22 bp, Homo sapiens
aatgcttattattaatagaatg

SEQ ID NO: 7092436 - DNA, 22 bp, Homo sapiens
aatgcttcctcctcacctcagg

SEQ ID NO: 7092437 - DNA, 22 bp, Homo sapiens
aatgctttaaatcctagtgtaa

SEQ ID NO: 7092438 - DNA, 22 bp, Homo sapiens
aatgctttaattgcatgtagtg

SEQ ID NO: 7092439 - DNA, 22 bp, Homo sapiens
aatgctttaattgcatgtagtg

SEQ ID NO: 7092440 - DNA, 22 bp, Homo sapiens
aatgctttagcagtgattagtg

SEQ ID NO: 7092441 - DNA, 22 bp, Homo sapiens
aactttaaaaaatatgtctgtt

SEQ ID NO: 7092442 - DNA, 20 bp, Homo sapiens
aacttgttttgttttctaat

SEQ ID NO: 7092443 - DNA, 20 bp, Homo sapiens
aacttgttttgttttctaat

SEQ ID NO: 7092444 - DNA, 22 bp, Homo sapiens
aacttgtttcttccattcaaca

SEQ ID NO: 7092445 - DNA, 21 bp, Homo sapiens
aacttgtatttctccttattc

SEQ ID NO: 7092446 - DNA, 22 bp, Homo sapiens
aacttgtattgaaaatgggtaa

SEQ ID NO: 7092447 - DNA, 22 bp, Homo sapiens
aacttgtatatgttattcagag

SEQ ID NO: 7092448 - DNA, 22 bp, Homo sapiens
aacttgtatatgttattcagag

SEQ ID NO: 7092449 - DNA, 22 bp, Homo sapiens
aacttgtaggactgcactgtag

SEQ ID NO: 7092450 - DNA, 22 bp, Homo sapiens
aacttgtaatgaaaggcaatag

SEQ ID NO: 7092451 - DNA, 22 bp, Homo sapiens
aacttgtaggactgcactgtag

SEQ ID NO: 7092452 - DNA, 22 bp, Homo sapiens
aactttaaggctataaattatg

SEQ ID NO: 7092453 - DNA, 22 bp, Homo sapiens
aactttaaggctataaattatg

SEQ ID NO: 7092454 - DNA, 22 bp, Homo sapiens
aactttaaagaggaggcttggg

SEQ ID NO: 7092455 - DNA, 22 bp, Homo sapiens
aactttaaagaggaggcttggg

SEQ ID NO: 7092456 - DNA, 22 bp, Homo sapiens
aactttacactgctttacatga

SEQ ID NO: 7092457 - DNA, 22 bp, Homo sapiens
aatgtaaagttgggcacaaatg

SEQ ID NO: 7092458 - DNA, 22 bp, Homo sapiens
aatgtaaacagcaagagaaggg

SEQ ID NO: 7092459 - DNA, 22 bp, Homo sapiens
aatgtacaaaccttctttgtag

SEQ ID NO: 7092460 - DNA, 22 bp, Homo sapiens
aatgtacaaaccttctttgtag

SEQ ID NO: 7092461 - DNA, 22 bp, Homo sapiens
aatgtacaaaagtcagccaact

SEQ ID NO: 7092462 - DNA, 22 bp, Homo sapiens
aatgtacaaaagtcagccaact

SEQ ID NO: 7092463 - DNA, 22 bp, Homo sapiens
aatgatgacaggataaagaaca

SEQ ID NO: 7092464 - DNA, 22 bp, Homo sapiens
aatgcacaaaggtgtctattgc

SEQ ID NO: 7092465 - DNA, 18 bp, Homo sapiens
aatgcacacatttactcc

SEQ ID NO: 7092466 - DNA, 22 bp, Homo sapiens
aatgaacaaatggtgctgcttg

SEQ ID NO: 7092467 - DNA, 21 bp, Homo sapiens
aatgatgaaagatgacagagt

SEQ ID NO: 7092468 - DNA, 21 bp, Homo sapiens
aatgatgaaagatgacagagt

SEQ ID NO: 7092469 - DNA, 22 bp, Homo sapiens
aatgatgaactcagagggaacc

SEQ ID NO: 7092470 - DNA, 22 bp, Homo sapiens
aatgaaatgtagcttatccata

SEQ ID NO: 7092471 - DNA, 22 bp, Homo sapiens
aatgaaatgtagcttatccata

SEQ ID NO: 7092472 - DNA, 22 bp, Homo sapiens
aatgaacaaaatatgctttgca

SEQ ID NO: 7092473 - DNA, 18 bp, Homo sapiens
aatgaaatgtacaccttt

SEQ ID NO: 7092474 - DNA, 18 bp, Homo sapiens
aatgaaatgtacaccttt

SEQ ID NO: 7092475 - DNA, 18 bp, Homo sapiens
aatgaaatgtacaccttt

SEQ ID NO: 7092476 - DNA, 22 bp, Homo sapiens
aatgaaatgtagcttatccata

SEQ ID NO: 7092477 - DNA, 22 bp, Homo sapiens
aatgaaatgtagcttatccata

SEQ ID NO: 7092478 - DNA, 22 bp, Homo sapiens
aatgaaatgtagcttatccata

SEQ ID NO: 7092479 - DNA, 22 bp, Homo sapiens
aatgaaatgtagcttatccata

SEQ ID NO: 7092480 - DNA, 22 bp, Homo sapiens
aatgcaccttggcagggattca

SEQ ID NO: 7092481 - DNA, 22 bp, Homo sapiens
aatgcacctaccttgattctgc

SEQ ID NO: 7092482 - DNA, 22 bp, Homo sapiens
aatgcacatgtcttggcctcac

SEQ ID NO: 7092483 - DNA, 22 bp, Homo sapiens
aatgcacatgttgtaataaata

SEQ ID NO: 7092484 - DNA, 22 bp, Homo sapiens
aatgcagagtaaatatttaatt

SEQ ID NO: 7092485 - DNA, 22 bp, Homo sapiens
aatgcagagtaaatatttaatt

SEQ ID NO: 7092486 - DNA, 22 bp, Homo sapiens
aatgcagagtaaatatttaatt

SEQ ID NO: 7092487 - DNA, 19 bp, Homo sapiens
aatgcagagtgtggtcttt

SEQ ID NO: 7092488 - DNA, 18 bp, Homo sapiens
aatgcacacatttactcc

SEQ ID NO: 7092489 - DNA, 22 bp, Homo sapiens
aatgcacataaatatggtctta

SEQ ID NO: 7092490 - DNA, 22 bp, Homo sapiens
aatgcacatgccacatgtggta

SEQ ID NO: 7092491 - DNA, 22 bp, Homo sapiens
aatgaaatctgctgggtaaaga

SEQ ID NO: 7092492 - DNA, 22 bp, Homo sapiens
aatgaaatctgctgggtaaaga

SEQ ID NO: 7092493 - DNA, 22 bp, Homo sapiens
aatgaaatctgctgggtaaaga

SEQ ID NO: 7092494 - DNA, 22 bp, Homo sapiens
aatgaaatgaagatatgatcag

SEQ ID NO: 7092495 - DNA, 22 bp, Homo sapiens
aatgaaatgaagatatgatcag

SEQ ID NO: 7092496 - DNA, 22 bp, Homo sapiens
aatgaaatgaagatatgatcag

SEQ ID NO: 7092497 - DNA, 22 bp, Homo sapiens
aatctgtagggaacaactgtac

SEQ ID NO: 7092498 - DNA, 22 bp, Homo sapiens
aatgaaactgtatatagactgt

SEQ ID NO: 7092499 - DNA, 22 bp, Homo sapiens
aatgaaagaatgaaacagccca

SEQ ID NO: 7092500 - DNA, 22 bp, Homo sapiens
aatgaaatagttggctgtagag

SEQ ID NO: 7092501 - DNA, 22 bp, Homo sapiens
aatgaaatagttggctgtagag

SEQ ID NO: 7092502 - DNA, 22 bp, Homo sapiens
aatctggacacagttctcatgc

SEQ ID NO: 7092503 - DNA, 22 bp, Homo sapiens
aatctggacacagttctcatgc

SEQ ID NO: 7092504 - DNA, 22 bp, Homo sapiens
aatctggagttaatgttttcgc

SEQ ID NO: 7092505 - DNA, 22 bp, Homo sapiens
aatctgtaacattcaataaaga

SEQ ID NO: 7092506 - DNA, 22 bp, Homo sapiens
aatctgtaacattcaataaaga

SEQ ID NO: 7092507 - DNA, 22 bp, Homo sapiens
aatctgtagggaacaactgtac

SEQ ID NO: 7092508 - DNA, 20 bp, Homo sapiens
aatctgaatcccagtcctag

SEQ ID NO: 7092509 - DNA, 22 bp, Homo sapiens
aatctgaaagtatggagcagta

SEQ ID NO: 7092510 - DNA, 22 bp, Homo sapiens
aatctctttggctcaaggatcc

SEQ ID NO: 7092511 - DNA, 22 bp, Homo sapiens
aatctctttggctcaaggatcc

SEQ ID NO: 7092512 - DNA, 22 bp, Homo sapiens
aatctgagggaacttgaactcc

SEQ ID NO: 7092513 - DNA, 22 bp, Homo sapiens
aatctgagggaacttgaactcc

SEQ ID NO: 7092514 - DNA, 22 bp, Homo sapiens
aatctgcacccactgaaaatgc

SEQ ID NO: 7092515 - DNA, 22 bp, Homo sapiens
aatctgcataagcacagttgga

SEQ ID NO: 7092516 - DNA, 22 bp, Homo sapiens
aatctcatgagcttcttgtccc

SEQ ID NO: 7092517 - DNA, 22 bp, Homo sapiens
aatctcagagatatctgtgtcc

SEQ ID NO: 7092518 - DNA, 22 bp, Homo sapiens
aatctctctggggttcagtcct

SEQ ID NO: 7092519 - DNA, 22 bp, Homo sapiens
aatctctctggggttcagtcct

SEQ ID NO: 7092520 - DNA, 22 bp, Homo sapiens
aatctcttgggaggaatgaatt

SEQ ID NO: 7092521 - DNA, 22 bp, Homo sapiens
aatctcttggttcagaagcctc

SEQ ID NO: 7092522 - DNA, 22 bp, Homo sapiens
aatatttctccttcgttatagc

SEQ ID NO: 7092523 - DNA, 22 bp, Homo sapiens
aatatttctccttcgttatagc

SEQ ID NO: 7092524 - DNA, 22 bp, Homo sapiens
aatatttctccttcgttatagc

SEQ ID NO: 7092525 - DNA, 22 bp, Homo sapiens
aatatttctgcagaatggtttt

SEQ ID NO: 7092526 - DNA, 22 bp, Homo sapiens
aatatttctgcagaatggtttt

SEQ ID NO: 7092527 - DNA, 22 bp, Homo sapiens
aatatttctggtgcttctcact

SEQ ID NO: 7092528 - DNA, 22 bp, Homo sapiens
aatatttctgtagctatgttct

SEQ ID NO: 7092529 - DNA, 22 bp, Homo sapiens
aatatttctgtagctatgttct

SEQ ID NO: 7092530 - DNA, 22 bp, Homo sapiens
aatccagatgagcaatcatact

SEQ ID NO: 7092531 - DNA, 22 bp, Homo sapiens
aatctcactcaaagaattctct

SEQ ID NO: 7092532 - DNA, 22 bp, Homo sapiens
aatatctgtggccatacaattt

SEQ ID NO: 7092533 - DNA, 22 bp, Homo sapiens
aatatctgtggccatacaattt

SEQ ID NO: 7092534 - DNA, 22 bp, Homo sapiens
aatatctgtctctaatgcatat

SEQ ID NO: 7092535 - DNA, 22 bp, Homo sapiens
aatatctgtctctaatgcatat

SEQ ID NO: 7092536 - DNA, 22 bp, Homo sapiens
aatatctgtctctaatgcatat

SEQ ID NO: 7092537 - DNA, 22 bp, Homo sapiens
aatatctgtctctaatgcatat

SEQ ID NO: 7092538 - DNA, 22 bp, Homo sapiens
aatatctgtggccatacaattt

SEQ ID NO: 7092539 - DNA, 22 bp, Homo sapiens
aatatctgtggccatacaattt

SEQ ID NO: 7092540 - DNA, 22 bp, Homo sapiens
aatatctgttgttctaagccac

SEQ ID NO: 7092541 - DNA, 22 bp, Homo sapiens
aatattgagaaccagcatgttt

SEQ ID NO: 7092542 - DNA, 22 bp, Homo sapiens
aatattgagaaccagcatgttt

SEQ ID NO: 7092543 - DNA, 22 bp, Homo sapiens
aatatttatgacaggaagtagc

SEQ ID NO: 7092544 - DNA, 22 bp, Homo sapiens
aatatttatgacaggaagtagc

SEQ ID NO: 7092545 - DNA, 22 bp, Homo sapiens
aatatttatgacaggaagtagc

SEQ ID NO: 7092546 - DNA, 22 bp, Homo sapiens
aatatttatgacaggaagtagc

SEQ ID NO: 7092547 - DNA, 22 bp, Homo sapiens
aatatttatgacaggaagtagc

SEQ ID NO: 7092548 - DNA, 22 bp, Homo sapiens
aatatttatgacaggaagtagc

SEQ ID NO: 7092549 - DNA, 22 bp, Homo sapiens
aatatttatatttctcttccct

SEQ ID NO: 7092550 - DNA, 22 bp, Homo sapiens
aatatttatatttctcttccct

SEQ ID NO: 7092551 - DNA, 22 bp, Homo sapiens
aatatttatatttctcttccct

SEQ ID NO: 7092552 - DNA, 22 bp, Homo sapiens
aatatctggagatgctttttgt

SEQ ID NO: 7092553 - DNA, 22 bp, Homo sapiens
aatacagtaggtaatagttcat

SEQ ID NO: 7092554 - DNA, 22 bp, Homo sapiens
aatacagtaggtaatagttcat

SEQ ID NO: 7092555 - DNA, 22 bp, Homo sapiens
aatacagtcttactagaaaatc

SEQ ID NO: 7092556 - DNA, 22 bp, Homo sapiens
aatacagtgaaagtgagcaagg

SEQ ID NO: 7092557 - DNA, 22 bp, Homo sapiens
aatacagtgaaagtgagcaagg

SEQ ID NO: 7092558 - DNA, 21 bp, Homo sapiens
aatacagtgaagaatttcttt

SEQ ID NO: 7092559 - DNA, 19 bp, Homo sapiens
aatacagtgttatagaatt

SEQ ID NO: 7092560 - DNA, 19 bp, Homo sapiens
aatacagtgttatagaatt

SEQ ID NO: 7092561 - DNA, 19 bp, Homo sapiens
aatacagtgttatagaatt

SEQ ID NO: 7092562 - DNA, 22 bp, Homo sapiens
aatacataataagttttgtctg

SEQ ID NO: 7092563 - DNA, 22 bp, Homo sapiens
aatacatatggaattccatgtt

SEQ ID NO: 7092564 - DNA, 22 bp, Homo sapiens
aatacagcagatggagacaaat

SEQ ID NO: 7092565 - DNA, 22 bp, Homo sapiens
aatacagcagatggagacaaat

SEQ ID NO: 7092566 - DNA, 22 bp, Homo sapiens
aatacagatggcatgtgaagat

SEQ ID NO: 7092567 - DNA, 22 bp, Homo sapiens
aatacagatggcatgtgaagat

SEQ ID NO: 7092568 - DNA, 22 bp, Homo sapiens
aatacagatgagcttctgcctc

SEQ ID NO: 7092569 - DNA, 22 bp, Homo sapiens
aatacagatgagcttctgcctc

SEQ ID NO: 7092570 - DNA, 22 bp, Homo sapiens
aatacagatattcagtggtact

SEQ ID NO: 7092571 - DNA, 22 bp, Homo sapiens
aatacagaggggtcacaattca

SEQ ID NO: 7092572 - DNA, 22 bp, Homo sapiens
aatacagaggggtcacaattca

SEQ ID NO: 7092573 - DNA, 22 bp, Homo sapiens
aatacagaggggtcacaattca

SEQ ID NO: 7092574 - DNA, 22 bp, Homo sapiens
aataatgtaggatgataaatga

SEQ ID NO: 7092575 - DNA, 22 bp, Homo sapiens
aataatgtctgctattttaaaa

SEQ ID NO: 7092576 - DNA, 22 bp, Homo sapiens
aataatgtctgctattttaaaa

SEQ ID NO: 7092577 - DNA, 22 bp, Homo sapiens
aataatgtctttggcttgacca

SEQ ID NO: 7092578 - DNA, 22 bp, Homo sapiens
aataatatttgaagcttcaaag

SEQ ID NO: 7092579 - DNA, 22 bp, Homo sapiens
aataatattcctctgtgtgcgt

SEQ ID NO: 7092580 - DNA, 22 bp, Homo sapiens
aataatatttgaagcttcaaag

SEQ ID NO: 7092581 - DNA, 22 bp, Homo sapiens
aataagaattgccagatttgaa

SEQ ID NO: 7092582 - DNA, 22 bp, Homo sapiens
aataatctccctttttgtatgt

SEQ ID NO: 7092583 - DNA, 22 bp, Homo sapiens
aataatctccctttttgtatgt

SEQ ID NO: 7092584 - DNA, 22 bp, Homo sapiens
aataatcttgactactgaatca

SEQ ID NO: 7092585 - DNA, 22 bp, Homo sapiens
aataatcttgactactgaatca

SEQ ID NO: 7092586 - DNA, 22 bp, Homo sapiens
aataatgagacagcttatttaa

SEQ ID NO: 7092587 - DNA, 22 bp, Homo sapiens
aataatgagcttgtctaattgt

SEQ ID NO: 7092588 - DNA, 22 bp, Homo sapiens
aataatgataatggttatagct

SEQ ID NO: 7092589 - DNA, 19 bp, Homo sapiens
aataatgccagatgtctgt

SEQ ID NO: 7092590 - DNA, 22 bp, Homo sapiens
aataatgtacatacatatttcg

SEQ ID NO: 7092591 - DNA, 22 bp, Homo sapiens
aacagtttatgagatatgctat

SEQ ID NO: 7092592 - DNA, 22 bp, Homo sapiens
aacagtttatcaagtttttaca

SEQ ID NO: 7092593 - DNA, 22 bp, Homo sapiens
aacagtttatcaagtttttaca

SEQ ID NO: 7092594 - DNA, 21 bp, Homo sapiens
aacagttctctttgaaggtgt

SEQ ID NO: 7092595 - DNA, 22 bp, Homo sapiens
aacagttgatgtagctttggag

SEQ ID NO: 7092596 - DNA, 22 bp, Homo sapiens
aacagtttatgagatatgctat

SEQ ID NO: 7092597 - DNA, 22 bp, Homo sapiens
aacagtttatgagatatgctat

SEQ ID NO: 7092598 - DNA, 22 bp, Homo sapiens
aacagtttatgataaattctta

SEQ ID NO: 7092599 - DNA, 22 bp, Homo sapiens
aacagtttatgataaattctta

SEQ ID NO: 7092600 - DNA, 22 bp, Homo sapiens
aagttacaagactaaatggaag

SEQ ID NO: 7092601 - DNA, 22 bp, Homo sapiens
aagttacacagagttggaggct

SEQ ID NO: 7092602 - DNA, 22 bp, Homo sapiens
aagttacacagagttggaggct

SEQ ID NO: 7092603 - DNA, 22 bp, Homo sapiens
aagttacacattttcattgtaa

SEQ ID NO: 7092604 - DNA, 22 bp, Homo sapiens
aagttacacattttcattgtaa

SEQ ID NO: 7092605 - DNA, 22 bp, Homo sapiens
aagttacacattttcattgtaa

SEQ ID NO: 7092606 - DNA, 22 bp, Homo sapiens
aagttacagattgggagcagag

SEQ ID NO: 7092607 - DNA, 22 bp, Homo sapiens
aagttacagattgggagcagag

SEQ ID NO: 7092608 - DNA, 22 bp, Homo sapiens
aagttacaggagaaagagatca

SEQ ID NO: 7092609 - DNA, 22 bp, Homo sapiens
aagttacaggagaaagagatca

SEQ ID NO: 7092610 - DNA, 22 bp, Homo sapiens
aagttaagcatggccatgtgac

SEQ ID NO: 7092611 - DNA, 22 bp, Homo sapiens
aagttaaggatcttgagatgat

SEQ ID NO: 7092612 - DNA, 22 bp, Homo sapiens
aagttaaggcacatgctttgga

SEQ ID NO: 7092613 - DNA, 22 bp, Homo sapiens
aagttaaggcacatgctttgga

SEQ ID NO: 7092614 - DNA, 22 bp, Homo sapiens
aagttaagggtcccagtctgtt

SEQ ID NO: 7092615 - DNA, 22 bp, Homo sapiens
aagttaattaacctctccatca

SEQ ID NO: 7092616 - DNA, 22 bp, Homo sapiens
aagttacaagactaaatggaag

SEQ ID NO: 7092617 - DNA, 22 bp, Homo sapiens
aagttacaagactaaatggaag

SEQ ID NO: 7092618 - DNA, 22 bp, Homo sapiens
aagttacaggagaaagagatca

SEQ ID NO: 7092619 - DNA, 22 bp, Homo sapiens
aagttacagtcagaggttaaca

SEQ ID NO: 7092620 - DNA, 22 bp, Homo sapiens
aagttacagtcagaggttaaca

SEQ ID NO: 7092621 - DNA, 22 bp, Homo sapiens
aagttacagtctgcttgctgac

SEQ ID NO: 7092622 - DNA, 22 bp, Homo sapiens
aagttacagtctgcttgctgac

SEQ ID NO: 7092623 - DNA, 22 bp, Homo sapiens
aagttacagtctgcttgctgac

SEQ ID NO: 7092624 - DNA, 22 bp, Homo sapiens
aagttacagttacagaatggag

SEQ ID NO: 7092625 - DNA, 22 bp, Homo sapiens
aagttacagttacagaatggag

SEQ ID NO: 7092626 - DNA, 22 bp, Homo sapiens
aagttacagttaggggtgatga

SEQ ID NO: 7092627 - DNA, 22 bp, Homo sapiens
aagttacagttaggggtgatga

SEQ ID NO: 7092628 - DNA, 22 bp, Homo sapiens
aagttacagttatgaaactcac

SEQ ID NO: 7092629 - DNA, 22 bp, Homo sapiens
aagttacagttatgaaactcac

SEQ ID NO: 7092630 - DNA, 22 bp, Homo sapiens
aagttacagttatgaaactcac

SEQ ID NO: 7092631 - DNA, 22 bp, Homo sapiens
aagttacatattcttgggctat

SEQ ID NO: 7092632 - DNA, 22 bp, Homo sapiens
aagttacatattcttgggctat

SEQ ID NO: 7092633 - DNA, 22 bp, Homo sapiens
aagttacataaatgtcctctag

SEQ ID NO: 7092634 - DNA, 20 bp, Homo sapiens
aagttacattgtattgtacc

SEQ ID NO: 7092635 - DNA, 20 bp, Homo sapiens
aagttacattgtattgtacc

SEQ ID NO: 7092636 - DNA, 22 bp, Homo sapiens
aataagaacttgtctctggcag

SEQ ID NO: 7092637 - DNA, 22 bp, Homo sapiens
aataagaattgccagatttgaa

SEQ ID NO: 7092638 - DNA, 22 bp, Homo sapiens
aataagaattgccagatttgaa

SEQ ID NO: 7092639 - DNA, 22 bp, Homo sapiens
aataagaattgccagatttgaa

SEQ ID NO: 7092640 - DNA, 22 bp, Homo sapiens
aagttacataaatgtcctctag

SEQ ID NO: 7092641 - DNA, 22 bp, Homo sapiens
aagttacataaatgtcctctag

SEQ ID NO: 7092642 - DNA, 22 bp, Homo sapiens
aagttacagttggaactgtgaa

SEQ ID NO: 7092643 - DNA, 22 bp, Homo sapiens
aagttacagttattatttaaaa

SEQ ID NO: 7092644 - DNA, 22 bp, Homo sapiens
aagttacagttattatttaaaa

SEQ ID NO: 7092645 - DNA, 22 bp, Homo sapiens
aagttacagttattatttaaaa

SEQ ID NO: 7092646 - DNA, 22 bp, Homo sapiens
aagttacagttggaactgtgaa

SEQ ID NO: 7092647 - DNA, 22 bp, Homo sapiens
aagttacagttggaactgtgaa

SEQ ID NO: 7092648 - DNA, 22 bp, Homo sapiens
aagcagggagaaatttttcttc

SEQ ID NO: 7092649 - DNA, 23 bp, Homo sapiens
aagcagggagattcttagctgag

SEQ ID NO: 7092650 - DNA, 21 bp, Homo sapiens
aagcaggctgtaatcatgtgg

SEQ ID NO: 7092651 - DNA, 22 bp, Homo sapiens
aagcaggctcacgccaggcagt

SEQ ID NO: 7092652 - DNA, 22 bp, Homo sapiens
aagcaggctcacgccaggcagt

SEQ ID NO: 7092653 - DNA, 22 bp, Homo sapiens
aagcaggcttggtgtggccgct

SEQ ID NO: 7092654 - DNA, 22 bp, Homo sapiens
aagcaggcttggtgtggccgct

SEQ ID NO: 7092655 - DNA, 21 bp, Homo sapiens
aagcagggactgcccaggtcc

SEQ ID NO: 7092656 - DNA, 22 bp, Homo sapiens
acagagcacagtcgggatggga

SEQ ID NO: 7092657 - DNA, 22 bp, Homo sapiens
acagagcacagtcgggatggga

SEQ ID NO: 7092658 - DNA, 22 bp, Homo sapiens
acagagcacagtcgggatggga

SEQ ID NO: 7092659 - DNA, 22 bp, Homo sapiens
aagcaggaaggagcccagggca

SEQ ID NO: 7092660 - DNA, 22 bp, Homo sapiens
aagcaggacgtatttctatcct

SEQ ID NO: 7092661 - DNA, 22 bp, Homo sapiens
aagcaggacgtatttctatcct

SEQ ID NO: 7092662 - DNA, 22 bp, Homo sapiens
aagcaggcgagggcctggagca

SEQ ID NO: 7092663 - DNA, 22 bp, Homo sapiens
aagcaggctagattgaagggct

SEQ ID NO: 7092664 - DNA, 22 bp, Homo sapiens
aagcaggctagattgaagggct

SEQ ID NO: 7092665 - DNA, 22 bp, Homo sapiens
aagcaggctcacgccaggcagt

SEQ ID NO: 7092666 - DNA, 22 bp, Homo sapiens
aagcagggtgtcttgacccatg

SEQ ID NO: 7092667 - DNA, 22 bp, Homo sapiens
aagcagggtgtcttgacccatg

SEQ ID NO: 7092668 - DNA, 22 bp, Homo sapiens
aagcagggtttttccaccgcag

SEQ ID NO: 7092669 - DNA, 22 bp, Homo sapiens
aagcagggtttttccaccgcag

SEQ ID NO: 7092670 - DNA, 22 bp, Homo sapiens
aagcaggtaaatatgtttccct

SEQ ID NO: 7092671 - DNA, 22 bp, Homo sapiens
aagcaggtaaatatgtttccct

SEQ ID NO: 7092672 - DNA, 22 bp, Homo sapiens
aagcagggtttttccaccgcag

SEQ ID NO: 7092673 - DNA, 22 bp, Homo sapiens
aagcaggtgtgagccagtgggc

SEQ ID NO: 7092674 - DNA, 22 bp, Homo sapiens
aagcagtaatgaggtactattt

SEQ ID NO: 7092675 - DNA, 22 bp, Homo sapiens
aagcagtaatgaggtactattt

SEQ ID NO: 7092676 - DNA, 22 bp, Homo sapiens
aagcagtagaatgcattgcttt

SEQ ID NO: 7092677 - DNA, 22 bp, Homo sapiens
aagcagtagaatgcattgcttt

SEQ ID NO: 7092678 - DNA, 22 bp, Homo sapiens
aagcagtagggccaacttgcag

SEQ ID NO: 7092679 - DNA, 22 bp, Homo sapiens
aagcagtagggccaacttgcag

SEQ ID NO: 7092680 - DNA, 22 bp, Homo sapiens
aagcagtatggtatttaagtca

SEQ ID NO: 7092681 - DNA, 22 bp, Homo sapiens
aagcagggtcttcctcagttgg

SEQ ID NO: 7092682 - DNA, 18 bp, Homo sapiens
aagcagggtccattgtgc

SEQ ID NO: 7092683 - DNA, 18 bp, Homo sapiens
aagcagggtccattgtgc

SEQ ID NO: 7092684 - DNA, 22 bp, Homo sapiens
aagcagggctccctggggactc

SEQ ID NO: 7092685 - DNA, 22 bp, Homo sapiens
aagcagggctttaagcggtttt

SEQ ID NO: 7092686 - DNA, 22 bp, Homo sapiens
aagcagggctccctggggactc

SEQ ID NO: 7092687 - DNA, 22 bp, Homo sapiens
aagcagggctccctggggactc

SEQ ID NO: 7092688 - DNA, 22 bp, Homo sapiens
aagcagggctccctggggactc

SEQ ID NO: 7092689 - DNA, 22 bp, Homo sapiens
aagcagggctagaccaagaaga

SEQ ID NO: 7092690 - DNA, 22 bp, Homo sapiens
aagcagggctagaccaagaaga

SEQ ID NO: 7092691 - DNA, 22 bp, Homo sapiens
aagcagggctccctggggactc

SEQ ID NO: 7092692 - DNA, 22 bp, Homo sapiens
aagcagggctccctggggactc

SEQ ID NO: 7092693 - DNA, 22 bp, Homo sapiens
acagcagggggagctgttggac

SEQ ID NO: 7092694 - DNA, 22 bp, Homo sapiens
acagcagggggagctgttggac

SEQ ID NO: 7092695 - DNA, 21 bp, Homo sapiens
acagcagggctggcatgacag

SEQ ID NO: 7092696 - DNA, 21 bp, Homo sapiens
acagcagggctggcatgacag

SEQ ID NO: 7092697 - DNA, 22 bp, Homo sapiens
acagcagggggagctgttggac

SEQ ID NO: 7092698 - DNA, 22 bp, Homo sapiens
acagcagggggagctgttggac

SEQ ID NO: 7092699 - DNA, 22 bp, Homo sapiens
acagcagggggagctgttggac

SEQ ID NO: 7092700 - DNA, 19 bp, Homo sapiens
acagcaggtgtggggataa

SEQ ID NO: 7092701 - DNA, 19 bp, Homo sapiens
acagcaggtgtggggataa

SEQ ID NO: 7092702 - DNA, 22 bp, Homo sapiens
acagcaggtagctttgtgcctc

SEQ ID NO: 7092703 - DNA, 22 bp, Homo sapiens
acagcaggggtggaataaacgt

SEQ ID NO: 7092704 - DNA, 22 bp, Homo sapiens
acagcaggggtggaataaacgt

SEQ ID NO: 7092705 - DNA, 22 bp, Homo sapiens
acagcagggtcacattccctct

SEQ ID NO: 7092706 - DNA, 22 bp, Homo sapiens
acagcagggtcacattccctct

SEQ ID NO: 7092707 - DNA, 22 bp, Homo sapiens
aagcagtgttcccagctggccc

SEQ ID NO: 7092708 - DNA, 22 bp, Homo sapiens
aagcagtgttcccagctggccc

SEQ ID NO: 7092709 - DNA, 22 bp, Homo sapiens
aagcagtgcgctcatctaaggg

SEQ ID NO: 7092710 - DNA, 22 bp, Homo sapiens
aagcagtgttcccagctggccc

SEQ ID NO: 7092711 - DNA, 22 bp, Homo sapiens
aagcagttaatgttttgtcaat

SEQ ID NO: 7092712 - DNA, 22 bp, Homo sapiens
aagcagttactatttactatta

SEQ ID NO: 7092713 - DNA, 22 bp, Homo sapiens
aagcagtcttggctgggttcag

SEQ ID NO: 7092714 - DNA, 20 bp, Homo sapiens
aagcagtgaggtgaggagtg

SEQ ID NO: 7092715 - DNA, 22 bp, Homo sapiens
aagcagtgactctcagaggcag

SEQ ID NO: 7092716 - DNA, 22 bp, Homo sapiens
aagcagtgataagagctaccat

SEQ ID NO: 7092717 - DNA, 22 bp, Homo sapiens
aagcagtgatgcatacagctgt

SEQ ID NO: 7092718 - DNA, 22 bp, Homo sapiens
aagcagtgataagagctaccat

SEQ ID NO: 7092719 - DNA, 22 bp, Homo sapiens
aagcagtgatgcatacagctgt

SEQ ID NO: 7092720 - DNA, 22 bp, Homo sapiens
aagcagtgatgcatacagctgt

SEQ ID NO: 7092721 - DNA, 22 bp, Homo sapiens
aagcataaaacgttacaacatg

SEQ ID NO: 7092722 - DNA, 22 bp, Homo sapiens
acagcaggaagctggagggaaa

SEQ ID NO: 7092723 - DNA, 22 bp, Homo sapiens
aagccctgacctgagagtccgt

SEQ ID NO: 7092724 - DNA, 23 bp, Homo sapiens
aagccctgaaggtttcaggccct

SEQ ID NO: 7092725 - DNA, 22 bp, Homo sapiens
aagccctgacctgagagtccgt

SEQ ID NO: 7092726 - DNA, 22 bp, Homo sapiens
aagccctgacctgagagtccgt

SEQ ID NO: 7092727 - DNA, 22 bp, Homo sapiens
aagccctcattagccatagccc

SEQ ID NO: 7092728 - DNA, 23 bp, Homo sapiens
aagccctgaaggtttcaggccct

SEQ ID NO: 7092729 - DNA, 23 bp, Homo sapiens
aagccccaaggaacttcctggga

SEQ ID NO: 7092730 - DNA, 23 bp, Homo sapiens
aagccccaaggaacttcctggga

SEQ ID NO: 7092731 - DNA, 22 bp, Homo sapiens
aagcccctcgggtgcgcacgcg

SEQ ID NO: 7092732 - DNA, 19 bp, Homo sapiens
aagcccggctgctgagagg

SEQ ID NO: 7092733 - DNA, 22 bp, Homo sapiens
aagcccggttgggaacgtggtg

SEQ ID NO: 7092734 - DNA, 22 bp, Homo sapiens
acagctgctctatatctcagcc

SEQ ID NO: 7092735 - DNA, 22 bp, Homo sapiens
acagctgctctatatctcagcc

SEQ ID NO: 7092736 - DNA, 22 bp, Homo sapiens
acagctgctgcttctcactggg

SEQ ID NO: 7092737 - DNA, 22 bp, Homo sapiens
acagctgctgcttctcactggg

SEQ ID NO: 7092738 - DNA, 22 bp, Homo sapiens
acagctgctgtggaggttttca

SEQ ID NO: 7092739 - DNA, 22 bp, Homo sapiens
acagctgctgtttttgaaggac

SEQ ID NO: 7092740 - DNA, 22 bp, Homo sapiens
acagctgctgtttttgaaggac

SEQ ID NO: 7092741 - DNA, 22 bp, Homo sapiens
acagctgctttctcttactatg

SEQ ID NO: 7092742 - DNA, 22 bp, Homo sapiens
acagctgctttctcttactatg

SEQ ID NO: 7092743 - DNA, 22 bp, Homo sapiens
aagcccagtaccttcagtgagg

SEQ ID NO: 7092744 - DNA, 22 bp, Homo sapiens
aagcccagtaccttcagtgagg

SEQ ID NO: 7092745 - DNA, 22 bp, Homo sapiens
aagcccagtaccttcagtgagg

SEQ ID NO: 7092746 - DNA, 19 bp, Homo sapiens
aagcccagtgtatgctctt

SEQ ID NO: 7092747 - DNA, 19 bp, Homo sapiens
aagcccagtgtatgctctt

SEQ ID NO: 7092748 - DNA, 19 bp, Homo sapiens
aagcccagtgtatgctctt

SEQ ID NO: 7092749 - DNA, 22 bp, Homo sapiens
aagcccagtttcacactgagac

SEQ ID NO: 7092750 - DNA, 22 bp, Homo sapiens
aagcccagtttcacactgagac

SEQ ID NO: 7092751 - DNA, 22 bp, Homo sapiens
aagcccagtttcacactgagac

SEQ ID NO: 7092752 - DNA, 22 bp, Homo sapiens
aagcccagtttcacactgagac

SEQ ID NO: 7092753 - DNA, 22 bp, Homo sapiens
aagcccagtttcacactgagac

SEQ ID NO: 7092754 - DNA, 23 bp, Homo sapiens
aagccccaaggaacttcctggga

SEQ ID NO: 7092755 - DNA, 22 bp, Homo sapiens
aagcccagctctgcctgctctg

SEQ ID NO: 7092756 - DNA, 22 bp, Homo sapiens
aagcccagctctgcctgctctg

SEQ ID NO: 7092757 - DNA, 22 bp, Homo sapiens
aagcccagctctgcctgctctg

SEQ ID NO: 7092758 - DNA, 22 bp, Homo sapiens
aagcccagctctgcctgctctg

SEQ ID NO: 7092759 - DNA, 22 bp, Homo sapiens
aagcccagctctgcctgctctg

SEQ ID NO: 7092760 - DNA, 22 bp, Homo sapiens
aagcccagctgaaagcattttt

SEQ ID NO: 7092761 - DNA, 22 bp, Homo sapiens
aagcccagctgaaagcattttt

SEQ ID NO: 7092762 - DNA, 22 bp, Homo sapiens
aagcccagctgaaagcattttt

SEQ ID NO: 7092763 - DNA, 22 bp, Homo sapiens
aagcccagggaatggtcgggag

SEQ ID NO: 7092764 - DNA, 22 bp, Homo sapiens
aagcccagggaatggtcgggag

SEQ ID NO: 7092765 - DNA, 22 bp, Homo sapiens
aagcccaggtaagtggctcatg

SEQ ID NO: 7092766 - DNA, 22 bp, Homo sapiens
aagcccaggtaagtggctcatg

SEQ ID NO: 7092767 - DNA, 22 bp, Homo sapiens
aagcccaggtaagtggctcatg

SEQ ID NO: 7092768 - DNA, 22 bp, Homo sapiens
acagcaggttacagtggcacag

SEQ ID NO: 7092769 - DNA, 22 bp, Homo sapiens
acagcaggttacagtggcacag

SEQ ID NO: 7092770 - DNA, 19 bp, Homo sapiens
acagcaggtgtggggataa

SEQ ID NO: 7092771 - DNA, 22 bp, Homo sapiens
acagcaggttacagtggcacag

SEQ ID NO: 7092772 - DNA, 22 bp, Homo sapiens
acagccagatctgagagatctt

SEQ ID NO: 7092773 - DNA, 22 bp, Homo sapiens
acagccagatctgagagatctt

SEQ ID NO: 7092774 - DNA, 22 bp, Homo sapiens
acagccaggaattctggagaag

SEQ ID NO: 7092775 - DNA, 22 bp, Homo sapiens
acagccaggacttggccctctt

SEQ ID NO: 7092776 - DNA, 22 bp, Homo sapiens
acagccaggagccatgggcagg

SEQ ID NO: 7092777 - DNA, 22 bp, Homo sapiens
acagccaggagccatgggcagg

SEQ ID NO: 7092778 - DNA, 22 bp, Homo sapiens
acagccagcagagctgtttcct

SEQ ID NO: 7092779 - DNA, 22 bp, Homo sapiens
acagccagcttgatgggatccg

SEQ ID NO: 7092780 - DNA, 22 bp, Homo sapiens
acagccagcttgatgggatccg

SEQ ID NO: 7092781 - DNA, 21 bp, Homo sapiens
acagccaggaacatgaggggc

SEQ ID NO: 7092782 - DNA, 21 bp, Homo sapiens
acagccaggaacatgaggggc

SEQ ID NO: 7092783 - DNA, 22 bp, Homo sapiens
acagccaggaattctggagaag

SEQ ID NO: 7092784 - DNA, 22 bp, Homo sapiens
aagccaggtttgaaatatccca

SEQ ID NO: 7092785 - DNA, 22 bp, Homo sapiens
aagcccagcatccctgcaccag

SEQ ID NO: 7092786 - DNA, 22 bp, Homo sapiens
aagcccagcatccctgcaccag

SEQ ID NO: 7092787 - DNA, 22 bp, Homo sapiens
aagcccagcatccctgcaccag

SEQ ID NO: 7092788 - DNA, 22 bp, Homo sapiens
aagcccagcatccctgcaccag

SEQ ID NO: 7092789 - DNA, 22 bp, Homo sapiens
acagccaggcccagcacgcagg

SEQ ID NO: 7092790 - DNA, 22 bp, Homo sapiens
acagccaggcccagcacgcagg

SEQ ID NO: 7092791 - DNA, 22 bp, Homo sapiens
acagccagggacatacaatggt

SEQ ID NO: 7092792 - DNA, 22 bp, Homo sapiens
acagccagggacatacaatggt

SEQ ID NO: 7092793 - DNA, 22 bp, Homo sapiens
acagccagggacatacaatggt

SEQ ID NO: 7092794 - DNA, 22 bp, Homo sapiens
acagccaggagccatgggcagg

SEQ ID NO: 7092795 - DNA, 22 bp, Homo sapiens
acagccaggagccatgggcagg

SEQ ID NO: 7092796 - DNA, 22 bp, Homo sapiens
acagccaggaggaactcagtga

SEQ ID NO: 7092797 - DNA, 22 bp, Homo sapiens
acagccaggaggaactcagtga

SEQ ID NO: 7092798 - DNA, 22 bp, Homo sapiens
acagccaggaggaactcagtga

SEQ ID NO: 7092799 - DNA, 23 bp, Homo sapiens
acagccaggatgggagcagaagc

SEQ ID NO: 7092800 - DNA, 23 bp, Homo sapiens
acagccaggatgggagcagaagc

SEQ ID NO: 7092801 - DNA, 23 bp, Homo sapiens
acagccaggatgggagcagaagc

SEQ ID NO: 7092802 - DNA, 23 bp, Homo sapiens
acagccaggatgggagcagaagc

SEQ ID NO: 7092803 - DNA, 23 bp, Homo sapiens
acagccaggatgggagcagaagc

SEQ ID NO: 7092804 - DNA, 22 bp, Homo sapiens
acagccaggcccagcacgcagg

SEQ ID NO: 7092805 - DNA, 22 bp, Homo sapiens
acagccaggcccagcacgcagg

SEQ ID NO: 7092806 - DNA, 22 bp, Homo sapiens
acagccaggcccagcacgcagg

SEQ ID NO: 7092807 - DNA, 20 bp, Homo sapiens
acacatatagcagcataaac

SEQ ID NO: 7092808 - DNA, 20 bp, Homo sapiens
acacatatagcagcataaac

SEQ ID NO: 7092809 - DNA, 20 bp, Homo sapiens
acacatatagcagcataaac

SEQ ID NO: 7092810 - DNA, 20 bp, Homo sapiens
acacatatagcagcataaac

SEQ ID NO: 7092811 - DNA, 22 bp, Homo sapiens
acacatatatacatatttgtgc

SEQ ID NO: 7092812 - DNA, 22 bp, Homo sapiens
acacatatatacatatttgtgc

SEQ ID NO: 7092813 - DNA, 22 bp, Homo sapiens
acacatatatacatatttgtgc

SEQ ID NO: 7092814 - DNA, 22 bp, Homo sapiens
acacatatatacatatttgtgc

SEQ ID NO: 7092815 - DNA, 22 bp, Homo sapiens
acacatataccactgtaaatga

SEQ ID NO: 7092816 - DNA, 22 bp, Homo sapiens
acacatataccactgtaaatga

SEQ ID NO: 7092817 - DNA, 17 bp, Homo sapiens
acacatacatgggccat

SEQ ID NO: 7092818 - DNA, 22 bp, Homo sapiens
acacatacatggggaagatgag

SEQ ID NO: 7092819 - DNA, 22 bp, Homo sapiens
aagatacagtgaaagggcattg

SEQ ID NO: 7092820 - DNA, 22 bp, Homo sapiens
aagatacatatttgttctagtg

SEQ ID NO: 7092821 - DNA, 22 bp, Homo sapiens
aagatacatatttgttctagtg

SEQ ID NO: 7092822 - DNA, 22 bp, Homo sapiens
aagatacatatttgttctagtg

SEQ ID NO: 7092823 - DNA, 22 bp, Homo sapiens
aagatacatatttgttctagtg

SEQ ID NO: 7092824 - DNA, 22 bp, Homo sapiens
aagatacatcaaagcaaattgg

SEQ ID NO: 7092825 - DNA, 22 bp, Homo sapiens
acacataagcctaatcatctcc

SEQ ID NO: 7092826 - DNA, 22 bp, Homo sapiens
aagatacacgttgtattgaata

SEQ ID NO: 7092827 - DNA, 22 bp, Homo sapiens
aagatacacgttgtattgaata

SEQ ID NO: 7092828 - DNA, 22 bp, Homo sapiens
aagatacacgttgtattgaata

SEQ ID NO: 7092829 - DNA, 22 bp, Homo sapiens
aagatacacgttgtattgaata

SEQ ID NO: 7092830 - DNA, 22 bp, Homo sapiens
aagatacacgttgtattgaata

SEQ ID NO: 7092831 - DNA, 22 bp, Homo sapiens
aagatacacgttgtattgaata

SEQ ID NO: 7092832 - DNA, 22 bp, Homo sapiens
aagatacagacagagccaaaat

SEQ ID NO: 7092833 - DNA, 22 bp, Homo sapiens
aagatacagacagagccaaaat

SEQ ID NO: 7092834 - DNA, 23 bp, Homo sapiens
aagatacaggtgtggaatggttt

SEQ ID NO: 7092835 - DNA, 23 bp, Homo sapiens
aagatacaggtgtggaatggttt

SEQ ID NO: 7092836 - DNA, 22 bp, Homo sapiens
acacttcatgcattcttcactc

SEQ ID NO: 7092837 - DNA, 22 bp, Homo sapiens
acacttcatgcattcttcactc

SEQ ID NO: 7092838 - DNA, 18 bp, Homo sapiens
acacttcctggtggtgtg

SEQ ID NO: 7092839 - DNA, 18 bp, Homo sapiens
acacttcctggtggtgtg

SEQ ID NO: 7092840 - DNA, 22 bp, Homo sapiens
acacttctcccatctcctgttg

SEQ ID NO: 7092841 - DNA, 22 bp, Homo sapiens
acacttctctttgaagaacaat

SEQ ID NO: 7092842 - DNA, 22 bp, Homo sapiens
acacttctctttgaagaacaat

SEQ ID NO: 7092843 - DNA, 22 bp, Homo sapiens
acacttctttgtcacctgcttc

SEQ ID NO: 7092844 - DNA, 23 bp, Homo sapiens
acagaaagttctgctggacagag

SEQ ID NO: 7092845 - DNA, 23 bp, Homo sapiens
acagaaagttctgctggacagag

SEQ ID NO: 7092846 - DNA, 23 bp, Homo sapiens
acagaaagttctgctggacagag

SEQ ID NO: 7092847 - DNA, 23 bp, Homo sapiens
acagaaagttctgctggacagag

SEQ ID NO: 7092848 - DNA, 20 bp, Homo sapiens
acagaaagctgccttgtccc

SEQ ID NO: 7092849 - DNA, 20 bp, Homo sapiens
acagaaagctgccttgtccc

SEQ ID NO: 7092850 - DNA, 20 bp, Homo sapiens
acagaaagctgccttgtccc

SEQ ID NO: 7092851 - DNA, 22 bp, Homo sapiens
acagaaagatgatttgaaatgg

SEQ ID NO: 7092852 - DNA, 22 bp, Homo sapiens
acactttaagcatttcacactg

SEQ ID NO: 7092853 - DNA, 22 bp, Homo sapiens
acagaaagatgatttgaaatgg

SEQ ID NO: 7092854 - DNA, 22 bp, Homo sapiens
acacttgtggcctttctagtaa

SEQ ID NO: 7092855 - DNA, 22 bp, Homo sapiens
acacttgtgttgaaagctgtta

SEQ ID NO: 7092856 - DNA, 22 bp, Homo sapiens
acacttgttaagaagaggatat

SEQ ID NO: 7092857 - DNA, 22 bp, Homo sapiens
acacttggagcaacacttatgg

SEQ ID NO: 7092858 - DNA, 22 bp, Homo sapiens
acacttgtaatggagaacacta

SEQ ID NO: 7092859 - DNA, 22 bp, Homo sapiens
acacttgtaatggagaacacta

SEQ ID NO: 7092860 - DNA, 20 bp, Homo sapiens
acacttgacaccagaaatgg

SEQ ID NO: 7092861 - DNA, 20 bp, Homo sapiens
acacttgacaccagaaatgg

SEQ ID NO: 7092862 - DNA, 22 bp, Homo sapiens
acacttgaggaatgtggtgatt

SEQ ID NO: 7092863 - DNA, 22 bp, Homo sapiens
acacttgaggtttttaggtgcg

SEQ ID NO: 7092864 - DNA, 22 bp, Homo sapiens
acacttgataggtcaaatcagt

SEQ ID NO: 7092865 - DNA, 22 bp, Homo sapiens
acacttgccatgctgcacactg

SEQ ID NO: 7092866 - DNA, 23 bp, Homo sapiens
acagacattccataatgtacacc

SEQ ID NO: 7092867 - DNA, 23 bp, Homo sapiens
acagacattccataatgtacacc

SEQ ID NO: 7092868 - DNA, 22 bp, Homo sapiens
acagacatttaataaatgctga

SEQ ID NO: 7092869 - DNA, 22 bp, Homo sapiens
acagacatttaataaatgctga

SEQ ID NO: 7092870 - DNA, 23 bp, Homo sapiens
acagacaacactgatgagagaaa

SEQ ID NO: 7092871 - DNA, 23 bp, Homo sapiens
acagacaacactgatgagagaaa

SEQ ID NO: 7092872 - DNA, 22 bp, Homo sapiens
acagacatttaataaatgctga

SEQ ID NO: 7092873 - DNA, 22 bp, Homo sapiens
acagacatttaataaatgctga

SEQ ID NO: 7092874 - DNA, 19 bp, Homo sapiens
acagacatttgcaattagc

SEQ ID NO: 7092875 - DNA, 22 bp, Homo sapiens
acagacattttaagacacttta

SEQ ID NO: 7092876 - DNA, 18 bp, Homo sapiens
acagaaatagctgtgcct

SEQ ID NO: 7092877 - DNA, 18 bp, Homo sapiens
acagaaatagctgtgcct

SEQ ID NO: 7092878 - DNA, 18 bp, Homo sapiens
acagaaatagctgtgcct

SEQ ID NO: 7092879 - DNA, 18 bp, Homo sapiens
acagaaatagctgtgcct

SEQ ID NO: 7092880 - DNA, 18 bp, Homo sapiens
acagaaatagctgtgcct

SEQ ID NO: 7092881 - DNA, 22 bp, Homo sapiens
acagaaatatagaaggtaggaa

SEQ ID NO: 7092882 - DNA, 23 bp, Homo sapiens
acagaaagttctgctggacagag

SEQ ID NO: 7092883 - DNA, 22 bp, Homo sapiens
acagaaataactttttatgttt

SEQ ID NO: 7092884 - DNA, 23 bp, Homo sapiens
acagaaagttctgctggacagag

SEQ ID NO: 7092885 - DNA, 22 bp, Homo sapiens
acagaaataactttttatgttt

SEQ ID NO: 7092886 - DNA, 22 bp, Homo sapiens
acagaaataactttttatgttt

SEQ ID NO: 7092887 - DNA, 22 bp, Homo sapiens
acagaaataactttttatgttt

SEQ ID NO: 7092888 - DNA, 22 bp, Homo sapiens
acagaaatgatgtttggcaata

SEQ ID NO: 7092889 - DNA, 22 bp, Homo sapiens
acagaaatgatgtttggcaata

SEQ ID NO: 7092890 - DNA, 23 bp, Homo sapiens
acagaaatcatttgtaaggtacc

SEQ ID NO: 7092891 - DNA, 23 bp, Homo sapiens
acagaaatcatttgtaaggtacc

SEQ ID NO: 7092892 - DNA, 22 bp, Homo sapiens
acagaaatattcgtggtgcttg

SEQ ID NO: 7092893 - DNA, 22 bp, Homo sapiens
acagaaatatagaaggtaggaa

SEQ ID NO: 7092894 - DNA, 22 bp, Homo sapiens
acagaaatattcgtggtgcttg

SEQ ID NO: 7092895 - DNA, 23 bp, Homo sapiens
acagaaatcatttgtaaggtacc

SEQ ID NO: 7092896 - DNA, 23 bp, Homo sapiens
acagaaatcatttgtaaggtacc

SEQ ID NO: 7092897 - DNA, 23 bp, Homo sapiens
acagaaatcatttgtaaggtacc

SEQ ID NO: 7092898 - DNA, 22 bp, Homo sapiens
acagagcaactttatttcatgg

SEQ ID NO: 7092899 - DNA, 22 bp, Homo sapiens
acagagatgtcagattggcagc

SEQ ID NO: 7092900 - DNA, 22 bp, Homo sapiens
acagagatgtcagattggcagc

SEQ ID NO: 7092901 - DNA, 22 bp, Homo sapiens
acagagatgtggatgagggatt

SEQ ID NO: 7092902 - DNA, 22 bp, Homo sapiens
acagagatgtggatgagggatt

SEQ ID NO: 7092903 - DNA, 22 bp, Homo sapiens
acagagcaataacagggagagg

SEQ ID NO: 7092904 - DNA, 22 bp, Homo sapiens
acagagcaataacagggagagg

SEQ ID NO: 7092905 - DNA, 22 bp, Homo sapiens
acagagcaatgcgtgttctcta

SEQ ID NO: 7092906 - DNA, 22 bp, Homo sapiens
acagagatgggaacattcaggt

SEQ ID NO: 7092907 - DNA, 22 bp, Homo sapiens
acagagatgggaacattcaggt

SEQ ID NO: 7092908 - DNA, 22 bp, Homo sapiens
acagagatggcacagagaaggt

SEQ ID NO: 7092909 - DNA, 22 bp, Homo sapiens
acagagatggcacagagaaggt

SEQ ID NO: 7092910 - DNA, 22 bp, Homo sapiens
acagagatggcacagagaaggt

SEQ ID NO: 7092911 - DNA, 22 bp, Homo sapiens
acagagatggcttttcagaggc

SEQ ID NO: 7092912 - DNA, 22 bp, Homo sapiens
acagagatggcttttcagaggc

SEQ ID NO: 7092913 - DNA, 22 bp, Homo sapiens
acagagatggcttttcagaggc

SEQ ID NO: 7092914 - DNA, 22 bp, Homo sapiens
acagagatgaattagacagggt

SEQ ID NO: 7092915 - DNA, 22 bp, Homo sapiens
acagagatgaattagacagggt

SEQ ID NO: 7092916 - DNA, 22 bp, Homo sapiens
acagagatgagtcaacacagct

SEQ ID NO: 7092917 - DNA, 22 bp, Homo sapiens
acagagatgagtcaacacagct

SEQ ID NO: 7092918 - DNA, 22 bp, Homo sapiens
acagagatgcaagtgtgtattt

SEQ ID NO: 7092919 - DNA, 22 bp, Homo sapiens
acagagatgcaagtgtgtattt

SEQ ID NO: 7092920 - DNA, 22 bp, Homo sapiens
acagagatggcacagagaaggt

SEQ ID NO: 7092921 - DNA, 22 bp, Homo sapiens
acagagatggcacagagaaggt

SEQ ID NO: 7092922 - DNA, 22 bp, Homo sapiens
acagagatgaataatacaggtg

SEQ ID NO: 7092923 - DNA, 22 bp, Homo sapiens
acagagatgaataatacaggtg

SEQ ID NO: 7092924 - DNA, 22 bp, Homo sapiens
acagagatgaataatacaggtg

SEQ ID NO: 7092925 - DNA, 22 bp, Homo sapiens
acagagatgaattagacagggt

SEQ ID NO: 7092926 - DNA, 20 bp, Homo sapiens
acagagatcagctgatgggc

SEQ ID NO: 7092927 - DNA, 20 bp, Homo sapiens
acagagatcagctgatgggc

SEQ ID NO: 7092928 - DNA, 20 bp, Homo sapiens
acagagatcctctctttatc

SEQ ID NO: 7092929 - DNA, 23 bp, Homo sapiens
acagagatcttgacttgtatgga

SEQ ID NO: 7092930 - DNA, 22 bp, Homo sapiens
acagactggagtgagagaaata

SEQ ID NO: 7092931 - DNA, 22 bp, Homo sapiens
acagactggcctgtctcgcacc

SEQ ID NO: 7092932 - DNA, 22 bp, Homo sapiens
acagaccaagtttccagcaggt

SEQ ID NO: 7092933 - DNA, 22 bp, Homo sapiens
acagacctatggcagctgccat

SEQ ID NO: 7092934 - DNA, 22 bp, Homo sapiens
acagacctctagattacatttg

SEQ ID NO: 7092935 - DNA, 22 bp, Homo sapiens
acagacctgattcaagtcttga

SEQ ID NO: 7092936 - DNA, 22 bp, Homo sapiens
acagacctgggcacagaaagga

SEQ ID NO: 7092937 - DNA, 22 bp, Homo sapiens
acagactgattcattgctcagg

SEQ ID NO: 7092938 - DNA, 22 bp, Homo sapiens
aatgtacaagggttccagtttt

SEQ ID NO: 7092939 - DNA, 22 bp, Homo sapiens
aatgtacaagggttccagtttt

SEQ ID NO: 7092940 - DNA, 22 bp, Homo sapiens
aatgtacaagggttccagtttt

SEQ ID NO: 7092941 - DNA, 22 bp, Homo sapiens
aatgtacaagggttccagtttt

SEQ ID NO: 7092942 - DNA, 22 bp, Homo sapiens
aatgtacaataagacaaagagg

SEQ ID NO: 7092943 - DNA, 22 bp, Homo sapiens
aatgtacaataagacaaagagg

SEQ ID NO: 7092944 - DNA, 22 bp, Homo sapiens
aatgtacaataagacaaagagg

SEQ ID NO: 7092945 - DNA, 22 bp, Homo sapiens
aatgtacaataagacaaagagg

SEQ ID NO: 7092946 - DNA, 22 bp, Homo sapiens
aatgtacaataagacaaagagg

SEQ ID NO: 7092947 - DNA, 22 bp, Homo sapiens
aagaacaggttctagaaccatt

SEQ ID NO: 7092948 - DNA, 22 bp, Homo sapiens
aagaacaggttctagaaccatt

SEQ ID NO: 7092949 - DNA, 22 bp, Homo sapiens
aagaacattgatattgtctatg

SEQ ID NO: 7092950 - DNA, 22 bp, Homo sapiens
aagaacattcgaactattttct

SEQ ID NO: 7092951 - DNA, 22 bp, Homo sapiens
aagaacattcgaactattttct

SEQ ID NO: 7092952 - DNA, 22 bp, Homo sapiens
aagaacaggttctagaaccatt

SEQ ID NO: 7092953 - DNA, 22 bp, Homo sapiens
aagaacaggttctagaaccatt

SEQ ID NO: 7092954 - DNA, 22 bp, Homo sapiens
aagaacagtgtcctgggactcg

SEQ ID NO: 7092955 - DNA, 22 bp, Homo sapiens
aagaacatgttaaaagattcac

SEQ ID NO: 7092956 - DNA, 22 bp, Homo sapiens
aagaacattttgtagaatgaca

SEQ ID NO: 7092957 - DNA, 22 bp, Homo sapiens
aagaacattttgtagaatgaca

SEQ ID NO: 7092958 - DNA, 22 bp, Homo sapiens
aagaacattttgtagaatgaca

SEQ ID NO: 7092959 - DNA, 22 bp, Homo sapiens
aagaacattgatattgtctatg

SEQ ID NO: 7092960 - DNA, 22 bp, Homo sapiens
aagaacattttgtagaatgaca

SEQ ID NO: 7092961 - DNA, 22 bp, Homo sapiens
aagaacattttgtagaatgaca

SEQ ID NO: 7092962 - DNA, 23 bp, Homo sapiens
aagaactgcgaatggagaaagta

SEQ ID NO: 7092963 - DNA, 22 bp, Homo sapiens
aagaactcaacatagagtggga

SEQ ID NO: 7092964 - DNA, 19 bp, Homo sapiens
aagaactatgtgattacag

SEQ ID NO: 7092965 - DNA, 19 bp, Homo sapiens
aagaactatgtgattacag

SEQ ID NO: 7092966 - DNA, 22 bp, Homo sapiens
aagaactatctctggctgtagg

SEQ ID NO: 7092967 - DNA, 22 bp, Homo sapiens
aagaaccaaaatgaagctaggt

SEQ ID NO: 7092968 - DNA, 22 bp, Homo sapiens
aagaagatggttaactttcagt

SEQ ID NO: 7092969 - DNA, 22 bp, Homo sapiens
aagaagagaactggcatcctaa

SEQ ID NO: 7092970 - DNA, 22 bp, Homo sapiens
aagaagatggttaactttcagt

SEQ ID NO: 7092971 - DNA, 19 bp, Homo sapiens
aagaagcaataagctgtga

SEQ ID NO: 7092972 - DNA, 19 bp, Homo sapiens
aagaagcaataagctgtga

SEQ ID NO: 7092973 - DNA, 19 bp, Homo sapiens
aagaagcaataagctgtga

SEQ ID NO: 7092974 - DNA, 19 bp, Homo sapiens
aagaagcaataagctgtga

SEQ ID NO: 7092975 - DNA, 21 bp, Homo sapiens
aagaagcaatttattggaagg

SEQ ID NO: 7092976 - DNA, 21 bp, Homo sapiens
aagaagcaatttattggaagg

SEQ ID NO: 7092977 - DNA, 21 bp, Homo sapiens
aagaagcaatttattggaagg

SEQ ID NO: 7092978 - DNA, 22 bp, Homo sapiens
aagaagcactttcctacatgtt

SEQ ID NO: 7092979 - DNA, 22 bp, Homo sapiens
aagaagcactttcctacatgtt

SEQ ID NO: 7092980 - DNA, 22 bp, Homo sapiens
aagaagcactttcctacatgtt

SEQ ID NO: 7092981 - DNA, 22 bp, Homo sapiens
aattttatctctaagcaggctt

SEQ ID NO: 7092982 - DNA, 22 bp, Homo sapiens
aattttatctctaagcaggctt

SEQ ID NO: 7092983 - DNA, 22 bp, Homo sapiens
aattttatctctaagcaggctt

SEQ ID NO: 7092984 - DNA, 22 bp, Homo sapiens
acaaaaattagctgggcatggt

SEQ ID NO: 7092985 - DNA, 22 bp, Homo sapiens
acaaaaattagctgggcatggt

SEQ ID NO: 7092986 - DNA, 22 bp, Homo sapiens
acaaaaattagctgggcatggt

SEQ ID NO: 7092987 - DNA, 22 bp, Homo sapiens
acaaaacagtgttcctgcccct

SEQ ID NO: 7092988 - DNA, 22 bp, Homo sapiens
acaaaacagtgttcctgcccct

SEQ ID NO: 7092989 - DNA, 22 bp, Homo sapiens
acaaaacagtgttcctgcccct

SEQ ID NO: 7092990 - DNA, 22 bp, Homo sapiens
acaaaacagtgttcctgcccct

SEQ ID NO: 7092991 - DNA, 22 bp, Homo sapiens
aagaagaagtgttatttttaga

SEQ ID NO: 7092992 - DNA, 22 bp, Homo sapiens
aagaagaagtgttatttttaga

SEQ ID NO: 7092993 - DNA, 22 bp, Homo sapiens
aagaagaattattccctaatca

SEQ ID NO: 7092994 - DNA, 22 bp, Homo sapiens
aagaagaattattccctaatca

SEQ ID NO: 7092995 - DNA, 22 bp, Homo sapiens
aagaagagaaatgtgctgctgg

SEQ ID NO: 7092996 - DNA, 22 bp, Homo sapiens
aagaagagaaatgtgctgctgg

SEQ ID NO: 7092997 - DNA, 22 bp, Homo sapiens
aagaactgtatcaagatgtagt

SEQ ID NO: 7092998 - DNA, 22 bp, Homo sapiens
aagaacttgggctgagtgaaag

SEQ ID NO: 7092999 - DNA, 22 bp, Homo sapiens
aagaactttaaagcacttatga

SEQ ID NO: 7093000 - DNA, 22 bp, Homo sapiens
acaaaagtgtaggaattcctta

SEQ ID NO: 7093001 - DNA, 22 bp, Homo sapiens
acaaaagtgtaggaattcctta

SEQ ID NO: 7093002 - DNA, 22 bp, Homo sapiens
acaaaagtgtaggaattcctta

SEQ ID NO: 7093003 - DNA, 22 bp, Homo sapiens
acaaaagcactgcagagtaagc

SEQ ID NO: 7093004 - DNA, 22 bp, Homo sapiens
acaaaagcttttggagggttgt

SEQ ID NO: 7093005 - DNA, 22 bp, Homo sapiens
acaaaagtgagtgtgtctcaga

SEQ ID NO: 7093006 - DNA, 22 bp, Homo sapiens
acaaaagtgagtgtgtctcaga

SEQ ID NO: 7093007 - DNA, 22 bp, Homo sapiens
acaaaagaataagatgagtcat

SEQ ID NO: 7093008 - DNA, 22 bp, Homo sapiens
acaaaagcactgcagagtaagc

SEQ ID NO: 7093009 - DNA, 22 bp, Homo sapiens
acaaaagcactgcagagtaagc

SEQ ID NO: 7093010 - DNA, 22 bp, Homo sapiens
acaaaagaataagatgagtcat

SEQ ID NO: 7093011 - DNA, 22 bp, Homo sapiens
acaaaagaataagatgagtcat

SEQ ID NO: 7093012 - DNA, 21 bp, Homo sapiens
acaaaagaagctgccttttaa

SEQ ID NO: 7093013 - DNA, 22 bp, Homo sapiens
acaaaactcttgctgggatttt

SEQ ID NO: 7093014 - DNA, 22 bp, Homo sapiens
acaaaactcttgctgggatttt

SEQ ID NO: 7093015 - DNA, 22 bp, Homo sapiens
acaaaaccagaaaatctctacc

SEQ ID NO: 7093016 - DNA, 22 bp, Homo sapiens
acaaaagaataagatgagtcat

SEQ ID NO: 7093017 - DNA, 22 bp, Homo sapiens
acaaaagaataagatgagtcat

SEQ ID NO: 7093018 - DNA, 22 bp, Homo sapiens
aagaatatctgttttatttagg

SEQ ID NO: 7093019 - DNA, 22 bp, Homo sapiens
aagaatatctgttttatttagg

SEQ ID NO: 7093020 - DNA, 22 bp, Homo sapiens
acaaaatagagttctcccctgg

SEQ ID NO: 7093021 - DNA, 22 bp, Homo sapiens
acaaaatagagttctcccctgg

SEQ ID NO: 7093022 - DNA, 22 bp, Homo sapiens
aagaatatctgttttatttagg

SEQ ID NO: 7093023 - DNA, 22 bp, Homo sapiens
aagaatatctgttttatttagg

SEQ ID NO: 7093024 - DNA, 22 bp, Homo sapiens
aagaatatagattttttgaagt

SEQ ID NO: 7093025 - DNA, 17 bp, Homo sapiens
aagaatcattagagaag

SEQ ID NO: 7093026 - DNA, 17 bp, Homo sapiens
aagaatcattagagaag

SEQ ID NO: 7093027 - DNA, 22 bp, Homo sapiens
aagaatcatctgaactttgagg

SEQ ID NO: 7093028 - DNA, 22 bp, Homo sapiens
aagaatatttcctgcacttggg

SEQ ID NO: 7093029 - DNA, 22 bp, Homo sapiens
aagaatatttcctgcacttggg

SEQ ID NO: 7093030 - DNA, 23 bp, Homo sapiens
aagaatcagtaagtaaggagacc

SEQ ID NO: 7093031 - DNA, 22 bp, Homo sapiens
acaaatatttactgaatccact

SEQ ID NO: 7093032 - DNA, 22 bp, Homo sapiens
acaaagctagagaagagaattg

SEQ ID NO: 7093033 - DNA, 22 bp, Homo sapiens
aagaatcattgtaaagttctgt

SEQ ID NO: 7093034 - DNA, 22 bp, Homo sapiens
aagaatctatggtacatccaag

SEQ ID NO: 7093035 - DNA, 23 bp, Homo sapiens
aagaatctcagaattagaaatac

SEQ ID NO: 7093036 - DNA, 22 bp, Homo sapiens
acaaatctgttttatagacttt

SEQ ID NO: 7093037 - DNA, 22 bp, Homo sapiens
acaaatgaacatataagcttga

SEQ ID NO: 7093038 - DNA, 22 bp, Homo sapiens
acaaatgaacatataagcttga

SEQ ID NO: 7093039 - DNA, 22 bp, Homo sapiens
acaaatgaacctgaaatctcag

SEQ ID NO: 7093040 - DNA, 22 bp, Homo sapiens
acaaatgaacctgaaatctcag

SEQ ID NO: 7093041 - DNA, 22 bp, Homo sapiens
acaaatgaacctgaaatctcag

SEQ ID NO: 7093042 - DNA, 22 bp, Homo sapiens
acaaatgaatcatacataatgt

SEQ ID NO: 7093043 - DNA, 22 bp, Homo sapiens
acaaatgaatcatacataatgt

SEQ ID NO: 7093044 - DNA, 22 bp, Homo sapiens
acaaatgaatcatacataatgt

SEQ ID NO: 7093045 - DNA, 22 bp, Homo sapiens
acaaatgactatttggtacagg

SEQ ID NO: 7093046 - DNA, 22 bp, Homo sapiens
acaaatgactatttggtacagg

SEQ ID NO: 7093047 - DNA, 22 bp, Homo sapiens
acaatatacacatcctaatggg

SEQ ID NO: 7093048 - DNA, 22 bp, Homo sapiens
acaatagtcaatgcacgtcatt

SEQ ID NO: 7093049 - DNA, 20 bp, Homo sapiens
acaatagatttgagcaaagt

SEQ ID NO: 7093050 - DNA, 20 bp, Homo sapiens
acaatagatttgagcaaagt

SEQ ID NO: 7093051 - DNA, 22 bp, Homo sapiens
acaatagacccatgacacatac

SEQ ID NO: 7093052 - DNA, 22 bp, Homo sapiens
acaatagacccatgacacatac

SEQ ID NO: 7093053 - DNA, 22 bp, Homo sapiens
acaatagagttctcataggaca

SEQ ID NO: 7093054 - DNA, 22 bp, Homo sapiens
acaatagagttctcataggaca

SEQ ID NO: 7093055 - DNA, 22 bp, Homo sapiens
acaatagagttctcataggaca

SEQ ID NO: 7093056 - DNA, 22 bp, Homo sapiens
acaatagagttctcataggaca

SEQ ID NO: 7093057 - DNA, 22 bp, Homo sapiens
acaatagatactgggcacatat

SEQ ID NO: 7093058 - DNA, 22 bp, Homo sapiens
acaatagatactgggcacatat

SEQ ID NO: 7093059 - DNA, 20 bp, Homo sapiens
acaatagatttgagcaaagt

SEQ ID NO: 7093060 - DNA, 22 bp, Homo sapiens
acaacaaaatcactagtcttcc

SEQ ID NO: 7093061 - DNA, 22 bp, Homo sapiens
acaaggcttatagttgcttttt

SEQ ID NO: 7093062 - DNA, 22 bp, Homo sapiens
acaaggcttcacacagtatgaa

SEQ ID NO: 7093063 - DNA, 22 bp, Homo sapiens
acaaggcttcacacagtatgaa

SEQ ID NO: 7093064 - DNA, 22 bp, Homo sapiens
acaaggcttcatattcttttta

SEQ ID NO: 7093065 - DNA, 21 bp, Homo sapiens
acaatagacataagcagagca

SEQ ID NO: 7093066 - DNA, 22 bp, Homo sapiens
acaatagacccatgacacatac

SEQ ID NO: 7093067 - DNA, 22 bp, Homo sapiens
acaatagacccatgacacatac

SEQ ID NO: 7093068 - DNA, 22 bp, Homo sapiens
acaaatttcataggcaaatttt

SEQ ID NO: 7093069 - DNA, 22 bp, Homo sapiens
acaaatttcataggcaaatttt

SEQ ID NO: 7093070 - DNA, 22 bp, Homo sapiens
acaaattgttgcttcatgaatg

SEQ ID NO: 7093071 - DNA, 22 bp, Homo sapiens
acaaatttattgaagggcatat

SEQ ID NO: 7093072 - DNA, 22 bp, Homo sapiens
acaaatttattgaagggcatat

SEQ ID NO: 7093073 - DNA, 22 bp, Homo sapiens
acaaatttgaatcctgacttct

SEQ ID NO: 7093074 - DNA, 22 bp, Homo sapiens
acaaatttgaatcctgacttct

SEQ ID NO: 7093075 - DNA, 22 bp, Homo sapiens
acaaatttggtgagagtaaata

SEQ ID NO: 7093076 - DNA, 22 bp, Homo sapiens
acaaatttgtgtagttatggca

SEQ ID NO: 7093077 - DNA, 22 bp, Homo sapiens
acaatatagtccatgagcatgc

SEQ ID NO: 7093078 - DNA, 22 bp, Homo sapiens
acaatatagtccatgagcatgc

SEQ ID NO: 7093079 - DNA, 22 bp, Homo sapiens
acaatatagtccatgagcatgc

SEQ ID NO: 7093080 - DNA, 22 bp, Homo sapiens
acaatatgaattcccttggtta

SEQ ID NO: 7093081 - DNA, 22 bp, Homo sapiens
acaatatgggatatacatttta

SEQ ID NO: 7093082 - DNA, 22 bp, Homo sapiens
acaatatgggatatacatttta

SEQ ID NO: 7093083 - DNA, 22 bp, Homo sapiens
acaatatcagctcaagccctgt

SEQ ID NO: 7093084 - DNA, 20 bp, Homo sapiens
acaatatgtagatgaatagc

SEQ ID NO: 7093085 - DNA, 20 bp, Homo sapiens
acaatatgtagatgaatagc

SEQ ID NO: 7093086 - DNA, 20 bp, Homo sapiens
acaatatgtagatgaatagc

SEQ ID NO: 7093087 - DNA, 22 bp, Homo sapiens
acaatattgtacccagaagttt

SEQ ID NO: 7093088 - DNA, 22 bp, Homo sapiens
acaatattgtacccagaagttt

SEQ ID NO: 7093089 - DNA, 22 bp, Homo sapiens
acaatatgttttggcccttata

SEQ ID NO: 7093090 - DNA, 22 bp, Homo sapiens
acaatgtagttgtcatgagaca

SEQ ID NO: 7093091 - DNA, 22 bp, Homo sapiens
acaatgtagttgtcatgagaca

SEQ ID NO: 7093092 - DNA, 22 bp, Homo sapiens
acaatgtcaaaataggaaacat

SEQ ID NO: 7093093 - DNA, 21 bp, Homo sapiens
acaatgtcaaggtcagacatt

SEQ ID NO: 7093094 - DNA, 22 bp, Homo sapiens
acaatgtcacctctcatgtttt

SEQ ID NO: 7093095 - DNA, 22 bp, Homo sapiens
acaatgtaggctgaaaaagctt

SEQ ID NO: 7093096 - DNA, 22 bp, Homo sapiens
acaatgtaggagtatgacagta

SEQ ID NO: 7093097 - DNA, 22 bp, Homo sapiens
acaatgtaggatatgtacttgt

SEQ ID NO: 7093098 - DNA, 21 bp, Homo sapiens
acaatgtcaaggtcagacatt

SEQ ID NO: 7093099 - DNA, 22 bp, Homo sapiens
acaatgtcacctctcatgtttt

SEQ ID NO: 7093100 - DNA, 22 bp, Homo sapiens
acaatgtctcatattcgtgttc

SEQ ID NO: 7093101 - DNA, 22 bp, Homo sapiens
acaatgtctgctatttggctct

SEQ ID NO: 7093102 - DNA, 23 bp, Homo sapiens
acaatgtctgttcataaaatacc

SEQ ID NO: 7093103 - DNA, 23 bp, Homo sapiens
acaatgtctgttcataaaatacc

SEQ ID NO: 7093104 - DNA, 22 bp, Homo sapiens
acaatgtctttgtctccttcag

SEQ ID NO: 7093105 - DNA, 22 bp, Homo sapiens
acaatgtgacctgacagtgtta

SEQ ID NO: 7093106 - DNA, 22 bp, Homo sapiens
acaatgtgataatttaaagata

SEQ ID NO: 7093107 - DNA, 22 bp, Homo sapiens
acaatgtgtttttatacatttg

SEQ ID NO: 7093108 - DNA, 22 bp, Homo sapiens
acaatgttctacatatacataa

SEQ ID NO: 7093109 - DNA, 22 bp, Homo sapiens
acaatgttctacatatacataa

SEQ ID NO: 7093110 - DNA, 22 bp, Homo sapiens
acacagcaacttgcagtatgga

SEQ ID NO: 7093111 - DNA, 22 bp, Homo sapiens
acacagcaacttgcagtatgga

SEQ ID NO: 7093112 - DNA, 22 bp, Homo sapiens
acacagcaacttgcagtatgga

SEQ ID NO: 7093113 - DNA, 22 bp, Homo sapiens
acacagcaacttgcagtatgga

SEQ ID NO: 7093114 - DNA, 22 bp, Homo sapiens
acacagagcttctcaactggga

SEQ ID NO: 7093115 - DNA, 22 bp, Homo sapiens
acacagagcttctcaactggga

SEQ ID NO: 7093116 - DNA, 22 bp, Homo sapiens
acacagagccagggaatacagt

SEQ ID NO: 7093117 - DNA, 22 bp, Homo sapiens
acacagagctggaactgcttca

SEQ ID NO: 7093118 - DNA, 22 bp, Homo sapiens
acacagagccaaaccatatcac

SEQ ID NO: 7093119 - DNA, 22 bp, Homo sapiens
acacagagccagggaatacagt

SEQ ID NO: 7093120 - DNA, 22 bp, Homo sapiens
acacagagcaaatcatgacaga

SEQ ID NO: 7093121 - DNA, 22 bp, Homo sapiens
acacagagcaaatcatgacaga

SEQ ID NO: 7093122 - DNA, 22 bp, Homo sapiens
acacagagcaaatcatgacaga

SEQ ID NO: 7093123 - DNA, 22 bp, Homo sapiens
acacagagcaaatcatgacaga

SEQ ID NO: 7093124 - DNA, 17 bp, Homo sapiens
acacagagattaacaca

SEQ ID NO: 7093125 - DNA, 20 bp, Homo sapiens
acacagactcagcttggatg

SEQ ID NO: 7093126 - DNA, 22 bp, Homo sapiens
acacagagatgtaaagttaggc

SEQ ID NO: 7093127 - DNA, 22 bp, Homo sapiens
acacagagatgtaaagttaggc

SEQ ID NO: 7093128 - DNA, 17 bp, Homo sapiens
acacagagattaacaca

SEQ ID NO: 7093129 - DNA, 17 bp, Homo sapiens
acacagagattaacaca

SEQ ID NO: 7093130 - DNA, 17 bp, Homo sapiens
acacagacaggcagaca

SEQ ID NO: 7093131 - DNA, 17 bp, Homo sapiens
acacagacaggcagaca

SEQ ID NO: 7093132 - DNA, 17 bp, Homo sapiens
acacagacaggcagaca

SEQ ID NO: 7093133 - DNA, 20 bp, Homo sapiens
acacagactcagcttggatg

SEQ ID NO: 7093134 - DNA, 20 bp, Homo sapiens
acacagactcagcttggatg

SEQ ID NO: 7093135 - DNA, 20 bp, Homo sapiens
acacagactcagcttggatg

SEQ ID NO: 7093136 - DNA, 22 bp, Homo sapiens
acacacatgcctttcctaagta

SEQ ID NO: 7093137 - DNA, 22 bp, Homo sapiens
acaatgttctctgagttgtgtg

SEQ ID NO: 7093138 - DNA, 22 bp, Homo sapiens
acaatgttctctgagttgtgtg

SEQ ID NO: 7093139 - DNA, 22 bp, Homo sapiens
acaatgttctgtctgacttgtc

SEQ ID NO: 7093140 - DNA, 22 bp, Homo sapiens
acaatgttctgtctgacttgtc

SEQ ID NO: 7093141 - DNA, 22 bp, Homo sapiens
acacacatgcctttcctaagta

SEQ ID NO: 7093142 - DNA, 22 bp, Homo sapiens
acacacatgcctttcctaagta

SEQ ID NO: 7093143 - DNA, 22 bp, Homo sapiens
acacacatgcctttcctaagta

SEQ ID NO: 7093144 - DNA, 22 bp, Homo sapiens
acacagctttcagtcattatct

SEQ ID NO: 7093145 - DNA, 22 bp, Homo sapiens
acacagctgtgcagttttttca

SEQ ID NO: 7093146 - DNA, 22 bp, Homo sapiens
acacagctgtgcagttttttca

SEQ ID NO: 7093147 - DNA, 22 bp, Homo sapiens
acacagcttcaaagtctaattc

SEQ ID NO: 7093148 - DNA, 22 bp, Homo sapiens
acacagctagtgagtggcagag

SEQ ID NO: 7093149 - DNA, 22 bp, Homo sapiens
acacagctatggggtaggaaac

SEQ ID NO: 7093150 - DNA, 22 bp, Homo sapiens
acacagctatggggtaggaaac

SEQ ID NO: 7093151 - DNA, 22 bp, Homo sapiens
acacagctcacaacgtgtgcat

SEQ ID NO: 7093152 - DNA, 22 bp, Homo sapiens
acacagccgtgaatctgcttct

SEQ ID NO: 7093153 - DNA, 22 bp, Homo sapiens
acacagctagtgagtggcagag

SEQ ID NO: 7093154 - DNA, 22 bp, Homo sapiens
acacagccgtgaatctgcttct

SEQ ID NO: 7093155 - DNA, 22 bp, Homo sapiens
acacagccgtgaatctgcttct

SEQ ID NO: 7093156 - DNA, 22 bp, Homo sapiens
acacagccccacggtgagcaaa

SEQ ID NO: 7093157 - DNA, 17 bp, Homo sapiens
acacagccaggttctcc

SEQ ID NO: 7093158 - DNA, 17 bp, Homo sapiens
acacagccaggttctcc

SEQ ID NO: 7093159 - DNA, 22 bp, Homo sapiens
aagagtttccatgctctgtgct

SEQ ID NO: 7093160 - DNA, 22 bp, Homo sapiens
aagataacaggaggagtttgta

SEQ ID NO: 7093161 - DNA, 22 bp, Homo sapiens
aagagtttccagttgtggctca

SEQ ID NO: 7093162 - DNA, 22 bp, Homo sapiens
aagataatattcattaactaga

SEQ ID NO: 7093163 - DNA, 22 bp, Homo sapiens
aagataatattcattaactaga

SEQ ID NO: 7093164 - DNA, 22 bp, Homo sapiens
aagataatattcattaactaga

SEQ ID NO: 7093165 - DNA, 22 bp, Homo sapiens
aagataatgtgtctgtctttgc

SEQ ID NO: 7093166 - DNA, 22 bp, Homo sapiens
aagataatgttctagctgtcag

SEQ ID NO: 7093167 - DNA, 22 bp, Homo sapiens
aagataatgttctagctgtcag

SEQ ID NO: 7093168 - DNA, 22 bp, Homo sapiens
aagatacaaatgtcaatattgg

SEQ ID NO: 7093169 - DNA, 22 bp, Homo sapiens
aagatacaaatgtcaatattgg

SEQ ID NO: 7093170 - DNA, 22 bp, Homo sapiens
aagatacaaatgtcaatattgg

SEQ ID NO: 7093171 - DNA, 22 bp, Homo sapiens
aagatacaccaagagcctagta

SEQ ID NO: 7093172 - DNA, 22 bp, Homo sapiens
aagatacaccaagagcctagta

SEQ ID NO: 7093173 - DNA, 22 bp, Homo sapiens
aagatacacggtcaactctcaa

SEQ ID NO: 7093174 - DNA, 22 bp, Homo sapiens
aagatacacggtcaactctcaa

SEQ ID NO: 7093175 - DNA, 22 bp, Homo sapiens
aagatacacggtcaactctcaa

SEQ ID NO: 7093176 - DNA, 22 bp, Homo sapiens
aagatacacggtcaactctcaa

SEQ ID NO: 7093177 - DNA, 22 bp, Homo sapiens
aagatacacggtcaactctcaa

SEQ ID NO: 7093178 - DNA, 22 bp, Homo sapiens
aaagggagcatggctgcaggga

SEQ ID NO: 7093179 - DNA, 22 bp, Homo sapiens
aaagggagcatggctgcaggga

SEQ ID NO: 7093180 - DNA, 22 bp, Homo sapiens
aaagggagcatggctgcaggga

SEQ ID NO: 7093181 - DNA, 22 bp, Homo sapiens
aaagggagcatggctgcaggga

SEQ ID NO: 7093182 - DNA, 22 bp, Homo sapiens
aaagggagcatggctgcaggga

SEQ ID NO: 7093183 - DNA, 22 bp, Homo sapiens
aaagggagcatggctgcaggga

SEQ ID NO: 7093184 - DNA, 22 bp, Homo sapiens
aaagggaggggcgataagccgg

SEQ ID NO: 7093185 - DNA, 22 bp, Homo sapiens
aaagggaggggcgataagccgg

SEQ ID NO: 7093186 - DNA, 22 bp, Homo sapiens
aaagggaggggcgataagccgg

SEQ ID NO: 7093187 - DNA, 22 bp, Homo sapiens
aaagtcacatataacaagggca

SEQ ID NO: 7093188 - DNA, 22 bp, Homo sapiens
aaagggaatgtgtaggacatgt

SEQ ID NO: 7093189 - DNA, 22 bp, Homo sapiens
aaagggaatgtgtaggacatgt

SEQ ID NO: 7093190 - DNA, 22 bp, Homo sapiens
aaaggcttttggtatataggag

SEQ ID NO: 7093191 - DNA, 22 bp, Homo sapiens
aaaggctttaaagaaccagaac

SEQ ID NO: 7093192 - DNA, 22 bp, Homo sapiens
aaagggaactctaattatcttc

SEQ ID NO: 7093193 - DNA, 22 bp, Homo sapiens
aaaggctggggactgaggaagg

SEQ ID NO: 7093194 - DNA, 22 bp, Homo sapiens
aaaggctggggactgaggaagg

SEQ ID NO: 7093195 - DNA, 22 bp, Homo sapiens
aaaggcttaacagaagaccttt

SEQ ID NO: 7093196 - DNA, 22 bp, Homo sapiens
aaaggctggattcagagaggtg

SEQ ID NO: 7093197 - DNA, 22 bp, Homo sapiens
aaaggctggggactgaggaagg

SEQ ID NO: 7093198 - DNA, 22 bp, Homo sapiens
aaaggctggattcagagaggtg

SEQ ID NO: 7093199 - DNA, 22 bp, Homo sapiens
aaaggcttaatgttgttgtaat

SEQ ID NO: 7093200 - DNA, 22 bp, Homo sapiens
aaaggcttagacacagaactgt

SEQ ID NO: 7093201 - DNA, 22 bp, Homo sapiens
aaaggcttagacacagaactgt

SEQ ID NO: 7093202 - DNA, 22 bp, Homo sapiens
aaaggcttctttgctccatgtc

SEQ ID NO: 7093203 - DNA, 22 bp, Homo sapiens
aaaggcttgtttgaggactggt

SEQ ID NO: 7093204 - DNA, 22 bp, Homo sapiens
aaaggcttgtttgaggactggt

SEQ ID NO: 7093205 - DNA, 22 bp, Homo sapiens
aaaggctttaaaatgtacatat

SEQ ID NO: 7093206 - DNA, 22 bp, Homo sapiens
aaaggctttaaaatgtacatat

SEQ ID NO: 7093207 - DNA, 22 bp, Homo sapiens
aaaggctctattgttttcatat

SEQ ID NO: 7093208 - DNA, 18 bp, Homo sapiens
aaaggctgaatatagaag

SEQ ID NO: 7093209 - DNA, 18 bp, Homo sapiens
aaaggctgaatatagaag

SEQ ID NO: 7093210 - DNA, 22 bp, Homo sapiens
aaaggctgcaaagctgtaagtg

SEQ ID NO: 7093211 - DNA, 22 bp, Homo sapiens
aaaggctgcaaagctgtaagtg

SEQ ID NO: 7093212 - DNA, 22 bp, Homo sapiens
aaaggctgcaaagctgtaagtg

SEQ ID NO: 7093213 - DNA, 22 bp, Homo sapiens
aaaggctgcaaagctgtaagtg

SEQ ID NO: 7093214 - DNA, 22 bp, Homo sapiens
aaaggctgccaggtaaaatatt

SEQ ID NO: 7093215 - DNA, 22 bp, Homo sapiens
aaaggctgcctcagtgccatga

SEQ ID NO: 7093216 - DNA, 22 bp, Homo sapiens
aaaggctgcctcagtgccatga

SEQ ID NO: 7093217 - DNA, 22 bp, Homo sapiens
aaaggctggaaactgaagataa

SEQ ID NO: 7093218 - DNA, 22 bp, Homo sapiens
aaaggctggaaactgaagataa

SEQ ID NO: 7093219 - DNA, 22 bp, Homo sapiens
aaaggctggaaactgaagataa

SEQ ID NO: 7093220 - DNA, 22 bp, Homo sapiens
aaaggctatgagatagaagata

SEQ ID NO: 7093221 - DNA, 22 bp, Homo sapiens
aaaggctattcagggacttgcc

SEQ ID NO: 7093222 - DNA, 22 bp, Homo sapiens
aaaggctattcagggacttgcc

SEQ ID NO: 7093223 - DNA, 22 bp, Homo sapiens
aaaggctattcagggacttgcc

SEQ ID NO: 7093224 - DNA, 22 bp, Homo sapiens
aaaggctatttttagatgtttg

SEQ ID NO: 7093225 - DNA, 22 bp, Homo sapiens
aaaggctcaacagctgtacttt

SEQ ID NO: 7093226 - DNA, 22 bp, Homo sapiens
aaaggctcatacagaaaataca

SEQ ID NO: 7093227 - DNA, 23 bp, Homo sapiens
aaaggctatcaaagttttgctga

SEQ ID NO: 7093228 - DNA, 22 bp, Homo sapiens
aaaggctatgagatagaagata

SEQ ID NO: 7093229 - DNA, 22 bp, Homo sapiens
aacatgcaaagctatgatgtat

SEQ ID NO: 7093230 - DNA, 22 bp, Homo sapiens
aacatgatttcatgcatttaga

SEQ ID NO: 7093231 - DNA, 22 bp, Homo sapiens
aacatgcaaagctatgatgtat

SEQ ID NO: 7093232 - DNA, 19 bp, Homo sapiens
aacatgacagccactctgg

SEQ ID NO: 7093233 - DNA, 22 bp, Homo sapiens
aacatgagcattcttgtgcttg

SEQ ID NO: 7093234 - DNA, 22 bp, Homo sapiens
aacatgagtctgtgtgaaagtg

SEQ ID NO: 7093235 - DNA, 22 bp, Homo sapiens
aacatgaggcactgagtttcat

SEQ ID NO: 7093236 - DNA, 21 bp, Homo sapiens
aacatgatatgtgtatggatt

SEQ ID NO: 7093237 - DNA, 22 bp, Homo sapiens
aacatgatgacaaaggtatatt

SEQ ID NO: 7093238 - DNA, 22 bp, Homo sapiens
aacatgatgacaaaggtatatt

SEQ ID NO: 7093239 - DNA, 22 bp, Homo sapiens
aacatgatgacaaaggtatatt

SEQ ID NO: 7093240 - DNA, 22 bp, Homo sapiens
aacttctttgagctccagtttt

SEQ ID NO: 7093241 - DNA, 22 bp, Homo sapiens
aacttgaaaacctcatgaattg

SEQ ID NO: 7093242 - DNA, 22 bp, Homo sapiens
aacttgaaccacagaagctgcc

SEQ ID NO: 7093243 - DNA, 22 bp, Homo sapiens
aacttgaagttgcagaaagtac

SEQ ID NO: 7093244 - DNA, 22 bp, Homo sapiens
aacttgaatgagaacttttgcc

SEQ ID NO: 7093245 - DNA, 22 bp, Homo sapiens
aacttctctgaagtgacctgtt

SEQ ID NO: 7093246 - DNA, 22 bp, Homo sapiens
aacttctcagcctgcacctggc

SEQ ID NO: 7093247 - DNA, 22 bp, Homo sapiens
aacttctcatacaaagaacaag

SEQ ID NO: 7093248 - DNA, 22 bp, Homo sapiens
aacttctcaactagcttagagt

SEQ ID NO: 7093249 - DNA, 22 bp, Homo sapiens
aacttctggatgtttcaaatgt

SEQ ID NO: 7093250 - DNA, 22 bp, Homo sapiens
aacttctggatgtttcaaatgt

SEQ ID NO: 7093251 - DNA, 22 bp, Homo sapiens
aaagttctgggggagaagaacg

SEQ ID NO: 7093252 - DNA, 22 bp, Homo sapiens
aaagttctgggggagaagaacg

SEQ ID NO: 7093253 - DNA, 22 bp, Homo sapiens
aaagttctggagaaaataatga

SEQ ID NO: 7093254 - DNA, 22 bp, Homo sapiens
aaagttctttctcttatttggt

SEQ ID NO: 7093255 - DNA, 22 bp, Homo sapiens
aaagttcttcatttttattgga

SEQ ID NO: 7093256 - DNA, 22 bp, Homo sapiens
aaagttctgggggtgtttctgg

SEQ ID NO: 7093257 - DNA, 22 bp, Homo sapiens
aaagttctgggggagaagaacg

SEQ ID NO: 7093258 - DNA, 22 bp, Homo sapiens
aaagttacacgactatttatgt

SEQ ID NO: 7093259 - DNA, 22 bp, Homo sapiens
aaagttctcctggattgtgctg

SEQ ID NO: 7093260 - DNA, 22 bp, Homo sapiens
aaagtcacgctgatgggaaatg

SEQ ID NO: 7093261 - DNA, 22 bp, Homo sapiens
aaagtcacgctgatgggaaatg

SEQ ID NO: 7093262 - DNA, 22 bp, Homo sapiens
aaagtccagagggcacactgaa

SEQ ID NO: 7093263 - DNA, 22 bp, Homo sapiens
aaagtccagagggcacactgaa

SEQ ID NO: 7093264 - DNA, 22 bp, Homo sapiens
aaagtcacttacagctcttttg

SEQ ID NO: 7093265 - DNA, 22 bp, Homo sapiens
aaagtccagggaaagagcgtct

SEQ ID NO: 7093266 - DNA, 22 bp, Homo sapiens
aaagtccagggaaagagcgtct

SEQ ID NO: 7093267 - DNA, 22 bp, Homo sapiens
aaagtccaggggctggaggcgg

SEQ ID NO: 7093268 - DNA, 22 bp, Homo sapiens
aaagtccaggggctggaggcgg

SEQ ID NO: 7093269 - DNA, 20 bp, Homo sapiens
aaagtcccttagtgggagca

SEQ ID NO: 7093270 - DNA, 22 bp, Homo sapiens
aaagtcctagcgatccacagaa

SEQ ID NO: 7093271 - DNA, 22 bp, Homo sapiens
aaagtcctagcgatccacagaa

SEQ ID NO: 7093272 - DNA, 22 bp, Homo sapiens
aaagtcctagcgatccacagaa

SEQ ID NO: 7093273 - DNA, 22 bp, Homo sapiens
aaagtcctagcgatccacagaa

SEQ ID NO: 7093274 - DNA, 22 bp, Homo sapiens
aaagtcctgactgcaggggatg

SEQ ID NO: 7093275 - DNA, 22 bp, Homo sapiens
aaagtcctgttaactgttaaca

SEQ ID NO: 7093276 - DNA, 22 bp, Homo sapiens
aaagtcctgttaactgttaaca

SEQ ID NO: 7093277 - DNA, 22 bp, Homo sapiens
aaagtcctgtttgaaggacctg

SEQ ID NO: 7093278 - DNA, 22 bp, Homo sapiens
aaagtccttgcagtttcctctt

SEQ ID NO: 7093279 - DNA, 22 bp, Homo sapiens
aaagtcctttttgccatgcaag

SEQ ID NO: 7093280 - DNA, 22 bp, Homo sapiens
aaagtcctttttgccatgcaag

SEQ ID NO: 7093281 - DNA, 20 bp, Homo sapiens
aaagtctcaacagctgagaa

SEQ ID NO: 7093282 - DNA, 20 bp, Homo sapiens
aaagtctcaacagctgagaa

SEQ ID NO: 7093283 - DNA, 20 bp, Homo sapiens
aaagtctcaacagctgagaa

SEQ ID NO: 7093284 - DNA, 22 bp, Homo sapiens
aaagtctcaggcaaaccaggac

SEQ ID NO: 7093285 - DNA, 22 bp, Homo sapiens
aaagtcttaatgtaagtttagt

SEQ ID NO: 7093286 - DNA, 22 bp, Homo sapiens
aaagtcttaatgtaagtttagt

SEQ ID NO: 7093287 - DNA, 20 bp, Homo sapiens
aaagtcttatggttaatttt

SEQ ID NO: 7093288 - DNA, 20 bp, Homo sapiens
aaagtcttatggttaatttt

SEQ ID NO: 7093289 - DNA, 20 bp, Homo sapiens
aaagtcttatggttaatttt

SEQ ID NO: 7093290 - DNA, 22 bp, Homo sapiens
aaagtcttcacggcactagtgt

SEQ ID NO: 7093291 - DNA, 22 bp, Homo sapiens
aaagtcttcacggcactagtgt

SEQ ID NO: 7093292 - DNA, 22 bp, Homo sapiens
aaagtcttcacggcactagtgt

SEQ ID NO: 7093293 - DNA, 22 bp, Homo sapiens
aaagtcttgcattgatcttgaa

SEQ ID NO: 7093294 - DNA, 22 bp, Homo sapiens
aaagtcttgcattgatcttgaa

SEQ ID NO: 7093295 - DNA, 22 bp, Homo sapiens
aaagtcttgttacgttccattg

SEQ ID NO: 7093296 - DNA, 22 bp, Homo sapiens
aaagtctttattttgtatcttt

SEQ ID NO: 7093297 - DNA, 22 bp, Homo sapiens
aaagtctttattttgtatcttt

SEQ ID NO: 7093298 - DNA, 22 bp, Homo sapiens
aaagtctttctcatagtcacgc

SEQ ID NO: 7093299 - DNA, 22 bp, Homo sapiens
aaagtctttctcattggccatg

SEQ ID NO: 7093300 - DNA, 22 bp, Homo sapiens
aacttccaccaaatagtatata

SEQ ID NO: 7093301 - DNA, 22 bp, Homo sapiens
aacttccaggccttgaattatt

SEQ ID NO: 7093302 - DNA, 22 bp, Homo sapiens
aacttccttctagttcatatgt

SEQ ID NO: 7093303 - DNA, 22 bp, Homo sapiens
aacttccttctagttcatatgt

SEQ ID NO: 7093304 - DNA, 22 bp, Homo sapiens
aacttccttctagttcatatgt

SEQ ID NO: 7093305 - DNA, 22 bp, Homo sapiens
aacttccttgggtatgaaaaca

SEQ ID NO: 7093306 - DNA, 22 bp, Homo sapiens
aaattgctgaccaagtatattc

SEQ ID NO: 7093307 - DNA, 22 bp, Homo sapiens
aaattgcttataaagatgaatg

SEQ ID NO: 7093308 - DNA, 22 bp, Homo sapiens
aaattccattttgtgactattc

SEQ ID NO: 7093309 - DNA, 22 bp, Homo sapiens
aaattccattttgtgactattc

SEQ ID NO: 7093310 - DNA, 22 bp, Homo sapiens
aaattccattatgataatttcg

SEQ ID NO: 7093311 - DNA, 22 bp, Homo sapiens
aaattccagttcttttacctgc

SEQ ID NO: 7093312 - DNA, 22 bp, Homo sapiens
aaattccaccagaatcagtaat

SEQ ID NO: 7093313 - DNA, 22 bp, Homo sapiens
aaattccagaaactcagtatat

SEQ ID NO: 7093314 - DNA, 22 bp, Homo sapiens
aaattccaccagaatcagtaat

SEQ ID NO: 7093315 - DNA, 22 bp, Homo sapiens
aaattcatttttcttagtgtgc

SEQ ID NO: 7093316 - DNA, 22 bp, Homo sapiens
aaattcagttttaataatcact

SEQ ID NO: 7093317 - DNA, 22 bp, Homo sapiens
aaattcatatgttgaaatgcta

SEQ ID NO: 7093318 - DNA, 22 bp, Homo sapiens
aaattcatatgttgaaatgcta

SEQ ID NO: 7093319 - DNA, 22 bp, Homo sapiens
aaattcatatgttgaaatgcta

SEQ ID NO: 7093320 - DNA, 22 bp, Homo sapiens
aaattcatatgttgaaatgcta

SEQ ID NO: 7093321 - DNA, 22 bp, Homo sapiens
aaattcatttttcttagtgtgc

SEQ ID NO: 7093322 - DNA, 22 bp, Homo sapiens
aaattcatttttcttagtgtgc

SEQ ID NO: 7093323 - DNA, 22 bp, Homo sapiens
aaattcagttcctcagccacat

SEQ ID NO: 7093324 - DNA, 22 bp, Homo sapiens
aaattcagcatcctgcactgga

SEQ ID NO: 7093325 - DNA, 23 bp, Homo sapiens
aaattcagtccttcaactctgag

SEQ ID NO: 7093326 - DNA, 23 bp, Homo sapiens
aaattcagtccttcaactctgag

SEQ ID NO: 7093327 - DNA, 22 bp, Homo sapiens
aaagacatgacacattggagag

SEQ ID NO: 7093328 - DNA, 22 bp, Homo sapiens
aaagacatgacacattggagag

SEQ ID NO: 7093329 - DNA, 22 bp, Homo sapiens
aaattagatatgtgtgagactc

SEQ ID NO: 7093330 - DNA, 22 bp, Homo sapiens
aaattcagatggctttcttttc

SEQ ID NO: 7093331 - DNA, 22 bp, Homo sapiens
aaattgtaggatcacatgacct

SEQ ID NO: 7093332 - DNA, 22 bp, Homo sapiens
aaattgtaggatcacatgacct

SEQ ID NO: 7093333 - DNA, 22 bp, Homo sapiens
aaattgtaatgacttcacttga

SEQ ID NO: 7093334 - DNA, 22 bp, Homo sapiens
aaattgtaatgacttcacttga

SEQ ID NO: 7093335 - DNA, 22 bp, Homo sapiens
aaattggattgggagaatgtga

SEQ ID NO: 7093336 - DNA, 22 bp, Homo sapiens
aaattggattttaaactgttgg

SEQ ID NO: 7093337 - DNA, 22 bp, Homo sapiens
aaagcagcacatggatatcagt

SEQ ID NO: 7093338 - DNA, 22 bp, Homo sapiens
aaagcagcaacgtgcatataac

SEQ ID NO: 7093339 - DNA, 22 bp, Homo sapiens
aaagcagcaagtatttgttact

SEQ ID NO: 7093340 - DNA, 22 bp, Homo sapiens
aaagcagcaagtatttgttact

SEQ ID NO: 7093341 - DNA, 22 bp, Homo sapiens
aaagcagcaagtatttgttact

SEQ ID NO: 7093342 - DNA, 22 bp, Homo sapiens
aaattgtcagaattcagaaagt

SEQ ID NO: 7093343 - DNA, 22 bp, Homo sapiens
aaattgtataatgttccagctg

SEQ ID NO: 7093344 - DNA, 22 bp, Homo sapiens
aaattgtataatgttccagctg

SEQ ID NO: 7093345 - DNA, 22 bp, Homo sapiens
aaattgtatattccatttgtat

SEQ ID NO: 7093346 - DNA, 22 bp, Homo sapiens
aaagcaggttatgaccatggcc

SEQ ID NO: 7093347 - DNA, 22 bp, Homo sapiens
aaagcaggttatgaccatggcc

SEQ ID NO: 7093348 - DNA, 22 bp, Homo sapiens
aaagcaggttatgaccatggcc

SEQ ID NO: 7093349 - DNA, 22 bp, Homo sapiens
aaagcaggttgcaattacagtg

SEQ ID NO: 7093350 - DNA, 22 bp, Homo sapiens
aaagcagtagttttcaaatagt

SEQ ID NO: 7093351 - DNA, 22 bp, Homo sapiens
aaagcagtagttttcaaatagt

SEQ ID NO: 7093352 - DNA, 22 bp, Homo sapiens
aaagcagtataagtaacggaag

SEQ ID NO: 7093353 - DNA, 22 bp, Homo sapiens
aaagcagtataagtaacggaag

SEQ ID NO: 7093354 - DNA, 22 bp, Homo sapiens
aaagcagtatagtggaagggct

SEQ ID NO: 7093355 - DNA, 22 bp, Homo sapiens
aaagcagtatattggtagttgt

SEQ ID NO: 7093356 - DNA, 22 bp, Homo sapiens
aaagcagtatattggtagttgt

SEQ ID NO: 7093357 - DNA, 22 bp, Homo sapiens
aaagcagtatgaaaggcaataa

SEQ ID NO: 7093358 - DNA, 20 bp, Homo sapiens
aaagcagtatgcaagtagag

SEQ ID NO: 7093359 - DNA, 20 bp, Homo sapiens
aaagcagtatgcaagtagag

SEQ ID NO: 7093360 - DNA, 22 bp, Homo sapiens
aaagcagtcactccagtgtgat

SEQ ID NO: 7093361 - DNA, 22 bp, Homo sapiens
aaagcagtccttcccttaaggt

SEQ ID NO: 7093362 - DNA, 22 bp, Homo sapiens
aaagcagtccttcccttaaggt

SEQ ID NO: 7093363 - DNA, 22 bp, Homo sapiens
aaagcagtctcagacttaagca

SEQ ID NO: 7093364 - DNA, 22 bp, Homo sapiens
aaagcagtctcagacttaagca

SEQ ID NO: 7093365 - DNA, 22 bp, Homo sapiens
aaagcagtctgttttaacctga

SEQ ID NO: 7093366 - DNA, 22 bp, Homo sapiens
aaagcagtctgttttaacctga

SEQ ID NO: 7093367 - DNA, 22 bp, Homo sapiens
aaagcagtgcaccttaattgat

SEQ ID NO: 7093368 - DNA, 22 bp, Homo sapiens
aaagcagtgcaccttaattgat

SEQ ID NO: 7093369 - DNA, 23 bp, Homo sapiens
aaagccaagtcagtctactggaa

SEQ ID NO: 7093370 - DNA, 23 bp, Homo sapiens
aaagccaagtcagtctactggaa

SEQ ID NO: 7093371 - DNA, 22 bp, Homo sapiens
aaaggaagtgccactcttcttc

SEQ ID NO: 7093372 - DNA, 22 bp, Homo sapiens
aaagccaagctgggaaggcagg

SEQ ID NO: 7093373 - DNA, 22 bp, Homo sapiens
aaagccaagctgggaaggcagg

SEQ ID NO: 7093374 - DNA, 22 bp, Homo sapiens
aaagccaaatgaaagatggttc

SEQ ID NO: 7093375 - DNA, 22 bp, Homo sapiens
aaagccaaatgaaagatggttc

SEQ ID NO: 7093376 - DNA, 22 bp, Homo sapiens
aaagccaaatgaaagatggttc

SEQ ID NO: 7093377 - DNA, 22 bp, Homo sapiens
aaagcattactagactggattt

SEQ ID NO: 7093378 - DNA, 20 bp, Homo sapiens
aaagcatttacttgtgattg

SEQ ID NO: 7093379 - DNA, 22 bp, Homo sapiens
aaagcatttcatgtctagaaag

SEQ ID NO: 7093380 - DNA, 22 bp, Homo sapiens
aaagcatttcatgtctagaaag

SEQ ID NO: 7093381 - DNA, 22 bp, Homo sapiens
aaagcatttcatgtctagaaag

SEQ ID NO: 7093382 - DNA, 22 bp, Homo sapiens
aaagcatgtgaatagaatatgg

SEQ ID NO: 7093383 - DNA, 22 bp, Homo sapiens
aaagcatggcatgaagaacatg

SEQ ID NO: 7093384 - DNA, 22 bp, Homo sapiens
aaagcatggttaaagacagtgg

SEQ ID NO: 7093385 - DNA, 22 bp, Homo sapiens
aaagcatgttctgggaatagta

SEQ ID NO: 7093386 - DNA, 22 bp, Homo sapiens
aaagcatgttgggtccctcttt

SEQ ID NO: 7093387 - DNA, 22 bp, Homo sapiens
aaagcatgttgggtccctcttt

SEQ ID NO: 7093388 - DNA, 22 bp, Homo sapiens
aaagcatggcatgaagaacatg

SEQ ID NO: 7093389 - DNA, 22 bp, Homo sapiens
aaagcatggcatgaagaacatg

SEQ ID NO: 7093390 - DNA, 22 bp, Homo sapiens
aaagcatgattagatagatgat

SEQ ID NO: 7093391 - DNA, 22 bp, Homo sapiens
aaagcatgctactttatatagg

SEQ ID NO: 7093392 - DNA, 22 bp, Homo sapiens
aaagcatgctactttatatagg

SEQ ID NO: 7093393 - DNA, 22 bp, Homo sapiens
aaagcatgactcaagaattact

SEQ ID NO: 7093394 - DNA, 22 bp, Homo sapiens
aaagcatcagatctgacacttc

SEQ ID NO: 7093395 - DNA, 21 bp, Homo sapiens
aaagcatcacgaacatttggg

SEQ ID NO: 7093396 - DNA, 22 bp, Homo sapiens
aaagcagtgctgtgagaacact

SEQ ID NO: 7093397 - DNA, 19 bp, Homo sapiens
aaagcagtgcatcctcttt

SEQ ID NO: 7093398 - DNA, 22 bp, Homo sapiens
aaagcagtgctgtgagaacact

SEQ ID NO: 7093399 - DNA, 22 bp, Homo sapiens
aaagcagtgctgtgagaacact

SEQ ID NO: 7093400 - DNA, 22 bp, Homo sapiens
aaagcagtgctgtgagaacact

SEQ ID NO: 7093401 - DNA, 21 bp, Homo sapiens
aaagcagttcttcctgcctct

SEQ ID NO: 7093402 - DNA, 22 bp, Homo sapiens
aaagcatagaattagagttagg

SEQ ID NO: 7093403 - DNA, 22 bp, Homo sapiens
aaagcatattaggactgaatta

SEQ ID NO: 7093404 - DNA, 22 bp, Homo sapiens
aaaggcactggatagctgggga

SEQ ID NO: 7093405 - DNA, 22 bp, Homo sapiens
aaaggcagagtgctcagctggc

SEQ ID NO: 7093406 - DNA, 22 bp, Homo sapiens
aaaggcactgatcttatccagt

SEQ ID NO: 7093407 - DNA, 20 bp, Homo sapiens
aaaggcacagcaacagagct

SEQ ID NO: 7093408 - DNA, 22 bp, Homo sapiens
aaaggcagagtgctcagctggc

SEQ ID NO: 7093409 - DNA, 22 bp, Homo sapiens
aacatgaaacccaaacagaata

SEQ ID NO: 7093410 - DNA, 22 bp, Homo sapiens
aacatgaaagttgctaagtgca

SEQ ID NO: 7093411 - DNA, 22 bp, Homo sapiens
aacatgaaagttgctaagtgca

SEQ ID NO: 7093412 - DNA, 22 bp, Homo sapiens
aacatgaaagttgctaagtgca

SEQ ID NO: 7093413 - DNA, 22 bp, Homo sapiens
aacatgaaagttgctaagtgca

SEQ ID NO: 7093414 - DNA, 22 bp, Homo sapiens
aacatgaaggtaggatggtttt

SEQ ID NO: 7093415 - DNA, 22 bp, Homo sapiens
aacatgaaggtaggatggtttt

SEQ ID NO: 7093416 - DNA, 22 bp, Homo sapiens
aacatgaaggtaggatggtttt

SEQ ID NO: 7093417 - DNA, 22 bp, Homo sapiens
aacatgaagttttctatagtga

SEQ ID NO: 7093418 - DNA, 22 bp, Homo sapiens
aaaggcacacactccttgttat

SEQ ID NO: 7093419 - DNA, 22 bp, Homo sapiens
aaaggcacaaattcagcatttt

SEQ ID NO: 7093420 - DNA, 22 bp, Homo sapiens
aaaggattagagataccatgcc

SEQ ID NO: 7093421 - DNA, 22 bp, Homo sapiens
aaaggcaaaattcttagcagga

SEQ ID NO: 7093422 - DNA, 22 bp, Homo sapiens
aaaggcaaaattcttagcagga

SEQ ID NO: 7093423 - DNA, 22 bp, Homo sapiens
aaaggattaaataaatgtgctg

SEQ ID NO: 7093424 - DNA, 22 bp, Homo sapiens
aaaggagttactcataaagctt

SEQ ID NO: 7093425 - DNA, 22 bp, Homo sapiens
aaaggagttactcataaagctt

SEQ ID NO: 7093426 - DNA, 22 bp, Homo sapiens
aaaggaatattcaaaacagtca

SEQ ID NO: 7093427 - DNA, 22 bp, Homo sapiens
aaaggaatattcaaaacagtca

SEQ ID NO: 7093428 - DNA, 22 bp, Homo sapiens
aaatgaggttaatacagtgctt

SEQ ID NO: 7093429 - DNA, 22 bp, Homo sapiens
aaatgaggttaatacagtgctt

SEQ ID NO: 7093430 - DNA, 22 bp, Homo sapiens
aaatgagtagcgatgcacatta

SEQ ID NO: 7093431 - DNA, 22 bp, Homo sapiens
aaatgacattaggatcctgcat

SEQ ID NO: 7093432 - DNA, 22 bp, Homo sapiens
aaatgatcatgtaatttcagaa

SEQ ID NO: 7093433 - DNA, 22 bp, Homo sapiens
aaatgatagtatggaactagga

SEQ ID NO: 7093434 - DNA, 22 bp, Homo sapiens
aaatgatagtatggaactagga

SEQ ID NO: 7093435 - DNA, 22 bp, Homo sapiens
aaatgatcatgtaatttcagaa

SEQ ID NO: 7093436 - DNA, 22 bp, Homo sapiens
aaatgatagtatggaactagga

SEQ ID NO: 7093437 - DNA, 22 bp, Homo sapiens
aaatgataccgaaactgcccgg

SEQ ID NO: 7093438 - DNA, 22 bp, Homo sapiens
aaatgataccgaaactgcccgg

SEQ ID NO: 7093439 - DNA, 22 bp, Homo sapiens
aaatgagtttcctcaatgtcct

SEQ ID NO: 7093440 - DNA, 22 bp, Homo sapiens
aaatgagtttgcctctagatag

SEQ ID NO: 7093441 - DNA, 22 bp, Homo sapiens
aaatgagtagcgatgcacatta

SEQ ID NO: 7093442 - DNA, 22 bp, Homo sapiens
aaatgagtagcgatgcacatta

SEQ ID NO: 7093443 - DNA, 22 bp, Homo sapiens
aaatcagaggtcagctgtacca

SEQ ID NO: 7093444 - DNA, 22 bp, Homo sapiens
aaatcagagaatatatttagaa

SEQ ID NO: 7093445 - DNA, 22 bp, Homo sapiens
aaatcagacacagtgaaagtta

SEQ ID NO: 7093446 - DNA, 22 bp, Homo sapiens
aaatcagacttgaattttcatc

SEQ ID NO: 7093447 - DNA, 22 bp, Homo sapiens
aaatcagacttgaattttcatc

SEQ ID NO: 7093448 - DNA, 22 bp, Homo sapiens
aaatcagagtagaattgagcca

SEQ ID NO: 7093449 - DNA, 22 bp, Homo sapiens
aaatcagagtctgattttaagg

SEQ ID NO: 7093450 - DNA, 22 bp, Homo sapiens
aaatcagagtggttggtcatcc

SEQ ID NO: 7093451 - DNA, 22 bp, Homo sapiens
aaatgaaatgagtgcctggagg

SEQ ID NO: 7093452 - DNA, 22 bp, Homo sapiens
aaatgaacagttgcattctctg

SEQ ID NO: 7093453 - DNA, 22 bp, Homo sapiens
aaatgaacagttgcattctctg

SEQ ID NO: 7093454 - DNA, 22 bp, Homo sapiens
aaatgaacagttgcattctctg

SEQ ID NO: 7093455 - DNA, 22 bp, Homo sapiens
aaatgaacatcaagaatagcct

SEQ ID NO: 7093456 - DNA, 22 bp, Homo sapiens
aaatcacttaaatggcttattt

SEQ ID NO: 7093457 - DNA, 22 bp, Homo sapiens
aaatcagaaaatatggagagga

SEQ ID NO: 7093458 - DNA, 19 bp, Homo sapiens
aaatcagaatctgcatttt

SEQ ID NO: 7093459 - DNA, 22 bp, Homo sapiens
aaatcactgattaaagttagaa

SEQ ID NO: 7093460 - DNA, 17 bp, Homo sapiens
aaatcactgtcagttca

SEQ ID NO: 7093461 - DNA, 22 bp, Homo sapiens
aaatcactaagttatagtgtgg

SEQ ID NO: 7093462 - DNA, 22 bp, Homo sapiens
aaatcacagggtctctaagtat

SEQ ID NO: 7093463 - DNA, 22 bp, Homo sapiens
aaatcaaggagggattatattt

SEQ ID NO: 7093464 - DNA, 22 bp, Homo sapiens
aaatcaaggagggattatattt

SEQ ID NO: 7093465 - DNA, 22 bp, Homo sapiens
aaatcacagggtctctaagtat

SEQ ID NO: 7093466 - DNA, 22 bp, Homo sapiens
aaatcacagggtctctaagtat

SEQ ID NO: 7093467 - DNA, 22 bp, Homo sapiens
aaatcacagggtctctaagtat

SEQ ID NO: 7093468 - DNA, 23 bp, Homo sapiens
aaatattcttttttagtaagtgc

SEQ ID NO: 7093469 - DNA, 23 bp, Homo sapiens
aaatattcttttttagtaagtgc

SEQ ID NO: 7093470 - DNA, 22 bp, Homo sapiens
aaatattggtaggatgcttgtt

SEQ ID NO: 7093471 - DNA, 22 bp, Homo sapiens
aaatattggtaggatgcttgtt

SEQ ID NO: 7093472 - DNA, 22 bp, Homo sapiens
aaatatttgtctgaggcggttg

SEQ ID NO: 7093473 - DNA, 22 bp, Homo sapiens
aaatcaaaagacatgtgtttta

SEQ ID NO: 7093474 - DNA, 22 bp, Homo sapiens
aaatcaaggagggattatattt

SEQ ID NO: 7093475 - DNA, 22 bp, Homo sapiens
aaatgcttgcaacatcccaggt

SEQ ID NO: 7093476 - DNA, 22 bp, Homo sapiens
aaatgcttgtaaattttccatg

SEQ ID NO: 7093477 - DNA, 20 bp, Homo sapiens
aaatgcttttgacacatatt

SEQ ID NO: 7093478 - DNA, 20 bp, Homo sapiens
aaatgcttttgacacatatt

SEQ ID NO: 7093479 - DNA, 19 bp, Homo sapiens
aaatggaaaactttgggaa

SEQ ID NO: 7093480 - DNA, 22 bp, Homo sapiens
aaatggaaaatgctgttttggt

SEQ ID NO: 7093481 - DNA, 22 bp, Homo sapiens
aaatggaaaatgctgttttggt

SEQ ID NO: 7093482 - DNA, 22 bp, Homo sapiens
aaatggaactgggctactaggt

SEQ ID NO: 7093483 - DNA, 22 bp, Homo sapiens
aaatggaactgggctactaggt

SEQ ID NO: 7093484 - DNA, 22 bp, Homo sapiens
aaatggaactgggctactaggt

SEQ ID NO: 7093485 - DNA, 22 bp, Homo sapiens
aaatggaactgggctactaggt

SEQ ID NO: 7093486 - DNA, 22 bp, Homo sapiens
aaatggaactgttgtgcatttg

SEQ ID NO: 7093487 - DNA, 22 bp, Homo sapiens
aaatggaactgttgtgcatttg

SEQ ID NO: 7093488 - DNA, 22 bp, Homo sapiens
aaatgccaggattattagaggc

SEQ ID NO: 7093489 - DNA, 22 bp, Homo sapiens
aaatgctgagtgtttagagatc

SEQ ID NO: 7093490 - DNA, 22 bp, Homo sapiens
aaatgctgcagctagtgtgttt

SEQ ID NO: 7093491 - DNA, 20 bp, Homo sapiens
aaatgctgtaatgtttggga

SEQ ID NO: 7093492 - DNA, 20 bp, Homo sapiens
aaatgctgtgctgttgccat

SEQ ID NO: 7093493 - DNA, 22 bp, Homo sapiens
aaatgctgtgttttaacataga

SEQ ID NO: 7093494 - DNA, 22 bp, Homo sapiens
aaatgctgttcttttaggtaga

SEQ ID NO: 7093495 - DNA, 22 bp, Homo sapiens
aaatgcttagaggtgttcaaat

SEQ ID NO: 7093496 - DNA, 22 bp, Homo sapiens
aaatgcttattagtgtcacaaa

SEQ ID NO: 7093497 - DNA, 22 bp, Homo sapiens
aaatgcttattagtgtcacaaa

SEQ ID NO: 7093498 - DNA, 22 bp, Homo sapiens
aaatgcttattagtgtcacaaa

SEQ ID NO: 7093499 - DNA, 22 bp, Homo sapiens
aaatgcaaggccatgtgaagga

SEQ ID NO: 7093500 - DNA, 22 bp, Homo sapiens
aaatgcaaggccatgtgaagga

SEQ ID NO: 7093501 - DNA, 22 bp, Homo sapiens
aaatgcaaggccatgtgaagga

SEQ ID NO: 7093502 - DNA, 22 bp, Homo sapiens
aaatgcaaggcacattcctttt

SEQ ID NO: 7093503 - DNA, 22 bp, Homo sapiens
aaatgcaaggcacattcctttt

SEQ ID NO: 7093504 - DNA, 22 bp, Homo sapiens
aaatgattgtcaaagttctgtt

SEQ ID NO: 7093505 - DNA, 22 bp, Homo sapiens
aaatgcaacgggctttccttat

SEQ ID NO: 7093506 - DNA, 22 bp, Homo sapiens
aaatgcaacgggctttccttat

SEQ ID NO: 7093507 - DNA, 22 bp, Homo sapiens
aaatgcaaggattttgttaggc

SEQ ID NO: 7093508 - DNA, 22 bp, Homo sapiens
aaatgcaaggattttgttaggc

SEQ ID NO: 7093509 - DNA, 20 bp, Homo sapiens
aaatgatgggaataatctat

SEQ ID NO: 7093510 - DNA, 20 bp, Homo sapiens
aaatgatgggaataatctat

SEQ ID NO: 7093511 - DNA, 22 bp, Homo sapiens
aaatgatggaaatgaggctgaa

SEQ ID NO: 7093512 - DNA, 22 bp, Homo sapiens
aaatgatgctacagttttccca

SEQ ID NO: 7093513 - DNA, 22 bp, Homo sapiens
aaatgatgctcacagattagtg

SEQ ID NO: 7093514 - DNA, 22 bp, Homo sapiens
aaatgatggtactcatgtttag

SEQ ID NO: 7093515 - DNA, 22 bp, Homo sapiens
aaatgcaattgtatgtactcca

SEQ ID NO: 7093516 - DNA, 22 bp, Homo sapiens
aaatgcaattcaggaagacaag

SEQ ID NO: 7093517 - DNA, 22 bp, Homo sapiens
aaatgcaaggccatgtgaagga

SEQ ID NO: 7093518 - DNA, 22 bp, Homo sapiens
aaatgcaagttcatattttgtt

SEQ ID NO: 7093519 - DNA, 22 bp, Homo sapiens
aaatgcaattcaggaagacaag

SEQ ID NO: 7093520 - DNA, 22 bp, Homo sapiens
aaatgcaattcaggaagacaag

SEQ ID NO: 7093521 - DNA, 22 bp, Homo sapiens
aaatgcacaaagattttgcact

SEQ ID NO: 7093522 - DNA, 22 bp, Homo sapiens
aaatgcaattgtatgtactcca

SEQ ID NO: 7093523 - DNA, 22 bp, Homo sapiens
aaatgcacaataaagtaaaggc

SEQ ID NO: 7093524 - DNA, 22 bp, Homo sapiens
aaatgcacaggagaaccaattc

SEQ ID NO: 7093525 - DNA, 22 bp, Homo sapiens
aaatgcacacaccaggaaacta

SEQ ID NO: 7093526 - DNA, 22 bp, Homo sapiens
aaatgcacagagccttagagat

SEQ ID NO: 7093527 - DNA, 22 bp, Homo sapiens
aaatgcacagaggccagagagg

SEQ ID NO: 7093528 - DNA, 22 bp, Homo sapiens
aagaaggcggaccagaagggag

SEQ ID NO: 7093529 - DNA, 22 bp, Homo sapiens
aagaaggcctggtagacgtctt

SEQ ID NO: 7093530 - DNA, 22 bp, Homo sapiens
aagaaggcggaccagaagggag

SEQ ID NO: 7093531 - DNA, 22 bp, Homo sapiens
aagaaggcggaccagaagggag

SEQ ID NO: 7093532 - DNA, 22 bp, Homo sapiens
aagaaggaagtgtggacatcac

SEQ ID NO: 7093533 - DNA, 22 bp, Homo sapiens
aagaagctgtagggattaactc

SEQ ID NO: 7093534 - DNA, 22 bp, Homo sapiens
aagaagctgcgtggtatgtgaa

SEQ ID NO: 7093535 - DNA, 22 bp, Homo sapiens
aagaagctgcgtggtatgtgaa

SEQ ID NO: 7093536 - DNA, 22 bp, Homo sapiens
aagaagcatgagaagattttat

SEQ ID NO: 7093537 - DNA, 22 bp, Homo sapiens
aagaagcaggtcacagacaggg

SEQ ID NO: 7093538 - DNA, 22 bp, Homo sapiens
aagaagcaggtcacagacaggg

SEQ ID NO: 7093539 - DNA, 22 bp, Homo sapiens
aagaagcaggtcacagacaggg

SEQ ID NO: 7093540 - DNA, 22 bp, Homo sapiens
aagaagcaggtcacagacaggg

SEQ ID NO: 7093541 - DNA, 22 bp, Homo sapiens
aagaagcatggctgtagattcc

SEQ ID NO: 7093542 - DNA, 22 bp, Homo sapiens
aagaagcatggctgtagattcc

SEQ ID NO: 7093543 - DNA, 20 bp, Homo sapiens
aagaagccgggaaggcaggc

SEQ ID NO: 7093544 - DNA, 20 bp, Homo sapiens
aagaagccgggaaggcaggc

SEQ ID NO: 7093545 - DNA, 22 bp, Homo sapiens
aagaagctaagactatctgggt

SEQ ID NO: 7093546 - DNA, 22 bp, Homo sapiens
aagaagctaagactatctgggt

SEQ ID NO: 7093547 - DNA, 22 bp, Homo sapiens
aaagttgagttttatgtgttac

SEQ ID NO: 7093548 - DNA, 19 bp, Homo sapiens
aaagttgagaaacaatgga

SEQ ID NO: 7093549 - DNA, 22 bp, Homo sapiens
aaagttctttttctataaatcc

SEQ ID NO: 7093550 - DNA, 22 bp, Homo sapiens
aaagttgaccgaaagattttga

SEQ ID NO: 7093551 - DNA, 22 bp, Homo sapiens
aaagttgactactaaggaatgt

SEQ ID NO: 7093552 - DNA, 22 bp, Homo sapiens
aaagttgactactaaggaatgt

SEQ ID NO: 7093553 - DNA, 22 bp, Homo sapiens
aaagttgatttggagggatatt

SEQ ID NO: 7093554 - DNA, 22 bp, Homo sapiens
aaagttgcaggtggtgagaggt

SEQ ID NO: 7093555 - DNA, 22 bp, Homo sapiens
aaagttgctgtcctagctggct

SEQ ID NO: 7093556 - DNA, 22 bp, Homo sapiens
aaagttgtaatggaagaaatgc

SEQ ID NO: 7093557 - DNA, 22 bp, Homo sapiens
aaagttgttcagtaagaaactc

SEQ ID NO: 7093558 - DNA, 22 bp, Homo sapiens
aagaagcagctgccaggccagt

SEQ ID NO: 7093559 - DNA, 22 bp, Homo sapiens
aagaaggtgtggaaagatgctc

SEQ ID NO: 7093560 - DNA, 22 bp, Homo sapiens
aagaaggcttcagagcccagga

SEQ ID NO: 7093561 - DNA, 22 bp, Homo sapiens
aagaagtggtccttttctttct

SEQ ID NO: 7093562 - DNA, 22 bp, Homo sapiens
aagaagtggtccttttctttct

SEQ ID NO: 7093563 - DNA, 22 bp, Homo sapiens
aagaagtggtccttttctttct

SEQ ID NO: 7093564 - DNA, 22 bp, Homo sapiens
aagaagtggttggaagaagcat

SEQ ID NO: 7093565 - DNA, 22 bp, Homo sapiens
aagaagttaataatggtgagaa

SEQ ID NO: 7093566 - DNA, 22 bp, Homo sapiens
aaatacaaaaattagccaggca

SEQ ID NO: 7093567 - DNA, 22 bp, Homo sapiens
aaatacaatttcaggctgtaat

SEQ ID NO: 7093568 - DNA, 22 bp, Homo sapiens
aaatacaatttcaggctgtaat

SEQ ID NO: 7093569 - DNA, 22 bp, Homo sapiens
aaatacagattctgactcagag

SEQ ID NO: 7093570 - DNA, 22 bp, Homo sapiens
aaatacagattcttgtgtctat

SEQ ID NO: 7093571 - DNA, 22 bp, Homo sapiens
aaatacagattcttgtgtctat

SEQ ID NO: 7093572 - DNA, 22 bp, Homo sapiens
aaatacagattcttgtgtctat

SEQ ID NO: 7093573 - DNA, 22 bp, Homo sapiens
aaatacagcagactcctgttgt

SEQ ID NO: 7093574 - DNA, 19 bp, Homo sapiens
aaatacagcagctgtttcc

SEQ ID NO: 7093575 - DNA, 19 bp, Homo sapiens
aaatacagcagctgtttcc

SEQ ID NO: 7093576 - DNA, 22 bp, Homo sapiens
aaatacaggagtttggacttct

SEQ ID NO: 7093577 - DNA, 22 bp, Homo sapiens
aaatacaggagtttggacttct

SEQ ID NO: 7093578 - DNA, 22 bp, Homo sapiens
aaatacaggagtttggacttct

SEQ ID NO: 7093579 - DNA, 22 bp, Homo sapiens
aaatacatacactgtacgtggc

SEQ ID NO: 7093580 - DNA, 22 bp, Homo sapiens
aaatacataaaggttgtaccag

SEQ ID NO: 7093581 - DNA, 22 bp, Homo sapiens
aaatacatacactgtacgtggc

SEQ ID NO: 7093582 - DNA, 22 bp, Homo sapiens
aaatacattagacggagagtta

SEQ ID NO: 7093583 - DNA, 22 bp, Homo sapiens
aagagagaactcccttcgccag

SEQ ID NO: 7093584 - DNA, 22 bp, Homo sapiens
aagagagaactcccttcgccag

SEQ ID NO: 7093585 - DNA, 22 bp, Homo sapiens
aaatacagtggcagcagataat

SEQ ID NO: 7093586 - DNA, 22 bp, Homo sapiens
aaatacagtggcagcagataat

SEQ ID NO: 7093587 - DNA, 22 bp, Homo sapiens
aaatacagtggcagcagataat

SEQ ID NO: 7093588 - DNA, 22 bp, Homo sapiens
aaatacagtggcagcagataat

SEQ ID NO: 7093589 - DNA, 22 bp, Homo sapiens
aaatacagtggcagcagataat

SEQ ID NO: 7093590 - DNA, 22 bp, Homo sapiens
aaatacagtggcagcagataat

SEQ ID NO: 7093591 - DNA, 22 bp, Homo sapiens
aaatacagtgtgtgttctttga

SEQ ID NO: 7093592 - DNA, 22 bp, Homo sapiens
aaatacagtgtgtgttctttga

SEQ ID NO: 7093593 - DNA, 22 bp, Homo sapiens
aaatacagtgtgtgttctttga

SEQ ID NO: 7093594 - DNA, 22 bp, Homo sapiens
aaatacataaaggttgtaccag

SEQ ID NO: 7093595 - DNA, 22 bp, Homo sapiens
aaatacataaaggttgtaccag

SEQ ID NO: 7093596 - DNA, 22 bp, Homo sapiens
aagagtttcttactggcatcta

SEQ ID NO: 7093597 - DNA, 22 bp, Homo sapiens
aagagtttctttattaaccttt

SEQ ID NO: 7093598 - DNA, 22 bp, Homo sapiens
aagagtttctttattaaccttt

SEQ ID NO: 7093599 - DNA, 22 bp, Homo sapiens
aagagtttctgggtcaaggatt

SEQ ID NO: 7093600 - DNA, 22 bp, Homo sapiens
aagagtttctgattcagtaggt

SEQ ID NO: 7093601 - DNA, 19 bp, Homo sapiens
aaatatcagagagatgata

SEQ ID NO: 7093602 - DNA, 22 bp, Homo sapiens
aaatatagtgacacttatagtc

SEQ ID NO: 7093603 - DNA, 22 bp, Homo sapiens
aaatatagtgacacttatagtc

SEQ ID NO: 7093604 - DNA, 22 bp, Homo sapiens
aaatatagtgacacttatagtc

SEQ ID NO: 7093605 - DNA, 22 bp, Homo sapiens
aagagttttctataatcttggc

SEQ ID NO: 7093606 - DNA, 22 bp, Homo sapiens
aagagttttagacaaactgatt

SEQ ID NO: 7093607 - DNA, 22 bp, Homo sapiens
aagagtttgtcagatctgcacg

SEQ ID NO: 7093608 - DNA, 22 bp, Homo sapiens
aagagtttgtcagatctgcacg

SEQ ID NO: 7093609 - DNA, 22 bp, Homo sapiens
aagagtttgggcaagtcataaa

SEQ ID NO: 7093610 - DNA, 22 bp, Homo sapiens
aagagtttgacctgtgccatcc

SEQ ID NO: 7093611 - DNA, 22 bp, Homo sapiens
aaatatgagagtaggagtttgg

SEQ ID NO: 7093612 - DNA, 22 bp, Homo sapiens
aagataaactcttgatttctga

SEQ ID NO: 7093613 - DNA, 22 bp, Homo sapiens
aaatatgagatgttctctttcg

SEQ ID NO: 7093614 - DNA, 22 bp, Homo sapiens
aaatatgagatgttctctttcg

SEQ ID NO: 7093615 - DNA, 23 bp, Homo sapiens
aaatattcttttttagtaagtgc

SEQ ID NO: 7093616 - DNA, 22 bp, Homo sapiens
aagataaactcttgatttctga

SEQ ID NO: 7093617 - DNA, 22 bp, Homo sapiens
aagataaactcttgatttctga

SEQ ID NO: 7093618 - DNA, 22 bp, Homo sapiens
aagagtttttaatgggtactgg

SEQ ID NO: 7093619 - DNA, 22 bp, Homo sapiens
aagagtttttggagtgtgagtt

SEQ ID NO: 7093620 - DNA, 22 bp, Homo sapiens
aagagttttctctgatggcatt

SEQ ID NO: 7093621 - DNA, 22 bp, Homo sapiens
aagagagagtgcgctcacagaa

SEQ ID NO: 7093622 - DNA, 22 bp, Homo sapiens
aagagagagtgcgctcacagaa

SEQ ID NO: 7093623 - DNA, 22 bp, Homo sapiens
aagagagagtgcgctcacagaa

SEQ ID NO: 7093624 - DNA, 22 bp, Homo sapiens
aagagagagtgcgctcacagaa

SEQ ID NO: 7093625 - DNA, 22 bp, Homo sapiens
aagagagagttcctaggcaaaa

SEQ ID NO: 7093626 - DNA, 22 bp, Homo sapiens
aagagagagttcctaggcaaaa

SEQ ID NO: 7093627 - DNA, 22 bp, Homo sapiens
aagagagagttcctaggcaaaa

SEQ ID NO: 7093628 - DNA, 22 bp, Homo sapiens
aagagagagttcctaggcaaaa

SEQ ID NO: 7093629 - DNA, 22 bp, Homo sapiens
aagagagaccatgggggacagg

SEQ ID NO: 7093630 - DNA, 22 bp, Homo sapiens
aagagagagcattcttctgtta

SEQ ID NO: 7093631 - DNA, 22 bp, Homo sapiens
aagagagagcattcttctgtta

SEQ ID NO: 7093632 - DNA, 22 bp, Homo sapiens
aagagagagtgcgctcacagaa

SEQ ID NO: 7093633 - DNA, 22 bp, Homo sapiens
aagagagagtgcgctcacagaa

SEQ ID NO: 7093634 - DNA, 22 bp, Homo sapiens
aagagagaagtctctctggttc

SEQ ID NO: 7093635 - DNA, 22 bp, Homo sapiens
aagagagaagtctctctggttc

SEQ ID NO: 7093636 - DNA, 22 bp, Homo sapiens
aagagagaagtctctctggttc

SEQ ID NO: 7093637 - DNA, 22 bp, Homo sapiens
aagagagacaataggtagcatt

SEQ ID NO: 7093638 - DNA, 22 bp, Homo sapiens
aagagagacaataggtagcatt

SEQ ID NO: 7093639 - DNA, 22 bp, Homo sapiens
aagagagacaataggtagcatt

SEQ ID NO: 7093640 - DNA, 22 bp, Homo sapiens
aagagagacaataggtagcatt

SEQ ID NO: 7093641 - DNA, 22 bp, Homo sapiens
aagagagacaataggtagcatt

SEQ ID NO: 7093642 - DNA, 22 bp, Homo sapiens
aagagagaccatgggggacagg

SEQ ID NO: 7093643 - DNA, 22 bp, Homo sapiens
aagagagaccatgggggacagg

SEQ ID NO: 7093644 - DNA, 22 bp, Homo sapiens
aagagagaccatgggggacagg

SEQ ID NO: 7093645 - DNA, 22 bp, Homo sapiens
aagagagaccatgggggacagg

SEQ ID NO: 7093646 - DNA, 22 bp, Homo sapiens
aagagagaccatgggggacagg

SEQ ID NO: 7093647 - DNA, 22 bp, Homo sapiens
aagagagaccatgggggacagg

SEQ ID NO: 7093648 - DNA, 22 bp, Homo sapiens
aaatataatttctgcctcaata

SEQ ID NO: 7093649 - DNA, 22 bp, Homo sapiens
aaatatacggtccctaacagtc

SEQ ID NO: 7093650 - DNA, 22 bp, Homo sapiens
aaatatacggtccctaacagtc

SEQ ID NO: 7093651 - DNA, 22 bp, Homo sapiens
aaatagtaaagtggtagccatc

SEQ ID NO: 7093652 - DNA, 22 bp, Homo sapiens
aaatagtcctgggaatagtact

SEQ ID NO: 7093653 - DNA, 22 bp, Homo sapiens
aaatagtcctgggaatagtact

SEQ ID NO: 7093654 - DNA, 22 bp, Homo sapiens
aaatatactagatgatgaccca

SEQ ID NO: 7093655 - DNA, 22 bp, Homo sapiens
aaatatacggtccctaacagtc

SEQ ID NO: 7093656 - DNA, 22 bp, Homo sapiens
aaatatagcaattatgcctact

SEQ ID NO: 7093657 - DNA, 22 bp, Homo sapiens
aaatatagtaaatgcatagttc

SEQ ID NO: 7093658 - DNA, 22 bp, Homo sapiens
aaatatagtaaatgcatagttc

SEQ ID NO: 7093659 - DNA, 22 bp, Homo sapiens
aaataaaggtccactttagggc

SEQ ID NO: 7093660 - DNA, 22 bp, Homo sapiens
aaataaaggaactgttttccca

SEQ ID NO: 7093661 - DNA, 22 bp, Homo sapiens
aaataaaggtccactttagggc

SEQ ID NO: 7093662 - DNA, 22 bp, Homo sapiens
aaataaactgaagcacagagag

SEQ ID NO: 7093663 - DNA, 22 bp, Homo sapiens
aaataaaggaactgttttccca

SEQ ID NO: 7093664 - DNA, 22 bp, Homo sapiens
aaataaaggtccactttagggc

SEQ ID NO: 7093665 - DNA, 22 bp, Homo sapiens
aaataaaggtccactttagggc

SEQ ID NO: 7093666 - DNA, 22 bp, Homo sapiens
aaataaaggtccactttagggc

SEQ ID NO: 7093667 - DNA, 22 bp, Homo sapiens
aaataaaggtccactttagggc

SEQ ID NO: 7093668 - DNA, 22 bp, Homo sapiens
aaataaaggtccactttagggc

SEQ ID NO: 7093669 - DNA, 22 bp, Homo sapiens
aaataacagtcagggacaacat

SEQ ID NO: 7093670 - DNA, 22 bp, Homo sapiens
aaatacaatttcaggctgtaat

SEQ ID NO: 7093671 - DNA, 22 bp, Homo sapiens
aaataacagtcagggacaacat

SEQ ID NO: 7093672 - DNA, 22 bp, Homo sapiens
aaatacacgtacatgtgtaaaa

SEQ ID NO: 7093673 - DNA, 21 bp, Homo sapiens
aaatacagaaacttgttttca

SEQ ID NO: 7093674 - DNA, 21 bp, Homo sapiens
aaatacagaaacttgttttca

SEQ ID NO: 7093675 - DNA, 22 bp, Homo sapiens
aaatacacgtacatgtgtaaaa

SEQ ID NO: 7093676 - DNA, 21 bp, Homo sapiens
aaatacagaaacttgttttca

SEQ ID NO: 7093677 - DNA, 22 bp, Homo sapiens
aaatacagagttgcttaaaagc

SEQ ID NO: 7093678 - DNA, 22 bp, Homo sapiens
aaatacagagttgcttaaaagc

SEQ ID NO: 7093679 - DNA, 22 bp, Homo sapiens
aaatacagagttgcttaaaagc

SEQ ID NO: 7093680 - DNA, 22 bp, Homo sapiens
aaatacagagttgcttaaaagc

SEQ ID NO: 7093681 - DNA, 22 bp, Homo sapiens
aaatacagatagatttaaccca

SEQ ID NO: 7093682 - DNA, 22 bp, Homo sapiens
aaatacagatagatttaaccca

SEQ ID NO: 7093683 - DNA, 21 bp, Homo sapiens
aaatacagatgcaaatctgtt

SEQ ID NO: 7093684 - DNA, 21 bp, Homo sapiens
aaatacagatgcaaatctgtt

SEQ ID NO: 7093685 - DNA, 21 bp, Homo sapiens
aaatacagatgcaaatctgtt

SEQ ID NO: 7093686 - DNA, 21 bp, Homo sapiens
aaatgaatgtggtagtgcaag

SEQ ID NO: 7093687 - DNA, 21 bp, Homo sapiens
aaatgaatgtggtagtgcaag

SEQ ID NO: 7093688 - DNA, 21 bp, Homo sapiens
aaatgaatgtggtagtgcaag

SEQ ID NO: 7093689 - DNA, 21 bp, Homo sapiens
aaatgaatgtggtagtgcaag

SEQ ID NO: 7093690 - DNA, 21 bp, Homo sapiens
aaatgaatgtggtagtgcaag

SEQ ID NO: 7093691 - DNA, 21 bp, Homo sapiens
aaatgaatgtggtagtgcaag

SEQ ID NO: 7093692 - DNA, 22 bp, Homo sapiens
aaatccagtttgtcatttccca

SEQ ID NO: 7093693 - DNA, 22 bp, Homo sapiens
aaatgaacatcaagaatagcct

SEQ ID NO: 7093694 - DNA, 22 bp, Homo sapiens
aaatgaactcaatgatctccca

SEQ ID NO: 7093695 - DNA, 22 bp, Homo sapiens
aaatgaactcaatgatctccca

SEQ ID NO: 7093696 - DNA, 22 bp, Homo sapiens
aaatgaactcttcctgcatccc

SEQ ID NO: 7093697 - DNA, 22 bp, Homo sapiens
aaatgaactcttcctgcatccc

SEQ ID NO: 7093698 - DNA, 22 bp, Homo sapiens
aaatgacaataaaagtccatgc

SEQ ID NO: 7093699 - DNA, 22 bp, Homo sapiens
aaatgacaataaaagtccatgc

SEQ ID NO: 7093700 - DNA, 21 bp, Homo sapiens
aaatgaatgtggtagtgcaag

SEQ ID NO: 7093701 - DNA, 22 bp, Homo sapiens
aaatgacaataaaagtccatgc

SEQ ID NO: 7093702 - DNA, 22 bp, Homo sapiens
aaatgacaataaaagtccatgc

SEQ ID NO: 7093703 - DNA, 22 bp, Homo sapiens
aaatgacaataaaagtccatgc

SEQ ID NO: 7093704 - DNA, 22 bp, Homo sapiens
aaatgacaataaaagtccatgc

SEQ ID NO: 7093705 - DNA, 22 bp, Homo sapiens
aaatgacaataaaagtccatgc

SEQ ID NO: 7093706 - DNA, 22 bp, Homo sapiens
aaatgacactaggctttttgca

SEQ ID NO: 7093707 - DNA, 22 bp, Homo sapiens
aaatgacactaggctttttgca

SEQ ID NO: 7093708 - DNA, 22 bp, Homo sapiens
aaatgacactcattcagtgtca

SEQ ID NO: 7093709 - DNA, 22 bp, Homo sapiens
aaatgacactaggctttttgca

SEQ ID NO: 7093710 - DNA, 22 bp, Homo sapiens
aaatgacactaggctttttgca

SEQ ID NO: 7093711 - DNA, 22 bp, Homo sapiens
aaatgacactaggctttttgca

SEQ ID NO: 7093712 - DNA, 22 bp, Homo sapiens
aaatgacactaggctttttgca

SEQ ID NO: 7093713 - DNA, 22 bp, Homo sapiens
aaatgacagagtaagctgttta

SEQ ID NO: 7093714 - DNA, 22 bp, Homo sapiens
aaatgacagttctctctgagta

SEQ ID NO: 7093715 - DNA, 22 bp, Homo sapiens
aaatgacagttctctctgagta

SEQ ID NO: 7093716 - DNA, 22 bp, Homo sapiens
aaatgacactcattcagtgtca

SEQ ID NO: 7093717 - DNA, 22 bp, Homo sapiens
aaatgacactcattcagtgtca

SEQ ID NO: 7093718 - DNA, 22 bp, Homo sapiens
aaatgacagagtaagctgttta

SEQ ID NO: 7093719 - DNA, 22 bp, Homo sapiens
aaactgtttccctccataacct

SEQ ID NO: 7093720 - DNA, 22 bp, Homo sapiens
aaactgtttccctccataacct

SEQ ID NO: 7093721 - DNA, 22 bp, Homo sapiens
aaactgttgtggtttatcatta

SEQ ID NO: 7093722 - DNA, 22 bp, Homo sapiens
aaactgttcctttttcagcaac

SEQ ID NO: 7093723 - DNA, 22 bp, Homo sapiens
aaactgttcctttttcagcaac

SEQ ID NO: 7093724 - DNA, 23 bp, Homo sapiens
aaactgttgcttcaatgtatcct

SEQ ID NO: 7093725 - DNA, 22 bp, Homo sapiens
aaatgacagttctctctgagta

SEQ ID NO: 7093726 - DNA, 23 bp, Homo sapiens
aaatgacatatggtttctgaagg

SEQ ID NO: 7093727 - DNA, 22 bp, Homo sapiens
aaactgtgagctagtaaatagg

SEQ ID NO: 7093728 - DNA, 22 bp, Homo sapiens
aaactgttatagcagaaaggac

SEQ ID NO: 7093729 - DNA, 22 bp, Homo sapiens
aaacttcaagattcaagcctgg

SEQ ID NO: 7093730 - DNA, 22 bp, Homo sapiens
aaacttcaagattcaagcctgg

SEQ ID NO: 7093731 - DNA, 22 bp, Homo sapiens
aaacttcaactggaatgggcta

SEQ ID NO: 7093732 - DNA, 22 bp, Homo sapiens
aaacttagtagagttcatatta

SEQ ID NO: 7093733 - DNA, 22 bp, Homo sapiens
aaacttcagactccccacttct

SEQ ID NO: 7093734 - DNA, 22 bp, Homo sapiens
aaacttcagactccccacttct

SEQ ID NO: 7093735 - DNA, 22 bp, Homo sapiens
aaacttcagggaataaaagagt

SEQ ID NO: 7093736 - DNA, 22 bp, Homo sapiens
aaacttcagggaataaaagagt

SEQ ID NO: 7093737 - DNA, 22 bp, Homo sapiens
aaacttcaaggatttgcaaatc

SEQ ID NO: 7093738 - DNA, 22 bp, Homo sapiens
aaacttcaaggatttgcaaatc

SEQ ID NO: 7093739 - DNA, 22 bp, Homo sapiens
aaacttcagtaggagccaacct

SEQ ID NO: 7093740 - DNA, 22 bp, Homo sapiens
aaacttcagggaataaaagagt

SEQ ID NO: 7093741 - DNA, 22 bp, Homo sapiens
aaacttcatggataatataaag

SEQ ID NO: 7093742 - DNA, 17 bp, Homo sapiens
aaacttcattctcagga

SEQ ID NO: 7093743 - DNA, 22 bp, Homo sapiens
aaacttcagtgaatgacttatg

SEQ ID NO: 7093744 - DNA, 22 bp, Homo sapiens
aaacttcatggataatataaag

SEQ ID NO: 7093745 - DNA, 22 bp, Homo sapiens
aaacttcatggataatataaag

SEQ ID NO: 7093746 - DNA, 22 bp, Homo sapiens
aaatggtggctcttttaaattg

SEQ ID NO: 7093747 - DNA, 22 bp, Homo sapiens
aaatggtgttgtatttagtctc

SEQ ID NO: 7093748 - DNA, 22 bp, Homo sapiens
aaatggtgtttctaatgctaga

SEQ ID NO: 7093749 - DNA, 22 bp, Homo sapiens
aaatggtgtttctaatgctaga

SEQ ID NO: 7093750 - DNA, 22 bp, Homo sapiens
aaatggtgtttctaatgctaga

SEQ ID NO: 7093751 - DNA, 22 bp, Homo sapiens
aaatggttacaatgctttgctt

SEQ ID NO: 7093752 - DNA, 22 bp, Homo sapiens
aaatggtttaattatgtttaat

SEQ ID NO: 7093753 - DNA, 22 bp, Homo sapiens
aaatggtttaattatgtttaat

SEQ ID NO: 7093754 - DNA, 22 bp, Homo sapiens
aaatgtctgagacttctgaact

SEQ ID NO: 7093755 - DNA, 22 bp, Homo sapiens
aaatgtctgtatgagaaagaga

SEQ ID NO: 7093756 - DNA, 22 bp, Homo sapiens
aaatgtctgttagtcatatcat

SEQ ID NO: 7093757 - DNA, 22 bp, Homo sapiens
aaatgtctgttagtcatatcat

SEQ ID NO: 7093758 - DNA, 23 bp, Homo sapiens
aaatgtcttctagctcttgagaa

SEQ ID NO: 7093759 - DNA, 22 bp, Homo sapiens
aaatgtctttatctcatgtaac

SEQ ID NO: 7093760 - DNA, 22 bp, Homo sapiens
aaatgtctttatctcatgtaac

SEQ ID NO: 7093761 - DNA, 22 bp, Homo sapiens
aaatgtctttatctcatgtaac

SEQ ID NO: 7093762 - DNA, 22 bp, Homo sapiens
aaagacacacagtgcttcagtt

SEQ ID NO: 7093763 - DNA, 22 bp, Homo sapiens
aaagacacacagtgcttcagtt

SEQ ID NO: 7093764 - DNA, 22 bp, Homo sapiens
aaatgtgagttatagcaataga

SEQ ID NO: 7093765 - DNA, 23 bp, Homo sapiens
aaatgtgagggaaaatctttctg

SEQ ID NO: 7093766 - DNA, 22 bp, Homo sapiens
aaatgtctttcaatagagaaat

SEQ ID NO: 7093767 - DNA, 22 bp, Homo sapiens
aaatgtctttgagtatttctgc

SEQ ID NO: 7093768 - DNA, 22 bp, Homo sapiens
aaatgtgacagatgcagtacag

SEQ ID NO: 7093769 - DNA, 22 bp, Homo sapiens
aaagacatcagaaccagctgag

SEQ ID NO: 7093770 - DNA, 22 bp, Homo sapiens
aaagacatatttctaagtttat

SEQ ID NO: 7093771 - DNA, 22 bp, Homo sapiens
aaagacagatggcaaggatgat

SEQ ID NO: 7093772 - DNA, 22 bp, Homo sapiens
aaagacagatggcaaggatgat

SEQ ID NO: 7093773 - DNA, 22 bp, Homo sapiens
aaagacagtggattcaaaatcc

SEQ ID NO: 7093774 - DNA, 22 bp, Homo sapiens
aaagacagtggattcaaaatcc

SEQ ID NO: 7093775 - DNA, 22 bp, Homo sapiens
aaagacagtggattcaaaatcc

SEQ ID NO: 7093776 - DNA, 22 bp, Homo sapiens
aaagacagtggattcaaaatcc

SEQ ID NO: 7093777 - DNA, 22 bp, Homo sapiens
aaagacagtggattcaaaatcc

SEQ ID NO: 7093778 - DNA, 22 bp, Homo sapiens
aaagacagatggcaaggatgat

SEQ ID NO: 7093779 - DNA, 22 bp, Homo sapiens
aaagacagatggcaaggatgat

SEQ ID NO: 7093780 - DNA, 22 bp, Homo sapiens
aaagacagagctgtaggggaaa

SEQ ID NO: 7093781 - DNA, 22 bp, Homo sapiens
aaagacagatggcaaggatgat

SEQ ID NO: 7093782 - DNA, 22 bp, Homo sapiens
aaagacagatggcaaggatgat

SEQ ID NO: 7093783 - DNA, 22 bp, Homo sapiens
aaagacagatggcaaggatgat

SEQ ID NO: 7093784 - DNA, 22 bp, Homo sapiens
aaagacagacggaaacctgagg

SEQ ID NO: 7093785 - DNA, 22 bp, Homo sapiens
aaagacagacggaaacctgagg

SEQ ID NO: 7093786 - DNA, 22 bp, Homo sapiens
aaagctatttgttatgagagaa

SEQ ID NO: 7093787 - DNA, 22 bp, Homo sapiens
aaagctatttgtgagttataga

SEQ ID NO: 7093788 - DNA, 22 bp, Homo sapiens
aaagctatttattacagagaat

SEQ ID NO: 7093789 - DNA, 22 bp, Homo sapiens
aaagctatttattacagagaat

SEQ ID NO: 7093790 - DNA, 22 bp, Homo sapiens
aaagctattcaacacgaacatg

SEQ ID NO: 7093791 - DNA, 22 bp, Homo sapiens
aaagctattcaacacgaacatg

SEQ ID NO: 7093792 - DNA, 22 bp, Homo sapiens
aaagctatgaggcatgcatttc

SEQ ID NO: 7093793 - DNA, 22 bp, Homo sapiens
aaagctatagggtcaagcattt

SEQ ID NO: 7093794 - DNA, 22 bp, Homo sapiens
aaagctagtaatattttaatcc

SEQ ID NO: 7093795 - DNA, 22 bp, Homo sapiens
aaagctagtaatattttaatcc

SEQ ID NO: 7093796 - DNA, 22 bp, Homo sapiens
aaagctatagggtcaagcattt

SEQ ID NO: 7093797 - DNA, 22 bp, Homo sapiens
aaaattttgccctatccttcat

SEQ ID NO: 7093798 - DNA, 22 bp, Homo sapiens
aaagccagggacagtgtgcatg

SEQ ID NO: 7093799 - DNA, 22 bp, Homo sapiens
aaagccagggacagtgtgcatg

SEQ ID NO: 7093800 - DNA, 22 bp, Homo sapiens
aaaattgtcagaagttgatctt

SEQ ID NO: 7093801 - DNA, 22 bp, Homo sapiens
aaaattgtcagaagttgatctt

SEQ ID NO: 7093802 - DNA, 22 bp, Homo sapiens
aaaattgtcgaacagtagtaac

SEQ ID NO: 7093803 - DNA, 22 bp, Homo sapiens
aaaattttactggtgtttcctt

SEQ ID NO: 7093804 - DNA, 22 bp, Homo sapiens
aaaattttcagcttgacttgat

SEQ ID NO: 7093805 - DNA, 22 bp, Homo sapiens
aaaattttcagcttgacttgat

SEQ ID NO: 7093806 - DNA, 22 bp, Homo sapiens
aaaattttgccctatccttcat

SEQ ID NO: 7093807 - DNA, 22 bp, Homo sapiens
aaagctcacagtaatacaaggc

SEQ ID NO: 7093808 - DNA, 22 bp, Homo sapiens
aaagctctgagaagcactgcaa

SEQ ID NO: 7093809 - DNA, 22 bp, Homo sapiens
aaagctcttaatgagattatcc

SEQ ID NO: 7093810 - DNA, 22 bp, Homo sapiens
aaaggaatgagcttctgttagg

SEQ ID NO: 7093811 - DNA, 22 bp, Homo sapiens
aaaggacacacaggaggtgtct

SEQ ID NO: 7093812 - DNA, 22 bp, Homo sapiens
aaaggacatgtcaatatcaggc

SEQ ID NO: 7093813 - DNA, 22 bp, Homo sapiens
aaaggacatgtcaatatcaggc

SEQ ID NO: 7093814 - DNA, 22 bp, Homo sapiens
aaaggagagtaggttactccat

SEQ ID NO: 7093815 - DNA, 22 bp, Homo sapiens
aaaggagagtgagtcagatgcc

SEQ ID NO: 7093816 - DNA, 22 bp, Homo sapiens
aaaggagagtgagtcagatgcc

SEQ ID NO: 7093817 - DNA, 22 bp, Homo sapiens
aaaggagagtgagtcagatgcc

SEQ ID NO: 7093818 - DNA, 22 bp, Homo sapiens
aaaggagagtgagtcagatgcc

SEQ ID NO: 7093819 - DNA, 22 bp, Homo sapiens
aaaggagataaagggcccttca

SEQ ID NO: 7093820 - DNA, 22 bp, Homo sapiens
aaaggagataaagggcccttca

SEQ ID NO: 7093821 - DNA, 22 bp, Homo sapiens
aaaggaggaatggagagatgct

SEQ ID NO: 7093822 - DNA, 22 bp, Homo sapiens
aaaggaggaatggagagatgct

SEQ ID NO: 7093823 - DNA, 22 bp, Homo sapiens
aaaggaggaatggagagatgct

SEQ ID NO: 7093824 - DNA, 22 bp, Homo sapiens
aaaggaggaatggagagatgct

SEQ ID NO: 7093825 - DNA, 22 bp, Homo sapiens
aaaggaggaatggagagatgct

SEQ ID NO: 7093826 - DNA, 22 bp, Homo sapiens
aaaggagaaaacatacaggact

SEQ ID NO: 7093827 - DNA, 22 bp, Homo sapiens
aaaggagaaaacatacaggact

SEQ ID NO: 7093828 - DNA, 22 bp, Homo sapiens
aaaggagaaaacatacaggact

SEQ ID NO: 7093829 - DNA, 22 bp, Homo sapiens
aaaggactggatattaaagagt

SEQ ID NO: 7093830 - DNA, 22 bp, Homo sapiens
aaaggactggatattaaagagt

SEQ ID NO: 7093831 - DNA, 22 bp, Homo sapiens
aaaggagaaaacatacaggact

SEQ ID NO: 7093832 - DNA, 22 bp, Homo sapiens
aaaggagaaaacatacaggact

SEQ ID NO: 7093833 - DNA, 22 bp, Homo sapiens
aaaggagacagtcttacctgga

SEQ ID NO: 7093834 - DNA, 22 bp, Homo sapiens
aaaggagacagtcttacctgga

SEQ ID NO: 7093835 - DNA, 22 bp, Homo sapiens
aaaggagacttcagatctcctt

SEQ ID NO: 7093836 - DNA, 22 bp, Homo sapiens
aaaggagacttcagatctcctt

SEQ ID NO: 7093837 - DNA, 22 bp, Homo sapiens
aaagtcatctgtcctaggctct

SEQ ID NO: 7093838 - DNA, 22 bp, Homo sapiens
aaagtcatgtaatgatatgatt

SEQ ID NO: 7093839 - DNA, 22 bp, Homo sapiens
aaagtcatctaggagcagattt

SEQ ID NO: 7093840 - DNA, 22 bp, Homo sapiens
aaagtcatctaggagcagattt

SEQ ID NO: 7093841 - DNA, 22 bp, Homo sapiens
aaagttcattgatgactgaggt

SEQ ID NO: 7093842 - DNA, 22 bp, Homo sapiens
aaagtcattgtaatatatgcta

SEQ ID NO: 7093843 - DNA, 22 bp, Homo sapiens
aaagtcattggaatattaatga

SEQ ID NO: 7093844 - DNA, 22 bp, Homo sapiens
aaagtcattggaatattaatga

SEQ ID NO: 7093845 - DNA, 22 bp, Homo sapiens
aaagtttttaagcaagaccctt

SEQ ID NO: 7093846 - DNA, 22 bp, Homo sapiens
aaataaactgaagcacagagag

SEQ ID NO: 7093847 - DNA, 22 bp, Homo sapiens
aaagttttctgccttcattaga

SEQ ID NO: 7093848 - DNA, 22 bp, Homo sapiens
aaagttttgttgattgtggaat

SEQ ID NO: 7093849 - DNA, 22 bp, Homo sapiens
aaagttttattcaagcattagt

SEQ ID NO: 7093850 - DNA, 22 bp, Homo sapiens
aaagttttattcaagcattagt

SEQ ID NO: 7093851 - DNA, 19 bp, Homo sapiens
aaagttttattctcatttg

SEQ ID NO: 7093852 - DNA, 19 bp, Homo sapiens
aaagttttattctcatttg

SEQ ID NO: 7093853 - DNA, 22 bp, Homo sapiens
aaagttttctgccttcattaga

SEQ ID NO: 7093854 - DNA, 22 bp, Homo sapiens
aaagtacatgcaattcttctga

SEQ ID NO: 7093855 - DNA, 22 bp, Homo sapiens
aaagtacatgcaattcttctga

SEQ ID NO: 7093856 - DNA, 22 bp, Homo sapiens
aaagtacatgtttggccatttg

SEQ ID NO: 7093857 - DNA, 22 bp, Homo sapiens
aaagtacatagcatattccaac

SEQ ID NO: 7093858 - DNA, 22 bp, Homo sapiens
aaagtacatgagattcaagggg

SEQ ID NO: 7093859 - DNA, 22 bp, Homo sapiens
aaagtcacttccttctgtcagc

SEQ ID NO: 7093860 - DNA, 22 bp, Homo sapiens
aaagtcacttccttctgtcagc

SEQ ID NO: 7093861 - DNA, 22 bp, Homo sapiens
aaagtcaggctgtgtacctaac

SEQ ID NO: 7093862 - DNA, 22 bp, Homo sapiens
aaagtcaggctgtgtacctaac

SEQ ID NO: 7093863 - DNA, 22 bp, Homo sapiens
aaagtcagttggccagatcact

SEQ ID NO: 7093864 - DNA, 22 bp, Homo sapiens
aaagtcagttggccagatcact

SEQ ID NO: 7093865 - DNA, 22 bp, Homo sapiens
aaagtacaaggaaaggatctga

SEQ ID NO: 7093866 - DNA, 22 bp, Homo sapiens
aaagtacaatattgagattgat

SEQ ID NO: 7093867 - DNA, 22 bp, Homo sapiens
aaaggttagacagctctgcata

SEQ ID NO: 7093868 - DNA, 22 bp, Homo sapiens
aaagtacaatattgagattgat

SEQ ID NO: 7093869 - DNA, 22 bp, Homo sapiens
aaagtacacacagagccaagaa

SEQ ID NO: 7093870 - DNA, 22 bp, Homo sapiens
aaagtacacacagagccaagaa

SEQ ID NO: 7093871 - DNA, 22 bp, Homo sapiens
aaagtacacacagagccaagaa

SEQ ID NO: 7093872 - DNA, 22 bp, Homo sapiens
aaagtacagatggtgaggttgg

SEQ ID NO: 7093873 - DNA, 22 bp, Homo sapiens
aaagtacagatggtgaggttgg

SEQ ID NO: 7093874 - DNA, 22 bp, Homo sapiens
aaagtacagatggtgaggttgg

SEQ ID NO: 7093875 - DNA, 22 bp, Homo sapiens
aaagtacagccacatccaagta

SEQ ID NO: 7093876 - DNA, 22 bp, Homo sapiens
aaagtacagccacatccaagta

SEQ ID NO: 7093877 - DNA, 22 bp, Homo sapiens
aaagtacagccacatccaagta

SEQ ID NO: 7093878 - DNA, 22 bp, Homo sapiens
aaagtacagggttgtggggtga

SEQ ID NO: 7093879 - DNA, 22 bp, Homo sapiens
aaagtacatagcatattccaac

SEQ ID NO: 7093880 - DNA, 22 bp, Homo sapiens
aaaataacttctactatttgca

SEQ ID NO: 7093881 - DNA, 22 bp, Homo sapiens
aaaataacttctactatttgca

SEQ ID NO: 7093882 - DNA, 22 bp, Homo sapiens
aaaataacttctactatttgca

SEQ ID NO: 7093883 - DNA, 22 bp, Homo sapiens
aaaataagttggtcctgtcctt

SEQ ID NO: 7093884 - DNA, 22 bp, Homo sapiens
aaaatacacatactaggggaaa

SEQ ID NO: 7093885 - DNA, 22 bp, Homo sapiens
aaaatacacatactaggggaaa

SEQ ID NO: 7093886 - DNA, 22 bp, Homo sapiens
aaaatacacatactaggggaaa

SEQ ID NO: 7093887 - DNA, 22 bp, Homo sapiens
aaaataacttctactatttgca

SEQ ID NO: 7093888 - DNA, 22 bp, Homo sapiens
aaaataacttctactatttgca

SEQ ID NO: 7093889 - DNA, 18 bp, Homo sapiens
aaaataacaaagttggct

SEQ ID NO: 7093890 - DNA, 21 bp, Homo sapiens
aaaagtttgacaggaaaggga

SEQ ID NO: 7093891 - DNA, 22 bp, Homo sapiens
aaaagtttgtgcaaacactcag

SEQ ID NO: 7093892 - DNA, 18 bp, Homo sapiens
aaaataacaaagttggct

SEQ ID NO: 7093893 - DNA, 22 bp, Homo sapiens
aaaatactactgtcttcttccc

SEQ ID NO: 7093894 - DNA, 22 bp, Homo sapiens
aaaatacacatactaggggaaa

SEQ ID NO: 7093895 - DNA, 22 bp, Homo sapiens
aaaatctggcaacactaagttt

SEQ ID NO: 7093896 - DNA, 22 bp, Homo sapiens
aaaatgagatacagtttgaaag

SEQ ID NO: 7093897 - DNA, 22 bp, Homo sapiens
aaaagctttgccagatgagttg

SEQ ID NO: 7093898 - DNA, 22 bp, Homo sapiens
aaaagctctttctgctgtagat

SEQ ID NO: 7093899 - DNA, 22 bp, Homo sapiens
aaaagctagtcaatgatgtatt

SEQ ID NO: 7093900 - DNA, 22 bp, Homo sapiens
aaaagctttgttaataggtttg

SEQ ID NO: 7093901 - DNA, 22 bp, Homo sapiens
aaaagctttgttaataggtttg

SEQ ID NO: 7093902 - DNA, 21 bp, Homo sapiens
aaaaggaaggtctgtttgggg

SEQ ID NO: 7093903 - DNA, 19 bp, Homo sapiens
aaaaggaatattctttggg

SEQ ID NO: 7093904 - DNA, 19 bp, Homo sapiens
aaaaggaatattctttggg

SEQ ID NO: 7093905 - DNA, 22 bp, Homo sapiens
aaaaggacaagctttggagtta

SEQ ID NO: 7093906 - DNA, 22 bp, Homo sapiens
aaaagtattttgagcactttat

SEQ ID NO: 7093907 - DNA, 22 bp, Homo sapiens
aaaagtgttcaggaagaataat

SEQ ID NO: 7093908 - DNA, 22 bp, Homo sapiens
aaaagtttaagactcattctag

SEQ ID NO: 7093909 - DNA, 22 bp, Homo sapiens
aaaagtttaagactcattctag

SEQ ID NO: 7093910 - DNA, 22 bp, Homo sapiens
aaaagtttaagactcattctag

SEQ ID NO: 7093911 - DNA, 22 bp, Homo sapiens
aaaatgatatcctgacttttat

SEQ ID NO: 7093912 - DNA, 22 bp, Homo sapiens
aaaatgatatcctgacttttat

SEQ ID NO: 7093913 - DNA, 22 bp, Homo sapiens
aaaatgatatcctgacttttat

SEQ ID NO: 7093914 - DNA, 22 bp, Homo sapiens
aaaatgatatcctgacttttat

SEQ ID NO: 7093915 - DNA, 22 bp, Homo sapiens
aaaatgatgctgtaatttggca

SEQ ID NO: 7093916 - DNA, 22 bp, Homo sapiens
aaaatgcaaacctacctacata

SEQ ID NO: 7093917 - DNA, 22 bp, Homo sapiens
aaaatgcaaacctacctacata

SEQ ID NO: 7093918 - DNA, 20 bp, Homo sapiens
aaaatgatgggcagggcagg

SEQ ID NO: 7093919 - DNA, 22 bp, Homo sapiens
aaaatgcaaacctacctacata

SEQ ID NO: 7093920 - DNA, 22 bp, Homo sapiens
aaaatgtaaagcttgagtgtag

SEQ ID NO: 7093921 - DNA, 22 bp, Homo sapiens
aaaatgtaaagcttgagtgtag

SEQ ID NO: 7093922 - DNA, 22 bp, Homo sapiens
aaaatgggtttcttcaacctca

SEQ ID NO: 7093923 - DNA, 18 bp, Homo sapiens
aaaatgcaggcgacatgg

SEQ ID NO: 7093924 - DNA, 18 bp, Homo sapiens
aaaatgcaggcgacatgg

SEQ ID NO: 7093925 - DNA, 22 bp, Homo sapiens
aaaatgcatgagaatgtgctcg

SEQ ID NO: 7093926 - DNA, 18 bp, Homo sapiens
aaaatgcaggcgacatgg

SEQ ID NO: 7093927 - DNA, 18 bp, Homo sapiens
aaaatgcaggcgacatgg

SEQ ID NO: 7093928 - DNA, 18 bp, Homo sapiens
aaaatgcaggcgacatgg

SEQ ID NO: 7093929 - DNA, 18 bp, Homo sapiens
aaaatgcaggcgacatgg

SEQ ID NO: 7093930 - DNA, 22 bp, Homo sapiens
aaaatgcatgagaatgtgctcg

SEQ ID NO: 7093931 - DNA, 22 bp, Homo sapiens
aaaatgcatgagaatgtgctcg

SEQ ID NO: 7093932 - DNA, 22 bp, Homo sapiens
aaagcagggtccaaggagatgt

SEQ ID NO: 7093933 - DNA, 22 bp, Homo sapiens
aaaattgtaggaactgaatcaa

SEQ ID NO: 7093934 - DNA, 22 bp, Homo sapiens
aaaattgtaggaactgaatcaa

SEQ ID NO: 7093935 - DNA, 22 bp, Homo sapiens
aaagcagggaaatctatttgca

SEQ ID NO: 7093936 - DNA, 22 bp, Homo sapiens
aaagcagggatgaggctagagg

SEQ ID NO: 7093937 - DNA, 22 bp, Homo sapiens
aaagcagggatgaggctagagg

SEQ ID NO: 7093938 - DNA, 22 bp, Homo sapiens
aaagcagggcgatgtcctcctc

SEQ ID NO: 7093939 - DNA, 22 bp, Homo sapiens
aaagcagggtccaaggagatgt

SEQ ID NO: 7093940 - DNA, 22 bp, Homo sapiens
aaagcagggtccaaggagatgt

SEQ ID NO: 7093941 - DNA, 22 bp, Homo sapiens
aaagcagcggtgtctttactgc

SEQ ID NO: 7093942 - DNA, 22 bp, Homo sapiens
aaagcagcctgctcatcctgga

SEQ ID NO: 7093943 - DNA, 22 bp, Homo sapiens
aaagcagctgatagtctcatct

SEQ ID NO: 7093944 - DNA, 22 bp, Homo sapiens
aaagcagctgatctcagagcct

SEQ ID NO: 7093945 - DNA, 22 bp, Homo sapiens
aaagcagctgctctggccttga

SEQ ID NO: 7093946 - DNA, 22 bp, Homo sapiens
aaagcagctgctctggccttga

SEQ ID NO: 7093947 - DNA, 22 bp, Homo sapiens
aaagcagctgtttgactttcca

SEQ ID NO: 7093948 - DNA, 22 bp, Homo sapiens
aaagcaggcagcaggctggatt

SEQ ID NO: 7093949 - DNA, 22 bp, Homo sapiens
aaagcaggcagcaggctggatt

SEQ ID NO: 7093950 - DNA, 22 bp, Homo sapiens
aaaatgtatgatggaggtgcta

SEQ ID NO: 7093951 - DNA, 21 bp, Homo sapiens
aaaatgtagacttttccctga

SEQ ID NO: 7093952 - DNA, 22 bp, Homo sapiens
aaagcaatggatgagaatctgt

SEQ ID NO: 7093953 - DNA, 22 bp, Homo sapiens
aaagcaatggatgagaatctgt

SEQ ID NO: 7093954 - DNA, 22 bp, Homo sapiens
aaagcagcagcacgtggaagag

SEQ ID NO: 7093955 - DNA, 22 bp, Homo sapiens
aaagcagcagcacgtggaagag

SEQ ID NO: 7093956 - DNA, 22 bp, Homo sapiens
aaagcagcagttccatcacctg

SEQ ID NO: 7093957 - DNA, 22 bp, Homo sapiens
aaagcagccacagagagagcgt

SEQ ID NO: 7093958 - DNA, 22 bp, Homo sapiens
aaagcagcagcacctgcatttc

SEQ ID NO: 7093959 - DNA, 22 bp, Homo sapiens
aaagcagcagcacctgcatttc

SEQ ID NO: 7093960 - DNA, 22 bp, Homo sapiens
aaagcagcctgctcatcctgga

SEQ ID NO: 7093961 - DNA, 22 bp, Homo sapiens
aaagcagccacagagagagcgt

SEQ ID NO: 7093962 - DNA, 22 bp, Homo sapiens
aaagcagccacagagagagcgt

SEQ ID NO: 7093963 - DNA, 22 bp, Homo sapiens
aaagcagccactctctctgcct

SEQ ID NO: 7093964 - DNA, 23 bp, Homo sapiens
aaaacagcttcctccagtggctc

SEQ ID NO: 7093965 - DNA, 23 bp, Homo sapiens
aaaacagcttcctccagtggctc

SEQ ID NO: 7093966 - DNA, 22 bp, Homo sapiens
aaaacagaggtgcctgggccca

SEQ ID NO: 7093967 - DNA, 22 bp, Homo sapiens
aaaacagacagccagtgtagag

SEQ ID NO: 7093968 - DNA, 22 bp, Homo sapiens
aaaacagaggtgcctgggccca

SEQ ID NO: 7093969 - DNA, 22 bp, Homo sapiens
aaaacagacagccagtgtagag

SEQ ID NO: 7093970 - DNA, 22 bp, Homo sapiens
aaaacagacagccagtgtagag

SEQ ID NO: 7093971 - DNA, 22 bp, Homo sapiens
aaaacagacagccagtgtagag

SEQ ID NO: 7093972 - DNA, 22 bp, Homo sapiens
aaaacactgcctgcttgactga

SEQ ID NO: 7093973 - DNA, 22 bp, Homo sapiens
aaaacactgcctgcttgactga

SEQ ID NO: 7093974 - DNA, 22 bp, Homo sapiens
aaaacactgcctgcttgactga

SEQ ID NO: 7093975 - DNA, 22 bp, Homo sapiens
aaaacactgcctgcttgactga

SEQ ID NO: 7093976 - DNA, 22 bp, Homo sapiens
aaaacactgcaaagctgattgg

SEQ ID NO: 7093977 - DNA, 22 bp, Homo sapiens
aaaacacaagaagcagggtaca

SEQ ID NO: 7093978 - DNA, 22 bp, Homo sapiens
aaaacacactggaccaatttaa

SEQ ID NO: 7093979 - DNA, 22 bp, Homo sapiens
aaaacacactggaccaatttaa

SEQ ID NO: 7093980 - DNA, 22 bp, Homo sapiens
aaaacacactggaccaatttaa

SEQ ID NO: 7093981 - DNA, 22 bp, Homo sapiens
aaaacagtttttgctaactgct

SEQ ID NO: 7093982 - DNA, 22 bp, Homo sapiens
aaaagagcttggttgattttgc

SEQ ID NO: 7093983 - DNA, 22 bp, Homo sapiens
aaaagagcttggttgattttgc

SEQ ID NO: 7093984 - DNA, 22 bp, Homo sapiens
aaaagagccacttatgacctca

SEQ ID NO: 7093985 - DNA, 22 bp, Homo sapiens
aaaacagtttaggcatcacagt

SEQ ID NO: 7093986 - DNA, 22 bp, Homo sapiens
aaaacagtttaggcatcacagt

SEQ ID NO: 7093987 - DNA, 22 bp, Homo sapiens
aaaacagtttttgctaactgct

SEQ ID NO: 7093988 - DNA, 22 bp, Homo sapiens
aaaacaggagttttggtaggct

SEQ ID NO: 7093989 - DNA, 22 bp, Homo sapiens
aaaacaggagttttggtaggct

SEQ ID NO: 7093990 - DNA, 22 bp, Homo sapiens
aaaacaggagttttggtaggct

SEQ ID NO: 7093991 - DNA, 22 bp, Homo sapiens
aaaacaggtgtcagcaaactat

SEQ ID NO: 7093992 - DNA, 22 bp, Homo sapiens
aaaacagttataaacagagtca

SEQ ID NO: 7093993 - DNA, 22 bp, Homo sapiens
aaaacagttataaacagagtca

SEQ ID NO: 7093994 - DNA, 22 bp, Homo sapiens
aaaacagttataaacagagtca

SEQ ID NO: 7093995 - DNA, 22 bp, Homo sapiens
aaaacagtttaggcatcacagt

SEQ ID NO: 7093996 - DNA, 20 bp, Homo sapiens
aaaagcagccagagatggta

SEQ ID NO: 7093997 - DNA, 22 bp, Homo sapiens
aaaagcagatctccaaagtcta

SEQ ID NO: 7093998 - DNA, 22 bp, Homo sapiens
aaaagcagagactctggagcta

SEQ ID NO: 7093999 - DNA, 22 bp, Homo sapiens
aaaagcagagactctggagcta

SEQ ID NO: 7094000 - DNA, 22 bp, Homo sapiens
aaaagcagagactctggagcta

SEQ ID NO: 7094001 - DNA, 22 bp, Homo sapiens
aaaagcagaccacgctttgtgg

SEQ ID NO: 7094002 - DNA, 22 bp, Homo sapiens
aaaagcaattgcgggttttgcc

SEQ ID NO: 7094003 - DNA, 22 bp, Homo sapiens
aaaagcaattgcgggttttgcc

SEQ ID NO: 7094004 - DNA, 22 bp, Homo sapiens
aaaagcactacaatttcgcttc

SEQ ID NO: 7094005 - DNA, 22 bp, Homo sapiens
aaaagcaattgcagttcttgcc

SEQ ID NO: 7094006 - DNA, 22 bp, Homo sapiens
aaaagcaattgcagttcttgcc

SEQ ID NO: 7094007 - DNA, 22 bp, Homo sapiens
aaaagcaagttgcctaggttga

SEQ ID NO: 7094008 - DNA, 22 bp, Homo sapiens
aaaagcagttatctgggaggaa

SEQ ID NO: 7094009 - DNA, 22 bp, Homo sapiens
aaaagcagtaaatgtatgacct

SEQ ID NO: 7094010 - DNA, 22 bp, Homo sapiens
aaaagcaggtactcagcttggg

SEQ ID NO: 7094011 - DNA, 22 bp, Homo sapiens
aaaagcagtaaatgtatgacct

SEQ ID NO: 7094012 - DNA, 22 bp, Homo sapiens
aaaagcagttatctgggaggaa

SEQ ID NO: 7094013 - DNA, 22 bp, Homo sapiens
aaaagcagtttatagtcagttg

SEQ ID NO: 7094014 - DNA, 22 bp, Homo sapiens
aaaagcagtttatagtcagttg

SEQ ID NO: 7094015 - DNA, 22 bp, Homo sapiens
aaaagcagtttatagtcagttg

SEQ ID NO: 7094016 - DNA, 20 bp, Homo sapiens
aaaagcagccagagatggta

SEQ ID NO: 7094017 - DNA, 20 bp, Homo sapiens
aaaagcagccagagatggta

SEQ ID NO: 7094018 - DNA, 22 bp, Homo sapiens
aaaagcaggtactcagcttggg

SEQ ID NO: 7094019 - DNA, 22 bp, Homo sapiens
aaaagccaaggtcctcttcaga

SEQ ID NO: 7094020 - DNA, 22 bp, Homo sapiens
aaaagccatgcatacctaagag

SEQ ID NO: 7094021 - DNA, 22 bp, Homo sapiens
aaaagcatctcaaaggagcttc

SEQ ID NO: 7094022 - DNA, 22 bp, Homo sapiens
aaaagcatctcaaaggagcttc

SEQ ID NO: 7094023 - DNA, 22 bp, Homo sapiens
aaaagcattacatggtacgtat

SEQ ID NO: 7094024 - DNA, 22 bp, Homo sapiens
aaaagccaaggtcctcttcaga

SEQ ID NO: 7094025 - DNA, 22 bp, Homo sapiens
aaaaccaagttttccttagtct

SEQ ID NO: 7094026 - DNA, 22 bp, Homo sapiens
aaaaccaagttttccttagtct

SEQ ID NO: 7094027 - DNA, 22 bp, Homo sapiens
aaaacattttactgccatctca

SEQ ID NO: 7094028 - DNA, 22 bp, Homo sapiens
aaaacattgaattgcacactat

SEQ ID NO: 7094029 - DNA, 22 bp, Homo sapiens
aaaacattgaattgcacactat

SEQ ID NO: 7094030 - DNA, 22 bp, Homo sapiens
aaaacattgaattgcacactat

SEQ ID NO: 7094031 - DNA, 22 bp, Homo sapiens
aaaacattgaattgcacactat

SEQ ID NO: 7094032 - DNA, 22 bp, Homo sapiens
aaaacatgtccatacagaaact

SEQ ID NO: 7094033 - DNA, 22 bp, Homo sapiens
aaaacatgtccatacagaaact

SEQ ID NO: 7094034 - DNA, 22 bp, Homo sapiens
aaaacatgtccatacagaaact

SEQ ID NO: 7094035 - DNA, 22 bp, Homo sapiens
aaaacatgtccatacagaaact

SEQ ID NO: 7094036 - DNA, 22 bp, Homo sapiens
aaaacatgtccatacagaaact

SEQ ID NO: 7094037 - DNA, 22 bp, Homo sapiens
aaaacattctgtgaactctcaa

SEQ ID NO: 7094038 - DNA, 22 bp, Homo sapiens
aaaacattctgtgaactctcaa

SEQ ID NO: 7094039 - DNA, 22 bp, Homo sapiens
aaaacattctgtgaactctcaa

SEQ ID NO: 7094040 - DNA, 22 bp, Homo sapiens
aaaacattctgtgaactctcaa

SEQ ID NO: 7094041 - DNA, 22 bp, Homo sapiens
aaaaccacaaaagtggcttggt

SEQ ID NO: 7094042 - DNA, 22 bp, Homo sapiens
aaaaccacaatgacttttgcac

SEQ ID NO: 7094043 - DNA, 22 bp, Homo sapiens
aaaaccacaatgacttttgcag

SEQ ID NO: 7094044 - DNA, 22 bp, Homo sapiens
aaaaccacaattacttttgcac

SEQ ID NO: 7094045 - DNA, 22 bp, Homo sapiens
aaaaccacagttacttttgcac

SEQ ID NO: 7094046 - DNA, 22 bp, Homo sapiens
aaaaccacttccttgctattgg

SEQ ID NO: 7094047 - DNA, 22 bp, Homo sapiens
aaaaccacttccttgctattgg

SEQ ID NO: 7094048 - DNA, 22 bp, Homo sapiens
aaaaccacttccttgctattgg

SEQ ID NO: 7094049 - DNA, 22 bp, Homo sapiens
aaaaccagacactgtttctggg

SEQ ID NO: 7094050 - DNA, 22 bp, Homo sapiens
aaaaccagacactgtttctggg

SEQ ID NO: 7094051 - DNA, 22 bp, Homo sapiens
aaaaccaggcgtttcctattat

SEQ ID NO: 7094052 - DNA, 22 bp, Homo sapiens
aaaagaggttaaccaggtgtgt

SEQ ID NO: 7094053 - DNA, 22 bp, Homo sapiens
aaaagaggttaaccaggtgtgt

SEQ ID NO: 7094054 - DNA, 22 bp, Homo sapiens
aaaagagtcttaggcagtcata

SEQ ID NO: 7094055 - DNA, 22 bp, Homo sapiens
aaaagagtcttaggcagtcata

SEQ ID NO: 7094056 - DNA, 22 bp, Homo sapiens
aaaagagtcttaggcagtcata

SEQ ID NO: 7094057 - DNA, 22 bp, Homo sapiens
aaaagagtgactgataagtata

SEQ ID NO: 7094058 - DNA, 22 bp, Homo sapiens
aaaagagtgactgataagtata

SEQ ID NO: 7094059 - DNA, 22 bp, Homo sapiens
aaaacacaagaagcagggtaca

SEQ ID NO: 7094060 - DNA, 22 bp, Homo sapiens
aaaacacaagaagcagggtaca

SEQ ID NO: 7094061 - DNA, 22 bp, Homo sapiens
aaaaattgctgagaacggaatt

SEQ ID NO: 7094062 - DNA, 22 bp, Homo sapiens
aaaaattgctgagaacggaatt

SEQ ID NO: 7094063 - DNA, 22 bp, Homo sapiens
aaaaatttatggttcttctctg

SEQ ID NO: 7094064 - DNA, 22 bp, Homo sapiens
aaaaatgaaacggctggttggc

SEQ ID NO: 7094065 - DNA, 22 bp, Homo sapiens
aaaaatgttatctactgtccga

SEQ ID NO: 7094066 - DNA, 20 bp, Homo sapiens
aaaaattgatatcgcttcct

SEQ ID NO: 7094067 - DNA, 22 bp, Homo sapiens
aaaagcaagaggctggattaaa

SEQ ID NO: 7094068 - DNA, 22 bp, Homo sapiens
aaaagagtgtttcaactttggc

SEQ ID NO: 7094069 - DNA, 22 bp, Homo sapiens
aaaagatgaaatggtgtcttgg

SEQ ID NO: 7094070 - DNA, 22 bp, Homo sapiens
aaaagatgaaatggtgtcttgg

SEQ ID NO: 7094071 - DNA, 22 bp, Homo sapiens
aaaagcaagaggctggattaaa

SEQ ID NO: 7094072 - DNA, 22 bp, Homo sapiens
aaaagcaaggcagtctgtctga

SEQ ID NO: 7094073 - DNA, 22 bp, Homo sapiens
aaaagcaaggcagtctgtctga

SEQ ID NO: 7094074 - DNA, 22 bp, Homo sapiens
aaaagcaaggcagtctgtctga

SEQ ID NO: 7094075 - DNA, 22 bp, Homo sapiens
aaaagcaaggcagtctgtctga

SEQ ID NO: 7094076 - DNA, 22 bp, Homo sapiens
aaaagcaagttgcctaggttga

SEQ ID NO: 7094077 - DNA, 22 bp, Homo sapiens
aaaagcaagttgcctaggttga

SEQ ID NO: 7094078 - DNA, 22 bp, Homo sapiens
aaaagcaagttgcctaggttga

SEQ ID NO: 7094079 - DNA, 22 bp, Homo sapiens
agaagccagccttgcctccttt

SEQ ID NO: 7094080 - DNA, 22 bp, Homo sapiens
agaagccagattgtagtgggac

SEQ ID NO: 7094081 - DNA, 22 bp, Homo sapiens
agaagccagtcgctctcccgca

SEQ ID NO: 7094082 - DNA, 22 bp, Homo sapiens
agaagccagtcgctctcccgca

SEQ ID NO: 7094083 - DNA, 22 bp, Homo sapiens
agaagccagcttcagctgcccg

SEQ ID NO: 7094084 - DNA, 22 bp, Homo sapiens
agaagccagcttcagctgcccg

SEQ ID NO: 7094085 - DNA, 22 bp, Homo sapiens
agaagccagcttcagctgcccg

SEQ ID NO: 7094086 - DNA, 22 bp, Homo sapiens
agaagcttgaaggagcagtgac

SEQ ID NO: 7094087 - DNA, 22 bp, Homo sapiens
agaagctgttgcattcctggcg

SEQ ID NO: 7094088 - DNA, 22 bp, Homo sapiens
agaaggaaaacctgtcttatgt

SEQ ID NO: 7094089 - DNA, 22 bp, Homo sapiens
agaaggaaaacctgtcttatgt

SEQ ID NO: 7094090 - DNA, 22 bp, Homo sapiens
agaaggaaaacctgtcttatgt

SEQ ID NO: 7094091 - DNA, 22 bp, Homo sapiens
agaaggaaacagctgtgctttg

SEQ ID NO: 7094092 - DNA, 22 bp, Homo sapiens
agaaggaaacagctgtgctttg

SEQ ID NO: 7094093 - DNA, 22 bp, Homo sapiens
agaaggaaacagctgtgctttg

SEQ ID NO: 7094094 - DNA, 18 bp, Homo sapiens
agaaggagctatgggcag

SEQ ID NO: 7094095 - DNA, 22 bp, Homo sapiens
agaaggacccggtgggagatga

SEQ ID NO: 7094096 - DNA, 18 bp, Homo sapiens
aatgcaatgtatttgcag

SEQ ID NO: 7094097 - DNA, 22 bp, Homo sapiens
aatgcacaaaaattgtatgtaa

SEQ ID NO: 7094098 - DNA, 22 bp, Homo sapiens
aatgcacaaaaattgtatgtaa

SEQ ID NO: 7094099 - DNA, 22 bp, Homo sapiens
agaaggaaggctgagtgctgat

SEQ ID NO: 7094100 - DNA, 22 bp, Homo sapiens
agaaggaaggataactgcatta

SEQ ID NO: 7094101 - DNA, 22 bp, Homo sapiens
agaaggaaggataactgcatta

SEQ ID NO: 7094102 - DNA, 22 bp, Homo sapiens
agaaggaaggctgagtgctgat

SEQ ID NO: 7094103 - DNA, 22 bp, Homo sapiens
agaaggaaggctgagtgctgat

SEQ ID NO: 7094104 - DNA, 22 bp, Homo sapiens
agaaggaaggctgagtgctgat

SEQ ID NO: 7094105 - DNA, 22 bp, Homo sapiens
agaaggaagccaggagggtgca

SEQ ID NO: 7094106 - DNA, 22 bp, Homo sapiens
agaaggaagccaggagggtgca

SEQ ID NO: 7094107 - DNA, 22 bp, Homo sapiens
agaaggaaggaagcattctgtt

SEQ ID NO: 7094108 - DNA, 22 bp, Homo sapiens
agaaggaaggaagcattctgtt

SEQ ID NO: 7094109 - DNA, 22 bp, Homo sapiens
agaaggaaggataactgcatta

SEQ ID NO: 7094110 - DNA, 23 bp, Homo sapiens
aatgccatattggatttcttcag

SEQ ID NO: 7094111 - DNA, 22 bp, Homo sapiens
aatgccatcagagaaaactctt

SEQ ID NO: 7094112 - DNA, 22 bp, Homo sapiens
aatgccatcagagaaaactctt

SEQ ID NO: 7094113 - DNA, 22 bp, Homo sapiens
aatgccatccctctgtcaccaa

SEQ ID NO: 7094114 - DNA, 22 bp, Homo sapiens
aatgccatctggtgatgtatta

SEQ ID NO: 7094115 - DNA, 18 bp, Homo sapiens
aatgcatttatggagatg

SEQ ID NO: 7094116 - DNA, 22 bp, Homo sapiens
aatgcattttattatatgtgac

SEQ ID NO: 7094117 - DNA, 22 bp, Homo sapiens
aatgccaacttggatatacatt

SEQ ID NO: 7094118 - DNA, 22 bp, Homo sapiens
aatgccatgctaagggcttggt

SEQ ID NO: 7094119 - DNA, 22 bp, Homo sapiens
aatgccattccatcacacacct

SEQ ID NO: 7094120 - DNA, 22 bp, Homo sapiens
aatgccattccatcacacacct

SEQ ID NO: 7094121 - DNA, 22 bp, Homo sapiens
aatgccattgatttatatactt

SEQ ID NO: 7094122 - DNA, 16 bp, Homo sapiens
aatgccatttagaggt

SEQ ID NO: 7094123 - DNA, 22 bp, Homo sapiens
aatgccattttaggcatgtcct

SEQ ID NO: 7094124 - DNA, 22 bp, Homo sapiens
aatgccattttctataaaaaga

SEQ ID NO: 7094125 - DNA, 22 bp, Homo sapiens
aatgcccccaggcctggaggag

SEQ ID NO: 7094126 - DNA, 22 bp, Homo sapiens
aatgcctaagtaattattttga

SEQ ID NO: 7094127 - DNA, 19 bp, Homo sapiens
aatgcctcaaattgggaga

SEQ ID NO: 7094128 - DNA, 19 bp, Homo sapiens
aatgcctcagagacttaag

SEQ ID NO: 7094129 - DNA, 22 bp, Homo sapiens
aatgcctcagcagttattattc

SEQ ID NO: 7094130 - DNA, 22 bp, Homo sapiens
aatgcctcgccttatttatttt

SEQ ID NO: 7094131 - DNA, 22 bp, Homo sapiens
aatgcctcttggaagaagactt

SEQ ID NO: 7094132 - DNA, 22 bp, Homo sapiens
aatgcctctttggagttatttc

SEQ ID NO: 7094133 - DNA, 22 bp, Homo sapiens
aatgcctcttttctccagtcca

SEQ ID NO: 7094134 - DNA, 22 bp, Homo sapiens
aatgcctggcgattagtgtagc

SEQ ID NO: 7094135 - DNA, 22 bp, Homo sapiens
aatgccttcaagtatctgagga

SEQ ID NO: 7094136 - DNA, 22 bp, Homo sapiens
aatgccttcccatttatacttt

SEQ ID NO: 7094137 - DNA, 22 bp, Homo sapiens
aatgcatacgtgtttgtggcaa

SEQ ID NO: 7094138 - DNA, 22 bp, Homo sapiens
aatgcataccatgtcatctttg

SEQ ID NO: 7094139 - DNA, 22 bp, Homo sapiens
aatgcataccatgtcatctttg

SEQ ID NO: 7094140 - DNA, 22 bp, Homo sapiens
aatgcataccatgtcatctttg

SEQ ID NO: 7094141 - DNA, 19 bp, Homo sapiens
aatgcatggaagttggaga

SEQ ID NO: 7094142 - DNA, 22 bp, Homo sapiens
aatgcatgtattcattgtggaa

SEQ ID NO: 7094143 - DNA, 22 bp, Homo sapiens
aatgcatgtttcctctcagcag

SEQ ID NO: 7094144 - DNA, 22 bp, Homo sapiens
aatgcatgtttcctctcagcag

SEQ ID NO: 7094145 - DNA, 22 bp, Homo sapiens
aatgcattaaagttagagactt

SEQ ID NO: 7094146 - DNA, 22 bp, Homo sapiens
aatgcattaaagttagagactt

SEQ ID NO: 7094147 - DNA, 22 bp, Homo sapiens
aatgcattaaagttagagactt

SEQ ID NO: 7094148 - DNA, 22 bp, Homo sapiens
aatgcattgttgatttggagtg

SEQ ID NO: 7094149 - DNA, 18 bp, Homo sapiens
aatgcatttatggagatg

SEQ ID NO: 7094150 - DNA, 22 bp, Homo sapiens
aatgcattctttcatggacctg

SEQ ID NO: 7094151 - DNA, 22 bp, Homo sapiens
aatgcattgattgctggaaata

SEQ ID NO: 7094152 - DNA, 22 bp, Homo sapiens
aatgcattgattgctggaaata

SEQ ID NO: 7094153 - DNA, 22 bp, Homo sapiens
aatgcattccactgagatttgt

SEQ ID NO: 7094154 - DNA, 22 bp, Homo sapiens
aatgcattccactgagatttgt

SEQ ID NO: 7094155 - DNA, 22 bp, Homo sapiens
aatgcattctcggtttgtgtgt

SEQ ID NO: 7094156 - DNA, 22 bp, Homo sapiens
aatgcattctcggtttgtgtgt

SEQ ID NO: 7094157 - DNA, 22 bp, Homo sapiens
aatgcattctcggtttgtgtgt

SEQ ID NO: 7094158 - DNA, 21 bp, Homo sapiens
aatgcattaacataaagctga

SEQ ID NO: 7094159 - DNA, 21 bp, Homo sapiens
aatgcattaacataaagctga

SEQ ID NO: 7094160 - DNA, 21 bp, Homo sapiens
aatgcattaacataaagctga

SEQ ID NO: 7094161 - DNA, 23 bp, Homo sapiens
aatgcattaatttgggagagtac

SEQ ID NO: 7094162 - DNA, 23 bp, Homo sapiens
aatgcattaatttgggagagtac

SEQ ID NO: 7094163 - DNA, 22 bp, Homo sapiens
aatgcattagctacatatgtct

SEQ ID NO: 7094164 - DNA, 18 bp, Homo sapiens
agaagccacgaggagtcc

SEQ ID NO: 7094165 - DNA, 22 bp, Homo sapiens
agaagccactggaggttgagat

SEQ ID NO: 7094166 - DNA, 22 bp, Homo sapiens
agaagccactgctcccagtgag

SEQ ID NO: 7094167 - DNA, 22 bp, Homo sapiens
agaagccactgctcccagtgag

SEQ ID NO: 7094168 - DNA, 22 bp, Homo sapiens
agaagccagaggcagtgggtac

SEQ ID NO: 7094169 - DNA, 22 bp, Homo sapiens
agaagccagaggcagtgggtac

SEQ ID NO: 7094170 - DNA, 22 bp, Homo sapiens
agaagccagaatattcatggat

SEQ ID NO: 7094171 - DNA, 22 bp, Homo sapiens
agaagccagaatattcatggat

SEQ ID NO: 7094172 - DNA, 22 bp, Homo sapiens
aatgaatgaaccacatataaca

SEQ ID NO: 7094173 - DNA, 22 bp, Homo sapiens
aatgaatgaaccacatataaca

SEQ ID NO: 7094174 - DNA, 22 bp, Homo sapiens
agaagcagctttcaaggtgatt

SEQ ID NO: 7094175 - DNA, 22 bp, Homo sapiens
agaagcagctttcaaggtgatt

SEQ ID NO: 7094176 - DNA, 22 bp, Homo sapiens
agaagcagctttcaaggtgatt

SEQ ID NO: 7094177 - DNA, 22 bp, Homo sapiens
agaagcagctttcaaggtgatt

SEQ ID NO: 7094178 - DNA, 22 bp, Homo sapiens
agaagcagctttcaaggtgatt

SEQ ID NO: 7094179 - DNA, 22 bp, Homo sapiens
aatgaataacaatcctctggag

SEQ ID NO: 7094180 - DNA, 22 bp, Homo sapiens
aatgaataccgtttcactcagt

SEQ ID NO: 7094181 - DNA, 22 bp, Homo sapiens
aatgaataccgtttcactcagt

SEQ ID NO: 7094182 - DNA, 20 bp, Homo sapiens
aatgaagttattaatgatgt

SEQ ID NO: 7094183 - DNA, 22 bp, Homo sapiens
aatgaagtgttatttagtttca

SEQ ID NO: 7094184 - DNA, 22 bp, Homo sapiens
aatgaagtgtttagaagtttta

SEQ ID NO: 7094185 - DNA, 22 bp, Homo sapiens
aatgaagccaggtagaagagaa

SEQ ID NO: 7094186 - DNA, 22 bp, Homo sapiens
aatgaagccaggtagaagagaa

SEQ ID NO: 7094187 - DNA, 22 bp, Homo sapiens
aatgaagcaagctgctgtgttt

SEQ ID NO: 7094188 - DNA, 22 bp, Homo sapiens
aatgaagcagtccatctgctct

SEQ ID NO: 7094189 - DNA, 22 bp, Homo sapiens
aatgaagcagtccatctgctct

SEQ ID NO: 7094190 - DNA, 22 bp, Homo sapiens
aatgaagacacatctttctcat

SEQ ID NO: 7094191 - DNA, 22 bp, Homo sapiens
aatgaagattatggtgattaag

SEQ ID NO: 7094192 - DNA, 22 bp, Homo sapiens
aatgaagattatggtgattaag

SEQ ID NO: 7094193 - DNA, 22 bp, Homo sapiens
aatgaagattatggtgattaag

SEQ ID NO: 7094194 - DNA, 22 bp, Homo sapiens
agaactgtcacgagtgacaaag

SEQ ID NO: 7094195 - DNA, 22 bp, Homo sapiens
agaactctatattcatgaacaa

SEQ ID NO: 7094196 - DNA, 22 bp, Homo sapiens
agaactctcgctggatcagact

SEQ ID NO: 7094197 - DNA, 22 bp, Homo sapiens
agaactctcgctggatcagact

SEQ ID NO: 7094198 - DNA, 22 bp, Homo sapiens
agaactctttatctgtggaatg

SEQ ID NO: 7094199 - DNA, 21 bp, Homo sapiens
agaactgattaaataagcagt

SEQ ID NO: 7094200 - DNA, 22 bp, Homo sapiens
agaacacactgggggaaacaag

SEQ ID NO: 7094201 - DNA, 22 bp, Homo sapiens
aatctatatgcttttcacatac

SEQ ID NO: 7094202 - DNA, 22 bp, Homo sapiens
agaacacacgtcagagtttcct

SEQ ID NO: 7094203 - DNA, 22 bp, Homo sapiens
agaacgaatgcttcagctctag

SEQ ID NO: 7094204 - DNA, 22 bp, Homo sapiens
agaactattgcaataacaagaa

SEQ ID NO: 7094205 - DNA, 19 bp, Homo sapiens
agaactcagtatcttttct

SEQ ID NO: 7094206 - DNA, 22 bp, Homo sapiens
agaactctaggattggctggat

SEQ ID NO: 7094207 - DNA, 22 bp, Homo sapiens
agaactctaggattggctggat

SEQ ID NO: 7094208 - DNA, 22 bp, Homo sapiens
aatgaagaaatggacatcttta

SEQ ID NO: 7094209 - DNA, 22 bp, Homo sapiens
aatgaacttcagtgatttctgg

SEQ ID NO: 7094210 - DNA, 22 bp, Homo sapiens
aatgaagaaatggacatcttta

SEQ ID NO: 7094211 - DNA, 22 bp, Homo sapiens
aatgaagaaatggacatcttta

SEQ ID NO: 7094212 - DNA, 22 bp, Homo sapiens
agaagaaatgaggccgttctgc

SEQ ID NO: 7094213 - DNA, 22 bp, Homo sapiens
aatgaactgtgttaactgaata

SEQ ID NO: 7094214 - DNA, 22 bp, Homo sapiens
agaagaaactgtcggggatatt

SEQ ID NO: 7094215 - DNA, 22 bp, Homo sapiens
agaagaaagattgaaggttcct

SEQ ID NO: 7094216 - DNA, 22 bp, Homo sapiens
agaagaaagattgaaggttcct

SEQ ID NO: 7094217 - DNA, 22 bp, Homo sapiens
agaagaaagattgaaggttcct

SEQ ID NO: 7094218 - DNA, 22 bp, Homo sapiens
agaagaaagattgaaggttcct

SEQ ID NO: 7094219 - DNA, 22 bp, Homo sapiens
agaagaaagattgaaggttcct

SEQ ID NO: 7094220 - DNA, 22 bp, Homo sapiens
agaagaaagattgaaggttcct

SEQ ID NO: 7094221 - DNA, 22 bp, Homo sapiens
agaagaaagattgaaggttcct

SEQ ID NO: 7094222 - DNA, 22 bp, Homo sapiens
agaactgtccccagagagcact

SEQ ID NO: 7094223 - DNA, 22 bp, Homo sapiens
agaactgtccttggaggagagt

SEQ ID NO: 7094224 - DNA, 22 bp, Homo sapiens
agaagaaactgtcggggatatt

SEQ ID NO: 7094225 - DNA, 22 bp, Homo sapiens
agaagaaactgtcggggatatt

SEQ ID NO: 7094226 - DNA, 22 bp, Homo sapiens
agaagaaactgtcggggatatt

SEQ ID NO: 7094227 - DNA, 22 bp, Homo sapiens
agaagaaactgtcggggatatt

SEQ ID NO: 7094228 - DNA, 22 bp, Homo sapiens
acttttatcaaggaagtgatct

SEQ ID NO: 7094229 - DNA, 22 bp, Homo sapiens
acttttatgataatcaatgttc

SEQ ID NO: 7094230 - DNA, 22 bp, Homo sapiens
acttttatgataatcaatgttc

SEQ ID NO: 7094231 - DNA, 22 bp, Homo sapiens
acttttatgataatcaatgttc

SEQ ID NO: 7094232 - DNA, 22 bp, Homo sapiens
acttttatgataatcaatgttc

SEQ ID NO: 7094233 - DNA, 22 bp, Homo sapiens
acttttaaggggccttgattta

SEQ ID NO: 7094234 - DNA, 22 bp, Homo sapiens
acttttaaggggccttgattta

SEQ ID NO: 7094235 - DNA, 22 bp, Homo sapiens
acttttaaggggccttgattta

SEQ ID NO: 7094236 - DNA, 22 bp, Homo sapiens
acttttaaggggccttgattta

SEQ ID NO: 7094237 - DNA, 22 bp, Homo sapiens
acttttatcaaggaagtgatct

SEQ ID NO: 7094238 - DNA, 22 bp, Homo sapiens
acttttatcaaggaagtgatct

SEQ ID NO: 7094239 - DNA, 22 bp, Homo sapiens
acttttcaaatgggaaactcag

SEQ ID NO: 7094240 - DNA, 22 bp, Homo sapiens
aatcaagagttgtgtaatattt

SEQ ID NO: 7094241 - DNA, 22 bp, Homo sapiens
aatcaagagttgtgtaatattt

SEQ ID NO: 7094242 - DNA, 22 bp, Homo sapiens
aatcaagtcaaccatcatgtgc

SEQ ID NO: 7094243 - DNA, 23 bp, Homo sapiens
aatcaagttttgatgaggaagcc

SEQ ID NO: 7094244 - DNA, 22 bp, Homo sapiens
aatcaatgttagtcatgaattt

SEQ ID NO: 7094245 - DNA, 22 bp, Homo sapiens
actttgttgatgaaatagtttt

SEQ ID NO: 7094246 - DNA, 22 bp, Homo sapiens
actttgttgttccttgtctaaa

SEQ ID NO: 7094247 - DNA, 22 bp, Homo sapiens
actttgttgttccttgtctaaa

SEQ ID NO: 7094248 - DNA, 22 bp, Homo sapiens
actttgttgatgaaatagtttt

SEQ ID NO: 7094249 - DNA, 22 bp, Homo sapiens
actttgttgaagaatatgttag

SEQ ID NO: 7094250 - DNA, 22 bp, Homo sapiens
actttgttgaagaatatgttag

SEQ ID NO: 7094251 - DNA, 22 bp, Homo sapiens
actttgttgaagaatatgttag

SEQ ID NO: 7094252 - DNA, 22 bp, Homo sapiens
actttgaatttttgtgggtagc

SEQ ID NO: 7094253 - DNA, 22 bp, Homo sapiens
actttgacagcattttaattat

SEQ ID NO: 7094254 - DNA, 22 bp, Homo sapiens
actttgcaaaaggaaatcacct

SEQ ID NO: 7094255 - DNA, 22 bp, Homo sapiens
acttttaaatgagtttcagttg

SEQ ID NO: 7094256 - DNA, 22 bp, Homo sapiens
acttttaaatgagtttcagttg

SEQ ID NO: 7094257 - DNA, 22 bp, Homo sapiens
acttttaaatgagtttcagttg

SEQ ID NO: 7094258 - DNA, 22 bp, Homo sapiens
acttttaaatgagtttcagttg

SEQ ID NO: 7094259 - DNA, 22 bp, Homo sapiens
acttttaaatgagtttcagttg

SEQ ID NO: 7094260 - DNA, 22 bp, Homo sapiens
acttttaaatgagtttcagttg

SEQ ID NO: 7094261 - DNA, 22 bp, Homo sapiens
actttgtttccatatttgtagc

SEQ ID NO: 7094262 - DNA, 22 bp, Homo sapiens
actttgttttatagcacataag

SEQ ID NO: 7094263 - DNA, 22 bp, Homo sapiens
actttgttttcatgaaacagct

SEQ ID NO: 7094264 - DNA, 22 bp, Homo sapiens
aataggtagccagatatataaa

SEQ ID NO: 7094265 - DNA, 22 bp, Homo sapiens
aataggtctgatagtatacctt

SEQ ID NO: 7094266 - DNA, 22 bp, Homo sapiens
aatagtacaatctacagacata

SEQ ID NO: 7094267 - DNA, 22 bp, Homo sapiens
aataggcagttggatatgcaag

SEQ ID NO: 7094268 - DNA, 22 bp, Homo sapiens
aataggaagcaccaaattctcc

SEQ ID NO: 7094269 - DNA, 22 bp, Homo sapiens
aatagcttattgacagtgaatt

SEQ ID NO: 7094270 - DNA, 22 bp, Homo sapiens
aatagcttattgacagtgaatt

SEQ ID NO: 7094271 - DNA, 22 bp, Homo sapiens
aatagcttggacccattgcttt

SEQ ID NO: 7094272 - DNA, 22 bp, Homo sapiens
aatagccaaagtgcatttatga

SEQ ID NO: 7094273 - DNA, 22 bp, Homo sapiens
aatagcatgttcatgataaaat

SEQ ID NO: 7094274 - DNA, 22 bp, Homo sapiens
aatagcatgtaagtttaaaaga

SEQ ID NO: 7094275 - DNA, 22 bp, Homo sapiens
aatagcatgtaagtttaaaaga

SEQ ID NO: 7094276 - DNA, 22 bp, Homo sapiens
aatagctgagggtgaggcccaa

SEQ ID NO: 7094277 - DNA, 17 bp, Homo sapiens
aatagctgctcagagag

SEQ ID NO: 7094278 - DNA, 17 bp, Homo sapiens
aatagctgctcagagag

SEQ ID NO: 7094279 - DNA, 23 bp, Homo sapiens
aatagctggtaatgatagcacaa

SEQ ID NO: 7094280 - DNA, 22 bp, Homo sapiens
aatagctgggaggcacattcat

SEQ ID NO: 7094281 - DNA, 22 bp, Homo sapiens
aatagcttagtcctgattctgt

SEQ ID NO: 7094282 - DNA, 22 bp, Homo sapiens
aatcgcttggtaattttaaaag

SEQ ID NO: 7094283 - DNA, 22 bp, Homo sapiens
aatctaagccaccagtagtttc

SEQ ID NO: 7094284 - DNA, 22 bp, Homo sapiens
aatcctggcctagctgggctca

SEQ ID NO: 7094285 - DNA, 22 bp, Homo sapiens
aatcctggctgcgttggccagc

SEQ ID NO: 7094286 - DNA, 22 bp, Homo sapiens
agaaagggatgaggtagctgct

SEQ ID NO: 7094287 - DNA, 22 bp, Homo sapiens
agaaagggaccagttcttttga

SEQ ID NO: 7094288 - DNA, 22 bp, Homo sapiens
agaaagggagagccagcacacg

SEQ ID NO: 7094289 - DNA, 22 bp, Homo sapiens
agaaagggagagccagcacacg

SEQ ID NO: 7094290 - DNA, 22 bp, Homo sapiens
agaaagggagcgtggatcaatt

SEQ ID NO: 7094291 - DNA, 22 bp, Homo sapiens
agaaaggcagggatgaggattg

SEQ ID NO: 7094292 - DNA, 22 bp, Homo sapiens
agaaaggcagggatgaggattg

SEQ ID NO: 7094293 - DNA, 17 bp, Homo sapiens
agaaaggcagttcctct

SEQ ID NO: 7094294 - DNA, 22 bp, Homo sapiens
agaaagggaactggcaaagcca

SEQ ID NO: 7094295 - DNA, 22 bp, Homo sapiens
agaaagggaactggcaaagcca

SEQ ID NO: 7094296 - DNA, 17 bp, Homo sapiens
agaaaggcagttcctct

SEQ ID NO: 7094297 - DNA, 22 bp, Homo sapiens
agaaagggaactggcaaagcca

SEQ ID NO: 7094298 - DNA, 22 bp, Homo sapiens
agaaagggaccagttcttttga

SEQ ID NO: 7094299 - DNA, 22 bp, Homo sapiens
aatctaagccaccagtagtttc

SEQ ID NO: 7094300 - DNA, 22 bp, Homo sapiens
aatctaaggacttagcattgct

SEQ ID NO: 7094301 - DNA, 22 bp, Homo sapiens
aatctacatagagatcaaatga

SEQ ID NO: 7094302 - DNA, 22 bp, Homo sapiens
aatctacatgcaatatttttag

SEQ ID NO: 7094303 - DNA, 22 bp, Homo sapiens
aatctacatgcaatatttttag

SEQ ID NO: 7094304 - DNA, 22 bp, Homo sapiens
aatctacatgcaatatttttag

SEQ ID NO: 7094305 - DNA, 22 bp, Homo sapiens
aatctacatttcagttttgccc

SEQ ID NO: 7094306 - DNA, 22 bp, Homo sapiens
aatctacatttcagttttgccc

SEQ ID NO: 7094307 - DNA, 19 bp, Homo sapiens
aatctagaaatatgtgttc

SEQ ID NO: 7094308 - DNA, 19 bp, Homo sapiens
aatctagaaatatgtgttc

SEQ ID NO: 7094309 - DNA, 19 bp, Homo sapiens
aatctagaaatatgtgttc

SEQ ID NO: 7094310 - DNA, 23 bp, Homo sapiens
aatctagaatgacctactcatct

SEQ ID NO: 7094311 - DNA, 22 bp, Homo sapiens
aatctagaattttaggggtata

SEQ ID NO: 7094312 - DNA, 22 bp, Homo sapiens
aatctagagaactgtggggcag

SEQ ID NO: 7094313 - DNA, 22 bp, Homo sapiens
aatctagagacaatttgaatat

SEQ ID NO: 7094314 - DNA, 22 bp, Homo sapiens
aatctagagtgctaggtctgtg

SEQ ID NO: 7094315 - DNA, 22 bp, Homo sapiens
aatctagagttcccagcataaa

SEQ ID NO: 7094316 - DNA, 22 bp, Homo sapiens
aatctagagttcccagcataaa

SEQ ID NO: 7094317 - DNA, 22 bp, Homo sapiens
aatctagattcggatcaaaggg

SEQ ID NO: 7094318 - DNA, 23 bp, Homo sapiens
aatctatacttaggctggtaata

SEQ ID NO: 7094319 - DNA, 22 bp, Homo sapiens
agaaaggaggaagaatgacctc

SEQ ID NO: 7094320 - DNA, 22 bp, Homo sapiens
agaaaggaggaagaatgacctc

SEQ ID NO: 7094321 - DNA, 22 bp, Homo sapiens
agaaaggattagtttggtataa

SEQ ID NO: 7094322 - DNA, 22 bp, Homo sapiens
agaaaggattagtttggtataa

SEQ ID NO: 7094323 - DNA, 22 bp, Homo sapiens
agaaaggcaatattaactacac

SEQ ID NO: 7094324 - DNA, 22 bp, Homo sapiens
agaaaggcagggatgaggattg

SEQ ID NO: 7094325 - DNA, 22 bp, Homo sapiens
agaaaggagcaccgtgggggat

SEQ ID NO: 7094326 - DNA, 22 bp, Homo sapiens
agaaaggagcaccgtgggggat

SEQ ID NO: 7094327 - DNA, 22 bp, Homo sapiens
agaaaggagcaccgtgggggat

SEQ ID NO: 7094328 - DNA, 22 bp, Homo sapiens
agaaaggagcaccgtgggggat

SEQ ID NO: 7094329 - DNA, 22 bp, Homo sapiens
agaaaggacatctccctttaag

SEQ ID NO: 7094330 - DNA, 22 bp, Homo sapiens
agaaaggacatctccctttaag

SEQ ID NO: 7094331 - DNA, 22 bp, Homo sapiens
agaaaggagaccagctctgccc

SEQ ID NO: 7094332 - DNA, 22 bp, Homo sapiens
agaaagcttatgaatgggcaag

SEQ ID NO: 7094333 - DNA, 22 bp, Homo sapiens
agaaagcttatgaatgggcaag

SEQ ID NO: 7094334 - DNA, 22 bp, Homo sapiens
agaaagcttatgaatgggcaag

SEQ ID NO: 7094335 - DNA, 22 bp, Homo sapiens
agaaaggaagggaggagtttat

SEQ ID NO: 7094336 - DNA, 22 bp, Homo sapiens
agaaaggaagggaggagtttat

SEQ ID NO: 7094337 - DNA, 22 bp, Homo sapiens
agaaaggaagggaggagtttat

SEQ ID NO: 7094338 - DNA, 22 bp, Homo sapiens
agaaactgacaggaaatgaatt

SEQ ID NO: 7094339 - DNA, 22 bp, Homo sapiens
agaaactgacaggaaatgaatt

SEQ ID NO: 7094340 - DNA, 22 bp, Homo sapiens
aatcacatctcattcaacagcc

SEQ ID NO: 7094341 - DNA, 22 bp, Homo sapiens
aatcacatctcattcaacagcc

SEQ ID NO: 7094342 - DNA, 22 bp, Homo sapiens
agaaactgaattatttctgagg

SEQ ID NO: 7094343 - DNA, 20 bp, Homo sapiens
aatcacagttaactctttct

SEQ ID NO: 7094344 - DNA, 22 bp, Homo sapiens
aatcacagtgggtactagattg

SEQ ID NO: 7094345 - DNA, 22 bp, Homo sapiens
aatcacagccagcttccgctat

SEQ ID NO: 7094346 - DNA, 22 bp, Homo sapiens
aatcacaggcatagattgctcc

SEQ ID NO: 7094347 - DNA, 22 bp, Homo sapiens
aatcacaggcatagattgctcc

SEQ ID NO: 7094348 - DNA, 22 bp, Homo sapiens
aatcacagttagtaagggagaa

SEQ ID NO: 7094349 - DNA, 22 bp, Homo sapiens
aatcacagtttcaagtaatgca

SEQ ID NO: 7094350 - DNA, 22 bp, Homo sapiens
aatcacagtttcaagtaatgca

SEQ ID NO: 7094351 - DNA, 22 bp, Homo sapiens
aatcacatagccatctctttga

SEQ ID NO: 7094352 - DNA, 22 bp, Homo sapiens
aatcacatagccatctctttga

SEQ ID NO: 7094353 - DNA, 22 bp, Homo sapiens
aatcacaattacttttgcacca

SEQ ID NO: 7094354 - DNA, 22 bp, Homo sapiens
aatcacaaatttagacagagct

SEQ ID NO: 7094355 - DNA, 22 bp, Homo sapiens
aatcacaaatttagacagagct

SEQ ID NO: 7094356 - DNA, 22 bp, Homo sapiens
aatcacaaatttagacagagct

SEQ ID NO: 7094357 - DNA, 22 bp, Homo sapiens
aatcacaaatgcaagttgtcac

SEQ ID NO: 7094358 - DNA, 22 bp, Homo sapiens
aatcacaattacttttgcacca

SEQ ID NO: 7094359 - DNA, 22 bp, Homo sapiens
aatcacacaaaggcaacttttg

SEQ ID NO: 7094360 - DNA, 22 bp, Homo sapiens
aatcacagagtccagcagatga

SEQ ID NO: 7094361 - DNA, 22 bp, Homo sapiens
actctttattgtttgtggctag

SEQ ID NO: 7094362 - DNA, 18 bp, Homo sapiens
actctttctgcccacagg

SEQ ID NO: 7094363 - DNA, 22 bp, Homo sapiens
actcttttatgcattccttcag

SEQ ID NO: 7094364 - DNA, 19 bp, Homo sapiens
actcttttccttttgaatc

SEQ ID NO: 7094365 - DNA, 22 bp, Homo sapiens
actcttttataaagcatcttga

SEQ ID NO: 7094366 - DNA, 22 bp, Homo sapiens
actgaaaaagtatgattcactg

SEQ ID NO: 7094367 - DNA, 22 bp, Homo sapiens
actgaaaatgaattagaaacag

SEQ ID NO: 7094368 - DNA, 22 bp, Homo sapiens
actgaaaaagtatgattcactg

SEQ ID NO: 7094369 - DNA, 22 bp, Homo sapiens
actgaaaaagacatcttggtaa

SEQ ID NO: 7094370 - DNA, 22 bp, Homo sapiens
actgaaaatgaattagaaacag

SEQ ID NO: 7094371 - DNA, 22 bp, Homo sapiens
aagttcccgaggaccacagttg

SEQ ID NO: 7094372 - DNA, 18 bp, Homo sapiens
aagttccacaagagatct

SEQ ID NO: 7094373 - DNA, 22 bp, Homo sapiens
aagttcctcttctctgcaggga

SEQ ID NO: 7094374 - DNA, 22 bp, Homo sapiens
aagttcatcaaagagtaaatat

SEQ ID NO: 7094375 - DNA, 22 bp, Homo sapiens
aagttcatcaaagagtaaatat

SEQ ID NO: 7094376 - DNA, 22 bp, Homo sapiens
aagttcatggtaggttggaagg

SEQ ID NO: 7094377 - DNA, 22 bp, Homo sapiens
aagttcaatcagatgaaaaagc

SEQ ID NO: 7094378 - DNA, 22 bp, Homo sapiens
actgcaggagacacagctgctg

SEQ ID NO: 7094379 - DNA, 22 bp, Homo sapiens
actgcaggccttggtgccagca

SEQ ID NO: 7094380 - DNA, 22 bp, Homo sapiens
actgcaggatgtgctcctattg

SEQ ID NO: 7094381 - DNA, 22 bp, Homo sapiens
actgcaggagacacagctgctg

SEQ ID NO: 7094382 - DNA, 18 bp, Homo sapiens
actgcaggagaggtgagg

SEQ ID NO: 7094383 - DNA, 18 bp, Homo sapiens
actgcaggagaggtgagg

SEQ ID NO: 7094384 - DNA, 22 bp, Homo sapiens
aagttcctgggccaagtccagg

SEQ ID NO: 7094385 - DNA, 22 bp, Homo sapiens
aagttcctgttactccccagaa

SEQ ID NO: 7094386 - DNA, 22 bp, Homo sapiens
aagttccttagccttagggctt

SEQ ID NO: 7094387 - DNA, 22 bp, Homo sapiens
aagttctaacatctacgtggaa

SEQ ID NO: 7094388 - DNA, 22 bp, Homo sapiens
actgcactccagcctgggtgac

SEQ ID NO: 7094389 - DNA, 22 bp, Homo sapiens
actgcagccttgaactctgggc

SEQ ID NO: 7094390 - DNA, 22 bp, Homo sapiens
actgcaggccttggtgccagca

SEQ ID NO: 7094391 - DNA, 19 bp, Homo sapiens
actgcagggaggaggtgtg

SEQ ID NO: 7094392 - DNA, 22 bp, Homo sapiens
actgcagggcatcctggccaag

SEQ ID NO: 7094393 - DNA, 22 bp, Homo sapiens
actgcagggcatcctggccaag

SEQ ID NO: 7094394 - DNA, 22 bp, Homo sapiens
actgcaggtggatggcacttta

SEQ ID NO: 7094395 - DNA, 22 bp, Homo sapiens
actgcaggtggatggcacttta

SEQ ID NO: 7094396 - DNA, 22 bp, Homo sapiens
actgcagtcatcatctccctgg

SEQ ID NO: 7094397 - DNA, 22 bp, Homo sapiens
actgcagtggcaggaacttatc

SEQ ID NO: 7094398 - DNA, 22 bp, Homo sapiens
actgcagttggtgacaataacc

SEQ ID NO: 7094399 - DNA, 22 bp, Homo sapiens
actgcagttggtgacaataacc

SEQ ID NO: 7094400 - DNA, 22 bp, Homo sapiens
actgcatctgaactgtgaatgg

SEQ ID NO: 7094401 - DNA, 22 bp, Homo sapiens
actgcatgataataatagcaga

SEQ ID NO: 7094402 - DNA, 22 bp, Homo sapiens
actgcatgctttacatgacatg

SEQ ID NO: 7094403 - DNA, 22 bp, Homo sapiens
actgcatgtaaggcaatatgtt

SEQ ID NO: 7094404 - DNA, 20 bp, Homo sapiens
aagttttctccaaatacagt

SEQ ID NO: 7094405 - DNA, 22 bp, Homo sapiens
aagtgtttcaataatttggacc

SEQ ID NO: 7094406 - DNA, 22 bp, Homo sapiens
aagtgtttcaataatttggacc

SEQ ID NO: 7094407 - DNA, 22 bp, Homo sapiens
aagtgtttatttataacgatct

SEQ ID NO: 7094408 - DNA, 22 bp, Homo sapiens
aagtgtttatggttattgttaa

SEQ ID NO: 7094409 - DNA, 22 bp, Homo sapiens
aagtgtttattgattggtctag

SEQ ID NO: 7094410 - DNA, 22 bp, Homo sapiens
aagtgtttattgattggtctag

SEQ ID NO: 7094411 - DNA, 22 bp, Homo sapiens
aagtgtttacttaaagtcatgg

SEQ ID NO: 7094412 - DNA, 22 bp, Homo sapiens
aagtgtttacttaaagtcatgg

SEQ ID NO: 7094413 - DNA, 22 bp, Homo sapiens
aagtgtttacttaaagtcatgg

SEQ ID NO: 7094414 - DNA, 22 bp, Homo sapiens
aagtgtttacttaaagtcatgg

SEQ ID NO: 7094415 - DNA, 22 bp, Homo sapiens
aagtgtttagagagggccttct

SEQ ID NO: 7094416 - DNA, 22 bp, Homo sapiens
aagtgtttaggtttgcagtcga

SEQ ID NO: 7094417 - DNA, 22 bp, Homo sapiens
aagtgtttatggttattgttaa

SEQ ID NO: 7094418 - DNA, 22 bp, Homo sapiens
aagtgttaaaagattaaatgct

SEQ ID NO: 7094419 - DNA, 22 bp, Homo sapiens
aagtgttacagaaacaaatgaa

SEQ ID NO: 7094420 - DNA, 22 bp, Homo sapiens
aagtgttatgtaggatttcaga

SEQ ID NO: 7094421 - DNA, 22 bp, Homo sapiens
aagtgtttaaattatttgcagg

SEQ ID NO: 7094422 - DNA, 22 bp, Homo sapiens
aagtgtttaaattatttgcagg

SEQ ID NO: 7094423 - DNA, 22 bp, Homo sapiens
aagtgtttaacggtgattgagc

SEQ ID NO: 7094424 - DNA, 22 bp, Homo sapiens
aagtgtttaatggttttgatga

SEQ ID NO: 7094425 - DNA, 22 bp, Homo sapiens
actctttacttaaactctaagt

SEQ ID NO: 7094426 - DNA, 20 bp, Homo sapiens
actctttagaagggaaaaca

SEQ ID NO: 7094427 - DNA, 22 bp, Homo sapiens
actctttagaggtacatctctt

SEQ ID NO: 7094428 - DNA, 22 bp, Homo sapiens
actctttaacagactttgatct

SEQ ID NO: 7094429 - DNA, 22 bp, Homo sapiens
actcttcttgctgctcattaat

SEQ ID NO: 7094430 - DNA, 22 bp, Homo sapiens
actcttgattgatttagtcttt

SEQ ID NO: 7094431 - DNA, 18 bp, Homo sapiens
actctgggacctgttatt

SEQ ID NO: 7094432 - DNA, 22 bp, Homo sapiens
actctgggaatcctcaccttcc

SEQ ID NO: 7094433 - DNA, 22 bp, Homo sapiens
aagtgtttccattgtgcaggct

SEQ ID NO: 7094434 - DNA, 22 bp, Homo sapiens
aagtgtttccgggagacttggt

SEQ ID NO: 7094435 - DNA, 22 bp, Homo sapiens
aagtgtttcttggaatgttgcg

SEQ ID NO: 7094436 - DNA, 22 bp, Homo sapiens
aagtgtttcttggaatgttgcg

SEQ ID NO: 7094437 - DNA, 22 bp, Homo sapiens
aagtgtttggggatcattttaa

SEQ ID NO: 7094438 - DNA, 22 bp, Homo sapiens
aagtgttttctccccaccaggc

SEQ ID NO: 7094439 - DNA, 22 bp, Homo sapiens
aagtgttttctccccaccaggc

SEQ ID NO: 7094440 - DNA, 22 bp, Homo sapiens
aagtgtctttatatttgagaaa

SEQ ID NO: 7094441 - DNA, 22 bp, Homo sapiens
aagtgtcttttagccactttta

SEQ ID NO: 7094442 - DNA, 22 bp, Homo sapiens
aagtgtgggaagtaggtggcga

SEQ ID NO: 7094443 - DNA, 22 bp, Homo sapiens
aagtgtgggaagtaggtggcga

SEQ ID NO: 7094444 - DNA, 22 bp, Homo sapiens
aagtgtgggaagtaggtggcga

SEQ ID NO: 7094445 - DNA, 22 bp, Homo sapiens
aagtgtgggactagggctccag

SEQ ID NO: 7094446 - DNA, 22 bp, Homo sapiens
aagtgtgggactagggctccag

SEQ ID NO: 7094447 - DNA, 22 bp, Homo sapiens
aagtgtggggtctcagagctga

SEQ ID NO: 7094448 - DNA, 22 bp, Homo sapiens
aagtgtggggtctcagagctga

SEQ ID NO: 7094449 - DNA, 22 bp, Homo sapiens
aagtgtggtttaggcatctttt

SEQ ID NO: 7094450 - DNA, 22 bp, Homo sapiens
aagtgtgtattgtttatgctgc

SEQ ID NO: 7094451 - DNA, 22 bp, Homo sapiens
aagtgtgtatttttcttcagtg

SEQ ID NO: 7094452 - DNA, 21 bp, Homo sapiens
aagtgtgtcccagcagccggg

SEQ ID NO: 7094453 - DNA, 22 bp, Homo sapiens
aagtgtgtctggcggcccagtg

SEQ ID NO: 7094454 - DNA, 22 bp, Homo sapiens
aagtgtgtcttgggaagggagg

SEQ ID NO: 7094455 - DNA, 22 bp, Homo sapiens
aagtgtgtgagcctgtcaggct

SEQ ID NO: 7094456 - DNA, 22 bp, Homo sapiens
aagtgtgtgggcaggcagtggt

SEQ ID NO: 7094457 - DNA, 22 bp, Homo sapiens
aagtgtgtgggcaggcagtggt

SEQ ID NO: 7094458 - DNA, 19 bp, Homo sapiens
aagtgtgttgagccaggat

SEQ ID NO: 7094459 - DNA, 22 bp, Homo sapiens
aagtgtctgctggctctaccct

SEQ ID NO: 7094460 - DNA, 22 bp, Homo sapiens
aagtgtcttaactccttttggg

SEQ ID NO: 7094461 - DNA, 22 bp, Homo sapiens
aagtgtcttctgatggggtgtg

SEQ ID NO: 7094462 - DNA, 22 bp, Homo sapiens
aagtgtctttatatttgagaaa

SEQ ID NO: 7094463 - DNA, 22 bp, Homo sapiens
aagtgtctgacacaaaatatgt

SEQ ID NO: 7094464 - DNA, 22 bp, Homo sapiens
aagtgtctgatggagcgaaatg

SEQ ID NO: 7094465 - DNA, 22 bp, Homo sapiens
aagtgtctgcaaaatgacagag

SEQ ID NO: 7094466 - DNA, 22 bp, Homo sapiens
acctgcctcagtgcagctggat

SEQ ID NO: 7094467 - DNA, 22 bp, Homo sapiens
acctgcctcagtgcagctggat

SEQ ID NO: 7094468 - DNA, 22 bp, Homo sapiens
acctgcctatggagccacatgg

SEQ ID NO: 7094469 - DNA, 22 bp, Homo sapiens
acctgcctatggagccacatgg

SEQ ID NO: 7094470 - DNA, 22 bp, Homo sapiens
aataagttgcctgttgaatcat

SEQ ID NO: 7094471 - DNA, 22 bp, Homo sapiens
aataagtgatgatgagtcactc

SEQ ID NO: 7094472 - DNA, 22 bp, Homo sapiens
aataagtacttggggataactt

SEQ ID NO: 7094473 - DNA, 22 bp, Homo sapiens
aataagttgcctgttgaatcat

SEQ ID NO: 7094474 - DNA, 22 bp, Homo sapiens
aataagttgcctgttgaatcat

SEQ ID NO: 7094475 - DNA, 22 bp, Homo sapiens
aataagttgcttcagcttggtg

SEQ ID NO: 7094476 - DNA, 22 bp, Homo sapiens
aataagttgcttcagcttggtg

SEQ ID NO: 7094477 - DNA, 22 bp, Homo sapiens
aataagcaagcctgtgtgcaag

SEQ ID NO: 7094478 - DNA, 22 bp, Homo sapiens
aataagccagcccatgtgaccc

SEQ ID NO: 7094479 - DNA, 22 bp, Homo sapiens
aataagctgctaggaacttagt

SEQ ID NO: 7094480 - DNA, 22 bp, Homo sapiens
aataagctgctaggaacttagt

SEQ ID NO: 7094481 - DNA, 22 bp, Homo sapiens
aataagctgctaggaacttagt

SEQ ID NO: 7094482 - DNA, 22 bp, Homo sapiens
aataagctggagctatattgag

SEQ ID NO: 7094483 - DNA, 19 bp, Homo sapiens
aataagcttgggtaaaact

SEQ ID NO: 7094484 - DNA, 19 bp, Homo sapiens
aataagcttgggtaaaact

SEQ ID NO: 7094485 - DNA, 22 bp, Homo sapiens
actgggcaccatcatgagatgg

SEQ ID NO: 7094486 - DNA, 22 bp, Homo sapiens
actgggcaccatcatgagatgg

SEQ ID NO: 7094487 - DNA, 22 bp, Homo sapiens
actgggcaccatcatgagatag

SEQ ID NO: 7094488 - DNA, 22 bp, Homo sapiens
actgggcaccatcatgagatag

SEQ ID NO: 7094489 - DNA, 22 bp, Homo sapiens
actgggattacaggtgggagtc

SEQ ID NO: 7094490 - DNA, 22 bp, Homo sapiens
actgggcaaggatatgatgggt

SEQ ID NO: 7094491 - DNA, 22 bp, Homo sapiens
aataatagcagagtttacaatc

SEQ ID NO: 7094492 - DNA, 22 bp, Homo sapiens
aataatagcagagtttacaatc

SEQ ID NO: 7094493 - DNA, 22 bp, Homo sapiens
aataatagcagagtttacaatc

SEQ ID NO: 7094494 - DNA, 22 bp, Homo sapiens
actggggaatggaactgggaat

SEQ ID NO: 7094495 - DNA, 22 bp, Homo sapiens
actggggaatggaactgggaat

SEQ ID NO: 7094496 - DNA, 22 bp, Homo sapiens
actggggaatggaactgggaat

SEQ ID NO: 7094497 - DNA, 22 bp, Homo sapiens
actggggaatggaactgggaat

SEQ ID NO: 7094498 - DNA, 22 bp, Homo sapiens
actggggactctggccttttga

SEQ ID NO: 7094499 - DNA, 22 bp, Homo sapiens
actggggagagtcatgccagca

SEQ ID NO: 7094500 - DNA, 22 bp, Homo sapiens
actggggagagtcatgccagca

SEQ ID NO: 7094501 - DNA, 22 bp, Homo sapiens
aataataagatactaagggagt

SEQ ID NO: 7094502 - DNA, 22 bp, Homo sapiens
aataatacatgagattaatgtt

SEQ ID NO: 7094503 - DNA, 22 bp, Homo sapiens
aataatacatgagattaatgtt

SEQ ID NO: 7094504 - DNA, 22 bp, Homo sapiens
actgggagtcatgaggaaggag

SEQ ID NO: 7094505 - DNA, 22 bp, Homo sapiens
actgggagtcatgaggaaggag

SEQ ID NO: 7094506 - DNA, 22 bp, Homo sapiens
actgggagtcatgaggaaggag

SEQ ID NO: 7094507 - DNA, 22 bp, Homo sapiens
actgggagtcatgaggaaggag

SEQ ID NO: 7094508 - DNA, 22 bp, Homo sapiens
actgggagggtcttgaagaggg

SEQ ID NO: 7094509 - DNA, 22 bp, Homo sapiens
actgggagggtcttgaagaggg

SEQ ID NO: 7094510 - DNA, 22 bp, Homo sapiens
actgggagggtcttgaagaggg

SEQ ID NO: 7094511 - DNA, 22 bp, Homo sapiens
actgggagggtcttgaagaggg

SEQ ID NO: 7094512 - DNA, 22 bp, Homo sapiens
actgggagtcatgaggaaggag

SEQ ID NO: 7094513 - DNA, 22 bp, Homo sapiens
actgggaggcatctggagctga

SEQ ID NO: 7094514 - DNA, 22 bp, Homo sapiens
actgggaggcatctggagctga

SEQ ID NO: 7094515 - DNA, 22 bp, Homo sapiens
actgggaggcatctggagctga

SEQ ID NO: 7094516 - DNA, 22 bp, Homo sapiens
actgggaggcatctggagctga

SEQ ID NO: 7094517 - DNA, 22 bp, Homo sapiens
actgggaggcaaagagcaagga

SEQ ID NO: 7094518 - DNA, 22 bp, Homo sapiens
actgggaggcaaagagcaagga

SEQ ID NO: 7094519 - DNA, 22 bp, Homo sapiens
aataaaatggtcagttttctca

SEQ ID NO: 7094520 - DNA, 22 bp, Homo sapiens
aataaaatggtcagttttctca

SEQ ID NO: 7094521 - DNA, 22 bp, Homo sapiens
actggctgatatggctaggaag

SEQ ID NO: 7094522 - DNA, 22 bp, Homo sapiens
actggctgatatggctaggaag

SEQ ID NO: 7094523 - DNA, 22 bp, Homo sapiens
aataaaatgaactggtagagtt

SEQ ID NO: 7094524 - DNA, 22 bp, Homo sapiens
aataaaatgaactggtagagtt

SEQ ID NO: 7094525 - DNA, 22 bp, Homo sapiens
aataaaatggtcagttttctca

SEQ ID NO: 7094526 - DNA, 22 bp, Homo sapiens
aataaaatggtcagttttctca

SEQ ID NO: 7094527 - DNA, 22 bp, Homo sapiens
aataaaatggtcagttttctca

SEQ ID NO: 7094528 - DNA, 20 bp, Homo sapiens
aataaaagaagccttcaccc

SEQ ID NO: 7094529 - DNA, 22 bp, Homo sapiens
aataaaatgaactggtagagtt

SEQ ID NO: 7094530 - DNA, 22 bp, Homo sapiens
aataaaatgaactggtagagtt

SEQ ID NO: 7094531 - DNA, 22 bp, Homo sapiens
aagtttttcacattgctgttgt

SEQ ID NO: 7094532 - DNA, 20 bp, Homo sapiens
aagttttctccaaatacagt

SEQ ID NO: 7094533 - DNA, 21 bp, Homo sapiens
aataaaacagttggtgtcaat

SEQ ID NO: 7094534 - DNA, 22 bp, Homo sapiens
aatagaatgtaatctaatacat

SEQ ID NO: 7094535 - DNA, 22 bp, Homo sapiens
actgtctctctagcagttcagg

SEQ ID NO: 7094536 - DNA, 18 bp, Homo sapiens
actgtctctgagagtggt

SEQ ID NO: 7094537 - DNA, 18 bp, Homo sapiens
actgtctctgagagtggt

SEQ ID NO: 7094538 - DNA, 22 bp, Homo sapiens
actgtctgagctgattgagcta

SEQ ID NO: 7094539 - DNA, 22 bp, Homo sapiens
actgtctgagtcaggagtcaca

SEQ ID NO: 7094540 - DNA, 22 bp, Homo sapiens
actgtcctagaacctgcagctc

SEQ ID NO: 7094541 - DNA, 22 bp, Homo sapiens
actgtcctgaatactgcatgac

SEQ ID NO: 7094542 - DNA, 22 bp, Homo sapiens
actgtcctgaatactgcatgac

SEQ ID NO: 7094543 - DNA, 22 bp, Homo sapiens
aatagcatcctaaaacatactt

SEQ ID NO: 7094544 - DNA, 22 bp, Homo sapiens
aatagcatcctaaaacatactt

SEQ ID NO: 7094545 - DNA, 22 bp, Homo sapiens
aatagcatagagttaaaatgca

SEQ ID NO: 7094546 - DNA, 22 bp, Homo sapiens
aatagcatcttctgagacaaag

SEQ ID NO: 7094547 - DNA, 22 bp, Homo sapiens
aatagcagaagactagtagaca

SEQ ID NO: 7094548 - DNA, 19 bp, Homo sapiens
aatagcaggagcagttccc

SEQ ID NO: 7094549 - DNA, 22 bp, Homo sapiens
aatagcataagatgtcaaatag

SEQ ID NO: 7094550 - DNA, 22 bp, Homo sapiens
aatagcatagagttaaaatgca

SEQ ID NO: 7094551 - DNA, 22 bp, Homo sapiens
aatagcacacttgtgagcatta

SEQ ID NO: 7094552 - DNA, 22 bp, Homo sapiens
aatagcaattacatttgcacca

SEQ ID NO: 7094553 - DNA, 22 bp, Homo sapiens
aatagcaaagttatcaaattaa

SEQ ID NO: 7094554 - DNA, 22 bp, Homo sapiens
aatagcaaatgctcatttgaaa

SEQ ID NO: 7094555 - DNA, 22 bp, Homo sapiens
actgtacacagtggtgtactgt

SEQ ID NO: 7094556 - DNA, 22 bp, Homo sapiens
actgtacacagtggtgtactgt

SEQ ID NO: 7094557 - DNA, 22 bp, Homo sapiens
actgtacacagtggtgtactgt

SEQ ID NO: 7094558 - DNA, 22 bp, Homo sapiens
actgtacacacttctctgtctt

SEQ ID NO: 7094559 - DNA, 22 bp, Homo sapiens
actgtacacacttctctgtctt

SEQ ID NO: 7094560 - DNA, 22 bp, Homo sapiens
actgtacacacttctctgtctt

SEQ ID NO: 7094561 - DNA, 22 bp, Homo sapiens
actgtacaacctctgcccctgt

SEQ ID NO: 7094562 - DNA, 22 bp, Homo sapiens
actgtacaactgctgagcagaa

SEQ ID NO: 7094563 - DNA, 22 bp, Homo sapiens
actgtacaactgctgagcagaa

SEQ ID NO: 7094564 - DNA, 22 bp, Homo sapiens
actggggagagtcatgccagca

SEQ ID NO: 7094565 - DNA, 22 bp, Homo sapiens
actggggagtggttttgggaag

SEQ ID NO: 7094566 - DNA, 22 bp, Homo sapiens
actggggagtggttttgggaag

SEQ ID NO: 7094567 - DNA, 22 bp, Homo sapiens
actgtaatattttaagatgtct

SEQ ID NO: 7094568 - DNA, 22 bp, Homo sapiens
actgtaatattttaagatgtct

SEQ ID NO: 7094569 - DNA, 22 bp, Homo sapiens
actgtaatggtggatccatgtc

SEQ ID NO: 7094570 - DNA, 22 bp, Homo sapiens
actgtaattatctgaacgtgca

SEQ ID NO: 7094571 - DNA, 22 bp, Homo sapiens
actgtaattatctgaacgtgca

SEQ ID NO: 7094572 - DNA, 22 bp, Homo sapiens
actgtaattggattgtctgact

SEQ ID NO: 7094573 - DNA, 22 bp, Homo sapiens
actgtaattggattgtctgact

SEQ ID NO: 7094574 - DNA, 22 bp, Homo sapiens
actgtacaaatattgcaaaata

SEQ ID NO: 7094575 - DNA, 22 bp, Homo sapiens
actgtacaaatattgcaaaata

SEQ ID NO: 7094576 - DNA, 22 bp, Homo sapiens
actgtacacagtggtgtactgt

SEQ ID NO: 7094577 - DNA, 22 bp, Homo sapiens
actgtacacattcgtcaagact

SEQ ID NO: 7094578 - DNA, 22 bp, Homo sapiens
actgtacacattcgtcaagact

SEQ ID NO: 7094579 - DNA, 22 bp, Homo sapiens
actgtacacgtgtcatttacag

SEQ ID NO: 7094580 - DNA, 22 bp, Homo sapiens
actgtacacgtgtcatttacag

SEQ ID NO: 7094581 - DNA, 22 bp, Homo sapiens
actgtacacgtgtcatttacag

SEQ ID NO: 7094582 - DNA, 22 bp, Homo sapiens
actgtacatatggattctaaga

SEQ ID NO: 7094583 - DNA, 22 bp, Homo sapiens
actgtacatatggattctaaga

SEQ ID NO: 7094584 - DNA, 22 bp, Homo sapiens
actgtacatgcatcttgtctat

SEQ ID NO: 7094585 - DNA, 22 bp, Homo sapiens
actgtacatgcatcttgtctat

SEQ ID NO: 7094586 - DNA, 21 bp, Homo sapiens
actgtcatttgcttagggagg

SEQ ID NO: 7094587 - DNA, 22 bp, Homo sapiens
actgtccattcactcatattca

SEQ ID NO: 7094588 - DNA, 22 bp, Homo sapiens
actgtcccatttatgtagacat

SEQ ID NO: 7094589 - DNA, 22 bp, Homo sapiens
actgtcccatttatgtagacat

SEQ ID NO: 7094590 - DNA, 22 bp, Homo sapiens
actgtcctagaacctgcagctc

SEQ ID NO: 7094591 - DNA, 22 bp, Homo sapiens
aaggggtgggcattagagcagt

SEQ ID NO: 7094592 - DNA, 22 bp, Homo sapiens
aaggggtgggcattagagcagt

SEQ ID NO: 7094593 - DNA, 22 bp, Homo sapiens
aaggggtgggcattagagcagt

SEQ ID NO: 7094594 - DNA, 22 bp, Homo sapiens
aagggtgctgctatcaggaagc

SEQ ID NO: 7094595 - DNA, 22 bp, Homo sapiens
aagggtgggccctggcagccat

SEQ ID NO: 7094596 - DNA, 22 bp, Homo sapiens
aagggtgggccctggcagccat

SEQ ID NO: 7094597 - DNA, 22 bp, Homo sapiens
aagggtgggccctggcagccat

SEQ ID NO: 7094598 - DNA, 22 bp, Homo sapiens
aagggtgggcaccgccaggtca

SEQ ID NO: 7094599 - DNA, 22 bp, Homo sapiens
aagggtgggcaccgccaggtca

SEQ ID NO: 7094600 - DNA, 22 bp, Homo sapiens
aagggtgggcaccgccaggtca

SEQ ID NO: 7094601 - DNA, 22 bp, Homo sapiens
aagggtgggccctggcagccat

SEQ ID NO: 7094602 - DNA, 22 bp, Homo sapiens
aagggtgggccctggcagccat

SEQ ID NO: 7094603 - DNA, 22 bp, Homo sapiens
aagggtgggccctggcagccat

SEQ ID NO: 7094604 - DNA, 22 bp, Homo sapiens
aagggtggtgtaggagatcaaa

SEQ ID NO: 7094605 - DNA, 22 bp, Homo sapiens
aagggtgggcaccgccaggtca

SEQ ID NO: 7094606 - DNA, 22 bp, Homo sapiens
aagggtggatttctgagctcta

SEQ ID NO: 7094607 - DNA, 22 bp, Homo sapiens
aagggtgggcaccgccaggtca

SEQ ID NO: 7094608 - DNA, 22 bp, Homo sapiens
aagggtggatttctgagctcta

SEQ ID NO: 7094609 - DNA, 22 bp, Homo sapiens
aagggtggatttctgagctcta

SEQ ID NO: 7094610 - DNA, 22 bp, Homo sapiens
aagggttgaagataaataaggt

SEQ ID NO: 7094611 - DNA, 22 bp, Homo sapiens
aagggtggtgtaggagatcaaa

SEQ ID NO: 7094612 - DNA, 22 bp, Homo sapiens
aagggtggtgtaggagatcaaa

SEQ ID NO: 7094613 - DNA, 22 bp, Homo sapiens
aagggtgttgatcagagaggat

SEQ ID NO: 7094614 - DNA, 22 bp, Homo sapiens
aagggtgttgatcagagaggat

SEQ ID NO: 7094615 - DNA, 22 bp, Homo sapiens
aagggttggggaagagcaaatt

SEQ ID NO: 7094616 - DNA, 22 bp, Homo sapiens
aagggtttgtctccctcaaggc

SEQ ID NO: 7094617 - DNA, 22 bp, Homo sapiens
aaggtaatccataatagttact

SEQ ID NO: 7094618 - DNA, 22 bp, Homo sapiens
aaggtaatccataatagttact

SEQ ID NO: 7094619 - DNA, 22 bp, Homo sapiens
acccaggcagcaggagctaaag

SEQ ID NO: 7094620 - DNA, 22 bp, Homo sapiens
aaggtagatgttgtcatgccca

SEQ ID NO: 7094621 - DNA, 22 bp, Homo sapiens
aaggtacagttttaagaataag

SEQ ID NO: 7094622 - DNA, 22 bp, Homo sapiens
aaggtacagggaaggagcaaga

SEQ ID NO: 7094623 - DNA, 22 bp, Homo sapiens
aaggtacagggtattagattat

SEQ ID NO: 7094624 - DNA, 22 bp, Homo sapiens
aaggtacaaagtattatttaaa

SEQ ID NO: 7094625 - DNA, 22 bp, Homo sapiens
aaggtaatgaaacagcagctaa

SEQ ID NO: 7094626 - DNA, 22 bp, Homo sapiens
aaggtacagaaattaacaagga

SEQ ID NO: 7094627 - DNA, 22 bp, Homo sapiens
aaggtacagaaattaacaagga

SEQ ID NO: 7094628 - DNA, 22 bp, Homo sapiens
aaggtacaggcattgctgcagc

SEQ ID NO: 7094629 - DNA, 22 bp, Homo sapiens
aaggtacagggaaggagcaaga

SEQ ID NO: 7094630 - DNA, 22 bp, Homo sapiens
aaggtacagggaaggagcaaga

SEQ ID NO: 7094631 - DNA, 22 bp, Homo sapiens
accagagctggctctgagcacc

SEQ ID NO: 7094632 - DNA, 22 bp, Homo sapiens
accagagctggctctgagcacc

SEQ ID NO: 7094633 - DNA, 22 bp, Homo sapiens
accagagctggctctgagcacc

SEQ ID NO: 7094634 - DNA, 22 bp, Homo sapiens
accagagcttacatgctagaaa

SEQ ID NO: 7094635 - DNA, 22 bp, Homo sapiens
accagaggaagggaatctcaag

SEQ ID NO: 7094636 - DNA, 22 bp, Homo sapiens
accagaggaagggaatctcaag

SEQ ID NO: 7094637 - DNA, 20 bp, Homo sapiens
accagaggaaagagcagtga

SEQ ID NO: 7094638 - DNA, 20 bp, Homo sapiens
accagaggaaagagcagtga

SEQ ID NO: 7094639 - DNA, 20 bp, Homo sapiens
accagaggaaagagcagtga

SEQ ID NO: 7094640 - DNA, 22 bp, Homo sapiens
accagagcttacatgctagaaa

SEQ ID NO: 7094641 - DNA, 22 bp, Homo sapiens
accagagtaatgtgtggaaatt

SEQ ID NO: 7094642 - DNA, 22 bp, Homo sapiens
accagagggagacttcctcttc

SEQ ID NO: 7094643 - DNA, 22 bp, Homo sapiens
accagagggagacttcctcttc

SEQ ID NO: 7094644 - DNA, 22 bp, Homo sapiens
accagaggaggaattaccttcc

SEQ ID NO: 7094645 - DNA, 22 bp, Homo sapiens
accagaggaggaattaccttcc

SEQ ID NO: 7094646 - DNA, 22 bp, Homo sapiens
accagcaagattttgctttgca

SEQ ID NO: 7094647 - DNA, 22 bp, Homo sapiens
accagcacctgataggcagtaa

SEQ ID NO: 7094648 - DNA, 22 bp, Homo sapiens
accagcacctgataggcagtaa

SEQ ID NO: 7094649 - DNA, 22 bp, Homo sapiens
accagcacggattagaatgctt

SEQ ID NO: 7094650 - DNA, 22 bp, Homo sapiens
accagcacctgataggcagtaa

SEQ ID NO: 7094651 - DNA, 22 bp, Homo sapiens
aaggggaagagaccgcagagtc

SEQ ID NO: 7094652 - DNA, 22 bp, Homo sapiens
aagggggcggcagccagtggaa

SEQ ID NO: 7094653 - DNA, 22 bp, Homo sapiens
aaggggggcacctgcatgcccg

SEQ ID NO: 7094654 - DNA, 22 bp, Homo sapiens
aaggggggcacctgcatgcccg

SEQ ID NO: 7094655 - DNA, 22 bp, Homo sapiens
aaggggtgagcagaggcttcgc

SEQ ID NO: 7094656 - DNA, 22 bp, Homo sapiens
aaggggtgagcagaggcttcgc

SEQ ID NO: 7094657 - DNA, 22 bp, Homo sapiens
aaggggtgagcagaggcttcgc

SEQ ID NO: 7094658 - DNA, 22 bp, Homo sapiens
aaggggtgagcagaggcttcgc

SEQ ID NO: 7094659 - DNA, 19 bp, Homo sapiens
aaggggtgagggaagcaga

SEQ ID NO: 7094660 - DNA, 19 bp, Homo sapiens
aaggggtgagggaagcaga

SEQ ID NO: 7094661 - DNA, 19 bp, Homo sapiens
aaggggtgagggaagcaga

SEQ ID NO: 7094662 - DNA, 22 bp, Homo sapiens
aaggggtgcaagttaatcagca

SEQ ID NO: 7094663 - DNA, 22 bp, Homo sapiens
aaggggtgcaagttaatcagca

SEQ ID NO: 7094664 - DNA, 22 bp, Homo sapiens
aaggggtgctgttggaaaccca

SEQ ID NO: 7094665 - DNA, 22 bp, Homo sapiens
aaggggtgctgttggaaaccca

SEQ ID NO: 7094666 - DNA, 22 bp, Homo sapiens
aagggctggccctgggaagagt

SEQ ID NO: 7094667 - DNA, 18 bp, Homo sapiens
aagggctggcctttggag

SEQ ID NO: 7094668 - DNA, 18 bp, Homo sapiens
aagggctggcctttggag

SEQ ID NO: 7094669 - DNA, 22 bp, Homo sapiens
aagggctggccctgggaagagt

SEQ ID NO: 7094670 - DNA, 22 bp, Homo sapiens
aagggctggccctgggaagagt

SEQ ID NO: 7094671 - DNA, 22 bp, Homo sapiens
aagggctggccctgggaagagt

SEQ ID NO: 7094672 - DNA, 22 bp, Homo sapiens
aagggctgggtctggttaaccc

SEQ ID NO: 7094673 - DNA, 19 bp, Homo sapiens
aagggctgggcacctcact

SEQ ID NO: 7094674 - DNA, 19 bp, Homo sapiens
aagggctgggcacctcact

SEQ ID NO: 7094675 - DNA, 22 bp, Homo sapiens
aagggctggccacattctgggt

SEQ ID NO: 7094676 - DNA, 22 bp, Homo sapiens
aagggctggccacattctgggt

SEQ ID NO: 7094677 - DNA, 22 bp, Homo sapiens
aagggctggatctctctgagca

SEQ ID NO: 7094678 - DNA, 22 bp, Homo sapiens
aagggctggatctctctgagca

SEQ ID NO: 7094679 - DNA, 22 bp, Homo sapiens
aagggctggatctctctgagca

SEQ ID NO: 7094680 - DNA, 22 bp, Homo sapiens
aagggctggatctctctgagca

SEQ ID NO: 7094681 - DNA, 22 bp, Homo sapiens
aagggctggatctctctgagca

SEQ ID NO: 7094682 - DNA, 22 bp, Homo sapiens
aagggctggagaggaaaggttg

SEQ ID NO: 7094683 - DNA, 22 bp, Homo sapiens
acatttcagattcatgaagtga

SEQ ID NO: 7094684 - DNA, 22 bp, Homo sapiens
acatttcagcgtgcatgacatg

SEQ ID NO: 7094685 - DNA, 22 bp, Homo sapiens
acatttcagcgtgcatgacatg

SEQ ID NO: 7094686 - DNA, 22 bp, Homo sapiens
acatttcagcgtgcatgacatg

SEQ ID NO: 7094687 - DNA, 22 bp, Homo sapiens
acatttcagcgtgcatgacatg

SEQ ID NO: 7094688 - DNA, 22 bp, Homo sapiens
acatttcagtaagtgttaattt

SEQ ID NO: 7094689 - DNA, 22 bp, Homo sapiens
aagggctggagaggaaaggttg

SEQ ID NO: 7094690 - DNA, 22 bp, Homo sapiens
aagggctggagaggaaaggttg

SEQ ID NO: 7094691 - DNA, 22 bp, Homo sapiens
aagggctggagaggaaaggttg

SEQ ID NO: 7094692 - DNA, 22 bp, Homo sapiens
aagggctgcaatccaaaacact

SEQ ID NO: 7094693 - DNA, 22 bp, Homo sapiens
acatttcagtgagctattgaag

SEQ ID NO: 7094694 - DNA, 23 bp, Homo sapiens
acatttcatataaaagggatcag

SEQ ID NO: 7094695 - DNA, 22 bp, Homo sapiens
aagggcagaatagagaagatgg

SEQ ID NO: 7094696 - DNA, 22 bp, Homo sapiens
aagggcagaatagagaagatgg

SEQ ID NO: 7094697 - DNA, 22 bp, Homo sapiens
aagggcagaatagagaagatgg

SEQ ID NO: 7094698 - DNA, 22 bp, Homo sapiens
aagggcagaatagagaagatgg

SEQ ID NO: 7094699 - DNA, 22 bp, Homo sapiens
aagggcagaatagagaagatgg

SEQ ID NO: 7094700 - DNA, 22 bp, Homo sapiens
aagggattgatcttgacacagt

SEQ ID NO: 7094701 - DNA, 22 bp, Homo sapiens
aagggcagaaagggacgctttg

SEQ ID NO: 7094702 - DNA, 22 bp, Homo sapiens
aagggagacagttgtgtgagga

SEQ ID NO: 7094703 - DNA, 22 bp, Homo sapiens
aagggagacagttgtgtgagga

SEQ ID NO: 7094704 - DNA, 20 bp, Homo sapiens
aagggagaataatgattgta

SEQ ID NO: 7094705 - DNA, 22 bp, Homo sapiens
acatgcatgtgaatatggacac

SEQ ID NO: 7094706 - DNA, 22 bp, Homo sapiens
acatgcatgtgaatatggacac

SEQ ID NO: 7094707 - DNA, 22 bp, Homo sapiens
acatgcatgtgaatatggacac

SEQ ID NO: 7094708 - DNA, 22 bp, Homo sapiens
acatgcatgttgtgtagggggg

SEQ ID NO: 7094709 - DNA, 22 bp, Homo sapiens
acatgcatgttgtgtagggggg

SEQ ID NO: 7094710 - DNA, 22 bp, Homo sapiens
acatgcatgttgtgtagggggg

SEQ ID NO: 7094711 - DNA, 22 bp, Homo sapiens
aagggaggggatgtaagcctgg

SEQ ID NO: 7094712 - DNA, 22 bp, Homo sapiens
aagggaggtaaagctatttaaa

SEQ ID NO: 7094713 - DNA, 22 bp, Homo sapiens
aagggaggtaaagctatttaaa

SEQ ID NO: 7094714 - DNA, 22 bp, Homo sapiens
aagggaggtaaagctatttaaa

SEQ ID NO: 7094715 - DNA, 22 bp, Homo sapiens
acatttcagattcatgaagtga

SEQ ID NO: 7094716 - DNA, 22 bp, Homo sapiens
acatttcagattcatgaagtga

SEQ ID NO: 7094717 - DNA, 22 bp, Homo sapiens
acatttcagattcatgaagtga

SEQ ID NO: 7094718 - DNA, 22 bp, Homo sapiens
aagggcagagggaatcccacat

SEQ ID NO: 7094719 - DNA, 22 bp, Homo sapiens
acatttcagatgtaatgtgatg

SEQ ID NO: 7094720 - DNA, 22 bp, Homo sapiens
acatttcagatgtaatgtgatg

SEQ ID NO: 7094721 - DNA, 20 bp, Homo sapiens
aagggcagagggaacagact

SEQ ID NO: 7094722 - DNA, 22 bp, Homo sapiens
aagggcagaatagagaagatgg

SEQ ID NO: 7094723 - DNA, 20 bp, Homo sapiens
aagggcagagggaacagact

SEQ ID NO: 7094724 - DNA, 20 bp, Homo sapiens
aagggcagagggaacagact

SEQ ID NO: 7094725 - DNA, 20 bp, Homo sapiens
aagggcagagggaacagact

SEQ ID NO: 7094726 - DNA, 20 bp, Homo sapiens
aagggcagagggaacagact

SEQ ID NO: 7094727 - DNA, 20 bp, Homo sapiens
aagggcagagggaacagact

SEQ ID NO: 7094728 - DNA, 20 bp, Homo sapiens
aagggcagagggaacagact

SEQ ID NO: 7094729 - DNA, 22 bp, Homo sapiens
aagggcagagggaatcccacat

SEQ ID NO: 7094730 - DNA, 22 bp, Homo sapiens
aagggcagagggaatcccacat

SEQ ID NO: 7094731 - DNA, 22 bp, Homo sapiens
aagggcagagggaatcccacat

SEQ ID NO: 7094732 - DNA, 22 bp, Homo sapiens
aagggcagagggaatcccacat

SEQ ID NO: 7094733 - DNA, 22 bp, Homo sapiens
acccaggggcagccttgctgtg

SEQ ID NO: 7094734 - DNA, 22 bp, Homo sapiens
acccaggggcagccttgctgtg

SEQ ID NO: 7094735 - DNA, 22 bp, Homo sapiens
acccaggggcagccttgctgtg

SEQ ID NO: 7094736 - DNA, 22 bp, Homo sapiens
acccagggcttaaggcggtgca

SEQ ID NO: 7094737 - DNA, 21 bp, Homo sapiens
acccaggggaagcagaaactg

SEQ ID NO: 7094738 - DNA, 22 bp, Homo sapiens
acccagggctcaagcgtaggca

SEQ ID NO: 7094739 - DNA, 22 bp, Homo sapiens
acccagggcttaaggcggtgca

SEQ ID NO: 7094740 - DNA, 22 bp, Homo sapiens
acccagggcttaaggcggtgca

SEQ ID NO: 7094741 - DNA, 22 bp, Homo sapiens
acccagggctcaagcgtaggca

SEQ ID NO: 7094742 - DNA, 22 bp, Homo sapiens
acccagggctcaagcgtaggca

SEQ ID NO: 7094743 - DNA, 22 bp, Homo sapiens
acccagggctcaagcgtaggca

SEQ ID NO: 7094744 - DNA, 22 bp, Homo sapiens
acccagggcagccagcggggag

SEQ ID NO: 7094745 - DNA, 22 bp, Homo sapiens
acccagggccacagcccgcagt

SEQ ID NO: 7094746 - DNA, 22 bp, Homo sapiens
acccagggccacagcccgcagt

SEQ ID NO: 7094747 - DNA, 22 bp, Homo sapiens
acccagggcagccagcggggag

SEQ ID NO: 7094748 - DNA, 22 bp, Homo sapiens
acccagggagtgctcctgttct

SEQ ID NO: 7094749 - DNA, 22 bp, Homo sapiens
aaggtggttgtaggctggtctg

SEQ ID NO: 7094750 - DNA, 22 bp, Homo sapiens
aaggtggtttgattatcccact

SEQ ID NO: 7094751 - DNA, 22 bp, Homo sapiens
aaggtggtttgcagacagaata

SEQ ID NO: 7094752 - DNA, 22 bp, Homo sapiens
aaggtggtttgctaatcccaac

SEQ ID NO: 7094753 - DNA, 22 bp, Homo sapiens
aaggtggtgagtacagttaggt

SEQ ID NO: 7094754 - DNA, 22 bp, Homo sapiens
aaggtggtgagtacagttaggt

SEQ ID NO: 7094755 - DNA, 22 bp, Homo sapiens
aaggtggtgatcatcttgaagg

SEQ ID NO: 7094756 - DNA, 22 bp, Homo sapiens
aaggtggtgcttctgctcctct

SEQ ID NO: 7094757 - DNA, 22 bp, Homo sapiens
aaggtggttcgctggtacccag

SEQ ID NO: 7094758 - DNA, 22 bp, Homo sapiens
aaggtggttgcaattaccataa

SEQ ID NO: 7094759 - DNA, 19 bp, Homo sapiens
acccaggggtttatgtgtg

SEQ ID NO: 7094760 - DNA, 22 bp, Homo sapiens
acccaggggcgaagctggccac

SEQ ID NO: 7094761 - DNA, 22 bp, Homo sapiens
acccaggggcgaagctggccac

SEQ ID NO: 7094762 - DNA, 22 bp, Homo sapiens
acccagggtagaacctcagagc

SEQ ID NO: 7094763 - DNA, 22 bp, Homo sapiens
acccagggtagaacctcagagc

SEQ ID NO: 7094764 - DNA, 22 bp, Homo sapiens
aaggtgtcaccagattggcagg

SEQ ID NO: 7094765 - DNA, 22 bp, Homo sapiens
aaggtgtcaaactagaagatgt

SEQ ID NO: 7094766 - DNA, 19 bp, Homo sapiens
aaggtggtttgtctctgta

SEQ ID NO: 7094767 - DNA, 22 bp, Homo sapiens
aaggtgtcactgggacaggaaa

SEQ ID NO: 7094768 - DNA, 22 bp, Homo sapiens
aaggtgtcaccagattggcagg

SEQ ID NO: 7094769 - DNA, 20 bp, Homo sapiens
acctcctggaagcaggtgcc

SEQ ID NO: 7094770 - DNA, 22 bp, Homo sapiens
acctatttatgcaattatgaaa

SEQ ID NO: 7094771 - DNA, 22 bp, Homo sapiens
acctatttatgcaattatgaaa

SEQ ID NO: 7094772 - DNA, 22 bp, Homo sapiens
acctcaagaatgtataacacag

SEQ ID NO: 7094773 - DNA, 20 bp, Homo sapiens
acctcctggcgggcatcctc

SEQ ID NO: 7094774 - DNA, 22 bp, Homo sapiens
acctcctggcctcaagcaatcc

SEQ ID NO: 7094775 - DNA, 22 bp, Homo sapiens
acctctctgggcctgcttcctg

SEQ ID NO: 7094776 - DNA, 22 bp, Homo sapiens
acctctcaggtcttcctcatat

SEQ ID NO: 7094777 - DNA, 22 bp, Homo sapiens
acctctctgggcctgcttcctg

SEQ ID NO: 7094778 - DNA, 22 bp, Homo sapiens
acctctcttgtagctgctggtg

SEQ ID NO: 7094779 - DNA, 22 bp, Homo sapiens
acctctgaacatttttaagact

SEQ ID NO: 7094780 - DNA, 22 bp, Homo sapiens
acctctgaaggtttacatttcc

SEQ ID NO: 7094781 - DNA, 20 bp, Homo sapiens
acctctgacccagagcaggc

SEQ ID NO: 7094782 - DNA, 22 bp, Homo sapiens
acctctgacctctgagagagaa

SEQ ID NO: 7094783 - DNA, 19 bp, Homo sapiens
acctctgagaatgccagtc

SEQ ID NO: 7094784 - DNA, 19 bp, Homo sapiens
acctctgagaatgccagtc

SEQ ID NO: 7094785 - DNA, 22 bp, Homo sapiens
acctctgagccatggaaggtga

SEQ ID NO: 7094786 - DNA, 22 bp, Homo sapiens
acctctgaggtgaggaggagct

SEQ ID NO: 7094787 - DNA, 22 bp, Homo sapiens
acctctgccactttctaactct

SEQ ID NO: 7094788 - DNA, 22 bp, Homo sapiens
acctctgctcaagacccctccg

SEQ ID NO: 7094789 - DNA, 22 bp, Homo sapiens
acctctggacactgcatccttc

SEQ ID NO: 7094790 - DNA, 22 bp, Homo sapiens
acctctggcaccccctggcttg

SEQ ID NO: 7094791 - DNA, 22 bp, Homo sapiens
aagtcatcactcctctgaactt

SEQ ID NO: 7094792 - DNA, 22 bp, Homo sapiens
aagtccagtgctttagattcca

SEQ ID NO: 7094793 - DNA, 22 bp, Homo sapiens
aagtccagtttttccaggtggt

SEQ ID NO: 7094794 - DNA, 22 bp, Homo sapiens
aagtccataggtttcatgaggg

SEQ ID NO: 7094795 - DNA, 22 bp, Homo sapiens
aagtccatagtttgcattacag

SEQ ID NO: 7094796 - DNA, 22 bp, Homo sapiens
aagtccatagtttgcattaggg

SEQ ID NO: 7094797 - DNA, 22 bp, Homo sapiens
aagtccatgatcaagatgtggc

SEQ ID NO: 7094798 - DNA, 18 bp, Homo sapiens
aagtccatgggtttggga

SEQ ID NO: 7094799 - DNA, 22 bp, Homo sapiens
aagtccattcttccagccagct

SEQ ID NO: 7094800 - DNA, 22 bp, Homo sapiens
aagtccattcttccagccagct

SEQ ID NO: 7094801 - DNA, 22 bp, Homo sapiens
aagtcagtgctagctaatggct

SEQ ID NO: 7094802 - DNA, 22 bp, Homo sapiens
aagtcagtgaaaaggcatcatc

SEQ ID NO: 7094803 - DNA, 22 bp, Homo sapiens
aagtcagtgctagctaatggct

SEQ ID NO: 7094804 - DNA, 22 bp, Homo sapiens
aagtatattttttgaagcatat

SEQ ID NO: 7094805 - DNA, 22 bp, Homo sapiens
aagtatctcaaaaacagtaatc

SEQ ID NO: 7094806 - DNA, 22 bp, Homo sapiens
aagtatattttttgaagcatat

SEQ ID NO: 7094807 - DNA, 22 bp, Homo sapiens
aagtatatttagctgagcttgt

SEQ ID NO: 7094808 - DNA, 22 bp, Homo sapiens
aagtatatttagctgagcttgt

SEQ ID NO: 7094809 - DNA, 22 bp, Homo sapiens
aagtatatactaaatgttaatc

SEQ ID NO: 7094810 - DNA, 22 bp, Homo sapiens
aagtatatactaaatgttaatc

SEQ ID NO: 7094811 - DNA, 20 bp, Homo sapiens
aagtatatgtccgtgtactt

SEQ ID NO: 7094812 - DNA, 22 bp, Homo sapiens
aagtagcaaggaagattatgat

SEQ ID NO: 7094813 - DNA, 22 bp, Homo sapiens
aagtagcagggattacaggtgt

SEQ ID NO: 7094814 - DNA, 22 bp, Homo sapiens
aagtagcatcaaggaggatcca

SEQ ID NO: 7094815 - DNA, 18 bp, Homo sapiens
aagtagatcatgagccac

SEQ ID NO: 7094816 - DNA, 22 bp, Homo sapiens
aagtagacaataataagacatg

SEQ ID NO: 7094817 - DNA, 22 bp, Homo sapiens
aagtagacttttgcatcaagga

SEQ ID NO: 7094818 - DNA, 22 bp, Homo sapiens
aagtatatactaaatgttaatc

SEQ ID NO: 7094819 - DNA, 19 bp, Homo sapiens
aagtatagtcagccttcta

SEQ ID NO: 7094820 - DNA, 22 bp, Homo sapiens
aagtataatcaaagcagggcta

SEQ ID NO: 7094821 - DNA, 22 bp, Homo sapiens
aagtataagctattcttcatga

SEQ ID NO: 7094822 - DNA, 22 bp, Homo sapiens
aagtagtgtgctccagcggtga

SEQ ID NO: 7094823 - DNA, 22 bp, Homo sapiens
aagtagttgtccctgaggaacg

SEQ ID NO: 7094824 - DNA, 22 bp, Homo sapiens
aagtataagctattcttcatga

SEQ ID NO: 7094825 - DNA, 22 bp, Homo sapiens
aagtccctttaatcagtgcctt

SEQ ID NO: 7094826 - DNA, 22 bp, Homo sapiens
aagtccctttaatcagtgcctt

SEQ ID NO: 7094827 - DNA, 22 bp, Homo sapiens
aagtccctgtggggtggaggct

SEQ ID NO: 7094828 - DNA, 22 bp, Homo sapiens
aagtccctttaatcagtgcctt

SEQ ID NO: 7094829 - DNA, 22 bp, Homo sapiens
aagtccctggttcctagcaaaa

SEQ ID NO: 7094830 - DNA, 22 bp, Homo sapiens
aagtccctggttcctagcaaaa

SEQ ID NO: 7094831 - DNA, 20 bp, Homo sapiens
aagtccctaagtctctggcc

SEQ ID NO: 7094832 - DNA, 22 bp, Homo sapiens
aagtccctggttcctagcaaaa

SEQ ID NO: 7094833 - DNA, 20 bp, Homo sapiens
aagtccctaagtctctggcc

SEQ ID NO: 7094834 - DNA, 22 bp, Homo sapiens
aagtcccatctgcctccatgta

SEQ ID NO: 7094835 - DNA, 22 bp, Homo sapiens
aagtcccatctgcctccatgta

SEQ ID NO: 7094836 - DNA, 22 bp, Homo sapiens
aagtccctggtgctggctgcgc

SEQ ID NO: 7094837 - DNA, 22 bp, Homo sapiens
aagtcccaatccctggcctgct

SEQ ID NO: 7094838 - DNA, 22 bp, Homo sapiens
aagtcccatctgcctccatgta

SEQ ID NO: 7094839 - DNA, 22 bp, Homo sapiens
aagtcccatctgcctccatgta

SEQ ID NO: 7094840 - DNA, 22 bp, Homo sapiens
aagtccctttaatcagtgcctt

SEQ ID NO: 7094841 - DNA, 22 bp, Homo sapiens
aagtccgaaggctggagtggac

SEQ ID NO: 7094842 - DNA, 22 bp, Homo sapiens
aagtcctagacagagccttggc

SEQ ID NO: 7094843 - DNA, 22 bp, Homo sapiens
aagtcctgaaacttctttctga

SEQ ID NO: 7094844 - DNA, 22 bp, Homo sapiens
aagtcctgaaacttctttctga

SEQ ID NO: 7094845 - DNA, 22 bp, Homo sapiens
aagtcctgaagacacagaaaag

SEQ ID NO: 7094846 - DNA, 22 bp, Homo sapiens
aagtcctgaataggggccctgg

SEQ ID NO: 7094847 - DNA, 20 bp, Homo sapiens
aagtcctgacctagtctaaa

SEQ ID NO: 7094848 - DNA, 22 bp, Homo sapiens
aagtcctgagaccagaaaatgg

SEQ ID NO: 7094849 - DNA, 22 bp, Homo sapiens
aagtcctgccacctataagcct

SEQ ID NO: 7094850 - DNA, 22 bp, Homo sapiens
aagtcctgccacctataagcct

SEQ ID NO: 7094851 - DNA, 22 bp, Homo sapiens
aagtcctgccagcaaatgtata

SEQ ID NO: 7094852 - DNA, 22 bp, Homo sapiens
aagtcctggatattaaattgat

SEQ ID NO: 7094853 - DNA, 22 bp, Homo sapiens
aagtcctgggcatttgaacagg

SEQ ID NO: 7094854 - DNA, 22 bp, Homo sapiens
aagtcctgggtgagaactgtcc

SEQ ID NO: 7094855 - DNA, 22 bp, Homo sapiens
aagtcctgtgctagagacacct

SEQ ID NO: 7094856 - DNA, 22 bp, Homo sapiens
aagtcctgtgtgcttacacttg

SEQ ID NO: 7094857 - DNA, 22 bp, Homo sapiens
acctgcctagttggttctgccc

SEQ ID NO: 7094858 - DNA, 22 bp, Homo sapiens
acctgccctggaggaagatatt

SEQ ID NO: 7094859 - DNA, 22 bp, Homo sapiens
acctgcccttaacactgtgtgc

SEQ ID NO: 7094860 - DNA, 22 bp, Homo sapiens
aagtccttggagaatagaaagg

SEQ ID NO: 7094861 - DNA, 22 bp, Homo sapiens
aagtcctttaatatcacatagt

SEQ ID NO: 7094862 - DNA, 22 bp, Homo sapiens
aagtcctttaatatcacatagt

SEQ ID NO: 7094863 - DNA, 22 bp, Homo sapiens
aagtcctttaatatcacatagt

SEQ ID NO: 7094864 - DNA, 22 bp, Homo sapiens
aagtcctgttcctcatacttcc

SEQ ID NO: 7094865 - DNA, 22 bp, Homo sapiens
aagtccttgaagaaacagttct

SEQ ID NO: 7094866 - DNA, 22 bp, Homo sapiens
aagtccttggagaatagaaagg

SEQ ID NO: 7094867 - DNA, 22 bp, Homo sapiens
acctgcctatcagctgcctgct

SEQ ID NO: 7094868 - DNA, 22 bp, Homo sapiens
acctgcctatcagctgcctgct

SEQ ID NO: 7094869 - DNA, 22 bp, Homo sapiens
acctgcctatcagctgcctgct

SEQ ID NO: 7094870 - DNA, 22 bp, Homo sapiens
acctgcctatggagccacatgg

SEQ ID NO: 7094871 - DNA, 22 bp, Homo sapiens
acctgcctatcagctgcctgct

SEQ ID NO: 7094872 - DNA, 22 bp, Homo sapiens
aaggaaggttcatagtcaaaga

SEQ ID NO: 7094873 - DNA, 22 bp, Homo sapiens
aaggaaggttcatagtcaaaga

SEQ ID NO: 7094874 - DNA, 22 bp, Homo sapiens
aaggaaggttcatagtcaaaga

SEQ ID NO: 7094875 - DNA, 21 bp, Homo sapiens
aaggaagtgactttagtggtt

SEQ ID NO: 7094876 - DNA, 21 bp, Homo sapiens
aaggaatgaatggatggatga

SEQ ID NO: 7094877 - DNA, 21 bp, Homo sapiens
aaggaatgaatggatggatga

SEQ ID NO: 7094878 - DNA, 22 bp, Homo sapiens
aaggaatgctctaggagggcag

SEQ ID NO: 7094879 - DNA, 19 bp, Homo sapiens
aaggaatggctttaagtag

SEQ ID NO: 7094880 - DNA, 17 bp, Homo sapiens
aaggaatgtcagaagtt

SEQ ID NO: 7094881 - DNA, 16 bp, Homo sapiens
aaggaatgtcattctg

SEQ ID NO: 7094882 - DNA, 22 bp, Homo sapiens
aaggaattccctttctgacaga

SEQ ID NO: 7094883 - DNA, 22 bp, Homo sapiens
aaggaatttgaggctgcagtga

SEQ ID NO: 7094884 - DNA, 22 bp, Homo sapiens
aaggacaaagcagagctggatg

SEQ ID NO: 7094885 - DNA, 22 bp, Homo sapiens
aaggaagggaaatagtgatgtc

SEQ ID NO: 7094886 - DNA, 22 bp, Homo sapiens
aaggaagggaaatagtgatgtc

SEQ ID NO: 7094887 - DNA, 22 bp, Homo sapiens
aaggaagggaaatagtgatgtc

SEQ ID NO: 7094888 - DNA, 22 bp, Homo sapiens
aaggaagggaaatagtgatgtc

SEQ ID NO: 7094889 - DNA, 22 bp, Homo sapiens
aaggaagctgttagacatgcat

SEQ ID NO: 7094890 - DNA, 22 bp, Homo sapiens
aaggaaggaattgatcatgcgc

SEQ ID NO: 7094891 - DNA, 22 bp, Homo sapiens
aaggaaggaattgatcatgcgc

SEQ ID NO: 7094892 - DNA, 22 bp, Homo sapiens
aaggaagggaaatagtgatgtc

SEQ ID NO: 7094893 - DNA, 22 bp, Homo sapiens
aaggaaggtactcagtgattct

SEQ ID NO: 7094894 - DNA, 22 bp, Homo sapiens
aaggaagcagccagagaccctc

SEQ ID NO: 7094895 - DNA, 22 bp, Homo sapiens
aaggaagatgctggcctgggga

SEQ ID NO: 7094896 - DNA, 22 bp, Homo sapiens
aaggaagatgctggcctgggga

SEQ ID NO: 7094897 - DNA, 22 bp, Homo sapiens
aaggaagaatcatcacgttggg

SEQ ID NO: 7094898 - DNA, 22 bp, Homo sapiens
aaggaagatgaggtgctgctta

SEQ ID NO: 7094899 - DNA, 22 bp, Homo sapiens
aaggaagatgctggcctgggga

SEQ ID NO: 7094900 - DNA, 22 bp, Homo sapiens
aaggacaggcacagtggtggag

SEQ ID NO: 7094901 - DNA, 22 bp, Homo sapiens
aaggacaggagaaaacgggatc

SEQ ID NO: 7094902 - DNA, 22 bp, Homo sapiens
aaggacaggcacagtggtggag

SEQ ID NO: 7094903 - DNA, 22 bp, Homo sapiens
aaggacaggcacagtggtggag

SEQ ID NO: 7094904 - DNA, 22 bp, Homo sapiens
aaggacaggcacagtggtggag

SEQ ID NO: 7094905 - DNA, 22 bp, Homo sapiens
aaggacaggagaaaacgggatc

SEQ ID NO: 7094906 - DNA, 22 bp, Homo sapiens
aaggacagagagccattccaga

SEQ ID NO: 7094907 - DNA, 22 bp, Homo sapiens
aaggacaggagaaaacgggatc

SEQ ID NO: 7094908 - DNA, 22 bp, Homo sapiens
aaggacaggagaaaacgggatc

SEQ ID NO: 7094909 - DNA, 22 bp, Homo sapiens
aaggacaggagaaaacgggatc

SEQ ID NO: 7094910 - DNA, 22 bp, Homo sapiens
aaggacagagagccattccaga

SEQ ID NO: 7094911 - DNA, 22 bp, Homo sapiens
aaggacagagagccattccaga

SEQ ID NO: 7094912 - DNA, 22 bp, Homo sapiens
aaggacagagagccattccaga

SEQ ID NO: 7094913 - DNA, 22 bp, Homo sapiens
aaggacagagagccattccaga

SEQ ID NO: 7094914 - DNA, 22 bp, Homo sapiens
aaggacagaaacagattgctgg

SEQ ID NO: 7094915 - DNA, 22 bp, Homo sapiens
aaggacagaaacagattgctgg

SEQ ID NO: 7094916 - DNA, 22 bp, Homo sapiens
aaggacagagagccattccaga

SEQ ID NO: 7094917 - DNA, 22 bp, Homo sapiens
aaggacaagtagtatttgcatc

SEQ ID NO: 7094918 - DNA, 19 bp, Homo sapiens
aaggacacaacagagatag

SEQ ID NO: 7094919 - DNA, 22 bp, Homo sapiens
aaggacacggggctggctctgg

SEQ ID NO: 7094920 - DNA, 22 bp, Homo sapiens
aaggacagaaacagattgctgg

SEQ ID NO: 7094921 - DNA, 22 bp, Homo sapiens
aaggacagaaacagattgctgg

SEQ ID NO: 7094922 - DNA, 22 bp, Homo sapiens
aaggagggaaagcagtgcttct

SEQ ID NO: 7094923 - DNA, 22 bp, Homo sapiens
aaggaggcctgcgagaaggggc

SEQ ID NO: 7094924 - DNA, 22 bp, Homo sapiens
aaggaggcctggcagatgaaga

SEQ ID NO: 7094925 - DNA, 22 bp, Homo sapiens
aaggcaaatgtgttcttttagt

SEQ ID NO: 7094926 - DNA, 22 bp, Homo sapiens
aaggatttttgctaggaagaca

SEQ ID NO: 7094927 - DNA, 22 bp, Homo sapiens
aaggcaaaagaggtgtcatcac

SEQ ID NO: 7094928 - DNA, 22 bp, Homo sapiens
aagcttcttagaatgcatgtgc

SEQ ID NO: 7094929 - DNA, 22 bp, Homo sapiens
aagcttcttagaatgcatgtgc

SEQ ID NO: 7094930 - DNA, 20 bp, Homo sapiens
aagcttccttgggcgcccgg

SEQ ID NO: 7094931 - DNA, 23 bp, Homo sapiens
aagcttccttgactggcccctag

SEQ ID NO: 7094932 - DNA, 22 bp, Homo sapiens
aagcttcatttcaactcagggg

SEQ ID NO: 7094933 - DNA, 22 bp, Homo sapiens
aagcttcatctgatgccgaact

SEQ ID NO: 7094934 - DNA, 22 bp, Homo sapiens
aagcttcatttcaactcagggg

SEQ ID NO: 7094935 - DNA, 22 bp, Homo sapiens
aagcttcttagaatgcatgtgc

SEQ ID NO: 7094936 - DNA, 22 bp, Homo sapiens
aagcttgaatcaatggatatcc

SEQ ID NO: 7094937 - DNA, 22 bp, Homo sapiens
aagcttgaggtcagtagatgtt

SEQ ID NO: 7094938 - DNA, 22 bp, Homo sapiens
aagcttgatgcagagtcaggga

SEQ ID NO: 7094939 - DNA, 22 bp, Homo sapiens
aagcttgattgtagtctagaca

SEQ ID NO: 7094940 - DNA, 22 bp, Homo sapiens
aagcttggaagtcttcctttca

SEQ ID NO: 7094941 - DNA, 21 bp, Homo sapiens
aagcttggctgatgttattgg

SEQ ID NO: 7094942 - DNA, 22 bp, Homo sapiens
aagcttgggaaccacggtaatc

SEQ ID NO: 7094943 - DNA, 22 bp, Homo sapiens
aaggaagaagggaagttactta

SEQ ID NO: 7094944 - DNA, 22 bp, Homo sapiens
aaggaagaagggaagttactta

SEQ ID NO: 7094945 - DNA, 22 bp, Homo sapiens
aagctgttagggagtggtaggt

SEQ ID NO: 7094946 - DNA, 22 bp, Homo sapiens
aagctgttctccagtgactcag

SEQ ID NO: 7094947 - DNA, 22 bp, Homo sapiens
aagctgttctctaagtttcatg

SEQ ID NO: 7094948 - DNA, 22 bp, Homo sapiens
aagctgttctgaatcagtaagt

SEQ ID NO: 7094949 - DNA, 22 bp, Homo sapiens
aagctgttctgaatcagtaagt

SEQ ID NO: 7094950 - DNA, 22 bp, Homo sapiens
aagctgttgaagtaattcagcc

SEQ ID NO: 7094951 - DNA, 22 bp, Homo sapiens
aagctgttgccctgctctttct

SEQ ID NO: 7094952 - DNA, 22 bp, Homo sapiens
aagctgtttgcagtggatggag

SEQ ID NO: 7094953 - DNA, 22 bp, Homo sapiens
aagcttaatcagtctggttgca

SEQ ID NO: 7094954 - DNA, 22 bp, Homo sapiens
aagcttacagttccacgtagca

SEQ ID NO: 7094955 - DNA, 22 bp, Homo sapiens
aagcttatatcagaacaatgct

SEQ ID NO: 7094956 - DNA, 23 bp, Homo sapiens
aagcttattgccaccttggggag

SEQ ID NO: 7094957 - DNA, 22 bp, Homo sapiens
aagcttcaatgagataattgtt

SEQ ID NO: 7094958 - DNA, 22 bp, Homo sapiens
aagcttcacattgaacttgggt

SEQ ID NO: 7094959 - DNA, 20 bp, Homo sapiens
aagcttcacttcatttgatc

SEQ ID NO: 7094960 - DNA, 22 bp, Homo sapiens
aagcttcaggcccacccatgtc

SEQ ID NO: 7094961 - DNA, 22 bp, Homo sapiens
aagcttcagtggactgtagtgt

SEQ ID NO: 7094962 - DNA, 22 bp, Homo sapiens
aagcttcagtggactgtagtgt

SEQ ID NO: 7094963 - DNA, 22 bp, Homo sapiens
aagcttcagtgtgagcatgtaa

SEQ ID NO: 7094964 - DNA, 22 bp, Homo sapiens
aagcttcagttctggggcaatg

SEQ ID NO: 7094965 - DNA, 22 bp, Homo sapiens
aagcttcatatatgtgtgagtc

SEQ ID NO: 7094966 - DNA, 22 bp, Homo sapiens
aagctgtgtgcagatgatctca

SEQ ID NO: 7094967 - DNA, 22 bp, Homo sapiens
aagctgtgtaagttgcttggtt

SEQ ID NO: 7094968 - DNA, 22 bp, Homo sapiens
aagctgtgagctggatgctcca

SEQ ID NO: 7094969 - DNA, 22 bp, Homo sapiens
aagctgtgcaggaactgcttgc

SEQ ID NO: 7094970 - DNA, 22 bp, Homo sapiens
aagctgtgcctttgcctagaat

SEQ ID NO: 7094971 - DNA, 22 bp, Homo sapiens
aagctggatgtaggatccccct

SEQ ID NO: 7094972 - DNA, 22 bp, Homo sapiens
aagctggatgccttcctcccaa

SEQ ID NO: 7094973 - DNA, 22 bp, Homo sapiens
aagctggatgtaggatccccct

SEQ ID NO: 7094974 - DNA, 22 bp, Homo sapiens
aagctggagagtttcacagatg

SEQ ID NO: 7094975 - DNA, 22 bp, Homo sapiens
aagctggagagtttcacagatg

SEQ ID NO: 7094976 - DNA, 22 bp, Homo sapiens
aagctggaggctgagatcacca

SEQ ID NO: 7094977 - DNA, 22 bp, Homo sapiens
aagctggagtgcagtgcaatgg

SEQ ID NO: 7094978 - DNA, 22 bp, Homo sapiens
aagctggaggctgagatcacca

SEQ ID NO: 7094979 - DNA, 22 bp, Homo sapiens
acagctggagtgaggatggagt

SEQ ID NO: 7094980 - DNA, 22 bp, Homo sapiens
acagctggagtgaggatggagt

SEQ ID NO: 7094981 - DNA, 22 bp, Homo sapiens
acagctggagtgttggtgaggt

SEQ ID NO: 7094982 - DNA, 22 bp, Homo sapiens
aagctggagagtttcacagatg

SEQ ID NO: 7094983 - DNA, 22 bp, Homo sapiens
acagctggaggtctgtgagcac

SEQ ID NO: 7094984 - DNA, 22 bp, Homo sapiens
acagctggagtgaggatggagt

SEQ ID NO: 7094985 - DNA, 22 bp, Homo sapiens
acagctggaggggctgcagagg

SEQ ID NO: 7094986 - DNA, 22 bp, Homo sapiens
acagctggaggggctgcagagg

SEQ ID NO: 7094987 - DNA, 22 bp, Homo sapiens
acagctggaggggctgcagagg

SEQ ID NO: 7094988 - DNA, 22 bp, Homo sapiens
acagctggaggccccattgtcc

SEQ ID NO: 7094989 - DNA, 22 bp, Homo sapiens
acagctggacaggggagagttt

SEQ ID NO: 7094990 - DNA, 22 bp, Homo sapiens
acagctggagccctatggctgg

SEQ ID NO: 7094991 - DNA, 22 bp, Homo sapiens
acatcctcccgatctactggct

SEQ ID NO: 7094992 - DNA, 22 bp, Homo sapiens
acatccgcaggttataaagccc

SEQ ID NO: 7094993 - DNA, 22 bp, Homo sapiens
acatcccttgctcggggcccct

SEQ ID NO: 7094994 - DNA, 22 bp, Homo sapiens
acatcctgaagtcagtcatttg

SEQ ID NO: 7094995 - DNA, 22 bp, Homo sapiens
acatcctgaagtcagtcatttg

SEQ ID NO: 7094996 - DNA, 20 bp, Homo sapiens
acatcctggtgactagaact

SEQ ID NO: 7094997 - DNA, 22 bp, Homo sapiens
acatccttggttgattaatcaa

SEQ ID NO: 7094998 - DNA, 22 bp, Homo sapiens
acatccttagggcagcagccag

SEQ ID NO: 7094999 - DNA, 22 bp, Homo sapiens
acatccttgattatgtaaggat

SEQ ID NO: 7095000 - DNA, 22 bp, Homo sapiens
acatccttaaggttagggtttc

SEQ ID NO: 7095001 - DNA, 22 bp, Homo sapiens
acatctagaagatctgggagat

SEQ ID NO: 7095002 - DNA, 22 bp, Homo sapiens
acatctagactcttgccctctt

SEQ ID NO: 7095003 - DNA, 22 bp, Homo sapiens
acatctagactcttgccctctt

SEQ ID NO: 7095004 - DNA, 22 bp, Homo sapiens
acatctatttttttctgtccat

SEQ ID NO: 7095005 - DNA, 22 bp, Homo sapiens
acatctatttttttctgtccat

SEQ ID NO: 7095006 - DNA, 22 bp, Homo sapiens
acatctcaaattccaggctcca

SEQ ID NO: 7095007 - DNA, 22 bp, Homo sapiens
acatctcaaattccaggctcca

SEQ ID NO: 7095008 - DNA, 22 bp, Homo sapiens
acatctcacttctttgaaggct

SEQ ID NO: 7095009 - DNA, 22 bp, Homo sapiens
acatgacaaaatgcacaggatt

SEQ ID NO: 7095010 - DNA, 22 bp, Homo sapiens
acatgacaaaatgcacaggatt

SEQ ID NO: 7095011 - DNA, 22 bp, Homo sapiens
acatgacaaaatgcacaggatt

SEQ ID NO: 7095012 - DNA, 22 bp, Homo sapiens
acatgaatgcagccataacact

SEQ ID NO: 7095013 - DNA, 22 bp, Homo sapiens
acatgaatatatgaagttcaac

SEQ ID NO: 7095014 - DNA, 22 bp, Homo sapiens
acatgaagcaagaaagatgcta

SEQ ID NO: 7095015 - DNA, 22 bp, Homo sapiens
acatgaagtggtcagatcaaac

SEQ ID NO: 7095016 - DNA, 22 bp, Homo sapiens
acatctcagaactgagtaaccg

SEQ ID NO: 7095017 - DNA, 22 bp, Homo sapiens
acatctcagaactgagtaaccg

SEQ ID NO: 7095018 - DNA, 22 bp, Homo sapiens
acatctcagaactgagtaaccg

SEQ ID NO: 7095019 - DNA, 22 bp, Homo sapiens
acatctcatgaatgataaatca

SEQ ID NO: 7095020 - DNA, 22 bp, Homo sapiens
acatgaaatgcagcctgtaacc

SEQ ID NO: 7095021 - DNA, 22 bp, Homo sapiens
acatgaaattctagctgaaccc

SEQ ID NO: 7095022 - DNA, 22 bp, Homo sapiens
acatgaacactgcttgccacat

SEQ ID NO: 7095023 - DNA, 20 bp, Homo sapiens
acatgaacagggctacagca

SEQ ID NO: 7095024 - DNA, 20 bp, Homo sapiens
acatgaacagggctacagca

SEQ ID NO: 7095025 - DNA, 22 bp, Homo sapiens
acatgaacatgctcaaataact

SEQ ID NO: 7095026 - DNA, 22 bp, Homo sapiens
acatgaacattatatcagcaag

SEQ ID NO: 7095027 - DNA, 19 bp, Homo sapiens
acatgcatatggacagttg

SEQ ID NO: 7095028 - DNA, 22 bp, Homo sapiens
acatgcatatacttaaatatgt

SEQ ID NO: 7095029 - DNA, 19 bp, Homo sapiens
acatgcatatggacagttg

SEQ ID NO: 7095030 - DNA, 19 bp, Homo sapiens
acatgcatatggacagttg

SEQ ID NO: 7095031 - DNA, 22 bp, Homo sapiens
acatgcatctccaggctcattt

SEQ ID NO: 7095032 - DNA, 22 bp, Homo sapiens
acatgcatctccaggctcattt

SEQ ID NO: 7095033 - DNA, 22 bp, Homo sapiens
acatgcatctctgggacacatg

SEQ ID NO: 7095034 - DNA, 22 bp, Homo sapiens
acatgcatctctgggacacatg

SEQ ID NO: 7095035 - DNA, 22 bp, Homo sapiens
acatgcatgaaatccataaaca

SEQ ID NO: 7095036 - DNA, 22 bp, Homo sapiens
acatgcatgaaatccataaaca

SEQ ID NO: 7095037 - DNA, 22 bp, Homo sapiens
acatgcatatacttaaatatgt

SEQ ID NO: 7095038 - DNA, 22 bp, Homo sapiens
acatgcataggagaagtcttta

SEQ ID NO: 7095039 - DNA, 22 bp, Homo sapiens
acatgcatatacttaaatatgt

SEQ ID NO: 7095040 - DNA, 22 bp, Homo sapiens
acatgcatatacttaaatatgt

SEQ ID NO: 7095041 - DNA, 22 bp, Homo sapiens
acatgcatatacttaaatatgt

SEQ ID NO: 7095042 - DNA, 21 bp, Homo sapiens
acatgcatagagagatttctg

SEQ ID NO: 7095043 - DNA, 21 bp, Homo sapiens
acatgcatagagagatttctg

SEQ ID NO: 7095044 - DNA, 21 bp, Homo sapiens
acatgcatagagagatttctg

SEQ ID NO: 7095045 - DNA, 22 bp, Homo sapiens
acatgcataggagaagtcttta

SEQ ID NO: 7095046 - DNA, 22 bp, Homo sapiens
acatgcatgctttggtgggtgt

SEQ ID NO: 7095047 - DNA, 22 bp, Homo sapiens
acatgcatgctttggtgggtgt

SEQ ID NO: 7095048 - DNA, 22 bp, Homo sapiens
acatgcatgctttggtgggtgt

SEQ ID NO: 7095049 - DNA, 22 bp, Homo sapiens
acatgcatggacatgtatatat

SEQ ID NO: 7095050 - DNA, 22 bp, Homo sapiens
acatgcatggacatgtatatat

SEQ ID NO: 7095051 - DNA, 22 bp, Homo sapiens
acatgcatggacatgtatatat

SEQ ID NO: 7095052 - DNA, 22 bp, Homo sapiens
acatgcatggacatgtatatat

SEQ ID NO: 7095053 - DNA, 22 bp, Homo sapiens
acatgcatggacatgtatatat

SEQ ID NO: 7095054 - DNA, 22 bp, Homo sapiens
acatgcatggacatgtatatat

SEQ ID NO: 7095055 - DNA, 22 bp, Homo sapiens
acatgcatggagggaaaatgtc

SEQ ID NO: 7095056 - DNA, 22 bp, Homo sapiens
acatgcatggagggaaaatgtc

SEQ ID NO: 7095057 - DNA, 22 bp, Homo sapiens
acatgcatggagggaaaatgtc

SEQ ID NO: 7095058 - DNA, 22 bp, Homo sapiens
acatgcatggctgcttaaatta

SEQ ID NO: 7095059 - DNA, 22 bp, Homo sapiens
acatgcatggctgcttaaatta

SEQ ID NO: 7095060 - DNA, 22 bp, Homo sapiens
acatgcatggctgcttaaatta

SEQ ID NO: 7095061 - DNA, 22 bp, Homo sapiens
acatgcatggggtaatggtatt

SEQ ID NO: 7095062 - DNA, 22 bp, Homo sapiens
acatgcatggggtaatggtatt

SEQ ID NO: 7095063 - DNA, 22 bp, Homo sapiens
acatgcatggggtaatggtatt

SEQ ID NO: 7095064 - DNA, 22 bp, Homo sapiens
acatgcatggtgttgggttgga

SEQ ID NO: 7095065 - DNA, 22 bp, Homo sapiens
acatgcatggtgttgggttgga

SEQ ID NO: 7095066 - DNA, 22 bp, Homo sapiens
acatgcatggtgttgggttgga

SEQ ID NO: 7095067 - DNA, 22 bp, Homo sapiens
acatgcatgtcatcagcccttt

SEQ ID NO: 7095068 - DNA, 22 bp, Homo sapiens
acatgcatgtcatcagcccttt

SEQ ID NO: 7095069 - DNA, 22 bp, Homo sapiens
acatgcatgtctatgggcaggt

SEQ ID NO: 7095070 - DNA, 22 bp, Homo sapiens
acatgcatgtctatgggcaggt

SEQ ID NO: 7095071 - DNA, 22 bp, Homo sapiens
acatgcatgtctatgggcaggt

SEQ ID NO: 7095072 - DNA, 22 bp, Homo sapiens
acatgcatgtctatgggcaggt

SEQ ID NO: 7095073 - DNA, 22 bp, Homo sapiens
acatgacagtgcttagcaaact

SEQ ID NO: 7095074 - DNA, 22 bp, Homo sapiens
acatgacagtgcttagcaaact

SEQ ID NO: 7095075 - DNA, 22 bp, Homo sapiens
acatgacagtgcttagcaaact

SEQ ID NO: 7095076 - DNA, 22 bp, Homo sapiens
acatgacatagtagaaaagccc

SEQ ID NO: 7095077 - DNA, 22 bp, Homo sapiens
acatgacatagtagaaaagccc

SEQ ID NO: 7095078 - DNA, 22 bp, Homo sapiens
acatgacatagtagaaaagccc

SEQ ID NO: 7095079 - DNA, 22 bp, Homo sapiens
acatgactataattacttaaat

SEQ ID NO: 7095080 - DNA, 17 bp, Homo sapiens
acatgactgcacaaagt

SEQ ID NO: 7095081 - DNA, 22 bp, Homo sapiens
acatgcatacacgtacatacct

SEQ ID NO: 7095082 - DNA, 22 bp, Homo sapiens
acatgcatacacgtacatacct

SEQ ID NO: 7095083 - DNA, 22 bp, Homo sapiens
acatgcatacacgtacatacct

SEQ ID NO: 7095084 - DNA, 22 bp, Homo sapiens
acatgcatacgtgtgtttaaaa

SEQ ID NO: 7095085 - DNA, 22 bp, Homo sapiens
acatgcatacgtgtgtttaaaa

SEQ ID NO: 7095086 - DNA, 22 bp, Homo sapiens
acatgcatacgtgtgtttaaaa

SEQ ID NO: 7095087 - DNA, 22 bp, Homo sapiens
acatgcatactgctgccaacgc

SEQ ID NO: 7095088 - DNA, 22 bp, Homo sapiens
acatgcatactgctgccaacgc

SEQ ID NO: 7095089 - DNA, 22 bp, Homo sapiens
acatgcatactgctgccaacgc

SEQ ID NO: 7095090 - DNA, 19 bp, Homo sapiens
acatgacaacaggggaggc

SEQ ID NO: 7095091 - DNA, 19 bp, Homo sapiens
acatgacaacaggggaggc

SEQ ID NO: 7095092 - DNA, 22 bp, Homo sapiens
acatgacaaggtttataaggct

SEQ ID NO: 7095093 - DNA, 22 bp, Homo sapiens
acatgacaaggtttataaggct

SEQ ID NO: 7095094 - DNA, 22 bp, Homo sapiens
acatgacacaggcctggccaat

SEQ ID NO: 7095095 - DNA, 22 bp, Homo sapiens
acatgacacaggcctggccaat

SEQ ID NO: 7095096 - DNA, 22 bp, Homo sapiens
acatgacacaggcctggccaat

SEQ ID NO: 7095097 - DNA, 22 bp, Homo sapiens
acatgacacctctggctgggtg

SEQ ID NO: 7095098 - DNA, 22 bp, Homo sapiens
acatgacacctctggctgggtg

SEQ ID NO: 7095099 - DNA, 22 bp, Homo sapiens
acatgacacctctggctgggtg

SEQ ID NO: 7095100 - DNA, 22 bp, Homo sapiens
acatgacagggaatgaggtgaa

SEQ ID NO: 7095101 - DNA, 22 bp, Homo sapiens
acatgacagggaatgaggtgaa

SEQ ID NO: 7095102 - DNA, 22 bp, Homo sapiens
acatgacagtgactttataaga

SEQ ID NO: 7095103 - DNA, 22 bp, Homo sapiens
acatgacagtgactttataaga

SEQ ID NO: 7095104 - DNA, 22 bp, Homo sapiens
acatgacagtgactttataaga

SEQ ID NO: 7095105 - DNA, 22 bp, Homo sapiens
acatgacagtgactttataaga

SEQ ID NO: 7095106 - DNA, 22 bp, Homo sapiens
acatgacagtgactttataaga

SEQ ID NO: 7095107 - DNA, 22 bp, Homo sapiens
acatgacagtgcttagcaaact

SEQ ID NO: 7095108 - DNA, 22 bp, Homo sapiens
acatgacagtgcttagcaaact

SEQ ID NO: 7095109 - DNA, 22 bp, Homo sapiens
acatgacagtgcttagcaaact

SEQ ID NO: 7095110 - DNA, 22 bp, Homo sapiens
aaggccagattctctctagggg

SEQ ID NO: 7095111 - DNA, 22 bp, Homo sapiens
aaggccagattctctctagggg

SEQ ID NO: 7095112 - DNA, 22 bp, Homo sapiens
aaggccagagtactagaggctg

SEQ ID NO: 7095113 - DNA, 22 bp, Homo sapiens
aaggccagagttgaactgctcc

SEQ ID NO: 7095114 - DNA, 22 bp, Homo sapiens
aaggccagagttgaactgctcc

SEQ ID NO: 7095115 - DNA, 22 bp, Homo sapiens
aaggccagcagtttgagaccag

SEQ ID NO: 7095116 - DNA, 22 bp, Homo sapiens
aaggccagccctaatgatgctc

SEQ ID NO: 7095117 - DNA, 22 bp, Homo sapiens
aaggccagccctaatgatgctc

SEQ ID NO: 7095118 - DNA, 22 bp, Homo sapiens
aaggccagcctgagagctaaca

SEQ ID NO: 7095119 - DNA, 22 bp, Homo sapiens
aaggccagcctgagagctaaca

SEQ ID NO: 7095120 - DNA, 22 bp, Homo sapiens
aaggccagcctgagagctaaca

SEQ ID NO: 7095121 - DNA, 22 bp, Homo sapiens
aaggccagccttggaaccctga

SEQ ID NO: 7095122 - DNA, 22 bp, Homo sapiens
aaggccagagcgtgtcctgcct

SEQ ID NO: 7095123 - DNA, 22 bp, Homo sapiens
aaggccagagcagactggagtt

SEQ ID NO: 7095124 - DNA, 22 bp, Homo sapiens
aaggccagagcgtgtcctgcct

SEQ ID NO: 7095125 - DNA, 22 bp, Homo sapiens
aaggccagagcagactggagtt

SEQ ID NO: 7095126 - DNA, 22 bp, Homo sapiens
aaggccagagcagactggagtt

SEQ ID NO: 7095127 - DNA, 22 bp, Homo sapiens
aaggccagagtactagaggctg

SEQ ID NO: 7095128 - DNA, 22 bp, Homo sapiens
aaggcaccatgagatgctggtt

SEQ ID NO: 7095129 - DNA, 22 bp, Homo sapiens
aaggcacattcctgaaaacaat

SEQ ID NO: 7095130 - DNA, 22 bp, Homo sapiens
aaggcacattcctgaaaacaat

SEQ ID NO: 7095131 - DNA, 22 bp, Homo sapiens
aaggcacatgacctaggcctgg

SEQ ID NO: 7095132 - DNA, 22 bp, Homo sapiens
aaggcattacctaagtttggga

SEQ ID NO: 7095133 - DNA, 22 bp, Homo sapiens
aaggcattacctaagtttggga

SEQ ID NO: 7095134 - DNA, 22 bp, Homo sapiens
aaggcattcaagatggaagttg

SEQ ID NO: 7095135 - DNA, 22 bp, Homo sapiens
aaggcattgctgatcctcaggt

SEQ ID NO: 7095136 - DNA, 22 bp, Homo sapiens
aaggccagagcagactggagtt

SEQ ID NO: 7095137 - DNA, 18 bp, Homo sapiens
aaggcacaggagaacatt

SEQ ID NO: 7095138 - DNA, 18 bp, Homo sapiens
aaggcacaggagaacatt

SEQ ID NO: 7095139 - DNA, 18 bp, Homo sapiens
aaggcacaggagaacatt

SEQ ID NO: 7095140 - DNA, 17 bp, Homo sapiens
aaggcacagggcactgg

SEQ ID NO: 7095141 - DNA, 22 bp, Homo sapiens
aaggcacagccacttgatcatc

SEQ ID NO: 7095142 - DNA, 18 bp, Homo sapiens
aaggcacaggagaacatt

SEQ ID NO: 7095143 - DNA, 17 bp, Homo sapiens
aaggcacagggcactgg

SEQ ID NO: 7095144 - DNA, 17 bp, Homo sapiens
aaggcacagggcactgg

SEQ ID NO: 7095145 - DNA, 22 bp, Homo sapiens
aaggcacatattgcagatcttg

SEQ ID NO: 7095146 - DNA, 22 bp, Homo sapiens
aaggcacatattttagagtcac

SEQ ID NO: 7095147 - DNA, 22 bp, Homo sapiens
aaggcacatattttagagtcac

SEQ ID NO: 7095148 - DNA, 22 bp, Homo sapiens
aaggcacagaggcagggcactt

SEQ ID NO: 7095149 - DNA, 22 bp, Homo sapiens
aaggcacagaggcagggcactt

SEQ ID NO: 7095150 - DNA, 22 bp, Homo sapiens
aaggcacagaggcagggcactt

SEQ ID NO: 7095151 - DNA, 22 bp, Homo sapiens
aaggcacagccacttgatcatc

SEQ ID NO: 7095152 - DNA, 22 bp, Homo sapiens
aaggcacacagttagatagagc

SEQ ID NO: 7095153 - DNA, 22 bp, Homo sapiens
aaggcacacagttagatagagc

SEQ ID NO: 7095154 - DNA, 22 bp, Homo sapiens
aaggcacagaggcagggcactt

SEQ ID NO: 7095155 - DNA, 22 bp, Homo sapiens
aaggcaattggcttgtataaga

SEQ ID NO: 7095156 - DNA, 22 bp, Homo sapiens
aaggcacaacacaagagggtga

SEQ ID NO: 7095157 - DNA, 22 bp, Homo sapiens
aaggcaactgtaaaacatgcac

SEQ ID NO: 7095158 - DNA, 22 bp, Homo sapiens
aaggcaaatgtgttcttttagt

SEQ ID NO: 7095159 - DNA, 22 bp, Homo sapiens
agaggcaaaaatctatggcaac

SEQ ID NO: 7095160 - DNA, 22 bp, Homo sapiens
agaggattgttactgattagct

SEQ ID NO: 7095161 - DNA, 20 bp, Homo sapiens
agaggatttatgtggatgtg

SEQ ID NO: 7095162 - DNA, 22 bp, Homo sapiens
agaggattttaaaagcatatgt

SEQ ID NO: 7095163 - DNA, 22 bp, Homo sapiens
agaggattttaaaagcatatgt

SEQ ID NO: 7095164 - DNA, 22 bp, Homo sapiens
agaggattttaacttatgcaac

SEQ ID NO: 7095165 - DNA, 22 bp, Homo sapiens
agaggattcttagaattctgag

SEQ ID NO: 7095166 - DNA, 22 bp, Homo sapiens
agaggattgaaggatttgttga

SEQ ID NO: 7095167 - DNA, 22 bp, Homo sapiens
agaggatgttctaggcactcat

SEQ ID NO: 7095168 - DNA, 22 bp, Homo sapiens
agaggattatattttcaacaag

SEQ ID NO: 7095169 - DNA, 22 bp, Homo sapiens
aatttcacagtgaactttgagg

SEQ ID NO: 7095170 - DNA, 22 bp, Homo sapiens
aatttcacagtgaactttgagg

SEQ ID NO: 7095171 - DNA, 22 bp, Homo sapiens
aatttcacagctggtctatggg

SEQ ID NO: 7095172 - DNA, 22 bp, Homo sapiens
aatttcacagctggtctatggg

SEQ ID NO: 7095173 - DNA, 18 bp, Homo sapiens
aatttccatatgaattgc

SEQ ID NO: 7095174 - DNA, 18 bp, Homo sapiens
aatttccatatgaattgc

SEQ ID NO: 7095175 - DNA, 22 bp, Homo sapiens
aatttcctgggataaaaagcca

SEQ ID NO: 7095176 - DNA, 23 bp, Homo sapiens
aatttcccctgtctctgatttgg

SEQ ID NO: 7095177 - DNA, 18 bp, Homo sapiens
aatttccatatgaattgc

SEQ ID NO: 7095178 - DNA, 22 bp, Homo sapiens
aatttcggttcaaggcccagtt

SEQ ID NO: 7095179 - DNA, 22 bp, Homo sapiens
aatttcctgggataaaaagcca

SEQ ID NO: 7095180 - DNA, 22 bp, Homo sapiens
aatttcggttcaaggcccagtt

SEQ ID NO: 7095181 - DNA, 22 bp, Homo sapiens
aatttctaattgaatctctctt

SEQ ID NO: 7095182 - DNA, 22 bp, Homo sapiens
aatttctaattgaatctctctt

SEQ ID NO: 7095183 - DNA, 22 bp, Homo sapiens
agaggaggtccttttctgatgt

SEQ ID NO: 7095184 - DNA, 22 bp, Homo sapiens
agaggacaaaatgagaagtgct

SEQ ID NO: 7095185 - DNA, 22 bp, Homo sapiens
agaggacaaaatgagaagtgct

SEQ ID NO: 7095186 - DNA, 22 bp, Homo sapiens
agaggaggtccttttctgatgt

SEQ ID NO: 7095187 - DNA, 22 bp, Homo sapiens
agaggaggtccttttctgatgt

SEQ ID NO: 7095188 - DNA, 22 bp, Homo sapiens
agaggaggtccttttctgatgt

SEQ ID NO: 7095189 - DNA, 22 bp, Homo sapiens
agaggaggtggtgatgctttaa

SEQ ID NO: 7095190 - DNA, 22 bp, Homo sapiens
agaggaggtggtgatgctttaa

SEQ ID NO: 7095191 - DNA, 22 bp, Homo sapiens
agaggagtattttctaagggaa

SEQ ID NO: 7095192 - DNA, 22 bp, Homo sapiens
agaggaggtggtgatgctttaa

SEQ ID NO: 7095193 - DNA, 22 bp, Homo sapiens
agaggaggtggtgatgctttaa

SEQ ID NO: 7095194 - DNA, 22 bp, Homo sapiens
agaggagtattttctaagggaa

SEQ ID NO: 7095195 - DNA, 22 bp, Homo sapiens
agaggagtgggaagcagtgcaa

SEQ ID NO: 7095196 - DNA, 22 bp, Homo sapiens
agaggatcatctagtttgactc

SEQ ID NO: 7095197 - DNA, 22 bp, Homo sapiens
agaggatgattttaaggacact

SEQ ID NO: 7095198 - DNA, 22 bp, Homo sapiens
agaggatgattttaaggacact

SEQ ID NO: 7095199 - DNA, 22 bp, Homo sapiens
agaggatggttgaggaagacct

SEQ ID NO: 7095200 - DNA, 22 bp, Homo sapiens
agaggatggttgaggaagacct

SEQ ID NO: 7095201 - DNA, 21 bp, Homo sapiens
agaggaagtgattggtctggc

SEQ ID NO: 7095202 - DNA, 22 bp, Homo sapiens
agaggaagtaatcaggacctgc

SEQ ID NO: 7095203 - DNA, 22 bp, Homo sapiens
agaggaagtaatcaggacctgc

SEQ ID NO: 7095204 - DNA, 22 bp, Homo sapiens
agaggaagtaatcaggacctgc

SEQ ID NO: 7095205 - DNA, 22 bp, Homo sapiens
agaggaagtaatcaggacctgc

SEQ ID NO: 7095206 - DNA, 22 bp, Homo sapiens
agaggaagtaatcaggacctgc

SEQ ID NO: 7095207 - DNA, 22 bp, Homo sapiens
agaggaagtaatcaggacctgc

SEQ ID NO: 7095208 - DNA, 22 bp, Homo sapiens
agaggaagtaatcaggacctgc

SEQ ID NO: 7095209 - DNA, 22 bp, Homo sapiens
agaggaatgtatttccctgcaa

SEQ ID NO: 7095210 - DNA, 22 bp, Homo sapiens
agaggaatctgtctagacacaa

SEQ ID NO: 7095211 - DNA, 22 bp, Homo sapiens
agaggaatctgtctagacacaa

SEQ ID NO: 7095212 - DNA, 22 bp, Homo sapiens
agaggaatttctggaaggaggc

SEQ ID NO: 7095213 - DNA, 22 bp, Homo sapiens
agaggaataaatttctgtagtg

SEQ ID NO: 7095214 - DNA, 21 bp, Homo sapiens
agaggaagtgattggtctggc

SEQ ID NO: 7095215 - DNA, 22 bp, Homo sapiens
agaggaatatgggtgcactaga

SEQ ID NO: 7095216 - DNA, 21 bp, Homo sapiens
agaggaagtgattggtctggc

SEQ ID NO: 7095217 - DNA, 22 bp, Homo sapiens
aattccagctaggaaaagcttc

SEQ ID NO: 7095218 - DNA, 22 bp, Homo sapiens
aattccagctaggaaaagcttc

SEQ ID NO: 7095219 - DNA, 22 bp, Homo sapiens
aattccaggatgcaggaggtgc

SEQ ID NO: 7095220 - DNA, 21 bp, Homo sapiens
agagctggtaggtaggtaggt

SEQ ID NO: 7095221 - DNA, 22 bp, Homo sapiens
agaggaaggatgcatatccaaa

SEQ ID NO: 7095222 - DNA, 22 bp, Homo sapiens
agaggaaggatgcatatccaaa

SEQ ID NO: 7095223 - DNA, 22 bp, Homo sapiens
agaggaagtaatcaggacctgc

SEQ ID NO: 7095224 - DNA, 20 bp, Homo sapiens
aattccagcatgatatttat

SEQ ID NO: 7095225 - DNA, 20 bp, Homo sapiens
aattccagcatgatatttat

SEQ ID NO: 7095226 - DNA, 22 bp, Homo sapiens
aattccagaccacaagtgattt

SEQ ID NO: 7095227 - DNA, 22 bp, Homo sapiens
aattccagaccacaagtgattt

SEQ ID NO: 7095228 - DNA, 22 bp, Homo sapiens
aattccacagctgcacagaggt

SEQ ID NO: 7095229 - DNA, 22 bp, Homo sapiens
aattccacagatgtctatctgt

SEQ ID NO: 7095230 - DNA, 22 bp, Homo sapiens
aattccaagagcttcctaagtg

SEQ ID NO: 7095231 - DNA, 18 bp, Homo sapiens
aattccaagccataggag

SEQ ID NO: 7095232 - DNA, 22 bp, Homo sapiens
aattccaagtagcatcccatca

SEQ ID NO: 7095233 - DNA, 22 bp, Homo sapiens
aattccaacagacaaagttaga

SEQ ID NO: 7095234 - DNA, 22 bp, Homo sapiens
aattccaacagacaaagttaga

SEQ ID NO: 7095235 - DNA, 22 bp, Homo sapiens
agagctggaagctgctcttaga

SEQ ID NO: 7095236 - DNA, 22 bp, Homo sapiens
agagctggaaaagttgttttaa

SEQ ID NO: 7095237 - DNA, 22 bp, Homo sapiens
agagctggaaaagttgttttaa

SEQ ID NO: 7095238 - DNA, 22 bp, Homo sapiens
agagctggaatcagacctcagg

SEQ ID NO: 7095239 - DNA, 22 bp, Homo sapiens
aattcatagcaacaaagaccca

SEQ ID NO: 7095240 - DNA, 22 bp, Homo sapiens
aattcatagcaacaaagaccca

SEQ ID NO: 7095241 - DNA, 22 bp, Homo sapiens
aattcatatggatatgctagta

SEQ ID NO: 7095242 - DNA, 22 bp, Homo sapiens
aattccaaatgttttcaatcca

SEQ ID NO: 7095243 - DNA, 22 bp, Homo sapiens
aattcattgccagaatctatga

SEQ ID NO: 7095244 - DNA, 22 bp, Homo sapiens
aattcattgccagaatctatga

SEQ ID NO: 7095245 - DNA, 22 bp, Homo sapiens
aattcatcattttatagctagt

SEQ ID NO: 7095246 - DNA, 22 bp, Homo sapiens
aattcatccatgaacaattcca

SEQ ID NO: 7095247 - DNA, 22 bp, Homo sapiens
aattcatccatgaacaattcca

SEQ ID NO: 7095248 - DNA, 22 bp, Homo sapiens
aattcatccatgaacaattcca

SEQ ID NO: 7095249 - DNA, 22 bp, Homo sapiens
aattcattaagaaagagctaaa

SEQ ID NO: 7095250 - DNA, 22 bp, Homo sapiens
aattcattgccagaatctatga

SEQ ID NO: 7095251 - DNA, 22 bp, Homo sapiens
agagctgccgagctggggccat

SEQ ID NO: 7095252 - DNA, 22 bp, Homo sapiens
agagctgccgagctggggccat

SEQ ID NO: 7095253 - DNA, 22 bp, Homo sapiens
agagctgccgagctggggccat

SEQ ID NO: 7095254 - DNA, 22 bp, Homo sapiens
agagctgcagggtggacccagg

SEQ ID NO: 7095255 - DNA, 22 bp, Homo sapiens
agagctgcccacacagcagatt

SEQ ID NO: 7095256 - DNA, 22 bp, Homo sapiens
agagctgcccacacagcagatt

SEQ ID NO: 7095257 - DNA, 22 bp, Homo sapiens
agagctgcaatttcatgtggtg

SEQ ID NO: 7095258 - DNA, 22 bp, Homo sapiens
agagctgcaatttcatgtggtg

SEQ ID NO: 7095259 - DNA, 22 bp, Homo sapiens
agagctgcagggtggacccagg

SEQ ID NO: 7095260 - DNA, 22 bp, Homo sapiens
agagctgaggatccagctgagc

SEQ ID NO: 7095261 - DNA, 22 bp, Homo sapiens
agagctgaggatccagctgagc

SEQ ID NO: 7095262 - DNA, 22 bp, Homo sapiens
agagctgcaacttcataggcct

SEQ ID NO: 7095263 - DNA, 22 bp, Homo sapiens
agagctgcaatttcatgtggtg

SEQ ID NO: 7095264 - DNA, 22 bp, Homo sapiens
agagctgaggatccagctgagc

SEQ ID NO: 7095265 - DNA, 22 bp, Homo sapiens
agagctgagaatgtggcttcct

SEQ ID NO: 7095266 - DNA, 22 bp, Homo sapiens
agagctgagcaccaagcatggt

SEQ ID NO: 7095267 - DNA, 22 bp, Homo sapiens
agagctgaatttgggtggtgga

SEQ ID NO: 7095268 - DNA, 22 bp, Homo sapiens
aattaagaaaatgttttatgat

SEQ ID NO: 7095269 - DNA, 22 bp, Homo sapiens
aattaagagagagttgaagcaa

SEQ ID NO: 7095270 - DNA, 22 bp, Homo sapiens
aattaagagagagttgaagcaa

SEQ ID NO: 7095271 - DNA, 22 bp, Homo sapiens
aattaagagagagttgaagcaa

SEQ ID NO: 7095272 - DNA, 22 bp, Homo sapiens
aattaagtcacacacctaaacc

SEQ ID NO: 7095273 - DNA, 22 bp, Homo sapiens
aattaatggaaagtaaggaagg

SEQ ID NO: 7095274 - DNA, 22 bp, Homo sapiens
aattaatatttgtggaattaat

SEQ ID NO: 7095275 - DNA, 22 bp, Homo sapiens
aattaatatttgtggaattaat

SEQ ID NO: 7095276 - DNA, 22 bp, Homo sapiens
aattaatggaaagtaaggaagg

SEQ ID NO: 7095277 - DNA, 22 bp, Homo sapiens
agagcacagcagatctctgatg

SEQ ID NO: 7095278 - DNA, 22 bp, Homo sapiens
aattaacagagggcttattact

SEQ ID NO: 7095279 - DNA, 22 bp, Homo sapiens
aattaactaaaattcactttat

SEQ ID NO: 7095280 - DNA, 22 bp, Homo sapiens
agagcacaaattttaaggaggc

SEQ ID NO: 7095281 - DNA, 22 bp, Homo sapiens
agagcacactgacgtcagtctg

SEQ ID NO: 7095282 - DNA, 22 bp, Homo sapiens
agagcacactgacgtcagtctg

SEQ ID NO: 7095283 - DNA, 22 bp, Homo sapiens
agagcacagaagaataggtgct

SEQ ID NO: 7095284 - DNA, 22 bp, Homo sapiens
agagcacagaagttatatgtta

SEQ ID NO: 7095285 - DNA, 22 bp, Homo sapiens
agagctgaattcaagtgctggc

SEQ ID NO: 7095286 - DNA, 22 bp, Homo sapiens
agagctgaattcaagtgctggc

SEQ ID NO: 7095287 - DNA, 22 bp, Homo sapiens
agagcctggctcccagctaccg

SEQ ID NO: 7095288 - DNA, 22 bp, Homo sapiens
agagcctggctcccagctaccg

SEQ ID NO: 7095289 - DNA, 22 bp, Homo sapiens
agagcctggctcccagctaccg

SEQ ID NO: 7095290 - DNA, 22 bp, Homo sapiens
aattacagtcggagcagcactg

SEQ ID NO: 7095291 - DNA, 22 bp, Homo sapiens
agagcctggcaaaaggtcctgc

SEQ ID NO: 7095292 - DNA, 21 bp, Homo sapiens
aattacagatggaattacaga

SEQ ID NO: 7095293 - DNA, 21 bp, Homo sapiens
aattacagatggaattacaga

SEQ ID NO: 7095294 - DNA, 21 bp, Homo sapiens
aattacagatggaattacaga

SEQ ID NO: 7095295 - DNA, 23 bp, Homo sapiens
aattacaaccaagaactggaagg

SEQ ID NO: 7095296 - DNA, 23 bp, Homo sapiens
aattacaaccaagaactggaagg

SEQ ID NO: 7095297 - DNA, 22 bp, Homo sapiens
aattaattcagtttttaaggga

SEQ ID NO: 7095298 - DNA, 22 bp, Homo sapiens
aattaattttgttcattcagtc

SEQ ID NO: 7095299 - DNA, 22 bp, Homo sapiens
aattaattttgttcattcagtc

SEQ ID NO: 7095300 - DNA, 22 bp, Homo sapiens
aatgctattcattaagcctact

SEQ ID NO: 7095301 - DNA, 22 bp, Homo sapiens
aatgctctctgccatagctaac

SEQ ID NO: 7095302 - DNA, 22 bp, Homo sapiens
aatgctacagaagtgatcttgg

SEQ ID NO: 7095303 - DNA, 22 bp, Homo sapiens
aatgctatcggctctaagcatg

SEQ ID NO: 7095304 - DNA, 22 bp, Homo sapiens
aatgctctttgaatttgtcaga

SEQ ID NO: 7095305 - DNA, 22 bp, Homo sapiens
aatgctgaatttagtatttatg

SEQ ID NO: 7095306 - DNA, 22 bp, Homo sapiens
aatgctgagggatgagagaggc

SEQ ID NO: 7095307 - DNA, 22 bp, Homo sapiens
aatgctaaaatggcactaaagt

SEQ ID NO: 7095308 - DNA, 22 bp, Homo sapiens
aatgctaaatgtgttatgttaa

SEQ ID NO: 7095309 - DNA, 22 bp, Homo sapiens
aatgcgtattgagcatctacta

SEQ ID NO: 7095310 - DNA, 22 bp, Homo sapiens
aatgccttggagagcctagagg

SEQ ID NO: 7095311 - DNA, 22 bp, Homo sapiens
aatgccttggagagcctagagg

SEQ ID NO: 7095312 - DNA, 22 bp, Homo sapiens
aatgccttgcctgctacaactt

SEQ ID NO: 7095313 - DNA, 22 bp, Homo sapiens
aatgccttggagagcctagagg

SEQ ID NO: 7095314 - DNA, 22 bp, Homo sapiens
aatgccttggagagcctagagg

SEQ ID NO: 7095315 - DNA, 22 bp, Homo sapiens
aatgccttggagagcctagagg

SEQ ID NO: 7095316 - DNA, 22 bp, Homo sapiens
aatgccttggagagcctagagg

SEQ ID NO: 7095317 - DNA, 22 bp, Homo sapiens
agacagggtgatcgcttgagcc

SEQ ID NO: 7095318 - DNA, 22 bp, Homo sapiens
agacaggtaaatagagatgctg

SEQ ID NO: 7095319 - DNA, 22 bp, Homo sapiens
agacaggtaaatagagatgctg

SEQ ID NO: 7095320 - DNA, 22 bp, Homo sapiens
agacaggtagcaggacagatat

SEQ ID NO: 7095321 - DNA, 23 bp, Homo sapiens
agacatcaggatggtggctggga

SEQ ID NO: 7095322 - DNA, 23 bp, Homo sapiens
agacatcaggatggtggctggga

SEQ ID NO: 7095323 - DNA, 22 bp, Homo sapiens
agacatgacagatagttgctag

SEQ ID NO: 7095324 - DNA, 22 bp, Homo sapiens
agacatgacagatagttgctag

SEQ ID NO: 7095325 - DNA, 22 bp, Homo sapiens
agacatgagaaacccaccagag

SEQ ID NO: 7095326 - DNA, 19 bp, Homo sapiens
agacatgagacacaggatg

SEQ ID NO: 7095327 - DNA, 19 bp, Homo sapiens
agacatgagacacaggatg

SEQ ID NO: 7095328 - DNA, 22 bp, Homo sapiens
agacatgcaataatgtgcactc

SEQ ID NO: 7095329 - DNA, 22 bp, Homo sapiens
agacatgcattgcaatatccat

SEQ ID NO: 7095330 - DNA, 22 bp, Homo sapiens
agacatgccaagaaacccagtg

SEQ ID NO: 7095331 - DNA, 22 bp, Homo sapiens
agacatggagaaggagccagtg

SEQ ID NO: 7095332 - DNA, 22 bp, Homo sapiens
agacatgtcaccaattcttact

SEQ ID NO: 7095333 - DNA, 22 bp, Homo sapiens
agacatgtcaccaattcttact

SEQ ID NO: 7095334 - DNA, 22 bp, Homo sapiens
agacatggagaaggagccagtg

SEQ ID NO: 7095335 - DNA, 22 bp, Homo sapiens
agacatgtccacaaagcattca

SEQ ID NO: 7095336 - DNA, 21 bp, Homo sapiens
agacatgtgaactaaaggtga

SEQ ID NO: 7095337 - DNA, 21 bp, Homo sapiens
agacatgtgaactaaaggtga

SEQ ID NO: 7095338 - DNA, 22 bp, Homo sapiens
agacatgtggtataatcagggg

SEQ ID NO: 7095339 - DNA, 22 bp, Homo sapiens
agacatgtggtataatcagggg

SEQ ID NO: 7095340 - DNA, 22 bp, Homo sapiens
agacattatgctgagtgaaaga

SEQ ID NO: 7095341 - DNA, 22 bp, Homo sapiens
agacattatgctgagtgaaaga

SEQ ID NO: 7095342 - DNA, 22 bp, Homo sapiens
agacattatgctgagtgaaaga

SEQ ID NO: 7095343 - DNA, 22 bp, Homo sapiens
agacattatggctttcactggg

SEQ ID NO: 7095344 - DNA, 22 bp, Homo sapiens
agacattatggctttcactggg

SEQ ID NO: 7095345 - DNA, 22 bp, Homo sapiens
aatgtataatatttaatgcttt

SEQ ID NO: 7095346 - DNA, 22 bp, Homo sapiens
aatgtataatatttaatgcttt

SEQ ID NO: 7095347 - DNA, 22 bp, Homo sapiens
aatgtataatatttaatgcttt

SEQ ID NO: 7095348 - DNA, 22 bp, Homo sapiens
agacattgttggcctatcctct

SEQ ID NO: 7095349 - DNA, 22 bp, Homo sapiens
agacatttagacccctgtagtt

SEQ ID NO: 7095350 - DNA, 22 bp, Homo sapiens
agacatttatgtttctctagga

SEQ ID NO: 7095351 - DNA, 22 bp, Homo sapiens
agacatttatgtttctctagga

SEQ ID NO: 7095352 - DNA, 22 bp, Homo sapiens
agacatttattcacacatttat

SEQ ID NO: 7095353 - DNA, 22 bp, Homo sapiens
agacatttattcacacatttat

SEQ ID NO: 7095354 - DNA, 22 bp, Homo sapiens
aatgtatgagcgtgaaagcact

SEQ ID NO: 7095355 - DNA, 22 bp, Homo sapiens
aatgtatctgccacgatgctat

SEQ ID NO: 7095356 - DNA, 22 bp, Homo sapiens
aatgtatcagtgatttgcttgc

SEQ ID NO: 7095357 - DNA, 22 bp, Homo sapiens
aatgtatcggagcttggggtgg

SEQ ID NO: 7095358 - DNA, 22 bp, Homo sapiens
aatgtatctagacttgctggct

SEQ ID NO: 7095359 - DNA, 20 bp, Homo sapiens
aatgtatattttatgccagg

SEQ ID NO: 7095360 - DNA, 20 bp, Homo sapiens
aatgtatatgtgaccccaaa

SEQ ID NO: 7095361 - DNA, 20 bp, Homo sapiens
aatgtatatgtgaccccaaa

SEQ ID NO: 7095362 - DNA, 20 bp, Homo sapiens
aatgtatattttatgccagg

SEQ ID NO: 7095363 - DNA, 20 bp, Homo sapiens
aatgtatattttatgccagg

SEQ ID NO: 7095364 - DNA, 22 bp, Homo sapiens
aatgtatgtgtatatcaaatca

SEQ ID NO: 7095365 - DNA, 22 bp, Homo sapiens
aatgtatgggtgagaaagttga

SEQ ID NO: 7095366 - DNA, 22 bp, Homo sapiens
aatgtatgtgtatatcaaatca

SEQ ID NO: 7095367 - DNA, 22 bp, Homo sapiens
aatgtattatacataatttgtg

SEQ ID NO: 7095368 - DNA, 22 bp, Homo sapiens
aatgtgtagcatttaatgcagt

SEQ ID NO: 7095369 - DNA, 22 bp, Homo sapiens
aatgtgtagcatttaatgcagt

SEQ ID NO: 7095370 - DNA, 22 bp, Homo sapiens
agagaaggggtaaagagtcctg

SEQ ID NO: 7095371 - DNA, 22 bp, Homo sapiens
agagaaggggtaaagagtcctg

SEQ ID NO: 7095372 - DNA, 22 bp, Homo sapiens
agagaaggggtaaagagtcctg

SEQ ID NO: 7095373 - DNA, 22 bp, Homo sapiens
agagaaggggtaaagagtcctg

SEQ ID NO: 7095374 - DNA, 22 bp, Homo sapiens
agagaaggggtaaagagtcctg

SEQ ID NO: 7095375 - DNA, 22 bp, Homo sapiens
agagaaggggtaaagagtcctg

SEQ ID NO: 7095376 - DNA, 22 bp, Homo sapiens
agagaagggggaaagatctcac

SEQ ID NO: 7095377 - DNA, 22 bp, Homo sapiens
agagaagggggaaagatctcac

SEQ ID NO: 7095378 - DNA, 22 bp, Homo sapiens
agagaagggggaaagatctcac

SEQ ID NO: 7095379 - DNA, 22 bp, Homo sapiens
agagaaggggtaaagagtcctg

SEQ ID NO: 7095380 - DNA, 22 bp, Homo sapiens
agagaaggggtaaagagtcctg

SEQ ID NO: 7095381 - DNA, 22 bp, Homo sapiens
agagaagggggaaagatctcac

SEQ ID NO: 7095382 - DNA, 22 bp, Homo sapiens
agagaagggggaaagatctcac

SEQ ID NO: 7095383 - DNA, 22 bp, Homo sapiens
agagaagggggaaagatctcac

SEQ ID NO: 7095384 - DNA, 22 bp, Homo sapiens
agagaagggggaaagatctcac

SEQ ID NO: 7095385 - DNA, 22 bp, Homo sapiens
agagaagggcctgtatgtaatc

SEQ ID NO: 7095386 - DNA, 22 bp, Homo sapiens
agagaagggcctgtatgtaatc

SEQ ID NO: 7095387 - DNA, 22 bp, Homo sapiens
agagaagggcctgtatgtaatc

SEQ ID NO: 7095388 - DNA, 21 bp, Homo sapiens
agagaagggattccaggccct

SEQ ID NO: 7095389 - DNA, 21 bp, Homo sapiens
agagaagggattccaggccct

SEQ ID NO: 7095390 - DNA, 21 bp, Homo sapiens
agagaagggactcttccagtc

SEQ ID NO: 7095391 - DNA, 21 bp, Homo sapiens
agagaagggattccaggccct

SEQ ID NO: 7095392 - DNA, 21 bp, Homo sapiens
agagaagggattccaggccct

SEQ ID NO: 7095393 - DNA, 21 bp, Homo sapiens
agagaagggattccaggccct

SEQ ID NO: 7095394 - DNA, 21 bp, Homo sapiens
agagaagggactcttccagtc

SEQ ID NO: 7095395 - DNA, 22 bp, Homo sapiens
agagaaggcatagaacttgagt

SEQ ID NO: 7095396 - DNA, 22 bp, Homo sapiens
agagaagggaagggattcaccc

SEQ ID NO: 7095397 - DNA, 22 bp, Homo sapiens
agagaagggaagggattcaccc

SEQ ID NO: 7095398 - DNA, 22 bp, Homo sapiens
agagaagggaagggattcaccc

SEQ ID NO: 7095399 - DNA, 22 bp, Homo sapiens
agagaagggaagggattcaccc

SEQ ID NO: 7095400 - DNA, 21 bp, Homo sapiens
agagaagggactcttccagtc

SEQ ID NO: 7095401 - DNA, 19 bp, Homo sapiens
agagaaggatcctatggtt

SEQ ID NO: 7095402 - DNA, 22 bp, Homo sapiens
agagaaggcatagaacttgagt

SEQ ID NO: 7095403 - DNA, 22 bp, Homo sapiens
agagaaatttccctgccttctg

SEQ ID NO: 7095404 - DNA, 19 bp, Homo sapiens
agagaaggatcctatggtt

SEQ ID NO: 7095405 - DNA, 22 bp, Homo sapiens
agagaaggcatagaacttgagt

SEQ ID NO: 7095406 - DNA, 22 bp, Homo sapiens
aatgtattatacataatttgtg

SEQ ID NO: 7095407 - DNA, 22 bp, Homo sapiens
aatgtattcctcatgcaagagt

SEQ ID NO: 7095408 - DNA, 22 bp, Homo sapiens
aatgtattcctcatgcaagagt

SEQ ID NO: 7095409 - DNA, 22 bp, Homo sapiens
agagaaattctcagtggaagat

SEQ ID NO: 7095410 - DNA, 22 bp, Homo sapiens
aatgtgtatactggcaattaag

SEQ ID NO: 7095411 - DNA, 22 bp, Homo sapiens
aatgtgtataagggagagctaa

SEQ ID NO: 7095412 - DNA, 22 bp, Homo sapiens
aatgtgtatactggcaattaag

SEQ ID NO: 7095413 - DNA, 22 bp, Homo sapiens
aatgtgtatactggcaattaag

SEQ ID NO: 7095414 - DNA, 22 bp, Homo sapiens
aatgtgtatatgaacatacagg

SEQ ID NO: 7095415 - DNA, 22 bp, Homo sapiens
aatgtgtatgaggaagagagaa

SEQ ID NO: 7095416 - DNA, 22 bp, Homo sapiens
aatgtgtcagcttgtcgatctt

SEQ ID NO: 7095417 - DNA, 22 bp, Homo sapiens
aatgtgtcagcttgtcgatctt

SEQ ID NO: 7095418 - DNA, 22 bp, Homo sapiens
aatgtgtcatttcccacaggtg

SEQ ID NO: 7095419 - DNA, 22 bp, Homo sapiens
aatgtgtcatttcccacaggtg

SEQ ID NO: 7095420 - DNA, 22 bp, Homo sapiens
aatgtgtcccttatttcacagg

SEQ ID NO: 7095421 - DNA, 22 bp, Homo sapiens
aatgtgtcccttatttcacagg

SEQ ID NO: 7095422 - DNA, 22 bp, Homo sapiens
aatgtgtctatgtggttcacag

SEQ ID NO: 7095423 - DNA, 22 bp, Homo sapiens
aatgtgtgaacactaatgcaac

SEQ ID NO: 7095424 - DNA, 22 bp, Homo sapiens
agagatctgtggattcattgtc

SEQ ID NO: 7095425 - DNA, 22 bp, Homo sapiens
agagatgaaaagggtactgagg

SEQ ID NO: 7095426 - DNA, 22 bp, Homo sapiens
agagatgaaaagggtactgagg

SEQ ID NO: 7095427 - DNA, 22 bp, Homo sapiens
agagcaattagcttaggtaaaa

SEQ ID NO: 7095428 - DNA, 22 bp, Homo sapiens
agagcaatttcttctccaagtt

SEQ ID NO: 7095429 - DNA, 22 bp, Homo sapiens
agagcacaaattagttggtctt

SEQ ID NO: 7095430 - DNA, 21 bp, Homo sapiens
agagcaagttaaggcattaat

SEQ ID NO: 7095431 - DNA, 22 bp, Homo sapiens
agagcaatggcatccagctgat

SEQ ID NO: 7095432 - DNA, 22 bp, Homo sapiens
agagcaagtgacagaaacaggg

SEQ ID NO: 7095433 - DNA, 22 bp, Homo sapiens
agagcaagtgacagaaacaggg

SEQ ID NO: 7095434 - DNA, 22 bp, Homo sapiens
agagcaagtgacagaaacaggg

SEQ ID NO: 7095435 - DNA, 22 bp, Homo sapiens
agagcaagtgacagaaacaggg

SEQ ID NO: 7095436 - DNA, 22 bp, Homo sapiens
agagatttctactgcactcttt

SEQ ID NO: 7095437 - DNA, 22 bp, Homo sapiens
agagatttgtcaatgatttcca

SEQ ID NO: 7095438 - DNA, 22 bp, Homo sapiens
agagatttatactgcaccagaa

SEQ ID NO: 7095439 - DNA, 22 bp, Homo sapiens
agagatttatactgcaccagaa

SEQ ID NO: 7095440 - DNA, 22 bp, Homo sapiens
agagatttctactgcactcttt

SEQ ID NO: 7095441 - DNA, 20 bp, Homo sapiens
agagattttagtagccacag

SEQ ID NO: 7095442 - DNA, 20 bp, Homo sapiens
agagattttagtagccacag

SEQ ID NO: 7095443 - DNA, 22 bp, Homo sapiens
agagcaaagggacatggaagag

SEQ ID NO: 7095444 - DNA, 22 bp, Homo sapiens
agagcaaagggacatggaagag

SEQ ID NO: 7095445 - DNA, 23 bp, Homo sapiens
agagcaaggaaatgaggtgtgat

SEQ ID NO: 7095446 - DNA, 22 bp, Homo sapiens
agagcaacagagaaatttaggt

SEQ ID NO: 7095447 - DNA, 22 bp, Homo sapiens
agatgccagcttacactgggaa

SEQ ID NO: 7095448 - DNA, 22 bp, Homo sapiens
agatgcatgtttatgtctttcc

SEQ ID NO: 7095449 - DNA, 22 bp, Homo sapiens
agatgcatgtttatgtctttcc

SEQ ID NO: 7095450 - DNA, 22 bp, Homo sapiens
agatgcatggaaatctcattac

SEQ ID NO: 7095451 - DNA, 22 bp, Homo sapiens
agatgcatggaaatctcattac

SEQ ID NO: 7095452 - DNA, 21 bp, Homo sapiens
agatgcagtttgcaggtgggt

SEQ ID NO: 7095453 - DNA, 21 bp, Homo sapiens
agatgcagtttgcaggtgggt

SEQ ID NO: 7095454 - DNA, 21 bp, Homo sapiens
agatgcagtttgcaggtgggt

SEQ ID NO: 7095455 - DNA, 21 bp, Homo sapiens
agatgcagtgacccactgggg

SEQ ID NO: 7095456 - DNA, 21 bp, Homo sapiens
agatgcagtgacccactgggg

SEQ ID NO: 7095457 - DNA, 22 bp, Homo sapiens
agatgcagatttggattcagga

SEQ ID NO: 7095458 - DNA, 22 bp, Homo sapiens
agatgcagatttggattcagga

SEQ ID NO: 7095459 - DNA, 22 bp, Homo sapiens
agatgcagtggttaacaataca

SEQ ID NO: 7095460 - DNA, 21 bp, Homo sapiens
agatgcagttatgagatgcag

SEQ ID NO: 7095461 - DNA, 21 bp, Homo sapiens
agatgcagttatgagatgcag

SEQ ID NO: 7095462 - DNA, 21 bp, Homo sapiens
agatgcagttatgagatgcag

SEQ ID NO: 7095463 - DNA, 22 bp, Homo sapiens
agatgcagacttggttcaggca

SEQ ID NO: 7095464 - DNA, 22 bp, Homo sapiens
agatgcagacttggttcaggca

SEQ ID NO: 7095465 - DNA, 22 bp, Homo sapiens
agatgcagacttggttcaggca

SEQ ID NO: 7095466 - DNA, 22 bp, Homo sapiens
agatgcagacttggttcaggca

SEQ ID NO: 7095467 - DNA, 22 bp, Homo sapiens
agatgcagagtttgctgtggac

SEQ ID NO: 7095468 - DNA, 22 bp, Homo sapiens
agatgctgctccacaggccagg

SEQ ID NO: 7095469 - DNA, 22 bp, Homo sapiens
agatgctgaagctgaggcaaca

SEQ ID NO: 7095470 - DNA, 22 bp, Homo sapiens
agatgctgaattattgtgcttt

SEQ ID NO: 7095471 - DNA, 21 bp, Homo sapiens
agatgctgatgctgcaggtcc

SEQ ID NO: 7095472 - DNA, 22 bp, Homo sapiens
agatgctgattgaatagatttc

SEQ ID NO: 7095473 - DNA, 22 bp, Homo sapiens
agatgctgcagcctggactgga

SEQ ID NO: 7095474 - DNA, 23 bp, Homo sapiens
acaacaggaaatcagacctgaac

SEQ ID NO: 7095475 - DNA, 22 bp, Homo sapiens
acaacagggtaaggcaggccat

SEQ ID NO: 7095476 - DNA, 22 bp, Homo sapiens
acaacagggtaaggcaggccat

SEQ ID NO: 7095477 - DNA, 22 bp, Homo sapiens
acaacagtagcctttacaaggc

SEQ ID NO: 7095478 - DNA, 22 bp, Homo sapiens
acaacagagctggactgagagg

SEQ ID NO: 7095479 - DNA, 22 bp, Homo sapiens
acaacagctgttcacaggggtc

SEQ ID NO: 7095480 - DNA, 23 bp, Homo sapiens
acaacaggaaatcagacctgaac

SEQ ID NO: 7095481 - DNA, 22 bp, Homo sapiens
acaacagtagcctttacaaggc

SEQ ID NO: 7095482 - DNA, 22 bp, Homo sapiens
acaacagtaggaaaacatgtct

SEQ ID NO: 7095483 - DNA, 22 bp, Homo sapiens
acaacagtaggaaaacatgtct

SEQ ID NO: 7095484 - DNA, 22 bp, Homo sapiens
acaaagtgctgacattacaggc

SEQ ID NO: 7095485 - DNA, 22 bp, Homo sapiens
acaaagtgcacaagatgagaac

SEQ ID NO: 7095486 - DNA, 22 bp, Homo sapiens
acaaagtctctaataatcttct

SEQ ID NO: 7095487 - DNA, 22 bp, Homo sapiens
acaaagtctctaataatcttct

SEQ ID NO: 7095488 - DNA, 22 bp, Homo sapiens
agagttccacgtacagcttttg

SEQ ID NO: 7095489 - DNA, 22 bp, Homo sapiens
acaaagtgtgcggagcccaggg

SEQ ID NO: 7095490 - DNA, 22 bp, Homo sapiens
acaaagtttcttctaacatctg

SEQ ID NO: 7095491 - DNA, 22 bp, Homo sapiens
acaaagtttcttctaacatctg

SEQ ID NO: 7095492 - DNA, 22 bp, Homo sapiens
acaaagtttcttctaacatctg

SEQ ID NO: 7095493 - DNA, 22 bp, Homo sapiens
acaaatagagattcaaataaag

SEQ ID NO: 7095494 - DNA, 22 bp, Homo sapiens
acaaatagagattcaaataaag

SEQ ID NO: 7095495 - DNA, 16 bp, Homo sapiens
acaaatacaactgctg

SEQ ID NO: 7095496 - DNA, 22 bp, Homo sapiens
agatctttagaagatagaatca

SEQ ID NO: 7095497 - DNA, 20 bp, Homo sapiens
agatcttttctatagaagtg

SEQ ID NO: 7095498 - DNA, 22 bp, Homo sapiens
agagtgggttataggcagactt

SEQ ID NO: 7095499 - DNA, 22 bp, Homo sapiens
agagtgggttataggcagactt

SEQ ID NO: 7095500 - DNA, 22 bp, Homo sapiens
agagtgggttataggcagactt

SEQ ID NO: 7095501 - DNA, 22 bp, Homo sapiens
agagtgggttataggcagactt

SEQ ID NO: 7095502 - DNA, 22 bp, Homo sapiens
agagtgggttataggcagactt

SEQ ID NO: 7095503 - DNA, 22 bp, Homo sapiens
agagtgggttataggcagactt

SEQ ID NO: 7095504 - DNA, 22 bp, Homo sapiens
agagtggtggccgtggtgtcac

SEQ ID NO: 7095505 - DNA, 22 bp, Homo sapiens
agagtgtaataagggcaagggc

SEQ ID NO: 7095506 - DNA, 22 bp, Homo sapiens
agagtgaagtttttgaaagtga

SEQ ID NO: 7095507 - DNA, 22 bp, Homo sapiens
agagtgaagtttttgaaagtga

SEQ ID NO: 7095508 - DNA, 20 bp, Homo sapiens
agagtgggtgtcacaggctg

SEQ ID NO: 7095509 - DNA, 20 bp, Homo sapiens
agagtgggtgtcacaggctg

SEQ ID NO: 7095510 - DNA, 20 bp, Homo sapiens
agagtgggtgtcacaggctg

SEQ ID NO: 7095511 - DNA, 22 bp, Homo sapiens
agagtgaagtttttgaaagtga

SEQ ID NO: 7095512 - DNA, 22 bp, Homo sapiens
agagtgaagttcatcgtgcagc

SEQ ID NO: 7095513 - DNA, 22 bp, Homo sapiens
agagtgaagtaattgttaggat

SEQ ID NO: 7095514 - DNA, 22 bp, Homo sapiens
aatttgtacaaaatgtttataa

SEQ ID NO: 7095515 - DNA, 22 bp, Homo sapiens
aatttgtataaaatggtgtttt

SEQ ID NO: 7095516 - DNA, 22 bp, Homo sapiens
aatttgtataaaatggtgtttt

SEQ ID NO: 7095517 - DNA, 22 bp, Homo sapiens
aatttggggaggttcagactct

SEQ ID NO: 7095518 - DNA, 22 bp, Homo sapiens
agagtgttatttgctctgtatt

SEQ ID NO: 7095519 - DNA, 22 bp, Homo sapiens
agagtgtgtctatggaaggggt

SEQ ID NO: 7095520 - DNA, 22 bp, Homo sapiens
agagtgtgtctatggaaggggt

SEQ ID NO: 7095521 - DNA, 22 bp, Homo sapiens
agagtgtgtggggctgaggtca

SEQ ID NO: 7095522 - DNA, 22 bp, Homo sapiens
agagtgtaccaaatatcctaca

SEQ ID NO: 7095523 - DNA, 22 bp, Homo sapiens
agagtgtggaaatgttcagagt

SEQ ID NO: 7095524 - DNA, 22 bp, Homo sapiens
agagtgtttttctgtcaaggac

SEQ ID NO: 7095525 - DNA, 22 bp, Homo sapiens
agagttaaatgaaatggtatgt

SEQ ID NO: 7095526 - DNA, 22 bp, Homo sapiens
agagttaagacgtacatgagtg

SEQ ID NO: 7095527 - DNA, 22 bp, Homo sapiens
agagttaagacgtacatgagtg

SEQ ID NO: 7095528 - DNA, 22 bp, Homo sapiens
agagttaatgcaggccaagcct

SEQ ID NO: 7095529 - DNA, 22 bp, Homo sapiens
agagttagtggcctcagcaggg

SEQ ID NO: 7095530 - DNA, 22 bp, Homo sapiens
agagttatattggttgagaatt

SEQ ID NO: 7095531 - DNA, 22 bp, Homo sapiens
agagttatcactccatgcagct

SEQ ID NO: 7095532 - DNA, 22 bp, Homo sapiens
aatttggcagtgtcttgaagta

SEQ ID NO: 7095533 - DNA, 22 bp, Homo sapiens
aatttggacttgggtgctagag

SEQ ID NO: 7095534 - DNA, 22 bp, Homo sapiens
aatttgattccctgcacctgtt

SEQ ID NO: 7095535 - DNA, 18 bp, Homo sapiens
aatttctttgacaactta

SEQ ID NO: 7095536 - DNA, 18 bp, Homo sapiens
aatttctttgacaactta

SEQ ID NO: 7095537 - DNA, 22 bp, Homo sapiens
aatttgatgagtttgtaagtct

SEQ ID NO: 7095538 - DNA, 22 bp, Homo sapiens
aatttgattcagcaaatgttca

SEQ ID NO: 7095539 - DNA, 22 bp, Homo sapiens
aatttgattccctgcacctgtt

SEQ ID NO: 7095540 - DNA, 22 bp, Homo sapiens
aatttctccagacagctgtgca

SEQ ID NO: 7095541 - DNA, 22 bp, Homo sapiens
aatttctcactctcttgatcac

SEQ ID NO: 7095542 - DNA, 22 bp, Homo sapiens
aatttcttgggagctcagagaa

SEQ ID NO: 7095543 - DNA, 22 bp, Homo sapiens
aatttcttgggagctcagagaa

SEQ ID NO: 7095544 - DNA, 22 bp, Homo sapiens
aatttcttcagctctaaaatgg

SEQ ID NO: 7095545 - DNA, 22 bp, Homo sapiens
agcacagggcccagcctaggcc

SEQ ID NO: 7095546 - DNA, 22 bp, Homo sapiens
agcacagggcccagcctaggcc

SEQ ID NO: 7095547 - DNA, 22 bp, Homo sapiens
agcacagggcccagcctaggcc

SEQ ID NO: 7095548 - DNA, 22 bp, Homo sapiens
agcacagggcccagcctaggcc

SEQ ID NO: 7095549 - DNA, 22 bp, Homo sapiens
agcacagggcccagcctaggcc

SEQ ID NO: 7095550 - DNA, 22 bp, Homo sapiens
agcacagggacaatgccaggtg

SEQ ID NO: 7095551 - DNA, 22 bp, Homo sapiens
agcacagggacaatgccaggtg

SEQ ID NO: 7095552 - DNA, 22 bp, Homo sapiens
agcacaggctttggtgtgaggg

SEQ ID NO: 7095553 - DNA, 22 bp, Homo sapiens
agcacagggacaatgccaggtg

SEQ ID NO: 7095554 - DNA, 22 bp, Homo sapiens
agcacagggacaatgccaggtg

SEQ ID NO: 7095555 - DNA, 22 bp, Homo sapiens
agcacagggacaatgccaggtg

SEQ ID NO: 7095556 - DNA, 22 bp, Homo sapiens
agcacaggctttggtgtgaggg

SEQ ID NO: 7095557 - DNA, 22 bp, Homo sapiens
agcacaggacgtagagcttgga

SEQ ID NO: 7095558 - DNA, 22 bp, Homo sapiens
agcacaggacgtagagcttgga

SEQ ID NO: 7095559 - DNA, 22 bp, Homo sapiens
agcacaggctttggtgtgaggg

SEQ ID NO: 7095560 - DNA, 22 bp, Homo sapiens
agcacaggctttggtgtgaggg

SEQ ID NO: 7095561 - DNA, 22 bp, Homo sapiens
agcacaggaccaaggaagctgt

SEQ ID NO: 7095562 - DNA, 22 bp, Homo sapiens
agcacaggacgtagagcttgga

SEQ ID NO: 7095563 - DNA, 22 bp, Homo sapiens
agcacaggaccaaggaagctgt

SEQ ID NO: 7095564 - DNA, 21 bp, Homo sapiens
acacaacaggcagtcattttc

SEQ ID NO: 7095565 - DNA, 22 bp, Homo sapiens
acacaaattgtaggataattgc

SEQ ID NO: 7095566 - DNA, 22 bp, Homo sapiens
acacaaattgtaggataattgc

SEQ ID NO: 7095567 - DNA, 22 bp, Homo sapiens
acacaacagaagagcaattgca

SEQ ID NO: 7095568 - DNA, 22 bp, Homo sapiens
acaatttttcaaagaagcttat

SEQ ID NO: 7095569 - DNA, 22 bp, Homo sapiens
acacaaaatcaaagtcctaggc

SEQ ID NO: 7095570 - DNA, 22 bp, Homo sapiens
agcacaggtaatacagagtaac

SEQ ID NO: 7095571 - DNA, 22 bp, Homo sapiens
agcacaggtaatacagagtaac

SEQ ID NO: 7095572 - DNA, 22 bp, Homo sapiens
agcacaggtaatacagagtaac

SEQ ID NO: 7095573 - DNA, 22 bp, Homo sapiens
agcacagggcccagcctaggcc

SEQ ID NO: 7095574 - DNA, 22 bp, Homo sapiens
agcacagggcccagcctaggcc

SEQ ID NO: 7095575 - DNA, 22 bp, Homo sapiens
agcacaggaacatggagatggg

SEQ ID NO: 7095576 - DNA, 22 bp, Homo sapiens
agcacaggaacatggagatggg

SEQ ID NO: 7095577 - DNA, 22 bp, Homo sapiens
agcacaggaccaaggaagctgt

SEQ ID NO: 7095578 - DNA, 22 bp, Homo sapiens
agcacaggaccaaggaagctgt

SEQ ID NO: 7095579 - DNA, 22 bp, Homo sapiens
agcacaggaccaaggaagctgt

SEQ ID NO: 7095580 - DNA, 22 bp, Homo sapiens
agcacaggaacatggagatggg

SEQ ID NO: 7095581 - DNA, 22 bp, Homo sapiens
agcacaggaacatggagatggg

SEQ ID NO: 7095582 - DNA, 22 bp, Homo sapiens
agcacaggaacatggagatggg

SEQ ID NO: 7095583 - DNA, 22 bp, Homo sapiens
agcacagaatggcttggaagcc

SEQ ID NO: 7095584 - DNA, 22 bp, Homo sapiens
agcacagaatggcttggaagcc

SEQ ID NO: 7095585 - DNA, 19 bp, Homo sapiens
agcacagacaagaccagca

SEQ ID NO: 7095586 - DNA, 19 bp, Homo sapiens
agcacagacaagaccagca

SEQ ID NO: 7095587 - DNA, 19 bp, Homo sapiens
agcacagacaagaccagca

SEQ ID NO: 7095588 - DNA, 22 bp, Homo sapiens
agcacagaaagcacatttgaaa

SEQ ID NO: 7095589 - DNA, 22 bp, Homo sapiens
agcacagaaagcacatttgaaa

SEQ ID NO: 7095590 - DNA, 22 bp, Homo sapiens
agcacagaaagtattgactgaa

SEQ ID NO: 7095591 - DNA, 22 bp, Homo sapiens
agcacagaaagtattgactgaa

SEQ ID NO: 7095592 - DNA, 22 bp, Homo sapiens
agcacagaatgaggtggaagtg

SEQ ID NO: 7095593 - DNA, 22 bp, Homo sapiens
agcacagaatgaggtggaagtg

SEQ ID NO: 7095594 - DNA, 22 bp, Homo sapiens
agcacacatcacttctgctcat

SEQ ID NO: 7095595 - DNA, 22 bp, Homo sapiens
agcacacagtcttccttcctcc

SEQ ID NO: 7095596 - DNA, 22 bp, Homo sapiens
agcacactgacctgaagccttg

SEQ ID NO: 7095597 - DNA, 22 bp, Homo sapiens
agcacactggcattgggaagct

SEQ ID NO: 7095598 - DNA, 22 bp, Homo sapiens
agcacactggcattgggaagct

SEQ ID NO: 7095599 - DNA, 22 bp, Homo sapiens
agcacacagtattagccattgt

SEQ ID NO: 7095600 - DNA, 22 bp, Homo sapiens
agcacacagtattagccattgt

SEQ ID NO: 7095601 - DNA, 22 bp, Homo sapiens
agcacacaggccacctccactt

SEQ ID NO: 7095602 - DNA, 22 bp, Homo sapiens
agcacacaggacttgattcatg

SEQ ID NO: 7095603 - DNA, 22 bp, Homo sapiens
agcacacaggacttgattcatg

SEQ ID NO: 7095604 - DNA, 22 bp, Homo sapiens
agcacacaggacttgattcatg

SEQ ID NO: 7095605 - DNA, 22 bp, Homo sapiens
agcacacaggacttgattcatg

SEQ ID NO: 7095606 - DNA, 22 bp, Homo sapiens
agcacacaggacttgattcatg

SEQ ID NO: 7095607 - DNA, 22 bp, Homo sapiens
agcacacaggacttgattcatg

SEQ ID NO: 7095608 - DNA, 22 bp, Homo sapiens
agcacacaggacttgattcatg

SEQ ID NO: 7095609 - DNA, 22 bp, Homo sapiens
agcacaaaagcagccacagatg

SEQ ID NO: 7095610 - DNA, 22 bp, Homo sapiens
agcacaaaagcagccacagatg

SEQ ID NO: 7095611 - DNA, 22 bp, Homo sapiens
agcaaggccgagaggatgctat

SEQ ID NO: 7095612 - DNA, 23 bp, Homo sapiens
agcacaaagtgttttccttgtag

SEQ ID NO: 7095613 - DNA, 22 bp, Homo sapiens
agcacaaatataaaaatgtctg

SEQ ID NO: 7095614 - DNA, 22 bp, Homo sapiens
agcacaaatataaaaatgtctg

SEQ ID NO: 7095615 - DNA, 22 bp, Homo sapiens
agcacaagtttctggcagacag

SEQ ID NO: 7095616 - DNA, 19 bp, Homo sapiens
acaataactcattgattgc

SEQ ID NO: 7095617 - DNA, 19 bp, Homo sapiens
acaataactcattgattgc

SEQ ID NO: 7095618 - DNA, 19 bp, Homo sapiens
acaataactcattgattgc

SEQ ID NO: 7095619 - DNA, 22 bp, Homo sapiens
acaataacttctgtttccttgc

SEQ ID NO: 7095620 - DNA, 18 bp, Homo sapiens
agcaaatattaagtgcat

SEQ ID NO: 7095621 - DNA, 18 bp, Homo sapiens
agcaaatattaagtgcat

SEQ ID NO: 7095622 - DNA, 22 bp, Homo sapiens
agcaaatattttgttgaagtgc

SEQ ID NO: 7095623 - DNA, 22 bp, Homo sapiens
acaagtttcattgtttagaacc

SEQ ID NO: 7095624 - DNA, 22 bp, Homo sapiens
agcaaatacttttcactgagcc

SEQ ID NO: 7095625 - DNA, 19 bp, Homo sapiens
agcaaatataatagtgttc

SEQ ID NO: 7095626 - DNA, 19 bp, Homo sapiens
agcaaatataatagtgttc

SEQ ID NO: 7095627 - DNA, 22 bp, Homo sapiens
agcaaataccaaaggctgatgt

SEQ ID NO: 7095628 - DNA, 22 bp, Homo sapiens
agcaaatacttgaataaaaaga

SEQ ID NO: 7095629 - DNA, 22 bp, Homo sapiens
agcaaatacttgaataaaaaga

SEQ ID NO: 7095630 - DNA, 22 bp, Homo sapiens
agcaaatacttgaataaaaaga

SEQ ID NO: 7095631 - DNA, 20 bp, Homo sapiens
acaatacaggttgtgtctga

SEQ ID NO: 7095632 - DNA, 20 bp, Homo sapiens
acaatacaggttgtgtctga

SEQ ID NO: 7095633 - DNA, 22 bp, Homo sapiens
acaataagtattgggcttttga

SEQ ID NO: 7095634 - DNA, 22 bp, Homo sapiens
acaataatgtattgccaaaagt

SEQ ID NO: 7095635 - DNA, 22 bp, Homo sapiens
acaatacaggcttctggactta

SEQ ID NO: 7095636 - DNA, 22 bp, Homo sapiens
acaatactagccaaggttatta

SEQ ID NO: 7095637 - DNA, 21 bp, Homo sapiens
acaatactatttgggggaagt

SEQ ID NO: 7095638 - DNA, 22 bp, Homo sapiens
acaatactattttcagtatcct

SEQ ID NO: 7095639 - DNA, 22 bp, Homo sapiens
acaatactattttcagtatcct

SEQ ID NO: 7095640 - DNA, 22 bp, Homo sapiens
acaatactcatgctctttttct

SEQ ID NO: 7095641 - DNA, 22 bp, Homo sapiens
acaatagaaggaaactgacata

SEQ ID NO: 7095642 - DNA, 22 bp, Homo sapiens
acaatagaaggaaactgacata

SEQ ID NO: 7095643 - DNA, 22 bp, Homo sapiens
acaatagaaataattaagcaca

SEQ ID NO: 7095644 - DNA, 22 bp, Homo sapiens
acaatagaaggaaactgacata

SEQ ID NO: 7095645 - DNA, 22 bp, Homo sapiens
acaatagaaggaaactgacata

SEQ ID NO: 7095646 - DNA, 22 bp, Homo sapiens
acaatacttaccaatgtttttg

SEQ ID NO: 7095647 - DNA, 19 bp, Homo sapiens
acaatagaaaagtcttttg

SEQ ID NO: 7095648 - DNA, 19 bp, Homo sapiens
acaatagaaaagtcttttg

SEQ ID NO: 7095649 - DNA, 19 bp, Homo sapiens
acaatagaaaagtcttttg

SEQ ID NO: 7095650 - DNA, 22 bp, Homo sapiens
acaatagaaataattaagcaca

SEQ ID NO: 7095651 - DNA, 22 bp, Homo sapiens
acaatagaaataattaagcaca

SEQ ID NO: 7095652 - DNA, 22 bp, Homo sapiens
acaatagaaataattaagcaca

SEQ ID NO: 7095653 - DNA, 18 bp, Homo sapiens
agattttgagaaatacaa

SEQ ID NO: 7095654 - DNA, 22 bp, Homo sapiens
acaacattcttaaatacactga

SEQ ID NO: 7095655 - DNA, 22 bp, Homo sapiens
acaacattcttaaatacactga

SEQ ID NO: 7095656 - DNA, 22 bp, Homo sapiens
acaacattcttaaatacactga

SEQ ID NO: 7095657 - DNA, 22 bp, Homo sapiens
acaacattatacatagaaagct

SEQ ID NO: 7095658 - DNA, 22 bp, Homo sapiens
acaacagtgtggtggaaggagc

SEQ ID NO: 7095659 - DNA, 22 bp, Homo sapiens
acaacagtccagtatagactgt

SEQ ID NO: 7095660 - DNA, 22 bp, Homo sapiens
acaacagtccagtatagactgt

SEQ ID NO: 7095661 - DNA, 22 bp, Homo sapiens
acaacagtccagtatagactgt

SEQ ID NO: 7095662 - DNA, 22 bp, Homo sapiens
acaacagtccagtatagactgt

SEQ ID NO: 7095663 - DNA, 22 bp, Homo sapiens
agcaaagtcagtggaaccatcc

SEQ ID NO: 7095664 - DNA, 22 bp, Homo sapiens
agcaaagtatgtgctgggagct

SEQ ID NO: 7095665 - DNA, 22 bp, Homo sapiens
agcaaagtccagtctgtgtaca

SEQ ID NO: 7095666 - DNA, 22 bp, Homo sapiens
agcaaagtccagtctgtgtaca

SEQ ID NO: 7095667 - DNA, 22 bp, Homo sapiens
agcaaataaagacaattatgtc

SEQ ID NO: 7095668 - DNA, 22 bp, Homo sapiens
agcaaagctgctcccttttgtc

SEQ ID NO: 7095669 - DNA, 21 bp, Homo sapiens
agcaaaggcaggagaggtttc

SEQ ID NO: 7095670 - DNA, 22 bp, Homo sapiens
agcaaagtagctgctgttctta

SEQ ID NO: 7095671 - DNA, 22 bp, Homo sapiens
agcaaagtagctgctgttctta

SEQ ID NO: 7095672 - DNA, 19 bp, Homo sapiens
agcaaatacatcaaaattg

SEQ ID NO: 7095673 - DNA, 22 bp, Homo sapiens
agcaaataattgtctttgaggg

SEQ ID NO: 7095674 - DNA, 23 bp, Homo sapiens
agcaaataatctgcttgcttttt

SEQ ID NO: 7095675 - DNA, 22 bp, Homo sapiens
agcaaataaagacaattatgtc

SEQ ID NO: 7095676 - DNA, 22 bp, Homo sapiens
agcaaataaagacaattatgtc

SEQ ID NO: 7095677 - DNA, 19 bp, Homo sapiens
agccagagtggcccagggg

SEQ ID NO: 7095678 - DNA, 19 bp, Homo sapiens
agccagagtggcccagggg

SEQ ID NO: 7095679 - DNA, 19 bp, Homo sapiens
agccagagtggcccagggg

SEQ ID NO: 7095680 - DNA, 19 bp, Homo sapiens
agccagagtggcccagggg

SEQ ID NO: 7095681 - DNA, 19 bp, Homo sapiens
agccagagtggcccagggg

SEQ ID NO: 7095682 - DNA, 19 bp, Homo sapiens
agccagagtggcccagggg

SEQ ID NO: 7095683 - DNA, 22 bp, Homo sapiens
agccagctggagaccactgttt

SEQ ID NO: 7095684 - DNA, 22 bp, Homo sapiens
agccagctggtgggtcagctgg

SEQ ID NO: 7095685 - DNA, 22 bp, Homo sapiens
agccagaggtcatgagcacagg

SEQ ID NO: 7095686 - DNA, 22 bp, Homo sapiens
agccagaggtcatgagcacagg

SEQ ID NO: 7095687 - DNA, 22 bp, Homo sapiens
agccagaggtcatgagcacagg

SEQ ID NO: 7095688 - DNA, 22 bp, Homo sapiens
agccagagggatctttctaaga

SEQ ID NO: 7095689 - DNA, 22 bp, Homo sapiens
agccagaggccagcctgcctca

SEQ ID NO: 7095690 - DNA, 22 bp, Homo sapiens
agccagaggccagcctgcctca

SEQ ID NO: 7095691 - DNA, 22 bp, Homo sapiens
agccagaggccagcctgcctca

SEQ ID NO: 7095692 - DNA, 22 bp, Homo sapiens
agccagaggccagcctgcctca

SEQ ID NO: 7095693 - DNA, 22 bp, Homo sapiens
agccagaggccagcctgcctca

SEQ ID NO: 7095694 - DNA, 22 bp, Homo sapiens
agccagaggccagcctgcctca

SEQ ID NO: 7095695 - DNA, 22 bp, Homo sapiens
agccaggaaccagctacagtct

SEQ ID NO: 7095696 - DNA, 22 bp, Homo sapiens
agccaggaaccagctacagtct

SEQ ID NO: 7095697 - DNA, 22 bp, Homo sapiens
agccagctgttctggggcagca

SEQ ID NO: 7095698 - DNA, 22 bp, Homo sapiens
agccagcttctttacggtggca

SEQ ID NO: 7095699 - DNA, 22 bp, Homo sapiens
agccaggaagagaggcctcacc

SEQ ID NO: 7095700 - DNA, 22 bp, Homo sapiens
agccaggaagagaggcctcacc

SEQ ID NO: 7095701 - DNA, 22 bp, Homo sapiens
agccaggaagagaggcctcacc

SEQ ID NO: 7095702 - DNA, 22 bp, Homo sapiens
agccagctgtgggctcaggcgg

SEQ ID NO: 7095703 - DNA, 22 bp, Homo sapiens
agccagctgtgggctcaggcgg

SEQ ID NO: 7095704 - DNA, 22 bp, Homo sapiens
agccagctgtgggctcaggcgg

SEQ ID NO: 7095705 - DNA, 22 bp, Homo sapiens
agccagctgtgtggtcaggcaa

SEQ ID NO: 7095706 - DNA, 22 bp, Homo sapiens
agccagctgtgtggtcaggcaa

SEQ ID NO: 7095707 - DNA, 22 bp, Homo sapiens
agccagctggtgggtcagctgg

SEQ ID NO: 7095708 - DNA, 22 bp, Homo sapiens
agccagctgtactgcctgctca

SEQ ID NO: 7095709 - DNA, 22 bp, Homo sapiens
agccagctgtggctatggctcc

SEQ ID NO: 7095710 - DNA, 22 bp, Homo sapiens
agccagagattgagatgcaggc

SEQ ID NO: 7095711 - DNA, 22 bp, Homo sapiens
agccagagattgagatgcaggc

SEQ ID NO: 7095712 - DNA, 22 bp, Homo sapiens
agccagagatccatccctagga

SEQ ID NO: 7095713 - DNA, 22 bp, Homo sapiens
agccacagtctgtagccagctt

SEQ ID NO: 7095714 - DNA, 22 bp, Homo sapiens
agccagagatccatccctagga

SEQ ID NO: 7095715 - DNA, 22 bp, Homo sapiens
agccagagattgagatgcaggc

SEQ ID NO: 7095716 - DNA, 22 bp, Homo sapiens
agccagagattgagatgcaggc

SEQ ID NO: 7095717 - DNA, 22 bp, Homo sapiens
agccacagtctgtagccagctt

SEQ ID NO: 7095718 - DNA, 22 bp, Homo sapiens
agccacagtctgtagccagctt

SEQ ID NO: 7095719 - DNA, 22 bp, Homo sapiens
agccacagtctgatgcctgaga

SEQ ID NO: 7095720 - DNA, 22 bp, Homo sapiens
agccagaggaacttgatgactg

SEQ ID NO: 7095721 - DNA, 22 bp, Homo sapiens
agccagaggaacttgatgactg

SEQ ID NO: 7095722 - DNA, 22 bp, Homo sapiens
agccagaggaacttgatgactg

SEQ ID NO: 7095723 - DNA, 22 bp, Homo sapiens
agccagagctgatgtcattctc

SEQ ID NO: 7095724 - DNA, 22 bp, Homo sapiens
agccagaggaacttgatgactg

SEQ ID NO: 7095725 - DNA, 22 bp, Homo sapiens
agccagaggaacttgatgactg

SEQ ID NO: 7095726 - DNA, 22 bp, Homo sapiens
agccagaggaagcctggccctc

SEQ ID NO: 7095727 - DNA, 22 bp, Homo sapiens
agccagaggaagcctggccctc

SEQ ID NO: 7095728 - DNA, 22 bp, Homo sapiens
agccagagattgagatgcaggc

SEQ ID NO: 7095729 - DNA, 22 bp, Homo sapiens
agccagagattgagatgcaggc

SEQ ID NO: 7095730 - DNA, 22 bp, Homo sapiens
agccagagattgagatgcaggc

SEQ ID NO: 7095731 - DNA, 22 bp, Homo sapiens
agccagagctgatgtcattctc

SEQ ID NO: 7095732 - DNA, 22 bp, Homo sapiens
agccagagctgatgtcattctc

SEQ ID NO: 7095733 - DNA, 22 bp, Homo sapiens
acacttatttttgtccacttcc

SEQ ID NO: 7095734 - DNA, 22 bp, Homo sapiens
acacttatacaaagaatgtctg

SEQ ID NO: 7095735 - DNA, 22 bp, Homo sapiens
acacttatttcttgtctaacca

SEQ ID NO: 7095736 - DNA, 22 bp, Homo sapiens
acacttaagcatgaagtataaa

SEQ ID NO: 7095737 - DNA, 22 bp, Homo sapiens
acactgttctttgcactgagaa

SEQ ID NO: 7095738 - DNA, 22 bp, Homo sapiens
acactgttctttgcactgagaa

SEQ ID NO: 7095739 - DNA, 20 bp, Homo sapiens
acactgttcttcacacattt

SEQ ID NO: 7095740 - DNA, 22 bp, Homo sapiens
acactgtgtttacatagagaat

SEQ ID NO: 7095741 - DNA, 22 bp, Homo sapiens
acactgttccacactaagaagg

SEQ ID NO: 7095742 - DNA, 22 bp, Homo sapiens
acactgttcctgaaattgttat

SEQ ID NO: 7095743 - DNA, 22 bp, Homo sapiens
agcaggtgtatataaggctgag

SEQ ID NO: 7095744 - DNA, 22 bp, Homo sapiens
agcaggtgtatcggtcacctac

SEQ ID NO: 7095745 - DNA, 22 bp, Homo sapiens
agcaggtgtatcggtcacctac

SEQ ID NO: 7095746 - DNA, 22 bp, Homo sapiens
agcaggtgtatataaggctgag

SEQ ID NO: 7095747 - DNA, 22 bp, Homo sapiens
agcaggtgtatataaggctgag

SEQ ID NO: 7095748 - DNA, 22 bp, Homo sapiens
agcaggtgtatataaggctgag

SEQ ID NO: 7095749 - DNA, 22 bp, Homo sapiens
agcaggtgtagggctctttgta

SEQ ID NO: 7095750 - DNA, 22 bp, Homo sapiens
agcaggtgtagggctctttgta

SEQ ID NO: 7095751 - DNA, 22 bp, Homo sapiens
agcaggtgtagggctctttgta

SEQ ID NO: 7095752 - DNA, 16 bp, Homo sapiens
agcaggtgtatagtgt

SEQ ID NO: 7095753 - DNA, 21 bp, Homo sapiens
agcaggtgtaaaggaggaaat

SEQ ID NO: 7095754 - DNA, 21 bp, Homo sapiens
agcaggtgtaaaggaggaaat

SEQ ID NO: 7095755 - DNA, 22 bp, Homo sapiens
agcaggtggtaggcagtcagca

SEQ ID NO: 7095756 - DNA, 22 bp, Homo sapiens
agcaggtggtctgttgctgctg

SEQ ID NO: 7095757 - DNA, 22 bp, Homo sapiens
agcaggtggtgggccagatttg

SEQ ID NO: 7095758 - DNA, 22 bp, Homo sapiens
agcaggtggtgggccagatttg

SEQ ID NO: 7095759 - DNA, 21 bp, Homo sapiens
agcaggtgtaaaggaggaaat

SEQ ID NO: 7095760 - DNA, 21 bp, Homo sapiens
agcaggtgtaaaggaggaaat

SEQ ID NO: 7095761 - DNA, 22 bp, Homo sapiens
agcaggtgagcacagccaggct

SEQ ID NO: 7095762 - DNA, 22 bp, Homo sapiens
agcaggtgatcgcgtgtgctcc

SEQ ID NO: 7095763 - DNA, 22 bp, Homo sapiens
agcaggtggtaggcagtcagca

SEQ ID NO: 7095764 - DNA, 22 bp, Homo sapiens
agcaggtggtaggcagtcagca

SEQ ID NO: 7095765 - DNA, 22 bp, Homo sapiens
agcaggtggtaggcagtcagca

SEQ ID NO: 7095766 - DNA, 22 bp, Homo sapiens
acacccagagcgccagtgccga

SEQ ID NO: 7095767 - DNA, 22 bp, Homo sapiens
acacccagagcgccagtgccga

SEQ ID NO: 7095768 - DNA, 22 bp, Homo sapiens
acacccagattatgcacacaaa

SEQ ID NO: 7095769 - DNA, 22 bp, Homo sapiens
acacccagattatgcacacaaa

SEQ ID NO: 7095770 - DNA, 22 bp, Homo sapiens
acaccatggttcccaaactgtg

SEQ ID NO: 7095771 - DNA, 22 bp, Homo sapiens
acaccattcaccatcagtacct

SEQ ID NO: 7095772 - DNA, 22 bp, Homo sapiens
acacccacctctttaggccatg

SEQ ID NO: 7095773 - DNA, 21 bp, Homo sapiens
acacccacttatgcccgcttg

SEQ ID NO: 7095774 - DNA, 22 bp, Homo sapiens
agcaggtgtatcggtcacctac

SEQ ID NO: 7095775 - DNA, 22 bp, Homo sapiens
agcaggtgtatcggtcacctac

SEQ ID NO: 7095776 - DNA, 22 bp, Homo sapiens
agcaggtgtcactttcactcca

SEQ ID NO: 7095777 - DNA, 22 bp, Homo sapiens
agcaggtgtcactttcactcca

SEQ ID NO: 7095778 - DNA, 22 bp, Homo sapiens
acaccagtcatttattcagtca

SEQ ID NO: 7095779 - DNA, 22 bp, Homo sapiens
acaccagtcatttattcagtca

SEQ ID NO: 7095780 - DNA, 22 bp, Homo sapiens
acaccagtccttactcattttt

SEQ ID NO: 7095781 - DNA, 22 bp, Homo sapiens
acaccagtttcttaagaatatt

SEQ ID NO: 7095782 - DNA, 22 bp, Homo sapiens
acaccatactcatgttggttcc

SEQ ID NO: 7095783 - DNA, 22 bp, Homo sapiens
agccaaggagtgcaggtggctt

SEQ ID NO: 7095784 - DNA, 22 bp, Homo sapiens
agccaaggagtgcaggtggctt

SEQ ID NO: 7095785 - DNA, 22 bp, Homo sapiens
agccaaggagtgcaggtggctt

SEQ ID NO: 7095786 - DNA, 22 bp, Homo sapiens
agccaaggcagctagagctctg

SEQ ID NO: 7095787 - DNA, 22 bp, Homo sapiens
agccaaggcagctagagctctg

SEQ ID NO: 7095788 - DNA, 22 bp, Homo sapiens
agccaaggactcagtggtaggc

SEQ ID NO: 7095789 - DNA, 18 bp, Homo sapiens
agccaaggaggaggagga

SEQ ID NO: 7095790 - DNA, 18 bp, Homo sapiens
agccaaggaggaggagga

SEQ ID NO: 7095791 - DNA, 18 bp, Homo sapiens
agccaaggaggaggagga

SEQ ID NO: 7095792 - DNA, 18 bp, Homo sapiens
agccaaggaggaggagga

SEQ ID NO: 7095793 - DNA, 22 bp, Homo sapiens
agccaaggagtgcaggtggctt

SEQ ID NO: 7095794 - DNA, 22 bp, Homo sapiens
agccaaggagtgcaggtggctt

SEQ ID NO: 7095795 - DNA, 22 bp, Homo sapiens
acacccagattatgcacacaaa

SEQ ID NO: 7095796 - DNA, 22 bp, Homo sapiens
acacccagctgggccacctcca

SEQ ID NO: 7095797 - DNA, 22 bp, Homo sapiens
acacccagcttttgaatgccct

SEQ ID NO: 7095798 - DNA, 22 bp, Homo sapiens
acacccagcttttgaatgccct

SEQ ID NO: 7095799 - DNA, 22 bp, Homo sapiens
acacccagctgggccacctcca

SEQ ID NO: 7095800 - DNA, 22 bp, Homo sapiens
acacccaggaataaggactggg

SEQ ID NO: 7095801 - DNA, 22 bp, Homo sapiens
agcatttacctcaatgcatctg

SEQ ID NO: 7095802 - DNA, 22 bp, Homo sapiens
agccaaggactcagtggtaggc

SEQ ID NO: 7095803 - DNA, 22 bp, Homo sapiens
agccaaggtatcatgagaggca

SEQ ID NO: 7095804 - DNA, 22 bp, Homo sapiens
agccaaggtatcatgagaggca

SEQ ID NO: 7095805 - DNA, 22 bp, Homo sapiens
agccaagggtcagctgcacaga

SEQ ID NO: 7095806 - DNA, 22 bp, Homo sapiens
agccaagggtcagctgcacaga

SEQ ID NO: 7095807 - DNA, 22 bp, Homo sapiens
agccaagggtcagctgcacaga

SEQ ID NO: 7095808 - DNA, 22 bp, Homo sapiens
agccaaggcagctagagctctg

SEQ ID NO: 7095809 - DNA, 22 bp, Homo sapiens
agccaaggcagctagagctctg

SEQ ID NO: 7095810 - DNA, 22 bp, Homo sapiens
agccaagggtcagctgcacaga

SEQ ID NO: 7095811 - DNA, 22 bp, Homo sapiens
agccaatctacaacaaaggata

SEQ ID NO: 7095812 - DNA, 22 bp, Homo sapiens
agccaatcatcctcagactctc

SEQ ID NO: 7095813 - DNA, 22 bp, Homo sapiens
agccaatctacaacaaaggata

SEQ ID NO: 7095814 - DNA, 22 bp, Homo sapiens
acactgtgtgacttctgagact

SEQ ID NO: 7095815 - DNA, 22 bp, Homo sapiens
agccaaggtcgccccagggcaa

SEQ ID NO: 7095816 - DNA, 22 bp, Homo sapiens
agccaataaatttacaactaga

SEQ ID NO: 7095817 - DNA, 22 bp, Homo sapiens
agccaaggtatcatgagaggca

SEQ ID NO: 7095818 - DNA, 22 bp, Homo sapiens
agccaaggtcgccccagggcaa

SEQ ID NO: 7095819 - DNA, 22 bp, Homo sapiens
agccaaggtcgccccagggcaa

SEQ ID NO: 7095820 - DNA, 22 bp, Homo sapiens
acacaagaataatgatgaaggt

SEQ ID NO: 7095821 - DNA, 22 bp, Homo sapiens
acacaagattgtgtattgaatt

SEQ ID NO: 7095822 - DNA, 22 bp, Homo sapiens
acacaagattgtgtattgaatt

SEQ ID NO: 7095823 - DNA, 20 bp, Homo sapiens
acacaagcacttctggtatt

SEQ ID NO: 7095824 - DNA, 23 bp, Homo sapiens
acacaatagagtactattcagcc

SEQ ID NO: 7095825 - DNA, 23 bp, Homo sapiens
acacaatagagtactattcagcc

SEQ ID NO: 7095826 - DNA, 19 bp, Homo sapiens
acacaatgacacatatata

SEQ ID NO: 7095827 - DNA, 22 bp, Homo sapiens
acacaatacagggctcaaaata

SEQ ID NO: 7095828 - DNA, 22 bp, Homo sapiens
acacaatacagggctcaaaata

SEQ ID NO: 7095829 - DNA, 23 bp, Homo sapiens
acacaatagagtactattcagcc

SEQ ID NO: 7095830 - DNA, 22 bp, Homo sapiens
acacaagtccctccatactctc

SEQ ID NO: 7095831 - DNA, 22 bp, Homo sapiens
acacaagtgaatattttaagga

SEQ ID NO: 7095832 - DNA, 22 bp, Homo sapiens
acacaagtccctccatactctc

SEQ ID NO: 7095833 - DNA, 22 bp, Homo sapiens
acacaataaatttatcctttga

SEQ ID NO: 7095834 - DNA, 22 bp, Homo sapiens
acacaatacagggctcaaaata

SEQ ID NO: 7095835 - DNA, 22 bp, Homo sapiens
acacaatacagggctcaaaata

SEQ ID NO: 7095836 - DNA, 22 bp, Homo sapiens
acacacaactcattgtgtaata

SEQ ID NO: 7095837 - DNA, 22 bp, Homo sapiens
acacacacaagcaggttgtgga

SEQ ID NO: 7095838 - DNA, 22 bp, Homo sapiens
acacacaactcattgtgtaata

SEQ ID NO: 7095839 - DNA, 19 bp, Homo sapiens
acacaatgacacatatata

SEQ ID NO: 7095840 - DNA, 22 bp, Homo sapiens
acacaatgattcacaagcagca

SEQ ID NO: 7095841 - DNA, 22 bp, Homo sapiens
acacaatgcatatttttccaga

SEQ ID NO: 7095842 - DNA, 22 bp, Homo sapiens
acacaatgcatatttttccaga

SEQ ID NO: 7095843 - DNA, 22 bp, Homo sapiens
acacaatggcgtgtgccacaga

SEQ ID NO: 7095844 - DNA, 22 bp, Homo sapiens
acacaatgtaccatatctccaa

SEQ ID NO: 7095845 - DNA, 22 bp, Homo sapiens
acacaatgtcatcataatgtca

SEQ ID NO: 7095846 - DNA, 22 bp, Homo sapiens
acacaatgtcatcataatgtca

SEQ ID NO: 7095847 - DNA, 22 bp, Homo sapiens
acacaatttcataaacaccatg

SEQ ID NO: 7095848 - DNA, 18 bp, Homo sapiens
acacacacacctgtgtat

SEQ ID NO: 7095849 - DNA, 18 bp, Homo sapiens
acacacacacctgtgtat

SEQ ID NO: 7095850 - DNA, 22 bp, Homo sapiens
acacacacaagcaggttgtgga

SEQ ID NO: 7095851 - DNA, 22 bp, Homo sapiens
acacagggcggaaagcatgaga

SEQ ID NO: 7095852 - DNA, 22 bp, Homo sapiens
acacagggcggaaagcatgaga

SEQ ID NO: 7095853 - DNA, 19 bp, Homo sapiens
acacagggctagagttaca

SEQ ID NO: 7095854 - DNA, 19 bp, Homo sapiens
acacagggctagagttaca

SEQ ID NO: 7095855 - DNA, 22 bp, Homo sapiens
acacagtatcaaatttcatctt

SEQ ID NO: 7095856 - DNA, 22 bp, Homo sapiens
acacagtatcaaatttcatctt

SEQ ID NO: 7095857 - DNA, 22 bp, Homo sapiens
acacagtatgaaaagtctagtt

SEQ ID NO: 7095858 - DNA, 22 bp, Homo sapiens
acacagtatgaaaagtctagtt

SEQ ID NO: 7095859 - DNA, 22 bp, Homo sapiens
acacagtatgaaaagtctagtt

SEQ ID NO: 7095860 - DNA, 22 bp, Homo sapiens
acacagtatgaaaagtctagtt

SEQ ID NO: 7095861 - DNA, 22 bp, Homo sapiens
acacagtatgacattggcagag

SEQ ID NO: 7095862 - DNA, 22 bp, Homo sapiens
acacagtatgacattggcagag

SEQ ID NO: 7095863 - DNA, 22 bp, Homo sapiens
acacagtatgcatctagaaatt

SEQ ID NO: 7095864 - DNA, 22 bp, Homo sapiens
acacagtatgcatctagaaatt

SEQ ID NO: 7095865 - DNA, 22 bp, Homo sapiens
acacagtattacaataggtgct

SEQ ID NO: 7095866 - DNA, 22 bp, Homo sapiens
acacagtattacaataggtgct

SEQ ID NO: 7095867 - DNA, 22 bp, Homo sapiens
acacagttcaggatcaaatagc

SEQ ID NO: 7095868 - DNA, 22 bp, Homo sapiens
acacagtgtcttaggtagtgtc

SEQ ID NO: 7095869 - DNA, 22 bp, Homo sapiens
acacagtgtgtgcagtcggacg

SEQ ID NO: 7095870 - DNA, 22 bp, Homo sapiens
acacagtggtgtttacaaaatt

SEQ ID NO: 7095871 - DNA, 22 bp, Homo sapiens
acacagtgtcagggcaggggcc

SEQ ID NO: 7095872 - DNA, 22 bp, Homo sapiens
acacagtattgtgactataact

SEQ ID NO: 7095873 - DNA, 22 bp, Homo sapiens
acacagtattgtgactataact

SEQ ID NO: 7095874 - DNA, 22 bp, Homo sapiens
acacagtattgtgactataact

SEQ ID NO: 7095875 - DNA, 22 bp, Homo sapiens
acacagtattgtgactataact

SEQ ID NO: 7095876 - DNA, 22 bp, Homo sapiens
acacagtattgtgactataact

SEQ ID NO: 7095877 - DNA, 22 bp, Homo sapiens
acacagtattgtgactataact

SEQ ID NO: 7095878 - DNA, 18 bp, Homo sapiens
acacagtggatgcctggt

SEQ ID NO: 7095879 - DNA, 22 bp, Homo sapiens
acacagtggtgagtctggacct

SEQ ID NO: 7095880 - DNA, 22 bp, Homo sapiens
acacagttcgtgcttttctatt

SEQ ID NO: 7095881 - DNA, 22 bp, Homo sapiens
acacagttcatgcatgaggtct

SEQ ID NO: 7095882 - DNA, 22 bp, Homo sapiens
acacagttcttagcaggtgtct

SEQ ID NO: 7095883 - DNA, 22 bp, Homo sapiens
acacagttctcttcttgtaact

SEQ ID NO: 7095884 - DNA, 22 bp, Homo sapiens
acacagttcgttgttttctact

SEQ ID NO: 7095885 - DNA, 22 bp, Homo sapiens
acacagtttatggtattctgtt

SEQ ID NO: 7095886 - DNA, 22 bp, Homo sapiens
acacagtttaaacgattagtac

SEQ ID NO: 7095887 - DNA, 22 bp, Homo sapiens
acacagtttaaacgattagtac

SEQ ID NO: 7095888 - DNA, 22 bp, Homo sapiens
acacagttggtggctcagtctg

SEQ ID NO: 7095889 - DNA, 22 bp, Homo sapiens
acacagtttaaacgattagtac

SEQ ID NO: 7095890 - DNA, 22 bp, Homo sapiens
acacagttgattgtcactcagg

SEQ ID NO: 7095891 - DNA, 22 bp, Homo sapiens
acacagttctttcactgttggt

SEQ ID NO: 7095892 - DNA, 22 bp, Homo sapiens
agcaggctttcaagagtcttct

SEQ ID NO: 7095893 - DNA, 22 bp, Homo sapiens
agcaggctttccacagaaggag

SEQ ID NO: 7095894 - DNA, 22 bp, Homo sapiens
agcaggctttccacagaaggag

SEQ ID NO: 7095895 - DNA, 22 bp, Homo sapiens
agcaggctttccacagaaggag

SEQ ID NO: 7095896 - DNA, 22 bp, Homo sapiens
agcaggctttccacagaaggag

SEQ ID NO: 7095897 - DNA, 21 bp, Homo sapiens
agcaggctttggagtggggct

SEQ ID NO: 7095898 - DNA, 21 bp, Homo sapiens
agcaggctttggagtggggct

SEQ ID NO: 7095899 - DNA, 21 bp, Homo sapiens
agcaggctttggagtggggct

SEQ ID NO: 7095900 - DNA, 21 bp, Homo sapiens
agcaggctttggagtggggct

SEQ ID NO: 7095901 - DNA, 22 bp, Homo sapiens
agcagggaagcctccagaacct

SEQ ID NO: 7095902 - DNA, 22 bp, Homo sapiens
agcagggaagcctccagaacct

SEQ ID NO: 7095903 - DNA, 19 bp, Homo sapiens
agcaggccacagggccagc

SEQ ID NO: 7095904 - DNA, 16 bp, Homo sapiens
acacagttttaaggca

SEQ ID NO: 7095905 - DNA, 22 bp, Homo sapiens
acacagtttttcagacagagat

SEQ ID NO: 7095906 - DNA, 22 bp, Homo sapiens
acacagtttttcagacagagat

SEQ ID NO: 7095907 - DNA, 22 bp, Homo sapiens
acacataagaaactacaaagag

SEQ ID NO: 7095908 - DNA, 19 bp, Homo sapiens
agcaggccacagggccagc

SEQ ID NO: 7095909 - DNA, 22 bp, Homo sapiens
agcaggcttggtccccagcctc

SEQ ID NO: 7095910 - DNA, 22 bp, Homo sapiens
agcaggcttgttatgtctgaga

SEQ ID NO: 7095911 - DNA, 22 bp, Homo sapiens
agcaggcttgttatgtctgaga

SEQ ID NO: 7095912 - DNA, 22 bp, Homo sapiens
acacatcatgccaagtttcacc

SEQ ID NO: 7095913 - DNA, 22 bp, Homo sapiens
acacatctatctctacacaagg

SEQ ID NO: 7095914 - DNA, 22 bp, Homo sapiens
acacatctatctctacacaagg

SEQ ID NO: 7095915 - DNA, 22 bp, Homo sapiens
acacatctatctctacacaagg

SEQ ID NO: 7095916 - DNA, 22 bp, Homo sapiens
acacatctatctctacacaagg

SEQ ID NO: 7095917 - DNA, 22 bp, Homo sapiens
acacatcagcctcagctttggg

SEQ ID NO: 7095918 - DNA, 22 bp, Homo sapiens
acacatcagaaatatgaatgag

SEQ ID NO: 7095919 - DNA, 22 bp, Homo sapiens
acacatatgtggcaactgtaga

SEQ ID NO: 7095920 - DNA, 22 bp, Homo sapiens
acacatatgtggcaactgtaga

SEQ ID NO: 7095921 - DNA, 22 bp, Homo sapiens
acacatatgtggcaactgtaga

SEQ ID NO: 7095922 - DNA, 22 bp, Homo sapiens
acacatattcatatgtacttac

SEQ ID NO: 7095923 - DNA, 22 bp, Homo sapiens
acacatattcatatgtacttac

SEQ ID NO: 7095924 - DNA, 22 bp, Homo sapiens
acacatatgtcattgaaaaatc

SEQ ID NO: 7095925 - DNA, 22 bp, Homo sapiens
agcagggactgagccagtggga

SEQ ID NO: 7095926 - DNA, 22 bp, Homo sapiens
agcagggagaccatctcttcct

SEQ ID NO: 7095927 - DNA, 22 bp, Homo sapiens
agcagggagaccatctcttcct

SEQ ID NO: 7095928 - DNA, 22 bp, Homo sapiens
agcagggactacgtgaaagtga

SEQ ID NO: 7095929 - DNA, 22 bp, Homo sapiens
agcagggactacgtgaaagtga

SEQ ID NO: 7095930 - DNA, 22 bp, Homo sapiens
agcagggactgagccagtggga

SEQ ID NO: 7095931 - DNA, 22 bp, Homo sapiens
agcagggacatggcatctctcc

SEQ ID NO: 7095932 - DNA, 22 bp, Homo sapiens
agcagggactacgtgaaagtga

SEQ ID NO: 7095933 - DNA, 22 bp, Homo sapiens
agcagggactacgtgaaagtga

SEQ ID NO: 7095934 - DNA, 22 bp, Homo sapiens
agcagggacatggcatctctcc

SEQ ID NO: 7095935 - DNA, 22 bp, Homo sapiens
agcagggaagcctccagaacct

SEQ ID NO: 7095936 - DNA, 22 bp, Homo sapiens
agcagggaatagcggaaagaat

SEQ ID NO: 7095937 - DNA, 22 bp, Homo sapiens
agcagggaatagcggaaagaat

SEQ ID NO: 7095938 - DNA, 22 bp, Homo sapiens
agcagggaatagcggaaagaat

SEQ ID NO: 7095939 - DNA, 19 bp, Homo sapiens
agcagggacatggaacttt

SEQ ID NO: 7095940 - DNA, 19 bp, Homo sapiens
agcagggacatggaacttt

SEQ ID NO: 7095941 - DNA, 18 bp, Homo sapiens
acagcaggtttcattctt

SEQ ID NO: 7095942 - DNA, 22 bp, Homo sapiens
acagcaggttttaactttgaag

SEQ ID NO: 7095943 - DNA, 22 bp, Homo sapiens
acagcaggttttaactttgaag

SEQ ID NO: 7095944 - DNA, 22 bp, Homo sapiens
acagcagtcagtgaatatttaa

SEQ ID NO: 7095945 - DNA, 18 bp, Homo sapiens
acagcaggtttcattctt

SEQ ID NO: 7095946 - DNA, 22 bp, Homo sapiens
acagcaggttattgttatggca

SEQ ID NO: 7095947 - DNA, 22 bp, Homo sapiens
acagcaggttattgttatggca

SEQ ID NO: 7095948 - DNA, 19 bp, Homo sapiens
acagcagggatttttggag

SEQ ID NO: 7095949 - DNA, 21 bp, Homo sapiens
acagcagggctggcatgacag

SEQ ID NO: 7095950 - DNA, 17 bp, Homo sapiens
acagcagggaagtgttg

SEQ ID NO: 7095951 - DNA, 17 bp, Homo sapiens
acagcagggaagtgttg

SEQ ID NO: 7095952 - DNA, 17 bp, Homo sapiens
acagcaggcccggaggg

SEQ ID NO: 7095953 - DNA, 22 bp, Homo sapiens
acagcagggaatatgggaattg

SEQ ID NO: 7095954 - DNA, 22 bp, Homo sapiens
acagcagggaatatgggaattg

SEQ ID NO: 7095955 - DNA, 17 bp, Homo sapiens
acagcaggcccggaggg

SEQ ID NO: 7095956 - DNA, 17 bp, Homo sapiens
acagcaggcccggaggg

SEQ ID NO: 7095957 - DNA, 22 bp, Homo sapiens
acagcaggcccatactggaagg

SEQ ID NO: 7095958 - DNA, 17 bp, Homo sapiens
acagcaggcccggaggg

SEQ ID NO: 7095959 - DNA, 22 bp, Homo sapiens
acagcaggcatgaatgacactg

SEQ ID NO: 7095960 - DNA, 22 bp, Homo sapiens
acagcaggcatgaatgacactg

SEQ ID NO: 7095961 - DNA, 22 bp, Homo sapiens
acagcaggcccatactggaagg

SEQ ID NO: 7095962 - DNA, 22 bp, Homo sapiens
acagcaggcccatactggaagg

SEQ ID NO: 7095963 - DNA, 22 bp, Homo sapiens
acagcaggcccatactggaagg

SEQ ID NO: 7095964 - DNA, 22 bp, Homo sapiens
acagcaggcccatactggaagg

SEQ ID NO: 7095965 - DNA, 22 bp, Homo sapiens
agctgaggttagtataaatgtg

SEQ ID NO: 7095966 - DNA, 22 bp, Homo sapiens
agctgaggttagtataaatgtg

SEQ ID NO: 7095967 - DNA, 23 bp, Homo sapiens
agctgaggtgcagatccaaagaa

SEQ ID NO: 7095968 - DNA, 23 bp, Homo sapiens
agctgaggtgcagatccaaagaa

SEQ ID NO: 7095969 - DNA, 23 bp, Homo sapiens
agctgaggtgcagatccaaagaa

SEQ ID NO: 7095970 - DNA, 23 bp, Homo sapiens
agctgaggtgcagatccaaagaa

SEQ ID NO: 7095971 - DNA, 21 bp, Homo sapiens
agctgaggtaaggcaagagag

SEQ ID NO: 7095972 - DNA, 21 bp, Homo sapiens
agctgaggtaaggcaagagag

SEQ ID NO: 7095973 - DNA, 21 bp, Homo sapiens
agctgaggtaaggcaagagag

SEQ ID NO: 7095974 - DNA, 22 bp, Homo sapiens
agctgatgtgacaaaacatagg

SEQ ID NO: 7095975 - DNA, 22 bp, Homo sapiens
agctgatgtgtccggagcagct

SEQ ID NO: 7095976 - DNA, 22 bp, Homo sapiens
agctgataggtgtaggatacac

SEQ ID NO: 7095977 - DNA, 22 bp, Homo sapiens
agctgatgccatgtggaacagt

SEQ ID NO: 7095978 - DNA, 22 bp, Homo sapiens
agctgatgtgtccggagcagct

SEQ ID NO: 7095979 - DNA, 22 bp, Homo sapiens
acagcaggcatgaatgacactg

SEQ ID NO: 7095980 - DNA, 22 bp, Homo sapiens
agctgaggttgaagagtgaacg

SEQ ID NO: 7095981 - DNA, 22 bp, Homo sapiens
agctgaggttagtataaatgtg

SEQ ID NO: 7095982 - DNA, 22 bp, Homo sapiens
agctgaggttgaagagtgaacg

SEQ ID NO: 7095983 - DNA, 22 bp, Homo sapiens
agctgaggttgaagagtgaacg

SEQ ID NO: 7095984 - DNA, 22 bp, Homo sapiens
agctgaggttgaagagtgaacg

SEQ ID NO: 7095985 - DNA, 22 bp, Homo sapiens
agctgaggttgaagagtgaacg

SEQ ID NO: 7095986 - DNA, 22 bp, Homo sapiens
agctgagttaattcatcactta

SEQ ID NO: 7095987 - DNA, 22 bp, Homo sapiens
acagcagcgtcaacttaaaatt

SEQ ID NO: 7095988 - DNA, 22 bp, Homo sapiens
acagcagcgtcaacttaaaatt

SEQ ID NO: 7095989 - DNA, 22 bp, Homo sapiens
acagcagcgtgaagtgtgttat

SEQ ID NO: 7095990 - DNA, 22 bp, Homo sapiens
acagcagcgtgaagtgtgttat

SEQ ID NO: 7095991 - DNA, 22 bp, Homo sapiens
agctgagaggtggcaagctgta

SEQ ID NO: 7095992 - DNA, 22 bp, Homo sapiens
agctgagaggtggcaagctgta

SEQ ID NO: 7095993 - DNA, 22 bp, Homo sapiens
agctgagggttcggtgtccaca

SEQ ID NO: 7095994 - DNA, 22 bp, Homo sapiens
agctgagggttcggtgtccaca

SEQ ID NO: 7095995 - DNA, 22 bp, Homo sapiens
agctgagggttcggtgtccaca

SEQ ID NO: 7095996 - DNA, 21 bp, Homo sapiens
agctgaggtaaggcaagagag

SEQ ID NO: 7095997 - DNA, 21 bp, Homo sapiens
agctgaggtaaggcaagagag

SEQ ID NO: 7095998 - DNA, 22 bp, Homo sapiens
agctgagggcaggatggggtga

SEQ ID NO: 7095999 - DNA, 22 bp, Homo sapiens
agctgagggcaggatggggtga

SEQ ID NO: 7096000 - DNA, 22 bp, Homo sapiens
agctgagggcaggatggggtga

SEQ ID NO: 7096001 - DNA, 22 bp, Homo sapiens
agctgagggttcggtgtccaca

SEQ ID NO: 7096002 - DNA, 18 bp, Homo sapiens
agctgaggggactgaaga

SEQ ID NO: 7096003 - DNA, 18 bp, Homo sapiens
agctgaggggactgaaga

SEQ ID NO: 7096004 - DNA, 18 bp, Homo sapiens
agctgaggggactgaaga

SEQ ID NO: 7096005 - DNA, 22 bp, Homo sapiens
acagcagccttgttggtttcga

SEQ ID NO: 7096006 - DNA, 22 bp, Homo sapiens
acagcagccttgttggtttcga

SEQ ID NO: 7096007 - DNA, 22 bp, Homo sapiens
acagcagccttgttggtttcga

SEQ ID NO: 7096008 - DNA, 20 bp, Homo sapiens
acagcagccttgctagaaac

SEQ ID NO: 7096009 - DNA, 20 bp, Homo sapiens
acagcagccttgctagaaac

SEQ ID NO: 7096010 - DNA, 20 bp, Homo sapiens
acagcagccttgctagaaac

SEQ ID NO: 7096011 - DNA, 22 bp, Homo sapiens
acagcagcctgcagccctgtgt

SEQ ID NO: 7096012 - DNA, 22 bp, Homo sapiens
acagcagcctgcagccctgtgt

SEQ ID NO: 7096013 - DNA, 22 bp, Homo sapiens
acagcagcagaccagcatatgt

SEQ ID NO: 7096014 - DNA, 22 bp, Homo sapiens
acagcagcagaccagcatatgt

SEQ ID NO: 7096015 - DNA, 22 bp, Homo sapiens
acagcagcataaactgactaag

SEQ ID NO: 7096016 - DNA, 22 bp, Homo sapiens
acagcagcataaactgactaag

SEQ ID NO: 7096017 - DNA, 22 bp, Homo sapiens
acagcagcactattgacatttt

SEQ ID NO: 7096018 - DNA, 22 bp, Homo sapiens
acagcagcactattgacatttt

SEQ ID NO: 7096019 - DNA, 22 bp, Homo sapiens
acagcagcagaccagcatatgt

SEQ ID NO: 7096020 - DNA, 22 bp, Homo sapiens
acagcagcagaccagcatatgt

SEQ ID NO: 7096021 - DNA, 22 bp, Homo sapiens
acagcagcatcctatttcactc

SEQ ID NO: 7096022 - DNA, 22 bp, Homo sapiens
acagcagcatcctatttcactc

SEQ ID NO: 7096023 - DNA, 22 bp, Homo sapiens
acagcagcatcctatttcactc

SEQ ID NO: 7096024 - DNA, 22 bp, Homo sapiens
acagcagccagccactgtgagc

SEQ ID NO: 7096025 - DNA, 22 bp, Homo sapiens
acagcagccagccactgtgagc

SEQ ID NO: 7096026 - DNA, 22 bp, Homo sapiens
acagcagccagccactgtgagc

SEQ ID NO: 7096027 - DNA, 21 bp, Homo sapiens
acagcagcaatctgtctttcc

SEQ ID NO: 7096028 - DNA, 21 bp, Homo sapiens
acagcagcaatctgtctttcc

SEQ ID NO: 7096029 - DNA, 22 bp, Homo sapiens
acagcagcactattgacatttt

SEQ ID NO: 7096030 - DNA, 22 bp, Homo sapiens
acagcagatttccctgggctcc

SEQ ID NO: 7096031 - DNA, 22 bp, Homo sapiens
acagcagcaatagcagtgacat

SEQ ID NO: 7096032 - DNA, 22 bp, Homo sapiens
acagcagatctggctacaggtt

SEQ ID NO: 7096033 - DNA, 22 bp, Homo sapiens
acagcagatctgtggagcttat

SEQ ID NO: 7096034 - DNA, 22 bp, Homo sapiens
acagcagatctgtggagcttat

SEQ ID NO: 7096035 - DNA, 22 bp, Homo sapiens
acagcagatctggctacaggtt

SEQ ID NO: 7096036 - DNA, 22 bp, Homo sapiens
acagcagatctggctacaggtt

SEQ ID NO: 7096037 - DNA, 22 bp, Homo sapiens
acagcagatctggctacaggtt

SEQ ID NO: 7096038 - DNA, 22 bp, Homo sapiens
acagcagatctggctacaggtt

SEQ ID NO: 7096039 - DNA, 22 bp, Homo sapiens
acagcagattacattctgctat

SEQ ID NO: 7096040 - DNA, 22 bp, Homo sapiens
acagcagatttccctgggctcc

SEQ ID NO: 7096041 - DNA, 22 bp, Homo sapiens
acagatacaaatatacaaatac

SEQ ID NO: 7096042 - DNA, 22 bp, Homo sapiens
acagataatttaattaatgcat

SEQ ID NO: 7096043 - DNA, 22 bp, Homo sapiens
acagataattagcataaatgct

SEQ ID NO: 7096044 - DNA, 22 bp, Homo sapiens
acagatacaaatatacaaatac

SEQ ID NO: 7096045 - DNA, 22 bp, Homo sapiens
acagatacagggacttggtatt

SEQ ID NO: 7096046 - DNA, 22 bp, Homo sapiens
acagatactataatgtaaagtg

SEQ ID NO: 7096047 - DNA, 22 bp, Homo sapiens
acagatactcagctctatgctt

SEQ ID NO: 7096048 - DNA, 19 bp, Homo sapiens
acagatagactccaaagca

SEQ ID NO: 7096049 - DNA, 19 bp, Homo sapiens
acagatagactccaaagca

SEQ ID NO: 7096050 - DNA, 22 bp, Homo sapiens
acagatagatgataatggcttt

SEQ ID NO: 7096051 - DNA, 22 bp, Homo sapiens
acagatagatgataatggcttt

SEQ ID NO: 7096052 - DNA, 22 bp, Homo sapiens
acagatagatttgagggaggct

SEQ ID NO: 7096053 - DNA, 22 bp, Homo sapiens
acagatagatttgagggaggct

SEQ ID NO: 7096054 - DNA, 22 bp, Homo sapiens
acagatagcactaagggatctg

SEQ ID NO: 7096055 - DNA, 22 bp, Homo sapiens
acagatagcactaagggatctg

SEQ ID NO: 7096056 - DNA, 17 bp, Homo sapiens
acagataggagccccat

SEQ ID NO: 7096057 - DNA, 23 bp, Homo sapiens
acagatagggaaggcagagtttc

SEQ ID NO: 7096058 - DNA, 22 bp, Homo sapiens
acagatagtatgtaaattaagc

SEQ ID NO: 7096059 - DNA, 22 bp, Homo sapiens
acagatatttaagagcttttgt

SEQ ID NO: 7096060 - DNA, 22 bp, Homo sapiens
acagatattatggtttctcctt

SEQ ID NO: 7096061 - DNA, 22 bp, Homo sapiens
acagatatgcaaagcaaatgga

SEQ ID NO: 7096062 - DNA, 22 bp, Homo sapiens
acagatatgttgggttcttgtt

SEQ ID NO: 7096063 - DNA, 22 bp, Homo sapiens
acagatatgttgggttcttgtt

SEQ ID NO: 7096064 - DNA, 22 bp, Homo sapiens
acagatatcctcagtctccaac

SEQ ID NO: 7096065 - DNA, 22 bp, Homo sapiens
acagatatcctcagtctccaac

SEQ ID NO: 7096066 - DNA, 22 bp, Homo sapiens
acagatatcctcagtctccaac

SEQ ID NO: 7096067 - DNA, 22 bp, Homo sapiens
acagatatatgattgtgtaaat

SEQ ID NO: 7096068 - DNA, 22 bp, Homo sapiens
acagatatatgattgtgtaaat

SEQ ID NO: 7096069 - DNA, 22 bp, Homo sapiens
acagatatatgattgtgtaaat

SEQ ID NO: 7096070 - DNA, 22 bp, Homo sapiens
acagatataaactatagtagtg

SEQ ID NO: 7096071 - DNA, 22 bp, Homo sapiens
acagatataaactatagtagtg

SEQ ID NO: 7096072 - DNA, 22 bp, Homo sapiens
acagatagtatgtaaattaagc

SEQ ID NO: 7096073 - DNA, 22 bp, Homo sapiens
acagatagtatgtaaattaagc

SEQ ID NO: 7096074 - DNA, 22 bp, Homo sapiens
acagatataaactatagtagtg

SEQ ID NO: 7096075 - DNA, 22 bp, Homo sapiens
acagatataaactatagtagtg

SEQ ID NO: 7096076 - DNA, 22 bp, Homo sapiens
acagatataaactatagtagtg

SEQ ID NO: 7096077 - DNA, 22 bp, Homo sapiens
acagatataaactatagtagtg

SEQ ID NO: 7096078 - DNA, 20 bp, Homo sapiens
acagcagataccacaactat

SEQ ID NO: 7096079 - DNA, 22 bp, Homo sapiens
acagcagagtgtgagatagcca

SEQ ID NO: 7096080 - DNA, 22 bp, Homo sapiens
acagcagagtgtgagatagcca

SEQ ID NO: 7096081 - DNA, 22 bp, Homo sapiens
acagcagagttgagtagttgca

SEQ ID NO: 7096082 - DNA, 22 bp, Homo sapiens
acagcagagtgtgagatagcca

SEQ ID NO: 7096083 - DNA, 20 bp, Homo sapiens
acagcagataccacaactat

SEQ ID NO: 7096084 - DNA, 20 bp, Homo sapiens
acagcagataccacaactat

SEQ ID NO: 7096085 - DNA, 22 bp, Homo sapiens
acagcagatctggctacaggtt

SEQ ID NO: 7096086 - DNA, 22 bp, Homo sapiens
acagcagatctggctacaggtt

SEQ ID NO: 7096087 - DNA, 22 bp, Homo sapiens
acagcagatctggctacaggtt

SEQ ID NO: 7096088 - DNA, 22 bp, Homo sapiens
acagcagagtggagatgagcac

SEQ ID NO: 7096089 - DNA, 22 bp, Homo sapiens
acagcagagtggagatgagcac

SEQ ID NO: 7096090 - DNA, 22 bp, Homo sapiens
acagcagaccccagtgccatgg

SEQ ID NO: 7096091 - DNA, 22 bp, Homo sapiens
acagcagagtggagatgagcac

SEQ ID NO: 7096092 - DNA, 22 bp, Homo sapiens
acagcagagtgtgagatagcca

SEQ ID NO: 7096093 - DNA, 22 bp, Homo sapiens
acagcagagtgtgagatagcca

SEQ ID NO: 7096094 - DNA, 21 bp, Homo sapiens
acagatatttcattgaacatt

SEQ ID NO: 7096095 - DNA, 22 bp, Homo sapiens
acagatatttaagagcttttgt

SEQ ID NO: 7096096 - DNA, 21 bp, Homo sapiens
acagatatttcattgaacatt

SEQ ID NO: 7096097 - DNA, 21 bp, Homo sapiens
acagatatttcattgaacatt

SEQ ID NO: 7096098 - DNA, 22 bp, Homo sapiens
acagcagaccactactagtagg

SEQ ID NO: 7096099 - DNA, 22 bp, Homo sapiens
acagcagaccccagtgccatgg

SEQ ID NO: 7096100 - DNA, 22 bp, Homo sapiens
acagcagaccccagtgccatgg

SEQ ID NO: 7096101 - DNA, 22 bp, Homo sapiens
acagcagaccccagtgccatgg

SEQ ID NO: 7096102 - DNA, 22 bp, Homo sapiens
acagaggtcatggagagttctc

SEQ ID NO: 7096103 - DNA, 22 bp, Homo sapiens
agccttcaacctagctagagca

SEQ ID NO: 7096104 - DNA, 22 bp, Homo sapiens
agccttcaacctagctagagca

SEQ ID NO: 7096105 - DNA, 22 bp, Homo sapiens
agcggctgctccgcaggctggc

SEQ ID NO: 7096106 - DNA, 22 bp, Homo sapiens
agcggctgctccgcaggctggc

SEQ ID NO: 7096107 - DNA, 22 bp, Homo sapiens
agcgggctcaagtggccagcag

SEQ ID NO: 7096108 - DNA, 22 bp, Homo sapiens
agcgggcaccctttgagggttt

SEQ ID NO: 7096109 - DNA, 20 bp, Homo sapiens
agcggctggcggaggacacg

SEQ ID NO: 7096110 - DNA, 20 bp, Homo sapiens
agcggctggcggaggacacg

SEQ ID NO: 7096111 - DNA, 22 bp, Homo sapiens
agcggtggtgtcggcagcggct

SEQ ID NO: 7096112 - DNA, 22 bp, Homo sapiens
agcggtggtgtcggcagcggct

SEQ ID NO: 7096113 - DNA, 22 bp, Homo sapiens
agcggtgtgcagcccctgcctg

SEQ ID NO: 7096114 - DNA, 22 bp, Homo sapiens
agcgggctcaagtggccagcag

SEQ ID NO: 7096115 - DNA, 22 bp, Homo sapiens
acagataattagcataaatgct

SEQ ID NO: 7096116 - DNA, 22 bp, Homo sapiens
agctaacacattccagctattt

SEQ ID NO: 7096117 - DNA, 23 bp, Homo sapiens
agctaacagatcgacaaagtata

SEQ ID NO: 7096118 - DNA, 22 bp, Homo sapiens
acagataataggatgtaccctg

SEQ ID NO: 7096119 - DNA, 22 bp, Homo sapiens
acagataattagcataaatgct

SEQ ID NO: 7096120 - DNA, 22 bp, Homo sapiens
acagataattagcataaatgct

SEQ ID NO: 7096121 - DNA, 22 bp, Homo sapiens
agctaaatgttgcttaaaattt

SEQ ID NO: 7096122 - DNA, 22 bp, Homo sapiens
agctaaagagccctacccaaag

SEQ ID NO: 7096123 - DNA, 22 bp, Homo sapiens
agctaaatgcatttcaagactg

SEQ ID NO: 7096124 - DNA, 21 bp, Homo sapiens
agcgtcaatatcgtcaacagg

SEQ ID NO: 7096125 - DNA, 22 bp, Homo sapiens
agcgtgggtccaaggctctggt

SEQ ID NO: 7096126 - DNA, 22 bp, Homo sapiens
agcgtgggtccaaggctctggt

SEQ ID NO: 7096127 - DNA, 22 bp, Homo sapiens
agcgtgtgcctcggggtacacg

SEQ ID NO: 7096128 - DNA, 22 bp, Homo sapiens
agcgtgtgcctcggggtacacg

SEQ ID NO: 7096129 - DNA, 22 bp, Homo sapiens
agcgtgtggagaactaagcaga

SEQ ID NO: 7096130 - DNA, 22 bp, Homo sapiens
agcgtgtgtgcgggtcttcttt

SEQ ID NO: 7096131 - DNA, 22 bp, Homo sapiens
agcgtgtggagaactaagcaga

SEQ ID NO: 7096132 - DNA, 22 bp, Homo sapiens
acagaggtcacctttgtatctt

SEQ ID NO: 7096133 - DNA, 22 bp, Homo sapiens
acagaggtaggacatgagatat

SEQ ID NO: 7096134 - DNA, 22 bp, Homo sapiens
acagagggtttctaaggatttg

SEQ ID NO: 7096135 - DNA, 22 bp, Homo sapiens
acagaggtaggacatgagatat

SEQ ID NO: 7096136 - DNA, 22 bp, Homo sapiens
acagagggtgtggaggaagacg

SEQ ID NO: 7096137 - DNA, 22 bp, Homo sapiens
acagagggtctgggcacaggac

SEQ ID NO: 7096138 - DNA, 22 bp, Homo sapiens
acagagggtctgggcacaggac

SEQ ID NO: 7096139 - DNA, 22 bp, Homo sapiens
acagagggtgtggaggaagacg

SEQ ID NO: 7096140 - DNA, 22 bp, Homo sapiens
acagagggtgtggaggaagacg

SEQ ID NO: 7096141 - DNA, 22 bp, Homo sapiens
acagagggtttctaaggatttg

SEQ ID NO: 7096142 - DNA, 19 bp, Homo sapiens
acagagggcaactgagaaa

SEQ ID NO: 7096143 - DNA, 19 bp, Homo sapiens
acagagggcaactgagaaa

SEQ ID NO: 7096144 - DNA, 19 bp, Homo sapiens
acagagggcaactgagaaa

SEQ ID NO: 7096145 - DNA, 22 bp, Homo sapiens
acagagggggccttggagtgca

SEQ ID NO: 7096146 - DNA, 22 bp, Homo sapiens
acagagggggccttggagtgca

SEQ ID NO: 7096147 - DNA, 22 bp, Homo sapiens
acagaggggtcacagcctgaag

SEQ ID NO: 7096148 - DNA, 22 bp, Homo sapiens
acagaggggtcacagcctgaag

SEQ ID NO: 7096149 - DNA, 22 bp, Homo sapiens
acagagggtctgggcacaggac

SEQ ID NO: 7096150 - DNA, 22 bp, Homo sapiens
acagagggtctgggcacaggac

SEQ ID NO: 7096151 - DNA, 22 bp, Homo sapiens
acagagggtctgggcacaggac

SEQ ID NO: 7096152 - DNA, 22 bp, Homo sapiens
acagagggtctgggcacaggac

SEQ ID NO: 7096153 - DNA, 23 bp, Homo sapiens
acagaggcttaaatgagtggcag

SEQ ID NO: 7096154 - DNA, 19 bp, Homo sapiens
acagagggcaactgagaaa

SEQ ID NO: 7096155 - DNA, 19 bp, Homo sapiens
acagagggcaactgagaaa

SEQ ID NO: 7096156 - DNA, 23 bp, Homo sapiens
acagaggcttaaatgagtggcag

SEQ ID NO: 7096157 - DNA, 22 bp, Homo sapiens
acagaggctgatcttcaagccc

SEQ ID NO: 7096158 - DNA, 22 bp, Homo sapiens
acagaggctgatcttcaagccc

SEQ ID NO: 7096159 - DNA, 22 bp, Homo sapiens
acagaggccgcctctctcacgg

SEQ ID NO: 7096160 - DNA, 22 bp, Homo sapiens
acagaggccccgtgggagagcc

SEQ ID NO: 7096161 - DNA, 22 bp, Homo sapiens
acagaggccgcctctctcacgg

SEQ ID NO: 7096162 - DNA, 22 bp, Homo sapiens
acagaggcctcggcctgcccag

SEQ ID NO: 7096163 - DNA, 22 bp, Homo sapiens
acagaggcctcgtaggtacaac

SEQ ID NO: 7096164 - DNA, 22 bp, Homo sapiens
acagaggcctcgtaggtacaac

SEQ ID NO: 7096165 - DNA, 22 bp, Homo sapiens
acagaggcctcgtaggtacaac

SEQ ID NO: 7096166 - DNA, 22 bp, Homo sapiens
acagaactttctgatcctgagc

SEQ ID NO: 7096167 - DNA, 22 bp, Homo sapiens
acagaacttcctgctggagtgg

SEQ ID NO: 7096168 - DNA, 22 bp, Homo sapiens
agccaggaatgcatgctctgct

SEQ ID NO: 7096169 - DNA, 19 bp, Homo sapiens
acagaagcatagaaaagga

SEQ ID NO: 7096170 - DNA, 22 bp, Homo sapiens
acagaaggcggggacaaggcgg

SEQ ID NO: 7096171 - DNA, 22 bp, Homo sapiens
acagaagtccccatgaagaagc

SEQ ID NO: 7096172 - DNA, 22 bp, Homo sapiens
acagaagtccccatgaagaagc

SEQ ID NO: 7096173 - DNA, 22 bp, Homo sapiens
acagaagctcaagagagcagtg

SEQ ID NO: 7096174 - DNA, 22 bp, Homo sapiens
acagaaggacttgagaaagaca

SEQ ID NO: 7096175 - DNA, 22 bp, Homo sapiens
acagaaggacttgagaaagaca

SEQ ID NO: 7096176 - DNA, 22 bp, Homo sapiens
acagaaggacttgagaaagaca

SEQ ID NO: 7096177 - DNA, 22 bp, Homo sapiens
acagaatactcataagaagggg

SEQ ID NO: 7096178 - DNA, 22 bp, Homo sapiens
acagaataaggtttatctctcc

SEQ ID NO: 7096179 - DNA, 22 bp, Homo sapiens
acagaagtttcaagtaagaagt

SEQ ID NO: 7096180 - DNA, 22 bp, Homo sapiens
acagaagtttcaagtaagaagt

SEQ ID NO: 7096181 - DNA, 22 bp, Homo sapiens
acagaagtttcaagtaagaagt

SEQ ID NO: 7096182 - DNA, 22 bp, Homo sapiens
acagaataactcttgcttgagt

SEQ ID NO: 7096183 - DNA, 22 bp, Homo sapiens
acagaataactcttgcttgagt

SEQ ID NO: 7096184 - DNA, 22 bp, Homo sapiens
acagaataactcttgcttgagt

SEQ ID NO: 7096185 - DNA, 22 bp, Homo sapiens
acagaagtgtgtgtgtaggaat

SEQ ID NO: 7096186 - DNA, 22 bp, Homo sapiens
acagaagtgttgaagttttcat

SEQ ID NO: 7096187 - DNA, 22 bp, Homo sapiens
acagaagttggaattagatact

SEQ ID NO: 7096188 - DNA, 22 bp, Homo sapiens
acagaagttggaattagatact

SEQ ID NO: 7096189 - DNA, 22 bp, Homo sapiens
acagaagtgagtggcaagaact

SEQ ID NO: 7096190 - DNA, 22 bp, Homo sapiens
acagaagtgagtggcaagaact

SEQ ID NO: 7096191 - DNA, 22 bp, Homo sapiens
acagaagtgagtggcaagaact

SEQ ID NO: 7096192 - DNA, 22 bp, Homo sapiens
acagaagtggcttcaaagagca

SEQ ID NO: 7096193 - DNA, 22 bp, Homo sapiens
acagaagtggcttcaaagagca

SEQ ID NO: 7096194 - DNA, 21 bp, Homo sapiens
acagaagtggcttggtctcag

SEQ ID NO: 7096195 - DNA, 21 bp, Homo sapiens
acagaagtggcttggtctcag

SEQ ID NO: 7096196 - DNA, 22 bp, Homo sapiens
acagaagtgtctttttcattca

SEQ ID NO: 7096197 - DNA, 22 bp, Homo sapiens
acagaatattgtaagtgccact

SEQ ID NO: 7096198 - DNA, 22 bp, Homo sapiens
acagaatattgtaagtgccact

SEQ ID NO: 7096199 - DNA, 22 bp, Homo sapiens
acagaatattgtaagtgccact

SEQ ID NO: 7096200 - DNA, 22 bp, Homo sapiens
acagaatattggttactgttgc

SEQ ID NO: 7096201 - DNA, 22 bp, Homo sapiens
acagaatatttggcatgcgtct

SEQ ID NO: 7096202 - DNA, 22 bp, Homo sapiens
acagaatatttggcatgcgtct

SEQ ID NO: 7096203 - DNA, 22 bp, Homo sapiens
acagaatattttatttagatca

SEQ ID NO: 7096204 - DNA, 22 bp, Homo sapiens
acagaatgcgtagtgcatgttg

SEQ ID NO: 7096205 - DNA, 22 bp, Homo sapiens
acagaatgcgtagtgcatgttg

SEQ ID NO: 7096206 - DNA, 22 bp, Homo sapiens
acagaatgcgtagtgcatgttg

SEQ ID NO: 7096207 - DNA, 20 bp, Homo sapiens
acagaatatgctggttgtgg

SEQ ID NO: 7096208 - DNA, 22 bp, Homo sapiens
acagaatattggttactgttgc

SEQ ID NO: 7096209 - DNA, 22 bp, Homo sapiens
acagaatagtagcttaaagtca

SEQ ID NO: 7096210 - DNA, 22 bp, Homo sapiens
acagaatagtcagctgtaggcc

SEQ ID NO: 7096211 - DNA, 22 bp, Homo sapiens
acagaatactcataagaagggg

SEQ ID NO: 7096212 - DNA, 22 bp, Homo sapiens
acagaatactcataagaagggg

SEQ ID NO: 7096213 - DNA, 22 bp, Homo sapiens
acagaatagagactgcctgctc

SEQ ID NO: 7096214 - DNA, 22 bp, Homo sapiens
acagaataggtacagtcagtca

SEQ ID NO: 7096215 - DNA, 22 bp, Homo sapiens
acagaataggtacagtcagtca

SEQ ID NO: 7096216 - DNA, 22 bp, Homo sapiens
acagaggcagtgtgagatactg

SEQ ID NO: 7096217 - DNA, 22 bp, Homo sapiens
acagaggcagtgtgagatactg

SEQ ID NO: 7096218 - DNA, 22 bp, Homo sapiens
acagaggccatgagctgccacc

SEQ ID NO: 7096219 - DNA, 21 bp, Homo sapiens
acagaggcatacagcttaagg

SEQ ID NO: 7096220 - DNA, 22 bp, Homo sapiens
acagaggccatgagctgccacc

SEQ ID NO: 7096221 - DNA, 22 bp, Homo sapiens
acagaatgggatttgaatattt

SEQ ID NO: 7096222 - DNA, 22 bp, Homo sapiens
acagaatgggatttgaatattt

SEQ ID NO: 7096223 - DNA, 22 bp, Homo sapiens
acagaattaaagtgtttgtgga

SEQ ID NO: 7096224 - DNA, 22 bp, Homo sapiens
acagaattaacatttgatgaat

SEQ ID NO: 7096225 - DNA, 22 bp, Homo sapiens
acagaattaacatttgatgaat

SEQ ID NO: 7096226 - DNA, 22 bp, Homo sapiens
acagaattaatgaaaattacaa

SEQ ID NO: 7096227 - DNA, 22 bp, Homo sapiens
acagagctgtacatgtgccatg

SEQ ID NO: 7096228 - DNA, 17 bp, Homo sapiens
acagaggcaggagtgga

SEQ ID NO: 7096229 - DNA, 22 bp, Homo sapiens
tacaaagatggaaggttatgtt

SEQ ID NO: 7096230 - DNA, 22 bp, Homo sapiens
tacaaagatagtgttagagtaa

SEQ ID NO: 7096231 - DNA, 22 bp, Homo sapiens
tacaaagatagtgttagagtaa

SEQ ID NO: 7096232 - DNA, 22 bp, Homo sapiens
tacaaagataaaatctcaccat

SEQ ID NO: 7096233 - DNA, 22 bp, Homo sapiens
tacaaagatagtgttagagtaa

SEQ ID NO: 7096234 - DNA, 22 bp, Homo sapiens
tacaaagatagtgttagagtaa

SEQ ID NO: 7096235 - DNA, 22 bp, Homo sapiens
tacaaaggagactctgtattta

SEQ ID NO: 7096236 - DNA, 22 bp, Homo sapiens
tacaaaggagactctgtattta

SEQ ID NO: 7096237 - DNA, 22 bp, Homo sapiens
tacaaaggagactctgtattta

SEQ ID NO: 7096238 - DNA, 22 bp, Homo sapiens
tacaaaggagataaattggagg

SEQ ID NO: 7096239 - DNA, 19 bp, Homo sapiens
tacaaaggaggatgtaaaa

SEQ ID NO: 7096240 - DNA, 22 bp, Homo sapiens
tacaaaggacagcagaaaaata

SEQ ID NO: 7096241 - DNA, 22 bp, Homo sapiens
tacaaaggacagcagaaaaata

SEQ ID NO: 7096242 - DNA, 22 bp, Homo sapiens
tacaaaggagaatagggtagca

SEQ ID NO: 7096243 - DNA, 22 bp, Homo sapiens
tacaaagcttgtactgtgtgac

SEQ ID NO: 7096244 - DNA, 22 bp, Homo sapiens
tacaaaggaaacttcttttccc

SEQ ID NO: 7096245 - DNA, 22 bp, Homo sapiens
tacaaaggaaacttcttttccc

SEQ ID NO: 7096246 - DNA, 22 bp, Homo sapiens
tacaaagcttgtactgtgtgac

SEQ ID NO: 7096247 - DNA, 22 bp, Homo sapiens
tacaaagcagttccaacacgaa

SEQ ID NO: 7096248 - DNA, 22 bp, Homo sapiens
tacaaagcctggtagatatctg

SEQ ID NO: 7096249 - DNA, 22 bp, Homo sapiens
tacaaagctactcgagggcagg

SEQ ID NO: 7096250 - DNA, 22 bp, Homo sapiens
tacaaagctgtatagcctggtc

SEQ ID NO: 7096251 - DNA, 22 bp, Homo sapiens
tacaaagggaatattggcttta

SEQ ID NO: 7096252 - DNA, 21 bp, Homo sapiens
tacaaagggaaattctggctc

SEQ ID NO: 7096253 - DNA, 22 bp, Homo sapiens
tacaaaggcttaaagagatttc

SEQ ID NO: 7096254 - DNA, 22 bp, Homo sapiens
tacaaaggcttaaagagatttc

SEQ ID NO: 7096255 - DNA, 22 bp, Homo sapiens
tacaaagggattggggtggata

SEQ ID NO: 7096256 - DNA, 22 bp, Homo sapiens
tacaaagggggaagagattctg

SEQ ID NO: 7096257 - DNA, 22 bp, Homo sapiens
tacaaagggggaagagattctg

SEQ ID NO: 7096258 - DNA, 22 bp, Homo sapiens
tacaaaggtatctttcctagat

SEQ ID NO: 7096259 - DNA, 22 bp, Homo sapiens
tacaaagtaatgtataatatcg

SEQ ID NO: 7096260 - DNA, 22 bp, Homo sapiens
tacaaaggagtagagaaggctt

SEQ ID NO: 7096261 - DNA, 22 bp, Homo sapiens
tacaaaggaggtgcatagaaca

SEQ ID NO: 7096262 - DNA, 22 bp, Homo sapiens
tacaaaggaggtgcatagaaca

SEQ ID NO: 7096263 - DNA, 22 bp, Homo sapiens
tacaaaggaggtgcatagaaca

SEQ ID NO: 7096264 - DNA, 22 bp, Homo sapiens
tacaaaggaggtgcatagaaca

SEQ ID NO: 7096265 - DNA, 22 bp, Homo sapiens
tacaaaggagtagagaaggctt

SEQ ID NO: 7096266 - DNA, 22 bp, Homo sapiens
tacaaaggcaggtttcccagga

SEQ ID NO: 7096267 - DNA, 22 bp, Homo sapiens
tacaaaggcaggtttcccagga

SEQ ID NO: 7096268 - DNA, 22 bp, Homo sapiens
tacaaaggcggtttttctgggc

SEQ ID NO: 7096269 - DNA, 22 bp, Homo sapiens
tacaaaggcggtttttctgggc

SEQ ID NO: 7096270 - DNA, 22 bp, Homo sapiens
tacaaaggcttaaagagatttc

SEQ ID NO: 7096271 - DNA, 22 bp, Homo sapiens
tacaaagtaatgtataatatcg

SEQ ID NO: 7096272 - DNA, 22 bp, Homo sapiens
tacaaagtagaaattcagtaaa

SEQ ID NO: 7096273 - DNA, 22 bp, Homo sapiens
tacaaagtagaaattcagtaaa

SEQ ID NO: 7096274 - DNA, 22 bp, Homo sapiens
tacaaagtatatttctagctgt

SEQ ID NO: 7096275 - DNA, 22 bp, Homo sapiens
tacaaagtcaccagcttcttgc

SEQ ID NO: 7096276 - DNA, 22 bp, Homo sapiens
tacaaagtcaccagcttcttgc

SEQ ID NO: 7096277 - DNA, 22 bp, Homo sapiens
tacaaagtcaccagcttcttgc

SEQ ID NO: 7096278 - DNA, 22 bp, Homo sapiens
taattatagccgctattttgct

SEQ ID NO: 7096279 - DNA, 22 bp, Homo sapiens
taattatagccgctattttgct

SEQ ID NO: 7096280 - DNA, 22 bp, Homo sapiens
taattatagccgctattttgct

SEQ ID NO: 7096281 - DNA, 22 bp, Homo sapiens
taattattatgacaacaattgc

SEQ ID NO: 7096282 - DNA, 22 bp, Homo sapiens
tacaaactctttatatttcata

SEQ ID NO: 7096283 - DNA, 22 bp, Homo sapiens
tacaaaaaattgatactgacga

SEQ ID NO: 7096284 - DNA, 22 bp, Homo sapiens
tacaaaaaattgatactgacga

SEQ ID NO: 7096285 - DNA, 22 bp, Homo sapiens
tacaaactgttattattattgt

SEQ ID NO: 7096286 - DNA, 22 bp, Homo sapiens
tacaaactgttattattattgt

SEQ ID NO: 7096287 - DNA, 22 bp, Homo sapiens
tacaaactgttattattattgt

SEQ ID NO: 7096288 - DNA, 20 bp, Homo sapiens
tacaaagaatgaggttcagg

SEQ ID NO: 7096289 - DNA, 22 bp, Homo sapiens
tacaaacttgttttaagtaagt

SEQ ID NO: 7096290 - DNA, 20 bp, Homo sapiens
tacaaagaatgaggttcagg

SEQ ID NO: 7096291 - DNA, 22 bp, Homo sapiens
tacaaagaggtaattgcatata

SEQ ID NO: 7096292 - DNA, 22 bp, Homo sapiens
tacaaagaggtaattgcatata

SEQ ID NO: 7096293 - DNA, 22 bp, Homo sapiens
tacaaagaggtaattgcatata

SEQ ID NO: 7096294 - DNA, 22 bp, Homo sapiens
tacaaagaggtaattgcatata

SEQ ID NO: 7096295 - DNA, 22 bp, Homo sapiens
tacaaagagtttggtctctaga

SEQ ID NO: 7096296 - DNA, 22 bp, Homo sapiens
tacaaagagtttggtctctaga

SEQ ID NO: 7096297 - DNA, 22 bp, Homo sapiens
tacaaagagtttggtctctaga

SEQ ID NO: 7096298 - DNA, 22 bp, Homo sapiens
tacaaagagtttggtctctaga

SEQ ID NO: 7096299 - DNA, 22 bp, Homo sapiens
taatagaatagtggaaacattg

SEQ ID NO: 7096300 - DNA, 22 bp, Homo sapiens
taatagaatagtggaaacattg

SEQ ID NO: 7096301 - DNA, 23 bp, Homo sapiens
taatagctgatgttggttttaat

SEQ ID NO: 7096302 - DNA, 22 bp, Homo sapiens
taatagctgtgggaaataaaag

SEQ ID NO: 7096303 - DNA, 22 bp, Homo sapiens
taatagctgttattgttataac

SEQ ID NO: 7096304 - DNA, 22 bp, Homo sapiens
taatggattaacgtccctgtcg

SEQ ID NO: 7096305 - DNA, 22 bp, Homo sapiens
taatggatttcgaacctctagc

SEQ ID NO: 7096306 - DNA, 22 bp, Homo sapiens
taatgggcccaaaggagctgag

SEQ ID NO: 7096307 - DNA, 22 bp, Homo sapiens
taatggtatttcaagacttgcc

SEQ ID NO: 7096308 - DNA, 22 bp, Homo sapiens
taatgggctatctgttgagact

SEQ ID NO: 7096309 - DNA, 21 bp, Homo sapiens
taatggtgatggttatgttct

SEQ ID NO: 7096310 - DNA, 22 bp, Homo sapiens
taatggtgcagtgggtgtaact

SEQ ID NO: 7096311 - DNA, 22 bp, Homo sapiens
taatggtgcttctgtgagataa

SEQ ID NO: 7096312 - DNA, 22 bp, Homo sapiens
taatggtgtttttctgtaattt

SEQ ID NO: 7096313 - DNA, 22 bp, Homo sapiens
taatggtttttctatactgtcc

SEQ ID NO: 7096314 - DNA, 22 bp, Homo sapiens
taatggttttttggagactgct

SEQ ID NO: 7096315 - DNA, 22 bp, Homo sapiens
taatggttttttggagactgct

SEQ ID NO: 7096316 - DNA, 22 bp, Homo sapiens
taatgtttagaagcagacagct

SEQ ID NO: 7096317 - DNA, 22 bp, Homo sapiens
taatgtttagaagcagacagct

SEQ ID NO: 7096318 - DNA, 22 bp, Homo sapiens
taatgtttccagtctatgatgg

SEQ ID NO: 7096319 - DNA, 22 bp, Homo sapiens
taatgtttccagtctatgatgg

SEQ ID NO: 7096320 - DNA, 22 bp, Homo sapiens
taatgtttccagtctatgatgg

SEQ ID NO: 7096321 - DNA, 22 bp, Homo sapiens
taatagaatagtggaaacattg

SEQ ID NO: 7096322 - DNA, 22 bp, Homo sapiens
taatagaatagtggaaacattg

SEQ ID NO: 7096323 - DNA, 22 bp, Homo sapiens
taatagaatagtggaaacattg

SEQ ID NO: 7096324 - DNA, 22 bp, Homo sapiens
taatacttgctttggatgtatg

SEQ ID NO: 7096325 - DNA, 22 bp, Homo sapiens
taatactttgaatgagagctaa

SEQ ID NO: 7096326 - DNA, 22 bp, Homo sapiens
taatactgatgtctgagcccca

SEQ ID NO: 7096327 - DNA, 22 bp, Homo sapiens
taatactgctgtgcttgagttg

SEQ ID NO: 7096328 - DNA, 23 bp, Homo sapiens
taatactgcttcagaggcttaga

SEQ ID NO: 7096329 - DNA, 19 bp, Homo sapiens
taatactggctgtagctgg

SEQ ID NO: 7096330 - DNA, 22 bp, Homo sapiens
taatactgggaaatacttgggt

SEQ ID NO: 7096331 - DNA, 22 bp, Homo sapiens
taatactgtaacttggtgggtc

SEQ ID NO: 7096332 - DNA, 22 bp, Homo sapiens
taatactgtatactgcaaattt

SEQ ID NO: 7096333 - DNA, 22 bp, Homo sapiens
taatactgtgcttcattttcct

SEQ ID NO: 7096334 - DNA, 22 bp, Homo sapiens
taattatacaaaaaggcatgca

SEQ ID NO: 7096335 - DNA, 22 bp, Homo sapiens
taattataacatgctttctggc

SEQ ID NO: 7096336 - DNA, 22 bp, Homo sapiens
taattataacagttacatctta

SEQ ID NO: 7096337 - DNA, 22 bp, Homo sapiens
taattataacagttacatctta

SEQ ID NO: 7096338 - DNA, 22 bp, Homo sapiens
taattataacagttacatctta

SEQ ID NO: 7096339 - DNA, 23 bp, Homo sapiens
taattagatgttgattcctgaga

SEQ ID NO: 7096340 - DNA, 22 bp, Homo sapiens
taattagagtttggtaaacaat

SEQ ID NO: 7096341 - DNA, 22 bp, Homo sapiens
taattataacagttacatctta

SEQ ID NO: 7096342 - DNA, 22 bp, Homo sapiens
taattataacagttacatctta

SEQ ID NO: 7096343 - DNA, 22 bp, Homo sapiens
taattacaggtccaaaacaatc

SEQ ID NO: 7096344 - DNA, 22 bp, Homo sapiens
taattactggaaatttcaaata

SEQ ID NO: 7096345 - DNA, 22 bp, Homo sapiens
taattagagtcacaagtaacca

SEQ ID NO: 7096346 - DNA, 22 bp, Homo sapiens
taattacagaggtttgccagtt

SEQ ID NO: 7096347 - DNA, 22 bp, Homo sapiens
taattacaggtccaaaacaatc

SEQ ID NO: 7096348 - DNA, 22 bp, Homo sapiens
taatgtttccagtctatgatgg

SEQ ID NO: 7096349 - DNA, 22 bp, Homo sapiens
taatgtttgagatgttggattt

SEQ ID NO: 7096350 - DNA, 22 bp, Homo sapiens
taatgtttgagatgttggattt

SEQ ID NO: 7096351 - DNA, 22 bp, Homo sapiens
taatgtttgggaaggtgctttg

SEQ ID NO: 7096352 - DNA, 22 bp, Homo sapiens
taatgtttgggaaggtgctttg

SEQ ID NO: 7096353 - DNA, 22 bp, Homo sapiens
taatgtttgggaaggtgctttg

SEQ ID NO: 7096354 - DNA, 22 bp, Homo sapiens
taatgtttttctcaacattgct

SEQ ID NO: 7096355 - DNA, 22 bp, Homo sapiens
taatgtttttctcaacattgct

SEQ ID NO: 7096356 - DNA, 22 bp, Homo sapiens
taatgtttttctcaacattgct

SEQ ID NO: 7096357 - DNA, 22 bp, Homo sapiens
taatgtttttctcaacattgct

SEQ ID NO: 7096358 - DNA, 22 bp, Homo sapiens
taattaacatacaaaacagctg

SEQ ID NO: 7096359 - DNA, 22 bp, Homo sapiens
taattacaaagcaagcacaggg

SEQ ID NO: 7096360 - DNA, 22 bp, Homo sapiens
taattacaaagcaagcacaggg

SEQ ID NO: 7096361 - DNA, 22 bp, Homo sapiens
taaggcaggactggatagctat

SEQ ID NO: 7096362 - DNA, 22 bp, Homo sapiens
taaggcaggactggatagctat

SEQ ID NO: 7096363 - DNA, 22 bp, Homo sapiens
taaggcaatggcattcttgaca

SEQ ID NO: 7096364 - DNA, 22 bp, Homo sapiens
taaggcaagagcagggtctttg

SEQ ID NO: 7096365 - DNA, 22 bp, Homo sapiens
taaggcaggtatggtaccaggc

SEQ ID NO: 7096366 - DNA, 22 bp, Homo sapiens
taaggcaaagtgatttcttaaa

SEQ ID NO: 7096367 - DNA, 22 bp, Homo sapiens
taactggtagattttaaatcgg

SEQ ID NO: 7096368 - DNA, 22 bp, Homo sapiens
taaggcaaaggggaagttatca

SEQ ID NO: 7096369 - DNA, 22 bp, Homo sapiens
taactgcagaggaaatgcatct

SEQ ID NO: 7096370 - DNA, 22 bp, Homo sapiens
taactggtactctggtagcctg

SEQ ID NO: 7096371 - DNA, 22 bp, Homo sapiens
taaggcagtgaaactattctgt

SEQ ID NO: 7096372 - DNA, 22 bp, Homo sapiens
taaggcagtgagaagaaacagg

SEQ ID NO: 7096373 - DNA, 22 bp, Homo sapiens
taaggcagtgagaagaaacagg

SEQ ID NO: 7096374 - DNA, 22 bp, Homo sapiens
taaggcataaggccagaggcta

SEQ ID NO: 7096375 - DNA, 22 bp, Homo sapiens
taaggcatgagtttatttcata

SEQ ID NO: 7096376 - DNA, 22 bp, Homo sapiens
taaggcatgctagcagtatgaa

SEQ ID NO: 7096377 - DNA, 22 bp, Homo sapiens
taaggcatgctagcagtatgaa

SEQ ID NO: 7096378 - DNA, 22 bp, Homo sapiens
taaggcattagagtgaaagcaa

SEQ ID NO: 7096379 - DNA, 22 bp, Homo sapiens
taaggcattatagagacagcct

SEQ ID NO: 7096380 - DNA, 22 bp, Homo sapiens
taaggcattctcatgctgtgaa

SEQ ID NO: 7096381 - DNA, 18 bp, Homo sapiens
taaggcattcttatgtga

SEQ ID NO: 7096382 - DNA, 18 bp, Homo sapiens
taaggcattcttatgtga

SEQ ID NO: 7096383 - DNA, 23 bp, Homo sapiens
taaggcattttttctgtatcagt

SEQ ID NO: 7096384 - DNA, 23 bp, Homo sapiens
taaggcattttttctgtatcagt

SEQ ID NO: 7096385 - DNA, 22 bp, Homo sapiens
taaggccaagttcatatacaac

SEQ ID NO: 7096386 - DNA, 22 bp, Homo sapiens
taaggccaagttcatatacaac

SEQ ID NO: 7096387 - DNA, 22 bp, Homo sapiens
taaggtttgcttatcttcgcct

SEQ ID NO: 7096388 - DNA, 22 bp, Homo sapiens
taaggtttgaagaagactgagc

SEQ ID NO: 7096389 - DNA, 22 bp, Homo sapiens
taaggtttcttcagatactagt

SEQ ID NO: 7096390 - DNA, 22 bp, Homo sapiens
taaggtttctagtttctaaact

SEQ ID NO: 7096391 - DNA, 19 bp, Homo sapiens
taaggtttaccagcaaaat

SEQ ID NO: 7096392 - DNA, 22 bp, Homo sapiens
taaggtttaacgccctgtctcg

SEQ ID NO: 7096393 - DNA, 22 bp, Homo sapiens
taaggtgtggtagtttagttct

SEQ ID NO: 7096394 - DNA, 22 bp, Homo sapiens
taaggtgaaaacacaagttgct

SEQ ID NO: 7096395 - DNA, 22 bp, Homo sapiens
taaggtgagctgtataacaggg

SEQ ID NO: 7096396 - DNA, 22 bp, Homo sapiens
taaggtgagctgtataacaggg

SEQ ID NO: 7096397 - DNA, 20 bp, Homo sapiens
taaggtgatctcagagaagc

SEQ ID NO: 7096398 - DNA, 22 bp, Homo sapiens
taaggtagccctaatgtgggtt

SEQ ID NO: 7096399 - DNA, 22 bp, Homo sapiens
taaggtcatggtgaataataag

SEQ ID NO: 7096400 - DNA, 22 bp, Homo sapiens
taagggttcagaatgcagtggt

SEQ ID NO: 7096401 - DNA, 22 bp, Homo sapiens
taagggggaactcagttcagaa

SEQ ID NO: 7096402 - DNA, 22 bp, Homo sapiens
taagggggaagatcatatttta

SEQ ID NO: 7096403 - DNA, 22 bp, Homo sapiens
taagggggcacttactctcagg

SEQ ID NO: 7096404 - DNA, 22 bp, Homo sapiens
taagggcaggttccaaaagggt

SEQ ID NO: 7096405 - DNA, 20 bp, Homo sapiens
taagggctaccagtgtttgg

SEQ ID NO: 7096406 - DNA, 22 bp, Homo sapiens
taagggctatgtgactgattaa

SEQ ID NO: 7096407 - DNA, 22 bp, Homo sapiens
taagggctcctgtcctggcttg

SEQ ID NO: 7096408 - DNA, 22 bp, Homo sapiens
taagggctctatcctactgttt

SEQ ID NO: 7096409 - DNA, 22 bp, Homo sapiens
taagggctgaacatttgtgtcc

SEQ ID NO: 7096410 - DNA, 22 bp, Homo sapiens
taagggctgacttggaactgtc

SEQ ID NO: 7096411 - DNA, 22 bp, Homo sapiens
taagggcttagttactggcaga

SEQ ID NO: 7096412 - DNA, 22 bp, Homo sapiens
taagggcttttaggtatttagt

SEQ ID NO: 7096413 - DNA, 17 bp, Homo sapiens
taagggggaaacggagc

SEQ ID NO: 7096414 - DNA, 22 bp, Homo sapiens
taaggcttagaagctatctgct

SEQ ID NO: 7096415 - DNA, 22 bp, Homo sapiens
taaggcttagaagctatctgct

SEQ ID NO: 7096416 - DNA, 22 bp, Homo sapiens
taaggcttatatacttagacat

SEQ ID NO: 7096417 - DNA, 22 bp, Homo sapiens
taaggcttatgatcagaaggtt

SEQ ID NO: 7096418 - DNA, 22 bp, Homo sapiens
taaggctttgtagtgattgctt

SEQ ID NO: 7096419 - DNA, 22 bp, Homo sapiens
taaggccaattacatatgttca

SEQ ID NO: 7096420 - DNA, 22 bp, Homo sapiens
taaggccaccgttatagaacca

SEQ ID NO: 7096421 - DNA, 22 bp, Homo sapiens
taaggctagcaagatgagaata

SEQ ID NO: 7096422 - DNA, 18 bp, Homo sapiens
taagtaaggtcatatggg

SEQ ID NO: 7096423 - DNA, 22 bp, Homo sapiens
taagtaatttgtgcagagatac

SEQ ID NO: 7096424 - DNA, 22 bp, Homo sapiens
taagtaatttgtgcagagatac

SEQ ID NO: 7096425 - DNA, 22 bp, Homo sapiens
taagtacaaatgtatacataag

SEQ ID NO: 7096426 - DNA, 22 bp, Homo sapiens
taagtacaaatgtatacataag

SEQ ID NO: 7096427 - DNA, 22 bp, Homo sapiens
taagtacaaatgtatacataag

SEQ ID NO: 7096428 - DNA, 22 bp, Homo sapiens
taagtacatttgggaccacctg

SEQ ID NO: 7096429 - DNA, 22 bp, Homo sapiens
taagtactaatattagtaactc

SEQ ID NO: 7096430 - DNA, 22 bp, Homo sapiens
taagtactgtctgtgccttctt

SEQ ID NO: 7096431 - DNA, 19 bp, Homo sapiens
taagtactttacaagtact

SEQ ID NO: 7096432 - DNA, 19 bp, Homo sapiens
taagtactttacaagtact

SEQ ID NO: 7096433 - DNA, 22 bp, Homo sapiens
taagtaaatttataatgtgatt

SEQ ID NO: 7096434 - DNA, 22 bp, Homo sapiens
taagtaaaacattcaagaagtc

SEQ ID NO: 7096435 - DNA, 22 bp, Homo sapiens
taagtaaatttataatgtgatt

SEQ ID NO: 7096436 - DNA, 22 bp, Homo sapiens
taagtaaatttataatgtgatt

SEQ ID NO: 7096437 - DNA, 22 bp, Homo sapiens
taaggttttgagaccagaacgt

SEQ ID NO: 7096438 - DNA, 22 bp, Homo sapiens
taagtaaaacattcaagaagtc

SEQ ID NO: 7096439 - DNA, 22 bp, Homo sapiens
taaggtttgtggggagcaaaag

SEQ ID NO: 7096440 - DNA, 22 bp, Homo sapiens
taaggtttggctgtctcttggt

SEQ ID NO: 7096441 - DNA, 22 bp, Homo sapiens
taagtgcatgattgaacttggc

SEQ ID NO: 7096442 - DNA, 22 bp, Homo sapiens
taagtgcaatgttttacttaaa

SEQ ID NO: 7096443 - DNA, 22 bp, Homo sapiens
taagtgcaatgttttacttaaa

SEQ ID NO: 7096444 - DNA, 22 bp, Homo sapiens
taagtgatttgtagtatactat

SEQ ID NO: 7096445 - DNA, 23 bp, Homo sapiens
taagtgataaagagtagagatgg

SEQ ID NO: 7096446 - DNA, 17 bp, Homo sapiens
taagtgattatctcata

SEQ ID NO: 7096447 - DNA, 17 bp, Homo sapiens
taagtgattatctcata

SEQ ID NO: 7096448 - DNA, 22 bp, Homo sapiens
taagtgaatattttcttctgta

SEQ ID NO: 7096449 - DNA, 20 bp, Homo sapiens
taagtgagaacatgtggtat

SEQ ID NO: 7096450 - DNA, 22 bp, Homo sapiens
taagtgagccctcagagtatgg

SEQ ID NO: 7096451 - DNA, 22 bp, Homo sapiens
taatacatcattcatctaagga

SEQ ID NO: 7096452 - DNA, 22 bp, Homo sapiens
taatacctactggtcattgcaa

SEQ ID NO: 7096453 - DNA, 22 bp, Homo sapiens
taatacctagagatgatacaaa

SEQ ID NO: 7096454 - DNA, 22 bp, Homo sapiens
taatacctggccttgatacagt

SEQ ID NO: 7096455 - DNA, 22 bp, Homo sapiens
taataccttgatctctcttgtc

SEQ ID NO: 7096456 - DNA, 22 bp, Homo sapiens
taatactgaaaggagtatcagc

SEQ ID NO: 7096457 - DNA, 22 bp, Homo sapiens
taatactgaaagggaaatgtcc

SEQ ID NO: 7096458 - DNA, 22 bp, Homo sapiens
taatactgaaagggaaatgtcc

SEQ ID NO: 7096459 - DNA, 21 bp, Homo sapiens
taatactgaaagtgacatctg

SEQ ID NO: 7096460 - DNA, 21 bp, Homo sapiens
taatactgaaagtgacatctg

SEQ ID NO: 7096461 - DNA, 22 bp, Homo sapiens
taatactgaaggtaaaatttct

SEQ ID NO: 7096462 - DNA, 22 bp, Homo sapiens
taatactgactaaagatatcaa

SEQ ID NO: 7096463 - DNA, 22 bp, Homo sapiens
taatactgagccaccaggtagg

SEQ ID NO: 7096464 - DNA, 22 bp, Homo sapiens
taataagcgtagaaggtatatc

SEQ ID NO: 7096465 - DNA, 22 bp, Homo sapiens
taagtgttgctctctctcagct

SEQ ID NO: 7096466 - DNA, 22 bp, Homo sapiens
taagtgttgatctgagtgctaa

SEQ ID NO: 7096467 - DNA, 22 bp, Homo sapiens
taagtgcatctgatctttcatg

SEQ ID NO: 7096468 - DNA, 22 bp, Homo sapiens
taagtgttgctctctctcagct

SEQ ID NO: 7096469 - DNA, 22 bp, Homo sapiens
taagtgtctctcgaattatgct

SEQ ID NO: 7096470 - DNA, 22 bp, Homo sapiens
taagtgttattattctcacttt

SEQ ID NO: 7096471 - DNA, 22 bp, Homo sapiens
taagtgttattattctcacttt

SEQ ID NO: 7096472 - DNA, 22 bp, Homo sapiens
taagtgtccctattgtgatttt

SEQ ID NO: 7096473 - DNA, 22 bp, Homo sapiens
taataatagcagtagctgccac

SEQ ID NO: 7096474 - DNA, 22 bp, Homo sapiens
taatacagggcactttgagtga

SEQ ID NO: 7096475 - DNA, 22 bp, Homo sapiens
taatacagtagcttttacacag

SEQ ID NO: 7096476 - DNA, 22 bp, Homo sapiens
taatacagtagcttttacacag

SEQ ID NO: 7096477 - DNA, 22 bp, Homo sapiens
taatacagtttccaagccagct

SEQ ID NO: 7096478 - DNA, 22 bp, Homo sapiens
taatacatcattcatctaagga

SEQ ID NO: 7096479 - DNA, 23 bp, Homo sapiens
tacattctgtatttttatagagt

SEQ ID NO: 7096480 - DNA, 23 bp, Homo sapiens
tacattctgtatttttatagagt

SEQ ID NO: 7096481 - DNA, 22 bp, Homo sapiens
tacattctggtggagaaagtaa

SEQ ID NO: 7096482 - DNA, 22 bp, Homo sapiens
tacattctggtggagaaagtaa

SEQ ID NO: 7096483 - DNA, 22 bp, Homo sapiens
tacattgaaagtcatttaatcc

SEQ ID NO: 7096484 - DNA, 22 bp, Homo sapiens
tacattgaaagtcatttaatcc

SEQ ID NO: 7096485 - DNA, 22 bp, Homo sapiens
tacattgaaatcaatggatgtg

SEQ ID NO: 7096486 - DNA, 22 bp, Homo sapiens
tacattctggaaaggcacagac

SEQ ID NO: 7096487 - DNA, 22 bp, Homo sapiens
tacattctgaaataaatggttt

SEQ ID NO: 7096488 - DNA, 22 bp, Homo sapiens
tacattctgaaataaatggttt

SEQ ID NO: 7096489 - DNA, 22 bp, Homo sapiens
tacattctcttcccattgtctc

SEQ ID NO: 7096490 - DNA, 22 bp, Homo sapiens
tacattctatatctgttacatc

SEQ ID NO: 7096491 - DNA, 22 bp, Homo sapiens
tacattctatatctgttacatc

SEQ ID NO: 7096492 - DNA, 22 bp, Homo sapiens
tacattctatatctgttacatc

SEQ ID NO: 7096493 - DNA, 22 bp, Homo sapiens
tacattctcttcccattgtctc

SEQ ID NO: 7096494 - DNA, 22 bp, Homo sapiens
tacattccttcgtttagagatt

SEQ ID NO: 7096495 - DNA, 22 bp, Homo sapiens
tacatttgctttgattttcagc

SEQ ID NO: 7096496 - DNA, 22 bp, Homo sapiens
tacatttgatttccactcatct

SEQ ID NO: 7096497 - DNA, 22 bp, Homo sapiens
tacatttgatttccactcatct

SEQ ID NO: 7096498 - DNA, 22 bp, Homo sapiens
tacatttgcctccaccaaaggt

SEQ ID NO: 7096499 - DNA, 22 bp, Homo sapiens
tacatttggatgtgcttaagtg

SEQ ID NO: 7096500 - DNA, 22 bp, Homo sapiens
tacatttggatgtgcttaagtg

SEQ ID NO: 7096501 - DNA, 22 bp, Homo sapiens
tacatttgggacaataagagaa

SEQ ID NO: 7096502 - DNA, 22 bp, Homo sapiens
tacattgaggcagtagctggag

SEQ ID NO: 7096503 - DNA, 22 bp, Homo sapiens
tacatttccttgactcctcaac

SEQ ID NO: 7096504 - DNA, 21 bp, Homo sapiens
tacatttgagagctataagct

SEQ ID NO: 7096505 - DNA, 22 bp, Homo sapiens
tacatttgattctctcctccaa

SEQ ID NO: 7096506 - DNA, 22 bp, Homo sapiens
tacattgaattttttagcatgt

SEQ ID NO: 7096507 - DNA, 22 bp, Homo sapiens
tacattgactctctgtccctaa

SEQ ID NO: 7096508 - DNA, 22 bp, Homo sapiens
tacattgacttggattgttaga

SEQ ID NO: 7096509 - DNA, 22 bp, Homo sapiens
tacattgagaaccactgcttag

SEQ ID NO: 7096510 - DNA, 22 bp, Homo sapiens
tacattcctgggctccacccta

SEQ ID NO: 7096511 - DNA, 22 bp, Homo sapiens
tacatgaacaaaatagcagaaa

SEQ ID NO: 7096512 - DNA, 22 bp, Homo sapiens
tacatctgatttacctactgaa

SEQ ID NO: 7096513 - DNA, 22 bp, Homo sapiens
tacatctttgtctatgaccagc

SEQ ID NO: 7096514 - DNA, 22 bp, Homo sapiens
tacatcatgtaagcagaatcat

SEQ ID NO: 7096515 - DNA, 22 bp, Homo sapiens
tacatcatgtaagcagaatcat

SEQ ID NO: 7096516 - DNA, 22 bp, Homo sapiens
tacatcattttggagatgagca

SEQ ID NO: 7096517 - DNA, 22 bp, Homo sapiens
tacatcattttggagatgagca

SEQ ID NO: 7096518 - DNA, 22 bp, Homo sapiens
tacatcattttggagatgagca

SEQ ID NO: 7096519 - DNA, 22 bp, Homo sapiens
tacatccaaatgaattagaatt

SEQ ID NO: 7096520 - DNA, 19 bp, Homo sapiens
tacatcctcttcctctttg

SEQ ID NO: 7096521 - DNA, 19 bp, Homo sapiens
tacatcctcttcctctttg

SEQ ID NO: 7096522 - DNA, 22 bp, Homo sapiens
tacatagtattcacattgtttt

SEQ ID NO: 7096523 - DNA, 22 bp, Homo sapiens
tacatagctcctagtgatgcat

SEQ ID NO: 7096524 - DNA, 22 bp, Homo sapiens
tacatagctcctagtgatgcat

SEQ ID NO: 7096525 - DNA, 22 bp, Homo sapiens
tacatagttccacttctgtttt

SEQ ID NO: 7096526 - DNA, 22 bp, Homo sapiens
tacatagtattcacattgtttt

SEQ ID NO: 7096527 - DNA, 22 bp, Homo sapiens
tacatatactgagtgatttgct

SEQ ID NO: 7096528 - DNA, 22 bp, Homo sapiens
tacatcatggtgagcaggaggc

SEQ ID NO: 7096529 - DNA, 22 bp, Homo sapiens
tacatcatggtgagcaggaggc

SEQ ID NO: 7096530 - DNA, 22 bp, Homo sapiens
tacatcatgtaagcagaatcat

SEQ ID NO: 7096531 - DNA, 22 bp, Homo sapiens
tacatatagacagttactctag

SEQ ID NO: 7096532 - DNA, 22 bp, Homo sapiens
tacatcatggcttcatgctgca

SEQ ID NO: 7096533 - DNA, 22 bp, Homo sapiens
tacatatagacagttactctag

SEQ ID NO: 7096534 - DNA, 22 bp, Homo sapiens
tacatatactgagtgatttgct

SEQ ID NO: 7096535 - DNA, 22 bp, Homo sapiens
tacatatactgagtgatttgct

SEQ ID NO: 7096536 - DNA, 22 bp, Homo sapiens
tacatatagacagttactctag

SEQ ID NO: 7096537 - DNA, 22 bp, Homo sapiens
tacatatagacagttactctag

SEQ ID NO: 7096538 - DNA, 22 bp, Homo sapiens
tacagtaactggaattcttctt

SEQ ID NO: 7096539 - DNA, 22 bp, Homo sapiens
tacagggacatggaacaggctc

SEQ ID NO: 7096540 - DNA, 22 bp, Homo sapiens
tacagtaagatgaaatagcaat

SEQ ID NO: 7096541 - DNA, 22 bp, Homo sapiens
tacagtaagatgaaatagcaat

SEQ ID NO: 7096542 - DNA, 22 bp, Homo sapiens
tacagtaagatgaaatagcaat

SEQ ID NO: 7096543 - DNA, 22 bp, Homo sapiens
tacagtaagatgaaatagcaat

SEQ ID NO: 7096544 - DNA, 22 bp, Homo sapiens
tacaggcatgtagcatggtgat

SEQ ID NO: 7096545 - DNA, 22 bp, Homo sapiens
tacaggctagggagagtgactg

SEQ ID NO: 7096546 - DNA, 22 bp, Homo sapiens
tacaggctgaactcaatgatga

SEQ ID NO: 7096547 - DNA, 22 bp, Homo sapiens
tacaggctgcagggctagaggg

SEQ ID NO: 7096548 - DNA, 19 bp, Homo sapiens
tacaggcagtttctacaat

SEQ ID NO: 7096549 - DNA, 19 bp, Homo sapiens
tacaggcagtttctacaat

SEQ ID NO: 7096550 - DNA, 19 bp, Homo sapiens
tacaggcagtttctacaat

SEQ ID NO: 7096551 - DNA, 22 bp, Homo sapiens
tacaggcactgaaatgcttatt

SEQ ID NO: 7096552 - DNA, 19 bp, Homo sapiens
tacaggatcctcatacagt

SEQ ID NO: 7096553 - DNA, 22 bp, Homo sapiens
tacaggatatcacttcatttct

SEQ ID NO: 7096554 - DNA, 20 bp, Homo sapiens
tacaggagtgagtgggtggg

SEQ ID NO: 7096555 - DNA, 19 bp, Homo sapiens
tacaggaggcctgcaatct

SEQ ID NO: 7096556 - DNA, 22 bp, Homo sapiens
tacaggaggattatcaaaggat

SEQ ID NO: 7096557 - DNA, 17 bp, Homo sapiens
tacaggagagcaggaac

SEQ ID NO: 7096558 - DNA, 22 bp, Homo sapiens
tacagcactctggggagcatga

SEQ ID NO: 7096559 - DNA, 22 bp, Homo sapiens
tacagcactctggggagcatga

SEQ ID NO: 7096560 - DNA, 21 bp, Homo sapiens
tacagcaccgagtaggccctc

SEQ ID NO: 7096561 - DNA, 22 bp, Homo sapiens
tacagcacggtgcatttactac

SEQ ID NO: 7096562 - DNA, 22 bp, Homo sapiens
tacaggagctgctctgtgatac

SEQ ID NO: 7096563 - DNA, 22 bp, Homo sapiens
tacaggagctgctctgtgatac

SEQ ID NO: 7096564 - DNA, 22 bp, Homo sapiens
tacaggagcatggggaagggat

SEQ ID NO: 7096565 - DNA, 22 bp, Homo sapiens
tacaggagcatggggaagggat

SEQ ID NO: 7096566 - DNA, 22 bp, Homo sapiens
tacaggagcacaaaagagttga

SEQ ID NO: 7096567 - DNA, 22 bp, Homo sapiens
tacagtaataaaatgagctaca

SEQ ID NO: 7096568 - DNA, 22 bp, Homo sapiens
tacagtaataaaatgagctaca

SEQ ID NO: 7096569 - DNA, 22 bp, Homo sapiens
tacagtaataaaatgagctaca

SEQ ID NO: 7096570 - DNA, 22 bp, Homo sapiens
tacagtaataaaatgagctaca

SEQ ID NO: 7096571 - DNA, 21 bp, Homo sapiens
tacagtaagttgggtggtcct

SEQ ID NO: 7096572 - DNA, 22 bp, Homo sapiens
tacagtaatctggacatgattt

SEQ ID NO: 7096573 - DNA, 22 bp, Homo sapiens
tacagtaatctggacatgattt

SEQ ID NO: 7096574 - DNA, 22 bp, Homo sapiens
tacagtaatgtgtccctgcagg

SEQ ID NO: 7096575 - DNA, 22 bp, Homo sapiens
tacagtacagtctagactctgg

SEQ ID NO: 7096576 - DNA, 22 bp, Homo sapiens
tacagtaccctgatgaactaaa

SEQ ID NO: 7096577 - DNA, 22 bp, Homo sapiens
tacagtacctgccacgttgttg

SEQ ID NO: 7096578 - DNA, 22 bp, Homo sapiens
tacagtagaatcttatagccca

SEQ ID NO: 7096579 - DNA, 22 bp, Homo sapiens
tacagtagaatcttatagccca

SEQ ID NO: 7096580 - DNA, 22 bp, Homo sapiens
tacagtagacaatgttagtatg

SEQ ID NO: 7096581 - DNA, 22 bp, Homo sapiens
tacagtagacaggaccacaggc

SEQ ID NO: 7096582 - DNA, 22 bp, Homo sapiens
tacagtagacaggaccacaggc

SEQ ID NO: 7096583 - DNA, 22 bp, Homo sapiens
tacagtagctactcaataacta

SEQ ID NO: 7096584 - DNA, 22 bp, Homo sapiens
tacagtagctgaggttctcagg

SEQ ID NO: 7096585 - DNA, 22 bp, Homo sapiens
tacatagagggtaatagcatca

SEQ ID NO: 7096586 - DNA, 22 bp, Homo sapiens
tacatagcaaggaaatgacaga

SEQ ID NO: 7096587 - DNA, 22 bp, Homo sapiens
tacatagcaaggaaatgacaga

SEQ ID NO: 7096588 - DNA, 22 bp, Homo sapiens
tacatactttttcttgcaagca

SEQ ID NO: 7096589 - DNA, 22 bp, Homo sapiens
tacatagaacatgtttaatgtc

SEQ ID NO: 7096590 - DNA, 22 bp, Homo sapiens
tacatagagaagttacagtgga

SEQ ID NO: 7096591 - DNA, 22 bp, Homo sapiens
tacatacattacctcatttagt

SEQ ID NO: 7096592 - DNA, 22 bp, Homo sapiens
tacatacattacctcatttagt

SEQ ID NO: 7096593 - DNA, 22 bp, Homo sapiens
tacatacattacctcatttagt

SEQ ID NO: 7096594 - DNA, 22 bp, Homo sapiens
tacataccttgacggtagatgg

SEQ ID NO: 7096595 - DNA, 22 bp, Homo sapiens
tacatactccataatgacagca

SEQ ID NO: 7096596 - DNA, 22 bp, Homo sapiens
tacatactccataatgacagca

SEQ ID NO: 7096597 - DNA, 22 bp, Homo sapiens
tacatactccataatgacagca

SEQ ID NO: 7096598 - DNA, 22 bp, Homo sapiens
tacatactccataatgacagca

SEQ ID NO: 7096599 - DNA, 22 bp, Homo sapiens
tacatacatggtggaatggtta

SEQ ID NO: 7096600 - DNA, 22 bp, Homo sapiens
tacatacatgtatgtgtgtatt

SEQ ID NO: 7096601 - DNA, 22 bp, Homo sapiens
tacatacatgtatgtgtgtatt

SEQ ID NO: 7096602 - DNA, 22 bp, Homo sapiens
tacatacattacctcatttagt

SEQ ID NO: 7096603 - DNA, 22 bp, Homo sapiens
tacaacaatttccacattagaa

SEQ ID NO: 7096604 - DNA, 22 bp, Homo sapiens
tacaacaatttccacattagaa

SEQ ID NO: 7096605 - DNA, 22 bp, Homo sapiens
tacaacaatttccacattagaa

SEQ ID NO: 7096606 - DNA, 22 bp, Homo sapiens
tacaacaatttccacattagaa

SEQ ID NO: 7096607 - DNA, 20 bp, Homo sapiens
tacaacaagtagagacatac

SEQ ID NO: 7096608 - DNA, 22 bp, Homo sapiens
tacaacaatttccacattagaa

SEQ ID NO: 7096609 - DNA, 22 bp, Homo sapiens
tacaacaatttccacattagaa

SEQ ID NO: 7096610 - DNA, 22 bp, Homo sapiens
tacaacaatttccacattagaa

SEQ ID NO: 7096611 - DNA, 22 bp, Homo sapiens
tacaacaatttccacattagaa

SEQ ID NO: 7096612 - DNA, 22 bp, Homo sapiens
tacaaatcagatcatgagttta

SEQ ID NO: 7096613 - DNA, 22 bp, Homo sapiens
tacaaatgaaccaactttgatg

SEQ ID NO: 7096614 - DNA, 20 bp, Homo sapiens
tacaaattttccatgtttcc

SEQ ID NO: 7096615 - DNA, 20 bp, Homo sapiens
tacaacaagtagagacatac

SEQ ID NO: 7096616 - DNA, 20 bp, Homo sapiens
tacaacaagtagagacatac

SEQ ID NO: 7096617 - DNA, 22 bp, Homo sapiens
tacaacaatttccacattagaa

SEQ ID NO: 7096618 - DNA, 22 bp, Homo sapiens
tacaacagacaggaataagatt

SEQ ID NO: 7096619 - DNA, 22 bp, Homo sapiens
tacaacagacaggaataagatt

SEQ ID NO: 7096620 - DNA, 22 bp, Homo sapiens
tacaacagacaggaataagatt

SEQ ID NO: 7096621 - DNA, 22 bp, Homo sapiens
tacaacaggaatttcaactttg

SEQ ID NO: 7096622 - DNA, 22 bp, Homo sapiens
tacaaagtgctttagaaatgaa

SEQ ID NO: 7096623 - DNA, 22 bp, Homo sapiens
tacaaagtgctttagaaatgaa

SEQ ID NO: 7096624 - DNA, 22 bp, Homo sapiens
tacaaagtgggaaacgaaggtt

SEQ ID NO: 7096625 - DNA, 22 bp, Homo sapiens
tacaaagtgtgcccatgctgag

SEQ ID NO: 7096626 - DNA, 22 bp, Homo sapiens
tacaaagtttgagaatgctttc

SEQ ID NO: 7096627 - DNA, 22 bp, Homo sapiens
tacaaagtttgagaatgctttc

SEQ ID NO: 7096628 - DNA, 22 bp, Homo sapiens
tacaaagtttggggtcctcaaa

SEQ ID NO: 7096629 - DNA, 22 bp, Homo sapiens
tacaaagttttcttggattgag

SEQ ID NO: 7096630 - DNA, 22 bp, Homo sapiens
tacaaagtgaaataattctgag

SEQ ID NO: 7096631 - DNA, 22 bp, Homo sapiens
tacaaagtgacaagctctgctg

SEQ ID NO: 7096632 - DNA, 22 bp, Homo sapiens
tacaaagtgacaagctctgctg

SEQ ID NO: 7096633 - DNA, 22 bp, Homo sapiens
tacaaagtgagcaacctctttt

SEQ ID NO: 7096634 - DNA, 22 bp, Homo sapiens
tacaaagtgagcaacctctttt

SEQ ID NO: 7096635 - DNA, 22 bp, Homo sapiens
tacaaagtgattttggaattga

SEQ ID NO: 7096636 - DNA, 22 bp, Homo sapiens
tacaaagtgctttagaaatgaa

SEQ ID NO: 7096637 - DNA, 22 bp, Homo sapiens
tacaaagtcccattgccatgga

SEQ ID NO: 7096638 - DNA, 22 bp, Homo sapiens
tacaaagtgaaataattctgag

SEQ ID NO: 7096639 - DNA, 22 bp, Homo sapiens
tacagaaaaacatctggagccg

SEQ ID NO: 7096640 - DNA, 22 bp, Homo sapiens
tacagaaaaacatctggagccg

SEQ ID NO: 7096641 - DNA, 22 bp, Homo sapiens
tacagaaaaacatctggagccg

SEQ ID NO: 7096642 - DNA, 22 bp, Homo sapiens
tacagaaaaacatctggagccg

SEQ ID NO: 7096643 - DNA, 22 bp, Homo sapiens
tacagaaaaacatctggagccg

SEQ ID NO: 7096644 - DNA, 22 bp, Homo sapiens
tacagaaaaacatctggagccg

SEQ ID NO: 7096645 - DNA, 22 bp, Homo sapiens
tacactttttactacagattct

SEQ ID NO: 7096646 - DNA, 22 bp, Homo sapiens
tacactttttactacagattct

SEQ ID NO: 7096647 - DNA, 22 bp, Homo sapiens
tacactgagcaggaagaagtgg

SEQ ID NO: 7096648 - DNA, 22 bp, Homo sapiens
tacacttttctggttactcttg

SEQ ID NO: 7096649 - DNA, 22 bp, Homo sapiens
tacacttttctggttactcttg

SEQ ID NO: 7096650 - DNA, 22 bp, Homo sapiens
tacactctaattctttggtcct

SEQ ID NO: 7096651 - DNA, 22 bp, Homo sapiens
tacaacagttcatgaaatgaaa

SEQ ID NO: 7096652 - DNA, 22 bp, Homo sapiens
tacaacagttcatgaaatgaaa

SEQ ID NO: 7096653 - DNA, 22 bp, Homo sapiens
tacaacataacgggcattcagt

SEQ ID NO: 7096654 - DNA, 22 bp, Homo sapiens
tacagaaagggatgattgatct

SEQ ID NO: 7096655 - DNA, 22 bp, Homo sapiens
tacagaaagacctctcgggaaa

SEQ ID NO: 7096656 - DNA, 22 bp, Homo sapiens
tacagaaagggatgattgatct

SEQ ID NO: 7096657 - DNA, 22 bp, Homo sapiens
tacagaaagggatgattgatct

SEQ ID NO: 7096658 - DNA, 22 bp, Homo sapiens
tacagaaagggatgattgatct

SEQ ID NO: 7096659 - DNA, 22 bp, Homo sapiens
tacagaaagggatgattgatct

SEQ ID NO: 7096660 - DNA, 20 bp, Homo sapiens
tacagaaacaggacttttgg

SEQ ID NO: 7096661 - DNA, 20 bp, Homo sapiens
tacagaaacaggacttttgg

SEQ ID NO: 7096662 - DNA, 22 bp, Homo sapiens
tacagaaagacctctcgggaaa

SEQ ID NO: 7096663 - DNA, 22 bp, Homo sapiens
tacagaaagacctctcgggaaa

SEQ ID NO: 7096664 - DNA, 22 bp, Homo sapiens
tacagaaaaacttggaggcttt

SEQ ID NO: 7096665 - DNA, 22 bp, Homo sapiens
tacagaaaaacttggaggcttt

SEQ ID NO: 7096666 - DNA, 22 bp, Homo sapiens
tacagaaaaacttggaggcttt

SEQ ID NO: 7096667 - DNA, 22 bp, Homo sapiens
tacagaaaaactggcattgaag

SEQ ID NO: 7096668 - DNA, 22 bp, Homo sapiens
tacagaaaaactggcattgaag

SEQ ID NO: 7096669 - DNA, 22 bp, Homo sapiens
tacagaaaaactggcattgaag

SEQ ID NO: 7096670 - DNA, 22 bp, Homo sapiens
tacagaaacagcgtggttagaa

SEQ ID NO: 7096671 - DNA, 22 bp, Homo sapiens
tacagaaacagcgtggttagaa

SEQ ID NO: 7096672 - DNA, 20 bp, Homo sapiens
tacagaaacaggacttttgg

SEQ ID NO: 7096673 - DNA, 20 bp, Homo sapiens
tacagaaacaggacttttgg

SEQ ID NO: 7096674 - DNA, 20 bp, Homo sapiens
tacagaaacaggacttttgg

SEQ ID NO: 7096675 - DNA, 22 bp, Homo sapiens
tacagaaacagcgtggttagaa

SEQ ID NO: 7096676 - DNA, 22 bp, Homo sapiens
tacagaaacagcgtggttagaa

SEQ ID NO: 7096677 - DNA, 22 bp, Homo sapiens
tacagaaacagcgtggttagaa

SEQ ID NO: 7096678 - DNA, 22 bp, Homo sapiens
tacagaaattgccaccagctct

SEQ ID NO: 7096679 - DNA, 22 bp, Homo sapiens
tacagaaattgccaccagctct

SEQ ID NO: 7096680 - DNA, 22 bp, Homo sapiens
tacagaaattgccaccagctct

SEQ ID NO: 7096681 - DNA, 22 bp, Homo sapiens
tacagaaattgccaccagctct

SEQ ID NO: 7096682 - DNA, 22 bp, Homo sapiens
tacagaaattgccaccagctct

SEQ ID NO: 7096683 - DNA, 22 bp, Homo sapiens
tacagaaattgccaccagctct

SEQ ID NO: 7096684 - DNA, 22 bp, Homo sapiens
tacagaaatacagtcaggccta

SEQ ID NO: 7096685 - DNA, 22 bp, Homo sapiens
tacagaaatacagtcaggccta

SEQ ID NO: 7096686 - DNA, 22 bp, Homo sapiens
tacagaaatacagtcaggccta

SEQ ID NO: 7096687 - DNA, 22 bp, Homo sapiens
tacagaaatactggggggttct

SEQ ID NO: 7096688 - DNA, 22 bp, Homo sapiens
tacagaaatactggggggttct

SEQ ID NO: 7096689 - DNA, 22 bp, Homo sapiens
tacagaaatactggggggttct

SEQ ID NO: 7096690 - DNA, 22 bp, Homo sapiens
tacagaaatcacatcgctttga

SEQ ID NO: 7096691 - DNA, 22 bp, Homo sapiens
tacagaaatcacatcgctttga

SEQ ID NO: 7096692 - DNA, 22 bp, Homo sapiens
tacagaaatcacatcgctttga

SEQ ID NO: 7096693 - DNA, 22 bp, Homo sapiens
tacagaagctgagacactgaga

SEQ ID NO: 7096694 - DNA, 22 bp, Homo sapiens
tacagaagctgagacactgaga

SEQ ID NO: 7096695 - DNA, 22 bp, Homo sapiens
tacagaagctgagacactgaga

SEQ ID NO: 7096696 - DNA, 18 bp, Homo sapiens
tacagaactggagtagaa

SEQ ID NO: 7096697 - DNA, 22 bp, Homo sapiens
tacagaagctgagacactgaga

SEQ ID NO: 7096698 - DNA, 22 bp, Homo sapiens
tacagaactgaagtagtgaaaa

SEQ ID NO: 7096699 - DNA, 22 bp, Homo sapiens
tacagaaattgccaccagctct

SEQ ID NO: 7096700 - DNA, 23 bp, Homo sapiens
tacagaaggagtagtcactaaga

SEQ ID NO: 7096701 - DNA, 22 bp, Homo sapiens
tacagaagcttttgaaaagatg

SEQ ID NO: 7096702 - DNA, 22 bp, Homo sapiens
tacagaagctgagacactgaga

SEQ ID NO: 7096703 - DNA, 22 bp, Homo sapiens
tacagatacagatctagataca

SEQ ID NO: 7096704 - DNA, 22 bp, Homo sapiens
tacagatacagatctagataca

SEQ ID NO: 7096705 - DNA, 22 bp, Homo sapiens
tacagatagaattagtgagtta

SEQ ID NO: 7096706 - DNA, 22 bp, Homo sapiens
tacagatagaattagtgagtta

SEQ ID NO: 7096707 - DNA, 22 bp, Homo sapiens
tacagagttttcctgccaagaa

SEQ ID NO: 7096708 - DNA, 22 bp, Homo sapiens
tacagataaaaatgctgttctt

SEQ ID NO: 7096709 - DNA, 22 bp, Homo sapiens
tacagataaaaatgctgttctt

SEQ ID NO: 7096710 - DNA, 22 bp, Homo sapiens
tacagataaattttaagtagaa

SEQ ID NO: 7096711 - DNA, 22 bp, Homo sapiens
tacagataaattttaagtagaa

SEQ ID NO: 7096712 - DNA, 22 bp, Homo sapiens
tacagataaattttaagtagaa

SEQ ID NO: 7096713 - DNA, 22 bp, Homo sapiens
tacagataactgaatgcagact

SEQ ID NO: 7096714 - DNA, 22 bp, Homo sapiens
tacagataactgaatgcagact

SEQ ID NO: 7096715 - DNA, 17 bp, Homo sapiens
tacagaaggcaccacaa

SEQ ID NO: 7096716 - DNA, 22 bp, Homo sapiens
tacagaagtaaataccaaaagc

SEQ ID NO: 7096717 - DNA, 22 bp, Homo sapiens
tacagaagtaaataccaaaagc

SEQ ID NO: 7096718 - DNA, 17 bp, Homo sapiens
tacagaaggcaccacaa

SEQ ID NO: 7096719 - DNA, 17 bp, Homo sapiens
tacagaaggcaccacaa

SEQ ID NO: 7096720 - DNA, 22 bp, Homo sapiens
tacagaataaagcgtgaagctt

SEQ ID NO: 7096721 - DNA, 22 bp, Homo sapiens
tacagaataaagcgtgaagctt

SEQ ID NO: 7096722 - DNA, 22 bp, Homo sapiens
tacagagtatttttaatatggt

SEQ ID NO: 7096723 - DNA, 22 bp, Homo sapiens
tacagagtggtgagatcttttg

SEQ ID NO: 7096724 - DNA, 22 bp, Homo sapiens
tacagagtggttgtccaactct

SEQ ID NO: 7096725 - DNA, 22 bp, Homo sapiens
tacagagtggttgtccaactct

SEQ ID NO: 7096726 - DNA, 22 bp, Homo sapiens
tacagagtgttattacagaatc

SEQ ID NO: 7096727 - DNA, 22 bp, Homo sapiens
tacagagttttcctgccaagaa

SEQ ID NO: 7096728 - DNA, 22 bp, Homo sapiens
tacagagttttcctgccaagaa

SEQ ID NO: 7096729 - DNA, 22 bp, Homo sapiens
tacagatatgttccatgcatcg

SEQ ID NO: 7096730 - DNA, 22 bp, Homo sapiens
tacagatatgtatgcacttttt

SEQ ID NO: 7096731 - DNA, 22 bp, Homo sapiens
tacagatatagagatttataga

SEQ ID NO: 7096732 - DNA, 22 bp, Homo sapiens
tacagatatagagatttataga

SEQ ID NO: 7096733 - DNA, 22 bp, Homo sapiens
tacagatatagagatttataga

SEQ ID NO: 7096734 - DNA, 22 bp, Homo sapiens
tacagatatagagatttataga

SEQ ID NO: 7096735 - DNA, 22 bp, Homo sapiens
tacagatatagagatttataga

SEQ ID NO: 7096736 - DNA, 22 bp, Homo sapiens
tacagataggaggaatctgaaa

SEQ ID NO: 7096737 - DNA, 22 bp, Homo sapiens
tacagataggaggaatctgaaa

SEQ ID NO: 7096738 - DNA, 22 bp, Homo sapiens
tacagataggaggaatctgaaa

SEQ ID NO: 7096739 - DNA, 22 bp, Homo sapiens
tacagatatagagatttataga

SEQ ID NO: 7096740 - DNA, 22 bp, Homo sapiens
tacagatattgtacagttatag

SEQ ID NO: 7096741 - DNA, 22 bp, Homo sapiens
tacagatattgtacagttatag

SEQ ID NO: 7096742 - DNA, 22 bp, Homo sapiens
tacagatatttctcttcaacaa

SEQ ID NO: 7096743 - DNA, 21 bp, Homo sapiens
tacagatgaggagaccaaggc

SEQ ID NO: 7096744 - DNA, 18 bp, Homo sapiens
tacagattatagatacat

SEQ ID NO: 7096745 - DNA, 18 bp, Homo sapiens
tacagattatagatacat

SEQ ID NO: 7096746 - DNA, 22 bp, Homo sapiens
tacagattgaggtttttaatat

SEQ ID NO: 7096747 - DNA, 22 bp, Homo sapiens
tacagattgaggtttttaatat

SEQ ID NO: 7096748 - DNA, 22 bp, Homo sapiens
tacagattttgtgaagaagtgt

SEQ ID NO: 7096749 - DNA, 22 bp, Homo sapiens
tacagattttgtgaagaagtgt

SEQ ID NO: 7096750 - DNA, 22 bp, Homo sapiens
tacagcaaagaaaccctcagtc

SEQ ID NO: 7096751 - DNA, 22 bp, Homo sapiens
tacagcaaagaaaccctcagtc

SEQ ID NO: 7096752 - DNA, 22 bp, Homo sapiens
tacagcaaagaaaccctcagtc

SEQ ID NO: 7096753 - DNA, 21 bp, Homo sapiens
tacagcaacggaggttttcta

SEQ ID NO: 7096754 - DNA, 22 bp, Homo sapiens
tacagcaagacagaccgctcaa

SEQ ID NO: 7096755 - DNA, 23 bp, Homo sapiens
tacagcaaggacaacataggtgg

SEQ ID NO: 7096756 - DNA, 23 bp, Homo sapiens
tacagcaaggacaacataggtgg

SEQ ID NO: 7096757 - DNA, 22 bp, Homo sapiens
tacagcaataatgacaccgctc

SEQ ID NO: 7096758 - DNA, 22 bp, Homo sapiens
tacagcaataatgacaccgctc

SEQ ID NO: 7096759 - DNA, 22 bp, Homo sapiens
tacagcaatgcctgaaatagta

SEQ ID NO: 7096760 - DNA, 22 bp, Homo sapiens
tacagcaatgcctgaaatagta

SEQ ID NO: 7096761 - DNA, 22 bp, Homo sapiens
tacagcaatgcctgaaatagta

SEQ ID NO: 7096762 - DNA, 22 bp, Homo sapiens
tacagcaatgctacaagatgac

SEQ ID NO: 7096763 - DNA, 22 bp, Homo sapiens
tacagcaatgctacaagatgac

SEQ ID NO: 7096764 - DNA, 22 bp, Homo sapiens
tacagcaatggttctaagagtc

SEQ ID NO: 7096765 - DNA, 22 bp, Homo sapiens
tacagcaatggttctaagagtc

SEQ ID NO: 7096766 - DNA, 22 bp, Homo sapiens
tacagcaatggttctaagagtc

SEQ ID NO: 7096767 - DNA, 22 bp, Homo sapiens
tacagcacaaagggcctttacc

SEQ ID NO: 7096768 - DNA, 22 bp, Homo sapiens
tacagcacaaagggcctttacc

SEQ ID NO: 7096769 - DNA, 22 bp, Homo sapiens
tacagcacagcaaagaggacgg

SEQ ID NO: 7096770 - DNA, 22 bp, Homo sapiens
tacagcacattgtgatggcact

SEQ ID NO: 7096771 - DNA, 22 bp, Homo sapiens
gttgagtgggttaggatgctga

SEQ ID NO: 7096772 - DNA, 22 bp, Homo sapiens
gttgagtgggttaggatgctga

SEQ ID NO: 7096773 - DNA, 22 bp, Homo sapiens
gttgaggtgatgccagccctgc

SEQ ID NO: 7096774 - DNA, 22 bp, Homo sapiens
gttgaggtgatgccagccctgc

SEQ ID NO: 7096775 - DNA, 22 bp, Homo sapiens
gttgaggtgatgccagccctgc

SEQ ID NO: 7096776 - DNA, 22 bp, Homo sapiens
gttgaggtgatgccagccctgc

SEQ ID NO: 7096777 - DNA, 22 bp, Homo sapiens
gttcatttatgatgtaacatgt

SEQ ID NO: 7096778 - DNA, 22 bp, Homo sapiens
gttcattttactgtaaatagca

SEQ ID NO: 7096779 - DNA, 22 bp, Homo sapiens
gttgaggtgatgccagccctgc

SEQ ID NO: 7096780 - DNA, 22 bp, Homo sapiens
gttcatgtggtttttaaaggat

SEQ ID NO: 7096781 - DNA, 22 bp, Homo sapiens
gttcatgtttgtgtattgctca

SEQ ID NO: 7096782 - DNA, 20 bp, Homo sapiens
gttcatgtctcaaatagaaa

SEQ ID NO: 7096783 - DNA, 22 bp, Homo sapiens
gttcattcatcaaatatttact

SEQ ID NO: 7096784 - DNA, 22 bp, Homo sapiens
gttcattgtgtgtggtcttctt

SEQ ID NO: 7096785 - DNA, 19 bp, Homo sapiens
gttcattgttcaggaaaat

SEQ ID NO: 7096786 - DNA, 22 bp, Homo sapiens
gttcatttaggaaaggaagagt

SEQ ID NO: 7096787 - DNA, 22 bp, Homo sapiens
gttcatttatgatgtaacatgt

SEQ ID NO: 7096788 - DNA, 22 bp, Homo sapiens
gttcataatttgaaggaatagg

SEQ ID NO: 7096789 - DNA, 22 bp, Homo sapiens
gttcagttttggggctgttaca

SEQ ID NO: 7096790 - DNA, 22 bp, Homo sapiens
gttcagtttggggtatttgaag

SEQ ID NO: 7096791 - DNA, 22 bp, Homo sapiens
gttcatatttaactaagatagg

SEQ ID NO: 7096792 - DNA, 22 bp, Homo sapiens
gttcatcactcagagacctccc

SEQ ID NO: 7096793 - DNA, 22 bp, Homo sapiens
gttcatccatattatagcatgt

SEQ ID NO: 7096794 - DNA, 22 bp, Homo sapiens
gttcatccatattatagcatgt

SEQ ID NO: 7096795 - DNA, 22 bp, Homo sapiens
gttcatccatattatagcatgt

SEQ ID NO: 7096796 - DNA, 22 bp, Homo sapiens
gttcatccatgtcagcgtatat

SEQ ID NO: 7096797 - DNA, 22 bp, Homo sapiens
gttcatccatgtcagcgtatat

SEQ ID NO: 7096798 - DNA, 22 bp, Homo sapiens
gttcatccatgtcagcgtatat

SEQ ID NO: 7096799 - DNA, 22 bp, Homo sapiens
gttcatcctgacttggattagt

SEQ ID NO: 7096800 - DNA, 22 bp, Homo sapiens
gttcatcctgacttggattagt

SEQ ID NO: 7096801 - DNA, 22 bp, Homo sapiens
gttcatcctgacttggattagt

SEQ ID NO: 7096802 - DNA, 22 bp, Homo sapiens
gttcatcttcctcccagtgcct

SEQ ID NO: 7096803 - DNA, 22 bp, Homo sapiens
gttcagtttgagattaccatgg

SEQ ID NO: 7096804 - DNA, 22 bp, Homo sapiens
gttcagtttgagattaccatgg

SEQ ID NO: 7096805 - DNA, 22 bp, Homo sapiens
gttcagttatttctgaagatat

SEQ ID NO: 7096806 - DNA, 22 bp, Homo sapiens
gttcagtattaatgagatgatt

SEQ ID NO: 7096807 - DNA, 22 bp, Homo sapiens
gttcagtattaatgagatgatt

SEQ ID NO: 7096808 - DNA, 22 bp, Homo sapiens
gttcagtcacgtgcccaagttc

SEQ ID NO: 7096809 - DNA, 22 bp, Homo sapiens
gttcagtggggccttgggggac

SEQ ID NO: 7096810 - DNA, 22 bp, Homo sapiens
gttcagtacctctaaactttgt

SEQ ID NO: 7096811 - DNA, 22 bp, Homo sapiens
gttcaggaagtctcagctggga

SEQ ID NO: 7096812 - DNA, 22 bp, Homo sapiens
gttcagggagacagactaaact

SEQ ID NO: 7096813 - DNA, 22 bp, Homo sapiens
gttcagctcaagcaataatttt

SEQ ID NO: 7096814 - DNA, 22 bp, Homo sapiens
gttcagcttacaaaatacacct

SEQ ID NO: 7096815 - DNA, 22 bp, Homo sapiens
gttcagcaatagatctagaggc

SEQ ID NO: 7096816 - DNA, 22 bp, Homo sapiens
gttcagcacaggtgctcagaca

SEQ ID NO: 7096817 - DNA, 22 bp, Homo sapiens
gttcagcacaggtgctcagaca

SEQ ID NO: 7096818 - DNA, 22 bp, Homo sapiens
gttcagcacaggtgctcagaca

SEQ ID NO: 7096819 - DNA, 22 bp, Homo sapiens
gttcagcagcagtgattttgtg

SEQ ID NO: 7096820 - DNA, 22 bp, Homo sapiens
gttcagcagcagtgattttgtg

SEQ ID NO: 7096821 - DNA, 22 bp, Homo sapiens
gttcagctaggaatggagatgc

SEQ ID NO: 7096822 - DNA, 22 bp, Homo sapiens
gttcagcaagaatgtttctatt

SEQ ID NO: 7096823 - DNA, 22 bp, Homo sapiens
gttcagcaagaatgtttctatt

SEQ ID NO: 7096824 - DNA, 22 bp, Homo sapiens
gttcagcaagaatgtttctatt

SEQ ID NO: 7096825 - DNA, 22 bp, Homo sapiens
gttcagcaagtactcagtccac

SEQ ID NO: 7096826 - DNA, 22 bp, Homo sapiens
gttcagcaagtactcagtccac

SEQ ID NO: 7096827 - DNA, 22 bp, Homo sapiens
gttcagcaagtactcagtccac

SEQ ID NO: 7096828 - DNA, 22 bp, Homo sapiens
gttcagcaatagatctagaggc

SEQ ID NO: 7096829 - DNA, 22 bp, Homo sapiens
gttcaccatatggtaatttaat

SEQ ID NO: 7096830 - DNA, 22 bp, Homo sapiens
gttcagagaaagagacacctta

SEQ ID NO: 7096831 - DNA, 22 bp, Homo sapiens
gttcagagtattaattgattta

SEQ ID NO: 7096832 - DNA, 22 bp, Homo sapiens
gttcacaaagtactgtatgcat

SEQ ID NO: 7096833 - DNA, 22 bp, Homo sapiens
gttacaaaggactgggggccac

SEQ ID NO: 7096834 - DNA, 22 bp, Homo sapiens
gttacaaaggactgggggccac

SEQ ID NO: 7096835 - DNA, 22 bp, Homo sapiens
gttacaaaggactgggggccac

SEQ ID NO: 7096836 - DNA, 22 bp, Homo sapiens
gttacaaaggtcataaaagtgt

SEQ ID NO: 7096837 - DNA, 22 bp, Homo sapiens
gttacaaaggtcataaaagtgt

SEQ ID NO: 7096838 - DNA, 22 bp, Homo sapiens
gttacaaaggtcataaaagtgt

SEQ ID NO: 7096839 - DNA, 22 bp, Homo sapiens
gttgcctaggctggtcttgaac

SEQ ID NO: 7096840 - DNA, 22 bp, Homo sapiens
gttgcctaggctggtcttgaac

SEQ ID NO: 7096841 - DNA, 22 bp, Homo sapiens
gttgcaggaagcacacacatgt

SEQ ID NO: 7096842 - DNA, 22 bp, Homo sapiens
gttgcaggaggatggctgcata

SEQ ID NO: 7096843 - DNA, 22 bp, Homo sapiens
gttgcagatgtggaactcgtgc

SEQ ID NO: 7096844 - DNA, 22 bp, Homo sapiens
gttgatatttgcagagtgtacc

SEQ ID NO: 7096845 - DNA, 22 bp, Homo sapiens
gttgcacaacttgaatggctgg

SEQ ID NO: 7096846 - DNA, 20 bp, Homo sapiens
gttggtcactttgagcagga

SEQ ID NO: 7096847 - DNA, 22 bp, Homo sapiens
gttggtccagcattgcctcact

SEQ ID NO: 7096848 - DNA, 22 bp, Homo sapiens
gttggggtaccttgaggctggg

SEQ ID NO: 7096849 - DNA, 22 bp, Homo sapiens
gttggggtccaatgaagcgagc

SEQ ID NO: 7096850 - DNA, 22 bp, Homo sapiens
gttgggagcagcagaccaagag

SEQ ID NO: 7096851 - DNA, 22 bp, Homo sapiens
gttgggagcagcagaccaagag

SEQ ID NO: 7096852 - DNA, 22 bp, Homo sapiens
gttgggatgtcaggcctaggtg

SEQ ID NO: 7096853 - DNA, 22 bp, Homo sapiens
gttgggcagaagcttgttgtgc

SEQ ID NO: 7096854 - DNA, 22 bp, Homo sapiens
gttgggctcattacagcctgct

SEQ ID NO: 7096855 - DNA, 22 bp, Homo sapiens
gttgggctgaagtgtgtgctta

SEQ ID NO: 7096856 - DNA, 22 bp, Homo sapiens
gttgggctgaagtgtgtgctta

SEQ ID NO: 7096857 - DNA, 22 bp, Homo sapiens
gttgggctgggagctgccctga

SEQ ID NO: 7096858 - DNA, 22 bp, Homo sapiens
gttgggcttatgtaattttaag

SEQ ID NO: 7096859 - DNA, 22 bp, Homo sapiens
gttgggcttcagatgagggtca

SEQ ID NO: 7096860 - DNA, 22 bp, Homo sapiens
gttgggcttcagatgagggtca

SEQ ID NO: 7096861 - DNA, 22 bp, Homo sapiens
gttggggaaggtgggagaatgt

SEQ ID NO: 7096862 - DNA, 22 bp, Homo sapiens
gttggggaaggtgggagaatgt

SEQ ID NO: 7096863 - DNA, 23 bp, Homo sapiens
gttgcctttgcatcttcatccat

SEQ ID NO: 7096864 - DNA, 22 bp, Homo sapiens
gttgctcaggcaggagtacagt

SEQ ID NO: 7096865 - DNA, 23 bp, Homo sapiens
gttgcctttgcatcttcatccat

SEQ ID NO: 7096866 - DNA, 22 bp, Homo sapiens
gttgctcaggcaggagtacagt

SEQ ID NO: 7096867 - DNA, 22 bp, Homo sapiens
gttgctcaggcaggagtacagt

SEQ ID NO: 7096868 - DNA, 22 bp, Homo sapiens
gttgctctatgtgtgttctatg

SEQ ID NO: 7096869 - DNA, 22 bp, Homo sapiens
gttgctctgggaaatggattca

SEQ ID NO: 7096870 - DNA, 22 bp, Homo sapiens
gttgggaaggtgaacatgatgc

SEQ ID NO: 7096871 - DNA, 22 bp, Homo sapiens
gttgggagcagcagaccaagag

SEQ ID NO: 7096872 - DNA, 22 bp, Homo sapiens
gttggtggatgtgggcagagca

SEQ ID NO: 7096873 - DNA, 22 bp, Homo sapiens
gttggtccaggagagtcacttc

SEQ ID NO: 7096874 - DNA, 22 bp, Homo sapiens
gttggtcctttgagcaagatcc

SEQ ID NO: 7096875 - DNA, 22 bp, Homo sapiens
gttgtaaatacagtactgaaac

SEQ ID NO: 7096876 - DNA, 19 bp, Homo sapiens
gttgtaaatggaggtttct

SEQ ID NO: 7096877 - DNA, 23 bp, Homo sapiens
gttgtaatggataatgcaaattg

SEQ ID NO: 7096878 - DNA, 22 bp, Homo sapiens
gttgtacaattgtttcacatgc

SEQ ID NO: 7096879 - DNA, 22 bp, Homo sapiens
gttgtacagacatgaaacttgc

SEQ ID NO: 7096880 - DNA, 22 bp, Homo sapiens
gtttcagaaatgttctcctgct

SEQ ID NO: 7096881 - DNA, 22 bp, Homo sapiens
gtttcagaggtgttcattttca

SEQ ID NO: 7096882 - DNA, 22 bp, Homo sapiens
gtttcagagttagtgctggctg

SEQ ID NO: 7096883 - DNA, 22 bp, Homo sapiens
gtttcagagttagtgctggctg

SEQ ID NO: 7096884 - DNA, 22 bp, Homo sapiens
gtttcagatatatttgtactta

SEQ ID NO: 7096885 - DNA, 22 bp, Homo sapiens
gtttcagatttggtttcagaag

SEQ ID NO: 7096886 - DNA, 22 bp, Homo sapiens
gtttcagcttcctttactgcag

SEQ ID NO: 7096887 - DNA, 22 bp, Homo sapiens
gtttcataattcaatcaaatga

SEQ ID NO: 7096888 - DNA, 22 bp, Homo sapiens
gtttcataattcaatcaaatga

SEQ ID NO: 7096889 - DNA, 22 bp, Homo sapiens
gtttcatatgcagttaacagca

SEQ ID NO: 7096890 - DNA, 18 bp, Homo sapiens
gtttcatgcatgtgaaac

SEQ ID NO: 7096891 - DNA, 22 bp, Homo sapiens
gtttcattacctgacccatgag

SEQ ID NO: 7096892 - DNA, 22 bp, Homo sapiens
gtttcattcggcagctcataag

SEQ ID NO: 7096893 - DNA, 22 bp, Homo sapiens
gtgtggcttgggtgaggcgcct

SEQ ID NO: 7096894 - DNA, 22 bp, Homo sapiens
gtgtgggaaggctaggatgctg

SEQ ID NO: 7096895 - DNA, 22 bp, Homo sapiens
gtgtgggaaggctaggatgctg

SEQ ID NO: 7096896 - DNA, 22 bp, Homo sapiens
gtgtgggaaggctaggatgctg

SEQ ID NO: 7096897 - DNA, 22 bp, Homo sapiens
gtgtgggacgggtgagtggcca

SEQ ID NO: 7096898 - DNA, 22 bp, Homo sapiens
gtgtgggacgggtgagtggcca

SEQ ID NO: 7096899 - DNA, 22 bp, Homo sapiens
gtgtgggaatggcggtcgtgca

SEQ ID NO: 7096900 - DNA, 22 bp, Homo sapiens
gtgtgggacgggtgagtggcca

SEQ ID NO: 7096901 - DNA, 22 bp, Homo sapiens
gtgtgggacgggtgagtggcca

SEQ ID NO: 7096902 - DNA, 22 bp, Homo sapiens
gtgtgggaaggctaggatgctg

SEQ ID NO: 7096903 - DNA, 22 bp, Homo sapiens
gtgtgggaatggcggtcgtgca

SEQ ID NO: 7096904 - DNA, 22 bp, Homo sapiens
gtgtgggaatggcggtcgtgca

SEQ ID NO: 7096905 - DNA, 22 bp, Homo sapiens
gttaagaagctagagatgaaca

SEQ ID NO: 7096906 - DNA, 22 bp, Homo sapiens
gttaagaagctagagatgaaca

SEQ ID NO: 7096907 - DNA, 22 bp, Homo sapiens
gtgtgggacgggtgagtggcca

SEQ ID NO: 7096908 - DNA, 22 bp, Homo sapiens
gttaagaacttgttgaaggtct

SEQ ID NO: 7096909 - DNA, 22 bp, Homo sapiens
gtgtggctacctcagaggagca

SEQ ID NO: 7096910 - DNA, 22 bp, Homo sapiens
gtgtggccttgggagaggtctg

SEQ ID NO: 7096911 - DNA, 22 bp, Homo sapiens
gtgtgcctttcacacactggga

SEQ ID NO: 7096912 - DNA, 22 bp, Homo sapiens
gtgtggccttgggagaggtctg

SEQ ID NO: 7096913 - DNA, 22 bp, Homo sapiens
gtgtggccttgggagaggtctg

SEQ ID NO: 7096914 - DNA, 22 bp, Homo sapiens
gtgtggccttgggagaggtctg

SEQ ID NO: 7096915 - DNA, 23 bp, Homo sapiens
gtgtgcctttatcttctgtactc

SEQ ID NO: 7096916 - DNA, 22 bp, Homo sapiens
gtgtgcctcccattagggtgta

SEQ ID NO: 7096917 - DNA, 22 bp, Homo sapiens
gtgtgcctcgccaagctgtcgg

SEQ ID NO: 7096918 - DNA, 22 bp, Homo sapiens
gtgtgcccttgttcagcagagt

SEQ ID NO: 7096919 - DNA, 22 bp, Homo sapiens
gtgtgcctcccattagggtgta

SEQ ID NO: 7096920 - DNA, 22 bp, Homo sapiens
gtgtggctagaagtgtcttgtt

SEQ ID NO: 7096921 - DNA, 18 bp, Homo sapiens
gtgtggctgagatgaggc

SEQ ID NO: 7096922 - DNA, 22 bp, Homo sapiens
gtgtggctgattgacatggtca

SEQ ID NO: 7096923 - DNA, 22 bp, Homo sapiens
gtgtggctgtgggagatgttca

SEQ ID NO: 7096924 - DNA, 21 bp, Homo sapiens
gttaagccttgaggtgattgt

SEQ ID NO: 7096925 - DNA, 22 bp, Homo sapiens
gttaaggatgcagagcatggaa

SEQ ID NO: 7096926 - DNA, 22 bp, Homo sapiens
gttaaggctgagcaggacactg

SEQ ID NO: 7096927 - DNA, 22 bp, Homo sapiens
gttaagtaaactatgatttatc

SEQ ID NO: 7096928 - DNA, 22 bp, Homo sapiens
gttaagtaaactatgatttatc

SEQ ID NO: 7096929 - DNA, 22 bp, Homo sapiens
gttaagtaccagattgtctgaa

SEQ ID NO: 7096930 - DNA, 22 bp, Homo sapiens
gttaataaaggtatagaatcag

SEQ ID NO: 7096931 - DNA, 22 bp, Homo sapiens
gttaataaaggtatagaatcag

SEQ ID NO: 7096932 - DNA, 22 bp, Homo sapiens
gttaatacaaccatgatcttct

SEQ ID NO: 7096933 - DNA, 22 bp, Homo sapiens
gttaatatttacctgtcaagaa

SEQ ID NO: 7096934 - DNA, 22 bp, Homo sapiens
gttaatgccattaggaaattta

SEQ ID NO: 7096935 - DNA, 22 bp, Homo sapiens
gttaatgcctacatattaagca

SEQ ID NO: 7096936 - DNA, 22 bp, Homo sapiens
gttaatgtgtctgacacaatgg

SEQ ID NO: 7096937 - DNA, 22 bp, Homo sapiens
gttaatgttatctgaagacagt

SEQ ID NO: 7096938 - DNA, 22 bp, Homo sapiens
gttaatttagtagagtccagat

SEQ ID NO: 7096939 - DNA, 22 bp, Homo sapiens
gttaatttagtagagtccagat

SEQ ID NO: 7096940 - DNA, 22 bp, Homo sapiens
gttacaaactcaggtgccaaaa

SEQ ID NO: 7096941 - DNA, 22 bp, Homo sapiens
gttacaaagcacttcaagtgaa

SEQ ID NO: 7096942 - DNA, 22 bp, Homo sapiens
gttacaaagcacttcaagtgaa

SEQ ID NO: 7096943 - DNA, 18 bp, Homo sapiens
gttaattttgaagttcat

SEQ ID NO: 7096944 - DNA, 22 bp, Homo sapiens
gttaatttgcagctttcgagct

SEQ ID NO: 7096945 - DNA, 22 bp, Homo sapiens
gttaatttgcagctttcgagct

SEQ ID NO: 7096946 - DNA, 18 bp, Homo sapiens
gttaattttgaagttcat

SEQ ID NO: 7096947 - DNA, 22 bp, Homo sapiens
gttacaaactcaggtgccaaaa

SEQ ID NO: 7096948 - DNA, 22 bp, Homo sapiens
gttacaaactcaggtgccaaaa

SEQ ID NO: 7096949 - DNA, 22 bp, Homo sapiens
gttacaaagcacttcaagtgaa

SEQ ID NO: 7096950 - DNA, 22 bp, Homo sapiens
gttacaaaggaagcttcactgc

SEQ ID NO: 7096951 - DNA, 22 bp, Homo sapiens
gttacaaaggaagcttcactgc

SEQ ID NO: 7096952 - DNA, 22 bp, Homo sapiens
gtgtgccaccagtcaaggtgaa

SEQ ID NO: 7096953 - DNA, 22 bp, Homo sapiens
gtgtgccaccactgacaggatt

SEQ ID NO: 7096954 - DNA, 22 bp, Homo sapiens
gtgtgccaccactgacaggatt

SEQ ID NO: 7096955 - DNA, 22 bp, Homo sapiens
gtgtgccaccactgacaggatt

SEQ ID NO: 7096956 - DNA, 22 bp, Homo sapiens
gtgtgccaccagtcaaggtgaa

SEQ ID NO: 7096957 - DNA, 22 bp, Homo sapiens
gtgtgccactgcctgaggaccc

SEQ ID NO: 7096958 - DNA, 22 bp, Homo sapiens
gtgtgccactgcctgaggaccc

SEQ ID NO: 7096959 - DNA, 22 bp, Homo sapiens
gtgtgccagacatgatgctatg

SEQ ID NO: 7096960 - DNA, 22 bp, Homo sapiens
gtgtgcatgtggaagcatgtat

SEQ ID NO: 7096961 - DNA, 22 bp, Homo sapiens
gtgtgccaacaaaagacagtgc

SEQ ID NO: 7096962 - DNA, 23 bp, Homo sapiens
gtgtgccaagcactgtgccagga

SEQ ID NO: 7096963 - DNA, 23 bp, Homo sapiens
gtgtgccaagcactgtgccagga

SEQ ID NO: 7096964 - DNA, 18 bp, Homo sapiens
gtgtgcagttgcaggggt

SEQ ID NO: 7096965 - DNA, 18 bp, Homo sapiens
gtgtgcagttgcaggggt

SEQ ID NO: 7096966 - DNA, 22 bp, Homo sapiens
gtgctgaaatggacctcaggaa

SEQ ID NO: 7096967 - DNA, 18 bp, Homo sapiens
gtgtgcagttgcaggggt

SEQ ID NO: 7096968 - DNA, 18 bp, Homo sapiens
gtgtgcagttgcaggggt

SEQ ID NO: 7096969 - DNA, 18 bp, Homo sapiens
gtgtgcagttgcaggggt

SEQ ID NO: 7096970 - DNA, 22 bp, Homo sapiens
gtgtgcatatgtgtggctctcc

SEQ ID NO: 7096971 - DNA, 22 bp, Homo sapiens
gtgctctgtgtattaggatgtc

SEQ ID NO: 7096972 - DNA, 23 bp, Homo sapiens
gtgctcttcagttttagggtcat

SEQ ID NO: 7096973 - DNA, 22 bp, Homo sapiens
gtgctctgtggattgagttgaa

SEQ ID NO: 7096974 - DNA, 22 bp, Homo sapiens
gtgctctgtgtattaggatgtc

SEQ ID NO: 7096975 - DNA, 22 bp, Homo sapiens
gtgctctgtgtattaggatgtc

SEQ ID NO: 7096976 - DNA, 22 bp, Homo sapiens
gtgctctgggctgcctgacatg

SEQ ID NO: 7096977 - DNA, 21 bp, Homo sapiens
gtgctctgggcagcagagggc

SEQ ID NO: 7096978 - DNA, 22 bp, Homo sapiens
gtgctctgagtttgcatgtcag

SEQ ID NO: 7096979 - DNA, 22 bp, Homo sapiens
gtgctctgagtttgcatgtcag

SEQ ID NO: 7096980 - DNA, 23 bp, Homo sapiens
gtgctctgcggtctgctagtctg

SEQ ID NO: 7096981 - DNA, 23 bp, Homo sapiens
gtgctctgcggtctgctagtctg

SEQ ID NO: 7096982 - DNA, 23 bp, Homo sapiens
gtgctctgcggtctgctagtctg

SEQ ID NO: 7096983 - DNA, 22 bp, Homo sapiens
gtgctctggccaagcgcgtgcg

SEQ ID NO: 7096984 - DNA, 22 bp, Homo sapiens
gtgctctcctggctgccctgac

SEQ ID NO: 7096985 - DNA, 22 bp, Homo sapiens
gtgctctccagccccacgtgga

SEQ ID NO: 7096986 - DNA, 22 bp, Homo sapiens
gtgctctccagccccacgtgga

SEQ ID NO: 7096987 - DNA, 22 bp, Homo sapiens
gtgctcctcacagtgtggccct

SEQ ID NO: 7096988 - DNA, 22 bp, Homo sapiens
gtgctcctggccacatgaagct

SEQ ID NO: 7096989 - DNA, 22 bp, Homo sapiens
gtgctccctccttcctcaagga

SEQ ID NO: 7096990 - DNA, 22 bp, Homo sapiens
gtgctccctccttcctcaagga

SEQ ID NO: 7096991 - DNA, 22 bp, Homo sapiens
gtgctccctccttcctcaagga

SEQ ID NO: 7096992 - DNA, 22 bp, Homo sapiens
gtgctccaacattagtgtgctt

SEQ ID NO: 7096993 - DNA, 22 bp, Homo sapiens
gtgctccaacattagtgtgctt

SEQ ID NO: 7096994 - DNA, 22 bp, Homo sapiens
gtgctccaggataggctgacct

SEQ ID NO: 7096995 - DNA, 19 bp, Homo sapiens
gtgctccagggcaaggagt

SEQ ID NO: 7096996 - DNA, 22 bp, Homo sapiens
gtgctccaggataggctgacct

SEQ ID NO: 7096997 - DNA, 19 bp, Homo sapiens
gtgctccagggcaaggagt

SEQ ID NO: 7096998 - DNA, 22 bp, Homo sapiens
gtgctccaggtcgctcagagag

SEQ ID NO: 7096999 - DNA, 22 bp, Homo sapiens
gtgctccaggtcgctcagagag

SEQ ID NO: 7097000 - DNA, 22 bp, Homo sapiens
gtgctccaggtcgctcagagag

SEQ ID NO: 7097001 - DNA, 22 bp, Homo sapiens
gtgctccaggtcgctcagagag

SEQ ID NO: 7097002 - DNA, 22 bp, Homo sapiens
gtgctcactccccacagtgccc

SEQ ID NO: 7097003 - DNA, 22 bp, Homo sapiens
gtgctcagcccggatgagatca

SEQ ID NO: 7097004 - DNA, 22 bp, Homo sapiens
gtgctcagcccggatgagatca

SEQ ID NO: 7097005 - DNA, 22 bp, Homo sapiens
gtgctcaggaccaaatgaacca

SEQ ID NO: 7097006 - DNA, 22 bp, Homo sapiens
gtgctcaggaccaaatgaacca

SEQ ID NO: 7097007 - DNA, 22 bp, Homo sapiens
gtgctcagggcctggctgggga

SEQ ID NO: 7097008 - DNA, 22 bp, Homo sapiens
gtgctcaggggcaatcctggga

SEQ ID NO: 7097009 - DNA, 22 bp, Homo sapiens
gtgctcaggggcaatcctggga

SEQ ID NO: 7097010 - DNA, 22 bp, Homo sapiens
gtgctcaggttcccatgagtgc

SEQ ID NO: 7097011 - DNA, 22 bp, Homo sapiens
gtttccaggctttggtatggtt

SEQ ID NO: 7097012 - DNA, 22 bp, Homo sapiens
gtttccaggctgggcagcgagc

SEQ ID NO: 7097013 - DNA, 22 bp, Homo sapiens
gtttccaggctgggcagcgagc

SEQ ID NO: 7097014 - DNA, 22 bp, Homo sapiens
gtttccaggcccctccctagac

SEQ ID NO: 7097015 - DNA, 22 bp, Homo sapiens
gtttccaggcgatatcagctgc

SEQ ID NO: 7097016 - DNA, 22 bp, Homo sapiens
gtttccatctccaggacataat

SEQ ID NO: 7097017 - DNA, 22 bp, Homo sapiens
gtttccatggctctgttaatgg

SEQ ID NO: 7097018 - DNA, 22 bp, Homo sapiens
gtttccatgggagaagacagtg

SEQ ID NO: 7097019 - DNA, 22 bp, Homo sapiens
gtttcccaaattgttcacaggg

SEQ ID NO: 7097020 - DNA, 22 bp, Homo sapiens
gtttcccaggctgtggggccct

SEQ ID NO: 7097021 - DNA, 22 bp, Homo sapiens
gtttcccagtctgcagagttct

SEQ ID NO: 7097022 - DNA, 21 bp, Homo sapiens
gttttcatgatagagtctgta

SEQ ID NO: 7097023 - DNA, 22 bp, Homo sapiens
gttttcatgtctattgggcata

SEQ ID NO: 7097024 - DNA, 22 bp, Homo sapiens
gttttcatgtctattgggcata

SEQ ID NO: 7097025 - DNA, 22 bp, Homo sapiens
gtttccagagtgagggcacttg

SEQ ID NO: 7097026 - DNA, 22 bp, Homo sapiens
gtttccagcttgggcccgggga

SEQ ID NO: 7097027 - DNA, 22 bp, Homo sapiens
gtttccagctttctgatgcttg

SEQ ID NO: 7097028 - DNA, 22 bp, Homo sapiens
gtttccaggaagggttgggagg

SEQ ID NO: 7097029 - DNA, 22 bp, Homo sapiens
gtttccaactagtatgatcagg

SEQ ID NO: 7097030 - DNA, 22 bp, Homo sapiens
gtttccaagatgctgccatcag

SEQ ID NO: 7097031 - DNA, 22 bp, Homo sapiens
gtttccacgtctcagttccaaa

SEQ ID NO: 7097032 - DNA, 22 bp, Homo sapiens
gtttccacgtctcagttccaaa

SEQ ID NO: 7097033 - DNA, 22 bp, Homo sapiens
gtttccacttatatggtaccta

SEQ ID NO: 7097034 - DNA, 22 bp, Homo sapiens
gtttccacttatatggtaccta

SEQ ID NO: 7097035 - DNA, 22 bp, Homo sapiens
gtttccacttgagaggactcct

SEQ ID NO: 7097036 - DNA, 22 bp, Homo sapiens
gtttccacttgagaggactcct

SEQ ID NO: 7097037 - DNA, 22 bp, Homo sapiens
gtttccagagatcatttacata

SEQ ID NO: 7097038 - DNA, 18 bp, Homo sapiens
gttttgaattgtcttaca

SEQ ID NO: 7097039 - DNA, 18 bp, Homo sapiens
gttttgaattgtcttaca

SEQ ID NO: 7097040 - DNA, 22 bp, Homo sapiens
gttttgatatatgcatacatta

SEQ ID NO: 7097041 - DNA, 22 bp, Homo sapiens
gttttgcagagtgcaataaatc

SEQ ID NO: 7097042 - DNA, 22 bp, Homo sapiens
gttttgcagagtgcaataaatc

SEQ ID NO: 7097043 - DNA, 19 bp, Homo sapiens
gttttgcaggcagagggga

SEQ ID NO: 7097044 - DNA, 19 bp, Homo sapiens
gttttgcaggcagagggga

SEQ ID NO: 7097045 - DNA, 22 bp, Homo sapiens
gttttgctcatttggtccaagg

SEQ ID NO: 7097046 - DNA, 22 bp, Homo sapiens
gttttgctcatttggtccaagg

SEQ ID NO: 7097047 - DNA, 22 bp, Homo sapiens
gttttgctgactcccacaggaa

SEQ ID NO: 7097048 - DNA, 21 bp, Homo sapiens
gttttgctggtatctggggat

SEQ ID NO: 7097049 - DNA, 22 bp, Homo sapiens
gttttgcttctcatgttaagtg

SEQ ID NO: 7097050 - DNA, 22 bp, Homo sapiens
gttttggagtcaggcttagatg

SEQ ID NO: 7097051 - DNA, 22 bp, Homo sapiens
gttttgtgaggcacccacaggt

SEQ ID NO: 7097052 - DNA, 18 bp, Homo sapiens
gttttgtggctagtagtg

SEQ ID NO: 7097053 - DNA, 22 bp, Homo sapiens
gttttgttcatgaacattgggt

SEQ ID NO: 7097054 - DNA, 22 bp, Homo sapiens
gttttgttcttgtccagggaaa

SEQ ID NO: 7097055 - DNA, 22 bp, Homo sapiens
gttttgttcatgaacattgggt

SEQ ID NO: 7097056 - DNA, 22 bp, Homo sapiens
gttttgttgctgcagagctcaa

SEQ ID NO: 7097057 - DNA, 22 bp, Homo sapiens
gttttcttcctgcaattggcat

SEQ ID NO: 7097058 - DNA, 22 bp, Homo sapiens
gttttcttcctgcaattggcat

SEQ ID NO: 7097059 - DNA, 22 bp, Homo sapiens
gttttcttcctgcaattggcat

SEQ ID NO: 7097060 - DNA, 22 bp, Homo sapiens
gttttctttgaatgcttctaga

SEQ ID NO: 7097061 - DNA, 22 bp, Homo sapiens
gttttctttgaatgcttctaga

SEQ ID NO: 7097062 - DNA, 22 bp, Homo sapiens
gttttctttgaatgcttctaga

SEQ ID NO: 7097063 - DNA, 22 bp, Homo sapiens
gttttctttgaatgcttctaga

SEQ ID NO: 7097064 - DNA, 22 bp, Homo sapiens
gttttcatgtctattgggcata

SEQ ID NO: 7097065 - DNA, 22 bp, Homo sapiens
gttttcattactgctgtgattt

SEQ ID NO: 7097066 - DNA, 22 bp, Homo sapiens
gttttcattactgctgtgattt

SEQ ID NO: 7097067 - DNA, 22 bp, Homo sapiens
gttttcattactgctgtgattt

SEQ ID NO: 7097068 - DNA, 22 bp, Homo sapiens
gttttcattactgctgtgattt

SEQ ID NO: 7097069 - DNA, 22 bp, Homo sapiens
gttttccactggattgtttgga

SEQ ID NO: 7097070 - DNA, 22 bp, Homo sapiens
gttttccactggattgtttgga

SEQ ID NO: 7097071 - DNA, 22 bp, Homo sapiens
gttttctttgaatgcttctaga

SEQ ID NO: 7097072 - DNA, 22 bp, Homo sapiens
gttttctttgaatgcttctaga

SEQ ID NO: 7097073 - DNA, 21 bp, Homo sapiens
gttttctttgatagagggaag

SEQ ID NO: 7097074 - DNA, 21 bp, Homo sapiens
gttttctttgatagagggaag

SEQ ID NO: 7097075 - DNA, 21 bp, Homo sapiens
gttttctttgatagagggaag

SEQ ID NO: 7097076 - DNA, 21 bp, Homo sapiens
gttttctttgatagagggaag

SEQ ID NO: 7097077 - DNA, 21 bp, Homo sapiens
gttttctttgatagagggaag

SEQ ID NO: 7097078 - DNA, 22 bp, Homo sapiens
gttttgaaatgaaagaaccaag

SEQ ID NO: 7097079 - DNA, 22 bp, Homo sapiens
gttttgaagaagaccttgaaac

SEQ ID NO: 7097080 - DNA, 22 bp, Homo sapiens
gttttgaatactactagaactt

SEQ ID NO: 7097081 - DNA, 22 bp, Homo sapiens
gttttgaatactactagaactt

SEQ ID NO: 7097082 - DNA, 22 bp, Homo sapiens
gttttgaatcactgcgcttcac

SEQ ID NO: 7097083 - DNA, 18 bp, Homo sapiens
gttttgaattgtcttaca

SEQ ID NO: 7097084 - DNA, 22 bp, Homo sapiens
taaaatggtaactttcatttgc

SEQ ID NO: 7097085 - DNA, 22 bp, Homo sapiens
taaaatgatctctcatgttctt

SEQ ID NO: 7097086 - DNA, 22 bp, Homo sapiens
taaaatagcatgtgcagtgaaa

SEQ ID NO: 7097087 - DNA, 22 bp, Homo sapiens
taaaagttttagttgtacataa

SEQ ID NO: 7097088 - DNA, 22 bp, Homo sapiens
taaaatagaggatgtcatgcta

SEQ ID NO: 7097089 - DNA, 22 bp, Homo sapiens
gtttttatctaatagcagttat

SEQ ID NO: 7097090 - DNA, 22 bp, Homo sapiens
gtttttatctaatagcagttat

SEQ ID NO: 7097091 - DNA, 22 bp, Homo sapiens
gtttttatctaatagcagttat

SEQ ID NO: 7097092 - DNA, 22 bp, Homo sapiens
gtttttatctaatagcagttat

SEQ ID NO: 7097093 - DNA, 22 bp, Homo sapiens
gtttttatatcctgtggagtgt

SEQ ID NO: 7097094 - DNA, 22 bp, Homo sapiens
gtttttatatcctgtggagtgt

SEQ ID NO: 7097095 - DNA, 19 bp, Homo sapiens
gttttgtttgcagaactta

SEQ ID NO: 7097096 - DNA, 22 bp, Homo sapiens
gttttgttttgagtcaactcca

SEQ ID NO: 7097097 - DNA, 19 bp, Homo sapiens
gttttgtttgcagaactta

SEQ ID NO: 7097098 - DNA, 22 bp, Homo sapiens
gttttgttttgagtcaactcca

SEQ ID NO: 7097099 - DNA, 22 bp, Homo sapiens
gttttgttttgagtcaactcca

SEQ ID NO: 7097100 - DNA, 22 bp, Homo sapiens
gtttttacagcagcaaaatact

SEQ ID NO: 7097101 - DNA, 22 bp, Homo sapiens
gtttttacagcagcaaaatact

SEQ ID NO: 7097102 - DNA, 22 bp, Homo sapiens
gtttttattgtgtaaatgtggg

SEQ ID NO: 7097103 - DNA, 22 bp, Homo sapiens
gtttttattgtgtaaatgtggg

SEQ ID NO: 7097104 - DNA, 22 bp, Homo sapiens
gtttttatctaatagcagttat

SEQ ID NO: 7097105 - DNA, 22 bp, Homo sapiens
gtttttattgtgtaaatgtggg

SEQ ID NO: 7097106 - DNA, 22 bp, Homo sapiens
gtttttattgtgtaaatgtggg

SEQ ID NO: 7097107 - DNA, 21 bp, Homo sapiens
gtttttcagccctgaggtgag

SEQ ID NO: 7097108 - DNA, 22 bp, Homo sapiens
taaaattgcggtgaatatttcc

SEQ ID NO: 7097109 - DNA, 22 bp, Homo sapiens
taaaattgcggtgaatatttcc

SEQ ID NO: 7097110 - DNA, 22 bp, Homo sapiens
taaacaagctggactgataagt

SEQ ID NO: 7097111 - DNA, 22 bp, Homo sapiens
taaaatttgtccctgagtgttg

SEQ ID NO: 7097112 - DNA, 22 bp, Homo sapiens
taaacaagaaacattttctgtt

SEQ ID NO: 7097113 - DNA, 22 bp, Homo sapiens
taaaatttgtccctgagtgttg

SEQ ID NO: 7097114 - DNA, 22 bp, Homo sapiens
taaaatttgtccctgagtgttg

SEQ ID NO: 7097115 - DNA, 22 bp, Homo sapiens
taaaatttgtccctgagtgttg

SEQ ID NO: 7097116 - DNA, 22 bp, Homo sapiens
taaaatttgtccctgagtgttg

SEQ ID NO: 7097117 - DNA, 22 bp, Homo sapiens
taaaatttgtccctgagtgttg

SEQ ID NO: 7097118 - DNA, 22 bp, Homo sapiens
taaaattgcggtgaatatttcc

SEQ ID NO: 7097119 - DNA, 22 bp, Homo sapiens
taaacactcacttcatagccat

SEQ ID NO: 7097120 - DNA, 22 bp, Homo sapiens
taaacaagggttactgagcatg

SEQ ID NO: 7097121 - DNA, 22 bp, Homo sapiens
taaacaagggttactgagcatg

SEQ ID NO: 7097122 - DNA, 22 bp, Homo sapiens
taaacaagggttactgagcatg

SEQ ID NO: 7097123 - DNA, 22 bp, Homo sapiens
taaacaagctgtctgatattct

SEQ ID NO: 7097124 - DNA, 22 bp, Homo sapiens
taaacaagctgtctgatattct

SEQ ID NO: 7097125 - DNA, 22 bp, Homo sapiens
taaacaagctgtctgatattct

SEQ ID NO: 7097126 - DNA, 22 bp, Homo sapiens
taaagggtaggttttactgtaa

SEQ ID NO: 7097127 - DNA, 22 bp, Homo sapiens
taaacagaattcaggcaagata

SEQ ID NO: 7097128 - DNA, 22 bp, Homo sapiens
taaacagaattcaggcaagata

SEQ ID NO: 7097129 - DNA, 22 bp, Homo sapiens
taaagggtaggttttactgtaa

SEQ ID NO: 7097130 - DNA, 22 bp, Homo sapiens
taaacagaaagcagatgtactt

SEQ ID NO: 7097131 - DNA, 22 bp, Homo sapiens
taaacagaatgcgtaagaagtg

SEQ ID NO: 7097132 - DNA, 22 bp, Homo sapiens
taaattatgttccatgtccttt

SEQ ID NO: 7097133 - DNA, 22 bp, Homo sapiens
taaattatgttccatgtccttt

SEQ ID NO: 7097134 - DNA, 22 bp, Homo sapiens
taaattcactcctggtagacct

SEQ ID NO: 7097135 - DNA, 22 bp, Homo sapiens
taaattatgtcacatgactctg

SEQ ID NO: 7097136 - DNA, 22 bp, Homo sapiens
taaattatgtcacatgactctg

SEQ ID NO: 7097137 - DNA, 22 bp, Homo sapiens
taaattatgttccatgtccttt

SEQ ID NO: 7097138 - DNA, 22 bp, Homo sapiens
taaattatggctggcagagcag

SEQ ID NO: 7097139 - DNA, 22 bp, Homo sapiens
taaattatggctggcagagcag

SEQ ID NO: 7097140 - DNA, 22 bp, Homo sapiens
taaattatggctggcagagcag

SEQ ID NO: 7097141 - DNA, 20 bp, Homo sapiens
taaattagccttgaagatta

SEQ ID NO: 7097142 - DNA, 22 bp, Homo sapiens
taaattaaagattggagaagga

SEQ ID NO: 7097143 - DNA, 22 bp, Homo sapiens
taaattaaagattggagaagga

SEQ ID NO: 7097144 - DNA, 23 bp, Homo sapiens
taaattacctttccagtgcaggg

SEQ ID NO: 7097145 - DNA, 20 bp, Homo sapiens
taaattagccttgaagatta

SEQ ID NO: 7097146 - DNA, 20 bp, Homo sapiens
taaattagccttgaagatta

SEQ ID NO: 7097147 - DNA, 22 bp, Homo sapiens
taaagtgcttatgataaccaag

SEQ ID NO: 7097148 - DNA, 22 bp, Homo sapiens
taaagtgcttatgataaccaag

SEQ ID NO: 7097149 - DNA, 22 bp, Homo sapiens
taaagtgcttcctaacccagag

SEQ ID NO: 7097150 - DNA, 22 bp, Homo sapiens
taaagtgcttcctaacccagag

SEQ ID NO: 7097151 - DNA, 22 bp, Homo sapiens
taaagtgtatgccatctctcat

SEQ ID NO: 7097152 - DNA, 22 bp, Homo sapiens
taaagtgtgcatggtcaaatat

SEQ ID NO: 7097153 - DNA, 22 bp, Homo sapiens
taaagtgtgcatggtcaaatat

SEQ ID NO: 7097154 - DNA, 22 bp, Homo sapiens
taaattaaagattggagaagga

SEQ ID NO: 7097155 - DNA, 22 bp, Homo sapiens
taaagtgctggatttgagtaaa

SEQ ID NO: 7097156 - DNA, 22 bp, Homo sapiens
taaagtgctggatttgagtaaa

SEQ ID NO: 7097157 - DNA, 23 bp, Homo sapiens
taaagtgctgatggtgagggagc

SEQ ID NO: 7097158 - DNA, 22 bp, Homo sapiens
taaagtgctggatttgagtaaa

SEQ ID NO: 7097159 - DNA, 22 bp, Homo sapiens
taaagtgctgggattataggcc

SEQ ID NO: 7097160 - DNA, 22 bp, Homo sapiens
taaagtgctgggattataggcc

SEQ ID NO: 7097161 - DNA, 22 bp, Homo sapiens
taaagtgcctcaggtcctgggt

SEQ ID NO: 7097162 - DNA, 22 bp, Homo sapiens
taaagtgcctcaggtcctgggt

SEQ ID NO: 7097163 - DNA, 22 bp, Homo sapiens
taaagtgcgacccagtccccag

SEQ ID NO: 7097164 - DNA, 22 bp, Homo sapiens
taaagtgcgacccagtccccag

SEQ ID NO: 7097165 - DNA, 22 bp, Homo sapiens
taaagtgctcataaaaatggat

SEQ ID NO: 7097166 - DNA, 22 bp, Homo sapiens
taaagtgctcataaaaatggat

SEQ ID NO: 7097167 - DNA, 22 bp, Homo sapiens
taaagtgctcataaaaatggat

SEQ ID NO: 7097168 - DNA, 23 bp, Homo sapiens
taaagtgctgatggtgagggagc

SEQ ID NO: 7097169 - DNA, 22 bp, Homo sapiens
taaagtcaaggtactgtttcac

SEQ ID NO: 7097170 - DNA, 22 bp, Homo sapiens
taaagtcaaggtactgtttcac

SEQ ID NO: 7097171 - DNA, 22 bp, Homo sapiens
taaagtgcccagggaaagcggg

SEQ ID NO: 7097172 - DNA, 22 bp, Homo sapiens
taaagtatccagttattcttct

SEQ ID NO: 7097173 - DNA, 22 bp, Homo sapiens
taaagtcaaaatatgggtaggc

SEQ ID NO: 7097174 - DNA, 22 bp, Homo sapiens
taaagtatattttttctcaata

SEQ ID NO: 7097175 - DNA, 22 bp, Homo sapiens
taaagtatccagttattcttct

SEQ ID NO: 7097176 - DNA, 22 bp, Homo sapiens
taaagtatccagttattcttct

SEQ ID NO: 7097177 - DNA, 22 bp, Homo sapiens
taaagtatccagttattcttct

SEQ ID NO: 7097178 - DNA, 22 bp, Homo sapiens
taaaggtttattcaacaaaata

SEQ ID NO: 7097179 - DNA, 22 bp, Homo sapiens
taaaggttgaaaactgactgcc

SEQ ID NO: 7097180 - DNA, 22 bp, Homo sapiens
taaagtaatccttcataaggag

SEQ ID NO: 7097181 - DNA, 22 bp, Homo sapiens
taaaggttgaaaactgactgcc

SEQ ID NO: 7097182 - DNA, 22 bp, Homo sapiens
taaaggttattgcactggagtt

SEQ ID NO: 7097183 - DNA, 22 bp, Homo sapiens
taaagtaatccttcataaggag

SEQ ID NO: 7097184 - DNA, 22 bp, Homo sapiens
taaagtagcaagtttagactga

SEQ ID NO: 7097185 - DNA, 22 bp, Homo sapiens
taaaggttataaaggttagggg

SEQ ID NO: 7097186 - DNA, 22 bp, Homo sapiens
taaaggttagtagcagggaaac

SEQ ID NO: 7097187 - DNA, 22 bp, Homo sapiens
taaaggtcaagagatgctgtct

SEQ ID NO: 7097188 - DNA, 22 bp, Homo sapiens
taaaggtcatcagattagcggg

SEQ ID NO: 7097189 - DNA, 22 bp, Homo sapiens
taaaggtccaaagagggctacg

SEQ ID NO: 7097190 - DNA, 22 bp, Homo sapiens
taaaggtctgaacacagtgagg

SEQ ID NO: 7097191 - DNA, 22 bp, Homo sapiens
taaaggtatgtcttaatcaaac

SEQ ID NO: 7097192 - DNA, 22 bp, Homo sapiens
taaaggtatgtcttaatcaaac

SEQ ID NO: 7097193 - DNA, 22 bp, Homo sapiens
taaaggtatgtcttaatcaaac

SEQ ID NO: 7097194 - DNA, 22 bp, Homo sapiens
taaaggtagtgtgacatattgt

SEQ ID NO: 7097195 - DNA, 22 bp, Homo sapiens
taaaggtagtgtgacatattgt

SEQ ID NO: 7097196 - DNA, 22 bp, Homo sapiens
taactgaatgtattacaacaga

SEQ ID NO: 7097197 - DNA, 22 bp, Homo sapiens
taactgagcctaaggcagtaga

SEQ ID NO: 7097198 - DNA, 22 bp, Homo sapiens
taactgatgttcccttactgta

SEQ ID NO: 7097199 - DNA, 22 bp, Homo sapiens
taactgaacagcctaattcttt

SEQ ID NO: 7097200 - DNA, 22 bp, Homo sapiens
taactcaaatacttatgttact

SEQ ID NO: 7097201 - DNA, 22 bp, Homo sapiens
taactcaaatatgttgtctgaa

SEQ ID NO: 7097202 - DNA, 22 bp, Homo sapiens
taactcactccaaaaaggcatt

SEQ ID NO: 7097203 - DNA, 22 bp, Homo sapiens
taactacatttcactgcaatta

SEQ ID NO: 7097204 - DNA, 22 bp, Homo sapiens
taactactaattgatgataatg

SEQ ID NO: 7097205 - DNA, 22 bp, Homo sapiens
taactacatttcactgcaatta

SEQ ID NO: 7097206 - DNA, 22 bp, Homo sapiens
taactagaatggctattttgag

SEQ ID NO: 7097207 - DNA, 22 bp, Homo sapiens
taactagaatggctattttgag

SEQ ID NO: 7097208 - DNA, 22 bp, Homo sapiens
taactagatgtgagaatattca

SEQ ID NO: 7097209 - DNA, 22 bp, Homo sapiens
taactacaagggcggtctctgt

SEQ ID NO: 7097210 - DNA, 22 bp, Homo sapiens
taactaagtgactcaagtgatc

SEQ ID NO: 7097211 - DNA, 22 bp, Homo sapiens
taactaagtgactcaagtgatc

SEQ ID NO: 7097212 - DNA, 22 bp, Homo sapiens
taacctttttatcttacctcca

SEQ ID NO: 7097213 - DNA, 20 bp, Homo sapiens
taacggaagctgtaaaatct

SEQ ID NO: 7097214 - DNA, 22 bp, Homo sapiens
taacctgactgctctttagaat

SEQ ID NO: 7097215 - DNA, 23 bp, Homo sapiens
taacctgagattgcaagggagct

SEQ ID NO: 7097216 - DNA, 22 bp, Homo sapiens
taacctgaggagaacagtgctt

SEQ ID NO: 7097217 - DNA, 23 bp, Homo sapiens
taacctgagttttttagatgcaa

SEQ ID NO: 7097218 - DNA, 22 bp, Homo sapiens
taacctttcaggcatgtaggtt

SEQ ID NO: 7097219 - DNA, 22 bp, Homo sapiens
taacctttctcttgtggctgac

SEQ ID NO: 7097220 - DNA, 22 bp, Homo sapiens
taacctttgaccttgcttgtgc

SEQ ID NO: 7097221 - DNA, 22 bp, Homo sapiens
taacctttggtgaaatattaac

SEQ ID NO: 7097222 - DNA, 22 bp, Homo sapiens
taacctttgttcaatgtaagat

SEQ ID NO: 7097223 - DNA, 22 bp, Homo sapiens
taacctttgttcaatgtaagat

SEQ ID NO: 7097224 - DNA, 22 bp, Homo sapiens
taacctacatgagaactttaaa

SEQ ID NO: 7097225 - DNA, 22 bp, Homo sapiens
taacctctatttttataaaagt

SEQ ID NO: 7097226 - DNA, 17 bp, Homo sapiens
taacctctctgaacctg

SEQ ID NO: 7097227 - DNA, 22 bp, Homo sapiens
taacctctctgtgcctcagttt

SEQ ID NO: 7097228 - DNA, 22 bp, Homo sapiens
taacctctgagctccagcttct

SEQ ID NO: 7097229 - DNA, 22 bp, Homo sapiens
taacctgaacacacaataggga

SEQ ID NO: 7097230 - DNA, 22 bp, Homo sapiens
taaccatattttccattaagtt

SEQ ID NO: 7097231 - DNA, 22 bp, Homo sapiens
taaccagacagaaacagctaga

SEQ ID NO: 7097232 - DNA, 22 bp, Homo sapiens
taaccaaagggcctaaggaatg

SEQ ID NO: 7097233 - DNA, 22 bp, Homo sapiens
taaccacattattatgggttct

SEQ ID NO: 7097234 - DNA, 22 bp, Homo sapiens
taacattaaaagagataattga

SEQ ID NO: 7097235 - DNA, 23 bp, Homo sapiens
taaatttcttgattcttatgtga

SEQ ID NO: 7097236 - DNA, 23 bp, Homo sapiens
taaatttcttgattcttatgtga

SEQ ID NO: 7097237 - DNA, 22 bp, Homo sapiens
taacattacggacatctgtcag

SEQ ID NO: 7097238 - DNA, 22 bp, Homo sapiens
taaattgttttctagaagttgt

SEQ ID NO: 7097239 - DNA, 22 bp, Homo sapiens
taaatttacccaaggaacatgt

SEQ ID NO: 7097240 - DNA, 22 bp, Homo sapiens
taaatttacccaaggaacatgt

SEQ ID NO: 7097241 - DNA, 22 bp, Homo sapiens
taaatttacccaaggaacatgt

SEQ ID NO: 7097242 - DNA, 22 bp, Homo sapiens
taaattgatcgtttgggatgaa

SEQ ID NO: 7097243 - DNA, 23 bp, Homo sapiens
taaattgatggtatgggttaagc

SEQ ID NO: 7097244 - DNA, 22 bp, Homo sapiens
taaattgagattattagggtaa

SEQ ID NO: 7097245 - DNA, 22 bp, Homo sapiens
taaattgagattattagggtaa

SEQ ID NO: 7097246 - DNA, 23 bp, Homo sapiens
taaattgatggtatgggttaagc

SEQ ID NO: 7097247 - DNA, 22 bp, Homo sapiens
taaattctgatcaagttccttc

SEQ ID NO: 7097248 - DNA, 22 bp, Homo sapiens
taaattgaaaatctacagaaca

SEQ ID NO: 7097249 - DNA, 22 bp, Homo sapiens
taaattctacaacttcaaagat

SEQ ID NO: 7097250 - DNA, 22 bp, Homo sapiens
taaattcagtgagtaatttctg

SEQ ID NO: 7097251 - DNA, 22 bp, Homo sapiens
taaattcagtgagtaatttctg

SEQ ID NO: 7097252 - DNA, 22 bp, Homo sapiens
taaattcagtgagtaatttctg

SEQ ID NO: 7097253 - DNA, 22 bp, Homo sapiens
taaattcagtgagtaatttctg

SEQ ID NO: 7097254 - DNA, 22 bp, Homo sapiens
taaattcagtgagtaatttctg

SEQ ID NO: 7097255 - DNA, 22 bp, Homo sapiens
taaattcagtgagtaatttctg

SEQ ID NO: 7097256 - DNA, 22 bp, Homo sapiens
taaattcagtgagtaatttctg

SEQ ID NO: 7097257 - DNA, 17 bp, Homo sapiens
tattagctagcttccag

SEQ ID NO: 7097258 - DNA, 22 bp, Homo sapiens
tattagctcatgatttcggtgg

SEQ ID NO: 7097259 - DNA, 22 bp, Homo sapiens
tattagctccagtactgttgcc

SEQ ID NO: 7097260 - DNA, 22 bp, Homo sapiens
tattagctccagtactgttgcc

SEQ ID NO: 7097261 - DNA, 22 bp, Homo sapiens
tattagctgtgtaactctggtt

SEQ ID NO: 7097262 - DNA, 21 bp, Homo sapiens
tattagcttctggtgctgttt

SEQ ID NO: 7097263 - DNA, 22 bp, Homo sapiens
tattagcttctggttttgttct

SEQ ID NO: 7097264 - DNA, 22 bp, Homo sapiens
tattagcagacaagctgctgga

SEQ ID NO: 7097265 - DNA, 22 bp, Homo sapiens
tattagcagcatgagaatgggc

SEQ ID NO: 7097266 - DNA, 22 bp, Homo sapiens
tattagcagccaacttagctgt

SEQ ID NO: 7097267 - DNA, 22 bp, Homo sapiens
tattagcagttgtatgtgtctg

SEQ ID NO: 7097268 - DNA, 22 bp, Homo sapiens
tattagcagttgtatgtgtctg

SEQ ID NO: 7097269 - DNA, 22 bp, Homo sapiens
tattagcagttgtatgtgtctg

SEQ ID NO: 7097270 - DNA, 22 bp, Homo sapiens
tattagcatatatgattcagtt

SEQ ID NO: 7097271 - DNA, 22 bp, Homo sapiens
tattagattaactttaatgtct

SEQ ID NO: 7097272 - DNA, 22 bp, Homo sapiens
tattagattaactttaatgtct

SEQ ID NO: 7097273 - DNA, 22 bp, Homo sapiens
tattagcaacagagctcttgtt

SEQ ID NO: 7097274 - DNA, 22 bp, Homo sapiens
tattagcaacagagctcttgtt

SEQ ID NO: 7097275 - DNA, 22 bp, Homo sapiens
tattagcaaccaagagcctcta

SEQ ID NO: 7097276 - DNA, 23 bp, Homo sapiens
tattagcaattcccacagagcag

SEQ ID NO: 7097277 - DNA, 22 bp, Homo sapiens
tattagcaacgtaacctctgaa

SEQ ID NO: 7097278 - DNA, 22 bp, Homo sapiens
tattagcaacgtaacctctgaa

SEQ ID NO: 7097279 - DNA, 23 bp, Homo sapiens
tattagcaattcccacagagcag

SEQ ID NO: 7097280 - DNA, 22 bp, Homo sapiens
tattagcacaaagcaaggtatt

SEQ ID NO: 7097281 - DNA, 22 bp, Homo sapiens
tattagaggaaccaaggtggag

SEQ ID NO: 7097282 - DNA, 22 bp, Homo sapiens
tattagaaaggctattgcatag

SEQ ID NO: 7097283 - DNA, 22 bp, Homo sapiens
tattagaaaggctattgcatag

SEQ ID NO: 7097284 - DNA, 22 bp, Homo sapiens
tattagaaaggctattgcatag

SEQ ID NO: 7097285 - DNA, 22 bp, Homo sapiens
tattagaaaggctattgcatag

SEQ ID NO: 7097286 - DNA, 22 bp, Homo sapiens
tattacgtaactacttaaattg

SEQ ID NO: 7097287 - DNA, 22 bp, Homo sapiens
tattactgaaaaggcaaagtag

SEQ ID NO: 7097288 - DNA, 22 bp, Homo sapiens
tattactgaggttttatggagt

SEQ ID NO: 7097289 - DNA, 22 bp, Homo sapiens
tattactgaggttttatggagt

SEQ ID NO: 7097290 - DNA, 22 bp, Homo sapiens
tattactgtcaatatcacagaa

SEQ ID NO: 7097291 - DNA, 22 bp, Homo sapiens
tattactgttacttcacactgt

SEQ ID NO: 7097292 - DNA, 22 bp, Homo sapiens
tattacatccacttttattgca

SEQ ID NO: 7097293 - DNA, 22 bp, Homo sapiens
tattacatccacttttattgca

SEQ ID NO: 7097294 - DNA, 22 bp, Homo sapiens
tattacagaatcaggcataact

SEQ ID NO: 7097295 - DNA, 22 bp, Homo sapiens
tattacagaatcaggcataact

SEQ ID NO: 7097296 - DNA, 22 bp, Homo sapiens
tattacagctttgattatctgg

SEQ ID NO: 7097297 - DNA, 22 bp, Homo sapiens
tattacagggctagttatgagt

SEQ ID NO: 7097298 - DNA, 19 bp, Homo sapiens
tatgtgtgcatttgtgcat

SEQ ID NO: 7097299 - DNA, 19 bp, Homo sapiens
tatgtgtgcatttgtgcat

SEQ ID NO: 7097300 - DNA, 22 bp, Homo sapiens
tatgtgtgctttttccatgcat

SEQ ID NO: 7097301 - DNA, 22 bp, Homo sapiens
tatgtgtgctttttccatgcat

SEQ ID NO: 7097302 - DNA, 22 bp, Homo sapiens
tatgtgtggcagctgggagtgt

SEQ ID NO: 7097303 - DNA, 22 bp, Homo sapiens
tatgtgtggcagctgggagtgt

SEQ ID NO: 7097304 - DNA, 22 bp, Homo sapiens
tatgtgtggcagctgggagtgt

SEQ ID NO: 7097305 - DNA, 20 bp, Homo sapiens
tattacacacaatgagcagt

SEQ ID NO: 7097306 - DNA, 22 bp, Homo sapiens
tatgtgcaaattaattgctaga

SEQ ID NO: 7097307 - DNA, 22 bp, Homo sapiens
tatgtgcacatacaagtgtgct

SEQ ID NO: 7097308 - DNA, 22 bp, Homo sapiens
tatgtgacatatctcagtttga

SEQ ID NO: 7097309 - DNA, 22 bp, Homo sapiens
tatgtgacttgacaaagcttcc

SEQ ID NO: 7097310 - DNA, 22 bp, Homo sapiens
tatgtgatataggctatttgat

SEQ ID NO: 7097311 - DNA, 22 bp, Homo sapiens
tatgtgtcctaagcaatcatcc

SEQ ID NO: 7097312 - DNA, 22 bp, Homo sapiens
tatgtgtcctgttaccggcagc

SEQ ID NO: 7097313 - DNA, 22 bp, Homo sapiens
tatgtgtctcagttgtgattga

SEQ ID NO: 7097314 - DNA, 22 bp, Homo sapiens
tatgtgtctcagttgtgattga

SEQ ID NO: 7097315 - DNA, 16 bp, Homo sapiens
tatgtgtctcatctac

SEQ ID NO: 7097316 - DNA, 22 bp, Homo sapiens
tatgtgtctgtcgtgcataaat

SEQ ID NO: 7097317 - DNA, 16 bp, Homo sapiens
tatgtgtctcatctac

SEQ ID NO: 7097318 - DNA, 21 bp, Homo sapiens
tatgtgtctgtggaaaactag

SEQ ID NO: 7097319 - DNA, 22 bp, Homo sapiens
tatgtgtctgtcgtgcataaat

SEQ ID NO: 7097320 - DNA, 18 bp, Homo sapiens
tatgtgtctgttacaact

SEQ ID NO: 7097321 - DNA, 22 bp, Homo sapiens
tatgtgtctttatctggctctt

SEQ ID NO: 7097322 - DNA, 18 bp, Homo sapiens
tatgtgtctgttacaact

SEQ ID NO: 7097323 - DNA, 22 bp, Homo sapiens
tatgtgtgcatgtatacattaa

SEQ ID NO: 7097324 - DNA, 19 bp, Homo sapiens
tatgtgtgcatttgtgcat

SEQ ID NO: 7097325 - DNA, 22 bp, Homo sapiens
tatgtctggcatgttgtaatta

SEQ ID NO: 7097326 - DNA, 22 bp, Homo sapiens
tatgtcttaatccttccttagg

SEQ ID NO: 7097327 - DNA, 22 bp, Homo sapiens
tatgtcttactacagcaattaa

SEQ ID NO: 7097328 - DNA, 22 bp, Homo sapiens
tatgtcttcgtcacctatctca

SEQ ID NO: 7097329 - DNA, 22 bp, Homo sapiens
tatgtcttgaaatgagaagcca

SEQ ID NO: 7097330 - DNA, 22 bp, Homo sapiens
tatgtcttgtgtttgctaatct

SEQ ID NO: 7097331 - DNA, 22 bp, Homo sapiens
tatgtctttagtatcttttgga

SEQ ID NO: 7097332 - DNA, 22 bp, Homo sapiens
tatgtctttgtccatgtgcagt

SEQ ID NO: 7097333 - DNA, 22 bp, Homo sapiens
tatgtctttgtcccactcccag

SEQ ID NO: 7097334 - DNA, 22 bp, Homo sapiens
tatgtcttttgcttgcaaatag

SEQ ID NO: 7097335 - DNA, 22 bp, Homo sapiens
tatgtcttttgcttgcaaatag

SEQ ID NO: 7097336 - DNA, 22 bp, Homo sapiens
tatgtgaatacagcagtggatg

SEQ ID NO: 7097337 - DNA, 22 bp, Homo sapiens
tatgtgacaaaagtaaactgca

SEQ ID NO: 7097338 - DNA, 22 bp, Homo sapiens
tatgtacataacatgaaatgca

SEQ ID NO: 7097339 - DNA, 22 bp, Homo sapiens
tatgtacagtccttaacttaaa

SEQ ID NO: 7097340 - DNA, 22 bp, Homo sapiens
tatgtacagtccttaacttaaa

SEQ ID NO: 7097341 - DNA, 22 bp, Homo sapiens
tatgtacagtccttaacttaaa

SEQ ID NO: 7097342 - DNA, 22 bp, Homo sapiens
tatgtacatacatgtgcatacg

SEQ ID NO: 7097343 - DNA, 22 bp, Homo sapiens
tatgtacatacatgtgcatacg

SEQ ID NO: 7097344 - DNA, 22 bp, Homo sapiens
tatgtacatacatgtgcatacg

SEQ ID NO: 7097345 - DNA, 22 bp, Homo sapiens
tatgtcctgctactctctcatg

SEQ ID NO: 7097346 - DNA, 22 bp, Homo sapiens
tatgtcctgttcagatcagaga

SEQ ID NO: 7097347 - DNA, 22 bp, Homo sapiens
tatgtctgaatcttatttaaat

SEQ ID NO: 7097348 - DNA, 22 bp, Homo sapiens
tatgtacagggatagaacttga

SEQ ID NO: 7097349 - DNA, 22 bp, Homo sapiens
tatgtacacttaagtttgagaa

SEQ ID NO: 7097350 - DNA, 22 bp, Homo sapiens
tatgtacagggatagaacttga

SEQ ID NO: 7097351 - DNA, 22 bp, Homo sapiens
tatgtacagggatagaacttga

SEQ ID NO: 7097352 - DNA, 22 bp, Homo sapiens
tatgtacaccggggaaggtggg

SEQ ID NO: 7097353 - DNA, 22 bp, Homo sapiens
tatgtacaccggggaaggtggg

SEQ ID NO: 7097354 - DNA, 22 bp, Homo sapiens
tatgtacacggtggctctgaag

SEQ ID NO: 7097355 - DNA, 22 bp, Homo sapiens
tatgtacacatacacttgtaat

SEQ ID NO: 7097356 - DNA, 22 bp, Homo sapiens
tatgtacacatacacttgtaat

SEQ ID NO: 7097357 - DNA, 22 bp, Homo sapiens
tatgtacacatacacttgtaat

SEQ ID NO: 7097358 - DNA, 22 bp, Homo sapiens
tatgagttcagttatcttaagt

SEQ ID NO: 7097359 - DNA, 22 bp, Homo sapiens
tatgagtggcgtagaggtaggg

SEQ ID NO: 7097360 - DNA, 22 bp, Homo sapiens
tatgaggcacttcattagctgg

SEQ ID NO: 7097361 - DNA, 22 bp, Homo sapiens
tatgagcttccagtgttgcatg

SEQ ID NO: 7097362 - DNA, 22 bp, Homo sapiens
tatgaggcttacaggcaggcca

SEQ ID NO: 7097363 - DNA, 22 bp, Homo sapiens
tatgaggtaggtattatactta

SEQ ID NO: 7097364 - DNA, 22 bp, Homo sapiens
tatgaggtattacaggaaatat

SEQ ID NO: 7097365 - DNA, 22 bp, Homo sapiens
tatgaggtattacaggaaatat

SEQ ID NO: 7097366 - DNA, 22 bp, Homo sapiens
tatgtacacacacatgcatgta

SEQ ID NO: 7097367 - DNA, 22 bp, Homo sapiens
tatgtacaatttgttgtatgtc

SEQ ID NO: 7097368 - DNA, 22 bp, Homo sapiens
tatgtacaagcacacatgtgac

SEQ ID NO: 7097369 - DNA, 22 bp, Homo sapiens
tatgtacaagcacacatgtgac

SEQ ID NO: 7097370 - DNA, 22 bp, Homo sapiens
tatgtacaagcacacatgtgac

SEQ ID NO: 7097371 - DNA, 22 bp, Homo sapiens
tatgtacaatcagcagttcata

SEQ ID NO: 7097372 - DNA, 22 bp, Homo sapiens
tatgtacaatcagcagttcata

SEQ ID NO: 7097373 - DNA, 22 bp, Homo sapiens
tatgtacaatcagcagttcata

SEQ ID NO: 7097374 - DNA, 22 bp, Homo sapiens
tattcattatgaccaaatctag

SEQ ID NO: 7097375 - DNA, 22 bp, Homo sapiens
tattccaaaatagttaagcact

SEQ ID NO: 7097376 - DNA, 22 bp, Homo sapiens
tattccttggcaaaaaatatat

SEQ ID NO: 7097377 - DNA, 22 bp, Homo sapiens
tattcctgttccccatcaccac

SEQ ID NO: 7097378 - DNA, 22 bp, Homo sapiens
tattcaaagtaccttcattgcc

SEQ ID NO: 7097379 - DNA, 22 bp, Homo sapiens
tattcaaagtaccttcattgcc

SEQ ID NO: 7097380 - DNA, 22 bp, Homo sapiens
tattattttagcactgaggatt

SEQ ID NO: 7097381 - DNA, 22 bp, Homo sapiens
tattattttagcactgaggatt

SEQ ID NO: 7097382 - DNA, 22 bp, Homo sapiens
tattatttttattcgagggaaa

SEQ ID NO: 7097383 - DNA, 22 bp, Homo sapiens
tattaggcaaagctaagtgtgt

SEQ ID NO: 7097384 - DNA, 22 bp, Homo sapiens
tattagcttctggttttgttct

SEQ ID NO: 7097385 - DNA, 22 bp, Homo sapiens
tattagcttgtttggcaggatg

SEQ ID NO: 7097386 - DNA, 22 bp, Homo sapiens
tattagctttagcctttggatg

SEQ ID NO: 7097387 - DNA, 22 bp, Homo sapiens
tattaggtagattttactgatt

SEQ ID NO: 7097388 - DNA, 22 bp, Homo sapiens
tattaggcatttgaggataaac

SEQ ID NO: 7097389 - DNA, 22 bp, Homo sapiens
tattaggcatttgaggataaac

SEQ ID NO: 7097390 - DNA, 22 bp, Homo sapiens
tattaggctagtcaatagagat

SEQ ID NO: 7097391 - DNA, 22 bp, Homo sapiens
tattaggctagtcaatagagat

SEQ ID NO: 7097392 - DNA, 22 bp, Homo sapiens
tattagggtaaatttgacatgc

SEQ ID NO: 7097393 - DNA, 22 bp, Homo sapiens
tattattaaatggcagaatttt

SEQ ID NO: 7097394 - DNA, 22 bp, Homo sapiens
tattaggtagattttactgatt

SEQ ID NO: 7097395 - DNA, 22 bp, Homo sapiens
tattaggtagattttactgatt

SEQ ID NO: 7097396 - DNA, 19 bp, Homo sapiens
tattatttgtagcaaggcc

SEQ ID NO: 7097397 - DNA, 22 bp, Homo sapiens
tattattgaatcagttctttga

SEQ ID NO: 7097398 - DNA, 22 bp, Homo sapiens
tattattgacatttacttggtg

SEQ ID NO: 7097399 - DNA, 22 bp, Homo sapiens
tattattgactattcagaatgt

SEQ ID NO: 7097400 - DNA, 22 bp, Homo sapiens
tattattatattggatgagact

SEQ ID NO: 7097401 - DNA, 22 bp, Homo sapiens
tattattatgcatagcatgaaa

SEQ ID NO: 7097402 - DNA, 22 bp, Homo sapiens
tattcttgactgcttactatgt

SEQ ID NO: 7097403 - DNA, 22 bp, Homo sapiens
tattcttgtaccttaaatgatt

SEQ ID NO: 7097404 - DNA, 22 bp, Homo sapiens
tattcttgtatactacaatctt

SEQ ID NO: 7097405 - DNA, 22 bp, Homo sapiens
tattgaaatccattacgttctt

SEQ ID NO: 7097406 - DNA, 22 bp, Homo sapiens
tattgaaatgaatgacagtgat

SEQ ID NO: 7097407 - DNA, 22 bp, Homo sapiens
tattgacaatttgtgaaactat

SEQ ID NO: 7097408 - DNA, 22 bp, Homo sapiens
tattgacaatttgtgaaactat

SEQ ID NO: 7097409 - DNA, 22 bp, Homo sapiens
tattgacaataggcaactgagg

SEQ ID NO: 7097410 - DNA, 22 bp, Homo sapiens
tattgacaatttgtgaaactat

SEQ ID NO: 7097411 - DNA, 22 bp, Homo sapiens
tattgacaataggcaactgagg

SEQ ID NO: 7097412 - DNA, 22 bp, Homo sapiens
tattgacaataggcaactgagg

SEQ ID NO: 7097413 - DNA, 22 bp, Homo sapiens
tattgaagattttgtggttgct

SEQ ID NO: 7097414 - DNA, 22 bp, Homo sapiens
tattgaaattcttcatgtcctc

SEQ ID NO: 7097415 - DNA, 22 bp, Homo sapiens
tattgaaattcttcatgtcctc

SEQ ID NO: 7097416 - DNA, 22 bp, Homo sapiens
tattgaaattcttcatgtcctc

SEQ ID NO: 7097417 - DNA, 22 bp, Homo sapiens
tattctccccggatcagggcaa

SEQ ID NO: 7097418 - DNA, 22 bp, Homo sapiens
tattctctccccaatcttgctt

SEQ ID NO: 7097419 - DNA, 22 bp, Homo sapiens
tattctctccccaatcttgctt

SEQ ID NO: 7097420 - DNA, 22 bp, Homo sapiens
tattctcatcatcactggagct

SEQ ID NO: 7097421 - DNA, 22 bp, Homo sapiens
tattctcattagtctgtattcc

SEQ ID NO: 7097422 - DNA, 22 bp, Homo sapiens
tattctacgagtttggtaattt

SEQ ID NO: 7097423 - DNA, 22 bp, Homo sapiens
tattctcagcaacacacatgga

SEQ ID NO: 7097424 - DNA, 22 bp, Homo sapiens
tattctcagtgctataagtaga

SEQ ID NO: 7097425 - DNA, 22 bp, Homo sapiens
tattctcagtgctataagtaga

SEQ ID NO: 7097426 - DNA, 22 bp, Homo sapiens
tattctggtttccggatctcta

SEQ ID NO: 7097427 - DNA, 22 bp, Homo sapiens
tattctgtgtgatatgtaaatg

SEQ ID NO: 7097428 - DNA, 22 bp, Homo sapiens
tattctgtgtgatatgtaaatg

SEQ ID NO: 7097429 - DNA, 22 bp, Homo sapiens
tattctgggtaccaaacttcaa

SEQ ID NO: 7097430 - DNA, 22 bp, Homo sapiens
tattctgctaagtgatttctac

SEQ ID NO: 7097431 - DNA, 22 bp, Homo sapiens
tatttaatttgctcattgtgat

SEQ ID NO: 7097432 - DNA, 22 bp, Homo sapiens
tatttaatttgctcattgtgat

SEQ ID NO: 7097433 - DNA, 22 bp, Homo sapiens
tatttaatttgctcattgtgat

SEQ ID NO: 7097434 - DNA, 20 bp, Homo sapiens
tatttacaacttagagcctc

SEQ ID NO: 7097435 - DNA, 20 bp, Homo sapiens
tatttacaacttagagcctc

SEQ ID NO: 7097436 - DNA, 22 bp, Homo sapiens
tatttataatctgccaaagaga

SEQ ID NO: 7097437 - DNA, 22 bp, Homo sapiens
tatttataatctgccaaagaga

SEQ ID NO: 7097438 - DNA, 22 bp, Homo sapiens
tatttataatctgccaaagaga

SEQ ID NO: 7097439 - DNA, 22 bp, Homo sapiens
tatttataatctgccaaagaga

SEQ ID NO: 7097440 - DNA, 22 bp, Homo sapiens
tatttataacagtgagaacggg

SEQ ID NO: 7097441 - DNA, 22 bp, Homo sapiens
tatttaattagtgattgtagag

SEQ ID NO: 7097442 - DNA, 22 bp, Homo sapiens
tattgacagtgactattggtag

SEQ ID NO: 7097443 - DNA, 22 bp, Homo sapiens
tattgacatttttatagcttga

SEQ ID NO: 7097444 - DNA, 22 bp, Homo sapiens
tattgacagtgactattggtag

SEQ ID NO: 7097445 - DNA, 22 bp, Homo sapiens
tattgacatttttatagcttga

SEQ ID NO: 7097446 - DNA, 22 bp, Homo sapiens
tattgacatttttatagcttga

SEQ ID NO: 7097447 - DNA, 22 bp, Homo sapiens
tattgacaggtgcctgcagaca

SEQ ID NO: 7097448 - DNA, 22 bp, Homo sapiens
tattgacagagggtcagaagag

SEQ ID NO: 7097449 - DNA, 22 bp, Homo sapiens
tattgacagatgcattatgttg

SEQ ID NO: 7097450 - DNA, 22 bp, Homo sapiens
tattgacagatgcattatgttg

SEQ ID NO: 7097451 - DNA, 22 bp, Homo sapiens
tattgacaatttgtgaaactat

SEQ ID NO: 7097452 - DNA, 22 bp, Homo sapiens
tattgacactttttgtgtagcc

SEQ ID NO: 7097453 - DNA, 22 bp, Homo sapiens
tattgacactttttgtgtagcc

SEQ ID NO: 7097454 - DNA, 22 bp, Homo sapiens
tattgacagagggtcagaagag

SEQ ID NO: 7097455 - DNA, 22 bp, Homo sapiens
tatttatgtggaccataagcct

SEQ ID NO: 7097456 - DNA, 21 bp, Homo sapiens
tatttattaatttgtaaggct

SEQ ID NO: 7097457 - DNA, 21 bp, Homo sapiens
tatttattaatttgtaaggct

SEQ ID NO: 7097458 - DNA, 21 bp, Homo sapiens
tatttattaatttgtaaggct

SEQ ID NO: 7097459 - DNA, 22 bp, Homo sapiens
tatttatcgagtgtctactatg

SEQ ID NO: 7097460 - DNA, 22 bp, Homo sapiens
tatttatcgagtgtctactatg

SEQ ID NO: 7097461 - DNA, 22 bp, Homo sapiens
tatttatcgagtgtctactatg

SEQ ID NO: 7097462 - DNA, 22 bp, Homo sapiens
tatttatcgagtgtctactatg

SEQ ID NO: 7097463 - DNA, 22 bp, Homo sapiens
tatttatcgagtgtctactatg

SEQ ID NO: 7097464 - DNA, 21 bp, Homo sapiens
tatttatctcaggctatcttt

SEQ ID NO: 7097465 - DNA, 22 bp, Homo sapiens
tatttatgtatgtggatgtgtt

SEQ ID NO: 7097466 - DNA, 22 bp, Homo sapiens
tatttatgtctctgcagagaat

SEQ ID NO: 7097467 - DNA, 22 bp, Homo sapiens
tatttatgtggaccataagcct

SEQ ID NO: 7097468 - DNA, 22 bp, Homo sapiens
tatttatgtggaccataagcct

SEQ ID NO: 7097469 - DNA, 22 bp, Homo sapiens
tatttatattctgccttctgct

SEQ ID NO: 7097470 - DNA, 22 bp, Homo sapiens
tatttataccaggtgatcggag

SEQ ID NO: 7097471 - DNA, 22 bp, Homo sapiens
tatttatattctgccttctgct

SEQ ID NO: 7097472 - DNA, 22 bp, Homo sapiens
tatttatcaaggtaggagaata

SEQ ID NO: 7097473 - DNA, 22 bp, Homo sapiens
tatttataatctgccaaagaga

SEQ ID NO: 7097474 - DNA, 22 bp, Homo sapiens
tatttataccaggtgatcggag

SEQ ID NO: 7097475 - DNA, 22 bp, Homo sapiens
tatttataatctgccaaagaga

SEQ ID NO: 7097476 - DNA, 22 bp, Homo sapiens
tatttataatctgccaaagaga

SEQ ID NO: 7097477 - DNA, 22 bp, Homo sapiens
tatttataatctgccaaagaga

SEQ ID NO: 7097478 - DNA, 22 bp, Homo sapiens
tatttctctcacggttgcctgg

SEQ ID NO: 7097479 - DNA, 22 bp, Homo sapiens
tatttctattccccaggcaagt

SEQ ID NO: 7097480 - DNA, 22 bp, Homo sapiens
tatttctaagctgtaagtctga

SEQ ID NO: 7097481 - DNA, 22 bp, Homo sapiens
tatttctattccccaggcaagt

SEQ ID NO: 7097482 - DNA, 22 bp, Homo sapiens
tatttctcagcattttacatcc

SEQ ID NO: 7097483 - DNA, 22 bp, Homo sapiens
tatttctcagcattttacatcc

SEQ ID NO: 7097484 - DNA, 22 bp, Homo sapiens
tatttctaagctgtaagtctga

SEQ ID NO: 7097485 - DNA, 22 bp, Homo sapiens
tatttctaagctgtaagtctga

SEQ ID NO: 7097486 - DNA, 22 bp, Homo sapiens
tatttattggacagtgttgctg

SEQ ID NO: 7097487 - DNA, 22 bp, Homo sapiens
tatttattggacagtgttgctg

SEQ ID NO: 7097488 - DNA, 22 bp, Homo sapiens
tatttattggacagtgttgctg

SEQ ID NO: 7097489 - DNA, 22 bp, Homo sapiens
tatttattggacagtgttgctg

SEQ ID NO: 7097490 - DNA, 22 bp, Homo sapiens
tatttattctttgtactgcctt

SEQ ID NO: 7097491 - DNA, 22 bp, Homo sapiens
tatttattctttgtactgcctt

SEQ ID NO: 7097492 - DNA, 22 bp, Homo sapiens
tatttattctttgtactgcctt

SEQ ID NO: 7097493 - DNA, 22 bp, Homo sapiens
tatttattctttgtactgcctt

SEQ ID NO: 7097494 - DNA, 22 bp, Homo sapiens
tatttattcattcagcaagcat

SEQ ID NO: 7097495 - DNA, 22 bp, Homo sapiens
tatttattcattcagcaagcat

SEQ ID NO: 7097496 - DNA, 22 bp, Homo sapiens
tatttattcattcagcaagcat

SEQ ID NO: 7097497 - DNA, 22 bp, Homo sapiens
tatttattcattcagcaagcat

SEQ ID NO: 7097498 - DNA, 22 bp, Homo sapiens
tatttattcattcagcaagcat

SEQ ID NO: 7097499 - DNA, 22 bp, Homo sapiens
tatccaattcaccattgatggg

SEQ ID NO: 7097500 - DNA, 22 bp, Homo sapiens
tatccaattcaccattgatggg

SEQ ID NO: 7097501 - DNA, 22 bp, Homo sapiens
tatccaattcaccattgatggg

SEQ ID NO: 7097502 - DNA, 22 bp, Homo sapiens
tatccaattcaccattgatggg

SEQ ID NO: 7097503 - DNA, 22 bp, Homo sapiens
tatccaaagtttctcagaaact

SEQ ID NO: 7097504 - DNA, 22 bp, Homo sapiens
tatccaaagtggcatattatag

SEQ ID NO: 7097505 - DNA, 22 bp, Homo sapiens
tatatgactgtattatgctttt

SEQ ID NO: 7097506 - DNA, 22 bp, Homo sapiens
tatatgactgtattatgctttt

SEQ ID NO: 7097507 - DNA, 22 bp, Homo sapiens
tatccatattcagactgtgaat

SEQ ID NO: 7097508 - DNA, 22 bp, Homo sapiens
tatccatgcctttgtgccttag

SEQ ID NO: 7097509 - DNA, 22 bp, Homo sapiens
tatccatgcctttgtgccttag

SEQ ID NO: 7097510 - DNA, 22 bp, Homo sapiens
tatccatggccaatcaaataca

SEQ ID NO: 7097511 - DNA, 22 bp, Homo sapiens
tatcccaggaggccacctgtca

SEQ ID NO: 7097512 - DNA, 22 bp, Homo sapiens
tatatcaccaaaaacagttctg

SEQ ID NO: 7097513 - DNA, 22 bp, Homo sapiens
tatatcagagttaaaagaatgt

SEQ ID NO: 7097514 - DNA, 22 bp, Homo sapiens
tatatcagcaaagcatttaaaa

SEQ ID NO: 7097515 - DNA, 22 bp, Homo sapiens
tatatcatggagattaacattc

SEQ ID NO: 7097516 - DNA, 19 bp, Homo sapiens
tatatattttggggttgtg

SEQ ID NO: 7097517 - DNA, 22 bp, Homo sapiens
tatatattcttaagtagtgtag

SEQ ID NO: 7097518 - DNA, 22 bp, Homo sapiens
tatatattcttaagtagtgtag

SEQ ID NO: 7097519 - DNA, 22 bp, Homo sapiens
tatatcatggagattaacattc

SEQ ID NO: 7097520 - DNA, 22 bp, Homo sapiens
tatatcatggagattaacattc

SEQ ID NO: 7097521 - DNA, 22 bp, Homo sapiens
tatatcatggagattaacattc

SEQ ID NO: 7097522 - DNA, 22 bp, Homo sapiens
tatatctaagtgtatgtaagag

SEQ ID NO: 7097523 - DNA, 22 bp, Homo sapiens
tatatcttatatgtgcaggtac

SEQ ID NO: 7097524 - DNA, 22 bp, Homo sapiens
tatatgacagtatcattttaaa

SEQ ID NO: 7097525 - DNA, 22 bp, Homo sapiens
tatatgacagtatcattttaaa

SEQ ID NO: 7097526 - DNA, 22 bp, Homo sapiens
tatatcttatatgtgcaggtac

SEQ ID NO: 7097527 - DNA, 22 bp, Homo sapiens
tatagttagtttcataatcatg

SEQ ID NO: 7097528 - DNA, 22 bp, Homo sapiens
tatagttagtttcataatcatg

SEQ ID NO: 7097529 - DNA, 22 bp, Homo sapiens
tatagttagtttcataatcatg

SEQ ID NO: 7097530 - DNA, 22 bp, Homo sapiens
tatagtatacttaaagtctatt

SEQ ID NO: 7097531 - DNA, 22 bp, Homo sapiens
tatagtgcattatttacagtaa

SEQ ID NO: 7097532 - DNA, 22 bp, Homo sapiens
tatagtaaaattttcatttatg

SEQ ID NO: 7097533 - DNA, 22 bp, Homo sapiens
tataggtgaataaatgagttta

SEQ ID NO: 7097534 - DNA, 22 bp, Homo sapiens
tataggtgaataaatgagttta

SEQ ID NO: 7097535 - DNA, 22 bp, Homo sapiens
tatagtaaaattttcatttatg

SEQ ID NO: 7097536 - DNA, 22 bp, Homo sapiens
tataggactgatcacattttca

SEQ ID NO: 7097537 - DNA, 22 bp, Homo sapiens
tataggcagatctgagaatatt

SEQ ID NO: 7097538 - DNA, 22 bp, Homo sapiens
tataggctcttgttaacctttt

SEQ ID NO: 7097539 - DNA, 22 bp, Homo sapiens
tataggctgatggcttcctgag

SEQ ID NO: 7097540 - DNA, 22 bp, Homo sapiens
tataggctgatggcttcctgag

SEQ ID NO: 7097541 - DNA, 22 bp, Homo sapiens
tataggaaatttatctcctggg

SEQ ID NO: 7097542 - DNA, 22 bp, Homo sapiens
tataggaaataggtcttctgtg

SEQ ID NO: 7097543 - DNA, 22 bp, Homo sapiens
tataggaaggcagattttagct

SEQ ID NO: 7097544 - DNA, 22 bp, Homo sapiens
tataggaaggcagattttagct

SEQ ID NO: 7097545 - DNA, 22 bp, Homo sapiens
tataggaagtaattgttgcctg

SEQ ID NO: 7097546 - DNA, 22 bp, Homo sapiens
tataggaatgacgtcatttcct

SEQ ID NO: 7097547 - DNA, 22 bp, Homo sapiens
tataggaccgacttgtttatag

SEQ ID NO: 7097548 - DNA, 22 bp, Homo sapiens
tatagcatggctatattgttgc

SEQ ID NO: 7097549 - DNA, 22 bp, Homo sapiens
tatagcttcaaatgctatagct

SEQ ID NO: 7097550 - DNA, 22 bp, Homo sapiens
tatagctttgctgagaaaaaga

SEQ ID NO: 7097551 - DNA, 22 bp, Homo sapiens
tataggaaacatacgtgactag

SEQ ID NO: 7097552 - DNA, 22 bp, Homo sapiens
tataggaaaggagtggtcacaa

SEQ ID NO: 7097553 - DNA, 22 bp, Homo sapiens
tatagcaattcagaatacatgt

SEQ ID NO: 7097554 - DNA, 21 bp, Homo sapiens
tatagcagcatgatttataat

SEQ ID NO: 7097555 - DNA, 22 bp, Homo sapiens
tatagcactgcaatatttccct

SEQ ID NO: 7097556 - DNA, 22 bp, Homo sapiens
tatagcatatacagataagctg

SEQ ID NO: 7097557 - DNA, 22 bp, Homo sapiens
tatctagatagtttagccatct

SEQ ID NO: 7097558 - DNA, 16 bp, Homo sapiens
tatctagagttgaggt

SEQ ID NO: 7097559 - DNA, 22 bp, Homo sapiens
tatctagataccaagaagcaca

SEQ ID NO: 7097560 - DNA, 22 bp, Homo sapiens
tatctagaaacagagttttact

SEQ ID NO: 7097561 - DNA, 22 bp, Homo sapiens
tatctagaaatttcttttgttg

SEQ ID NO: 7097562 - DNA, 22 bp, Homo sapiens
tatctagaactccagaatgtag

SEQ ID NO: 7097563 - DNA, 22 bp, Homo sapiens
tatctagagcagtggttctcaa

SEQ ID NO: 7097564 - DNA, 22 bp, Homo sapiens
tatctagagcctggaagtcttg

SEQ ID NO: 7097565 - DNA, 22 bp, Homo sapiens
tatctagagtcctgctgagaac

SEQ ID NO: 7097566 - DNA, 22 bp, Homo sapiens
tatctagaaacagagttttact

SEQ ID NO: 7097567 - DNA, 23 bp, Homo sapiens
tatctactttgcaattcagtacc

SEQ ID NO: 7097568 - DNA, 23 bp, Homo sapiens
tatctactttgcaattcagtacc

SEQ ID NO: 7097569 - DNA, 22 bp, Homo sapiens
tatctacattcttgtatcttct

SEQ ID NO: 7097570 - DNA, 21 bp, Homo sapiens
tatctacagtgtccattcagt

SEQ ID NO: 7097571 - DNA, 21 bp, Homo sapiens
tatctacagtgtccattcagt

SEQ ID NO: 7097572 - DNA, 22 bp, Homo sapiens
tatctacagttaatatgtcatc

SEQ ID NO: 7097573 - DNA, 22 bp, Homo sapiens
tatctacagttaatatgtcatc

SEQ ID NO: 7097574 - DNA, 22 bp, Homo sapiens
tatctacagttaatatgtcatc

SEQ ID NO: 7097575 - DNA, 22 bp, Homo sapiens
tatctacagttaatatgtcatc

SEQ ID NO: 7097576 - DNA, 22 bp, Homo sapiens
tatctacagttaatatgtcatc

SEQ ID NO: 7097577 - DNA, 22 bp, Homo sapiens
tatctacatgtaggtatgtatg

SEQ ID NO: 7097578 - DNA, 20 bp, Homo sapiens
tatctaaatgcttacattac

SEQ ID NO: 7097579 - DNA, 20 bp, Homo sapiens
tatctaaatgcttacattac

SEQ ID NO: 7097580 - DNA, 22 bp, Homo sapiens
tatctaaaggatttaatttagt

SEQ ID NO: 7097581 - DNA, 22 bp, Homo sapiens
tatctaaaggatttaatttagt

SEQ ID NO: 7097582 - DNA, 22 bp, Homo sapiens
tatctaaaggatttaatttagt

SEQ ID NO: 7097583 - DNA, 22 bp, Homo sapiens
tatctaaatggaatattccaga

SEQ ID NO: 7097584 - DNA, 22 bp, Homo sapiens
tatctacaggtgtcaggtaaga

SEQ ID NO: 7097585 - DNA, 23 bp, Homo sapiens
tatcctaaaggcaacaggaagtc

SEQ ID NO: 7097586 - DNA, 22 bp, Homo sapiens
tatccccctttctcaggaagct

SEQ ID NO: 7097587 - DNA, 22 bp, Homo sapiens
tatcctgctttgttcctcttga

SEQ ID NO: 7097588 - DNA, 22 bp, Homo sapiens
tatcccatgagccagctgcagc

SEQ ID NO: 7097589 - DNA, 22 bp, Homo sapiens
tatcccatgcctcattaaagtt

SEQ ID NO: 7097590 - DNA, 22 bp, Homo sapiens
tatccccacctctgttaaggac

SEQ ID NO: 7097591 - DNA, 22 bp, Homo sapiens
tatccgtgatgtttataaacca

SEQ ID NO: 7097592 - DNA, 22 bp, Homo sapiens
tatcctgttttgcacaattata

SEQ ID NO: 7097593 - DNA, 22 bp, Homo sapiens
tatccttgtactatagtattta

SEQ ID NO: 7097594 - DNA, 22 bp, Homo sapiens
tatctaaaggatttaatttagt

SEQ ID NO: 7097595 - DNA, 22 bp, Homo sapiens
tatgagaaaataaatatctgtt

SEQ ID NO: 7097596 - DNA, 22 bp, Homo sapiens
tatgagaaaataaatatctgtt

SEQ ID NO: 7097597 - DNA, 22 bp, Homo sapiens
tatgagaaaataaatatctgtt

SEQ ID NO: 7097598 - DNA, 22 bp, Homo sapiens
tatgacttttcccaattcagga

SEQ ID NO: 7097599 - DNA, 21 bp, Homo sapiens
tatgagaaaactgaggtgcat

SEQ ID NO: 7097600 - DNA, 22 bp, Homo sapiens
tatgagaaaggagaatgacttt

SEQ ID NO: 7097601 - DNA, 22 bp, Homo sapiens
tatgagaaaggagaatgacttt

SEQ ID NO: 7097602 - DNA, 22 bp, Homo sapiens
tatgagaaattgctgatatttg

SEQ ID NO: 7097603 - DNA, 22 bp, Homo sapiens
tatgagaacaagaacaatctcc

SEQ ID NO: 7097604 - DNA, 22 bp, Homo sapiens
tatgagaactgacagagtgcca

SEQ ID NO: 7097605 - DNA, 22 bp, Homo sapiens
tatgagaactgacagagtgcca

SEQ ID NO: 7097606 - DNA, 22 bp, Homo sapiens
tatgagaataatctggtaaata

SEQ ID NO: 7097607 - DNA, 22 bp, Homo sapiens
tatgacattataaaggattatt

SEQ ID NO: 7097608 - DNA, 22 bp, Homo sapiens
tatgacattataaaggattatt

SEQ ID NO: 7097609 - DNA, 22 bp, Homo sapiens
tatgacattatgtattacatgt

SEQ ID NO: 7097610 - DNA, 22 bp, Homo sapiens
tatgacatcagaagactttaaa

SEQ ID NO: 7097611 - DNA, 22 bp, Homo sapiens
tatgacatgtgatctcaagagg

SEQ ID NO: 7097612 - DNA, 22 bp, Homo sapiens
tatgacattataaaggattatt

SEQ ID NO: 7097613 - DNA, 22 bp, Homo sapiens
tatgacattatgtattacatgt

SEQ ID NO: 7097614 - DNA, 22 bp, Homo sapiens
tatgacattgctttttagaact

SEQ ID NO: 7097615 - DNA, 22 bp, Homo sapiens
tatgacattgctttttagaact

SEQ ID NO: 7097616 - DNA, 22 bp, Homo sapiens
tatgacagcaaatatccatgag

SEQ ID NO: 7097617 - DNA, 22 bp, Homo sapiens
tatgacagcaaatatccatgag

SEQ ID NO: 7097618 - DNA, 22 bp, Homo sapiens
tatgacaggcatgagatcctaa

SEQ ID NO: 7097619 - DNA, 22 bp, Homo sapiens
tatgacagtgaaaaaaatcaga

SEQ ID NO: 7097620 - DNA, 22 bp, Homo sapiens
tatgacagtgaaaaaaatcaga

SEQ ID NO: 7097621 - DNA, 22 bp, Homo sapiens
tatgacattttttgtggccttc

SEQ ID NO: 7097622 - DNA, 22 bp, Homo sapiens
tatgacattttttgtggccttc

SEQ ID NO: 7097623 - DNA, 22 bp, Homo sapiens
tatgacattttgccagcattgc

SEQ ID NO: 7097624 - DNA, 22 bp, Homo sapiens
tatgacattttgccagcattgc

SEQ ID NO: 7097625 - DNA, 22 bp, Homo sapiens
tatgacattttgccagcattgc

SEQ ID NO: 7097626 - DNA, 22 bp, Homo sapiens
tatgacattttgccagcattgc

SEQ ID NO: 7097627 - DNA, 22 bp, Homo sapiens
tatgactatagggcttagtgtt

SEQ ID NO: 7097628 - DNA, 22 bp, Homo sapiens
tatgaccttaggaagcaagaag

SEQ ID NO: 7097629 - DNA, 22 bp, Homo sapiens
tatgacttatttcatcagttct

SEQ ID NO: 7097630 - DNA, 22 bp, Homo sapiens
tatgactatagggcttagtgtt

SEQ ID NO: 7097631 - DNA, 22 bp, Homo sapiens
tatgacattgctttttagaact

SEQ ID NO: 7097632 - DNA, 22 bp, Homo sapiens
tatgacattggccaagttctgt

SEQ ID NO: 7097633 - DNA, 22 bp, Homo sapiens
tatgacattggccaagttctgt

SEQ ID NO: 7097634 - DNA, 22 bp, Homo sapiens
tatgacatttctctgatttgtg

SEQ ID NO: 7097635 - DNA, 22 bp, Homo sapiens
tatgacattttcccagatttat

SEQ ID NO: 7097636 - DNA, 22 bp, Homo sapiens
tatgacattttcccagatttat

SEQ ID NO: 7097637 - DNA, 22 bp, Homo sapiens
taggtgagggagcattgtgaga

SEQ ID NO: 7097638 - DNA, 20 bp, Homo sapiens
taggtgagggcagatagagg

SEQ ID NO: 7097639 - DNA, 22 bp, Homo sapiens
taggtgaggttacaagagttca

SEQ ID NO: 7097640 - DNA, 22 bp, Homo sapiens
taggtgaggttacaagagttca

SEQ ID NO: 7097641 - DNA, 22 bp, Homo sapiens
taggtcccagcatcttctgagc

SEQ ID NO: 7097642 - DNA, 22 bp, Homo sapiens
taggtcccagcatcttctgagc

SEQ ID NO: 7097643 - DNA, 22 bp, Homo sapiens
taggtcccttctgtcctggtct

SEQ ID NO: 7097644 - DNA, 22 bp, Homo sapiens
taggtctcctggcctagagatt

SEQ ID NO: 7097645 - DNA, 22 bp, Homo sapiens
taggtctctcttcttgatggga

SEQ ID NO: 7097646 - DNA, 22 bp, Homo sapiens
taggtctgaggctgcatcttgg

SEQ ID NO: 7097647 - DNA, 22 bp, Homo sapiens
taggggtgtttcgagagaggtt

SEQ ID NO: 7097648 - DNA, 22 bp, Homo sapiens
taggggtgtttcgagagaggtt

SEQ ID NO: 7097649 - DNA, 22 bp, Homo sapiens
taggggtgtttcgagagaggtt

SEQ ID NO: 7097650 - DNA, 22 bp, Homo sapiens
taggggtgtttcgagagaggtt

SEQ ID NO: 7097651 - DNA, 21 bp, Homo sapiens
taggtatttctatcatgtctc

SEQ ID NO: 7097652 - DNA, 22 bp, Homo sapiens
taggtcatcagattgacaaggg

SEQ ID NO: 7097653 - DNA, 22 bp, Homo sapiens
taggggtgggatccaggaatta

SEQ ID NO: 7097654 - DNA, 22 bp, Homo sapiens
taggggtgggatccaggaatta

SEQ ID NO: 7097655 - DNA, 22 bp, Homo sapiens
taggggtggagctaagagtccc

SEQ ID NO: 7097656 - DNA, 22 bp, Homo sapiens
taggggtggagctaagagtccc

SEQ ID NO: 7097657 - DNA, 22 bp, Homo sapiens
taggggtgggatccaggaatta

SEQ ID NO: 7097658 - DNA, 22 bp, Homo sapiens
taggggtgggatccaggaatta

SEQ ID NO: 7097659 - DNA, 22 bp, Homo sapiens
taggggtgaggccaggcatcag

SEQ ID NO: 7097660 - DNA, 22 bp, Homo sapiens
taggggtggagctaagagtccc

SEQ ID NO: 7097661 - DNA, 22 bp, Homo sapiens
taggggtggagctaagagtccc

SEQ ID NO: 7097662 - DNA, 22 bp, Homo sapiens
taggtgtctgctcttatttaac

SEQ ID NO: 7097663 - DNA, 23 bp, Homo sapiens
taggtgtctagtgtccactatgt

SEQ ID NO: 7097664 - DNA, 22 bp, Homo sapiens
taggtgtctgctcttatttaac

SEQ ID NO: 7097665 - DNA, 22 bp, Homo sapiens
taggtgtctgctcttatttaac

SEQ ID NO: 7097666 - DNA, 22 bp, Homo sapiens
taggtgtctggacaactttgta

SEQ ID NO: 7097667 - DNA, 22 bp, Homo sapiens
taggtgtctgtcctgggctgtg

SEQ ID NO: 7097668 - DNA, 22 bp, Homo sapiens
taggtgtcttgtcactaccgtt

SEQ ID NO: 7097669 - DNA, 22 bp, Homo sapiens
taggtgtcaggcctcctccagc

SEQ ID NO: 7097670 - DNA, 22 bp, Homo sapiens
taggtgtcaggtatagaattta

SEQ ID NO: 7097671 - DNA, 22 bp, Homo sapiens
taggtgtccatatatgtgtgta

SEQ ID NO: 7097672 - DNA, 19 bp, Homo sapiens
taggtgtccgccggaggtg

SEQ ID NO: 7097673 - DNA, 22 bp, Homo sapiens
taggtgtcctcgtccaaagatt

SEQ ID NO: 7097674 - DNA, 22 bp, Homo sapiens
taggtgtctaacaataagtgta

SEQ ID NO: 7097675 - DNA, 22 bp, Homo sapiens
taggtgctggataaagaatggt

SEQ ID NO: 7097676 - DNA, 22 bp, Homo sapiens
taggtgagtttggggaagatag

SEQ ID NO: 7097677 - DNA, 22 bp, Homo sapiens
taggtgcagtggctcatgcctg

SEQ ID NO: 7097678 - DNA, 22 bp, Homo sapiens
taggtgggtgacttccatgggg

SEQ ID NO: 7097679 - DNA, 22 bp, Homo sapiens
taggtggtagagcctggcttgc

SEQ ID NO: 7097680 - DNA, 22 bp, Homo sapiens
taggtgggtgacttccatgggg

SEQ ID NO: 7097681 - DNA, 22 bp, Homo sapiens
taggtgggtgacttccatgggg

SEQ ID NO: 7097682 - DNA, 22 bp, Homo sapiens
taggtggtgggatatgagcatc

SEQ ID NO: 7097683 - DNA, 22 bp, Homo sapiens
taggtggtgtgcgaagagcgtg

SEQ ID NO: 7097684 - DNA, 22 bp, Homo sapiens
taggtggttataaattcaaggc

SEQ ID NO: 7097685 - DNA, 22 bp, Homo sapiens
taggtggttatgtcagcctaga

SEQ ID NO: 7097686 - DNA, 17 bp, Homo sapiens
taggtggttgctggtct

SEQ ID NO: 7097687 - DNA, 22 bp, Homo sapiens
taggtggttgtctgctttccta

SEQ ID NO: 7097688 - DNA, 22 bp, Homo sapiens
taggtggttgtctgctttccta

SEQ ID NO: 7097689 - DNA, 22 bp, Homo sapiens
tataaatgcacttttgaaatat

SEQ ID NO: 7097690 - DNA, 22 bp, Homo sapiens
tataaatgcacttttgaaatat

SEQ ID NO: 7097691 - DNA, 22 bp, Homo sapiens
tataaagtttcgaaagatgtat

SEQ ID NO: 7097692 - DNA, 22 bp, Homo sapiens
tataaatctttgttcctagaat

SEQ ID NO: 7097693 - DNA, 22 bp, Homo sapiens
taggtgtcttgtgtatggtaca

SEQ ID NO: 7097694 - DNA, 22 bp, Homo sapiens
taggtgtctttctgtccttgtt

SEQ ID NO: 7097695 - DNA, 22 bp, Homo sapiens
tataaagtttcgaaagatgtat

SEQ ID NO: 7097696 - DNA, 22 bp, Homo sapiens
tataaatgcacttttgaaatat

SEQ ID NO: 7097697 - DNA, 22 bp, Homo sapiens
tataaatgccaggactttagat

SEQ ID NO: 7097698 - DNA, 22 bp, Homo sapiens
tataaatgccaggactttagat

SEQ ID NO: 7097699 - DNA, 22 bp, Homo sapiens
tataaattaatgtgcccatgag

SEQ ID NO: 7097700 - DNA, 20 bp, Homo sapiens
tataaattcagagctttggt

SEQ ID NO: 7097701 - DNA, 20 bp, Homo sapiens
tataaattcagagctttggt

SEQ ID NO: 7097702 - DNA, 21 bp, Homo sapiens
tataacacacttcagcttctc

SEQ ID NO: 7097703 - DNA, 22 bp, Homo sapiens
tataaattattaggctgctaaa

SEQ ID NO: 7097704 - DNA, 22 bp, Homo sapiens
tataagaaacaaggcaaatttt

SEQ ID NO: 7097705 - DNA, 22 bp, Homo sapiens
tataagaaacaaggcaaatttt

SEQ ID NO: 7097706 - DNA, 22 bp, Homo sapiens
tataatttatcatgtcacagtt

SEQ ID NO: 7097707 - DNA, 22 bp, Homo sapiens
tataactacttgaagagttcag

SEQ ID NO: 7097708 - DNA, 22 bp, Homo sapiens
tataactgagaagatacatagt

SEQ ID NO: 7097709 - DNA, 22 bp, Homo sapiens
tataacactcagaaagaatcat

SEQ ID NO: 7097710 - DNA, 22 bp, Homo sapiens
tataacaggaagtattcaaaca

SEQ ID NO: 7097711 - DNA, 22 bp, Homo sapiens
tataacactcagaaagaatcat

SEQ ID NO: 7097712 - DNA, 22 bp, Homo sapiens
tataacactcagaaagaatcat

SEQ ID NO: 7097713 - DNA, 22 bp, Homo sapiens
tataacaggaagtattcaaaca

SEQ ID NO: 7097714 - DNA, 22 bp, Homo sapiens
tataacaggaagtattcaaaca

SEQ ID NO: 7097715 - DNA, 22 bp, Homo sapiens
tatacaatggctgaatcatcca

SEQ ID NO: 7097716 - DNA, 22 bp, Homo sapiens
tatacacaaacaaggggttaag

SEQ ID NO: 7097717 - DNA, 22 bp, Homo sapiens
tatacaatggctgaatcatcca

SEQ ID NO: 7097718 - DNA, 22 bp, Homo sapiens
tatacaatggctgaatcatcca

SEQ ID NO: 7097719 - DNA, 22 bp, Homo sapiens
tatacaatgagtacattctggg

SEQ ID NO: 7097720 - DNA, 22 bp, Homo sapiens
tatacaatggctgaatcatcca

SEQ ID NO: 7097721 - DNA, 22 bp, Homo sapiens
tatacaatggctgaatcatcca

SEQ ID NO: 7097722 - DNA, 22 bp, Homo sapiens
tatacacaaggtgtgcatttgt

SEQ ID NO: 7097723 - DNA, 22 bp, Homo sapiens
tatacacacatgctccggcctt

SEQ ID NO: 7097724 - DNA, 22 bp, Homo sapiens
tatacacaaggtgtgcatttgt

SEQ ID NO: 7097725 - DNA, 22 bp, Homo sapiens
tatacacaaggtgtgcatttgt

SEQ ID NO: 7097726 - DNA, 22 bp, Homo sapiens
tatacacaaggtgtgcatttgt

SEQ ID NO: 7097727 - DNA, 22 bp, Homo sapiens
tatacacacctccaaagcagga

SEQ ID NO: 7097728 - DNA, 22 bp, Homo sapiens
tatacacacctccaaagcagga

SEQ ID NO: 7097729 - DNA, 22 bp, Homo sapiens
tatacacacctccaaagcagga

SEQ ID NO: 7097730 - DNA, 22 bp, Homo sapiens
tataatttatcatgtcacagtt

SEQ ID NO: 7097731 - DNA, 22 bp, Homo sapiens
tataatttatcatgtcacagtt

SEQ ID NO: 7097732 - DNA, 22 bp, Homo sapiens
tataatttatcatgtcacagtt

SEQ ID NO: 7097733 - DNA, 22 bp, Homo sapiens
tataatttatcatgtcacagtt

SEQ ID NO: 7097734 - DNA, 22 bp, Homo sapiens
tataatttggggaaagtggtgt

SEQ ID NO: 7097735 - DNA, 22 bp, Homo sapiens
tataatttggggaaagtggtgt

SEQ ID NO: 7097736 - DNA, 22 bp, Homo sapiens
tataatttggggaaagtggtgt

SEQ ID NO: 7097737 - DNA, 22 bp, Homo sapiens
tataatttggggaaagtggtgt

SEQ ID NO: 7097738 - DNA, 22 bp, Homo sapiens
tataatttggggaaagtggtgt

SEQ ID NO: 7097739 - DNA, 22 bp, Homo sapiens
tataatttggggaaagtggtgt

SEQ ID NO: 7097740 - DNA, 22 bp, Homo sapiens
tataatttggggaaagtggtgt

SEQ ID NO: 7097741 - DNA, 22 bp, Homo sapiens
tataattttaagtggtaaatta

SEQ ID NO: 7097742 - DNA, 22 bp, Homo sapiens
tataattttaagtggtaaatta

SEQ ID NO: 7097743 - DNA, 22 bp, Homo sapiens
tataattttaagtggtaaatta

SEQ ID NO: 7097744 - DNA, 22 bp, Homo sapiens
tataattttaagtggtaaatta

SEQ ID NO: 7097745 - DNA, 22 bp, Homo sapiens
tataattttaagtggtaaatta

SEQ ID NO: 7097746 - DNA, 22 bp, Homo sapiens
tataattttagaagagatggaa

SEQ ID NO: 7097747 - DNA, 22 bp, Homo sapiens
tataattttagaagagatggaa

SEQ ID NO: 7097748 - DNA, 22 bp, Homo sapiens
tataattttagaagagatggaa

SEQ ID NO: 7097749 - DNA, 22 bp, Homo sapiens
tataattttagaagagatggaa

SEQ ID NO: 7097750 - DNA, 22 bp, Homo sapiens
tataatttttctgtggccagtt

SEQ ID NO: 7097751 - DNA, 22 bp, Homo sapiens
tataatttttctgtggccagtt

SEQ ID NO: 7097752 - DNA, 22 bp, Homo sapiens
tataatttttctgtggccagtt

SEQ ID NO: 7097753 - DNA, 22 bp, Homo sapiens
tataatttttctgtggccagtt

SEQ ID NO: 7097754 - DNA, 22 bp, Homo sapiens
tatacaagtaatgctgaatgat

SEQ ID NO: 7097755 - DNA, 22 bp, Homo sapiens
tatacaatgagtacattctggg

SEQ ID NO: 7097756 - DNA, 22 bp, Homo sapiens
tatacacatatacgtttgtgtg

SEQ ID NO: 7097757 - DNA, 22 bp, Homo sapiens
tatacacatatacgtttgtgtg

SEQ ID NO: 7097758 - DNA, 22 bp, Homo sapiens
tatacacatatcttctaggcct

SEQ ID NO: 7097759 - DNA, 22 bp, Homo sapiens
tatacacaggaatctgtgaaaa

SEQ ID NO: 7097760 - DNA, 17 bp, Homo sapiens
tatacacagacagactg

SEQ ID NO: 7097761 - DNA, 17 bp, Homo sapiens
tatacacagacagactg

SEQ ID NO: 7097762 - DNA, 22 bp, Homo sapiens
tatacacatcctccaaagatag

SEQ ID NO: 7097763 - DNA, 22 bp, Homo sapiens
tatacacatcctccaaagatag

SEQ ID NO: 7097764 - DNA, 22 bp, Homo sapiens
tatacacatcctccaaagatag

SEQ ID NO: 7097765 - DNA, 23 bp, Homo sapiens
tatacacatgtggcagtatagtg

SEQ ID NO: 7097766 - DNA, 23 bp, Homo sapiens
tatacacatgtggcagtatagtg

SEQ ID NO: 7097767 - DNA, 23 bp, Homo sapiens
tatacacatgtggcagtatagtg

SEQ ID NO: 7097768 - DNA, 23 bp, Homo sapiens
tatacacatgtggcagtatagtg

SEQ ID NO: 7097769 - DNA, 22 bp, Homo sapiens
tatacacatgtgtgtattcata

SEQ ID NO: 7097770 - DNA, 22 bp, Homo sapiens
tatacacatgtgtgtattcata

SEQ ID NO: 7097771 - DNA, 22 bp, Homo sapiens
tatacacatgtgtgtattcata

SEQ ID NO: 7097772 - DNA, 22 bp, Homo sapiens
tatacacatgtgtgtattcata

SEQ ID NO: 7097773 - DNA, 22 bp, Homo sapiens
tatacacattacagtttcagga

SEQ ID NO: 7097774 - DNA, 22 bp, Homo sapiens
tatacacattacagtttcagga

SEQ ID NO: 7097775 - DNA, 22 bp, Homo sapiens
tatacacattacagtttcagga

SEQ ID NO: 7097776 - DNA, 22 bp, Homo sapiens
tatacacatttttacctatagt

SEQ ID NO: 7097777 - DNA, 22 bp, Homo sapiens
tatacagaaagaattcaagtct

SEQ ID NO: 7097778 - DNA, 22 bp, Homo sapiens
tatacagaacattaagaactgt

SEQ ID NO: 7097779 - DNA, 22 bp, Homo sapiens
tatagcaattcagaatacatgt

SEQ ID NO: 7097780 - DNA, 22 bp, Homo sapiens
taggatatgcatttttatacat

SEQ ID NO: 7097781 - DNA, 22 bp, Homo sapiens
taggatctatttgtatttcagg

SEQ ID NO: 7097782 - DNA, 22 bp, Homo sapiens
taggatctcaccatagaaggaa

SEQ ID NO: 7097783 - DNA, 22 bp, Homo sapiens
taggatatgtgaaatcatatta

SEQ ID NO: 7097784 - DNA, 22 bp, Homo sapiens
taggatatgtgaaatcatatta

SEQ ID NO: 7097785 - DNA, 22 bp, Homo sapiens
taggagtgcataaaactatatt

SEQ ID NO: 7097786 - DNA, 22 bp, Homo sapiens
taggagggttagagggaaatat

SEQ ID NO: 7097787 - DNA, 22 bp, Homo sapiens
taggagggttagagggaaatat

SEQ ID NO: 7097788 - DNA, 22 bp, Homo sapiens
taggagtcatttggtccctctt

SEQ ID NO: 7097789 - DNA, 22 bp, Homo sapiens
taggatatggtagaaatcattc

SEQ ID NO: 7097790 - DNA, 22 bp, Homo sapiens
taggatttaggctttaacatct

SEQ ID NO: 7097791 - DNA, 22 bp, Homo sapiens
taggatggtacaaggcaggggt

SEQ ID NO: 7097792 - DNA, 22 bp, Homo sapiens
taggatggtcacagagatggac

SEQ ID NO: 7097793 - DNA, 22 bp, Homo sapiens
taggatgtagctatgtcatcat

SEQ ID NO: 7097794 - DNA, 22 bp, Homo sapiens
taggatgtgccaggaaagaaag

SEQ ID NO: 7097795 - DNA, 22 bp, Homo sapiens
taggattccagaacagtgctgc

SEQ ID NO: 7097796 - DNA, 22 bp, Homo sapiens
taggacaggtgaggggctgtgg

SEQ ID NO: 7097797 - DNA, 22 bp, Homo sapiens
taggacaggtgaggggctgtgg

SEQ ID NO: 7097798 - DNA, 22 bp, Homo sapiens
taggaaacaaagcttagcagga

SEQ ID NO: 7097799 - DNA, 22 bp, Homo sapiens
taggaaaatatctcttattggg

SEQ ID NO: 7097800 - DNA, 22 bp, Homo sapiens
taggagggggaacaaggcatac

SEQ ID NO: 7097801 - DNA, 22 bp, Homo sapiens
taggagggggaacaaggcatac

SEQ ID NO: 7097802 - DNA, 22 bp, Homo sapiens
taggagggggaacaaggcatac

SEQ ID NO: 7097803 - DNA, 22 bp, Homo sapiens
taggagggccctgaaaatggca

SEQ ID NO: 7097804 - DNA, 22 bp, Homo sapiens
taggacagtttactttggttac

SEQ ID NO: 7097805 - DNA, 22 bp, Homo sapiens
taggacagtttactttggttac

SEQ ID NO: 7097806 - DNA, 22 bp, Homo sapiens
taggacaggtgaggggctgtgg

SEQ ID NO: 7097807 - DNA, 22 bp, Homo sapiens
taggacagtagctggtgcacag

SEQ ID NO: 7097808 - DNA, 22 bp, Homo sapiens
taggacagtagctggtgcacag

SEQ ID NO: 7097809 - DNA, 22 bp, Homo sapiens
taggacagtagctggtgcacag

SEQ ID NO: 7097810 - DNA, 22 bp, Homo sapiens
taggacagtagctggtgcacag

SEQ ID NO: 7097811 - DNA, 22 bp, Homo sapiens
taggacagtggagataaccaga

SEQ ID NO: 7097812 - DNA, 22 bp, Homo sapiens
taggacagtggagataaccaga

SEQ ID NO: 7097813 - DNA, 22 bp, Homo sapiens
taggacagtggagataaccaga

SEQ ID NO: 7097814 - DNA, 22 bp, Homo sapiens
taggacagttatgggttttatt

SEQ ID NO: 7097815 - DNA, 22 bp, Homo sapiens
taggacagttatgggttttatt

SEQ ID NO: 7097816 - DNA, 22 bp, Homo sapiens
taggacagtttactttggttac

SEQ ID NO: 7097817 - DNA, 22 bp, Homo sapiens
tagctttaggatggttctcttg

SEQ ID NO: 7097818 - DNA, 22 bp, Homo sapiens
tagctttagaaatattctcaga

SEQ ID NO: 7097819 - DNA, 22 bp, Homo sapiens
tagctttaccatagaagagtat

SEQ ID NO: 7097820 - DNA, 22 bp, Homo sapiens
tagctttaccatagaagagtat

SEQ ID NO: 7097821 - DNA, 22 bp, Homo sapiens
tagctttacaaagtgctgcacc

SEQ ID NO: 7097822 - DNA, 22 bp, Homo sapiens
tagctttagtgaaaaatatcag

SEQ ID NO: 7097823 - DNA, 22 bp, Homo sapiens
tagctttaggcacgtttgaatt

SEQ ID NO: 7097824 - DNA, 22 bp, Homo sapiens
tagctttgaacttctgggctca

SEQ ID NO: 7097825 - DNA, 22 bp, Homo sapiens
tagctttgaagttatttaacag

SEQ ID NO: 7097826 - DNA, 22 bp, Homo sapiens
tagctttgacagttgcaggcag

SEQ ID NO: 7097827 - DNA, 22 bp, Homo sapiens
tagctttgaccaacgactggtc

SEQ ID NO: 7097828 - DNA, 22 bp, Homo sapiens
tagctttgcaaaggaagtttta

SEQ ID NO: 7097829 - DNA, 22 bp, Homo sapiens
tagctttgccacacatgtagat

SEQ ID NO: 7097830 - DNA, 22 bp, Homo sapiens
tagctttgccatctgtcacata

SEQ ID NO: 7097831 - DNA, 22 bp, Homo sapiens
tagctttgcccgtgctggattt

SEQ ID NO: 7097832 - DNA, 22 bp, Homo sapiens
tagctttgcctgaagtaatcag

SEQ ID NO: 7097833 - DNA, 22 bp, Homo sapiens
tagctttgcctgttaatcacaa

SEQ ID NO: 7097834 - DNA, 22 bp, Homo sapiens
tagctttgctggcaagcatgtc

SEQ ID NO: 7097835 - DNA, 22 bp, Homo sapiens
tagctttggattctttggggaa

SEQ ID NO: 7097836 - DNA, 22 bp, Homo sapiens
tagctttgggaatgctctcctg

SEQ ID NO: 7097837 - DNA, 22 bp, Homo sapiens
taggaaaaatacagaattatat

SEQ ID NO: 7097838 - DNA, 22 bp, Homo sapiens
taggaaaaatacagaattatat

SEQ ID NO: 7097839 - DNA, 22 bp, Homo sapiens
taggaaaaagaggctggcaagg

SEQ ID NO: 7097840 - DNA, 22 bp, Homo sapiens
tagctttgtttatcaaggggca

SEQ ID NO: 7097841 - DNA, 22 bp, Homo sapiens
tagctttgtattatcagcattg

SEQ ID NO: 7097842 - DNA, 22 bp, Homo sapiens
tagctttgtcctccaccctcag

SEQ ID NO: 7097843 - DNA, 22 bp, Homo sapiens
tagctttgtgaagtttacagac

SEQ ID NO: 7097844 - DNA, 22 bp, Homo sapiens
tagctttgtgtatgatgtctgt

SEQ ID NO: 7097845 - DNA, 22 bp, Homo sapiens
tagctttgtgtcctgatttagc

SEQ ID NO: 7097846 - DNA, 16 bp, Homo sapiens
tagctttgtgttgtgg

SEQ ID NO: 7097847 - DNA, 22 bp, Homo sapiens
tagctttgttagaatgtcttca

SEQ ID NO: 7097848 - DNA, 22 bp, Homo sapiens
taggaaaaatacagaattatat

SEQ ID NO: 7097849 - DNA, 22 bp, Homo sapiens
taggaaaacgtgattttctcac

SEQ ID NO: 7097850 - DNA, 22 bp, Homo sapiens
taggaaaacgtgattttctcac

SEQ ID NO: 7097851 - DNA, 22 bp, Homo sapiens
taggaaaagcacaggatgttct

SEQ ID NO: 7097852 - DNA, 22 bp, Homo sapiens
taggaaaagcacaggatgttct

SEQ ID NO: 7097853 - DNA, 22 bp, Homo sapiens
taggaaaagcacaggatgttct

SEQ ID NO: 7097854 - DNA, 22 bp, Homo sapiens
taggaaaagtctagattgatga

SEQ ID NO: 7097855 - DNA, 22 bp, Homo sapiens
taggaaaagtctagattgatga

SEQ ID NO: 7097856 - DNA, 22 bp, Homo sapiens
taggaaaagtctagattgatga

SEQ ID NO: 7097857 - DNA, 22 bp, Homo sapiens
taggaaaagtctagattgatga

SEQ ID NO: 7097858 - DNA, 22 bp, Homo sapiens
tagggcagagtccaggatgggc

SEQ ID NO: 7097859 - DNA, 22 bp, Homo sapiens
tagggcagagtccaggatgggc

SEQ ID NO: 7097860 - DNA, 22 bp, Homo sapiens
tagggcactatttgtgactgaa

SEQ ID NO: 7097861 - DNA, 22 bp, Homo sapiens
tagggcagagcttgtacacgat

SEQ ID NO: 7097862 - DNA, 22 bp, Homo sapiens
tagggcagagcttgtacacgat

SEQ ID NO: 7097863 - DNA, 22 bp, Homo sapiens
tagggcaatatttcccagaaaa

SEQ ID NO: 7097864 - DNA, 22 bp, Homo sapiens
tagggcaatatttcccagaaaa

SEQ ID NO: 7097865 - DNA, 22 bp, Homo sapiens
tagggcaatatttcccagaaaa

SEQ ID NO: 7097866 - DNA, 22 bp, Homo sapiens
tagggcaatatttcccagaaaa

SEQ ID NO: 7097867 - DNA, 22 bp, Homo sapiens
tagggaggctacttcttgtagg

SEQ ID NO: 7097868 - DNA, 22 bp, Homo sapiens
tagggaggctacttcttgtagg

SEQ ID NO: 7097869 - DNA, 22 bp, Homo sapiens
tagggaggctacttcttgtagg

SEQ ID NO: 7097870 - DNA, 22 bp, Homo sapiens
tagggaggagggttttcaaatc

SEQ ID NO: 7097871 - DNA, 22 bp, Homo sapiens
tagggaggagggttttcaaatc

SEQ ID NO: 7097872 - DNA, 22 bp, Homo sapiens
tagggaggctacttcttgtagg

SEQ ID NO: 7097873 - DNA, 22 bp, Homo sapiens
tagggagatgcaagggacggag

SEQ ID NO: 7097874 - DNA, 22 bp, Homo sapiens
tagggagatgcaagggacggag

SEQ ID NO: 7097875 - DNA, 22 bp, Homo sapiens
tagggagctctggcagaaggaa

SEQ ID NO: 7097876 - DNA, 22 bp, Homo sapiens
tagggaggagggttttcaaatc

SEQ ID NO: 7097877 - DNA, 22 bp, Homo sapiens
tagggagtgcgtagcagggtgg

SEQ ID NO: 7097878 - DNA, 22 bp, Homo sapiens
tagggatgacgaaaggacagag

SEQ ID NO: 7097879 - DNA, 22 bp, Homo sapiens
taggctgggcattctggccagg

SEQ ID NO: 7097880 - DNA, 22 bp, Homo sapiens
taggctgggcattctggccagg

SEQ ID NO: 7097881 - DNA, 22 bp, Homo sapiens
taggctgggagcctgaggctag

SEQ ID NO: 7097882 - DNA, 22 bp, Homo sapiens
taggcagaaaggaaggcaagtt

SEQ ID NO: 7097883 - DNA, 22 bp, Homo sapiens
taggcactggggaggcagcatg

SEQ ID NO: 7097884 - DNA, 22 bp, Homo sapiens
taggcacttaataaatggtata

SEQ ID NO: 7097885 - DNA, 20 bp, Homo sapiens
tagggagatatgctcttttc

SEQ ID NO: 7097886 - DNA, 22 bp, Homo sapiens
tagggagatgcaagggacggag

SEQ ID NO: 7097887 - DNA, 22 bp, Homo sapiens
tagggagaggaagcaggccgct

SEQ ID NO: 7097888 - DNA, 22 bp, Homo sapiens
tagggactagtttcaaggctaa

SEQ ID NO: 7097889 - DNA, 22 bp, Homo sapiens
tagggagaaacaccaatttatt

SEQ ID NO: 7097890 - DNA, 22 bp, Homo sapiens
taggctgggcctgccttccagg

SEQ ID NO: 7097891 - DNA, 22 bp, Homo sapiens
tagggagaaacaccaatttatt

SEQ ID NO: 7097892 - DNA, 22 bp, Homo sapiens
tagggactagtttcaaggctaa

SEQ ID NO: 7097893 - DNA, 22 bp, Homo sapiens
taggatttattctacaatattg

SEQ ID NO: 7097894 - DNA, 22 bp, Homo sapiens
taggatttggctttagtcaggt

SEQ ID NO: 7097895 - DNA, 22 bp, Homo sapiens
taggattttaacccacctctga

SEQ ID NO: 7097896 - DNA, 22 bp, Homo sapiens
taggattttttggattctggat

SEQ ID NO: 7097897 - DNA, 22 bp, Homo sapiens
taggcaacatgtcgaatactgt

SEQ ID NO: 7097898 - DNA, 22 bp, Homo sapiens
taggcaatattagactttgtct

SEQ ID NO: 7097899 - DNA, 20 bp, Homo sapiens
taggcaattagtagataaca

SEQ ID NO: 7097900 - DNA, 21 bp, Homo sapiens
taggcaatttgttgtcatagc

SEQ ID NO: 7097901 - DNA, 22 bp, Homo sapiens
taggcacaaaatgaaaatggca

SEQ ID NO: 7097902 - DNA, 22 bp, Homo sapiens
taggcacaaaatgaaaatggca

SEQ ID NO: 7097903 - DNA, 22 bp, Homo sapiens
taggcacaagaccatgcaaagg

SEQ ID NO: 7097904 - DNA, 22 bp, Homo sapiens
taggcacaagaccatgcaaagg

SEQ ID NO: 7097905 - DNA, 22 bp, Homo sapiens
taggcactagacatggttacca

SEQ ID NO: 7097906 - DNA, 22 bp, Homo sapiens
taggcaccacctagggtgaccc

SEQ ID NO: 7097907 - DNA, 22 bp, Homo sapiens
taggcactgaggggagcaaggt

SEQ ID NO: 7097908 - DNA, 22 bp, Homo sapiens
taggcactgaggggagcaaggt

SEQ ID NO: 7097909 - DNA, 22 bp, Homo sapiens
taggcactgggctaggacaggt

SEQ ID NO: 7097910 - DNA, 22 bp, Homo sapiens
tagcccctgcctttgaacctgg

SEQ ID NO: 7097911 - DNA, 22 bp, Homo sapiens
tagcccctgcctttgaacctgg

SEQ ID NO: 7097912 - DNA, 22 bp, Homo sapiens
tagcccctgcctttgaacctgg

SEQ ID NO: 7097913 - DNA, 22 bp, Homo sapiens
tagccccagctactcggaagct

SEQ ID NO: 7097914 - DNA, 22 bp, Homo sapiens
tagccccagctactcggaagct

SEQ ID NO: 7097915 - DNA, 22 bp, Homo sapiens
tagccccagctactcggaagct

SEQ ID NO: 7097916 - DNA, 22 bp, Homo sapiens
tagcccctgcctttgaacctgg

SEQ ID NO: 7097917 - DNA, 22 bp, Homo sapiens
tagcccctgcctttgaacctgg

SEQ ID NO: 7097918 - DNA, 22 bp, Homo sapiens
tagccctcagcttggagcgtgg

SEQ ID NO: 7097919 - DNA, 22 bp, Homo sapiens
tagccctcatctgctcaaaagg

SEQ ID NO: 7097920 - DNA, 22 bp, Homo sapiens
tagccctctccagcgaggtctg

SEQ ID NO: 7097921 - DNA, 21 bp, Homo sapiens
tagcccttctccacctcgccc

SEQ ID NO: 7097922 - DNA, 19 bp, Homo sapiens
tagccctggccatcatgag

SEQ ID NO: 7097923 - DNA, 22 bp, Homo sapiens
tagcccttttctgagcccacat

SEQ ID NO: 7097924 - DNA, 22 bp, Homo sapiens
tagccctggagcagggaaatac

SEQ ID NO: 7097925 - DNA, 21 bp, Homo sapiens
tagccctctctgtctgtgtac

SEQ ID NO: 7097926 - DNA, 22 bp, Homo sapiens
tagcagctatgccattttgaca

SEQ ID NO: 7097927 - DNA, 22 bp, Homo sapiens
tagcagctcacagcctcccatt

SEQ ID NO: 7097928 - DNA, 22 bp, Homo sapiens
tagcagctcactaactctgcgt

SEQ ID NO: 7097929 - DNA, 22 bp, Homo sapiens
tagcagctcactaactctgcgt

SEQ ID NO: 7097930 - DNA, 22 bp, Homo sapiens
tagcagctccatttctctggca

SEQ ID NO: 7097931 - DNA, 22 bp, Homo sapiens
tagcagctccatttctctggca

SEQ ID NO: 7097932 - DNA, 22 bp, Homo sapiens
tagcagctcctaaacagtggtg

SEQ ID NO: 7097933 - DNA, 22 bp, Homo sapiens
tagcccagcatgagcagagctg

SEQ ID NO: 7097934 - DNA, 22 bp, Homo sapiens
tagcccagcatgagcagagctg

SEQ ID NO: 7097935 - DNA, 22 bp, Homo sapiens
tagcccagcatgagcagagctg

SEQ ID NO: 7097936 - DNA, 22 bp, Homo sapiens
tagcccagcatgagcagagctg

SEQ ID NO: 7097937 - DNA, 22 bp, Homo sapiens
tagcccagctaactcggtgagc

SEQ ID NO: 7097938 - DNA, 22 bp, Homo sapiens
tagcccagctaactcggtgagc

SEQ ID NO: 7097939 - DNA, 22 bp, Homo sapiens
tagcccagctcaaatgaccggt

SEQ ID NO: 7097940 - DNA, 22 bp, Homo sapiens
tagcccagctcaaatgaccggt

SEQ ID NO: 7097941 - DNA, 22 bp, Homo sapiens
tagcccagctcaaatgaccggt

SEQ ID NO: 7097942 - DNA, 22 bp, Homo sapiens
tagcccagcttggcctatttct

SEQ ID NO: 7097943 - DNA, 22 bp, Homo sapiens
tagcccaggagaattgtctttc

SEQ ID NO: 7097944 - DNA, 22 bp, Homo sapiens
tagcccaggagaattgtctttc

SEQ ID NO: 7097945 - DNA, 22 bp, Homo sapiens
tagcccaggctggagggcagtg

SEQ ID NO: 7097946 - DNA, 22 bp, Homo sapiens
tagcccaggctggagggcagtg

SEQ ID NO: 7097947 - DNA, 22 bp, Homo sapiens
tagcccaggctggagggcagtg

SEQ ID NO: 7097948 - DNA, 22 bp, Homo sapiens
tagcccaggctggagtgcaggg

SEQ ID NO: 7097949 - DNA, 22 bp, Homo sapiens
tagcccaggctggagtgcaggg

SEQ ID NO: 7097950 - DNA, 22 bp, Homo sapiens
tagcccaggctggagtgcaggg

SEQ ID NO: 7097951 - DNA, 22 bp, Homo sapiens
tagcccaggctgtagtgcagtg

SEQ ID NO: 7097952 - DNA, 22 bp, Homo sapiens
tagcccaggctgtagtgcagtg

SEQ ID NO: 7097953 - DNA, 22 bp, Homo sapiens
tagcccaggctgtagtgcagtg

SEQ ID NO: 7097954 - DNA, 22 bp, Homo sapiens
tagctcttaccaggtggccatg

SEQ ID NO: 7097955 - DNA, 22 bp, Homo sapiens
tagctcttaggtgcgtggctct

SEQ ID NO: 7097956 - DNA, 19 bp, Homo sapiens
tagctctgtcttattccaa

SEQ ID NO: 7097957 - DNA, 22 bp, Homo sapiens
tagctctgtgctctggatctgt

SEQ ID NO: 7097958 - DNA, 22 bp, Homo sapiens
tagctctgtggatctttttaag

SEQ ID NO: 7097959 - DNA, 22 bp, Homo sapiens
tagctctgaggccatctccggt

SEQ ID NO: 7097960 - DNA, 22 bp, Homo sapiens
tagctctgccaaatggaggctg

SEQ ID NO: 7097961 - DNA, 22 bp, Homo sapiens
tagctctggagtcttctcagaa

SEQ ID NO: 7097962 - DNA, 22 bp, Homo sapiens
tagctctggcattctttccaaa

SEQ ID NO: 7097963 - DNA, 22 bp, Homo sapiens
tagcctatagtttctgctaaga

SEQ ID NO: 7097964 - DNA, 22 bp, Homo sapiens
tagcctatcttcactaagagca

SEQ ID NO: 7097965 - DNA, 22 bp, Homo sapiens
tagcctctctcctccacaacct

SEQ ID NO: 7097966 - DNA, 22 bp, Homo sapiens
tagcctctggaatcctttctct

SEQ ID NO: 7097967 - DNA, 22 bp, Homo sapiens
tagcgaggtgtttctaggactg

SEQ ID NO: 7097968 - DNA, 22 bp, Homo sapiens
tagctcctggtgagcctactct

SEQ ID NO: 7097969 - DNA, 22 bp, Homo sapiens
tagctctagcactggataatcc

SEQ ID NO: 7097970 - DNA, 22 bp, Homo sapiens
tagctctctctatatgagtgac

SEQ ID NO: 7097971 - DNA, 22 bp, Homo sapiens
tagctctctttatctttctata

SEQ ID NO: 7097972 - DNA, 22 bp, Homo sapiens
tagctctgaccaagagactgag

SEQ ID NO: 7097973 - DNA, 22 bp, Homo sapiens
tagctcttgccatctgtcttat

SEQ ID NO: 7097974 - DNA, 22 bp, Homo sapiens
tagctctttattaaggcccaga

SEQ ID NO: 7097975 - DNA, 22 bp, Homo sapiens
tagctcttgtgttttacatata

SEQ ID NO: 7097976 - DNA, 22 bp, Homo sapiens
tagctctttgagattggttctt

SEQ ID NO: 7097977 - DNA, 22 bp, Homo sapiens
tagctgaagagggtattgtagg

SEQ ID NO: 7097978 - DNA, 22 bp, Homo sapiens
tagctgaaggctacagcagaac

SEQ ID NO: 7097979 - DNA, 22 bp, Homo sapiens
tagctgaagggcatttaataaa

SEQ ID NO: 7097980 - DNA, 22 bp, Homo sapiens
tagctgaagggcatttaataaa

SEQ ID NO: 7097981 - DNA, 22 bp, Homo sapiens
tagctgaagggcatttaataaa

SEQ ID NO: 7097982 - DNA, 22 bp, Homo sapiens
tagctgaatgccttggattttt

SEQ ID NO: 7097983 - DNA, 22 bp, Homo sapiens
tagctgaatgccttggattttt

SEQ ID NO: 7097984 - DNA, 22 bp, Homo sapiens
tagctttaatgagttggtaaga

SEQ ID NO: 7097985 - DNA, 22 bp, Homo sapiens
tagctttaatgagttggtaaga

SEQ ID NO: 7097986 - DNA, 22 bp, Homo sapiens
tagctttaatgagttggtaaga

SEQ ID NO: 7097987 - DNA, 22 bp, Homo sapiens
tagctttaatgagttggtaaga

SEQ ID NO: 7097988 - DNA, 22 bp, Homo sapiens
tagcttaaaccaatctgaataa

SEQ ID NO: 7097989 - DNA, 22 bp, Homo sapiens
tagaggtagcaacaggactaga

SEQ ID NO: 7097990 - DNA, 22 bp, Homo sapiens
tagaggtagatggtcagccaat

SEQ ID NO: 7097991 - DNA, 22 bp, Homo sapiens
tagaggtagagttacattagtc

SEQ ID NO: 7097992 - DNA, 22 bp, Homo sapiens
tagaggtactcccctcaaagtt

SEQ ID NO: 7097993 - DNA, 22 bp, Homo sapiens
tagagggttattaggacagaag

SEQ ID NO: 7097994 - DNA, 18 bp, Homo sapiens
tagagggggcctgggcat

SEQ ID NO: 7097995 - DNA, 18 bp, Homo sapiens
tagaggggaagaccttta

SEQ ID NO: 7097996 - DNA, 22 bp, Homo sapiens
tagaggggaatctgcctcctct

SEQ ID NO: 7097997 - DNA, 22 bp, Homo sapiens
tagaggggaatctgcctcctct

SEQ ID NO: 7097998 - DNA, 20 bp, Homo sapiens
tagaggggacaatcattgcc

SEQ ID NO: 7097999 - DNA, 18 bp, Homo sapiens
tagagggggcctgggcat

SEQ ID NO: 7098000 - DNA, 22 bp, Homo sapiens
tagaggtgagccatcaaggggc

SEQ ID NO: 7098001 - DNA, 22 bp, Homo sapiens
tagaggtgagattgtggtgctg

SEQ ID NO: 7098002 - DNA, 22 bp, Homo sapiens
tagaggtgagatattttatttt

SEQ ID NO: 7098003 - DNA, 22 bp, Homo sapiens
tagaggtgagatattttatttt

SEQ ID NO: 7098004 - DNA, 22 bp, Homo sapiens
tagaggtgagaggaactttgga

SEQ ID NO: 7098005 - DNA, 22 bp, Homo sapiens
tagaggtgagaggaactttgga

SEQ ID NO: 7098006 - DNA, 22 bp, Homo sapiens
tagaggtgagatattttatttt

SEQ ID NO: 7098007 - DNA, 22 bp, Homo sapiens
tagaggtgagacttcagtgaca

SEQ ID NO: 7098008 - DNA, 22 bp, Homo sapiens
tagaggtgacactgagaccata

SEQ ID NO: 7098009 - DNA, 22 bp, Homo sapiens
tagaggtatttttgatggtcat

SEQ ID NO: 7098010 - DNA, 22 bp, Homo sapiens
tagaggtataccaaaaaggcat

SEQ ID NO: 7098011 - DNA, 22 bp, Homo sapiens
tagaggtgttgttgatatagaa

SEQ ID NO: 7098012 - DNA, 22 bp, Homo sapiens
tagaggttgacagtgactgtga

SEQ ID NO: 7098013 - DNA, 22 bp, Homo sapiens
tagagtaaatagtatgagaaag

SEQ ID NO: 7098014 - DNA, 22 bp, Homo sapiens
tagcagaaccagtcagtgagcc

SEQ ID NO: 7098015 - DNA, 22 bp, Homo sapiens
tagcagaaccagtcagtgagcc

SEQ ID NO: 7098016 - DNA, 22 bp, Homo sapiens
tagaggtgttgacgccaaggta

SEQ ID NO: 7098017 - DNA, 22 bp, Homo sapiens
tagaggtgttgttgatatagaa

SEQ ID NO: 7098018 - DNA, 22 bp, Homo sapiens
tagaggtgttcattctctccat

SEQ ID NO: 7098019 - DNA, 22 bp, Homo sapiens
tagaggtgtcactttgggaagt

SEQ ID NO: 7098020 - DNA, 20 bp, Homo sapiens
tagaggtgggatttgggttt

SEQ ID NO: 7098021 - DNA, 21 bp, Homo sapiens
tagcagagagttaacttctcc

SEQ ID NO: 7098022 - DNA, 22 bp, Homo sapiens
tagcagagaggggacagtggca

SEQ ID NO: 7098023 - DNA, 22 bp, Homo sapiens
tagcagagaggtttcagctaat

SEQ ID NO: 7098024 - DNA, 22 bp, Homo sapiens
tagcagagaggggacagtggca

SEQ ID NO: 7098025 - DNA, 22 bp, Homo sapiens
tagcagagaggggacagtggca

SEQ ID NO: 7098026 - DNA, 22 bp, Homo sapiens
tagcagaagttccaatgcatat

SEQ ID NO: 7098027 - DNA, 22 bp, Homo sapiens
tagcagaagaacaacatgatct

SEQ ID NO: 7098028 - DNA, 22 bp, Homo sapiens
tagcagaagaacaacatgatct

SEQ ID NO: 7098029 - DNA, 22 bp, Homo sapiens
tagcagaagaacaacatgatct

SEQ ID NO: 7098030 - DNA, 22 bp, Homo sapiens
tagcagaagttccaatgcatat

SEQ ID NO: 7098031 - DNA, 22 bp, Homo sapiens
tagcagaagttccaatgcatat

SEQ ID NO: 7098032 - DNA, 22 bp, Homo sapiens
tagcagactttgtgtctggttt

SEQ ID NO: 7098033 - DNA, 22 bp, Homo sapiens
tagcagagaggggacagtggca

SEQ ID NO: 7098034 - DNA, 22 bp, Homo sapiens
tagcagaggctgtctgacttaa

SEQ ID NO: 7098035 - DNA, 22 bp, Homo sapiens
tagcagaggctactgctccttg

SEQ ID NO: 7098036 - DNA, 22 bp, Homo sapiens
tagcagaggctgtctgacttaa

SEQ ID NO: 7098037 - DNA, 22 bp, Homo sapiens
tagcagaggctactgctccttg

SEQ ID NO: 7098038 - DNA, 22 bp, Homo sapiens
tagcagagctgggactagatta

SEQ ID NO: 7098039 - DNA, 22 bp, Homo sapiens
tagcagaggaaaagagaacatt

SEQ ID NO: 7098040 - DNA, 22 bp, Homo sapiens
tagcagaggaaaagagaacatt

SEQ ID NO: 7098041 - DNA, 22 bp, Homo sapiens
tagcagaggaaaagagaacatt

SEQ ID NO: 7098042 - DNA, 22 bp, Homo sapiens
tagcagaggaaatccagagtaa

SEQ ID NO: 7098043 - DNA, 19 bp, Homo sapiens
tagcagagatgactccagc

SEQ ID NO: 7098044 - DNA, 22 bp, Homo sapiens
tagcagagtagtgcctccagat

SEQ ID NO: 7098045 - DNA, 22 bp, Homo sapiens
tagcagagtatcttgcaaatta

SEQ ID NO: 7098046 - DNA, 17 bp, Homo sapiens
tagcagcagtaattgtg

SEQ ID NO: 7098047 - DNA, 22 bp, Homo sapiens
tagcagcagtggtgtatttaga

SEQ ID NO: 7098048 - DNA, 22 bp, Homo sapiens
tagcagcccagtttctggccaa

SEQ ID NO: 7098049 - DNA, 22 bp, Homo sapiens
tagcagctacctggctaagagt

SEQ ID NO: 7098050 - DNA, 22 bp, Homo sapiens
tagcagcatttttgtagagtat

SEQ ID NO: 7098051 - DNA, 23 bp, Homo sapiens
tagcagcatttttagcctctgtc

SEQ ID NO: 7098052 - DNA, 23 bp, Homo sapiens
tagcagcatttttagcctctgtc

SEQ ID NO: 7098053 - DNA, 22 bp, Homo sapiens
tagcagcatcctgtggtgatgg

SEQ ID NO: 7098054 - DNA, 22 bp, Homo sapiens
tagcagcatcctgtggtgatgg

SEQ ID NO: 7098055 - DNA, 22 bp, Homo sapiens
tagcagcatgtaagtgagtaga

SEQ ID NO: 7098056 - DNA, 22 bp, Homo sapiens
tagacaatgccatcttgtggtt

SEQ ID NO: 7098057 - DNA, 22 bp, Homo sapiens
tagacacaaatctcagtgacac

SEQ ID NO: 7098058 - DNA, 22 bp, Homo sapiens
tagacacaaatctcagtgacac

SEQ ID NO: 7098059 - DNA, 22 bp, Homo sapiens
tagacacaaatctcagtgacac

SEQ ID NO: 7098060 - DNA, 22 bp, Homo sapiens
tagacacatcaaggatcagttt

SEQ ID NO: 7098061 - DNA, 22 bp, Homo sapiens
tagacacaggggaatgtgaggt

SEQ ID NO: 7098062 - DNA, 22 bp, Homo sapiens
tagacacatacccttgcccaaa

SEQ ID NO: 7098063 - DNA, 22 bp, Homo sapiens
tagacacatacccttgcccaaa

SEQ ID NO: 7098064 - DNA, 22 bp, Homo sapiens
tagacacatacccttgcccaaa

SEQ ID NO: 7098065 - DNA, 22 bp, Homo sapiens
tagacacaagagaagggtataa

SEQ ID NO: 7098066 - DNA, 22 bp, Homo sapiens
tagacacaagagaagggtataa

SEQ ID NO: 7098067 - DNA, 22 bp, Homo sapiens
tagacacaagagaagggtataa

SEQ ID NO: 7098068 - DNA, 22 bp, Homo sapiens
tagacacaagagaagggtataa

SEQ ID NO: 7098069 - DNA, 22 bp, Homo sapiens
tagacacaggggaatgtgaggt

SEQ ID NO: 7098070 - DNA, 22 bp, Homo sapiens
tagacaaaagggggcagatatg

SEQ ID NO: 7098071 - DNA, 22 bp, Homo sapiens
tagacaaaagggggcagatatg

SEQ ID NO: 7098072 - DNA, 22 bp, Homo sapiens
tagaattttctgctttgatagt

SEQ ID NO: 7098073 - DNA, 22 bp, Homo sapiens
tagacaaactgatacttggcga

SEQ ID NO: 7098074 - DNA, 22 bp, Homo sapiens
tagacaaactgatacttggcga

SEQ ID NO: 7098075 - DNA, 22 bp, Homo sapiens
tagacaaactgatacttggcga

SEQ ID NO: 7098076 - DNA, 22 bp, Homo sapiens
tagacaactggagatagtctga

SEQ ID NO: 7098077 - DNA, 22 bp, Homo sapiens
tagacaatatttgaaagtagtg

SEQ ID NO: 7098078 - DNA, 22 bp, Homo sapiens
tagaatttcatgtatgttgggg

SEQ ID NO: 7098079 - DNA, 22 bp, Homo sapiens
tagaattttctgctttgatagt

SEQ ID NO: 7098080 - DNA, 22 bp, Homo sapiens
tagaattttctgctttgatagt

SEQ ID NO: 7098081 - DNA, 22 bp, Homo sapiens
tagaatgagaaagtgtagcagg

SEQ ID NO: 7098082 - DNA, 22 bp, Homo sapiens
tagaatgacctcctcttagctt

SEQ ID NO: 7098083 - DNA, 22 bp, Homo sapiens
tagaatctttaaaattcatagt

SEQ ID NO: 7098084 - DNA, 22 bp, Homo sapiens
tagaaatggagaacagattaat

SEQ ID NO: 7098085 - DNA, 22 bp, Homo sapiens
tagaatctttaaaattcatagt

SEQ ID NO: 7098086 - DNA, 22 bp, Homo sapiens
tagaatgagaaagtgtagcagg

SEQ ID NO: 7098087 - DNA, 19 bp, Homo sapiens
tagaatgcccacttaaaaa

SEQ ID NO: 7098088 - DNA, 22 bp, Homo sapiens
tagaatgtagtgcttcaagatt

SEQ ID NO: 7098089 - DNA, 22 bp, Homo sapiens
tagaattcatgttactgttagc

SEQ ID NO: 7098090 - DNA, 22 bp, Homo sapiens
tagaattcaagattcaacaggc

SEQ ID NO: 7098091 - DNA, 22 bp, Homo sapiens
tagaattatgccttgctgtcca

SEQ ID NO: 7098092 - DNA, 22 bp, Homo sapiens
tagaatgttaagaatatgtata

SEQ ID NO: 7098093 - DNA, 22 bp, Homo sapiens
tagaatgttcacctttaaatga

SEQ ID NO: 7098094 - DNA, 23 bp, Homo sapiens
tagaatgtcattcaatgatatgg

SEQ ID NO: 7098095 - DNA, 23 bp, Homo sapiens
tagaatgtcattcaatgatatgg

SEQ ID NO: 7098096 - DNA, 22 bp, Homo sapiens
tagaatgtgcaaatgtgcacac

SEQ ID NO: 7098097 - DNA, 22 bp, Homo sapiens
tagaatgtgcctggaatacagt

SEQ ID NO: 7098098 - DNA, 22 bp, Homo sapiens
tagaatgtggaggtaacagact

SEQ ID NO: 7098099 - DNA, 22 bp, Homo sapiens
tagaatgtgcctggaatacagt

SEQ ID NO: 7098100 - DNA, 22 bp, Homo sapiens
tagaatgtggaggtaacagact

SEQ ID NO: 7098101 - DNA, 22 bp, Homo sapiens
tagaatgtggaggtaacagact

SEQ ID NO: 7098102 - DNA, 22 bp, Homo sapiens
tagaatgtggaggtaacagact

SEQ ID NO: 7098103 - DNA, 22 bp, Homo sapiens
tagaatgttaagaatatgtata

SEQ ID NO: 7098104 - DNA, 22 bp, Homo sapiens
tagaggctttcagcggtaggtc

SEQ ID NO: 7098105 - DNA, 22 bp, Homo sapiens
tagaggcttctactgctcactt

SEQ ID NO: 7098106 - DNA, 22 bp, Homo sapiens
tagaggctgggaattattttca

SEQ ID NO: 7098107 - DNA, 22 bp, Homo sapiens
tagagggaaggaagaatggatt

SEQ ID NO: 7098108 - DNA, 22 bp, Homo sapiens
tagaggggaaaatgcgtattaa

SEQ ID NO: 7098109 - DNA, 22 bp, Homo sapiens
tagaggggaaaatgcgtattaa

SEQ ID NO: 7098110 - DNA, 22 bp, Homo sapiens
tagaggctcttcattgcagtag

SEQ ID NO: 7098111 - DNA, 22 bp, Homo sapiens
tagaggctcctgtgtgtaggtt

SEQ ID NO: 7098112 - DNA, 22 bp, Homo sapiens
tagaggctactagaggcacctg

SEQ ID NO: 7098113 - DNA, 22 bp, Homo sapiens
tagaggccaaaatacccggcga

SEQ ID NO: 7098114 - DNA, 22 bp, Homo sapiens
tagaggccctgctcaccctccc

SEQ ID NO: 7098115 - DNA, 22 bp, Homo sapiens
tagaggcattaatgaataaaca

SEQ ID NO: 7098116 - DNA, 22 bp, Homo sapiens
tagaggcataagagggaagcag

SEQ ID NO: 7098117 - DNA, 21 bp, Homo sapiens
tagaggcaggagggactgcag

SEQ ID NO: 7098118 - DNA, 22 bp, Homo sapiens
tagacagatttaaaggaatgga

SEQ ID NO: 7098119 - DNA, 22 bp, Homo sapiens
tagacagatgttttctggctgt

SEQ ID NO: 7098120 - DNA, 22 bp, Homo sapiens
tagacactttagaagtaagggt

SEQ ID NO: 7098121 - DNA, 22 bp, Homo sapiens
tagacagaatccagcccacgcc

SEQ ID NO: 7098122 - DNA, 22 bp, Homo sapiens
tagacagaatccagcccacgcc

SEQ ID NO: 7098123 - DNA, 22 bp, Homo sapiens
tagacagagtgaagacaagtgg

SEQ ID NO: 7098124 - DNA, 22 bp, Homo sapiens
tagacacatcaagtatagttaa

SEQ ID NO: 7098125 - DNA, 22 bp, Homo sapiens
tagacacatcaagtatagttaa

SEQ ID NO: 7098126 - DNA, 22 bp, Homo sapiens
tagacacatacccttgcccaaa

SEQ ID NO: 7098127 - DNA, 22 bp, Homo sapiens
tagacacatcaaggatcagttt

SEQ ID NO: 7098128 - DNA, 22 bp, Homo sapiens
tagacacatcaagtatagttaa

SEQ ID NO: 7098129 - DNA, 22 bp, Homo sapiens
tagacacatcaagtatagttaa

SEQ ID NO: 7098130 - DNA, 22 bp, Homo sapiens
tagacacatccgtggaagcttc

SEQ ID NO: 7098131 - DNA, 22 bp, Homo sapiens
tagacacatccgtggaagcttc

SEQ ID NO: 7098132 - DNA, 22 bp, Homo sapiens
tagacacatccgtggaagcttc

SEQ ID NO: 7098133 - DNA, 22 bp, Homo sapiens
tagacacatccgtggaagcttc

SEQ ID NO: 7098134 - DNA, 22 bp, Homo sapiens
tagacacatcttcatccacaat

SEQ ID NO: 7098135 - DNA, 22 bp, Homo sapiens
tagacacatcttcatccacaat

SEQ ID NO: 7098136 - DNA, 22 bp, Homo sapiens
tagacacatcttcatccacaat

SEQ ID NO: 7098137 - DNA, 22 bp, Homo sapiens
tagacacatcttcatccacaat

SEQ ID NO: 7098138 - DNA, 22 bp, Homo sapiens
tagacactagggatttagtact

SEQ ID NO: 7098139 - DNA, 23 bp, Homo sapiens
tagacactcctttgtctgtcctt

SEQ ID NO: 7098140 - DNA, 22 bp, Homo sapiens
tagacactgtatgagctgggtg

SEQ ID NO: 7098141 - DNA, 22 bp, Homo sapiens
tagaaaggatattgagatgaat

SEQ ID NO: 7098142 - DNA, 22 bp, Homo sapiens
tagaaaggaagctacttagggg

SEQ ID NO: 7098143 - DNA, 22 bp, Homo sapiens
tagaaaggagcattttagacta

SEQ ID NO: 7098144 - DNA, 22 bp, Homo sapiens
tagaaaggatattgagatgaat

SEQ ID NO: 7098145 - DNA, 22 bp, Homo sapiens
tagaaaggatattgagatgaat

SEQ ID NO: 7098146 - DNA, 22 bp, Homo sapiens
tagaaaggaagctacttagggg

SEQ ID NO: 7098147 - DNA, 22 bp, Homo sapiens
tagaaaggaacaggtcagcgtt

SEQ ID NO: 7098148 - DNA, 22 bp, Homo sapiens
tagaaagcttggggtgtttaaa

SEQ ID NO: 7098149 - DNA, 22 bp, Homo sapiens
tagaaagctgagtaatacattt

SEQ ID NO: 7098150 - DNA, 22 bp, Homo sapiens
tagaaagctggaggaattcttt

SEQ ID NO: 7098151 - DNA, 22 bp, Homo sapiens
tagaaagaacttcatgtaaaac

SEQ ID NO: 7098152 - DNA, 22 bp, Homo sapiens
tagaaagaacttcatgtaaaac

SEQ ID NO: 7098153 - DNA, 22 bp, Homo sapiens
tagaaagaacttcatgtaaaac

SEQ ID NO: 7098154 - DNA, 22 bp, Homo sapiens
tagaaagcatgcaagtttgatg

SEQ ID NO: 7098155 - DNA, 19 bp, Homo sapiens
tagaaagccagaaaacaga

SEQ ID NO: 7098156 - DNA, 22 bp, Homo sapiens
tagaaagccctgtgttcactgc

SEQ ID NO: 7098157 - DNA, 22 bp, Homo sapiens
tagaaagcgttaaatctacaga

SEQ ID NO: 7098158 - DNA, 22 bp, Homo sapiens
tagaaagtcatgaattacacca

SEQ ID NO: 7098159 - DNA, 22 bp, Homo sapiens
tagaaagtcatgaattacacca

SEQ ID NO: 7098160 - DNA, 21 bp, Homo sapiens
tagaaagtcaaagctatcagc

SEQ ID NO: 7098161 - DNA, 22 bp, Homo sapiens
tagaaagtcaaaacactgtgtt

SEQ ID NO: 7098162 - DNA, 22 bp, Homo sapiens
tagaaagtcaaaacactgtgtt

SEQ ID NO: 7098163 - DNA, 22 bp, Homo sapiens
tagaaagtagggaaggtaggat

SEQ ID NO: 7098164 - DNA, 22 bp, Homo sapiens
tagaaagtagggaaggtaggat

SEQ ID NO: 7098165 - DNA, 22 bp, Homo sapiens
tagaaagtcaaaacactgtgtt

SEQ ID NO: 7098166 - DNA, 22 bp, Homo sapiens
tagaaagtagccacttacagag

SEQ ID NO: 7098167 - DNA, 22 bp, Homo sapiens
tagaaagtagggaaggtaggat

SEQ ID NO: 7098168 - DNA, 22 bp, Homo sapiens
tagaaagtactaaatttaactg

SEQ ID NO: 7098169 - DNA, 22 bp, Homo sapiens
tagaaagtactaaatttaactg

SEQ ID NO: 7098170 - DNA, 22 bp, Homo sapiens
tagaaagtaaatcagttttatt

SEQ ID NO: 7098171 - DNA, 22 bp, Homo sapiens
tagaaagtaaatcagttttatt

SEQ ID NO: 7098172 - DNA, 22 bp, Homo sapiens
tagaaagtaaacacgaagtctc

SEQ ID NO: 7098173 - DNA, 22 bp, Homo sapiens
tagaaaggcaatcattcttgga

SEQ ID NO: 7098174 - DNA, 22 bp, Homo sapiens
tagaaaggctgctgccaaccca

SEQ ID NO: 7098175 - DNA, 22 bp, Homo sapiens
tagaaaggcaagcgtgaaatat

SEQ ID NO: 7098176 - DNA, 22 bp, Homo sapiens
tagaaaggctgctgccaaccca

SEQ ID NO: 7098177 - DNA, 22 bp, Homo sapiens
tagaaagtaaacacgaagtctc

SEQ ID NO: 7098178 - DNA, 22 bp, Homo sapiens
tagaaagtggttgagagtttag

SEQ ID NO: 7098179 - DNA, 22 bp, Homo sapiens
tagaaagtggttgagagtttag

SEQ ID NO: 7098180 - DNA, 22 bp, Homo sapiens
tagaaataaatctgcagctggg

SEQ ID NO: 7098181 - DNA, 22 bp, Homo sapiens
tagaaataaatctgcagctggg

SEQ ID NO: 7098182 - DNA, 22 bp, Homo sapiens
tagaaataaatctgcagctggg

SEQ ID NO: 7098183 - DNA, 22 bp, Homo sapiens
tagaaagtgaaggttaattaat

SEQ ID NO: 7098184 - DNA, 22 bp, Homo sapiens
tagaaagtgaaggttaattaat

SEQ ID NO: 7098185 - DNA, 22 bp, Homo sapiens
tagaaagtggttgagagtttag

SEQ ID NO: 7098186 - DNA, 22 bp, Homo sapiens
tagaaagtggttgagagtttag

SEQ ID NO: 7098187 - DNA, 22 bp, Homo sapiens
tagaaatcacagaaaatcaggg

SEQ ID NO: 7098188 - DNA, 22 bp, Homo sapiens
tagaaatcacagatagggtcat

SEQ ID NO: 7098189 - DNA, 22 bp, Homo sapiens
tagaaatcagcaggcatatgta

SEQ ID NO: 7098190 - DNA, 22 bp, Homo sapiens
tagaaatcagcaggcatatgta

SEQ ID NO: 7098191 - DNA, 22 bp, Homo sapiens
tagaaatctacttagactttct

SEQ ID NO: 7098192 - DNA, 22 bp, Homo sapiens
tagaaatccccagtctcatagt

SEQ ID NO: 7098193 - DNA, 22 bp, Homo sapiens
tagaaatccccagtctcatagt

SEQ ID NO: 7098194 - DNA, 22 bp, Homo sapiens
tagaaatccccagtctcatagt

SEQ ID NO: 7098195 - DNA, 20 bp, Homo sapiens
tagaaatcttataaaagact

SEQ ID NO: 7098196 - DNA, 20 bp, Homo sapiens
tagaaatcttataaaagact

SEQ ID NO: 7098197 - DNA, 22 bp, Homo sapiens
tagaaatcaggtttttagaaag

SEQ ID NO: 7098198 - DNA, 21 bp, Homo sapiens
tagaaatcagctggtgcctct

SEQ ID NO: 7098199 - DNA, 17 bp, Homo sapiens
tagaaatcatagggttg

SEQ ID NO: 7098200 - DNA, 22 bp, Homo sapiens
tagaaatcatttagaagtattg

SEQ ID NO: 7098201 - DNA, 22 bp, Homo sapiens
tagaaatcatttagaagtattg

SEQ ID NO: 7098202 - DNA, 22 bp, Homo sapiens
tagaaatcatttagaagtattg

SEQ ID NO: 7098203 - DNA, 22 bp, Homo sapiens
tagaaatgaatgtttaaaagtc

SEQ ID NO: 7098204 - DNA, 22 bp, Homo sapiens
tagaaatgaatgtttaaaagtc

SEQ ID NO: 7098205 - DNA, 20 bp, Homo sapiens
tagaaatcttataaaagact

SEQ ID NO: 7098206 - DNA, 22 bp, Homo sapiens
tagaaatgattggttgagctct

SEQ ID NO: 7098207 - DNA, 22 bp, Homo sapiens
tagaaatgattggttgagctct

SEQ ID NO: 7098208 - DNA, 22 bp, Homo sapiens
tagaaatgattgagctgtaata

SEQ ID NO: 7098209 - DNA, 22 bp, Homo sapiens
tagaaatgattggttgagctct

SEQ ID NO: 7098210 - DNA, 22 bp, Homo sapiens
tagaaatgagccatggtagagc

SEQ ID NO: 7098211 - DNA, 22 bp, Homo sapiens
tagaaatgagccatggtagagc

SEQ ID NO: 7098212 - DNA, 22 bp, Homo sapiens
tagaaatgagccatggtagagc

SEQ ID NO: 7098213 - DNA, 22 bp, Homo sapiens
tagaaatgcccagattctgcta

SEQ ID NO: 7098214 - DNA, 22 bp, Homo sapiens
tagaaatgcagtgtactgtgtc

SEQ ID NO: 7098215 - DNA, 22 bp, Homo sapiens
tagaaatgattttgatgcttca

SEQ ID NO: 7098216 - DNA, 22 bp, Homo sapiens
tagaaatgattttgatgcttca

SEQ ID NO: 7098217 - DNA, 22 bp, Homo sapiens
tagaaacatcagctaaccaaaa

SEQ ID NO: 7098218 - DNA, 22 bp, Homo sapiens
tagaaacatcagctaaccaaaa

SEQ ID NO: 7098219 - DNA, 22 bp, Homo sapiens
tagaaacatcagctaaccaaaa

SEQ ID NO: 7098220 - DNA, 22 bp, Homo sapiens
tagaaacatcagctaaccaaaa

SEQ ID NO: 7098221 - DNA, 22 bp, Homo sapiens
tagaaacatgagagaaactctt

SEQ ID NO: 7098222 - DNA, 22 bp, Homo sapiens
tagaaacatgagagaaactctt

SEQ ID NO: 7098223 - DNA, 22 bp, Homo sapiens
tagaaacatatgtttgagacat

SEQ ID NO: 7098224 - DNA, 22 bp, Homo sapiens
tagaaacatcagctaaccaaaa

SEQ ID NO: 7098225 - DNA, 22 bp, Homo sapiens
tagaaacatcagctaaccaaaa

SEQ ID NO: 7098226 - DNA, 22 bp, Homo sapiens
tagaaacatgttctgttctgtt

SEQ ID NO: 7098227 - DNA, 22 bp, Homo sapiens
tagaaacatgttctgttctgtt

SEQ ID NO: 7098228 - DNA, 22 bp, Homo sapiens
tagaaacatgttctgttctgtt

SEQ ID NO: 7098229 - DNA, 22 bp, Homo sapiens
tagaaacatgttctgttctgtt

SEQ ID NO: 7098230 - DNA, 22 bp, Homo sapiens
tagaaacattcagttgcagtcc

SEQ ID NO: 7098231 - DNA, 22 bp, Homo sapiens
tagaaacatgagagaaactctt

SEQ ID NO: 7098232 - DNA, 22 bp, Homo sapiens
tagaaacatgagagaaactctt

SEQ ID NO: 7098233 - DNA, 22 bp, Homo sapiens
tagaaacatgttctgttctgtt

SEQ ID NO: 7098234 - DNA, 22 bp, Homo sapiens
tagaaacatgttctgttctgtt

SEQ ID NO: 7098235 - DNA, 22 bp, Homo sapiens
tagaaaccatctcactgctcag

SEQ ID NO: 7098236 - DNA, 22 bp, Homo sapiens
tagaaacccaggatttgtattt

SEQ ID NO: 7098237 - DNA, 22 bp, Homo sapiens
tagaaacccatgtttattcagt

SEQ ID NO: 7098238 - DNA, 22 bp, Homo sapiens
tagaaaccctgccttagtagct

SEQ ID NO: 7098239 - DNA, 22 bp, Homo sapiens
tagaaacctcagggaaatcttt

SEQ ID NO: 7098240 - DNA, 22 bp, Homo sapiens
tagaaactactagaataagaga

SEQ ID NO: 7098241 - DNA, 22 bp, Homo sapiens
tagaaacattcagttgcagtcc

SEQ ID NO: 7098242 - DNA, 22 bp, Homo sapiens
tagaaacattcagttgcagtcc

SEQ ID NO: 7098243 - DNA, 22 bp, Homo sapiens
tagaaacattcagttgcagtcc

SEQ ID NO: 7098244 - DNA, 22 bp, Homo sapiens
tagaaactgatagtcttgtgct

SEQ ID NO: 7098245 - DNA, 22 bp, Homo sapiens
tagaaactgatagtcttgtgct

SEQ ID NO: 7098246 - DNA, 22 bp, Homo sapiens
tagaaactctcacgagtgaaac

SEQ ID NO: 7098247 - DNA, 22 bp, Homo sapiens
tagaaagaaattcagattggct

SEQ ID NO: 7098248 - DNA, 22 bp, Homo sapiens
tagaaagaaattcagattggct

SEQ ID NO: 7098249 - DNA, 22 bp, Homo sapiens
tagaaagaaattcagattggct

SEQ ID NO: 7098250 - DNA, 22 bp, Homo sapiens
tagaaactcaggatactcttcc

SEQ ID NO: 7098251 - DNA, 22 bp, Homo sapiens
tagaaactcacgttatcattgc

SEQ ID NO: 7098252 - DNA, 22 bp, Homo sapiens
tagaaactcacgttatcattgc

SEQ ID NO: 7098253 - DNA, 22 bp, Homo sapiens
tagaaactcacgttatcattgc

SEQ ID NO: 7098254 - DNA, 22 bp, Homo sapiens
tagaaacagaaaactgtaatag

SEQ ID NO: 7098255 - DNA, 22 bp, Homo sapiens
tagaaacagaaaactgtaatag

SEQ ID NO: 7098256 - DNA, 22 bp, Homo sapiens
tagaaacacagatctggtgtca

SEQ ID NO: 7098257 - DNA, 22 bp, Homo sapiens
tagaaacacagatctggtgtca

SEQ ID NO: 7098258 - DNA, 22 bp, Homo sapiens
tagaaacagaaaactgtaatag

SEQ ID NO: 7098259 - DNA, 22 bp, Homo sapiens
tagaaacagaatatgagtgaga

SEQ ID NO: 7098260 - DNA, 22 bp, Homo sapiens
tagaaacagaatatgagtgaga

SEQ ID NO: 7098261 - DNA, 22 bp, Homo sapiens
tagaaacagaatatgagtgaga

SEQ ID NO: 7098262 - DNA, 22 bp, Homo sapiens
tagaaacaagtttctctttggg

SEQ ID NO: 7098263 - DNA, 22 bp, Homo sapiens
tagaaaagccccagctggaggg

SEQ ID NO: 7098264 - DNA, 22 bp, Homo sapiens
tagaaacaatgacatgcttgta

SEQ ID NO: 7098265 - DNA, 22 bp, Homo sapiens
tagaaacaatgacatgcttgta

SEQ ID NO: 7098266 - DNA, 22 bp, Homo sapiens
tagaaacaatgacatgcttgta

SEQ ID NO: 7098267 - DNA, 22 bp, Homo sapiens
tagaaacacagagagacccatg

SEQ ID NO: 7098268 - DNA, 22 bp, Homo sapiens
tagaaacacagagagacccatg

SEQ ID NO: 7098269 - DNA, 22 bp, Homo sapiens
tagaaacacagagagacccatg

SEQ ID NO: 7098270 - DNA, 22 bp, Homo sapiens
tagaaacatatgtttgagacat

SEQ ID NO: 7098271 - DNA, 22 bp, Homo sapiens
tagaaacatatgtttgagacat

SEQ ID NO: 7098272 - DNA, 22 bp, Homo sapiens
tagaaacatataggatggcagg

SEQ ID NO: 7098273 - DNA, 22 bp, Homo sapiens
tagaaacatataggatggcagg

SEQ ID NO: 7098274 - DNA, 22 bp, Homo sapiens
tagaaacatataggatggcagg

SEQ ID NO: 7098275 - DNA, 22 bp, Homo sapiens
tagaaacagcatatattagccc

SEQ ID NO: 7098276 - DNA, 22 bp, Homo sapiens
tagaaacagcatatattagccc

SEQ ID NO: 7098277 - DNA, 22 bp, Homo sapiens
tagaaacagcatatattagccc

SEQ ID NO: 7098278 - DNA, 22 bp, Homo sapiens
tagaaacagagagatatgcccc

SEQ ID NO: 7098279 - DNA, 22 bp, Homo sapiens
tagaaacagagcaggtggccca

SEQ ID NO: 7098280 - DNA, 22 bp, Homo sapiens
tagaaacagatgtttttgaaga

SEQ ID NO: 7098281 - DNA, 22 bp, Homo sapiens
tagaaacagatgtttttgaaga

SEQ ID NO: 7098282 - DNA, 22 bp, Homo sapiens
tagaaacagatgtttttgaaga

SEQ ID NO: 7098283 - DNA, 22 bp, Homo sapiens
tactttggttgaatatgtaatg

SEQ ID NO: 7098284 - DNA, 22 bp, Homo sapiens
tactttggttaatgaaatgtga

SEQ ID NO: 7098285 - DNA, 22 bp, Homo sapiens
tactttggttgaatatgtaatg

SEQ ID NO: 7098286 - DNA, 22 bp, Homo sapiens
tactttggttgaatatgtaatg

SEQ ID NO: 7098287 - DNA, 22 bp, Homo sapiens
tactttgtcattctaaccttcc

SEQ ID NO: 7098288 - DNA, 22 bp, Homo sapiens
tactttgtccatttgcaggcag

SEQ ID NO: 7098289 - DNA, 22 bp, Homo sapiens
tactttgtggagattaaaaata

SEQ ID NO: 7098290 - DNA, 22 bp, Homo sapiens
tacttttagcctatttgattct

SEQ ID NO: 7098291 - DNA, 22 bp, Homo sapiens
tacttttagcctatttgattct

SEQ ID NO: 7098292 - DNA, 22 bp, Homo sapiens
tacttttaaaattcacaggtat

SEQ ID NO: 7098293 - DNA, 20 bp, Homo sapiens
tactttgatctgataagcaa

SEQ ID NO: 7098294 - DNA, 22 bp, Homo sapiens
tactttggaagagttcatacag

SEQ ID NO: 7098295 - DNA, 22 bp, Homo sapiens
tactttggatccttacaatagc

SEQ ID NO: 7098296 - DNA, 22 bp, Homo sapiens
tactttggatccttacaatagc

SEQ ID NO: 7098297 - DNA, 22 bp, Homo sapiens
tactttggatccttacaatagc

SEQ ID NO: 7098298 - DNA, 22 bp, Homo sapiens
tactttggggacaatatggaat

SEQ ID NO: 7098299 - DNA, 22 bp, Homo sapiens
tactttggggacaatatggaat

SEQ ID NO: 7098300 - DNA, 22 bp, Homo sapiens
tactttgggtttagaataaact

SEQ ID NO: 7098301 - DNA, 22 bp, Homo sapiens
tactttgggtttagaataaact

SEQ ID NO: 7098302 - DNA, 22 bp, Homo sapiens
tactttggtatcaaactaaaac

SEQ ID NO: 7098303 - DNA, 22 bp, Homo sapiens
tactttgaattaaatatttcag

SEQ ID NO: 7098304 - DNA, 22 bp, Homo sapiens
tactttgaccaccatctgatta

SEQ ID NO: 7098305 - DNA, 22 bp, Homo sapiens
tactttgacgccggtgggaata

SEQ ID NO: 7098306 - DNA, 22 bp, Homo sapiens
tactttgagatgatgctgatcg

SEQ ID NO: 7098307 - DNA, 22 bp, Homo sapiens
tactttgagatgatgctgatcg

SEQ ID NO: 7098308 - DNA, 22 bp, Homo sapiens
tactttgagtaatggtagagat

SEQ ID NO: 7098309 - DNA, 22 bp, Homo sapiens
tactttgataaggttcttctat

SEQ ID NO: 7098310 - DNA, 22 bp, Homo sapiens
taccaaagaatattttaaatag

SEQ ID NO: 7098311 - DNA, 19 bp, Homo sapiens
tacatttgtgtacacttgt

SEQ ID NO: 7098312 - DNA, 22 bp, Homo sapiens
tacatttgttatagaaatgaag

SEQ ID NO: 7098313 - DNA, 22 bp, Homo sapiens
tacatttgttatagaaatgaag

SEQ ID NO: 7098314 - DNA, 22 bp, Homo sapiens
tacattttctaggggaccaaga

SEQ ID NO: 7098315 - DNA, 22 bp, Homo sapiens
tacattttctaggggaccaaga

SEQ ID NO: 7098316 - DNA, 22 bp, Homo sapiens
tacattttctaggggaccaaga

SEQ ID NO: 7098317 - DNA, 22 bp, Homo sapiens
taccaaaaccaagccattatct

SEQ ID NO: 7098318 - DNA, 22 bp, Homo sapiens
tacttttatgtgatgaaatctg

SEQ ID NO: 7098319 - DNA, 22 bp, Homo sapiens
tacttttattattgcccctcca

SEQ ID NO: 7098320 - DNA, 22 bp, Homo sapiens
tacttttatgtgatgaaatctg

SEQ ID NO: 7098321 - DNA, 22 bp, Homo sapiens
tacttttagcctatttgattct

SEQ ID NO: 7098322 - DNA, 22 bp, Homo sapiens
tacttttatgtgatgaaatctg

SEQ ID NO: 7098323 - DNA, 22 bp, Homo sapiens
tacttttatgtgatgaaatctg

SEQ ID NO: 7098324 - DNA, 22 bp, Homo sapiens
tactttttatgataagaactga

SEQ ID NO: 7098325 - DNA, 22 bp, Homo sapiens
tactttttagcacagtgtgtgc

SEQ ID NO: 7098326 - DNA, 19 bp, Homo sapiens
tactttttcaggacagagt

SEQ ID NO: 7098327 - DNA, 22 bp, Homo sapiens
tagaaaagaattttatttgata

SEQ ID NO: 7098328 - DNA, 22 bp, Homo sapiens
tagaaaagaattttatttgata

SEQ ID NO: 7098329 - DNA, 22 bp, Homo sapiens
tagaaaagaattttatttgata

SEQ ID NO: 7098330 - DNA, 22 bp, Homo sapiens
tactttttgtctctttgaatgt

SEQ ID NO: 7098331 - DNA, 22 bp, Homo sapiens
tactttttgtctctttgaatgt

SEQ ID NO: 7098332 - DNA, 22 bp, Homo sapiens
tactttttgtctctttgaatgt

SEQ ID NO: 7098333 - DNA, 22 bp, Homo sapiens
tactttttgtctctttgaatgt

SEQ ID NO: 7098334 - DNA, 22 bp, Homo sapiens
tagaaaactaatacatgcttga

SEQ ID NO: 7098335 - DNA, 22 bp, Homo sapiens
tagaaaactaatacatgcttga

SEQ ID NO: 7098336 - DNA, 22 bp, Homo sapiens
tagaaaactaatacatgcttga

SEQ ID NO: 7098337 - DNA, 22 bp, Homo sapiens
tagaaaagaagtctggccggga

SEQ ID NO: 7098338 - DNA, 22 bp, Homo sapiens
tcaggaaggcttcacacgagtg

SEQ ID NO: 7098339 - DNA, 22 bp, Homo sapiens
tcaggaaggcacttggtgtgtt

SEQ ID NO: 7098340 - DNA, 22 bp, Homo sapiens
tcaggaagctgctctgggtggt

SEQ ID NO: 7098341 - DNA, 22 bp, Homo sapiens
tcaggaagctgaattacaaaaa

SEQ ID NO: 7098342 - DNA, 22 bp, Homo sapiens
tcaggaggtttggattcagtta

SEQ ID NO: 7098343 - DNA, 22 bp, Homo sapiens
tcaggagtaaagaagacttgac

SEQ ID NO: 7098344 - DNA, 22 bp, Homo sapiens
tcaggagtaaagacagagttcc

SEQ ID NO: 7098345 - DNA, 22 bp, Homo sapiens
tcaggagtaaagacagagttcc

SEQ ID NO: 7098346 - DNA, 22 bp, Homo sapiens
tcaggagtaagggtaacccaga

SEQ ID NO: 7098347 - DNA, 22 bp, Homo sapiens
tcaggagtaagttataagtatt

SEQ ID NO: 7098348 - DNA, 22 bp, Homo sapiens
tcaggagtactggtgtctacag

SEQ ID NO: 7098349 - DNA, 22 bp, Homo sapiens
tcaggagtactggtgtctacag

SEQ ID NO: 7098350 - DNA, 22 bp, Homo sapiens
tcaggagtcctgcctgcagcct

SEQ ID NO: 7098351 - DNA, 22 bp, Homo sapiens
tcaggagtcctgcctgcagcct

SEQ ID NO: 7098352 - DNA, 22 bp, Homo sapiens
tcaggagtctgtgcagttccac

SEQ ID NO: 7098353 - DNA, 22 bp, Homo sapiens
tcaggagtctgtgcagttccac

SEQ ID NO: 7098354 - DNA, 22 bp, Homo sapiens
tcaggaggtgtaacgaatacag

SEQ ID NO: 7098355 - DNA, 22 bp, Homo sapiens
tcaggaggtgtaggtcaagtga

SEQ ID NO: 7098356 - DNA, 22 bp, Homo sapiens
tcaggaggtgtaggtcaagtga

SEQ ID NO: 7098357 - DNA, 17 bp, Homo sapiens
tcaggaggtgtttctag

SEQ ID NO: 7098358 - DNA, 17 bp, Homo sapiens
tcaggaggtgtttctag

SEQ ID NO: 7098359 - DNA, 22 bp, Homo sapiens
tcaggaggtttggattcagtta

SEQ ID NO: 7098360 - DNA, 17 bp, Homo sapiens
tcaggaggtgtttctag

SEQ ID NO: 7098361 - DNA, 22 bp, Homo sapiens
tcaggaggttgaccacggggca

SEQ ID NO: 7098362 - DNA, 22 bp, Homo sapiens
tcaggaggttgaccacggggca

SEQ ID NO: 7098363 - DNA, 22 bp, Homo sapiens
tcaggaagccggttaaatagat

SEQ ID NO: 7098364 - DNA, 21 bp, Homo sapiens
tcaggaagagccagttcatgc

SEQ ID NO: 7098365 - DNA, 22 bp, Homo sapiens
tcaggaagacaatctttggctc

SEQ ID NO: 7098366 - DNA, 22 bp, Homo sapiens
tcaggaagattagtttcctacc

SEQ ID NO: 7098367 - DNA, 22 bp, Homo sapiens
tcaggaagcatcctgaggtgtc

SEQ ID NO: 7098368 - DNA, 22 bp, Homo sapiens
tcaggaagacaatctttggctc

SEQ ID NO: 7098369 - DNA, 22 bp, Homo sapiens
tcaggaagaaagaagggagtgt

SEQ ID NO: 7098370 - DNA, 22 bp, Homo sapiens
tcaggaagaaattctgtatctt

SEQ ID NO: 7098371 - DNA, 22 bp, Homo sapiens
tcagctctgcaaggtcacctcc

SEQ ID NO: 7098372 - DNA, 22 bp, Homo sapiens
tcagctctgcaaggtcacctcc

SEQ ID NO: 7098373 - DNA, 22 bp, Homo sapiens
tcagctctgcaaggtcacctcc

SEQ ID NO: 7098374 - DNA, 22 bp, Homo sapiens
tcagctctgcaaggtcacctcc

SEQ ID NO: 7098375 - DNA, 22 bp, Homo sapiens
tcagctctgcactccactgtgg

SEQ ID NO: 7098376 - DNA, 22 bp, Homo sapiens
tcagctctgcactccactgtgg

SEQ ID NO: 7098377 - DNA, 22 bp, Homo sapiens
tcaggaacataatgtgagtcag

SEQ ID NO: 7098378 - DNA, 22 bp, Homo sapiens
tcaggaacatttaaccacaggg

SEQ ID NO: 7098379 - DNA, 22 bp, Homo sapiens
tcaggaaccctggtctcctgct

SEQ ID NO: 7098380 - DNA, 22 bp, Homo sapiens
tcaggaacttctaggaaagctg

SEQ ID NO: 7098381 - DNA, 20 bp, Homo sapiens
tcagccttgaatgcttgaaa

SEQ ID NO: 7098382 - DNA, 22 bp, Homo sapiens
tcagccttgcttctggactggt

SEQ ID NO: 7098383 - DNA, 22 bp, Homo sapiens
tcagcctggcaggatggcctgg

SEQ ID NO: 7098384 - DNA, 22 bp, Homo sapiens
tcagcctggtgattcctctgtc

SEQ ID NO: 7098385 - DNA, 22 bp, Homo sapiens
tcagcctggtgattcctctgtc

SEQ ID NO: 7098386 - DNA, 22 bp, Homo sapiens
tcagcctggtgattcctctgtc

SEQ ID NO: 7098387 - DNA, 18 bp, Homo sapiens
tcagcctgttgtctgcct

SEQ ID NO: 7098388 - DNA, 22 bp, Homo sapiens
tcagcctttgaagggctgcagg

SEQ ID NO: 7098389 - DNA, 16 bp, Homo sapiens
tcagctatagggattg

SEQ ID NO: 7098390 - DNA, 22 bp, Homo sapiens
tcagctatctgagaataaccct

SEQ ID NO: 7098391 - DNA, 15 bp, Homo sapiens
tcagctatcatttta

SEQ ID NO: 7098392 - DNA, 22 bp, Homo sapiens
tcagctatgaggtggtggttct

SEQ ID NO: 7098393 - DNA, 22 bp, Homo sapiens
tcagctatgttaatagccttct

SEQ ID NO: 7098394 - DNA, 22 bp, Homo sapiens
tcagctatgttttggaacaggg

SEQ ID NO: 7098395 - DNA, 22 bp, Homo sapiens
tcagctattgagggtggtgagt

SEQ ID NO: 7098396 - DNA, 22 bp, Homo sapiens
tcagctcactctgcttcctggg

SEQ ID NO: 7098397 - DNA, 22 bp, Homo sapiens
tcagctcactctgcttcctggg

SEQ ID NO: 7098398 - DNA, 22 bp, Homo sapiens
tcagctccacagctcctctgcc

SEQ ID NO: 7098399 - DNA, 22 bp, Homo sapiens
tcagctccacagctcctctgcc

SEQ ID NO: 7098400 - DNA, 22 bp, Homo sapiens
tcagctccacagctcctctgcc

SEQ ID NO: 7098401 - DNA, 22 bp, Homo sapiens
tcagctccagagttgcacagtg

SEQ ID NO: 7098402 - DNA, 22 bp, Homo sapiens
tcagctcctcatgcaggggata

SEQ ID NO: 7098403 - DNA, 22 bp, Homo sapiens
tcagctcctcagagcctcagtt

SEQ ID NO: 7098404 - DNA, 22 bp, Homo sapiens
tcagctcctcatgcaggggata

SEQ ID NO: 7098405 - DNA, 22 bp, Homo sapiens
tcagctcggcctaggcccacgg

SEQ ID NO: 7098406 - DNA, 22 bp, Homo sapiens
tcagctctaagttttatgcaaa

SEQ ID NO: 7098407 - DNA, 22 bp, Homo sapiens
tcagctccatccctgcttttgc

SEQ ID NO: 7098408 - DNA, 22 bp, Homo sapiens
tcagctcctatactttgtcctg

SEQ ID NO: 7098409 - DNA, 22 bp, Homo sapiens
tcagctcctcagagcctcagtt

SEQ ID NO: 7098410 - DNA, 22 bp, Homo sapiens
tcagctcctcagagcctcagtt

SEQ ID NO: 7098411 - DNA, 22 bp, Homo sapiens
tcagctctacacacacctgtgt

SEQ ID NO: 7098412 - DNA, 22 bp, Homo sapiens
tcagctctaagttttatgcaaa

SEQ ID NO: 7098413 - DNA, 22 bp, Homo sapiens
tcagctctaagttttatgcaaa

SEQ ID NO: 7098414 - DNA, 22 bp, Homo sapiens
tcagctctaagttttatgcaaa

SEQ ID NO: 7098415 - DNA, 22 bp, Homo sapiens
tcagctctacacacacctgtgt

SEQ ID NO: 7098416 - DNA, 22 bp, Homo sapiens
tcagctctacacacacctgtgt

SEQ ID NO: 7098417 - DNA, 22 bp, Homo sapiens
tcagctctctgggctcgaacct

SEQ ID NO: 7098418 - DNA, 22 bp, Homo sapiens
tcagctctcacagatctcaacc

SEQ ID NO: 7098419 - DNA, 22 bp, Homo sapiens
tcagctctctgggctcgaacct

SEQ ID NO: 7098420 - DNA, 22 bp, Homo sapiens
tcagctctcacagatctcaacc

SEQ ID NO: 7098421 - DNA, 22 bp, Homo sapiens
tcagctctacctgggagctgtc

SEQ ID NO: 7098422 - DNA, 22 bp, Homo sapiens
tcagctctacctgggagctgtc

SEQ ID NO: 7098423 - DNA, 22 bp, Homo sapiens
tcagctctcacagatctcaacc

SEQ ID NO: 7098424 - DNA, 22 bp, Homo sapiens
tcagcactttgaagcagaagga

SEQ ID NO: 7098425 - DNA, 22 bp, Homo sapiens
tcagcactttgaagcagaagga

SEQ ID NO: 7098426 - DNA, 22 bp, Homo sapiens
tcagcactttgaagcagaagga

SEQ ID NO: 7098427 - DNA, 22 bp, Homo sapiens
tcagcacttttactctctttgc

SEQ ID NO: 7098428 - DNA, 22 bp, Homo sapiens
tcagcacttggatttcagagat

SEQ ID NO: 7098429 - DNA, 22 bp, Homo sapiens
tcagcacttggatttcagagat

SEQ ID NO: 7098430 - DNA, 22 bp, Homo sapiens
tcagcactttgaagcagaagga

SEQ ID NO: 7098431 - DNA, 22 bp, Homo sapiens
tcagcactttttaaagcagcat

SEQ ID NO: 7098432 - DNA, 22 bp, Homo sapiens
tcagcactttttaaagcagcat

SEQ ID NO: 7098433 - DNA, 22 bp, Homo sapiens
tcagcactttttaaagcagcat

SEQ ID NO: 7098434 - DNA, 22 bp, Homo sapiens
tcagcactttttaaagcagcat

SEQ ID NO: 7098435 - DNA, 21 bp, Homo sapiens
tcagcagaaagcaaggtcagt

SEQ ID NO: 7098436 - DNA, 22 bp, Homo sapiens
tcagcagaaaggcactagatga

SEQ ID NO: 7098437 - DNA, 22 bp, Homo sapiens
tcagcagaaaggcactagatga

SEQ ID NO: 7098438 - DNA, 22 bp, Homo sapiens
tcagcagaaaggcactagatga

SEQ ID NO: 7098439 - DNA, 22 bp, Homo sapiens
tcagcagaacaaggaagcttaa

SEQ ID NO: 7098440 - DNA, 21 bp, Homo sapiens
tcagcagaaggaccactaggg

SEQ ID NO: 7098441 - DNA, 21 bp, Homo sapiens
tcagcagcttttgcagtccct

SEQ ID NO: 7098442 - DNA, 21 bp, Homo sapiens
tcagcagcttttgcagtccct

SEQ ID NO: 7098443 - DNA, 21 bp, Homo sapiens
tcagcagcttttgcagtccct

SEQ ID NO: 7098444 - DNA, 21 bp, Homo sapiens
tcagcagcttttgcagtccct

SEQ ID NO: 7098445 - DNA, 22 bp, Homo sapiens
tcagcaggcacaccaaaaactg

SEQ ID NO: 7098446 - DNA, 22 bp, Homo sapiens
tcagcaggcacaccaaaaactg

SEQ ID NO: 7098447 - DNA, 21 bp, Homo sapiens
tcagcaggcaccagaaggctg

SEQ ID NO: 7098448 - DNA, 21 bp, Homo sapiens
tcagcaggcaccagaaggctg

SEQ ID NO: 7098449 - DNA, 22 bp, Homo sapiens
tcagcaggcaccggaagtgttt

SEQ ID NO: 7098450 - DNA, 22 bp, Homo sapiens
tcagcaggcaccggaagtgttt

SEQ ID NO: 7098451 - DNA, 22 bp, Homo sapiens
tcagcaggcacggacaggctgc

SEQ ID NO: 7098452 - DNA, 22 bp, Homo sapiens
tcagcaggcacggacaggctgc

SEQ ID NO: 7098453 - DNA, 22 bp, Homo sapiens
tcagcaggcacggacaggctgc

SEQ ID NO: 7098454 - DNA, 22 bp, Homo sapiens
tcagcaggcacggacaggctgc

SEQ ID NO: 7098455 - DNA, 22 bp, Homo sapiens
tcagcaggcacggacaggctgc

SEQ ID NO: 7098456 - DNA, 22 bp, Homo sapiens
tcagcaggcagaaatctgcaga

SEQ ID NO: 7098457 - DNA, 22 bp, Homo sapiens
tcagcctgctccaagtgctgcc

SEQ ID NO: 7098458 - DNA, 22 bp, Homo sapiens
tcagcctgctccaagtgctgcc

SEQ ID NO: 7098459 - DNA, 22 bp, Homo sapiens
tcagcctgctccaagtgctgcc

SEQ ID NO: 7098460 - DNA, 22 bp, Homo sapiens
tcaggctggagtgcagtggcgc

SEQ ID NO: 7098461 - DNA, 22 bp, Homo sapiens
tcaggctggaatgcagtggggc

SEQ ID NO: 7098462 - DNA, 22 bp, Homo sapiens
tcaggctggagtgcagtggcgc

SEQ ID NO: 7098463 - DNA, 22 bp, Homo sapiens
tcaggctggagtgcagtggcgc

SEQ ID NO: 7098464 - DNA, 22 bp, Homo sapiens
tcaggctggagtgcagtggcgc

SEQ ID NO: 7098465 - DNA, 22 bp, Homo sapiens
tcaggctggagtgcagtggcgc

SEQ ID NO: 7098466 - DNA, 22 bp, Homo sapiens
tcaggctggaatgcagtggggc

SEQ ID NO: 7098467 - DNA, 22 bp, Homo sapiens
tcaggctggaatgcagtggggc

SEQ ID NO: 7098468 - DNA, 22 bp, Homo sapiens
tcaggctggaatgcagtggggc

SEQ ID NO: 7098469 - DNA, 18 bp, Homo sapiens
tcaggctggaagtttgcc

SEQ ID NO: 7098470 - DNA, 22 bp, Homo sapiens
tcaggctggaatgcagtggggc

SEQ ID NO: 7098471 - DNA, 22 bp, Homo sapiens
tcaggctgctttcatgcttaga

SEQ ID NO: 7098472 - DNA, 18 bp, Homo sapiens
tcaggctggaagtttgcc

SEQ ID NO: 7098473 - DNA, 18 bp, Homo sapiens
tcaggctggaagtttgcc

SEQ ID NO: 7098474 - DNA, 22 bp, Homo sapiens
tcaggctgctttcatgcttaga

SEQ ID NO: 7098475 - DNA, 22 bp, Homo sapiens
tcaggctgctgtactgtgaatg

SEQ ID NO: 7098476 - DNA, 22 bp, Homo sapiens
tcaggctgctttcatgcttaga

SEQ ID NO: 7098477 - DNA, 22 bp, Homo sapiens
tcaggctgctgtactgtgaatg

SEQ ID NO: 7098478 - DNA, 22 bp, Homo sapiens
tcaggctgctggccagcaggct

SEQ ID NO: 7098479 - DNA, 22 bp, Homo sapiens
tcaggctgctggccagcaggct

SEQ ID NO: 7098480 - DNA, 22 bp, Homo sapiens
tcaggctgctggccagcaggct

SEQ ID NO: 7098481 - DNA, 22 bp, Homo sapiens
tcaggctgctggccagcaggct

SEQ ID NO: 7098482 - DNA, 22 bp, Homo sapiens
tcaggctgctggccagcaggct

SEQ ID NO: 7098483 - DNA, 22 bp, Homo sapiens
tcaggctgctggccagcaggct

SEQ ID NO: 7098484 - DNA, 21 bp, Homo sapiens
tcaggctgatgtcgatgttag

SEQ ID NO: 7098485 - DNA, 22 bp, Homo sapiens
tcaggctgctggccagcaggct

SEQ ID NO: 7098486 - DNA, 22 bp, Homo sapiens
tcaggctgataggaggaactga

SEQ ID NO: 7098487 - DNA, 22 bp, Homo sapiens
tcaggctgaggtcatctgcatc

SEQ ID NO: 7098488 - DNA, 22 bp, Homo sapiens
tcaggctgaggtcatctgcatc

SEQ ID NO: 7098489 - DNA, 22 bp, Homo sapiens
tcaggctgataggaggaactga

SEQ ID NO: 7098490 - DNA, 22 bp, Homo sapiens
tcaggccttgtcctgacctcct

SEQ ID NO: 7098491 - DNA, 16 bp, Homo sapiens
tcaggcctggacgagc

SEQ ID NO: 7098492 - DNA, 22 bp, Homo sapiens
tcaggcctgtgctggaggagat

SEQ ID NO: 7098493 - DNA, 22 bp, Homo sapiens
tcaggcctgtgctggaggagat

SEQ ID NO: 7098494 - DNA, 22 bp, Homo sapiens
tcaggctgggctcctctcccca

SEQ ID NO: 7098495 - DNA, 18 bp, Homo sapiens
tcaggctgggcctccttc

SEQ ID NO: 7098496 - DNA, 18 bp, Homo sapiens
tcaggctgggcctccttc

SEQ ID NO: 7098497 - DNA, 18 bp, Homo sapiens
tcaggctgggcctccttc

SEQ ID NO: 7098498 - DNA, 22 bp, Homo sapiens
tcaggctgggagacaatcactg

SEQ ID NO: 7098499 - DNA, 18 bp, Homo sapiens
tcaggctgggcctccttc

SEQ ID NO: 7098500 - DNA, 22 bp, Homo sapiens
tcaggctgggagacaatcactg

SEQ ID NO: 7098501 - DNA, 22 bp, Homo sapiens
tcaggctgggagacaatcactg

SEQ ID NO: 7098502 - DNA, 22 bp, Homo sapiens
tcaggctggagtgcagtggcgc

SEQ ID NO: 7098503 - DNA, 22 bp, Homo sapiens
tcaggctggagtgcagtggcgc

SEQ ID NO: 7098504 - DNA, 22 bp, Homo sapiens
tcaggctgggctcctctcccca

SEQ ID NO: 7098505 - DNA, 22 bp, Homo sapiens
tcaggctgggctcctctcccca

SEQ ID NO: 7098506 - DNA, 22 bp, Homo sapiens
tcaggctgggctcctctcccca

SEQ ID NO: 7098507 - DNA, 22 bp, Homo sapiens
tcaggctggggtgctaaggtgt

SEQ ID NO: 7098508 - DNA, 22 bp, Homo sapiens
tcaggctggggtgctaaggtgt

SEQ ID NO: 7098509 - DNA, 22 bp, Homo sapiens
tcaggctggggtgctaaggtgt

SEQ ID NO: 7098510 - DNA, 22 bp, Homo sapiens
tcaggctggggtgctaaggtgt

SEQ ID NO: 7098511 - DNA, 22 bp, Homo sapiens
tcaggctggggtgctaaggtgt

SEQ ID NO: 7098512 - DNA, 17 bp, Homo sapiens
tcaggctgggtgcagtg

SEQ ID NO: 7098513 - DNA, 22 bp, Homo sapiens
tcaggctggggtgctaaggtgt

SEQ ID NO: 7098514 - DNA, 22 bp, Homo sapiens
tcagggaaaggggagagtcatt

SEQ ID NO: 7098515 - DNA, 22 bp, Homo sapiens
tcagggaaacctaaggaagcca

SEQ ID NO: 7098516 - DNA, 22 bp, Homo sapiens
tcagggaaacctaaggaagcca

SEQ ID NO: 7098517 - DNA, 22 bp, Homo sapiens
tcagggaaatttccatgtgttt

SEQ ID NO: 7098518 - DNA, 22 bp, Homo sapiens
tcagggaacaatgttatggctt

SEQ ID NO: 7098519 - DNA, 22 bp, Homo sapiens
tcagggaacaatgttatggctt

SEQ ID NO: 7098520 - DNA, 22 bp, Homo sapiens
tcagggaacctctcctgtttct

SEQ ID NO: 7098521 - DNA, 22 bp, Homo sapiens
tcagggaaattcaagggagatt

SEQ ID NO: 7098522 - DNA, 19 bp, Homo sapiens
tcaggcagttattcacaaa

SEQ ID NO: 7098523 - DNA, 19 bp, Homo sapiens
tcaggcagttattcacaaa

SEQ ID NO: 7098524 - DNA, 22 bp, Homo sapiens
tcaggcatgcattctgcaggtt

SEQ ID NO: 7098525 - DNA, 22 bp, Homo sapiens
tcaggcatgcattctgcaggtt

SEQ ID NO: 7098526 - DNA, 22 bp, Homo sapiens
tcaggcatggctcttcctcagg

SEQ ID NO: 7098527 - DNA, 22 bp, Homo sapiens
tcaggcatggctcttcctcagg

SEQ ID NO: 7098528 - DNA, 22 bp, Homo sapiens
tcaggcattcccatgcataaga

SEQ ID NO: 7098529 - DNA, 22 bp, Homo sapiens
tcaggcattcccatgcataaga

SEQ ID NO: 7098530 - DNA, 22 bp, Homo sapiens
tcaggccaaagaaacagcatga

SEQ ID NO: 7098531 - DNA, 22 bp, Homo sapiens
tcaggccaaagaaacagcatga

SEQ ID NO: 7098532 - DNA, 22 bp, Homo sapiens
tcaggccaaggtagacatgact

SEQ ID NO: 7098533 - DNA, 22 bp, Homo sapiens
tcaggcagtggtaaatgagtta

SEQ ID NO: 7098534 - DNA, 19 bp, Homo sapiens
tcaggcagttattcacaaa

SEQ ID NO: 7098535 - DNA, 19 bp, Homo sapiens
tcaggcagttattcacaaa

SEQ ID NO: 7098536 - DNA, 19 bp, Homo sapiens
tcaggcagttattcacaaa

SEQ ID NO: 7098537 - DNA, 20 bp, Homo sapiens
tcaggcagtggggaaaggca

SEQ ID NO: 7098538 - DNA, 20 bp, Homo sapiens
tcaggcagtggggaaaggca

SEQ ID NO: 7098539 - DNA, 20 bp, Homo sapiens
tcaggcagtggggaaaggca

SEQ ID NO: 7098540 - DNA, 20 bp, Homo sapiens
tcaggcagtggggaaaggca

SEQ ID NO: 7098541 - DNA, 22 bp, Homo sapiens
tcaggccacggctcactgagac

SEQ ID NO: 7098542 - DNA, 22 bp, Homo sapiens
tcaggccacttcacaggtgatt

SEQ ID NO: 7098543 - DNA, 22 bp, Homo sapiens
tcaggccacttcacaggtgatt

SEQ ID NO: 7098544 - DNA, 22 bp, Homo sapiens
tcaggccacttcacaggtgatt

SEQ ID NO: 7098545 - DNA, 22 bp, Homo sapiens
tcaggccagcaccatccctatc

SEQ ID NO: 7098546 - DNA, 22 bp, Homo sapiens
tcaggccagcaccatccctatc

SEQ ID NO: 7098547 - DNA, 22 bp, Homo sapiens
tcaggccagcaccatccctatc

SEQ ID NO: 7098548 - DNA, 22 bp, Homo sapiens
tcaggccaggagatcagattga

SEQ ID NO: 7098549 - DNA, 22 bp, Homo sapiens
tcaggcctgcaaatgaatggta

SEQ ID NO: 7098550 - DNA, 22 bp, Homo sapiens
tcaggcctgcaaggagagtccc

SEQ ID NO: 7098551 - DNA, 22 bp, Homo sapiens
tcaggcctgcaggcttcctgga

SEQ ID NO: 7098552 - DNA, 22 bp, Homo sapiens
tcaggcctgcaggcttcctgga

SEQ ID NO: 7098553 - DNA, 22 bp, Homo sapiens
tcaggcctgcaggcttcctgga

SEQ ID NO: 7098554 - DNA, 22 bp, Homo sapiens
tcaggcctgcagtgccaaccca

SEQ ID NO: 7098555 - DNA, 22 bp, Homo sapiens
tcaggcctgccctgaaagcaca

SEQ ID NO: 7098556 - DNA, 22 bp, Homo sapiens
tcaggcctgctgtatgatggat

SEQ ID NO: 7098557 - DNA, 21 bp, Homo sapiens
tcaggcagtgcaaatacatgg

SEQ ID NO: 7098558 - DNA, 21 bp, Homo sapiens
tcaggcagtgcaaatacatgg

SEQ ID NO: 7098559 - DNA, 22 bp, Homo sapiens
tcaggatgttaatatagcatta

SEQ ID NO: 7098560 - DNA, 22 bp, Homo sapiens
tcaggcagtctgactccggagg

SEQ ID NO: 7098561 - DNA, 22 bp, Homo sapiens
tcaggatggcttctgcatcaaa

SEQ ID NO: 7098562 - DNA, 17 bp, Homo sapiens
tcaggatgtagcagtag

SEQ ID NO: 7098563 - DNA, 22 bp, Homo sapiens
tcaggatgacttcaaggaggaa

SEQ ID NO: 7098564 - DNA, 22 bp, Homo sapiens
tcaggatggagtctatccagtg

SEQ ID NO: 7098565 - DNA, 22 bp, Homo sapiens
tcaggagtgataccatttgtca

SEQ ID NO: 7098566 - DNA, 22 bp, Homo sapiens
tcaggagtgcagcagtttggag

SEQ ID NO: 7098567 - DNA, 22 bp, Homo sapiens
tcaggagtgccagtaccttttg

SEQ ID NO: 7098568 - DNA, 21 bp, Homo sapiens
tcaggagtggagagaattggt

SEQ ID NO: 7098569 - DNA, 21 bp, Homo sapiens
tcaggagtggagagaattggt

SEQ ID NO: 7098570 - DNA, 19 bp, Homo sapiens
tcaggagttagttgtgctc

SEQ ID NO: 7098571 - DNA, 22 bp, Homo sapiens
tcaggagttgaaggggatcctg

SEQ ID NO: 7098572 - DNA, 22 bp, Homo sapiens
tcaggagtttcaggtgtaagtg

SEQ ID NO: 7098573 - DNA, 22 bp, Homo sapiens
tcaggagtttggcctacagagg

SEQ ID NO: 7098574 - DNA, 22 bp, Homo sapiens
tcaggagtttggcctacagagg

SEQ ID NO: 7098575 - DNA, 22 bp, Homo sapiens
tcaggagtttggcctacagagg

SEQ ID NO: 7098576 - DNA, 18 bp, Homo sapiens
tcaggagtttgtggatgg

SEQ ID NO: 7098577 - DNA, 22 bp, Homo sapiens
tcaggatgaagtcagaggggtc

SEQ ID NO: 7098578 - DNA, 22 bp, Homo sapiens
tcaggatgacttcaaggaggaa

SEQ ID NO: 7098579 - DNA, 22 bp, Homo sapiens
tcagtcttgaacagccccctgt

SEQ ID NO: 7098580 - DNA, 22 bp, Homo sapiens
tcagtcttccctccagtgcaac

SEQ ID NO: 7098581 - DNA, 17 bp, Homo sapiens
tcagtctctgtcctgga

SEQ ID NO: 7098582 - DNA, 17 bp, Homo sapiens
tcagtctctgtcctgga

SEQ ID NO: 7098583 - DNA, 22 bp, Homo sapiens
tcaggtttttctcaaatcaggt

SEQ ID NO: 7098584 - DNA, 21 bp, Homo sapiens
tcagtaaaaaaactacctaga

SEQ ID NO: 7098585 - DNA, 22 bp, Homo sapiens
tcaggtgtttaaggatagtgat

SEQ ID NO: 7098586 - DNA, 22 bp, Homo sapiens
tcaggtgtttctggagaagtaa

SEQ ID NO: 7098587 - DNA, 22 bp, Homo sapiens
tcaggtgtttctggagaagtaa

SEQ ID NO: 7098588 - DNA, 18 bp, Homo sapiens
tcaggtgttttctgtata

SEQ ID NO: 7098589 - DNA, 18 bp, Homo sapiens
tcaggtgttttctgtata

SEQ ID NO: 7098590 - DNA, 22 bp, Homo sapiens
tcaggtttaggaatttggaaag

SEQ ID NO: 7098591 - DNA, 22 bp, Homo sapiens
tcaggtgttagaagaaatttca

SEQ ID NO: 7098592 - DNA, 22 bp, Homo sapiens
tcaggtgtgttgtattttacca

SEQ ID NO: 7098593 - DNA, 22 bp, Homo sapiens
tcaggtgtgttgtattttacca

SEQ ID NO: 7098594 - DNA, 22 bp, Homo sapiens
tcaggtgttagaagaaatttca

SEQ ID NO: 7098595 - DNA, 22 bp, Homo sapiens
tcaggtgttctccactcagttt

SEQ ID NO: 7098596 - DNA, 22 bp, Homo sapiens
tcaggtgttctccactcagttt

SEQ ID NO: 7098597 - DNA, 22 bp, Homo sapiens
tcaggtgtttaaggatagtgat

SEQ ID NO: 7098598 - DNA, 22 bp, Homo sapiens
tcaggtgtggaccgaggtcaga

SEQ ID NO: 7098599 - DNA, 22 bp, Homo sapiens
tcaggtgtgggcagagaaacca

SEQ ID NO: 7098600 - DNA, 22 bp, Homo sapiens
tcaggtgtggtcaccacagggt

SEQ ID NO: 7098601 - DNA, 22 bp, Homo sapiens
tcaggtgtggtcaccacagggt

SEQ ID NO: 7098602 - DNA, 22 bp, Homo sapiens
tcaggtgtgtggctctggacca

SEQ ID NO: 7098603 - DNA, 22 bp, Homo sapiens
tcaggtgtgtggctctggacca

SEQ ID NO: 7098604 - DNA, 22 bp, Homo sapiens
tcaggtgtgtggtggaaggcag

SEQ ID NO: 7098605 - DNA, 22 bp, Homo sapiens
tcaggtgtgtggtggaaggcag

SEQ ID NO: 7098606 - DNA, 22 bp, Homo sapiens
tcaggtgtcaagcagggagctg

SEQ ID NO: 7098607 - DNA, 22 bp, Homo sapiens
tcaggtgtctatctaacctggt

SEQ ID NO: 7098608 - DNA, 22 bp, Homo sapiens
tcaggtgtctatctaacctggt

SEQ ID NO: 7098609 - DNA, 22 bp, Homo sapiens
tcaggtgtctgcctctttgagt

SEQ ID NO: 7098610 - DNA, 22 bp, Homo sapiens
tcaggtgtctgcctctttgagt

SEQ ID NO: 7098611 - DNA, 22 bp, Homo sapiens
tcaggtgtcttgtgggatttta

SEQ ID NO: 7098612 - DNA, 22 bp, Homo sapiens
tcaggtgtcttgtgggatttta

SEQ ID NO: 7098613 - DNA, 22 bp, Homo sapiens
tcaggtgtgaactatttggaaa

SEQ ID NO: 7098614 - DNA, 22 bp, Homo sapiens
tcaggtgtgaactatttggaaa

SEQ ID NO: 7098615 - DNA, 16 bp, Homo sapiens
tcaggtgtgacttttt

SEQ ID NO: 7098616 - DNA, 16 bp, Homo sapiens
tcaggtgtgacttttt

SEQ ID NO: 7098617 - DNA, 23 bp, Homo sapiens
tcaggtgtgcggactgctgagtc

SEQ ID NO: 7098618 - DNA, 16 bp, Homo sapiens
tcaggtgtgacttttt

SEQ ID NO: 7098619 - DNA, 23 bp, Homo sapiens
tcaggtgtgcggactgctgagtc

SEQ ID NO: 7098620 - DNA, 22 bp, Homo sapiens
tcaggtgtggaccgaggtcaga

SEQ ID NO: 7098621 - DNA, 22 bp, Homo sapiens
tcaggtgtgggcagagaaacca

SEQ ID NO: 7098622 - DNA, 22 bp, Homo sapiens
tcagggaataagtagatgagtg

SEQ ID NO: 7098623 - DNA, 18 bp, Homo sapiens
tcagggaatcttggcctt

SEQ ID NO: 7098624 - DNA, 17 bp, Homo sapiens
tcagggaatgaggttgt

SEQ ID NO: 7098625 - DNA, 18 bp, Homo sapiens
tcagggaagagaatatga

SEQ ID NO: 7098626 - DNA, 21 bp, Homo sapiens
tcagggaagtgtgcagaaggg

SEQ ID NO: 7098627 - DNA, 21 bp, Homo sapiens
tcagggaagtgtgcagaaggg

SEQ ID NO: 7098628 - DNA, 22 bp, Homo sapiens
tcagggaccaccactcacccag

SEQ ID NO: 7098629 - DNA, 23 bp, Homo sapiens
tcagggacatgatgtgtcatatc

SEQ ID NO: 7098630 - DNA, 22 bp, Homo sapiens
tcagggacatttagacactgat

SEQ ID NO: 7098631 - DNA, 22 bp, Homo sapiens
tcagggacaggatgggcatttc

SEQ ID NO: 7098632 - DNA, 22 bp, Homo sapiens
tcagggacagggtgctgctgcg

SEQ ID NO: 7098633 - DNA, 22 bp, Homo sapiens
tcagggacagggtgctgctgcg

SEQ ID NO: 7098634 - DNA, 22 bp, Homo sapiens
tcagggacagttcttagggtgg

SEQ ID NO: 7098635 - DNA, 22 bp, Homo sapiens
tcagggacaataagggaattga

SEQ ID NO: 7098636 - DNA, 21 bp, Homo sapiens
tcaggtggcagagtgtttatg

SEQ ID NO: 7098637 - DNA, 22 bp, Homo sapiens
tcagggacgtgagctcagagtc

SEQ ID NO: 7098638 - DNA, 21 bp, Homo sapiens
tcagggactaggtactgggga

SEQ ID NO: 7098639 - DNA, 22 bp, Homo sapiens
tcagggacccctctgagtggag

SEQ ID NO: 7098640 - DNA, 22 bp, Homo sapiens
tcaggtgtattgatgtctgtga

SEQ ID NO: 7098641 - DNA, 22 bp, Homo sapiens
tcaggtgtcaagcagggagctg

SEQ ID NO: 7098642 - DNA, 22 bp, Homo sapiens
tcaggtggccaaatgggagcgc

SEQ ID NO: 7098643 - DNA, 22 bp, Homo sapiens
tcaggtggccaaatgggagcgc

SEQ ID NO: 7098644 - DNA, 22 bp, Homo sapiens
tcaggtggccaaatgggagcgc

SEQ ID NO: 7098645 - DNA, 22 bp, Homo sapiens
tcaggtggccaaatgggagcgc

SEQ ID NO: 7098646 - DNA, 22 bp, Homo sapiens
tcaggtggccaaatgggagcgc

SEQ ID NO: 7098647 - DNA, 22 bp, Homo sapiens
tcagtcttttgccctgaggagt

SEQ ID NO: 7098648 - DNA, 22 bp, Homo sapiens
tcagtcttttgccctgaggagt

SEQ ID NO: 7098649 - DNA, 22 bp, Homo sapiens
tcagtgaaatgcatattcttcg

SEQ ID NO: 7098650 - DNA, 22 bp, Homo sapiens
tcagtgaaatgcatattcttcg

SEQ ID NO: 7098651 - DNA, 22 bp, Homo sapiens
tcagtgaaccttctgtggcagg

SEQ ID NO: 7098652 - DNA, 22 bp, Homo sapiens
tcagtctttcgaattcagccag

SEQ ID NO: 7098653 - DNA, 22 bp, Homo sapiens
tcagtctttaaaagctcaggaa

SEQ ID NO: 7098654 - DNA, 22 bp, Homo sapiens
tcagtctttcgaattcagccag

SEQ ID NO: 7098655 - DNA, 23 bp, Homo sapiens
tcagtcttggcttctgattttcc

SEQ ID NO: 7098656 - DNA, 22 bp, Homo sapiens
tcagtctttaaaagctcaggaa

SEQ ID NO: 7098657 - DNA, 22 bp, Homo sapiens
tcagtgatttctggggtgaggg

SEQ ID NO: 7098658 - DNA, 22 bp, Homo sapiens
tcagtgatttctggggtgaggg

SEQ ID NO: 7098659 - DNA, 22 bp, Homo sapiens
tcagtgatgaggtggctttcaa

SEQ ID NO: 7098660 - DNA, 23 bp, Homo sapiens
tcagtgatgttgaacctagcagt

SEQ ID NO: 7098661 - DNA, 20 bp, Homo sapiens
tcagtgattatctctgagtg

SEQ ID NO: 7098662 - DNA, 22 bp, Homo sapiens
tcagtgattggtggactgccta

SEQ ID NO: 7098663 - DNA, 22 bp, Homo sapiens
tcagtgaaccttctgtggcagg

SEQ ID NO: 7098664 - DNA, 22 bp, Homo sapiens
tcagtgacaactatgaatattt

SEQ ID NO: 7098665 - DNA, 22 bp, Homo sapiens
tcagtgacaactatgaatattt

SEQ ID NO: 7098666 - DNA, 21 bp, Homo sapiens
tcagtgacaggtgctgacctc

SEQ ID NO: 7098667 - DNA, 21 bp, Homo sapiens
tcagtgacaggtgctgacctc

SEQ ID NO: 7098668 - DNA, 22 bp, Homo sapiens
tcagtgactccttcttcctgct

SEQ ID NO: 7098669 - DNA, 22 bp, Homo sapiens
tcagtgactgggtattaaatca

SEQ ID NO: 7098670 - DNA, 22 bp, Homo sapiens
tcagtgactgggtattaaatca

SEQ ID NO: 7098671 - DNA, 22 bp, Homo sapiens
tcagtgactgggtattaaatca

SEQ ID NO: 7098672 - DNA, 22 bp, Homo sapiens
tcagtgcacccaattctctcca

SEQ ID NO: 7098673 - DNA, 21 bp, Homo sapiens
tcagtgcaattctatggggaa

SEQ ID NO: 7098674 - DNA, 22 bp, Homo sapiens
tcagtgcacaatgacggtggct

SEQ ID NO: 7098675 - DNA, 22 bp, Homo sapiens
tcagtgcaaaaaatgggctaga

SEQ ID NO: 7098676 - DNA, 22 bp, Homo sapiens
tcagtgcaaaaaatgggctaga

SEQ ID NO: 7098677 - DNA, 23 bp, Homo sapiens
tcagtgcaaaaataggattttgg

SEQ ID NO: 7098678 - DNA, 22 bp, Homo sapiens
tcagtgcaatcaaggtatgttt

SEQ ID NO: 7098679 - DNA, 22 bp, Homo sapiens
tcagtgcaatcaaggtatgttt

SEQ ID NO: 7098680 - DNA, 22 bp, Homo sapiens
tcagtgcacccaattctctcca

SEQ ID NO: 7098681 - DNA, 22 bp, Homo sapiens
tcagtgcagaatagtgatgcat

SEQ ID NO: 7098682 - DNA, 22 bp, Homo sapiens
tcagtgcacagagatttttgtt

SEQ ID NO: 7098683 - DNA, 22 bp, Homo sapiens
tcagtgcagactgtaagttgga

SEQ ID NO: 7098684 - DNA, 22 bp, Homo sapiens
tcagtgcagactgtaagttgga

SEQ ID NO: 7098685 - DNA, 20 bp, Homo sapiens
tcagtgcagattgtccaagt

SEQ ID NO: 7098686 - DNA, 22 bp, Homo sapiens
tcagtgcagcggcagcagctct

SEQ ID NO: 7098687 - DNA, 22 bp, Homo sapiens
tcagtgcaggaatctctagcca

SEQ ID NO: 7098688 - DNA, 22 bp, Homo sapiens
tcagtgcaggaatttccttaga

SEQ ID NO: 7098689 - DNA, 22 bp, Homo sapiens
tcagtgcagggtgggagagaga

SEQ ID NO: 7098690 - DNA, 22 bp, Homo sapiens
tcagtgcagggtgggagagaga

SEQ ID NO: 7098691 - DNA, 22 bp, Homo sapiens
tcagtgcagggtgggagagaga

SEQ ID NO: 7098692 - DNA, 22 bp, Homo sapiens
tcagtgtctgtgggcaggatgg

SEQ ID NO: 7098693 - DNA, 22 bp, Homo sapiens
tcagtgtctcatatgaggtttc

SEQ ID NO: 7098694 - DNA, 22 bp, Homo sapiens
tcagtgtccggagcctgagtgc

SEQ ID NO: 7098695 - DNA, 22 bp, Homo sapiens
tcagtgtccggagcctgagtgc

SEQ ID NO: 7098696 - DNA, 22 bp, Homo sapiens
tcagtgcagggtgggagagaga

SEQ ID NO: 7098697 - DNA, 22 bp, Homo sapiens
tcagtgcagtagaactttagtt

SEQ ID NO: 7098698 - DNA, 22 bp, Homo sapiens
tcagtggttggatgatggtcgc

SEQ ID NO: 7098699 - DNA, 21 bp, Homo sapiens
tcagtgtatttaagaatgttg

SEQ ID NO: 7098700 - DNA, 22 bp, Homo sapiens
tcagtgtcatcacttaatataa

SEQ ID NO: 7098701 - DNA, 21 bp, Homo sapiens
tcatggccagcaagtggcaga

SEQ ID NO: 7098702 - DNA, 20 bp, Homo sapiens
tcatggcagccacccacagg

SEQ ID NO: 7098703 - DNA, 22 bp, Homo sapiens
tcatggccaaagtcaggagtgt

SEQ ID NO: 7098704 - DNA, 22 bp, Homo sapiens
tcatggctctaaagacatagat

SEQ ID NO: 7098705 - DNA, 22 bp, Homo sapiens
tcatggcagtttaataagtggt

SEQ ID NO: 7098706 - DNA, 22 bp, Homo sapiens
tcatggcagtttaataagtggt

SEQ ID NO: 7098707 - DNA, 22 bp, Homo sapiens
tcatggcattgttaagggtttt

SEQ ID NO: 7098708 - DNA, 22 bp, Homo sapiens
tcatggcagccctttactagag

SEQ ID NO: 7098709 - DNA, 22 bp, Homo sapiens
tcatggcagccctttactagag

SEQ ID NO: 7098710 - DNA, 22 bp, Homo sapiens
tcatggcagtataattcctcaa

SEQ ID NO: 7098711 - DNA, 22 bp, Homo sapiens
tcatggcagtttaataagtggt

SEQ ID NO: 7098712 - DNA, 22 bp, Homo sapiens
tcatggcacttagtgtctcaaa

SEQ ID NO: 7098713 - DNA, 20 bp, Homo sapiens
tcatggcagccacccacagg

SEQ ID NO: 7098714 - DNA, 22 bp, Homo sapiens
tcatggcacttagcacagtcct

SEQ ID NO: 7098715 - DNA, 23 bp, Homo sapiens
tcatggaatgaattcttctgtta

SEQ ID NO: 7098716 - DNA, 23 bp, Homo sapiens
tcatggaatgaattcttctgtta

SEQ ID NO: 7098717 - DNA, 22 bp, Homo sapiens
tcatggagactttgagcctgtt

SEQ ID NO: 7098718 - DNA, 22 bp, Homo sapiens
tcatggataaaatattggttaa

SEQ ID NO: 7098719 - DNA, 22 bp, Homo sapiens
tcatggataaaatattggttaa

SEQ ID NO: 7098720 - DNA, 19 bp, Homo sapiens
tcatggatcaggtagttta

SEQ ID NO: 7098721 - DNA, 22 bp, Homo sapiens
tcatggatgatagcttcattgc

SEQ ID NO: 7098722 - DNA, 22 bp, Homo sapiens
tcatggatgatagcttcattgc

SEQ ID NO: 7098723 - DNA, 22 bp, Homo sapiens
tcatggatggccgggaggtgat

SEQ ID NO: 7098724 - DNA, 22 bp, Homo sapiens
tcatggatgggcccagctctgt

SEQ ID NO: 7098725 - DNA, 22 bp, Homo sapiens
tcatggatgggcccagctctgt

SEQ ID NO: 7098726 - DNA, 22 bp, Homo sapiens
tcatggattaaattattaagtt

SEQ ID NO: 7098727 - DNA, 22 bp, Homo sapiens
tcatggattaaattattaagtt

SEQ ID NO: 7098728 - DNA, 21 bp, Homo sapiens
tcatggattttctctgctttt

SEQ ID NO: 7098729 - DNA, 21 bp, Homo sapiens
tcatggattttctctgctttt

SEQ ID NO: 7098730 - DNA, 22 bp, Homo sapiens
tcatggcacatgccctccaggg

SEQ ID NO: 7098731 - DNA, 22 bp, Homo sapiens
tcatggcacatgccctccaggg

SEQ ID NO: 7098732 - DNA, 22 bp, Homo sapiens
tcatggcacatgccctccaggg

SEQ ID NO: 7098733 - DNA, 22 bp, Homo sapiens
tcatggcacttagcacagtcct

SEQ ID NO: 7098734 - DNA, 22 bp, Homo sapiens
tcatgcttagtttaatgctctg

SEQ ID NO: 7098735 - DNA, 22 bp, Homo sapiens
tcatgcttagtttaatgctctg

SEQ ID NO: 7098736 - DNA, 22 bp, Homo sapiens
tcatgctgggtactatggctgc

SEQ ID NO: 7098737 - DNA, 22 bp, Homo sapiens
tcatgcttaaaagacacttgag

SEQ ID NO: 7098738 - DNA, 22 bp, Homo sapiens
tcatgctttggttgctgtcctt

SEQ ID NO: 7098739 - DNA, 22 bp, Homo sapiens
tcatgctttgttaatgtggcac

SEQ ID NO: 7098740 - DNA, 22 bp, Homo sapiens
tcatggaaacaatgcggaaaaa

SEQ ID NO: 7098741 - DNA, 22 bp, Homo sapiens
tcatggaaacagcaatgctaat

SEQ ID NO: 7098742 - DNA, 22 bp, Homo sapiens
tcatggaaacagcaatgctaat

SEQ ID NO: 7098743 - DNA, 22 bp, Homo sapiens
tcatggaagaggtattttttgt

SEQ ID NO: 7098744 - DNA, 22 bp, Homo sapiens
tcatggaagaggtattttttgt

SEQ ID NO: 7098745 - DNA, 19 bp, Homo sapiens
tcatggaagaaatgtgata

SEQ ID NO: 7098746 - DNA, 22 bp, Homo sapiens
tcatggaagaaaggtttgtttc

SEQ ID NO: 7098747 - DNA, 23 bp, Homo sapiens
tcatggaactgggcaatcttgaa

SEQ ID NO: 7098748 - DNA, 23 bp, Homo sapiens
tcatggaactgggcaatcttgaa

SEQ ID NO: 7098749 - DNA, 21 bp, Homo sapiens
tcatggaagtaacaaacatat

SEQ ID NO: 7098750 - DNA, 22 bp, Homo sapiens
tcatggaatagagcagtggcaa

SEQ ID NO: 7098751 - DNA, 22 bp, Homo sapiens
tcatggaatagagcagtggcaa

SEQ ID NO: 7098752 - DNA, 20 bp, Homo sapiens
tcatggaatctcactctagt

SEQ ID NO: 7098753 - DNA, 20 bp, Homo sapiens
tcatggaatctcactctagt

SEQ ID NO: 7098754 - DNA, 20 bp, Homo sapiens
tcatggaatctcactctagt

SEQ ID NO: 7098755 - DNA, 22 bp, Homo sapiens
tcattacagagatataatctac

SEQ ID NO: 7098756 - DNA, 20 bp, Homo sapiens
tcattacagtgctaagatgt

SEQ ID NO: 7098757 - DNA, 22 bp, Homo sapiens
tcattacagagatataatctac

SEQ ID NO: 7098758 - DNA, 22 bp, Homo sapiens
tcattacagagatataatctac

SEQ ID NO: 7098759 - DNA, 22 bp, Homo sapiens
tcattacagagatataatctac

SEQ ID NO: 7098760 - DNA, 22 bp, Homo sapiens
tcattacagtgtttatatgtct

SEQ ID NO: 7098761 - DNA, 22 bp, Homo sapiens
tcattagaaatgcagattctca

SEQ ID NO: 7098762 - DNA, 22 bp, Homo sapiens
tcattagcagaagacagatgaa

SEQ ID NO: 7098763 - DNA, 22 bp, Homo sapiens
tcattagctgtggatggagtgg

SEQ ID NO: 7098764 - DNA, 18 bp, Homo sapiens
tcattagggattgcaaag

SEQ ID NO: 7098765 - DNA, 22 bp, Homo sapiens
tcattatcctagtatcttgaat

SEQ ID NO: 7098766 - DNA, 22 bp, Homo sapiens
tcattataaacatatgctaaag

SEQ ID NO: 7098767 - DNA, 22 bp, Homo sapiens
tcattatcctagtatcttgaat

SEQ ID NO: 7098768 - DNA, 22 bp, Homo sapiens
tcattatcttggctcatttctg

SEQ ID NO: 7098769 - DNA, 22 bp, Homo sapiens
tcattatcttggctcatttctg

SEQ ID NO: 7098770 - DNA, 22 bp, Homo sapiens
tcattattctctttaatgttct

SEQ ID NO: 7098771 - DNA, 22 bp, Homo sapiens
tcattattctctttaatgttct

SEQ ID NO: 7098772 - DNA, 22 bp, Homo sapiens
tcattatcttggctcatttctg

SEQ ID NO: 7098773 - DNA, 18 bp, Homo sapiens
tcattattgtttctggag

SEQ ID NO: 7098774 - DNA, 22 bp, Homo sapiens
tcattatttgctttagttatgt

SEQ ID NO: 7098775 - DNA, 22 bp, Homo sapiens
tcattatttgctttagttatgt

SEQ ID NO: 7098776 - DNA, 19 bp, Homo sapiens
tcattcaggaccagtggat

SEQ ID NO: 7098777 - DNA, 22 bp, Homo sapiens
tcattcagagagaatgttccag

SEQ ID NO: 7098778 - DNA, 22 bp, Homo sapiens
tcattcactgcccagcagtgta

SEQ ID NO: 7098779 - DNA, 22 bp, Homo sapiens
tcattcatactcttttctatta

SEQ ID NO: 7098780 - DNA, 22 bp, Homo sapiens
tcattcatactcttttctatta

SEQ ID NO: 7098781 - DNA, 22 bp, Homo sapiens
tcattgaacgaagagctccatt

SEQ ID NO: 7098782 - DNA, 16 bp, Homo sapiens
tcattgaagacagtac

SEQ ID NO: 7098783 - DNA, 22 bp, Homo sapiens
tcattcaatgtaagcatatata

SEQ ID NO: 7098784 - DNA, 23 bp, Homo sapiens
tcattcaaggctggtatctttca

SEQ ID NO: 7098785 - DNA, 23 bp, Homo sapiens
tcattcaaggctggtatctttca

SEQ ID NO: 7098786 - DNA, 18 bp, Homo sapiens
tcattcaaagtctactga

SEQ ID NO: 7098787 - DNA, 22 bp, Homo sapiens
tcattcaagatttcaatagatt

SEQ ID NO: 7098788 - DNA, 22 bp, Homo sapiens
tcattcaagatttcaatagatt

SEQ ID NO: 7098789 - DNA, 22 bp, Homo sapiens
tcattatttgctttagttatgt

SEQ ID NO: 7098790 - DNA, 22 bp, Homo sapiens
tcattattttggactggagtgt

SEQ ID NO: 7098791 - DNA, 18 bp, Homo sapiens
tcattcaaagtctactga

SEQ ID NO: 7098792 - DNA, 22 bp, Homo sapiens
tcatataagtttaaaactatct

SEQ ID NO: 7098793 - DNA, 22 bp, Homo sapiens
tcatataagtttaaaactatct

SEQ ID NO: 7098794 - DNA, 22 bp, Homo sapiens
tcatataagagctttagagtca

SEQ ID NO: 7098795 - DNA, 22 bp, Homo sapiens
tcatataagtttaaaactatct

SEQ ID NO: 7098796 - DNA, 22 bp, Homo sapiens
tcatataagtttaaaactatct

SEQ ID NO: 7098797 - DNA, 22 bp, Homo sapiens
tcatataagtttaaaactatct

SEQ ID NO: 7098798 - DNA, 22 bp, Homo sapiens
tcatataactggatattttcaa

SEQ ID NO: 7098799 - DNA, 22 bp, Homo sapiens
tcatataactggatattttcaa

SEQ ID NO: 7098800 - DNA, 22 bp, Homo sapiens
tcatagggcatcaagcagagca

SEQ ID NO: 7098801 - DNA, 22 bp, Homo sapiens
tcataggaatgatattttatct

SEQ ID NO: 7098802 - DNA, 22 bp, Homo sapiens
tcagtgttcgctcagggactcc

SEQ ID NO: 7098803 - DNA, 22 bp, Homo sapiens
tcatataccagagagtttatat

SEQ ID NO: 7098804 - DNA, 22 bp, Homo sapiens
tcatataagtttaaaactatct

SEQ ID NO: 7098805 - DNA, 22 bp, Homo sapiens
tcatatacctgcatgtgcatgt

SEQ ID NO: 7098806 - DNA, 22 bp, Homo sapiens
tcatatactgccttgtagatta

SEQ ID NO: 7098807 - DNA, 22 bp, Homo sapiens
tcatatagagggcatacaaatg

SEQ ID NO: 7098808 - DNA, 22 bp, Homo sapiens
tcatatatcgaatgggcatcat

SEQ ID NO: 7098809 - DNA, 22 bp, Homo sapiens
tcatatatcgaatgggcatcat

SEQ ID NO: 7098810 - DNA, 22 bp, Homo sapiens
tcatatatctgcaaagcagtat

SEQ ID NO: 7098811 - DNA, 22 bp, Homo sapiens
tcatatatctgcaaagcagtat

SEQ ID NO: 7098812 - DNA, 22 bp, Homo sapiens
tcatatatttagttgtgcaaca

SEQ ID NO: 7098813 - DNA, 22 bp, Homo sapiens
tcatatatttagttgtgcaaca

SEQ ID NO: 7098814 - DNA, 21 bp, Homo sapiens
tcatatattccagctgcagct

SEQ ID NO: 7098815 - DNA, 22 bp, Homo sapiens
tcatatatctgcaaagcagtat

SEQ ID NO: 7098816 - DNA, 22 bp, Homo sapiens
tcatatattttggcagtgatca

SEQ ID NO: 7098817 - DNA, 22 bp, Homo sapiens
tcatatattttggcagtgatca

SEQ ID NO: 7098818 - DNA, 22 bp, Homo sapiens
tcatattaacaatgaaactcag

SEQ ID NO: 7098819 - DNA, 22 bp, Homo sapiens
tcatattaacaatgaaactcag

SEQ ID NO: 7098820 - DNA, 22 bp, Homo sapiens
tcatatgcatatgaaatttttg

SEQ ID NO: 7098821 - DNA, 21 bp, Homo sapiens
tcatatttctcttgctattgt

SEQ ID NO: 7098822 - DNA, 21 bp, Homo sapiens
tcatatttctcttgctattgt

SEQ ID NO: 7098823 - DNA, 21 bp, Homo sapiens
tcatatttctcttgctattgt

SEQ ID NO: 7098824 - DNA, 21 bp, Homo sapiens
tcatatttctcttgctattgt

SEQ ID NO: 7098825 - DNA, 21 bp, Homo sapiens
tcatatttctcttgctattgt

SEQ ID NO: 7098826 - DNA, 22 bp, Homo sapiens
tcatatttcaaaatggctggag

SEQ ID NO: 7098827 - DNA, 22 bp, Homo sapiens
tcatatttatatgttggcacag

SEQ ID NO: 7098828 - DNA, 22 bp, Homo sapiens
tcatatttaggcctttaattca

SEQ ID NO: 7098829 - DNA, 22 bp, Homo sapiens
tcatatttaggcctttaattca

SEQ ID NO: 7098830 - DNA, 20 bp, Homo sapiens
tcatattgatgtagagcagc

SEQ ID NO: 7098831 - DNA, 22 bp, Homo sapiens
tcatattagggtaatgataaga

SEQ ID NO: 7098832 - DNA, 22 bp, Homo sapiens
tcatattagggtaatgataaga

SEQ ID NO: 7098833 - DNA, 22 bp, Homo sapiens
tcatattagggtaatgataaga

SEQ ID NO: 7098834 - DNA, 22 bp, Homo sapiens
tcatattagggtaatgataaga

SEQ ID NO: 7098835 - DNA, 22 bp, Homo sapiens
tcatattagggtaatgataaga

SEQ ID NO: 7098836 - DNA, 22 bp, Homo sapiens
tcatgctgaggggattttaaat

SEQ ID NO: 7098837 - DNA, 22 bp, Homo sapiens
tcatgctgagtcctggctttgt

SEQ ID NO: 7098838 - DNA, 22 bp, Homo sapiens
tcatgctgagtcctggctttgt

SEQ ID NO: 7098839 - DNA, 22 bp, Homo sapiens
tcatgctggcccagaatggagg

SEQ ID NO: 7098840 - DNA, 22 bp, Homo sapiens
tcatgccatccacatctgtttc

SEQ ID NO: 7098841 - DNA, 17 bp, Homo sapiens
tcatgcccaactattac

SEQ ID NO: 7098842 - DNA, 23 bp, Homo sapiens
tcatgcccaggctccagatgtca

SEQ ID NO: 7098843 - DNA, 22 bp, Homo sapiens
tcatgcctgattatgttactca

SEQ ID NO: 7098844 - DNA, 22 bp, Homo sapiens
tcatgctagttaagaacacaat

SEQ ID NO: 7098845 - DNA, 22 bp, Homo sapiens
tcatgctagttaagaacacaat

SEQ ID NO: 7098846 - DNA, 22 bp, Homo sapiens
tcatgctatgagcgagggcctg

SEQ ID NO: 7098847 - DNA, 22 bp, Homo sapiens
tcatgctatttcgaatgtaata

SEQ ID NO: 7098848 - DNA, 22 bp, Homo sapiens
tcatgctatttcgaatgtaata

SEQ ID NO: 7098849 - DNA, 22 bp, Homo sapiens
tcatgctatttcgaatgtaata

SEQ ID NO: 7098850 - DNA, 21 bp, Homo sapiens
tcatatttctcttgctattgt

SEQ ID NO: 7098851 - DNA, 21 bp, Homo sapiens
tcatgcatgagtttatatata

SEQ ID NO: 7098852 - DNA, 21 bp, Homo sapiens
tcatatttctcttgctattgt

SEQ ID NO: 7098853 - DNA, 21 bp, Homo sapiens
tcatgcatgagtttatatata

SEQ ID NO: 7098854 - DNA, 22 bp, Homo sapiens
tcatgcatgttgtactggccca

SEQ ID NO: 7098855 - DNA, 22 bp, Homo sapiens
tcatgcattaacacttcatttt

SEQ ID NO: 7098856 - DNA, 22 bp, Homo sapiens
tcatgcattgcagcacattcag

SEQ ID NO: 7098857 - DNA, 22 bp, Homo sapiens
tcatgcattggaatcttcctag

SEQ ID NO: 7098858 - DNA, 22 bp, Homo sapiens
tcatgcattggaatcttcctag

SEQ ID NO: 7098859 - DNA, 22 bp, Homo sapiens
tcatgcattggaatcttcctag

SEQ ID NO: 7098860 - DNA, 19 bp, Homo sapiens
tcatgcatttctaagtgca

SEQ ID NO: 7098861 - DNA, 22 bp, Homo sapiens
tcatgccaaactgaacacagtt

SEQ ID NO: 7098862 - DNA, 22 bp, Homo sapiens
tcatgccagctttgcttgtccc

SEQ ID NO: 7098863 - DNA, 22 bp, Homo sapiens
tcatgccagttaaaggctgtga

SEQ ID NO: 7098864 - DNA, 22 bp, Homo sapiens
tcaagagattgaataataactg

SEQ ID NO: 7098865 - DNA, 22 bp, Homo sapiens
tcaagagaagtgctccacagta

SEQ ID NO: 7098866 - DNA, 22 bp, Homo sapiens
tcaagacatattaaatgtgcga

SEQ ID NO: 7098867 - DNA, 21 bp, Homo sapiens
tcaagacagcatatttaagaa

SEQ ID NO: 7098868 - DNA, 22 bp, Homo sapiens
tcaagacagggtttaaggttga

SEQ ID NO: 7098869 - DNA, 20 bp, Homo sapiens
tcaagacagacatggagttt

SEQ ID NO: 7098870 - DNA, 22 bp, Homo sapiens
tcaagaatttttaatgtgactg

SEQ ID NO: 7098871 - DNA, 20 bp, Homo sapiens
tcaagacagacatggagttt

SEQ ID NO: 7098872 - DNA, 22 bp, Homo sapiens
tcaagacagatgggtaacttgg

SEQ ID NO: 7098873 - DNA, 22 bp, Homo sapiens
tcaaggagacagaaagcaatgg

SEQ ID NO: 7098874 - DNA, 22 bp, Homo sapiens
tcaaggaatttagtttagtaaa

SEQ ID NO: 7098875 - DNA, 22 bp, Homo sapiens
tcaagataagtcagtatatcaa

SEQ ID NO: 7098876 - DNA, 22 bp, Homo sapiens
tcaagataccaccattatatgt

SEQ ID NO: 7098877 - DNA, 22 bp, Homo sapiens
tcaagataccaccattatatgt

SEQ ID NO: 7098878 - DNA, 22 bp, Homo sapiens
tcaagatgaaagatgtagccat

SEQ ID NO: 7098879 - DNA, 22 bp, Homo sapiens
tcaagctgcatcagtgcagtga

SEQ ID NO: 7098880 - DNA, 22 bp, Homo sapiens
tcaagctggctgttgctatttc

SEQ ID NO: 7098881 - DNA, 22 bp, Homo sapiens
tcaagctggctgttgctatttc

SEQ ID NO: 7098882 - DNA, 22 bp, Homo sapiens
tcaaggaagatagctattatga

SEQ ID NO: 7098883 - DNA, 22 bp, Homo sapiens
tcaaggaagggatattcttgaa

SEQ ID NO: 7098884 - DNA, 20 bp, Homo sapiens
tatttctgggcaaccattta

SEQ ID NO: 7098885 - DNA, 20 bp, Homo sapiens
tatttctgggcaaccattta

SEQ ID NO: 7098886 - DNA, 22 bp, Homo sapiens
tatttctgggagttcagaaatt

SEQ ID NO: 7098887 - DNA, 22 bp, Homo sapiens
tatttctgtttatttgtacatc

SEQ ID NO: 7098888 - DNA, 22 bp, Homo sapiens
tatttcttcgggattcaagcta

SEQ ID NO: 7098889 - DNA, 22 bp, Homo sapiens
tatttctgtcagccagatatgg

SEQ ID NO: 7098890 - DNA, 22 bp, Homo sapiens
tcaagaatttggataagaaatg

SEQ ID NO: 7098891 - DNA, 22 bp, Homo sapiens
tcaagaatttttaatgtgactg

SEQ ID NO: 7098892 - DNA, 22 bp, Homo sapiens
tcaagaatttggataagaaatg

SEQ ID NO: 7098893 - DNA, 22 bp, Homo sapiens
tcaagaatagctgcaaacaggg

SEQ ID NO: 7098894 - DNA, 22 bp, Homo sapiens
tcaagaatttggataagaaatg

SEQ ID NO: 7098895 - DNA, 22 bp, Homo sapiens
tcaagaagtctgtaccatttga

SEQ ID NO: 7098896 - DNA, 22 bp, Homo sapiens
tcaagaatagctgcaaacaggg

SEQ ID NO: 7098897 - DNA, 22 bp, Homo sapiens
tatttcttgagtggtcagtttc

SEQ ID NO: 7098898 - DNA, 22 bp, Homo sapiens
tatttcttgagtggtcagtttc

SEQ ID NO: 7098899 - DNA, 22 bp, Homo sapiens
tcaagaaggagttatttattca

SEQ ID NO: 7098900 - DNA, 22 bp, Homo sapiens
tcaagaagtctgtaccatttga

SEQ ID NO: 7098901 - DNA, 22 bp, Homo sapiens
tatttcttcgggattcaagcta

SEQ ID NO: 7098902 - DNA, 22 bp, Homo sapiens
tatttcttgagactcgtcttcc

SEQ ID NO: 7098903 - DNA, 22 bp, Homo sapiens
tatttcttgagactcgtcttcc

SEQ ID NO: 7098904 - DNA, 19 bp, Homo sapiens
tcaagtcctaggcccacaa

SEQ ID NO: 7098905 - DNA, 22 bp, Homo sapiens
tcaagtcccagctcttcactta

SEQ ID NO: 7098906 - DNA, 22 bp, Homo sapiens
tcaagtcctgctgtggaccaca

SEQ ID NO: 7098907 - DNA, 19 bp, Homo sapiens
tcaagtcctaggcccacaa

SEQ ID NO: 7098908 - DNA, 22 bp, Homo sapiens
tcaagtctggagatctggaact

SEQ ID NO: 7098909 - DNA, 22 bp, Homo sapiens
tcaagtccaggaaagcacagtc

SEQ ID NO: 7098910 - DNA, 22 bp, Homo sapiens
tcaagtattattacagatgtag

SEQ ID NO: 7098911 - DNA, 22 bp, Homo sapiens
tcaaggtgcatacattctggct

SEQ ID NO: 7098912 - DNA, 22 bp, Homo sapiens
tcaaggtgtgttatgtgtaata

SEQ ID NO: 7098913 - DNA, 22 bp, Homo sapiens
tcaagtaacatgaacacacaga

SEQ ID NO: 7098914 - DNA, 22 bp, Homo sapiens
tcaagtagaactataatgatgt

SEQ ID NO: 7098915 - DNA, 23 bp, Homo sapiens
tcaagtaatactcccatcttggc

SEQ ID NO: 7098916 - DNA, 22 bp, Homo sapiens
tcaagtatatctagtcattagg

SEQ ID NO: 7098917 - DNA, 22 bp, Homo sapiens
tcaagtatgacatcaagtttct

SEQ ID NO: 7098918 - DNA, 22 bp, Homo sapiens
tcaagggaggagacacagccct

SEQ ID NO: 7098919 - DNA, 22 bp, Homo sapiens
tcaaggtgactgaactataaac

SEQ ID NO: 7098920 - DNA, 19 bp, Homo sapiens
tcaaggctgcctctccttt

SEQ ID NO: 7098921 - DNA, 22 bp, Homo sapiens
tcaaggcttttggttttccata

SEQ ID NO: 7098922 - DNA, 22 bp, Homo sapiens
tcaagggaggagacacagccct

SEQ ID NO: 7098923 - DNA, 19 bp, Homo sapiens
tcaaggctccctgagggat

SEQ ID NO: 7098924 - DNA, 22 bp, Homo sapiens
tcaaggctattaattctgtgag

SEQ ID NO: 7098925 - DNA, 22 bp, Homo sapiens
tcaaggctaaactttcagagta

SEQ ID NO: 7098926 - DNA, 22 bp, Homo sapiens
tcaaggctattaattctgtgag

SEQ ID NO: 7098927 - DNA, 22 bp, Homo sapiens
tcaaggcacttcatgtctcagt

SEQ ID NO: 7098928 - DNA, 22 bp, Homo sapiens
tcaaggccacagtgagcagagt

SEQ ID NO: 7098929 - DNA, 22 bp, Homo sapiens
tcaaggccacagtgagcagagt

SEQ ID NO: 7098930 - DNA, 21 bp, Homo sapiens
tcaaggccagcctgggcagcc

SEQ ID NO: 7098931 - DNA, 22 bp, Homo sapiens
tcaaggccagggaatgtagggg

SEQ ID NO: 7098932 - DNA, 22 bp, Homo sapiens
tcaaggcctatcctcatttgta

SEQ ID NO: 7098933 - DNA, 22 bp, Homo sapiens
tcaataaaattgttttcctatc

SEQ ID NO: 7098934 - DNA, 22 bp, Homo sapiens
tcaataaaattgttttcctatc

SEQ ID NO: 7098935 - DNA, 20 bp, Homo sapiens
tcaagttttgcttgacaaga

SEQ ID NO: 7098936 - DNA, 22 bp, Homo sapiens
tcaataaaattgttttcctatc

SEQ ID NO: 7098937 - DNA, 22 bp, Homo sapiens
tcaataaaattgttttcctatc

SEQ ID NO: 7098938 - DNA, 23 bp, Homo sapiens
tcaataactcgggttaaaataga

SEQ ID NO: 7098939 - DNA, 23 bp, Homo sapiens
tcaataactcgggttaaaataga

SEQ ID NO: 7098940 - DNA, 22 bp, Homo sapiens
tcaagttaggtggttgttagga

SEQ ID NO: 7098941 - DNA, 22 bp, Homo sapiens
tcaagtcttcacgtgatatctc

SEQ ID NO: 7098942 - DNA, 22 bp, Homo sapiens
tcaagtcttgagggacagcatt

SEQ ID NO: 7098943 - DNA, 22 bp, Homo sapiens
tcaagtcttgatgagacaaacc

SEQ ID NO: 7098944 - DNA, 22 bp, Homo sapiens
tcaagtcttgatgagacaaacc

SEQ ID NO: 7098945 - DNA, 22 bp, Homo sapiens
tcaagtgagcgtagctgaatgg

SEQ ID NO: 7098946 - DNA, 18 bp, Homo sapiens
tcaagtgattctcctgcc

SEQ ID NO: 7098947 - DNA, 22 bp, Homo sapiens
tcaagtttctctcagattatgg

SEQ ID NO: 7098948 - DNA, 20 bp, Homo sapiens
tcaagttttgcttgacaaga

SEQ ID NO: 7098949 - DNA, 22 bp, Homo sapiens
tcaagttaggtggttgttagga

SEQ ID NO: 7098950 - DNA, 22 bp, Homo sapiens
tcaataatggcaggataaattt

SEQ ID NO: 7098951 - DNA, 22 bp, Homo sapiens
tcaataatggcaggataaattt

SEQ ID NO: 7098952 - DNA, 22 bp, Homo sapiens
tcaatacacatgccgctgttct

SEQ ID NO: 7098953 - DNA, 22 bp, Homo sapiens
tcaataaggcaacattaagtta

SEQ ID NO: 7098954 - DNA, 22 bp, Homo sapiens
tcaataatggcaggataaattt

SEQ ID NO: 7098955 - DNA, 17 bp, Homo sapiens
tcaatacactgctttta

SEQ ID NO: 7098956 - DNA, 22 bp, Homo sapiens
tcaatacagaaaggatattttg

SEQ ID NO: 7098957 - DNA, 22 bp, Homo sapiens
tcaatacagaaaggatattttg

SEQ ID NO: 7098958 - DNA, 22 bp, Homo sapiens
tcaatacagaaaggatattttg

SEQ ID NO: 7098959 - DNA, 21 bp, Homo sapiens
tcaatacaggtgcatgtgtct

SEQ ID NO: 7098960 - DNA, 22 bp, Homo sapiens
tcaatttatgtggctattcatt

SEQ ID NO: 7098961 - DNA, 20 bp, Homo sapiens
tcaatttcaggtagcatagt

SEQ ID NO: 7098962 - DNA, 22 bp, Homo sapiens
tcaatttatgtggctattcatt

SEQ ID NO: 7098963 - DNA, 22 bp, Homo sapiens
tcaatttcaacagctgataaga

SEQ ID NO: 7098964 - DNA, 22 bp, Homo sapiens
tcaatttcattctattagttaa

SEQ ID NO: 7098965 - DNA, 22 bp, Homo sapiens
tcaatttcttggtttgataata

SEQ ID NO: 7098966 - DNA, 22 bp, Homo sapiens
tcaattttatgaaacaaagtga

SEQ ID NO: 7098967 - DNA, 22 bp, Homo sapiens
tcaattttatgaaacaaagtga

SEQ ID NO: 7098968 - DNA, 22 bp, Homo sapiens
tcaattttatgaaacaaagtga

SEQ ID NO: 7098969 - DNA, 22 bp, Homo sapiens
tcacaggctggtctccgaggac

SEQ ID NO: 7098970 - DNA, 22 bp, Homo sapiens
tcacaggctggtctccgaggac

SEQ ID NO: 7098971 - DNA, 22 bp, Homo sapiens
tcacaggcttgtgaacattgca

SEQ ID NO: 7098972 - DNA, 22 bp, Homo sapiens
tcacagggcattatggctccag

SEQ ID NO: 7098973 - DNA, 22 bp, Homo sapiens
tcacaggctctagggattaaga

SEQ ID NO: 7098974 - DNA, 22 bp, Homo sapiens
tcacaggctctccaccatgagg

SEQ ID NO: 7098975 - DNA, 22 bp, Homo sapiens
tcacaggctccagggcctggat

SEQ ID NO: 7098976 - DNA, 22 bp, Homo sapiens
tcacaggctctagggattaaga

SEQ ID NO: 7098977 - DNA, 22 bp, Homo sapiens
tcacaggctaaatttatgcagg

SEQ ID NO: 7098978 - DNA, 21 bp, Homo sapiens
tcacaggctcagggagagagt

SEQ ID NO: 7098979 - DNA, 22 bp, Homo sapiens
tcacaggcctggggcagagggc

SEQ ID NO: 7098980 - DNA, 22 bp, Homo sapiens
tcacaggcctggggcagagggc

SEQ ID NO: 7098981 - DNA, 22 bp, Homo sapiens
tcacaggcctggggcagagggc

SEQ ID NO: 7098982 - DNA, 22 bp, Homo sapiens
tcacaggcccaaaccacgctta

SEQ ID NO: 7098983 - DNA, 20 bp, Homo sapiens
tcacaggggaccaggagcag

SEQ ID NO: 7098984 - DNA, 23 bp, Homo sapiens
tcacaggggccagcgctctgtgg

SEQ ID NO: 7098985 - DNA, 22 bp, Homo sapiens
tcacagggtgtacatcacctat

SEQ ID NO: 7098986 - DNA, 22 bp, Homo sapiens
tcacagggtgtacatcacctat

SEQ ID NO: 7098987 - DNA, 21 bp, Homo sapiens
tcacaggtcaatgtgtgaagg

SEQ ID NO: 7098988 - DNA, 21 bp, Homo sapiens
tcacaggtcaatgtgtgaagg

SEQ ID NO: 7098989 - DNA, 22 bp, Homo sapiens
tcacaggtgtcatgctatgcac

SEQ ID NO: 7098990 - DNA, 22 bp, Homo sapiens
tcacagtaaaagcatggaagag

SEQ ID NO: 7098991 - DNA, 22 bp, Homo sapiens
tcacagtaaaagcatggaagag

SEQ ID NO: 7098992 - DNA, 22 bp, Homo sapiens
tcacagtaaatccagaagaaat

SEQ ID NO: 7098993 - DNA, 22 bp, Homo sapiens
tcacagtaactttgttgctttt

SEQ ID NO: 7098994 - DNA, 22 bp, Homo sapiens
tcacagtacatgattcagtggt

SEQ ID NO: 7098995 - DNA, 22 bp, Homo sapiens
tcacagtactccccaaagtttc

SEQ ID NO: 7098996 - DNA, 22 bp, Homo sapiens
tcacagtactgtgactattgac

SEQ ID NO: 7098997 - DNA, 22 bp, Homo sapiens
tcacagtactgtgactattgac

SEQ ID NO: 7098998 - DNA, 22 bp, Homo sapiens
tcacagtactgtgtgacttgag

SEQ ID NO: 7098999 - DNA, 22 bp, Homo sapiens
tcacagtagacttctcaagagc

SEQ ID NO: 7099000 - DNA, 22 bp, Homo sapiens
tcacagctccagactgcaactc

SEQ ID NO: 7099001 - DNA, 22 bp, Homo sapiens
tcacagaataaattgagaagac

SEQ ID NO: 7099002 - DNA, 22 bp, Homo sapiens
tcacagctcactgtagcctcga

SEQ ID NO: 7099003 - DNA, 22 bp, Homo sapiens
tcacagctcactgtagcctcga

SEQ ID NO: 7099004 - DNA, 22 bp, Homo sapiens
tcacagaataaatgtactggcc

SEQ ID NO: 7099005 - DNA, 22 bp, Homo sapiens
tcacagaataaatgtactggcc

SEQ ID NO: 7099006 - DNA, 22 bp, Homo sapiens
tcacagaataaatgtactggcc

SEQ ID NO: 7099007 - DNA, 22 bp, Homo sapiens
tcacagaataaattgagaagac

SEQ ID NO: 7099008 - DNA, 22 bp, Homo sapiens
tcacaggcccaaaccacgctta

SEQ ID NO: 7099009 - DNA, 22 bp, Homo sapiens
tcacaggataaggtggcatcac

SEQ ID NO: 7099010 - DNA, 22 bp, Homo sapiens
tcacaggcaaagaagattggtg

SEQ ID NO: 7099011 - DNA, 22 bp, Homo sapiens
tcacaggataaggtggcatcac

SEQ ID NO: 7099012 - DNA, 22 bp, Homo sapiens
tcacagaaggcatcacagaaga

SEQ ID NO: 7099013 - DNA, 22 bp, Homo sapiens
tcacagaaggaccttgtttcat

SEQ ID NO: 7099014 - DNA, 22 bp, Homo sapiens
tcacagaaggagggaagctagt

SEQ ID NO: 7099015 - DNA, 22 bp, Homo sapiens
tcacagaagatgctggatgttg

SEQ ID NO: 7099016 - DNA, 22 bp, Homo sapiens
tcacagaagcttgaagattttc

SEQ ID NO: 7099017 - DNA, 22 bp, Homo sapiens
tcacagaagttgaatttgcatg

SEQ ID NO: 7099018 - DNA, 22 bp, Homo sapiens
tcacagaagttgaatttgcatg

SEQ ID NO: 7099019 - DNA, 22 bp, Homo sapiens
tcacagaagttgaatttgcatg

SEQ ID NO: 7099020 - DNA, 22 bp, Homo sapiens
tcacagaagttgaatttgcatg

SEQ ID NO: 7099021 - DNA, 22 bp, Homo sapiens
tcacagaagtgtagtgaggaaa

SEQ ID NO: 7099022 - DNA, 22 bp, Homo sapiens
tcacagaagtgtagtgaggaaa

SEQ ID NO: 7099023 - DNA, 22 bp, Homo sapiens
tcacagaagtgtgtttcaggag

SEQ ID NO: 7099024 - DNA, 22 bp, Homo sapiens
tcacagaagggaaagatgccaa

SEQ ID NO: 7099025 - DNA, 22 bp, Homo sapiens
tcacagaagggaaagatgccaa

SEQ ID NO: 7099026 - DNA, 22 bp, Homo sapiens
tcacagaagtgtagtgaggaaa

SEQ ID NO: 7099027 - DNA, 22 bp, Homo sapiens
tcacaaagggagggatagctgg

SEQ ID NO: 7099028 - DNA, 22 bp, Homo sapiens
tcacaaatagctatattaagga

SEQ ID NO: 7099029 - DNA, 22 bp, Homo sapiens
tcacaaatagctatattaagga

SEQ ID NO: 7099030 - DNA, 22 bp, Homo sapiens
tcacaagagtaagttcatgcct

SEQ ID NO: 7099031 - DNA, 22 bp, Homo sapiens
tcacaagagtaagttcatgcct

SEQ ID NO: 7099032 - DNA, 22 bp, Homo sapiens
tcacaagataaacatagctcca

SEQ ID NO: 7099033 - DNA, 22 bp, Homo sapiens
tcacaagatacagttagaagca

SEQ ID NO: 7099034 - DNA, 22 bp, Homo sapiens
tcacaagatatttcagtccttt

SEQ ID NO: 7099035 - DNA, 22 bp, Homo sapiens
tcacaagatatttcagtccttt

SEQ ID NO: 7099036 - DNA, 22 bp, Homo sapiens
tcacaagatggctgctgcagcc

SEQ ID NO: 7099037 - DNA, 22 bp, Homo sapiens
tcacaagggccctgcagtccac

SEQ ID NO: 7099038 - DNA, 22 bp, Homo sapiens
tcacaaggtcctggtggataga

SEQ ID NO: 7099039 - DNA, 21 bp, Homo sapiens
tcacaagtactcatctctgcc

SEQ ID NO: 7099040 - DNA, 22 bp, Homo sapiens
tcacaagtttctcttgcatgcg

SEQ ID NO: 7099041 - DNA, 22 bp, Homo sapiens
tcacaagtttctcttgcatgcg

SEQ ID NO: 7099042 - DNA, 22 bp, Homo sapiens
tcacaatactcactcaatggct

SEQ ID NO: 7099043 - DNA, 20 bp, Homo sapiens
tcaattttctacaacatttg

SEQ ID NO: 7099044 - DNA, 20 bp, Homo sapiens
tcaattttctacaacatttg

SEQ ID NO: 7099045 - DNA, 20 bp, Homo sapiens
tcaattttctacaacatttg

SEQ ID NO: 7099046 - DNA, 20 bp, Homo sapiens
tcaattttctacaacatttg

SEQ ID NO: 7099047 - DNA, 22 bp, Homo sapiens
tcacaaaagcttttgaatttgg

SEQ ID NO: 7099048 - DNA, 22 bp, Homo sapiens
tcacaaaagcttttgaatttgg

SEQ ID NO: 7099049 - DNA, 22 bp, Homo sapiens
tcacaaaagcttttgaatttgg

SEQ ID NO: 7099050 - DNA, 22 bp, Homo sapiens
tcacaaaagcttttgaatttgg

SEQ ID NO: 7099051 - DNA, 22 bp, Homo sapiens
tcacaaaagcttttgaatttgg

SEQ ID NO: 7099052 - DNA, 22 bp, Homo sapiens
tcacaaaagcttttgaatttgg

SEQ ID NO: 7099053 - DNA, 22 bp, Homo sapiens
tcacaaaaggccatgtggcttc

SEQ ID NO: 7099054 - DNA, 22 bp, Homo sapiens
tcacaaaaggccatgtggcttc

SEQ ID NO: 7099055 - DNA, 22 bp, Homo sapiens
tcacaaagctttgataagcaga

SEQ ID NO: 7099056 - DNA, 22 bp, Homo sapiens
tcacaaagctttgataagcaga

SEQ ID NO: 7099057 - DNA, 22 bp, Homo sapiens
tcacaaaaggccatgtggcttc

SEQ ID NO: 7099058 - DNA, 22 bp, Homo sapiens
tcacaaaaggccatgtggcttc

SEQ ID NO: 7099059 - DNA, 22 bp, Homo sapiens
tcacaaaaggccatgtggcttc

SEQ ID NO: 7099060 - DNA, 22 bp, Homo sapiens
tcacaaacaatgctttggaatt

SEQ ID NO: 7099061 - DNA, 22 bp, Homo sapiens
tcacaaacaatgctttggaatt

SEQ ID NO: 7099062 - DNA, 22 bp, Homo sapiens
tcacaaagctttgataagcaga

SEQ ID NO: 7099063 - DNA, 22 bp, Homo sapiens
tcacaaagctttgataagcaga

SEQ ID NO: 7099064 - DNA, 22 bp, Homo sapiens
tcacaatatttatcttccaatt

SEQ ID NO: 7099065 - DNA, 22 bp, Homo sapiens
tcacaatgaaaaacactacata

SEQ ID NO: 7099066 - DNA, 22 bp, Homo sapiens
tcacaatatttatcttccaatt

SEQ ID NO: 7099067 - DNA, 22 bp, Homo sapiens
tcacaatatttatcttccaatt

SEQ ID NO: 7099068 - DNA, 22 bp, Homo sapiens
tcacaatatttatcttccaatt

SEQ ID NO: 7099069 - DNA, 22 bp, Homo sapiens
tcacaatactcactcaatggct

SEQ ID NO: 7099070 - DNA, 22 bp, Homo sapiens
tcacaatactcactcaatggct

SEQ ID NO: 7099071 - DNA, 20 bp, Homo sapiens
tcacaatatgagctcataca

SEQ ID NO: 7099072 - DNA, 22 bp, Homo sapiens
tcacacatgagtaaatacaggg

SEQ ID NO: 7099073 - DNA, 22 bp, Homo sapiens
tcacaatgaaaaacactacata

SEQ ID NO: 7099074 - DNA, 22 bp, Homo sapiens
tcacaatgaaaaacactacata

SEQ ID NO: 7099075 - DNA, 22 bp, Homo sapiens
tcacaatggcatagtataaaat

SEQ ID NO: 7099076 - DNA, 20 bp, Homo sapiens
tcacacatggtaagctatga

SEQ ID NO: 7099077 - DNA, 22 bp, Homo sapiens
tcacagaaaagctgagcatcag

SEQ ID NO: 7099078 - DNA, 20 bp, Homo sapiens
tcacagaaacaaatagagaa

SEQ ID NO: 7099079 - DNA, 22 bp, Homo sapiens
tcacagaaataagatagttatt

SEQ ID NO: 7099080 - DNA, 22 bp, Homo sapiens
tcacagaaataagatagttatt

SEQ ID NO: 7099081 - DNA, 22 bp, Homo sapiens
tcacagaaacagaatggcacag

SEQ ID NO: 7099082 - DNA, 22 bp, Homo sapiens
tcacagaaagctgtgtcctgac

SEQ ID NO: 7099083 - DNA, 22 bp, Homo sapiens
tcacagaacaagcctggtggag

SEQ ID NO: 7099084 - DNA, 22 bp, Homo sapiens
tcacagaagaagtagattgcat

SEQ ID NO: 7099085 - DNA, 22 bp, Homo sapiens
tcacagaagaagtagattgcat

SEQ ID NO: 7099086 - DNA, 22 bp, Homo sapiens
tcacagaacacaaatgccactt

SEQ ID NO: 7099087 - DNA, 22 bp, Homo sapiens
tcacagaacacaaatgccactt

SEQ ID NO: 7099088 - DNA, 22 bp, Homo sapiens
tcacagaacaatgtttagttct

SEQ ID NO: 7099089 - DNA, 22 bp, Homo sapiens
tcacagaacacaaatgccactt

SEQ ID NO: 7099090 - DNA, 22 bp, Homo sapiens
tcacagaagagcattaagatga

SEQ ID NO: 7099091 - DNA, 22 bp, Homo sapiens
tcacagaagagcattaagatga

SEQ ID NO: 7099092 - DNA, 22 bp, Homo sapiens
tcacagaagaagtagattgcat

SEQ ID NO: 7099093 - DNA, 22 bp, Homo sapiens
tcacagaagagatattgacaga

SEQ ID NO: 7099094 - DNA, 22 bp, Homo sapiens
tcacagaagagatattgacaga

SEQ ID NO: 7099095 - DNA, 22 bp, Homo sapiens
tcagagctaaggggagagcaaa

SEQ ID NO: 7099096 - DNA, 20 bp, Homo sapiens
tcagagctgcaggagagaaa

SEQ ID NO: 7099097 - DNA, 22 bp, Homo sapiens
tcagagctaaggggagagcaaa

SEQ ID NO: 7099098 - DNA, 22 bp, Homo sapiens
tcagagctaaggggagagcaaa

SEQ ID NO: 7099099 - DNA, 22 bp, Homo sapiens
tcagagccaatcatggtgcatt

SEQ ID NO: 7099100 - DNA, 22 bp, Homo sapiens
tcagagcccctccgctgtccca

SEQ ID NO: 7099101 - DNA, 22 bp, Homo sapiens
tcagagccctgctcctccccaa

SEQ ID NO: 7099102 - DNA, 22 bp, Homo sapiens
tcagagctgtgcttcaggaaag

SEQ ID NO: 7099103 - DNA, 22 bp, Homo sapiens
tcagagctgcccatgcaagggg

SEQ ID NO: 7099104 - DNA, 22 bp, Homo sapiens
tcagaggaaacaatctttagta

SEQ ID NO: 7099105 - DNA, 22 bp, Homo sapiens
tcagagcactggtgctaccttg

SEQ ID NO: 7099106 - DNA, 22 bp, Homo sapiens
tcagagcacttggctcatggca

SEQ ID NO: 7099107 - DNA, 22 bp, Homo sapiens
tcagagcacttggctcatggca

SEQ ID NO: 7099108 - DNA, 22 bp, Homo sapiens
tcagagaggttggtgataagaa

SEQ ID NO: 7099109 - DNA, 22 bp, Homo sapiens
tcagagaggttaaatatcttgt

SEQ ID NO: 7099110 - DNA, 22 bp, Homo sapiens
tcagagaggttaaatatcttgt

SEQ ID NO: 7099111 - DNA, 22 bp, Homo sapiens
tcagagaggttggtgataagaa

SEQ ID NO: 7099112 - DNA, 23 bp, Homo sapiens
tcagagaggccccctgcagagat

SEQ ID NO: 7099113 - DNA, 23 bp, Homo sapiens
tcagagaggccccctgcagagat

SEQ ID NO: 7099114 - DNA, 22 bp, Homo sapiens
tcagagaggcaatactgtttaa

SEQ ID NO: 7099115 - DNA, 22 bp, Homo sapiens
tcagagaggcaatactgtttaa

SEQ ID NO: 7099116 - DNA, 23 bp, Homo sapiens
tcagagaggccccctgcagagat

SEQ ID NO: 7099117 - DNA, 20 bp, Homo sapiens
tcagagcagttggcttgtct

SEQ ID NO: 7099118 - DNA, 22 bp, Homo sapiens
tcagagcattagaggtttgtat

SEQ ID NO: 7099119 - DNA, 22 bp, Homo sapiens
tcagagcattcgggtgacaaat

SEQ ID NO: 7099120 - DNA, 22 bp, Homo sapiens
tcagcacaggtcttgcaaaaca

SEQ ID NO: 7099121 - DNA, 22 bp, Homo sapiens
tcagcaccagttatcctcaggg

SEQ ID NO: 7099122 - DNA, 22 bp, Homo sapiens
tcagcaccagttatcctcaggg

SEQ ID NO: 7099123 - DNA, 22 bp, Homo sapiens
tcagcaccagttatcctcaggg

SEQ ID NO: 7099124 - DNA, 22 bp, Homo sapiens
tcagcactatacattttgaata

SEQ ID NO: 7099125 - DNA, 22 bp, Homo sapiens
tcagcactatacattttgaata

SEQ ID NO: 7099126 - DNA, 22 bp, Homo sapiens
tcagcactcgctacctagtaaa

SEQ ID NO: 7099127 - DNA, 22 bp, Homo sapiens
tcagcactgaaattcttcacat

SEQ ID NO: 7099128 - DNA, 22 bp, Homo sapiens
tcagcaatgagaactggcattt

SEQ ID NO: 7099129 - DNA, 22 bp, Homo sapiens
tcagcaagtggaccatcctggg

SEQ ID NO: 7099130 - DNA, 20 bp, Homo sapiens
tcagcacagctgacaaggtt

SEQ ID NO: 7099131 - DNA, 22 bp, Homo sapiens
tcagcacaggtcttgcaaaaca

SEQ ID NO: 7099132 - DNA, 22 bp, Homo sapiens
tcagcactgaatctggatttgc

SEQ ID NO: 7099133 - DNA, 22 bp, Homo sapiens
tcagcactgaatctggatttgc

SEQ ID NO: 7099134 - DNA, 22 bp, Homo sapiens
tcagcactgatagaagtcaata

SEQ ID NO: 7099135 - DNA, 22 bp, Homo sapiens
tcagcactgaaattcttcacat

SEQ ID NO: 7099136 - DNA, 22 bp, Homo sapiens
tcagcactgatagaagtcaata

SEQ ID NO: 7099137 - DNA, 22 bp, Homo sapiens
tcagcactgatagaagtcaata

SEQ ID NO: 7099138 - DNA, 22 bp, Homo sapiens
tcagcactgatgtttcagaaga

SEQ ID NO: 7099139 - DNA, 22 bp, Homo sapiens
tcagcactgatgtttcagaaga

SEQ ID NO: 7099140 - DNA, 22 bp, Homo sapiens
tcagcactgatgtttcagaaga

SEQ ID NO: 7099141 - DNA, 22 bp, Homo sapiens
tcagcactggcgctgggcaggt

SEQ ID NO: 7099142 - DNA, 22 bp, Homo sapiens
tcagcactggcgctgggcaggt

SEQ ID NO: 7099143 - DNA, 22 bp, Homo sapiens
tcagcactgtctattagtgaga

SEQ ID NO: 7099144 - DNA, 22 bp, Homo sapiens
tcagcactgtctattagtgaga

SEQ ID NO: 7099145 - DNA, 22 bp, Homo sapiens
tcagcactgtcttttatttgaa

SEQ ID NO: 7099146 - DNA, 22 bp, Homo sapiens
tcagcactgtcttttatttgaa

SEQ ID NO: 7099147 - DNA, 22 bp, Homo sapiens
tcagcactgtcttttatttgaa

SEQ ID NO: 7099148 - DNA, 22 bp, Homo sapiens
tcagcactgtgtccagtctccc

SEQ ID NO: 7099149 - DNA, 22 bp, Homo sapiens
tcagcactgtgtccagtctccc

SEQ ID NO: 7099150 - DNA, 22 bp, Homo sapiens
tcagcacttactagtggccttt

SEQ ID NO: 7099151 - DNA, 22 bp, Homo sapiens
tcagcacttactagtggccttt

SEQ ID NO: 7099152 - DNA, 22 bp, Homo sapiens
tcagcacttactagtggccttt

SEQ ID NO: 7099153 - DNA, 22 bp, Homo sapiens
tcagcacttggatttcagagat

SEQ ID NO: 7099154 - DNA, 22 bp, Homo sapiens
tcagaggaagccttggtgggag

SEQ ID NO: 7099155 - DNA, 22 bp, Homo sapiens
tcagaggaagcatcaagttctc

SEQ ID NO: 7099156 - DNA, 22 bp, Homo sapiens
tcagcaagtattttctgaatgc

SEQ ID NO: 7099157 - DNA, 22 bp, Homo sapiens
tcagcaagtggaccatcctggg

SEQ ID NO: 7099158 - DNA, 22 bp, Homo sapiens
tcagcaagtggaccatcctggg

SEQ ID NO: 7099159 - DNA, 22 bp, Homo sapiens
tcagaggaacactgtttcatgc

SEQ ID NO: 7099160 - DNA, 22 bp, Homo sapiens
tcagaggaaaggtcagatggct

SEQ ID NO: 7099161 - DNA, 22 bp, Homo sapiens
tcagaggaaaggtcagatggct

SEQ ID NO: 7099162 - DNA, 22 bp, Homo sapiens
tcagaggaaaggtcagatggct

SEQ ID NO: 7099163 - DNA, 22 bp, Homo sapiens
tcagaggaaaggtcagatggct

SEQ ID NO: 7099164 - DNA, 22 bp, Homo sapiens
tcagaggaaagggaacatagtc

SEQ ID NO: 7099165 - DNA, 22 bp, Homo sapiens
tcagaggaaagggaacatagtc

SEQ ID NO: 7099166 - DNA, 20 bp, Homo sapiens
tcagagaaggagctttcctg

SEQ ID NO: 7099167 - DNA, 22 bp, Homo sapiens
tcagagaagcttaagctgtaat

SEQ ID NO: 7099168 - DNA, 22 bp, Homo sapiens
tcagagaaggcaattttatggt

SEQ ID NO: 7099169 - DNA, 22 bp, Homo sapiens
tcagagaaggctgagtcacggc

SEQ ID NO: 7099170 - DNA, 20 bp, Homo sapiens
tcagagaagggactgagatt

SEQ ID NO: 7099171 - DNA, 22 bp, Homo sapiens
tcagagaagctgccaggcgagc

SEQ ID NO: 7099172 - DNA, 22 bp, Homo sapiens
tcagagaactgcagcccttcct

SEQ ID NO: 7099173 - DNA, 22 bp, Homo sapiens
tcagagaactggcatgtttaga

SEQ ID NO: 7099174 - DNA, 22 bp, Homo sapiens
tcagagaagacatcattgtgaa

SEQ ID NO: 7099175 - DNA, 22 bp, Homo sapiens
tcagagaactccacaccttagg

SEQ ID NO: 7099176 - DNA, 23 bp, Homo sapiens
tcagagaactcgggcagatgacc

SEQ ID NO: 7099177 - DNA, 23 bp, Homo sapiens
tcagagaactcgggcagatgacc

SEQ ID NO: 7099178 - DNA, 23 bp, Homo sapiens
tcagagaactcgggcagatgacc

SEQ ID NO: 7099179 - DNA, 22 bp, Homo sapiens
tcagaccatcctgctgttagtg

SEQ ID NO: 7099180 - DNA, 22 bp, Homo sapiens
tcagacctctgaccttgccaaa

SEQ ID NO: 7099181 - DNA, 22 bp, Homo sapiens
tcagacagtgtgatcagtctct

SEQ ID NO: 7099182 - DNA, 22 bp, Homo sapiens
tcagacagtgtgatcagtctct

SEQ ID NO: 7099183 - DNA, 22 bp, Homo sapiens
tcagacagtttgcagtgtgcct

SEQ ID NO: 7099184 - DNA, 22 bp, Homo sapiens
tcagacagtttgcagtgtgcct

SEQ ID NO: 7099185 - DNA, 22 bp, Homo sapiens
tcagacatctcataatgtatta

SEQ ID NO: 7099186 - DNA, 22 bp, Homo sapiens
tcagaaaataactgttagtttg

SEQ ID NO: 7099187 - DNA, 22 bp, Homo sapiens
tcagacagcttgcagggaggtg

SEQ ID NO: 7099188 - DNA, 22 bp, Homo sapiens
tcagacagcttgcagggaggtg

SEQ ID NO: 7099189 - DNA, 22 bp, Homo sapiens
tcagacagattttgacacttgc

SEQ ID NO: 7099190 - DNA, 22 bp, Homo sapiens
tcagacagcttgcagggaggtg

SEQ ID NO: 7099191 - DNA, 22 bp, Homo sapiens
tcagacagcttgggataactga

SEQ ID NO: 7099192 - DNA, 22 bp, Homo sapiens
tcagacaggcctctccagcctc

SEQ ID NO: 7099193 - DNA, 22 bp, Homo sapiens
tcagacaggctggacagcttgc

SEQ ID NO: 7099194 - DNA, 22 bp, Homo sapiens
tcagacaggctggacagcttgc

SEQ ID NO: 7099195 - DNA, 22 bp, Homo sapiens
tcagacaggcttctttctccct

SEQ ID NO: 7099196 - DNA, 22 bp, Homo sapiens
tcagacaggcttctttctccct

SEQ ID NO: 7099197 - DNA, 22 bp, Homo sapiens
tcagacagggagtcagaaaata

SEQ ID NO: 7099198 - DNA, 22 bp, Homo sapiens
tcagacagggagtcagaaaata

SEQ ID NO: 7099199 - DNA, 22 bp, Homo sapiens
tcagacagggagtcagaaaata

SEQ ID NO: 7099200 - DNA, 22 bp, Homo sapiens
tcagacagggcttctcaaactt

SEQ ID NO: 7099201 - DNA, 22 bp, Homo sapiens
tcagacagggagtcagaaaata

SEQ ID NO: 7099202 - DNA, 22 bp, Homo sapiens
tcagacagggcttctcaaactt

SEQ ID NO: 7099203 - DNA, 22 bp, Homo sapiens
tcagacagtcatcagagcttgt

SEQ ID NO: 7099204 - DNA, 22 bp, Homo sapiens
tcagacagtcatcagagcttgt

SEQ ID NO: 7099205 - DNA, 22 bp, Homo sapiens
tcagacagtcatcagagcttgt

SEQ ID NO: 7099206 - DNA, 20 bp, Homo sapiens
tcagacagtcgcagttctgg

SEQ ID NO: 7099207 - DNA, 22 bp, Homo sapiens
tcagacagtgtgatcagtctct

SEQ ID NO: 7099208 - DNA, 22 bp, Homo sapiens
tcagaaaagagaaaatcttata

SEQ ID NO: 7099209 - DNA, 22 bp, Homo sapiens
tcagaaaagaccacattattct

SEQ ID NO: 7099210 - DNA, 22 bp, Homo sapiens
tcacttttgatccctatgcagt

SEQ ID NO: 7099211 - DNA, 22 bp, Homo sapiens
tcacttttgatccctatgcagt

SEQ ID NO: 7099212 - DNA, 22 bp, Homo sapiens
tcacttttgggtttccagtaga

SEQ ID NO: 7099213 - DNA, 22 bp, Homo sapiens
tcactttttgatatcattctgc

SEQ ID NO: 7099214 - DNA, 22 bp, Homo sapiens
tcacttttgatccctatgcagt

SEQ ID NO: 7099215 - DNA, 22 bp, Homo sapiens
tcactttttgatatcattctgc

SEQ ID NO: 7099216 - DNA, 22 bp, Homo sapiens
tcacttttgggtttccagtaga

SEQ ID NO: 7099217 - DNA, 22 bp, Homo sapiens
tcactttttgatatcattctgc

SEQ ID NO: 7099218 - DNA, 22 bp, Homo sapiens
tcactttttgatatcattctgc

SEQ ID NO: 7099219 - DNA, 22 bp, Homo sapiens
tcagaaaagaccacattattct

SEQ ID NO: 7099220 - DNA, 22 bp, Homo sapiens
tcactctgatagataagctaac

SEQ ID NO: 7099221 - DNA, 20 bp, Homo sapiens
tcactctgatgctagggtgg

SEQ ID NO: 7099222 - DNA, 21 bp, Homo sapiens
tcactctgattaggtgtctct

SEQ ID NO: 7099223 - DNA, 22 bp, Homo sapiens
tcactctgcctccatattacta

SEQ ID NO: 7099224 - DNA, 22 bp, Homo sapiens
tcactctgcctccatattacta

SEQ ID NO: 7099225 - DNA, 22 bp, Homo sapiens
tcactctggcctctgcagcagt

SEQ ID NO: 7099226 - DNA, 22 bp, Homo sapiens
tcactagtcgcggggggaggta

SEQ ID NO: 7099227 - DNA, 22 bp, Homo sapiens
tcactagtcatcatatattttt

SEQ ID NO: 7099228 - DNA, 23 bp, Homo sapiens
tcactagtcaagtgcctttgagt

SEQ ID NO: 7099229 - DNA, 22 bp, Homo sapiens
tcactagtcatcaacttccatt

SEQ ID NO: 7099230 - DNA, 22 bp, Homo sapiens
tcactagtcatcaacttccatt

SEQ ID NO: 7099231 - DNA, 21 bp, Homo sapiens
tcactagtgccttctgtcatt

SEQ ID NO: 7099232 - DNA, 22 bp, Homo sapiens
tcactctgacttggcctccaac

SEQ ID NO: 7099233 - DNA, 22 bp, Homo sapiens
tcactagcattgttgaaggact

SEQ ID NO: 7099234 - DNA, 22 bp, Homo sapiens
tcactacattttagacagtaaa

SEQ ID NO: 7099235 - DNA, 22 bp, Homo sapiens
tcactactgtggaacaactgat

SEQ ID NO: 7099236 - DNA, 22 bp, Homo sapiens
tcactacacaatatatttcaga

SEQ ID NO: 7099237 - DNA, 22 bp, Homo sapiens
tcacccaggctggactgcagtg

SEQ ID NO: 7099238 - DNA, 19 bp, Homo sapiens
tcacccaggctgctggctc

SEQ ID NO: 7099239 - DNA, 22 bp, Homo sapiens
tcacccaggctggactgcagtg

SEQ ID NO: 7099240 - DNA, 22 bp, Homo sapiens
tcacccaggatattgaagtcag

SEQ ID NO: 7099241 - DNA, 19 bp, Homo sapiens
tcacccaggctgctggctc

SEQ ID NO: 7099242 - DNA, 19 bp, Homo sapiens
tcacccaggctgctggctc

SEQ ID NO: 7099243 - DNA, 22 bp, Homo sapiens
tcacccagccttggcgggtttg

SEQ ID NO: 7099244 - DNA, 22 bp, Homo sapiens
tcacccagcgggcgcacactcg

SEQ ID NO: 7099245 - DNA, 22 bp, Homo sapiens
tcacccagcgggcgcacactcg

SEQ ID NO: 7099246 - DNA, 22 bp, Homo sapiens
tcacccagcgggcgcacactcg

SEQ ID NO: 7099247 - DNA, 22 bp, Homo sapiens
tcacccagcgggcgcacactcg

SEQ ID NO: 7099248 - DNA, 22 bp, Homo sapiens
tcacccaggatattgaagtcag

SEQ ID NO: 7099249 - DNA, 22 bp, Homo sapiens
tcacccaggctggactgcagtg

SEQ ID NO: 7099250 - DNA, 22 bp, Homo sapiens
tcacccaggctggagtgcagtg

SEQ ID NO: 7099251 - DNA, 22 bp, Homo sapiens
tcacccaggctggagtgcagtg

SEQ ID NO: 7099252 - DNA, 22 bp, Homo sapiens
tcacccaggctggagtgcagtg

SEQ ID NO: 7099253 - DNA, 22 bp, Homo sapiens
tcacccaggctggagtgtagtg

SEQ ID NO: 7099254 - DNA, 22 bp, Homo sapiens
tcacccaggctggagtgtagtg

SEQ ID NO: 7099255 - DNA, 22 bp, Homo sapiens
tcacccaggctggagtgtagtg

SEQ ID NO: 7099256 - DNA, 22 bp, Homo sapiens
tcacccaggctggtatgcagtg

SEQ ID NO: 7099257 - DNA, 22 bp, Homo sapiens
tcacccaggctggagtgtagtg

SEQ ID NO: 7099258 - DNA, 22 bp, Homo sapiens
tcacccaggctggtatgcagtg

SEQ ID NO: 7099259 - DNA, 22 bp, Homo sapiens
tcacccaggctggtatgcagtg

SEQ ID NO: 7099260 - DNA, 22 bp, Homo sapiens
tcacccaggctggtgcgcagtg

SEQ ID NO: 7099261 - DNA, 22 bp, Homo sapiens
tcactacaacctccgcctcctg

SEQ ID NO: 7099262 - DNA, 22 bp, Homo sapiens
tcaccaggctagagtgcagtgg

SEQ ID NO: 7099263 - DNA, 22 bp, Homo sapiens
tcacccagcagctgcttctgct

SEQ ID NO: 7099264 - DNA, 22 bp, Homo sapiens
tcacccagcagctgcttctgct

SEQ ID NO: 7099265 - DNA, 22 bp, Homo sapiens
tcaccaggcaactatgtactcc

SEQ ID NO: 7099266 - DNA, 22 bp, Homo sapiens
tcaccaggattgggctgtaggc

SEQ ID NO: 7099267 - DNA, 22 bp, Homo sapiens
tcaccaggattgggctgtaggc

SEQ ID NO: 7099268 - DNA, 22 bp, Homo sapiens
tcaccaggattcctatcagtag

SEQ ID NO: 7099269 - DNA, 22 bp, Homo sapiens
tcaccaggactgagaccttggg

SEQ ID NO: 7099270 - DNA, 22 bp, Homo sapiens
tcaccagatctctctgtaatgg

SEQ ID NO: 7099271 - DNA, 22 bp, Homo sapiens
tcaccagctctgcctcgccagt

SEQ ID NO: 7099272 - DNA, 22 bp, Homo sapiens
tcaccactgaggccacgtggct

SEQ ID NO: 7099273 - DNA, 23 bp, Homo sapiens
tcaccagaaggggtcaataaaga

SEQ ID NO: 7099274 - DNA, 22 bp, Homo sapiens
tcaccactgaggccacgtggct

SEQ ID NO: 7099275 - DNA, 22 bp, Homo sapiens
tcaccagatctctctgtaatgg

SEQ ID NO: 7099276 - DNA, 22 bp, Homo sapiens
tcaccactcactcaggcaagtc

SEQ ID NO: 7099277 - DNA, 22 bp, Homo sapiens
tcaccactgaacagacctttgg

SEQ ID NO: 7099278 - DNA, 22 bp, Homo sapiens
tcacattttttactggacttaa

SEQ ID NO: 7099279 - DNA, 22 bp, Homo sapiens
tcacattttcaaaagctggtgc

SEQ ID NO: 7099280 - DNA, 22 bp, Homo sapiens
tcacagtatagagttattttgg

SEQ ID NO: 7099281 - DNA, 22 bp, Homo sapiens
tcacagtataacctcatatagg

SEQ ID NO: 7099282 - DNA, 22 bp, Homo sapiens
tcacagtataacctcatatagg

SEQ ID NO: 7099283 - DNA, 22 bp, Homo sapiens
tcacagtataacctcatatagg

SEQ ID NO: 7099284 - DNA, 22 bp, Homo sapiens
tcacagtagttgttctctgttt

SEQ ID NO: 7099285 - DNA, 22 bp, Homo sapiens
tcacagtagccatttcatgagt

SEQ ID NO: 7099286 - DNA, 22 bp, Homo sapiens
tcacagtagccatttcatgagt

SEQ ID NO: 7099287 - DNA, 22 bp, Homo sapiens
tcacattttctactactgtacg

SEQ ID NO: 7099288 - DNA, 22 bp, Homo sapiens
tcacattttcatattctctgag

SEQ ID NO: 7099289 - DNA, 22 bp, Homo sapiens
tcacattttcatattctctgag

SEQ ID NO: 7099290 - DNA, 22 bp, Homo sapiens
tcacattttctactactgtacg

SEQ ID NO: 7099291 - DNA, 22 bp, Homo sapiens
tcacattttctactactgtacg

SEQ ID NO: 7099292 - DNA, 22 bp, Homo sapiens
tcactttggattatgtaatttc

SEQ ID NO: 7099293 - DNA, 22 bp, Homo sapiens
tcactttggattatgtaatttc

SEQ ID NO: 7099294 - DNA, 23 bp, Homo sapiens
tcactttgatgtaattgaaaagc

SEQ ID NO: 7099295 - DNA, 22 bp, Homo sapiens
tcactttgatgacattgtagct

SEQ ID NO: 7099296 - DNA, 22 bp, Homo sapiens
tcactttgatgacattgtagct

SEQ ID NO: 7099297 - DNA, 22 bp, Homo sapiens
tcactttgaattccttgatttt

SEQ ID NO: 7099298 - DNA, 22 bp, Homo sapiens
tcactttcctcatcacgactag

SEQ ID NO: 7099299 - DNA, 22 bp, Homo sapiens
tcactttagatcttcatctctt

SEQ ID NO: 7099300 - DNA, 22 bp, Homo sapiens
tcactttactttgttaatctgg

SEQ ID NO: 7099301 - DNA, 22 bp, Homo sapiens
tcactttactttgttaatctgg

SEQ ID NO: 7099302 - DNA, 22 bp, Homo sapiens
tcactttagaggaaacattgag

SEQ ID NO: 7099303 - DNA, 19 bp, Homo sapiens
tcacttgtgccaggcactg

SEQ ID NO: 7099304 - DNA, 22 bp, Homo sapiens
tcactttaatgatttgtagaat

SEQ ID NO: 7099305 - DNA, 22 bp, Homo sapiens
tcactttaatgatttgtagaat

SEQ ID NO: 7099306 - DNA, 22 bp, Homo sapiens
tcactgtgtcctttctgcgtag

SEQ ID NO: 7099307 - DNA, 22 bp, Homo sapiens
tcactgttaataaatagcaaag

SEQ ID NO: 7099308 - DNA, 22 bp, Homo sapiens
tcactgttaataaatagcaaag

SEQ ID NO: 7099309 - DNA, 22 bp, Homo sapiens
tcactgttaataaatagcaaag

SEQ ID NO: 7099310 - DNA, 22 bp, Homo sapiens
tcactgttagagcaaacgtatg

SEQ ID NO: 7099311 - DNA, 22 bp, Homo sapiens
tcactgttgacctggaagtggg

SEQ ID NO: 7099312 - DNA, 19 bp, Homo sapiens
tcacttctgttagcatgga

SEQ ID NO: 7099313 - DNA, 19 bp, Homo sapiens
tcacttctgttagcatgga

SEQ ID NO: 7099314 - DNA, 19 bp, Homo sapiens
tcacttctgttagcatgga

SEQ ID NO: 7099315 - DNA, 22 bp, Homo sapiens
tcacttcttcccttgcacatat

SEQ ID NO: 7099316 - DNA, 22 bp, Homo sapiens
tcacttcttcccttgcacatat

SEQ ID NO: 7099317 - DNA, 22 bp, Homo sapiens
tcacttgaacctgggaggcaga

SEQ ID NO: 7099318 - DNA, 23 bp, Homo sapiens
tcacttgaagctagaatctgccc

SEQ ID NO: 7099319 - DNA, 19 bp, Homo sapiens
tcacttgaagttcagaaat

SEQ ID NO: 7099320 - DNA, 22 bp, Homo sapiens
tcacttgaattcattctgcgaa

SEQ ID NO: 7099321 - DNA, 22 bp, Homo sapiens
tcacttgaattcattctgcgaa

SEQ ID NO: 7099322 - DNA, 22 bp, Homo sapiens
tcacttgacccttctctagcct

SEQ ID NO: 7099323 - DNA, 22 bp, Homo sapiens
tcacttgacccttctctagcct

SEQ ID NO: 7099324 - DNA, 22 bp, Homo sapiens
tcacttgacctcttgaactcct

SEQ ID NO: 7099325 - DNA, 22 bp, Homo sapiens
tcacttgactccagtttcttct

SEQ ID NO: 7099326 - DNA, 22 bp, Homo sapiens
tcacttgactttccagtcttgg

SEQ ID NO: 7099327 - DNA, 22 bp, Homo sapiens
tcacttgagagatattagaagt

SEQ ID NO: 7099328 - DNA, 22 bp, Homo sapiens
tcacttgactttccagtcttgg

SEQ ID NO: 7099329 - DNA, 22 bp, Homo sapiens
tcacttgagagatattagaagt

SEQ ID NO: 7099330 - DNA, 22 bp, Homo sapiens
tcacttgagatgtaccacaaac

SEQ ID NO: 7099331 - DNA, 22 bp, Homo sapiens
tcacttgatccttccctgaaat

SEQ ID NO: 7099332 - DNA, 22 bp, Homo sapiens
tcacttgcctagcccagttcag

SEQ ID NO: 7099333 - DNA, 22 bp, Homo sapiens
tcacttgctaacagatattgag

SEQ ID NO: 7099334 - DNA, 22 bp, Homo sapiens
tcactgaactctcatagagaaa

SEQ ID NO: 7099335 - DNA, 22 bp, Homo sapiens
tcactgaaccagggatctctag

SEQ ID NO: 7099336 - DNA, 22 bp, Homo sapiens
tcactgaaccagggatctctag

SEQ ID NO: 7099337 - DNA, 22 bp, Homo sapiens
tcactgaaagtaattctagtga

SEQ ID NO: 7099338 - DNA, 22 bp, Homo sapiens
tcactgaaagaatgacattatg

SEQ ID NO: 7099339 - DNA, 22 bp, Homo sapiens
tcactgaaaaccatacttcttt

SEQ ID NO: 7099340 - DNA, 22 bp, Homo sapiens
tcactgaaaaccatacttcttt

SEQ ID NO: 7099341 - DNA, 22 bp, Homo sapiens
tcactgaaacctccacctctcg

SEQ ID NO: 7099342 - DNA, 22 bp, Homo sapiens
tcactctgttttactcactgtt

SEQ ID NO: 7099343 - DNA, 22 bp, Homo sapiens
tcactctgttttactcactgtt

SEQ ID NO: 7099344 - DNA, 22 bp, Homo sapiens
tcactctgttagaggaaagtgc

SEQ ID NO: 7099345 - DNA, 22 bp, Homo sapiens
tcactctgttttactcactgtt

SEQ ID NO: 7099346 - DNA, 22 bp, Homo sapiens
tcactctgtggcccaggcagtg

SEQ ID NO: 7099347 - DNA, 22 bp, Homo sapiens
tcactctgtggcccaggcagtg

SEQ ID NO: 7099348 - DNA, 22 bp, Homo sapiens
tcactgaatgcagatacgtgac

SEQ ID NO: 7099349 - DNA, 22 bp, Homo sapiens
tcactgaatacttgtctcatcc

SEQ ID NO: 7099350 - DNA, 22 bp, Homo sapiens
tcactgaatacttgtctcatcc

SEQ ID NO: 7099351 - DNA, 22 bp, Homo sapiens
tcactgaatacttgtctcatcc

SEQ ID NO: 7099352 - DNA, 22 bp, Homo sapiens
tcactgaagtcttcaagtagga

SEQ ID NO: 7099353 - DNA, 22 bp, Homo sapiens
tcactgaagtcttcaagtagga

SEQ ID NO: 7099354 - DNA, 22 bp, Homo sapiens
tcactgaaggaagacactgtca

SEQ ID NO: 7099355 - DNA, 21 bp, Homo sapiens
tcactgaagcctaagatgttt

SEQ ID NO: 7099356 - DNA, 22 bp, Homo sapiens
tcactgaagactgggctctaaa

SEQ ID NO: 7099357 - DNA, 22 bp, Homo sapiens
tcactgaatttcaagctagtgg

SEQ ID NO: 7099358 - DNA, 22 bp, Homo sapiens
tcactgacgtggggctacttga

SEQ ID NO: 7099359 - DNA, 22 bp, Homo sapiens
tcactgacgtggggctacttga

SEQ ID NO: 7099360 - DNA, 19 bp, Homo sapiens
tcactgaggctttgttggc

SEQ ID NO: 7099361 - DNA, 22 bp, Homo sapiens
tcactgatgcttatgaaagtgt

SEQ ID NO: 7099362 - DNA, 22 bp, Homo sapiens
tcactgatgcttatgaaagtgt

SEQ ID NO: 7099363 - DNA, 23 bp, Homo sapiens
tcactgatgttacagcagccagt

SEQ ID NO: 7099364 - DNA, 22 bp, Homo sapiens
tcactgattatgaaaatgaagg

SEQ ID NO: 7099365 - DNA, 23 bp, Homo sapiens
tcactgtgcccattgaggtagag

SEQ ID NO: 7099366 - DNA, 19 bp, Homo sapiens
tccccaagagttctagctc

SEQ ID NO: 7099367 - DNA, 22 bp, Homo sapiens
tccccaaagctttgtggtcagg

SEQ ID NO: 7099368 - DNA, 22 bp, Homo sapiens
tcccatttcatgctggctgtgg

SEQ ID NO: 7099369 - DNA, 22 bp, Homo sapiens
tcccatttcatgctggctgtgg

SEQ ID NO: 7099370 - DNA, 22 bp, Homo sapiens
tcccatttcttgcatccttgct

SEQ ID NO: 7099371 - DNA, 22 bp, Homo sapiens
tcccatttcttgcatccttgct

SEQ ID NO: 7099372 - DNA, 22 bp, Homo sapiens
tcccattttggatgcggattgg

SEQ ID NO: 7099373 - DNA, 22 bp, Homo sapiens
tcccattttggatgcggattgg

SEQ ID NO: 7099374 - DNA, 22 bp, Homo sapiens
tcccatttcacaacaaaactgg

SEQ ID NO: 7099375 - DNA, 22 bp, Homo sapiens
tccccaagtaaagatcctgaga

SEQ ID NO: 7099376 - DNA, 22 bp, Homo sapiens
tccccacacagatacagagtag

SEQ ID NO: 7099377 - DNA, 22 bp, Homo sapiens
tccccacatctctgcatcaggc

SEQ ID NO: 7099378 - DNA, 22 bp, Homo sapiens
tccccacatctctgcatcaggc

SEQ ID NO: 7099379 - DNA, 22 bp, Homo sapiens
tccccacatctctgcatcaggc

SEQ ID NO: 7099380 - DNA, 21 bp, Homo sapiens
tccccacatttctaaacagac

SEQ ID NO: 7099381 - DNA, 22 bp, Homo sapiens
tccccaccccagaactactagg

SEQ ID NO: 7099382 - DNA, 22 bp, Homo sapiens
tccccaggagcaatgattcagt

SEQ ID NO: 7099383 - DNA, 22 bp, Homo sapiens
tccccaggactaagttgcaatc

SEQ ID NO: 7099384 - DNA, 22 bp, Homo sapiens
tccccaggaatcaggtggttgc

SEQ ID NO: 7099385 - DNA, 22 bp, Homo sapiens
tccccaggaaggcccttcctgg

SEQ ID NO: 7099386 - DNA, 22 bp, Homo sapiens
tccccaggaaggcccttcctgg

SEQ ID NO: 7099387 - DNA, 22 bp, Homo sapiens
tccccactcaccactggccaaa

SEQ ID NO: 7099388 - DNA, 22 bp, Homo sapiens
tccccactcaccactggccaaa

SEQ ID NO: 7099389 - DNA, 22 bp, Homo sapiens
tccccactcaccactggccaaa

SEQ ID NO: 7099390 - DNA, 22 bp, Homo sapiens
tccccacctacacactgctcct

SEQ ID NO: 7099391 - DNA, 22 bp, Homo sapiens
tccccacctacacactgctcct

SEQ ID NO: 7099392 - DNA, 22 bp, Homo sapiens
tccccaccccagaactactagg

SEQ ID NO: 7099393 - DNA, 22 bp, Homo sapiens
tccccacctaagatacccatct

SEQ ID NO: 7099394 - DNA, 22 bp, Homo sapiens
tccccacctaagatacccatct

SEQ ID NO: 7099395 - DNA, 22 bp, Homo sapiens
tccccaggggcatctctctgct

SEQ ID NO: 7099396 - DNA, 22 bp, Homo sapiens
tccccaggggcatctctctgct

SEQ ID NO: 7099397 - DNA, 22 bp, Homo sapiens
tccccaggggcatctctctgct

SEQ ID NO: 7099398 - DNA, 22 bp, Homo sapiens
tccccaggggcatctctctgct

SEQ ID NO: 7099399 - DNA, 22 bp, Homo sapiens
tccccaggggcatctctctgct

SEQ ID NO: 7099400 - DNA, 20 bp, Homo sapiens
tccccagggcatcaggagca

SEQ ID NO: 7099401 - DNA, 22 bp, Homo sapiens
tccccagggctgcagagggtgt

SEQ ID NO: 7099402 - DNA, 22 bp, Homo sapiens
tccccagggctgcagagggtgt

SEQ ID NO: 7099403 - DNA, 20 bp, Homo sapiens
tccccagggcatcaggagca

SEQ ID NO: 7099404 - DNA, 20 bp, Homo sapiens
tccccagggcatcaggagca

SEQ ID NO: 7099405 - DNA, 22 bp, Homo sapiens
tccccaggagttttactttgca

SEQ ID NO: 7099406 - DNA, 22 bp, Homo sapiens
tccccagggtccctgcttccat

SEQ ID NO: 7099407 - DNA, 22 bp, Homo sapiens
tccccagggtccctgcttccat

SEQ ID NO: 7099408 - DNA, 22 bp, Homo sapiens
tccccaggggcctgggcacagt

SEQ ID NO: 7099409 - DNA, 22 bp, Homo sapiens
tccccaggggcctgggcacagt

SEQ ID NO: 7099410 - DNA, 22 bp, Homo sapiens
tccccaggggcctgggcacagt

SEQ ID NO: 7099411 - DNA, 22 bp, Homo sapiens
tccccaggggcatctctctgct

SEQ ID NO: 7099412 - DNA, 22 bp, Homo sapiens
tcccagggactgggctaggctt

SEQ ID NO: 7099413 - DNA, 22 bp, Homo sapiens
tcccagggatcctccgggtcgc

SEQ ID NO: 7099414 - DNA, 22 bp, Homo sapiens
tcccagggatcctccgggtcgc

SEQ ID NO: 7099415 - DNA, 22 bp, Homo sapiens
tcccagggatcctccgggtcgc

SEQ ID NO: 7099416 - DNA, 22 bp, Homo sapiens
tcccacagtgaagttcatgata

SEQ ID NO: 7099417 - DNA, 22 bp, Homo sapiens
tcccacaggtggagcttgcagt

SEQ ID NO: 7099418 - DNA, 22 bp, Homo sapiens
tcccacagtctcacaatgcata

SEQ ID NO: 7099419 - DNA, 22 bp, Homo sapiens
tcccacaggggctctgtgggtt

SEQ ID NO: 7099420 - DNA, 22 bp, Homo sapiens
tcccacaggaggagttggaaat

SEQ ID NO: 7099421 - DNA, 22 bp, Homo sapiens
tcccacagggcttctctgtaca

SEQ ID NO: 7099422 - DNA, 22 bp, Homo sapiens
tcccacagggcttctctgtaca

SEQ ID NO: 7099423 - DNA, 22 bp, Homo sapiens
tcccacagggcttctctgtaca

SEQ ID NO: 7099424 - DNA, 22 bp, Homo sapiens
tcccacaggagcctgagtccca

SEQ ID NO: 7099425 - DNA, 22 bp, Homo sapiens
tcccacaggagcctgagtccca

SEQ ID NO: 7099426 - DNA, 22 bp, Homo sapiens
tcccacagcttcgtgcttcccc

SEQ ID NO: 7099427 - DNA, 22 bp, Homo sapiens
tcccacaggaaagtagacattg

SEQ ID NO: 7099428 - DNA, 22 bp, Homo sapiens
tcccagggtgcgcctgccctcg

SEQ ID NO: 7099429 - DNA, 22 bp, Homo sapiens
tcccagggtgcgcctgccctcg

SEQ ID NO: 7099430 - DNA, 22 bp, Homo sapiens
tcccagggtgaaatgcagtagg

SEQ ID NO: 7099431 - DNA, 22 bp, Homo sapiens
tcccagggattaggacatggat

SEQ ID NO: 7099432 - DNA, 22 bp, Homo sapiens
tcccagggattaggacatggat

SEQ ID NO: 7099433 - DNA, 21 bp, Homo sapiens
tcccagggtcttatgggatgt

SEQ ID NO: 7099434 - DNA, 22 bp, Homo sapiens
tcccagggttacagccagggca

SEQ ID NO: 7099435 - DNA, 22 bp, Homo sapiens
tcccaggtgatgctgaggccac

SEQ ID NO: 7099436 - DNA, 22 bp, Homo sapiens
tcccaggtgatgctgaggccac

SEQ ID NO: 7099437 - DNA, 22 bp, Homo sapiens
tcccaggttccaccatccaggg

SEQ ID NO: 7099438 - DNA, 22 bp, Homo sapiens
tcccagggttacagccagggca

SEQ ID NO: 7099439 - DNA, 22 bp, Homo sapiens
tcccagggttacagccagggca

SEQ ID NO: 7099440 - DNA, 22 bp, Homo sapiens
tcccatcaatgtctgcagaaga

SEQ ID NO: 7099441 - DNA, 22 bp, Homo sapiens
tcccatcaatgtctgcagaaga

SEQ ID NO: 7099442 - DNA, 22 bp, Homo sapiens
tcccagtgtggcaggccatgga

SEQ ID NO: 7099443 - DNA, 22 bp, Homo sapiens
tcccagtgggtgactggaggct

SEQ ID NO: 7099444 - DNA, 22 bp, Homo sapiens
tcccagtggtcctggccctggg

SEQ ID NO: 7099445 - DNA, 22 bp, Homo sapiens
tcccagtggtcctggccctggg

SEQ ID NO: 7099446 - DNA, 22 bp, Homo sapiens
tcccaggttccaccatccaggg

SEQ ID NO: 7099447 - DNA, 22 bp, Homo sapiens
tcccaggttccaccatccaggg

SEQ ID NO: 7099448 - DNA, 20 bp, Homo sapiens
tcccagtcagccagagtgag

SEQ ID NO: 7099449 - DNA, 20 bp, Homo sapiens
tcccagtcagccagagtgag

SEQ ID NO: 7099450 - DNA, 20 bp, Homo sapiens
tcccagtcagccagagtgag

SEQ ID NO: 7099451 - DNA, 20 bp, Homo sapiens
tcccagtcagccagagtgag

SEQ ID NO: 7099452 - DNA, 22 bp, Homo sapiens
tcccagtctagagccggattgg

SEQ ID NO: 7099453 - DNA, 22 bp, Homo sapiens
tcccagtgaggtcctggctgtc

SEQ ID NO: 7099454 - DNA, 20 bp, Homo sapiens
tcccagtctttggtctgagc

SEQ ID NO: 7099455 - DNA, 22 bp, Homo sapiens
tcccagtgctacagacagggca

SEQ ID NO: 7099456 - DNA, 22 bp, Homo sapiens
tcccagtgctgctaaagaggta

SEQ ID NO: 7099457 - DNA, 22 bp, Homo sapiens
tcccagtgggaagcagcacgct

SEQ ID NO: 7099458 - DNA, 22 bp, Homo sapiens
tcccatcaggtttaggtgggag

SEQ ID NO: 7099459 - DNA, 22 bp, Homo sapiens
tcccatcactagcatctgcacc

SEQ ID NO: 7099460 - DNA, 22 bp, Homo sapiens
tcccatcactctggaatgggta

SEQ ID NO: 7099461 - DNA, 19 bp, Homo sapiens
tcccatcaggaactggctt

SEQ ID NO: 7099462 - DNA, 22 bp, Homo sapiens
tcccatcaatgtctgcagaaga

SEQ ID NO: 7099463 - DNA, 22 bp, Homo sapiens
tcccatcactagcatctgcacc

SEQ ID NO: 7099464 - DNA, 22 bp, Homo sapiens
tcccatcactagcatctgcacc

SEQ ID NO: 7099465 - DNA, 22 bp, Homo sapiens
tcccatggtctatatagaggca

SEQ ID NO: 7099466 - DNA, 22 bp, Homo sapiens
tcccattctgccaaggacattg

SEQ ID NO: 7099467 - DNA, 23 bp, Homo sapiens
tcccattgagctctgagaactgc

SEQ ID NO: 7099468 - DNA, 22 bp, Homo sapiens
tcccattgccatagataggaca

SEQ ID NO: 7099469 - DNA, 22 bp, Homo sapiens
tcccattgcccaggtagtgtac

SEQ ID NO: 7099470 - DNA, 23 bp, Homo sapiens
tcccattgccctatagtgcctca

SEQ ID NO: 7099471 - DNA, 23 bp, Homo sapiens
tcccattgccctatagtgcctca

SEQ ID NO: 7099472 - DNA, 22 bp, Homo sapiens
tcccattgtggaaggcagaaga

SEQ ID NO: 7099473 - DNA, 21 bp, Homo sapiens
tcccattgttcccctccagtg

SEQ ID NO: 7099474 - DNA, 22 bp, Homo sapiens
tcccatttatctagatgtcaga

SEQ ID NO: 7099475 - DNA, 22 bp, Homo sapiens
tcccatttatctagatgtcaga

SEQ ID NO: 7099476 - DNA, 22 bp, Homo sapiens
tcccattgtttgctctaggctg

SEQ ID NO: 7099477 - DNA, 22 bp, Homo sapiens
tcccatttattaattagtttgc

SEQ ID NO: 7099478 - DNA, 22 bp, Homo sapiens
tcccatttattaattagtttgc

SEQ ID NO: 7099479 - DNA, 22 bp, Homo sapiens
tcccatttcacaacaaaactgg

SEQ ID NO: 7099480 - DNA, 22 bp, Homo sapiens
tcccattctgccaaggacattg

SEQ ID NO: 7099481 - DNA, 22 bp, Homo sapiens
tcccatgttaggtgtttctgtt

SEQ ID NO: 7099482 - DNA, 22 bp, Homo sapiens
tccaggctgatccatgaagaat

SEQ ID NO: 7099483 - DNA, 19 bp, Homo sapiens
tccaggctgagagtcagct

SEQ ID NO: 7099484 - DNA, 19 bp, Homo sapiens
tccaggctgagagtcagct

SEQ ID NO: 7099485 - DNA, 19 bp, Homo sapiens
tccaggctgagagtcagct

SEQ ID NO: 7099486 - DNA, 22 bp, Homo sapiens
tccaggctgatccatgaagaat

SEQ ID NO: 7099487 - DNA, 21 bp, Homo sapiens
tccaggctgatgatgtcaact

SEQ ID NO: 7099488 - DNA, 22 bp, Homo sapiens
tccaggctgcaaggccacaggg

SEQ ID NO: 7099489 - DNA, 21 bp, Homo sapiens
tccaggctgatgatgtcaact

SEQ ID NO: 7099490 - DNA, 22 bp, Homo sapiens
tccaggctgcaaggccacaggg

SEQ ID NO: 7099491 - DNA, 22 bp, Homo sapiens
tccaggctgcaaggccacaggg

SEQ ID NO: 7099492 - DNA, 22 bp, Homo sapiens
tccaggctgcaaggccacaggg

SEQ ID NO: 7099493 - DNA, 22 bp, Homo sapiens
tccaggctctcaggtgtcagca

SEQ ID NO: 7099494 - DNA, 23 bp, Homo sapiens
tccaggctgaaggagcagatttt

SEQ ID NO: 7099495 - DNA, 23 bp, Homo sapiens
tccaggctgaaggagcagatttt

SEQ ID NO: 7099496 - DNA, 23 bp, Homo sapiens
tccaggctgaaggagcagatttt

SEQ ID NO: 7099497 - DNA, 22 bp, Homo sapiens
tccaggctgacgcagctattta

SEQ ID NO: 7099498 - DNA, 22 bp, Homo sapiens
tccaggctgacgcagctattta

SEQ ID NO: 7099499 - DNA, 19 bp, Homo sapiens
tccaggctgagagtcagct

SEQ ID NO: 7099500 - DNA, 22 bp, Homo sapiens
tccaggctctcaggtgtcagca

SEQ ID NO: 7099501 - DNA, 22 bp, Homo sapiens
tccaggctctcaggtgtcagca

SEQ ID NO: 7099502 - DNA, 22 bp, Homo sapiens
tccaggctctcaggtgtcagca

SEQ ID NO: 7099503 - DNA, 22 bp, Homo sapiens
tccaggctcagcacttgctact

SEQ ID NO: 7099504 - DNA, 22 bp, Homo sapiens
tccaggctctaggctgctctcc

SEQ ID NO: 7099505 - DNA, 22 bp, Homo sapiens
tccaggctctaggctgctctcc

SEQ ID NO: 7099506 - DNA, 22 bp, Homo sapiens
tccaggctctaggctgctctcc

SEQ ID NO: 7099507 - DNA, 22 bp, Homo sapiens
tccaggccactgcagaggctct

SEQ ID NO: 7099508 - DNA, 22 bp, Homo sapiens
tccaggccactgcagaggctct

SEQ ID NO: 7099509 - DNA, 22 bp, Homo sapiens
tccaggccactgcagaggctct

SEQ ID NO: 7099510 - DNA, 22 bp, Homo sapiens
tccaggccactgcagaggctct

SEQ ID NO: 7099511 - DNA, 22 bp, Homo sapiens
tccaggccacgacctcctggat

SEQ ID NO: 7099512 - DNA, 22 bp, Homo sapiens
tccaggccacgacctcctggat

SEQ ID NO: 7099513 - DNA, 22 bp, Homo sapiens
tccaggccactgcagaggctct

SEQ ID NO: 7099514 - DNA, 22 bp, Homo sapiens
tccaggccactgcagaggctct

SEQ ID NO: 7099515 - DNA, 22 bp, Homo sapiens
tccaggctaggtttacaggaca

SEQ ID NO: 7099516 - DNA, 22 bp, Homo sapiens
tccaggctaggtttacaggaca

SEQ ID NO: 7099517 - DNA, 22 bp, Homo sapiens
tccaggccaatgtagcaggccc

SEQ ID NO: 7099518 - DNA, 22 bp, Homo sapiens
tccaggccaatgtagcaggccc

SEQ ID NO: 7099519 - DNA, 22 bp, Homo sapiens
tccaggccaatgtagcaggccc

SEQ ID NO: 7099520 - DNA, 22 bp, Homo sapiens
tccaggcattggagagataatg

SEQ ID NO: 7099521 - DNA, 22 bp, Homo sapiens
tccaggccaatgtagcaggccc

SEQ ID NO: 7099522 - DNA, 22 bp, Homo sapiens
tccaggccaatgtagcaggccc

SEQ ID NO: 7099523 - DNA, 22 bp, Homo sapiens
tccaggccaatgtagcaggccc

SEQ ID NO: 7099524 - DNA, 22 bp, Homo sapiens
tccaggcatgttgggaagatga

SEQ ID NO: 7099525 - DNA, 22 bp, Homo sapiens
tccaggcatgttgggaagatga

SEQ ID NO: 7099526 - DNA, 15 bp, Homo sapiens
tccaggcattcattc

SEQ ID NO: 7099527 - DNA, 22 bp, Homo sapiens
tccaggcattccagccattcca

SEQ ID NO: 7099528 - DNA, 22 bp, Homo sapiens
tccaggcattccagccattcca

SEQ ID NO: 7099529 - DNA, 22 bp, Homo sapiens
tccaggccaatgtagcaggccc

SEQ ID NO: 7099530 - DNA, 22 bp, Homo sapiens
tccaggccaatgtagcaggccc

SEQ ID NO: 7099531 - DNA, 22 bp, Homo sapiens
tccaggccacatggatggcgat

SEQ ID NO: 7099532 - DNA, 22 bp, Homo sapiens
tccaggccacatggatggcgat

SEQ ID NO: 7099533 - DNA, 22 bp, Homo sapiens
tccaggccacatggatggcgat

SEQ ID NO: 7099534 - DNA, 22 bp, Homo sapiens
tccaggccacatggatggcgat

SEQ ID NO: 7099535 - DNA, 22 bp, Homo sapiens
tccaggccacgacctcctggat

SEQ ID NO: 7099536 - DNA, 22 bp, Homo sapiens
tccaggccacgacctcctggat

SEQ ID NO: 7099537 - DNA, 22 bp, Homo sapiens
tccaggccacatggatggcgat

SEQ ID NO: 7099538 - DNA, 22 bp, Homo sapiens
tccaggccacgacctcctggat

SEQ ID NO: 7099539 - DNA, 22 bp, Homo sapiens
tccaggccacgacctcctggat

SEQ ID NO: 7099540 - DNA, 22 bp, Homo sapiens
tccaggccacgacctcctggat

SEQ ID NO: 7099541 - DNA, 22 bp, Homo sapiens
tccaggcatgtggccagtactc

SEQ ID NO: 7099542 - DNA, 22 bp, Homo sapiens
tccaggcatgtctgagtccttc

SEQ ID NO: 7099543 - DNA, 23 bp, Homo sapiens
tccaggcatgagctctggatgga

SEQ ID NO: 7099544 - DNA, 22 bp, Homo sapiens
tccaggcatggtgtaattttgc

SEQ ID NO: 7099545 - DNA, 22 bp, Homo sapiens
tccaggcatgtcccaagccgga

SEQ ID NO: 7099546 - DNA, 17 bp, Homo sapiens
tccaggcatatctccta

SEQ ID NO: 7099547 - DNA, 16 bp, Homo sapiens
tccaggcatatctgag

SEQ ID NO: 7099548 - DNA, 22 bp, Homo sapiens
tccaggcatcccccaggacaga

SEQ ID NO: 7099549 - DNA, 22 bp, Homo sapiens
tccaggcatcccccaggacaga

SEQ ID NO: 7099550 - DNA, 22 bp, Homo sapiens
tccaggcatcccccaggacaga

SEQ ID NO: 7099551 - DNA, 19 bp, Homo sapiens
tccaggcatccttcaggct

SEQ ID NO: 7099552 - DNA, 22 bp, Homo sapiens
tccaggcatctgtattttttaa

SEQ ID NO: 7099553 - DNA, 23 bp, Homo sapiens
tccaggcatgagctctggatgga

SEQ ID NO: 7099554 - DNA, 22 bp, Homo sapiens
tccaggcataagccttgagtgt

SEQ ID NO: 7099555 - DNA, 22 bp, Homo sapiens
tccaggcataatgcccagtggt

SEQ ID NO: 7099556 - DNA, 22 bp, Homo sapiens
tccaggcatagaaggcacgcac

SEQ ID NO: 7099557 - DNA, 22 bp, Homo sapiens
tccaggcagggttaagggtcct

SEQ ID NO: 7099558 - DNA, 22 bp, Homo sapiens
tccaggcagggttaagggtcct

SEQ ID NO: 7099559 - DNA, 22 bp, Homo sapiens
tccaggcagtcattaatctcta

SEQ ID NO: 7099560 - DNA, 22 bp, Homo sapiens
tccaggcagttttccaggttgt

SEQ ID NO: 7099561 - DNA, 22 bp, Homo sapiens
tccaggcagttttccaggttgt

SEQ ID NO: 7099562 - DNA, 22 bp, Homo sapiens
tccaggagtttgagactgcagt

SEQ ID NO: 7099563 - DNA, 22 bp, Homo sapiens
tccaggcaaaaaccaactacag

SEQ ID NO: 7099564 - DNA, 20 bp, Homo sapiens
tccaggcagctcagagtgtc

SEQ ID NO: 7099565 - DNA, 22 bp, Homo sapiens
tccaggcagggcagccatcaag

SEQ ID NO: 7099566 - DNA, 22 bp, Homo sapiens
tccaggagtgctggttagagta

SEQ ID NO: 7099567 - DNA, 22 bp, Homo sapiens
tccaggagtgataaggccactg

SEQ ID NO: 7099568 - DNA, 22 bp, Homo sapiens
tccaggagtgataaggccactg

SEQ ID NO: 7099569 - DNA, 21 bp, Homo sapiens
tccaggagtggctgggcaggg

SEQ ID NO: 7099570 - DNA, 21 bp, Homo sapiens
tccaggagtggctgggcaggg

SEQ ID NO: 7099571 - DNA, 21 bp, Homo sapiens
tccaggagtggctgggcaggg

SEQ ID NO: 7099572 - DNA, 22 bp, Homo sapiens
tccaggagtggggcagaggtct

SEQ ID NO: 7099573 - DNA, 22 bp, Homo sapiens
tccaggagtgtgtgctaatggg

SEQ ID NO: 7099574 - DNA, 22 bp, Homo sapiens
tccaggagtgtgtgctaatggg

SEQ ID NO: 7099575 - DNA, 22 bp, Homo sapiens
tccaggagtggggcagaggtct

SEQ ID NO: 7099576 - DNA, 22 bp, Homo sapiens
tccaggagtttgacctgtgggc

SEQ ID NO: 7099577 - DNA, 22 bp, Homo sapiens
tccaggagtttgacctgtgggc

SEQ ID NO: 7099578 - DNA, 22 bp, Homo sapiens
tccaggagtttgacctgtgggc

SEQ ID NO: 7099579 - DNA, 22 bp, Homo sapiens
tccaggaggggtaggcagtatg

SEQ ID NO: 7099580 - DNA, 22 bp, Homo sapiens
tccaggaggggtaggcagtatg

SEQ ID NO: 7099581 - DNA, 22 bp, Homo sapiens
tccaggaggtatgagtggcccc

SEQ ID NO: 7099582 - DNA, 22 bp, Homo sapiens
tccaggaggtatgagtggcccc

SEQ ID NO: 7099583 - DNA, 22 bp, Homo sapiens
tccaggagggttttctgccttc

SEQ ID NO: 7099584 - DNA, 22 bp, Homo sapiens
tccaggagggttttctgccttc

SEQ ID NO: 7099585 - DNA, 22 bp, Homo sapiens
tccaggaggttgagactgcagt

SEQ ID NO: 7099586 - DNA, 20 bp, Homo sapiens
tccaggaggttagtgtggct

SEQ ID NO: 7099587 - DNA, 20 bp, Homo sapiens
tccaggaggttagtgtggct

SEQ ID NO: 7099588 - DNA, 20 bp, Homo sapiens
tccaggaggttagtgtggct

SEQ ID NO: 7099589 - DNA, 22 bp, Homo sapiens
tccaggaggtgaggggaccaaa

SEQ ID NO: 7099590 - DNA, 22 bp, Homo sapiens
tccaggaggtgaggggaccaaa

SEQ ID NO: 7099591 - DNA, 20 bp, Homo sapiens
tccaggaggttagtgtggct

SEQ ID NO: 7099592 - DNA, 22 bp, Homo sapiens
tccaggaggtatgagtggcccc

SEQ ID NO: 7099593 - DNA, 22 bp, Homo sapiens
tccaggaggtatgagtggcccc

SEQ ID NO: 7099594 - DNA, 22 bp, Homo sapiens
tccaggagtcagacagatggtg

SEQ ID NO: 7099595 - DNA, 22 bp, Homo sapiens
tccaggagtcagacagatggtg

SEQ ID NO: 7099596 - DNA, 22 bp, Homo sapiens
tccaggagtcagacagatggtg

SEQ ID NO: 7099597 - DNA, 22 bp, Homo sapiens
tccaggaggtttggaggaagca

SEQ ID NO: 7099598 - DNA, 22 bp, Homo sapiens
tccaggaggtttggaggaagca

SEQ ID NO: 7099599 - DNA, 22 bp, Homo sapiens
tccaggaggttgagtgagttcc

SEQ ID NO: 7099600 - DNA, 22 bp, Homo sapiens
tccaggagtcctgggagtgatt

SEQ ID NO: 7099601 - DNA, 22 bp, Homo sapiens
tccaggagtcctgggagtgatt

SEQ ID NO: 7099602 - DNA, 22 bp, Homo sapiens
tccaggagtcctgggtggcccc

SEQ ID NO: 7099603 - DNA, 22 bp, Homo sapiens
tccaggagtcctgggtggcccc

SEQ ID NO: 7099604 - DNA, 22 bp, Homo sapiens
tccaggagtctagcctcaggcc

SEQ ID NO: 7099605 - DNA, 22 bp, Homo sapiens
tccaggagtcctgggtggcccc

SEQ ID NO: 7099606 - DNA, 22 bp, Homo sapiens
tccaggagtctagcctcaggcc

SEQ ID NO: 7099607 - DNA, 22 bp, Homo sapiens
tccaggagtctagcctcaggcc

SEQ ID NO: 7099608 - DNA, 22 bp, Homo sapiens
tccatcaggctcgtgggctctc

SEQ ID NO: 7099609 - DNA, 22 bp, Homo sapiens
tccagtttatttttggcagggt

SEQ ID NO: 7099610 - DNA, 22 bp, Homo sapiens
tccatcaccatttctgcgagct

SEQ ID NO: 7099611 - DNA, 22 bp, Homo sapiens
tccagggctccccaacatccag

SEQ ID NO: 7099612 - DNA, 22 bp, Homo sapiens
tccagggctcattccctctgca

SEQ ID NO: 7099613 - DNA, 22 bp, Homo sapiens
tccagggctcattccctctgca

SEQ ID NO: 7099614 - DNA, 20 bp, Homo sapiens
tccagggctagggagctcat

SEQ ID NO: 7099615 - DNA, 20 bp, Homo sapiens
tccagggctagggagctcat

SEQ ID NO: 7099616 - DNA, 22 bp, Homo sapiens
tccagggcgtgtgtgaaggaaa

SEQ ID NO: 7099617 - DNA, 22 bp, Homo sapiens
tccagggcgtgtgtgaaggaaa

SEQ ID NO: 7099618 - DNA, 22 bp, Homo sapiens
tccagggcctgaggttgaagtg

SEQ ID NO: 7099619 - DNA, 22 bp, Homo sapiens
tccagggccttacctcttcaga

SEQ ID NO: 7099620 - DNA, 20 bp, Homo sapiens
tccagggccctggctcctct

SEQ ID NO: 7099621 - DNA, 20 bp, Homo sapiens
tccagggccctggctcctct

SEQ ID NO: 7099622 - DNA, 20 bp, Homo sapiens
tccagggccctggctcctct

SEQ ID NO: 7099623 - DNA, 20 bp, Homo sapiens
tccagggccctggctcctct

SEQ ID NO: 7099624 - DNA, 22 bp, Homo sapiens
tccagggccatctccatgaggc

SEQ ID NO: 7099625 - DNA, 22 bp, Homo sapiens
tccagggccagtccttgtctgt

SEQ ID NO: 7099626 - DNA, 22 bp, Homo sapiens
tccagggccatctccatgaggc

SEQ ID NO: 7099627 - DNA, 22 bp, Homo sapiens
tccagggccacagaggatgcta

SEQ ID NO: 7099628 - DNA, 22 bp, Homo sapiens
tccagggcagggtgcgcatggg

SEQ ID NO: 7099629 - DNA, 19 bp, Homo sapiens
tccagggcaggaacatgta

SEQ ID NO: 7099630 - DNA, 22 bp, Homo sapiens
tccaggctggaaatgtcaaact

SEQ ID NO: 7099631 - DNA, 22 bp, Homo sapiens
tccaggctgccacagtgcaacg

SEQ ID NO: 7099632 - DNA, 22 bp, Homo sapiens
tccaggctgccacagtgcaacg

SEQ ID NO: 7099633 - DNA, 22 bp, Homo sapiens
tccaggctggaaatgtcaaact

SEQ ID NO: 7099634 - DNA, 21 bp, Homo sapiens
tccaggctggaaggggcgttg

SEQ ID NO: 7099635 - DNA, 22 bp, Homo sapiens
tccaggctgcagtcttgccctc

SEQ ID NO: 7099636 - DNA, 22 bp, Homo sapiens
tccaggctgcagtcttgccctc

SEQ ID NO: 7099637 - DNA, 22 bp, Homo sapiens
tccatgaggcagggaggctggc

SEQ ID NO: 7099638 - DNA, 22 bp, Homo sapiens
tccatgagggacactggatgct

SEQ ID NO: 7099639 - DNA, 20 bp, Homo sapiens
tccatgagttagagactata

SEQ ID NO: 7099640 - DNA, 22 bp, Homo sapiens
tccatgagtttgaggaaaagag

SEQ ID NO: 7099641 - DNA, 22 bp, Homo sapiens
tccatgcaaacagtggctagct

SEQ ID NO: 7099642 - DNA, 20 bp, Homo sapiens
tccatgcaaatacagagttt

SEQ ID NO: 7099643 - DNA, 22 bp, Homo sapiens
tccatgcagagaactgaagtac

SEQ ID NO: 7099644 - DNA, 22 bp, Homo sapiens
tccatgagaggtaactttacaa

SEQ ID NO: 7099645 - DNA, 22 bp, Homo sapiens
tccatgagaggtaactttacaa

SEQ ID NO: 7099646 - DNA, 22 bp, Homo sapiens
tccatgagacagatactgtaag

SEQ ID NO: 7099647 - DNA, 17 bp, Homo sapiens
tccatgagacatgaaga

SEQ ID NO: 7099648 - DNA, 22 bp, Homo sapiens
tccatgagaacccttggagata

SEQ ID NO: 7099649 - DNA, 22 bp, Homo sapiens
tccatgagaacccttggagata

SEQ ID NO: 7099650 - DNA, 23 bp, Homo sapiens
tccatgagatgtgggcttctagt

SEQ ID NO: 7099651 - DNA, 17 bp, Homo sapiens
tccatgagacatgaaga

SEQ ID NO: 7099652 - DNA, 22 bp, Homo sapiens
tccatgagctagctttccaaag

SEQ ID NO: 7099653 - DNA, 22 bp, Homo sapiens
tccatgagctagggattcatca

SEQ ID NO: 7099654 - DNA, 22 bp, Homo sapiens
tccatgaggaccaaattcgtag

SEQ ID NO: 7099655 - DNA, 22 bp, Homo sapiens
tccatgaggcagggaggctggc

SEQ ID NO: 7099656 - DNA, 22 bp, Homo sapiens
tccatctgtctttcccatccac

SEQ ID NO: 7099657 - DNA, 22 bp, Homo sapiens
tccatctgtcaaatatcatgct

SEQ ID NO: 7099658 - DNA, 22 bp, Homo sapiens
tccatctgtttactataaagat

SEQ ID NO: 7099659 - DNA, 20 bp, Homo sapiens
tccatcttgggcagaagcag

SEQ ID NO: 7099660 - DNA, 22 bp, Homo sapiens
tccatctgcatttggtttctgt

SEQ ID NO: 7099661 - DNA, 22 bp, Homo sapiens
tccatctggagacttcctggtc

SEQ ID NO: 7099662 - DNA, 22 bp, Homo sapiens
tccatctggtgagtgaggagcc

SEQ ID NO: 7099663 - DNA, 22 bp, Homo sapiens
tccatctcacctgcactctgcg

SEQ ID NO: 7099664 - DNA, 22 bp, Homo sapiens
tccatctcacctgcactctgcg

SEQ ID NO: 7099665 - DNA, 22 bp, Homo sapiens
tccatccatgtaggaagatggt

SEQ ID NO: 7099666 - DNA, 22 bp, Homo sapiens
tccatccctgactcctcctgga

SEQ ID NO: 7099667 - DNA, 22 bp, Homo sapiens
tccatccatgtaggaagatggt

SEQ ID NO: 7099668 - DNA, 22 bp, Homo sapiens
tccatccaccctgcattatatt

SEQ ID NO: 7099669 - DNA, 22 bp, Homo sapiens
tccatccaggccagcagtaatc

SEQ ID NO: 7099670 - DNA, 21 bp, Homo sapiens
tcccacagcgccagctcctgt

SEQ ID NO: 7099671 - DNA, 21 bp, Homo sapiens
tcccacagcgccagctcctgt

SEQ ID NO: 7099672 - DNA, 21 bp, Homo sapiens
tcccacagcgccagctcctgt

SEQ ID NO: 7099673 - DNA, 22 bp, Homo sapiens
tcccacagatgctgtccagagt

SEQ ID NO: 7099674 - DNA, 22 bp, Homo sapiens
tcccacagagtggctcacctag

SEQ ID NO: 7099675 - DNA, 22 bp, Homo sapiens
tcccacagagtggctcacctag

SEQ ID NO: 7099676 - DNA, 22 bp, Homo sapiens
tcccaagtgtcttggaccaggg

SEQ ID NO: 7099677 - DNA, 22 bp, Homo sapiens
tcccaatttcgagagttttaga

SEQ ID NO: 7099678 - DNA, 22 bp, Homo sapiens
tcccacacagcccgctcaccgg

SEQ ID NO: 7099679 - DNA, 22 bp, Homo sapiens
tcccacacttgaaacaaggctg

SEQ ID NO: 7099680 - DNA, 22 bp, Homo sapiens
tcccaagcttagggctctcagt

SEQ ID NO: 7099681 - DNA, 22 bp, Homo sapiens
tcccaagcttagggctctcagt

SEQ ID NO: 7099682 - DNA, 22 bp, Homo sapiens
tcccaagccctggatgcctcag

SEQ ID NO: 7099683 - DNA, 22 bp, Homo sapiens
tcccaagccctggatgcctcag

SEQ ID NO: 7099684 - DNA, 21 bp, Homo sapiens
tcccaagctgctggctcagct

SEQ ID NO: 7099685 - DNA, 21 bp, Homo sapiens
tcccaagctgctggctcagct

SEQ ID NO: 7099686 - DNA, 21 bp, Homo sapiens
tcccaagctgctggctcagct

SEQ ID NO: 7099687 - DNA, 22 bp, Homo sapiens
tccatgccaggcagtcgatgca

SEQ ID NO: 7099688 - DNA, 20 bp, Homo sapiens
tccatgcagtttccatacag

SEQ ID NO: 7099689 - DNA, 22 bp, Homo sapiens
tccatgccaggcagtcgatgca

SEQ ID NO: 7099690 - DNA, 22 bp, Homo sapiens
tcccaagcaatgagtcagggcc

SEQ ID NO: 7099691 - DNA, 22 bp, Homo sapiens
tccatgcagaggagctggtggc

SEQ ID NO: 7099692 - DNA, 20 bp, Homo sapiens
tcccaaggatgcctgggtgt

SEQ ID NO: 7099693 - DNA, 20 bp, Homo sapiens
tcccaaggatgcctgggtgt

SEQ ID NO: 7099694 - DNA, 20 bp, Homo sapiens
tcccaaggatgcctgggtgt

SEQ ID NO: 7099695 - DNA, 22 bp, Homo sapiens
tcccaaggataagagagtctga

SEQ ID NO: 7099696 - DNA, 22 bp, Homo sapiens
tcccaaggcacagggcagggac

SEQ ID NO: 7099697 - DNA, 22 bp, Homo sapiens
tcccaaggcctctagttgatta

SEQ ID NO: 7099698 - DNA, 20 bp, Homo sapiens
tcccaagggctgagaggatc

SEQ ID NO: 7099699 - DNA, 20 bp, Homo sapiens
tcccaagggctgagaggatc

SEQ ID NO: 7099700 - DNA, 22 bp, Homo sapiens
tcccaaggtgctcggcaacagg

SEQ ID NO: 7099701 - DNA, 22 bp, Homo sapiens
tccagagcctttctgcttgaca

SEQ ID NO: 7099702 - DNA, 18 bp, Homo sapiens
tccagagctactgtggtg

SEQ ID NO: 7099703 - DNA, 22 bp, Homo sapiens
tccagagcctgcgcactggctg

SEQ ID NO: 7099704 - DNA, 22 bp, Homo sapiens
tccagagcctttccacccactt

SEQ ID NO: 7099705 - DNA, 22 bp, Homo sapiens
tccagagccccagtctagtggg

SEQ ID NO: 7099706 - DNA, 22 bp, Homo sapiens
tccagagcaggtggtcagaagg

SEQ ID NO: 7099707 - DNA, 22 bp, Homo sapiens
tccagagcaggtgtctacacag

SEQ ID NO: 7099708 - DNA, 22 bp, Homo sapiens
tccagagcaggtgtctacacag

SEQ ID NO: 7099709 - DNA, 22 bp, Homo sapiens
tccagagatcacactgggcagg

SEQ ID NO: 7099710 - DNA, 22 bp, Homo sapiens
tccagagatccaaagaatatga

SEQ ID NO: 7099711 - DNA, 22 bp, Homo sapiens
tcattgagttgcacttttacta

SEQ ID NO: 7099712 - DNA, 22 bp, Homo sapiens
tcattgataaagtactgctttt

SEQ ID NO: 7099713 - DNA, 22 bp, Homo sapiens
tcattgataaagtactgctttt

SEQ ID NO: 7099714 - DNA, 23 bp, Homo sapiens
tcattgatcttgtcagagcattt

SEQ ID NO: 7099715 - DNA, 22 bp, Homo sapiens
tcattgatggcttctttcttgc

SEQ ID NO: 7099716 - DNA, 22 bp, Homo sapiens
tcattgatggcttctttcttgc

SEQ ID NO: 7099717 - DNA, 22 bp, Homo sapiens
tcattgatggcttctttcttgc

SEQ ID NO: 7099718 - DNA, 22 bp, Homo sapiens
tcattgcaagctcatttatctg

SEQ ID NO: 7099719 - DNA, 22 bp, Homo sapiens
tcattgaatttggttcaatatg

SEQ ID NO: 7099720 - DNA, 22 bp, Homo sapiens
tcattgaatttggttcaatatg

SEQ ID NO: 7099721 - DNA, 22 bp, Homo sapiens
tcattgacagttgtttcaaata

SEQ ID NO: 7099722 - DNA, 22 bp, Homo sapiens
tcattgagcggttcttaaccca

SEQ ID NO: 7099723 - DNA, 22 bp, Homo sapiens
tcattgagttcaaatccttcat

SEQ ID NO: 7099724 - DNA, 22 bp, Homo sapiens
tcattgaagacttactggcttc

SEQ ID NO: 7099725 - DNA, 22 bp, Homo sapiens
tcattgaagcattttgtgtatt

SEQ ID NO: 7099726 - DNA, 22 bp, Homo sapiens
tcattgaagcccttgacaagcc

SEQ ID NO: 7099727 - DNA, 22 bp, Homo sapiens
tcattgaagtgactgaaagatt

SEQ ID NO: 7099728 - DNA, 22 bp, Homo sapiens
tcattgaatacatatttgggat

SEQ ID NO: 7099729 - DNA, 22 bp, Homo sapiens
tcattgaatatggggccataca

SEQ ID NO: 7099730 - DNA, 22 bp, Homo sapiens
tcattgaatgagatgcaataga

SEQ ID NO: 7099731 - DNA, 22 bp, Homo sapiens
tcattgaatgctctgcaggttg

SEQ ID NO: 7099732 - DNA, 22 bp, Homo sapiens
tcattgaattctgggggttgag

SEQ ID NO: 7099733 - DNA, 22 bp, Homo sapiens
tcattgaatttcacagctttat

SEQ ID NO: 7099734 - DNA, 22 bp, Homo sapiens
tcattgcagactaacaatctca

SEQ ID NO: 7099735 - DNA, 22 bp, Homo sapiens
tcattgcaggcattcccctgcc

SEQ ID NO: 7099736 - DNA, 22 bp, Homo sapiens
tcattgccatggcatttgcaga

SEQ ID NO: 7099737 - DNA, 22 bp, Homo sapiens
tcattgccatggcatttgcaga

SEQ ID NO: 7099738 - DNA, 19 bp, Homo sapiens
tccagaactgccctggcct

SEQ ID NO: 7099739 - DNA, 22 bp, Homo sapiens
tccagaaggccacccggggatg

SEQ ID NO: 7099740 - DNA, 22 bp, Homo sapiens
tccagagaggtttctccatgct

SEQ ID NO: 7099741 - DNA, 22 bp, Homo sapiens
tccagagctgagggtcagtaga

SEQ ID NO: 7099742 - DNA, 23 bp, Homo sapiens
tccagagctcatgctctcaacca

SEQ ID NO: 7099743 - DNA, 22 bp, Homo sapiens
tccagagctgtcctactgtgag

SEQ ID NO: 7099744 - DNA, 22 bp, Homo sapiens
tccagagctgggtctgtgctca

SEQ ID NO: 7099745 - DNA, 18 bp, Homo sapiens
tccagagctggtgcttct

SEQ ID NO: 7099746 - DNA, 22 bp, Homo sapiens
tccagaggcaaaaaggtatgga

SEQ ID NO: 7099747 - DNA, 22 bp, Homo sapiens
tccagaggtatgtagagagtat

SEQ ID NO: 7099748 - DNA, 22 bp, Homo sapiens
tccagcagaccatcaaggctca

SEQ ID NO: 7099749 - DNA, 22 bp, Homo sapiens
tccagagggcgatggctggggg

SEQ ID NO: 7099750 - DNA, 22 bp, Homo sapiens
tccagagggcgatggctggggg

SEQ ID NO: 7099751 - DNA, 22 bp, Homo sapiens
tccagagggcgatggctggggg

SEQ ID NO: 7099752 - DNA, 22 bp, Homo sapiens
tccagaggctctgagggagagt

SEQ ID NO: 7099753 - DNA, 22 bp, Homo sapiens
tccagaggctctgagggagagt

SEQ ID NO: 7099754 - DNA, 22 bp, Homo sapiens
tccagaggctccaaagggagat

SEQ ID NO: 7099755 - DNA, 20 bp, Homo sapiens
tccagaggccacatccagtg

SEQ ID NO: 7099756 - DNA, 22 bp, Homo sapiens
tccagcagactcatcagcaagg

SEQ ID NO: 7099757 - DNA, 22 bp, Homo sapiens
tccagcagactcatcagcaagg

SEQ ID NO: 7099758 - DNA, 23 bp, Homo sapiens
tccagcagagccttccaggaggg

SEQ ID NO: 7099759 - DNA, 22 bp, Homo sapiens
tccagcagaggttgataatacc

SEQ ID NO: 7099760 - DNA, 22 bp, Homo sapiens
tccagcagaggttgataatacc

SEQ ID NO: 7099761 - DNA, 22 bp, Homo sapiens
tccagcagagtctctgaggggg

SEQ ID NO: 7099762 - DNA, 22 bp, Homo sapiens
tccagcagagtctctgaggggg

SEQ ID NO: 7099763 - DNA, 18 bp, Homo sapiens
tccagcagcatagtttcc

SEQ ID NO: 7099764 - DNA, 23 bp, Homo sapiens
tccagcagccaagaagggtagaa

SEQ ID NO: 7099765 - DNA, 23 bp, Homo sapiens
tccagcagccaagaagggtagaa

SEQ ID NO: 7099766 - DNA, 22 bp, Homo sapiens
tccagcagccacacctctggac

SEQ ID NO: 7099767 - DNA, 22 bp, Homo sapiens
tccagcagccacacctctggac

SEQ ID NO: 7099768 - DNA, 22 bp, Homo sapiens
tccagcagccacacctctggac

SEQ ID NO: 7099769 - DNA, 22 bp, Homo sapiens
tccagcagcccgaaggcccatc

SEQ ID NO: 7099770 - DNA, 22 bp, Homo sapiens
tccagcagcccgaaggcccatc

SEQ ID NO: 7099771 - DNA, 22 bp, Homo sapiens
tccagcaggtccgagacaagtt

SEQ ID NO: 7099772 - DNA, 18 bp, Homo sapiens
tccagcaggtctgaggtg

SEQ ID NO: 7099773 - DNA, 22 bp, Homo sapiens
tccagcaggtgtttgccaactt

SEQ ID NO: 7099774 - DNA, 22 bp, Homo sapiens
tccagcaggtgtttgccaactt

SEQ ID NO: 7099775 - DNA, 22 bp, Homo sapiens
tccagctcccactctcactgct

SEQ ID NO: 7099776 - DNA, 22 bp, Homo sapiens
tccagctcccactctcactgct

SEQ ID NO: 7099777 - DNA, 22 bp, Homo sapiens
tccagctcccactctcactgct

SEQ ID NO: 7099778 - DNA, 22 bp, Homo sapiens
tccagctcccactctcactgct

SEQ ID NO: 7099779 - DNA, 22 bp, Homo sapiens
tccagctccacagcctccctgt

SEQ ID NO: 7099780 - DNA, 22 bp, Homo sapiens
tccagctccacagcctccctgt

SEQ ID NO: 7099781 - DNA, 22 bp, Homo sapiens
tccagctcccactctcactgct

SEQ ID NO: 7099782 - DNA, 22 bp, Homo sapiens
tccagctcatctgtctccatta

SEQ ID NO: 7099783 - DNA, 22 bp, Homo sapiens
tccagctcatctgtctccatta

SEQ ID NO: 7099784 - DNA, 22 bp, Homo sapiens
tccagctccacagcctccctgt

SEQ ID NO: 7099785 - DNA, 22 bp, Homo sapiens
tccagctcagggttggctcaag

SEQ ID NO: 7099786 - DNA, 20 bp, Homo sapiens
tccagctcagtttttttgtc

SEQ ID NO: 7099787 - DNA, 22 bp, Homo sapiens
tccagctcatctgtctccatta

SEQ ID NO: 7099788 - DNA, 22 bp, Homo sapiens
tccagctcatctgtctccatta

SEQ ID NO: 7099789 - DNA, 22 bp, Homo sapiens
tccagctcccactctcactgct

SEQ ID NO: 7099790 - DNA, 22 bp, Homo sapiens
tccagctcccactctcactgct

SEQ ID NO: 7099791 - DNA, 23 bp, Homo sapiens
tccagctcccttcaatggcactg

SEQ ID NO: 7099792 - DNA, 20 bp, Homo sapiens
tccagctccgtgttcttcct

SEQ ID NO: 7099793 - DNA, 20 bp, Homo sapiens
tccagctccgtgttcttcct

SEQ ID NO: 7099794 - DNA, 20 bp, Homo sapiens
tccagctccgtgttcttcct

SEQ ID NO: 7099795 - DNA, 20 bp, Homo sapiens
tccagctccgtgttcttcct

SEQ ID NO: 7099796 - DNA, 20 bp, Homo sapiens
tccagctccgtgttcttcct

SEQ ID NO: 7099797 - DNA, 17 bp, Homo sapiens
tccagctcctcattgtt

SEQ ID NO: 7099798 - DNA, 17 bp, Homo sapiens
tccagctcctcattgtt

SEQ ID NO: 7099799 - DNA, 17 bp, Homo sapiens
tccagctcctcattgtt

SEQ ID NO: 7099800 - DNA, 17 bp, Homo sapiens
tccagctcctcattgtt

SEQ ID NO: 7099801 - DNA, 17 bp, Homo sapiens
tccagctcctcattgtt

SEQ ID NO: 7099802 - DNA, 17 bp, Homo sapiens
tccagctcctcattgtt

SEQ ID NO: 7099803 - DNA, 22 bp, Homo sapiens
tccagctcctctacccgatgcg

SEQ ID NO: 7099804 - DNA, 22 bp, Homo sapiens
tccagctcctctacccgatgcg

SEQ ID NO: 7099805 - DNA, 22 bp, Homo sapiens
tccagctcctctacccgatgcg

SEQ ID NO: 7099806 - DNA, 22 bp, Homo sapiens
tccagctcctctacccgatgcg

SEQ ID NO: 7099807 - DNA, 22 bp, Homo sapiens
tccagctcctgagttcactgct

SEQ ID NO: 7099808 - DNA, 22 bp, Homo sapiens
tccagctcctgagttcactgct

SEQ ID NO: 7099809 - DNA, 22 bp, Homo sapiens
tccagctcaaattcagcttcca

SEQ ID NO: 7099810 - DNA, 22 bp, Homo sapiens
tccagctcacagatagcgtggg

SEQ ID NO: 7099811 - DNA, 22 bp, Homo sapiens
tccagctcacagatagcgtggg

SEQ ID NO: 7099812 - DNA, 22 bp, Homo sapiens
tccagctcaaattcagcttcca

SEQ ID NO: 7099813 - DNA, 22 bp, Homo sapiens
tccagctcaaagtgctcctgtc

SEQ ID NO: 7099814 - DNA, 22 bp, Homo sapiens
tccagctcaaagtgctcctgtc

SEQ ID NO: 7099815 - DNA, 22 bp, Homo sapiens
tccagctcaaattcagcttcca

SEQ ID NO: 7099816 - DNA, 22 bp, Homo sapiens
tccagcctttctactcactgag

SEQ ID NO: 7099817 - DNA, 22 bp, Homo sapiens
tccagctcaaagtgctcctgtc

SEQ ID NO: 7099818 - DNA, 22 bp, Homo sapiens
tccagctcaaagtgctcctgtc

SEQ ID NO: 7099819 - DNA, 22 bp, Homo sapiens
tccagctcaaagtgctcctgtc

SEQ ID NO: 7099820 - DNA, 22 bp, Homo sapiens
tccagctcaaagtgctcctgtc

SEQ ID NO: 7099821 - DNA, 22 bp, Homo sapiens
tccagctcacagatagcgtggg

SEQ ID NO: 7099822 - DNA, 22 bp, Homo sapiens
tccagctcacagatagcgtggg

SEQ ID NO: 7099823 - DNA, 18 bp, Homo sapiens
tccagctcacagatgggc

SEQ ID NO: 7099824 - DNA, 18 bp, Homo sapiens
tccagctcacagatgggc

SEQ ID NO: 7099825 - DNA, 18 bp, Homo sapiens
tccagctcacagatgggc

SEQ ID NO: 7099826 - DNA, 18 bp, Homo sapiens
tccagctcacagatgggc

SEQ ID NO: 7099827 - DNA, 22 bp, Homo sapiens
tccagctcagatgcagggatca

SEQ ID NO: 7099828 - DNA, 22 bp, Homo sapiens
tccagctcagatgcagggatca

SEQ ID NO: 7099829 - DNA, 22 bp, Homo sapiens
tccagctcagatgcagggatca

SEQ ID NO: 7099830 - DNA, 22 bp, Homo sapiens
tccagctcagatgcagggatca

SEQ ID NO: 7099831 - DNA, 22 bp, Homo sapiens
tccagctcagatgcagggatca

SEQ ID NO: 7099832 - DNA, 22 bp, Homo sapiens
tccagctcagatgcagggatca

SEQ ID NO: 7099833 - DNA, 22 bp, Homo sapiens
tccagctcagggttggctcaag

SEQ ID NO: 7099834 - DNA, 22 bp, Homo sapiens
tccagctcagggttggctcaag

SEQ ID NO: 7099835 - DNA, 22 bp, Homo sapiens
tccagctcagggttggctcaag

SEQ ID NO: 7099836 - DNA, 22 bp, Homo sapiens
tccagcctttctactcactgag

SEQ ID NO: 7099837 - DNA, 22 bp, Homo sapiens
tccagccaatcagagctgaggc

SEQ ID NO: 7099838 - DNA, 22 bp, Homo sapiens
tccagccaatcagagctgaggc

SEQ ID NO: 7099839 - DNA, 22 bp, Homo sapiens
tccagccaatcagagctgaggc

SEQ ID NO: 7099840 - DNA, 22 bp, Homo sapiens
tccagccaatcagagctgaggc

SEQ ID NO: 7099841 - DNA, 22 bp, Homo sapiens
tccagccaagccttggtagctg

SEQ ID NO: 7099842 - DNA, 22 bp, Homo sapiens
tccagccaagccttggtagctg

SEQ ID NO: 7099843 - DNA, 22 bp, Homo sapiens
tccagccaagccttggtagctg

SEQ ID NO: 7099844 - DNA, 22 bp, Homo sapiens
tccagccaatcagagctgaggc

SEQ ID NO: 7099845 - DNA, 22 bp, Homo sapiens
tccagccaatcagagctgaggc

SEQ ID NO: 7099846 - DNA, 20 bp, Homo sapiens
tccagcatataaactcctct

SEQ ID NO: 7099847 - DNA, 22 bp, Homo sapiens
tccagcattagatgtgaaattg

SEQ ID NO: 7099848 - DNA, 22 bp, Homo sapiens
tccagcattttgatacttgaaa

SEQ ID NO: 7099849 - DNA, 23 bp, Homo sapiens
tccagccaaatctggctgacagt

SEQ ID NO: 7099850 - DNA, 23 bp, Homo sapiens
tccagccaaatctggctgacagt

SEQ ID NO: 7099851 - DNA, 23 bp, Homo sapiens
tccagccaaatctggctgacagt

SEQ ID NO: 7099852 - DNA, 22 bp, Homo sapiens
tccagcaggttggtcaggtgca

SEQ ID NO: 7099853 - DNA, 22 bp, Homo sapiens
tccagcaggttggtcaggtgca

SEQ ID NO: 7099854 - DNA, 22 bp, Homo sapiens
tccagcaggttggtcaggtgca

SEQ ID NO: 7099855 - DNA, 22 bp, Homo sapiens
tccagcaggttggtcaggtgca

SEQ ID NO: 7099856 - DNA, 22 bp, Homo sapiens
tccagcagtaaggaaagtacat

SEQ ID NO: 7099857 - DNA, 20 bp, Homo sapiens
tccagcagtatgctatactt

SEQ ID NO: 7099858 - DNA, 22 bp, Homo sapiens
tccagcagtccatgtgagacac

SEQ ID NO: 7099859 - DNA, 16 bp, Homo sapiens
tccagcagtctctgta

SEQ ID NO: 7099860 - DNA, 22 bp, Homo sapiens
tccagcagtgctcaggactcac

SEQ ID NO: 7099861 - DNA, 22 bp, Homo sapiens
tccagctctgcttcacagtctc

SEQ ID NO: 7099862 - DNA, 22 bp, Homo sapiens
tccagctctggcttggctagct

SEQ ID NO: 7099863 - DNA, 22 bp, Homo sapiens
tccagctctggcttggctagct

SEQ ID NO: 7099864 - DNA, 22 bp, Homo sapiens
tccagctctgcttcacagtctc

SEQ ID NO: 7099865 - DNA, 18 bp, Homo sapiens
tccagctctgccacttac

SEQ ID NO: 7099866 - DNA, 22 bp, Homo sapiens
tccagctctgctgtgcgccggt

SEQ ID NO: 7099867 - DNA, 22 bp, Homo sapiens
tccagctctgctgtgcgccggt

SEQ ID NO: 7099868 - DNA, 22 bp, Homo sapiens
tccagctctgcttcacagtctc

SEQ ID NO: 7099869 - DNA, 22 bp, Homo sapiens
tccagctctgcttcacagtctc

SEQ ID NO: 7099870 - DNA, 18 bp, Homo sapiens
tccagctctgccacttac

SEQ ID NO: 7099871 - DNA, 22 bp, Homo sapiens
tccagctctgattctcactagc

SEQ ID NO: 7099872 - DNA, 22 bp, Homo sapiens
tccagctctgattctcactagc

SEQ ID NO: 7099873 - DNA, 21 bp, Homo sapiens
tccagctctcatagtgttcca

SEQ ID NO: 7099874 - DNA, 21 bp, Homo sapiens
tccagctctcatagtgttcca

SEQ ID NO: 7099875 - DNA, 21 bp, Homo sapiens
tccagctctcatagtgttcca

SEQ ID NO: 7099876 - DNA, 21 bp, Homo sapiens
tccagctctcatagtgttcca

SEQ ID NO: 7099877 - DNA, 22 bp, Homo sapiens
tccagctctgattctcactagc

SEQ ID NO: 7099878 - DNA, 22 bp, Homo sapiens
tccagctctgattctcactagc

SEQ ID NO: 7099879 - DNA, 21 bp, Homo sapiens
tccagctcctgccactcctta

SEQ ID NO: 7099880 - DNA, 21 bp, Homo sapiens
tccagctcctgccactcctta

SEQ ID NO: 7099881 - DNA, 22 bp, Homo sapiens
tccagctcctgagttcactgct

SEQ ID NO: 7099882 - DNA, 21 bp, Homo sapiens
tccagctcctgccactcctta

SEQ ID NO: 7099883 - DNA, 22 bp, Homo sapiens
tccagctctaacatgctgggcc

SEQ ID NO: 7099884 - DNA, 22 bp, Homo sapiens
tccagctctaacatgctgggcc

SEQ ID NO: 7099885 - DNA, 22 bp, Homo sapiens
tccagctctaacatgctgggcc

SEQ ID NO: 7099886 - DNA, 22 bp, Homo sapiens
tccagctctaacatgctgggcc

SEQ ID NO: 7099887 - DNA, 22 bp, Homo sapiens
tccagctctaaggctgatagcc

SEQ ID NO: 7099888 - DNA, 22 bp, Homo sapiens
tccagctctaaggctgatagcc

SEQ ID NO: 7099889 - DNA, 22 bp, Homo sapiens
tccagctctaaggctgatagcc

SEQ ID NO: 7099890 - DNA, 22 bp, Homo sapiens
tccagctctaaggctgatagcc

SEQ ID NO: 7099891 - DNA, 22 bp, Homo sapiens
tccagctctggcttggctagct

SEQ ID NO: 7099892 - DNA, 22 bp, Homo sapiens
tccagctctggcttggctagct

SEQ ID NO: 7099893 - DNA, 22 bp, Homo sapiens
tccagctctggcttggctagct

SEQ ID NO: 7099894 - DNA, 22 bp, Homo sapiens
tccagctctggcttggctagct

SEQ ID NO: 7099895 - DNA, 22 bp, Homo sapiens
tccagctctggcttggctagct

SEQ ID NO: 7099896 - DNA, 21 bp, Homo sapiens
tccagctcttatgttcatgaa

SEQ ID NO: 7099897 - DNA, 21 bp, Homo sapiens
tccagctcttatgttcatgaa

SEQ ID NO: 7099898 - DNA, 21 bp, Homo sapiens
tccagctcttatgttcatgaa

SEQ ID NO: 7099899 - DNA, 22 bp, Homo sapiens
tccagctcttcagttctgcaaa

SEQ ID NO: 7099900 - DNA, 22 bp, Homo sapiens
tccagctggggacatgggcttc

SEQ ID NO: 7099901 - DNA, 22 bp, Homo sapiens
tccagctggggcagtggctggg

SEQ ID NO: 7099902 - DNA, 22 bp, Homo sapiens
tccagctgtactttgtcctggc

SEQ ID NO: 7099903 - DNA, 22 bp, Homo sapiens
tccagctgtagtggatttgaga

SEQ ID NO: 7099904 - DNA, 22 bp, Homo sapiens
tccagctgttgatattctaggt

SEQ ID NO: 7099905 - DNA, 19 bp, Homo sapiens
tccagctgttttgagtcac

SEQ ID NO: 7099906 - DNA, 22 bp, Homo sapiens
tccagcttataggtagatttaa

SEQ ID NO: 7099907 - DNA, 22 bp, Homo sapiens
tccagcttataggtagatttaa

SEQ ID NO: 7099908 - DNA, 22 bp, Homo sapiens
tccagcttcagctcttggatag

SEQ ID NO: 7099909 - DNA, 22 bp, Homo sapiens
tccagcttccagtggctggctg

SEQ ID NO: 7099910 - DNA, 22 bp, Homo sapiens
tccagcttccagtggctggctg

SEQ ID NO: 7099911 - DNA, 22 bp, Homo sapiens
tccagcttgcctggtcttttgg

SEQ ID NO: 7099912 - DNA, 22 bp, Homo sapiens
tccagcttgacaaatgatttta

SEQ ID NO: 7099913 - DNA, 18 bp, Homo sapiens
tccagcttgcacttaaat

SEQ ID NO: 7099914 - DNA, 18 bp, Homo sapiens
tccagcttgcacttaaat

SEQ ID NO: 7099915 - DNA, 22 bp, Homo sapiens
tccagcttgacaaatgatttta

SEQ ID NO: 7099916 - DNA, 22 bp, Homo sapiens
tccagcttcttgacttggtggt

SEQ ID NO: 7099917 - DNA, 22 bp, Homo sapiens
tccagcttcttgacttggtggt

SEQ ID NO: 7099918 - DNA, 22 bp, Homo sapiens
tccagctttcacgctcctgcct

SEQ ID NO: 7099919 - DNA, 22 bp, Homo sapiens
tccagcttgggtgggaggaggt

SEQ ID NO: 7099920 - DNA, 22 bp, Homo sapiens
tccagcttgcttcaggatggtc

SEQ ID NO: 7099921 - DNA, 22 bp, Homo sapiens
tccagcttggagagaagtttct

SEQ ID NO: 7099922 - DNA, 22 bp, Homo sapiens
tccagcttggagagaagtttct

SEQ ID NO: 7099923 - DNA, 22 bp, Homo sapiens
tccagcttggagagaagtttct

SEQ ID NO: 7099924 - DNA, 22 bp, Homo sapiens
tccagcttggcagagctacctg

SEQ ID NO: 7099925 - DNA, 22 bp, Homo sapiens
tccagctttgagattttatgga

SEQ ID NO: 7099926 - DNA, 22 bp, Homo sapiens
tccagctttgagattttatgga

SEQ ID NO: 7099927 - DNA, 20 bp, Homo sapiens
tccagctttgcctctaactg

SEQ ID NO: 7099928 - DNA, 22 bp, Homo sapiens
tccagctttgcctgatcatata

SEQ ID NO: 7099929 - DNA, 22 bp, Homo sapiens
tccagctttggctctagctaca

SEQ ID NO: 7099930 - DNA, 22 bp, Homo sapiens
tccagcttttaccaaatgagca

SEQ ID NO: 7099931 - DNA, 22 bp, Homo sapiens
tccagcttttaccaaatgagca

SEQ ID NO: 7099932 - DNA, 22 bp, Homo sapiens
tccagcttttattggatgagga

SEQ ID NO: 7099933 - DNA, 22 bp, Homo sapiens
tccagcttttaccaaatgagca

SEQ ID NO: 7099934 - DNA, 22 bp, Homo sapiens
tccagcttttattggatgagga

SEQ ID NO: 7099935 - DNA, 22 bp, Homo sapiens
tccaggaaaaggcttgcagggg

SEQ ID NO: 7099936 - DNA, 22 bp, Homo sapiens
tccaggaaaaggcttgcagggg

SEQ ID NO: 7099937 - DNA, 22 bp, Homo sapiens
tccaggaaacagcatctcagca

SEQ ID NO: 7099938 - DNA, 19 bp, Homo sapiens
tccaggaggctgccattga

SEQ ID NO: 7099939 - DNA, 22 bp, Homo sapiens
tccaggagggattgggctgtgg

SEQ ID NO: 7099940 - DNA, 22 bp, Homo sapiens
tccaggaggctctggttgacgt

SEQ ID NO: 7099941 - DNA, 22 bp, Homo sapiens
tccaggaggctctggttgacgt

SEQ ID NO: 7099942 - DNA, 21 bp, Homo sapiens
tccaggaaagttttaagagtg

SEQ ID NO: 7099943 - DNA, 22 bp, Homo sapiens
tccaggaaatcagaagtggtaa

SEQ ID NO: 7099944 - DNA, 22 bp, Homo sapiens
gtcctgggggcagctgtgtcca

SEQ ID NO: 7099945 - DNA, 22 bp, Homo sapiens
gtcctgggggcagctgtgtcca

SEQ ID NO: 7099946 - DNA, 22 bp, Homo sapiens
gtctgccccacaggctcagttg

SEQ ID NO: 7099947 - DNA, 22 bp, Homo sapiens
gtctgcccgcctgcaaagtgtt

SEQ ID NO: 7099948 - DNA, 22 bp, Homo sapiens
gtctgcccatctccgggcgggg

SEQ ID NO: 7099949 - DNA, 22 bp, Homo sapiens
gtcctgggggcagctgtgtcca

SEQ ID NO: 7099950 - DNA, 22 bp, Homo sapiens
gtcctgggtccccgcaggtcag

SEQ ID NO: 7099951 - DNA, 22 bp, Homo sapiens
gtctgcccttcctctccacgat

SEQ ID NO: 7099952 - DNA, 22 bp, Homo sapiens
gtctgccctgcagacatgcctc

SEQ ID NO: 7099953 - DNA, 22 bp, Homo sapiens
gtctgccctcacgccagctggg

SEQ ID NO: 7099954 - DNA, 22 bp, Homo sapiens
gtctgccctcacgccagctggg

SEQ ID NO: 7099955 - DNA, 22 bp, Homo sapiens
gtctgccctcacatgcactctt

SEQ ID NO: 7099956 - DNA, 22 bp, Homo sapiens
gtctgcccggccttcctccacc

SEQ ID NO: 7099957 - DNA, 22 bp, Homo sapiens
gtcctgggcggagggctgctgt

SEQ ID NO: 7099958 - DNA, 22 bp, Homo sapiens
gtcctgggcggagggctgctgt

SEQ ID NO: 7099959 - DNA, 22 bp, Homo sapiens
gtcctgggcctgctgaggctga

SEQ ID NO: 7099960 - DNA, 22 bp, Homo sapiens
gtcctgggcctgctgaggctga

SEQ ID NO: 7099961 - DNA, 22 bp, Homo sapiens
gtcctgggcctgctgaggctga

SEQ ID NO: 7099962 - DNA, 22 bp, Homo sapiens
gtcctgggcggagggctgctgt

SEQ ID NO: 7099963 - DNA, 22 bp, Homo sapiens
gtcctgggcggagggctgctgt

SEQ ID NO: 7099964 - DNA, 22 bp, Homo sapiens
gtcctgggcggagggctgctgt

SEQ ID NO: 7099965 - DNA, 22 bp, Homo sapiens
gtcctggggaatacagaagccg

SEQ ID NO: 7099966 - DNA, 22 bp, Homo sapiens
gtcctggggattatagagtgtt

SEQ ID NO: 7099967 - DNA, 22 bp, Homo sapiens
gtcctggggattatagagtgtt

SEQ ID NO: 7099968 - DNA, 22 bp, Homo sapiens
gtcctggggattatagagtgtt

SEQ ID NO: 7099969 - DNA, 22 bp, Homo sapiens
gtcctggggattatagagtgtt

SEQ ID NO: 7099970 - DNA, 22 bp, Homo sapiens
gtcctggggatacagaagtgaa

SEQ ID NO: 7099971 - DNA, 22 bp, Homo sapiens
gtcctggggatacagaagtgaa

SEQ ID NO: 7099972 - DNA, 22 bp, Homo sapiens
gtcctggggatacagaagtgaa

SEQ ID NO: 7099973 - DNA, 22 bp, Homo sapiens
gtcctggggaatacagaagccg

SEQ ID NO: 7099974 - DNA, 22 bp, Homo sapiens
gtctgctgcttctgttgaagca

SEQ ID NO: 7099975 - DNA, 22 bp, Homo sapiens
gtctgctggcacgtcacagata

SEQ ID NO: 7099976 - DNA, 22 bp, Homo sapiens
gtctgctggcacgtcacagata

SEQ ID NO: 7099977 - DNA, 22 bp, Homo sapiens
gtctgctgtaggtaggacagca

SEQ ID NO: 7099978 - DNA, 22 bp, Homo sapiens
gtctgctgtgccttggggaaaa

SEQ ID NO: 7099979 - DNA, 22 bp, Homo sapiens
gtctgctgtgccttggggaaaa

SEQ ID NO: 7099980 - DNA, 22 bp, Homo sapiens
gtctggagcctgggtccctgct

SEQ ID NO: 7099981 - DNA, 22 bp, Homo sapiens
gtctggaggaaaaggttaaatg

SEQ ID NO: 7099982 - DNA, 22 bp, Homo sapiens
gtctggaggaaaaggttaaatg

SEQ ID NO: 7099983 - DNA, 22 bp, Homo sapiens
gtctggaggaggaagaaggcac

SEQ ID NO: 7099984 - DNA, 22 bp, Homo sapiens
gtctggaggaggaagaaggcac

SEQ ID NO: 7099985 - DNA, 22 bp, Homo sapiens
gtctggaggaggaagaaggcac

SEQ ID NO: 7099986 - DNA, 22 bp, Homo sapiens
gtctggaggagggctctgcggc

SEQ ID NO: 7099987 - DNA, 22 bp, Homo sapiens
gtctggaggagggctctgcggc

SEQ ID NO: 7099988 - DNA, 22 bp, Homo sapiens
gtctggaggcactttctcatga

SEQ ID NO: 7099989 - DNA, 22 bp, Homo sapiens
gtctggaggcactttctcatga

SEQ ID NO: 7099990 - DNA, 22 bp, Homo sapiens
gtctgctcatgctaccgcgggc

SEQ ID NO: 7099991 - DNA, 22 bp, Homo sapiens
gtctgctcatgctaccgcgggc

SEQ ID NO: 7099992 - DNA, 18 bp, Homo sapiens
gtctgccttctcccttcc

SEQ ID NO: 7099993 - DNA, 22 bp, Homo sapiens
gtctgcctttatcatctcctta

SEQ ID NO: 7099994 - DNA, 22 bp, Homo sapiens
gtctgcctttatcatctcctta

SEQ ID NO: 7099995 - DNA, 22 bp, Homo sapiens
gtctgcctgtctggatgacaga

SEQ ID NO: 7099996 - DNA, 22 bp, Homo sapiens
gtctgcctgggacgctgggagt

SEQ ID NO: 7099997 - DNA, 22 bp, Homo sapiens
gtctgcctgggacgctgggagt

SEQ ID NO: 7099998 - DNA, 22 bp, Homo sapiens
gtctgcctggaggcagctgctg

SEQ ID NO: 7099999 - DNA, 22 bp, Homo sapiens
gtctgcctggaggcagctgctg

SEQ ID NO: 7100000 - DNA, 22 bp, Homo sapiens
gtctgcctgcaatccagagact

SEQ ID NO: 7100001 - DNA, 22 bp, Homo sapiens
gtctgcctgctagtggctgcct

SEQ ID NO: 7100002 - DNA, 22 bp, Homo sapiens
gtctgcctgctagtggctgcct

SEQ ID NO: 7100003 - DNA, 22 bp, Homo sapiens
gtctgcctgctagtggctgcct

SEQ ID NO: 7100004 - DNA, 22 bp, Homo sapiens
gtctgcctctattgcctacctg

SEQ ID NO: 7100005 - DNA, 22 bp, Homo sapiens
gtctgcctctattgcctacctg

SEQ ID NO: 7100006 - DNA, 22 bp, Homo sapiens
gtctgcctcagccgggggccgc

SEQ ID NO: 7100007 - DNA, 22 bp, Homo sapiens
gtctgcctctttctttctgggt

SEQ ID NO: 7100008 - DNA, 22 bp, Homo sapiens
gtctgcctgcaatccagagact

SEQ ID NO: 7100009 - DNA, 22 bp, Homo sapiens
gtctgcctgcaatccagagact

SEQ ID NO: 7100010 - DNA, 22 bp, Homo sapiens
gtctgcccttggctcagccata

SEQ ID NO: 7100011 - DNA, 22 bp, Homo sapiens
gtctgcccttggctcagccata

SEQ ID NO: 7100012 - DNA, 22 bp, Homo sapiens
gtctgcctcagccgggggccgc

SEQ ID NO: 7100013 - DNA, 22 bp, Homo sapiens
gtgaacaggagaaagtgatgga

SEQ ID NO: 7100014 - DNA, 22 bp, Homo sapiens
gtgaacaggagaaagtgatgga

SEQ ID NO: 7100015 - DNA, 22 bp, Homo sapiens
gtgaaattgtatttggcattga

SEQ ID NO: 7100016 - DNA, 22 bp, Homo sapiens
gtgaacaaaatagcacatatta

SEQ ID NO: 7100017 - DNA, 22 bp, Homo sapiens
gtgaacaaggagactacaactt

SEQ ID NO: 7100018 - DNA, 22 bp, Homo sapiens
gtgaacatcagattacatgaga

SEQ ID NO: 7100019 - DNA, 22 bp, Homo sapiens
gtgaactaaggattcaaacttc

SEQ ID NO: 7100020 - DNA, 22 bp, Homo sapiens
gtgaactattgggtatcataaa

SEQ ID NO: 7100021 - DNA, 22 bp, Homo sapiens
gtgaaatattttgtttatgtca

SEQ ID NO: 7100022 - DNA, 22 bp, Homo sapiens
gtgaaatattttgtttatgtca

SEQ ID NO: 7100023 - DNA, 22 bp, Homo sapiens
gtgaaatattttgtttatgtca

SEQ ID NO: 7100024 - DNA, 22 bp, Homo sapiens
gtgaaatctgaggcccatgatg

SEQ ID NO: 7100025 - DNA, 22 bp, Homo sapiens
gtgaaatgaatctggaaatatt

SEQ ID NO: 7100026 - DNA, 22 bp, Homo sapiens
gtgaaattgtatttggcattga

SEQ ID NO: 7100027 - DNA, 22 bp, Homo sapiens
gtgaaattgtatttggcattga

SEQ ID NO: 7100028 - DNA, 22 bp, Homo sapiens
gtgaaagagatgcagcataatg

SEQ ID NO: 7100029 - DNA, 22 bp, Homo sapiens
gtgaaagagatgcagcataatg

SEQ ID NO: 7100030 - DNA, 22 bp, Homo sapiens
gtgaaatatttaacgtccaggt

SEQ ID NO: 7100031 - DNA, 22 bp, Homo sapiens
gtgaaacttcacattttgatag

SEQ ID NO: 7100032 - DNA, 22 bp, Homo sapiens
gtgaaacttcacattttgatag

SEQ ID NO: 7100033 - DNA, 22 bp, Homo sapiens
gtgaaactgctttgtaaactgt

SEQ ID NO: 7100034 - DNA, 22 bp, Homo sapiens
gtgaaactgctttgtaaactgt

SEQ ID NO: 7100035 - DNA, 22 bp, Homo sapiens
gtgaaactgctttgtaaactgt

SEQ ID NO: 7100036 - DNA, 17 bp, Homo sapiens
gtctggagtggccttca

SEQ ID NO: 7100037 - DNA, 22 bp, Homo sapiens
gtctggagtggggcctgagaat

SEQ ID NO: 7100038 - DNA, 22 bp, Homo sapiens
gtctggagtggggcctgagaat

SEQ ID NO: 7100039 - DNA, 22 bp, Homo sapiens
gtgaaaagagagcctgtgtcag

SEQ ID NO: 7100040 - DNA, 22 bp, Homo sapiens
gtctggaggcccgtcagcccta

SEQ ID NO: 7100041 - DNA, 22 bp, Homo sapiens
gtctggagggaagagatgtcag

SEQ ID NO: 7100042 - DNA, 22 bp, Homo sapiens
gtctggagggaagagatgtcag

SEQ ID NO: 7100043 - DNA, 22 bp, Homo sapiens
gtctggaggggagatttgggtt

SEQ ID NO: 7100044 - DNA, 22 bp, Homo sapiens
gtctggaggggagatttgggtt

SEQ ID NO: 7100045 - DNA, 22 bp, Homo sapiens
gtctggagggtgggtagagacc

SEQ ID NO: 7100046 - DNA, 22 bp, Homo sapiens
gtctggagggtgggtagagacc

SEQ ID NO: 7100047 - DNA, 18 bp, Homo sapiens
gtctggaggtcaggagct

SEQ ID NO: 7100048 - DNA, 18 bp, Homo sapiens
gtctggaggtcaggagct

SEQ ID NO: 7100049 - DNA, 22 bp, Homo sapiens
gtctggagtaccataaaaagga

SEQ ID NO: 7100050 - DNA, 23 bp, Homo sapiens
gtgacccaaggaccttccagaat

SEQ ID NO: 7100051 - DNA, 22 bp, Homo sapiens
gtgacccagaggctgactaaca

SEQ ID NO: 7100052 - DNA, 22 bp, Homo sapiens
gtgacccaggacactgtgtatc

SEQ ID NO: 7100053 - DNA, 22 bp, Homo sapiens
gtgacccaggtaggtaagcaat

SEQ ID NO: 7100054 - DNA, 22 bp, Homo sapiens
gtgaccatcatctcagctagtt

SEQ ID NO: 7100055 - DNA, 22 bp, Homo sapiens
gtgaccatcatctcagctagtt

SEQ ID NO: 7100056 - DNA, 22 bp, Homo sapiens
gtgaaggagttatcagtggtta

SEQ ID NO: 7100057 - DNA, 22 bp, Homo sapiens
gtgaaggataaggatctaaatt

SEQ ID NO: 7100058 - DNA, 22 bp, Homo sapiens
gtgaaggaggggccacagatat

SEQ ID NO: 7100059 - DNA, 22 bp, Homo sapiens
gtgaaggaggggccacagatat

SEQ ID NO: 7100060 - DNA, 22 bp, Homo sapiens
gtgaaggaggggccacagatat

SEQ ID NO: 7100061 - DNA, 22 bp, Homo sapiens
gtgaaggactgaatgaaaatgt

SEQ ID NO: 7100062 - DNA, 22 bp, Homo sapiens
gtgaaggactagcatggagggc

SEQ ID NO: 7100063 - DNA, 22 bp, Homo sapiens
gtgaaggactagcatggagggc

SEQ ID NO: 7100064 - DNA, 22 bp, Homo sapiens
gtgaaggaccaatatgactcat

SEQ ID NO: 7100065 - DNA, 22 bp, Homo sapiens
gtgaagccacagagccacgccg

SEQ ID NO: 7100066 - DNA, 22 bp, Homo sapiens
gtgaagcctcggaaccaagctc

SEQ ID NO: 7100067 - DNA, 22 bp, Homo sapiens
gtgaagaaggcaatacaaagaa

SEQ ID NO: 7100068 - DNA, 22 bp, Homo sapiens
gtgaagaccagggaacgctggc

SEQ ID NO: 7100069 - DNA, 22 bp, Homo sapiens
gtgaagaccagggaacgctggc

SEQ ID NO: 7100070 - DNA, 22 bp, Homo sapiens
gtgaactcagtctctcttgcta

SEQ ID NO: 7100071 - DNA, 22 bp, Homo sapiens
gtgaactctgactctcatgcct

SEQ ID NO: 7100072 - DNA, 22 bp, Homo sapiens
gtgaactgctgagttttatcat

SEQ ID NO: 7100073 - DNA, 22 bp, Homo sapiens
gtgaacttccagatgataaaca

SEQ ID NO: 7100074 - DNA, 22 bp, Homo sapiens
gtgaacttccagatgataaaca

SEQ ID NO: 7100075 - DNA, 22 bp, Homo sapiens
gtgaagagctgttgcagagatt

SEQ ID NO: 7100076 - DNA, 22 bp, Homo sapiens
gtgaagacttggagaagttaag

SEQ ID NO: 7100077 - DNA, 21 bp, Homo sapiens
gtgaagactttgcctttaaga

SEQ ID NO: 7100078 - DNA, 22 bp, Homo sapiens
gtgaagagctgttgcagagatt

SEQ ID NO: 7100079 - DNA, 22 bp, Homo sapiens
gtgaagagctgttgcagagatt

SEQ ID NO: 7100080 - DNA, 22 bp, Homo sapiens
gtgaagcagagtgtggaagcaa

SEQ ID NO: 7100081 - DNA, 22 bp, Homo sapiens
gtgaagcagggaaggaaaggat

SEQ ID NO: 7100082 - DNA, 22 bp, Homo sapiens
gtgaagcagttgcgtgggttcc

SEQ ID NO: 7100083 - DNA, 22 bp, Homo sapiens
gtgaagcagttgcgtgggttcc

SEQ ID NO: 7100084 - DNA, 22 bp, Homo sapiens
gtgaagcataactgaaggattt

SEQ ID NO: 7100085 - DNA, 22 bp, Homo sapiens
gtgaagcatatgcttctctgcc

SEQ ID NO: 7100086 - DNA, 22 bp, Homo sapiens
gtgaagcacatgggcgttgggt

SEQ ID NO: 7100087 - DNA, 22 bp, Homo sapiens
gtgaagcacatgggcgttgggt

SEQ ID NO: 7100088 - DNA, 22 bp, Homo sapiens
gtgaagcacgctgccgcactgg

SEQ ID NO: 7100089 - DNA, 21 bp, Homo sapiens
gtgcagaggaatgtagggggc

SEQ ID NO: 7100090 - DNA, 22 bp, Homo sapiens
gtgcagaggacgtggcggcctc

SEQ ID NO: 7100091 - DNA, 22 bp, Homo sapiens
gtgcagaggacgtggcggcctc

SEQ ID NO: 7100092 - DNA, 22 bp, Homo sapiens
gtgcagaggacgtggcggcctc

SEQ ID NO: 7100093 - DNA, 20 bp, Homo sapiens
gtgcagaggcagcctgtggg

SEQ ID NO: 7100094 - DNA, 22 bp, Homo sapiens
gtgcagagcaagggctgagggc

SEQ ID NO: 7100095 - DNA, 22 bp, Homo sapiens
gtgcagagcaagggctgagggc

SEQ ID NO: 7100096 - DNA, 16 bp, Homo sapiens
gtgcagagcaattcac

SEQ ID NO: 7100097 - DNA, 21 bp, Homo sapiens
gtgcagaggaatgtagggggc

SEQ ID NO: 7100098 - DNA, 22 bp, Homo sapiens
gtgcagatcctgattgcagttc

SEQ ID NO: 7100099 - DNA, 20 bp, Homo sapiens
gtgcagatgtcctttcacac

SEQ ID NO: 7100100 - DNA, 22 bp, Homo sapiens
gtgcagcaaactagtgcgaggg

SEQ ID NO: 7100101 - DNA, 22 bp, Homo sapiens
gtgcagcaaactagtgcgaggg

SEQ ID NO: 7100102 - DNA, 22 bp, Homo sapiens
gtgcagaggtcacaaaagtgaa

SEQ ID NO: 7100103 - DNA, 22 bp, Homo sapiens
gtgcagaggtcacaaaagtgaa

SEQ ID NO: 7100104 - DNA, 22 bp, Homo sapiens
gtgcagagtgctacattttatt

SEQ ID NO: 7100105 - DNA, 22 bp, Homo sapiens
gtgcagagtgctacattttatt

SEQ ID NO: 7100106 - DNA, 22 bp, Homo sapiens
gtgcagagtgtctgtggactga

SEQ ID NO: 7100107 - DNA, 20 bp, Homo sapiens
gtgcagaggcagcctgtggg

SEQ ID NO: 7100108 - DNA, 22 bp, Homo sapiens
gtgcagtgaccctggagagctg

SEQ ID NO: 7100109 - DNA, 22 bp, Homo sapiens
gtgcagtgagcagtgcagcacc

SEQ ID NO: 7100110 - DNA, 22 bp, Homo sapiens
gtgcagtggcagatcctagctc

SEQ ID NO: 7100111 - DNA, 22 bp, Homo sapiens
gtgcagtgaccctggagagctg

SEQ ID NO: 7100112 - DNA, 22 bp, Homo sapiens
gtgcaggtggctggtggcaccc

SEQ ID NO: 7100113 - DNA, 22 bp, Homo sapiens
gtgcagggtagcgacggcagga

SEQ ID NO: 7100114 - DNA, 22 bp, Homo sapiens
gtgcagggtagcgacggcagga

SEQ ID NO: 7100115 - DNA, 22 bp, Homo sapiens
gtgcagggtagcgacggcagga

SEQ ID NO: 7100116 - DNA, 22 bp, Homo sapiens
gtgcagggtcctaattgttaag

SEQ ID NO: 7100117 - DNA, 22 bp, Homo sapiens
gtgcagggtcctaattgttaag

SEQ ID NO: 7100118 - DNA, 22 bp, Homo sapiens
gtgcaggtgttttggctgccag

SEQ ID NO: 7100119 - DNA, 22 bp, Homo sapiens
gtgcaggtgttttggctgccag

SEQ ID NO: 7100120 - DNA, 22 bp, Homo sapiens
gtgctagggttggagtggggct

SEQ ID NO: 7100121 - DNA, 22 bp, Homo sapiens
gtgctaggtactttgatcggtt

SEQ ID NO: 7100122 - DNA, 22 bp, Homo sapiens
gtgctaggtgttggagatacag

SEQ ID NO: 7100123 - DNA, 22 bp, Homo sapiens
gtgctagggacaaagcagtgaa

SEQ ID NO: 7100124 - DNA, 19 bp, Homo sapiens
gtgccaaatgtgttataca

SEQ ID NO: 7100125 - DNA, 22 bp, Homo sapiens
gtgccaatccccaaaccctgct

SEQ ID NO: 7100126 - DNA, 22 bp, Homo sapiens
gtgccaatcgtgcattatattg

SEQ ID NO: 7100127 - DNA, 22 bp, Homo sapiens
gtgccaatgatatcctataatg

SEQ ID NO: 7100128 - DNA, 22 bp, Homo sapiens
gtgccaatgcactctagcctgg

SEQ ID NO: 7100129 - DNA, 22 bp, Homo sapiens
gtgccaattccacacccaatac

SEQ ID NO: 7100130 - DNA, 22 bp, Homo sapiens
gtgccacatggcctaatagaga

SEQ ID NO: 7100131 - DNA, 22 bp, Homo sapiens
gtgccacatggtccatgtatca

SEQ ID NO: 7100132 - DNA, 22 bp, Homo sapiens
gtgcatttgtgcatgcacatgt

SEQ ID NO: 7100133 - DNA, 22 bp, Homo sapiens
gtgcatttgtgcatgcacatgt

SEQ ID NO: 7100134 - DNA, 22 bp, Homo sapiens
gtgcatttggtgactctcaccc

SEQ ID NO: 7100135 - DNA, 22 bp, Homo sapiens
gtgcatttgacgaatactcact

SEQ ID NO: 7100136 - DNA, 22 bp, Homo sapiens
gtgcatttgacgaatactcact

SEQ ID NO: 7100137 - DNA, 22 bp, Homo sapiens
gtgcatttctcatacactaaat

SEQ ID NO: 7100138 - DNA, 22 bp, Homo sapiens
gtgcatttcaaggcacagctaa

SEQ ID NO: 7100139 - DNA, 20 bp, Homo sapiens
gtgcatttcacctgtactgt

SEQ ID NO: 7100140 - DNA, 20 bp, Homo sapiens
gtgcatttcacctgtactgt

SEQ ID NO: 7100141 - DNA, 22 bp, Homo sapiens
gtgcatttatatttgcctttgg

SEQ ID NO: 7100142 - DNA, 22 bp, Homo sapiens
gtgcatttatatttgcctttgg

SEQ ID NO: 7100143 - DNA, 22 bp, Homo sapiens
gtgcattgtaggatgttatgca

SEQ ID NO: 7100144 - DNA, 22 bp, Homo sapiens
gtgcatttaggtcacatgatgt

SEQ ID NO: 7100145 - DNA, 22 bp, Homo sapiens
gtgcatttaggtcacatgatgt

SEQ ID NO: 7100146 - DNA, 22 bp, Homo sapiens
gtgcatatgtgtgtatacaaac

SEQ ID NO: 7100147 - DNA, 22 bp, Homo sapiens
gtgcatatgtacctgtgatcat

SEQ ID NO: 7100148 - DNA, 22 bp, Homo sapiens
gtgcatatggttacagcaccgc

SEQ ID NO: 7100149 - DNA, 22 bp, Homo sapiens
gtgcatatatgtgcagcatcaa

SEQ ID NO: 7100150 - DNA, 22 bp, Homo sapiens
gtgcatatatgcacatatgtgt

SEQ ID NO: 7100151 - DNA, 22 bp, Homo sapiens
gtgcatatatatgggagggagc

SEQ ID NO: 7100152 - DNA, 22 bp, Homo sapiens
gtgcataaatagcagagctgtg

SEQ ID NO: 7100153 - DNA, 22 bp, Homo sapiens
gtgcataatttggcaatagaat

SEQ ID NO: 7100154 - DNA, 19 bp, Homo sapiens
gtgcagttcagagttcaat

SEQ ID NO: 7100155 - DNA, 22 bp, Homo sapiens
gtgcagttcccaaggtcacaca

SEQ ID NO: 7100156 - DNA, 22 bp, Homo sapiens
gtgcagttcttgtaacatgctg

SEQ ID NO: 7100157 - DNA, 22 bp, Homo sapiens
gtgcagttgaagcatggggaga

SEQ ID NO: 7100158 - DNA, 22 bp, Homo sapiens
gtgcagttgagacaataggctg

SEQ ID NO: 7100159 - DNA, 22 bp, Homo sapiens
gtgcagttgatagttttagtga

SEQ ID NO: 7100160 - DNA, 22 bp, Homo sapiens
gtgcagttgtggacatgacaac

SEQ ID NO: 7100161 - DNA, 22 bp, Homo sapiens
gtgcagagaaggagcagtagtt

SEQ ID NO: 7100162 - DNA, 22 bp, Homo sapiens
gtgcagagaaggagcagtagtt

SEQ ID NO: 7100163 - DNA, 22 bp, Homo sapiens
gtgcagagaaggagcagtagtt

SEQ ID NO: 7100164 - DNA, 22 bp, Homo sapiens
gtgcagagaaggagcagtagtt

SEQ ID NO: 7100165 - DNA, 22 bp, Homo sapiens
gtgcagagaaatgagaagtcga

SEQ ID NO: 7100166 - DNA, 22 bp, Homo sapiens
gtgcagagaggtggagggactt

SEQ ID NO: 7100167 - DNA, 22 bp, Homo sapiens
gtgcagagaggtggagggactt

SEQ ID NO: 7100168 - DNA, 22 bp, Homo sapiens
gtgcagagaggtggagggactt

SEQ ID NO: 7100169 - DNA, 22 bp, Homo sapiens
gtgcagagaggaccttggggag

SEQ ID NO: 7100170 - DNA, 22 bp, Homo sapiens
gtgcagagaaggagcagtagtt

SEQ ID NO: 7100171 - DNA, 22 bp, Homo sapiens
gtgcaccagtcacatgggcaga

SEQ ID NO: 7100172 - DNA, 22 bp, Homo sapiens
gtgcaccagtcacatgggcaga

SEQ ID NO: 7100173 - DNA, 22 bp, Homo sapiens
gtgcacctgaataccacatact

SEQ ID NO: 7100174 - DNA, 22 bp, Homo sapiens
gtgcacctgaataccacatact

SEQ ID NO: 7100175 - DNA, 22 bp, Homo sapiens
gtgcacgtggctaatgacagtt

SEQ ID NO: 7100176 - DNA, 22 bp, Homo sapiens
gtgcacttgatctagacagatt

SEQ ID NO: 7100177 - DNA, 22 bp, Homo sapiens
gtgcactttgggagtctcagtg

SEQ ID NO: 7100178 - DNA, 22 bp, Homo sapiens
gtgcagaagtaacaattaaaga

SEQ ID NO: 7100179 - DNA, 22 bp, Homo sapiens
gtgcagaatcagtacagaacga

SEQ ID NO: 7100180 - DNA, 22 bp, Homo sapiens
gtgcagaatcagtacagaacga

SEQ ID NO: 7100181 - DNA, 22 bp, Homo sapiens
gtgcagacccacgtccagggcc

SEQ ID NO: 7100182 - DNA, 22 bp, Homo sapiens
gtgcagacccacgtccagggcc

SEQ ID NO: 7100183 - DNA, 22 bp, Homo sapiens
gtgcagacttacagattatccc

SEQ ID NO: 7100184 - DNA, 22 bp, Homo sapiens
gtgagcagggcaggactgggga

SEQ ID NO: 7100185 - DNA, 22 bp, Homo sapiens
gtgagcaggatttcatggtgta

SEQ ID NO: 7100186 - DNA, 22 bp, Homo sapiens
gtgagcaggatttcatggtgta

SEQ ID NO: 7100187 - DNA, 22 bp, Homo sapiens
gtgagcaggatttcatggtgta

SEQ ID NO: 7100188 - DNA, 22 bp, Homo sapiens
gtgagcaggatttcatggtgta

SEQ ID NO: 7100189 - DNA, 22 bp, Homo sapiens
gtgcacagagcccagggccgcg

SEQ ID NO: 7100190 - DNA, 22 bp, Homo sapiens
gtgcacagaagcagaagctaga

SEQ ID NO: 7100191 - DNA, 22 bp, Homo sapiens
gtgcacaggtgggaaaatgagt

SEQ ID NO: 7100192 - DNA, 21 bp, Homo sapiens
gtgcacagtcctgcacacagg

SEQ ID NO: 7100193 - DNA, 21 bp, Homo sapiens
gtgcacagtcctgcacacagg

SEQ ID NO: 7100194 - DNA, 22 bp, Homo sapiens
gtgcacatcgtgcaggtttgtt

SEQ ID NO: 7100195 - DNA, 22 bp, Homo sapiens
gtgcacatcgtgcaggtttgtt

SEQ ID NO: 7100196 - DNA, 22 bp, Homo sapiens
gtgcacatcgtgcaggtttgtt

SEQ ID NO: 7100197 - DNA, 22 bp, Homo sapiens
gtgcacatatttgtgcatgcat

SEQ ID NO: 7100198 - DNA, 22 bp, Homo sapiens
gtgagcagcctcacctgagggt

SEQ ID NO: 7100199 - DNA, 23 bp, Homo sapiens
gtgagcagcccactaggaatgcc

SEQ ID NO: 7100200 - DNA, 22 bp, Homo sapiens
gtgagcagcctcacctgagggt

SEQ ID NO: 7100201 - DNA, 23 bp, Homo sapiens
gtgagcagcccactaggaatgcc

SEQ ID NO: 7100202 - DNA, 22 bp, Homo sapiens
gtgagcagcctcacctgagggt

SEQ ID NO: 7100203 - DNA, 22 bp, Homo sapiens
gtgagcagctcagggtggtctc

SEQ ID NO: 7100204 - DNA, 22 bp, Homo sapiens
gtgagcagctcagggtggtctc

SEQ ID NO: 7100205 - DNA, 22 bp, Homo sapiens
gtgagcaggataggggctccct

SEQ ID NO: 7100206 - DNA, 22 bp, Homo sapiens
gtgagcagctcagggtggtctc

SEQ ID NO: 7100207 - DNA, 22 bp, Homo sapiens
gtgagcagctcagggtggtctc

SEQ ID NO: 7100208 - DNA, 22 bp, Homo sapiens
gtgagcaggataggggctccct

SEQ ID NO: 7100209 - DNA, 22 bp, Homo sapiens
gtgagcaggataggggctccct

SEQ ID NO: 7100210 - DNA, 23 bp, Homo sapiens
gtgagcagcccactaggaatgcc

SEQ ID NO: 7100211 - DNA, 22 bp, Homo sapiens
gtgagagaaattggagggaatg

SEQ ID NO: 7100212 - DNA, 22 bp, Homo sapiens
gtgagagaaattggagggaatg

SEQ ID NO: 7100213 - DNA, 22 bp, Homo sapiens
gtgagagaaattggagggaatg

SEQ ID NO: 7100214 - DNA, 22 bp, Homo sapiens
gtgagagaatttgagttaaatt

SEQ ID NO: 7100215 - DNA, 22 bp, Homo sapiens
gtgagactcgcctttgtgtagc

SEQ ID NO: 7100216 - DNA, 22 bp, Homo sapiens
gtgagacacccaagagtcagat

SEQ ID NO: 7100217 - DNA, 22 bp, Homo sapiens
gtgagacacgtgtgtgacctgg

SEQ ID NO: 7100218 - DNA, 22 bp, Homo sapiens
gtgagacatcttgggaagtgat

SEQ ID NO: 7100219 - DNA, 22 bp, Homo sapiens
gtgagacatcttgggaagtgat

SEQ ID NO: 7100220 - DNA, 22 bp, Homo sapiens
gtgagaataccagcagtgagaa

SEQ ID NO: 7100221 - DNA, 23 bp, Homo sapiens
gtgagaatcctgccctgcacttg

SEQ ID NO: 7100222 - DNA, 22 bp, Homo sapiens
gtgagacaagatttgtaggcag

SEQ ID NO: 7100223 - DNA, 22 bp, Homo sapiens
gtgagacacccaagagtcagat

SEQ ID NO: 7100224 - DNA, 22 bp, Homo sapiens
gtgagacaagatttgtaggcag

SEQ ID NO: 7100225 - DNA, 22 bp, Homo sapiens
gtgagaaaattgcctaattttg

SEQ ID NO: 7100226 - DNA, 22 bp, Homo sapiens
gtgagaaaattgcctaattttg

SEQ ID NO: 7100227 - DNA, 22 bp, Homo sapiens
gtgagaaatgacaaatgtgtcg

SEQ ID NO: 7100228 - DNA, 22 bp, Homo sapiens
gtgagaaatggaacttcatacg

SEQ ID NO: 7100229 - DNA, 22 bp, Homo sapiens
gtgagaaatggaacttcatacg

SEQ ID NO: 7100230 - DNA, 22 bp, Homo sapiens
gtgagaaattgaatggctccca

SEQ ID NO: 7100231 - DNA, 22 bp, Homo sapiens
gtgaccttggcaatctctcaga

SEQ ID NO: 7100232 - DNA, 22 bp, Homo sapiens
gtgacccatgcagtggttttgg

SEQ ID NO: 7100233 - DNA, 21 bp, Homo sapiens
gtgacctgcgcggggcgcagc

SEQ ID NO: 7100234 - DNA, 22 bp, Homo sapiens
gtgacgtgaggggctcctgttg

SEQ ID NO: 7100235 - DNA, 22 bp, Homo sapiens
gtgactctacttaagattaagc

SEQ ID NO: 7100236 - DNA, 22 bp, Homo sapiens
gtgactctcactttacctgact

SEQ ID NO: 7100237 - DNA, 22 bp, Homo sapiens
gtgactctccactagtatgaaa

SEQ ID NO: 7100238 - DNA, 22 bp, Homo sapiens
gtgactctgtttctgaaaacag

SEQ ID NO: 7100239 - DNA, 22 bp, Homo sapiens
gtgactcttaaagcaaatcttg

SEQ ID NO: 7100240 - DNA, 22 bp, Homo sapiens
gtgactcttacctacccagcct

SEQ ID NO: 7100241 - DNA, 22 bp, Homo sapiens
gtgactgtttttaggaggagta

SEQ ID NO: 7100242 - DNA, 22 bp, Homo sapiens
gtattcaaggattttgttctac

SEQ ID NO: 7100243 - DNA, 22 bp, Homo sapiens
gtattcaagcgagcagatgtct

SEQ ID NO: 7100244 - DNA, 22 bp, Homo sapiens
gtattcaagcgagcagatgtct

SEQ ID NO: 7100245 - DNA, 22 bp, Homo sapiens
gtattcacatggtggtagattg

SEQ ID NO: 7100246 - DNA, 22 bp, Homo sapiens
gtattcacatggtggtagattg

SEQ ID NO: 7100247 - DNA, 22 bp, Homo sapiens
gtattcacctaaatgtagtttg

SEQ ID NO: 7100248 - DNA, 22 bp, Homo sapiens
gtattcacctaaatgtagtttg

SEQ ID NO: 7100249 - DNA, 22 bp, Homo sapiens
gtattcagtttgattgtctaca

SEQ ID NO: 7100250 - DNA, 22 bp, Homo sapiens
gtattcatattaaacatatcaa

SEQ ID NO: 7100251 - DNA, 22 bp, Homo sapiens
gtattcctgcaaatagcagtga

SEQ ID NO: 7100252 - DNA, 22 bp, Homo sapiens
gtattccttcagaagacgttta

SEQ ID NO: 7100253 - DNA, 22 bp, Homo sapiens
gtattcatttatttactcatcc

SEQ ID NO: 7100254 - DNA, 22 bp, Homo sapiens
gtattccattagtgttaatatc

SEQ ID NO: 7100255 - DNA, 22 bp, Homo sapiens
gtattcctaagtcatgacaaat

SEQ ID NO: 7100256 - DNA, 17 bp, Homo sapiens
gtattctttgccttcca

SEQ ID NO: 7100257 - DNA, 21 bp, Homo sapiens
gtattctttatgaagtgaaaa

SEQ ID NO: 7100258 - DNA, 22 bp, Homo sapiens
gtattcttggttatcaaaatac

SEQ ID NO: 7100259 - DNA, 22 bp, Homo sapiens
gtattcttggttatcaaaatac

SEQ ID NO: 7100260 - DNA, 22 bp, Homo sapiens
gtattcttgagtggcaactagg

SEQ ID NO: 7100261 - DNA, 22 bp, Homo sapiens
gtattcttatactcagtgagct

SEQ ID NO: 7100262 - DNA, 22 bp, Homo sapiens
gtattcttaaggattgagcaaa

SEQ ID NO: 7100263 - DNA, 22 bp, Homo sapiens
gtatttataggggaatgagagt

SEQ ID NO: 7100264 - DNA, 22 bp, Homo sapiens
gtatttaattctgtgcttctag

SEQ ID NO: 7100265 - DNA, 22 bp, Homo sapiens
gtatttaattctgtgcttctag

SEQ ID NO: 7100266 - DNA, 23 bp, Homo sapiens
gtatttcagcattctcagttaaa

SEQ ID NO: 7100267 - DNA, 22 bp, Homo sapiens
gtattgtatatttgcaaataca

SEQ ID NO: 7100268 - DNA, 22 bp, Homo sapiens
gtattgtattgaacacatgtga

SEQ ID NO: 7100269 - DNA, 22 bp, Homo sapiens
gtatttaattccattaagttag

SEQ ID NO: 7100270 - DNA, 22 bp, Homo sapiens
gtatttaattccattaagttag

SEQ ID NO: 7100271 - DNA, 22 bp, Homo sapiens
gtatttaattccattaagttag

SEQ ID NO: 7100272 - DNA, 23 bp, Homo sapiens
gtattgctgctggacatgtaatt

SEQ ID NO: 7100273 - DNA, 22 bp, Homo sapiens
gtattgcattttaatatgtgca

SEQ ID NO: 7100274 - DNA, 22 bp, Homo sapiens
gtattgggattatgggtgtgag

SEQ ID NO: 7100275 - DNA, 20 bp, Homo sapiens
gtattggggcctggaggaag

SEQ ID NO: 7100276 - DNA, 22 bp, Homo sapiens
gtattgggtgagggcaaagggt

SEQ ID NO: 7100277 - DNA, 21 bp, Homo sapiens
gtattgcagagttatgtgctc

SEQ ID NO: 7100278 - DNA, 21 bp, Homo sapiens
gtattgcagagttatgtgctc

SEQ ID NO: 7100279 - DNA, 22 bp, Homo sapiens
gtattgcaattactcttcttct

SEQ ID NO: 7100280 - DNA, 22 bp, Homo sapiens
gtacgtgcatgcacgtgtgcct

SEQ ID NO: 7100281 - DNA, 22 bp, Homo sapiens
gtacctgggggatccacttctt

SEQ ID NO: 7100282 - DNA, 22 bp, Homo sapiens
gtagaaattccatttactttga

SEQ ID NO: 7100283 - DNA, 22 bp, Homo sapiens
gtagaacatggtagggcaggtg

SEQ ID NO: 7100284 - DNA, 22 bp, Homo sapiens
gtagaaatgtaaccaggagata

SEQ ID NO: 7100285 - DNA, 22 bp, Homo sapiens
gtagaaattccatttactttga

SEQ ID NO: 7100286 - DNA, 22 bp, Homo sapiens
gtagaatatatggttagtattg

SEQ ID NO: 7100287 - DNA, 22 bp, Homo sapiens
gtagaattacctctctatgtcc

SEQ ID NO: 7100288 - DNA, 22 bp, Homo sapiens
gtagaattttaataatggagat

SEQ ID NO: 7100289 - DNA, 22 bp, Homo sapiens
gtagaactaggacttcaggtat

SEQ ID NO: 7100290 - DNA, 22 bp, Homo sapiens
gtagaactcccagtggtattgt

SEQ ID NO: 7100291 - DNA, 20 bp, Homo sapiens
gtagaaccatgtgtgctggg

SEQ ID NO: 7100292 - DNA, 22 bp, Homo sapiens
gtagaagagattttattcctta

SEQ ID NO: 7100293 - DNA, 22 bp, Homo sapiens
gtattattgggtagtatggtaa

SEQ ID NO: 7100294 - DNA, 22 bp, Homo sapiens
gtattattgtcatgaaataata

SEQ ID NO: 7100295 - DNA, 22 bp, Homo sapiens
gtattattgtcatgaaataata

SEQ ID NO: 7100296 - DNA, 20 bp, Homo sapiens
gtattaggtgttcctctttc

SEQ ID NO: 7100297 - DNA, 22 bp, Homo sapiens
gtattaggttggtgcaaaagta

SEQ ID NO: 7100298 - DNA, 22 bp, Homo sapiens
gtattaggttggtgcaaaattg

SEQ ID NO: 7100299 - DNA, 22 bp, Homo sapiens
gtattagttatctactgctgtg

SEQ ID NO: 7100300 - DNA, 22 bp, Homo sapiens
gtattagtttcctgttgctgct

SEQ ID NO: 7100301 - DNA, 18 bp, Homo sapiens
gtattagttttcagagag

SEQ ID NO: 7100302 - DNA, 22 bp, Homo sapiens
gtattagtcaattacagtgggg

SEQ ID NO: 7100303 - DNA, 22 bp, Homo sapiens
gtattattaagtgtatttgacc

SEQ ID NO: 7100304 - DNA, 22 bp, Homo sapiens
gtattagactgagaaatggagt

SEQ ID NO: 7100305 - DNA, 22 bp, Homo sapiens
gtattagactgagaaatggagt

SEQ ID NO: 7100306 - DNA, 22 bp, Homo sapiens
gtattagcaagagttgtgattt

SEQ ID NO: 7100307 - DNA, 22 bp, Homo sapiens
gtattagcaagagttgtgattt

SEQ ID NO: 7100308 - DNA, 22 bp, Homo sapiens
gtattagctaggttacctgggt

SEQ ID NO: 7100309 - DNA, 22 bp, Homo sapiens
gtattagctgaattatttccat

SEQ ID NO: 7100310 - DNA, 22 bp, Homo sapiens
gtattagctgatggtcctgtct

SEQ ID NO: 7100311 - DNA, 22 bp, Homo sapiens
gtattagctgccttggagctaa

SEQ ID NO: 7100312 - DNA, 22 bp, Homo sapiens
gtattagctgccttggagctaa

SEQ ID NO: 7100313 - DNA, 22 bp, Homo sapiens
gtattagctggataaagtaggt

SEQ ID NO: 7100314 - DNA, 22 bp, Homo sapiens
gtattagctgttagctacatca

SEQ ID NO: 7100315 - DNA, 22 bp, Homo sapiens
gtattagctgttagctacatca

SEQ ID NO: 7100316 - DNA, 22 bp, Homo sapiens
gtattaggaaatatgaagaaag

SEQ ID NO: 7100317 - DNA, 22 bp, Homo sapiens
gtattaggaggaacacaggcct

SEQ ID NO: 7100318 - DNA, 20 bp, Homo sapiens
gtattaggaggtaaatgtaa

SEQ ID NO: 7100319 - DNA, 22 bp, Homo sapiens
gtattaggaggtggagcctttg

SEQ ID NO: 7100320 - DNA, 22 bp, Homo sapiens
gtattagggccaaaggcaggaa

SEQ ID NO: 7100321 - DNA, 22 bp, Homo sapiens
gtattaggtggtggaattgtag

SEQ ID NO: 7100322 - DNA, 22 bp, Homo sapiens
gtattagaagaaattataggta

SEQ ID NO: 7100323 - DNA, 23 bp, Homo sapiens
gtagacagatgggccaaggtaat

SEQ ID NO: 7100324 - DNA, 22 bp, Homo sapiens
gtagacaagcacaggactcaga

SEQ ID NO: 7100325 - DNA, 22 bp, Homo sapiens
gtagacagaaagcggaatcata

SEQ ID NO: 7100326 - DNA, 23 bp, Homo sapiens
gtagacagatgggccaaggtaat

SEQ ID NO: 7100327 - DNA, 22 bp, Homo sapiens
gtacatttctcttgttcttatt

SEQ ID NO: 7100328 - DNA, 22 bp, Homo sapiens
gtacatttctcttgttcttatt

SEQ ID NO: 7100329 - DNA, 22 bp, Homo sapiens
gtacattttactttgtttgaat

SEQ ID NO: 7100330 - DNA, 22 bp, Homo sapiens
gtacattttactttgtttgaat

SEQ ID NO: 7100331 - DNA, 22 bp, Homo sapiens
gtacattttactttgtttgaat

SEQ ID NO: 7100332 - DNA, 22 bp, Homo sapiens
gtacattttgaggttaaaacaa

SEQ ID NO: 7100333 - DNA, 22 bp, Homo sapiens
gtacattttgaggttaaaacaa

SEQ ID NO: 7100334 - DNA, 23 bp, Homo sapiens
gtacccactcccatatgtccatc

SEQ ID NO: 7100335 - DNA, 22 bp, Homo sapiens
gtacccaggcacgccttgctga

SEQ ID NO: 7100336 - DNA, 22 bp, Homo sapiens
gtacccagtgattccttcttca

SEQ ID NO: 7100337 - DNA, 22 bp, Homo sapiens
gtaaaactgtctaatggtatat

SEQ ID NO: 7100338 - DNA, 22 bp, Homo sapiens
gtaaaacctgcttttcaacacc

SEQ ID NO: 7100339 - DNA, 22 bp, Homo sapiens
gtaaaactgcagaacttggagg

SEQ ID NO: 7100340 - DNA, 22 bp, Homo sapiens
gtaaaactgtctaatggtatat

SEQ ID NO: 7100341 - DNA, 22 bp, Homo sapiens
gtaaaactgtctaatggtatat

SEQ ID NO: 7100342 - DNA, 22 bp, Homo sapiens
gtaaaactgtctaatggtatat

SEQ ID NO: 7100343 - DNA, 22 bp, Homo sapiens
gtaaaactgtctaatggtatat

SEQ ID NO: 7100344 - DNA, 22 bp, Homo sapiens
gtacatttatttttgcagcata

SEQ ID NO: 7100345 - DNA, 22 bp, Homo sapiens
gtacatttcagtttccttaaga

SEQ ID NO: 7100346 - DNA, 22 bp, Homo sapiens
gtacatttcatttaaatgatgt

SEQ ID NO: 7100347 - DNA, 22 bp, Homo sapiens
gtacatttcatttaaatgatgt

SEQ ID NO: 7100348 - DNA, 22 bp, Homo sapiens
ggttttcaaagaggcatttcat

SEQ ID NO: 7100349 - DNA, 22 bp, Homo sapiens
ggttttcacctccagaatgtgc

SEQ ID NO: 7100350 - DNA, 22 bp, Homo sapiens
ggttttcagtttgtgagctctg

SEQ ID NO: 7100351 - DNA, 23 bp, Homo sapiens
ggttttcatggcattccttgcct

SEQ ID NO: 7100352 - DNA, 23 bp, Homo sapiens
ggttttcatggcattccttgcct

SEQ ID NO: 7100353 - DNA, 22 bp, Homo sapiens
ggttttctccccctcttctcag

SEQ ID NO: 7100354 - DNA, 22 bp, Homo sapiens
ggttttctccccctcttctcag

SEQ ID NO: 7100355 - DNA, 22 bp, Homo sapiens
ggttttgcaaatgagctaatga

SEQ ID NO: 7100356 - DNA, 22 bp, Homo sapiens
ggttttattaccccttaaacac

SEQ ID NO: 7100357 - DNA, 22 bp, Homo sapiens
ggttttattaactttaacatca

SEQ ID NO: 7100358 - DNA, 22 bp, Homo sapiens
ggttttattaactttaacatca

SEQ ID NO: 7100359 - DNA, 22 bp, Homo sapiens
ggttttatcctacccacacagc

SEQ ID NO: 7100360 - DNA, 22 bp, Homo sapiens
ggttttatagcagtactatcag

SEQ ID NO: 7100361 - DNA, 22 bp, Homo sapiens
ggttttggaagtgtgtctgcag

SEQ ID NO: 7100362 - DNA, 22 bp, Homo sapiens
ggttttggagcatggagagcct

SEQ ID NO: 7100363 - DNA, 18 bp, Homo sapiens
ggttttggcatgtgtgcc

SEQ ID NO: 7100364 - DNA, 22 bp, Homo sapiens
ggttttggctagaaatgcttaa

SEQ ID NO: 7100365 - DNA, 22 bp, Homo sapiens
gtaaaacaagctttatggttcc

SEQ ID NO: 7100366 - DNA, 22 bp, Homo sapiens
gtaaaacaagctttatggttcc

SEQ ID NO: 7100367 - DNA, 22 bp, Homo sapiens
gtaaaacaagctttatggttcc

SEQ ID NO: 7100368 - DNA, 22 bp, Homo sapiens
gtaaaacaagctttatggttcc

SEQ ID NO: 7100369 - DNA, 22 bp, Homo sapiens
gtaaaacatgttttaactagga

SEQ ID NO: 7100370 - DNA, 22 bp, Homo sapiens
gtaaaacatgttttaactagga

SEQ ID NO: 7100371 - DNA, 22 bp, Homo sapiens
gtaaaacatgttttaactagga

SEQ ID NO: 7100372 - DNA, 22 bp, Homo sapiens
ggtttcctggtcagctgaggca

SEQ ID NO: 7100373 - DNA, 22 bp, Homo sapiens
ggtttcagccctgctgttcctg

SEQ ID NO: 7100374 - DNA, 22 bp, Homo sapiens
ggtttccaaagatagagtagta

SEQ ID NO: 7100375 - DNA, 22 bp, Homo sapiens
ggtttgacagcttggggctgtc

SEQ ID NO: 7100376 - DNA, 22 bp, Homo sapiens
ggtttctctagggctgaccagt

SEQ ID NO: 7100377 - DNA, 22 bp, Homo sapiens
ggtttctctgggtgtgggtgct

SEQ ID NO: 7100378 - DNA, 22 bp, Homo sapiens
ggtttgacagcttggggctgtc

SEQ ID NO: 7100379 - DNA, 22 bp, Homo sapiens
ggttttaactacagaattgcaa

SEQ ID NO: 7100380 - DNA, 22 bp, Homo sapiens
ggttttaactacagaattgcaa

SEQ ID NO: 7100381 - DNA, 22 bp, Homo sapiens
ggtttgctgcagtctcgtcatc

SEQ ID NO: 7100382 - DNA, 22 bp, Homo sapiens
gtccaaggcaagtgtgcagagt

SEQ ID NO: 7100383 - DNA, 22 bp, Homo sapiens
gtccaagggtgcacaactagta

SEQ ID NO: 7100384 - DNA, 22 bp, Homo sapiens
gtccaaggtctttggagataga

SEQ ID NO: 7100385 - DNA, 22 bp, Homo sapiens
gtccaaggatgcaggatgctgt

SEQ ID NO: 7100386 - DNA, 22 bp, Homo sapiens
gtccaaggatgcaggatgctgt

SEQ ID NO: 7100387 - DNA, 22 bp, Homo sapiens
gtccaaggatggggtctcccag

SEQ ID NO: 7100388 - DNA, 22 bp, Homo sapiens
gtccacaaaattactatcttac

SEQ ID NO: 7100389 - DNA, 22 bp, Homo sapiens
gtccacaacatcagactaactg

SEQ ID NO: 7100390 - DNA, 22 bp, Homo sapiens
gtccaattctccttccctgggt

SEQ ID NO: 7100391 - DNA, 22 bp, Homo sapiens
gtccacaagcaggaagtgagcc

SEQ ID NO: 7100392 - DNA, 22 bp, Homo sapiens
gtcatttttttcgtaatagtgg

SEQ ID NO: 7100393 - DNA, 22 bp, Homo sapiens
gtccaaaagagccagccgggcg

SEQ ID NO: 7100394 - DNA, 22 bp, Homo sapiens
gtccaagagggagctacagagc

SEQ ID NO: 7100395 - DNA, 22 bp, Homo sapiens
gtccaagagggagctacagagc

SEQ ID NO: 7100396 - DNA, 22 bp, Homo sapiens
gtccaagagtcaagaagggggc

SEQ ID NO: 7100397 - DNA, 22 bp, Homo sapiens
gtccaagagtcaagaagggggc

SEQ ID NO: 7100398 - DNA, 22 bp, Homo sapiens
gtccaagagtcaagaagggggc

SEQ ID NO: 7100399 - DNA, 22 bp, Homo sapiens
gtcatttttgactttgaagtga

SEQ ID NO: 7100400 - DNA, 22 bp, Homo sapiens
gtcatttttttcgtaatagtgg

SEQ ID NO: 7100401 - DNA, 22 bp, Homo sapiens
gtcatttttttcgtaatagtgg

SEQ ID NO: 7100402 - DNA, 22 bp, Homo sapiens
gtcatttttcactgcatataga

SEQ ID NO: 7100403 - DNA, 22 bp, Homo sapiens
gtcatttttgactttgaagtga

SEQ ID NO: 7100404 - DNA, 22 bp, Homo sapiens
gtcatttttgactttgaagtga

SEQ ID NO: 7100405 - DNA, 22 bp, Homo sapiens
gtcatttttcactgcatataga

SEQ ID NO: 7100406 - DNA, 22 bp, Homo sapiens
gtcattttgctgcatatttaga

SEQ ID NO: 7100407 - DNA, 22 bp, Homo sapiens
gtcattttgctgcatatttaga

SEQ ID NO: 7100408 - DNA, 22 bp, Homo sapiens
gtcattttgctgcatatttaga

SEQ ID NO: 7100409 - DNA, 22 bp, Homo sapiens
gtcattttctagaattatttga

SEQ ID NO: 7100410 - DNA, 22 bp, Homo sapiens
gtcattttctagaattatttga

SEQ ID NO: 7100411 - DNA, 22 bp, Homo sapiens
gtatttccattagtgtgtgcac

SEQ ID NO: 7100412 - DNA, 22 bp, Homo sapiens
gtatttccattagtgtgtgcac

SEQ ID NO: 7100413 - DNA, 23 bp, Homo sapiens
gtatttcagcattctcagttaaa

SEQ ID NO: 7100414 - DNA, 22 bp, Homo sapiens
gtccccagctaatctctttgcc

SEQ ID NO: 7100415 - DNA, 22 bp, Homo sapiens
gtccccagagctggtggtggtt

SEQ ID NO: 7100416 - DNA, 22 bp, Homo sapiens
gtccccagagctggtggtggtt

SEQ ID NO: 7100417 - DNA, 22 bp, Homo sapiens
gtccccagagctggtggtggtt

SEQ ID NO: 7100418 - DNA, 22 bp, Homo sapiens
gtccccagaaaggtgaggcagg

SEQ ID NO: 7100419 - DNA, 22 bp, Homo sapiens
gtccccagaaaggtgaggcagg

SEQ ID NO: 7100420 - DNA, 22 bp, Homo sapiens
gtccccagaaaggtgaggcagg

SEQ ID NO: 7100421 - DNA, 22 bp, Homo sapiens
gtcccatttcaagaaattcatg

SEQ ID NO: 7100422 - DNA, 22 bp, Homo sapiens
gtcccattttctactatggaat

SEQ ID NO: 7100423 - DNA, 22 bp, Homo sapiens
gtcccattttgcagatagagca

SEQ ID NO: 7100424 - DNA, 22 bp, Homo sapiens
gtcccattttctactatggaat

SEQ ID NO: 7100425 - DNA, 22 bp, Homo sapiens
gtcccattttgcagatagagca

SEQ ID NO: 7100426 - DNA, 22 bp, Homo sapiens
gtcccattccctgtatcttaga

SEQ ID NO: 7100427 - DNA, 22 bp, Homo sapiens
gtcccattgctcattagctttc

SEQ ID NO: 7100428 - DNA, 22 bp, Homo sapiens
gtcccattccctgtatcttaga

SEQ ID NO: 7100429 - DNA, 22 bp, Homo sapiens
gtcccattgctcattagctttc

SEQ ID NO: 7100430 - DNA, 22 bp, Homo sapiens
gtcccattgttctgggcttggc

SEQ ID NO: 7100431 - DNA, 22 bp, Homo sapiens
gtcccattgttctgggcttggc

SEQ ID NO: 7100432 - DNA, 22 bp, Homo sapiens
gtcccatttcaagaaattcatg

SEQ ID NO: 7100433 - DNA, 22 bp, Homo sapiens
gtccactctctgccgtgcctgt

SEQ ID NO: 7100434 - DNA, 22 bp, Homo sapiens
gtccactctagggcagctctcg

SEQ ID NO: 7100435 - DNA, 22 bp, Homo sapiens
gtccactctctgccgtgcctgt

SEQ ID NO: 7100436 - DNA, 22 bp, Homo sapiens
gtccacttcaggactggccgct

SEQ ID NO: 7100437 - DNA, 21 bp, Homo sapiens
gtccacttccttcctgcttct

SEQ ID NO: 7100438 - DNA, 22 bp, Homo sapiens
gtccacttctgacttgttcaga

SEQ ID NO: 7100439 - DNA, 22 bp, Homo sapiens
gtccacttctgcctttctggat

SEQ ID NO: 7100440 - DNA, 22 bp, Homo sapiens
gtccacttgctgtgttcttaat

SEQ ID NO: 7100441 - DNA, 22 bp, Homo sapiens
gtccacttggcacaaggcactt

SEQ ID NO: 7100442 - DNA, 23 bp, Homo sapiens
gtccagaacccaggctggggtgg

SEQ ID NO: 7100443 - DNA, 22 bp, Homo sapiens
gtcccattcatctccctaggga

SEQ ID NO: 7100444 - DNA, 22 bp, Homo sapiens
gtcccatcccccttggcactca

SEQ ID NO: 7100445 - DNA, 22 bp, Homo sapiens
gtcccattcatctccctaggga

SEQ ID NO: 7100446 - DNA, 22 bp, Homo sapiens
gtccacagctggccagggcctc

SEQ ID NO: 7100447 - DNA, 22 bp, Homo sapiens
gtccacagctctgaggtctccc

SEQ ID NO: 7100448 - DNA, 18 bp, Homo sapiens
gtccacagccctcacagc

SEQ ID NO: 7100449 - DNA, 18 bp, Homo sapiens
gtccacagccctcacagc

SEQ ID NO: 7100450 - DNA, 22 bp, Homo sapiens
gtccacagagggctgggcaggc

SEQ ID NO: 7100451 - DNA, 18 bp, Homo sapiens
gtccacagattcttcact

SEQ ID NO: 7100452 - DNA, 22 bp, Homo sapiens
gtccacagctggccagggcctc

SEQ ID NO: 7100453 - DNA, 22 bp, Homo sapiens
gtccacagggatggccacacat

SEQ ID NO: 7100454 - DNA, 22 bp, Homo sapiens
gtccacagggatggccacacat

SEQ ID NO: 7100455 - DNA, 22 bp, Homo sapiens
gtccacagggatggccacacat

SEQ ID NO: 7100456 - DNA, 21 bp, Homo sapiens
gtccacaggggtttgtcctgg

SEQ ID NO: 7100457 - DNA, 22 bp, Homo sapiens
gtccacagtgaggtgtttaaat

SEQ ID NO: 7100458 - DNA, 22 bp, Homo sapiens
gtccacagtgaggtgtttaaat

SEQ ID NO: 7100459 - DNA, 22 bp, Homo sapiens
gtccactcactcttagtcactc

SEQ ID NO: 7100460 - DNA, 19 bp, Homo sapiens
gtccactccactcggtctc

SEQ ID NO: 7100461 - DNA, 22 bp, Homo sapiens
gtccactcccagtgcctgaggc

SEQ ID NO: 7100462 - DNA, 22 bp, Homo sapiens
gtccactcccagtgcctgaggc

SEQ ID NO: 7100463 - DNA, 22 bp, Homo sapiens
gtccactcccagtgcctgaggc

SEQ ID NO: 7100464 - DNA, 22 bp, Homo sapiens
gtcctgggagatgggaccctga

SEQ ID NO: 7100465 - DNA, 22 bp, Homo sapiens
gtcctgggagatgggaccctga

SEQ ID NO: 7100466 - DNA, 20 bp, Homo sapiens
gtcctgggagccacagcaca

SEQ ID NO: 7100467 - DNA, 20 bp, Homo sapiens
gtcctgggagccacagcaca

SEQ ID NO: 7100468 - DNA, 22 bp, Homo sapiens
gtcctgggaaggaagccaggga

SEQ ID NO: 7100469 - DNA, 22 bp, Homo sapiens
gtcctgggaaggaagccaggga

SEQ ID NO: 7100470 - DNA, 22 bp, Homo sapiens
gtcctgggaaggaagccaggga

SEQ ID NO: 7100471 - DNA, 22 bp, Homo sapiens
gtcctgggaaggaagccaggga

SEQ ID NO: 7100472 - DNA, 22 bp, Homo sapiens
gtccctggaatggactctgcgc

SEQ ID NO: 7100473 - DNA, 22 bp, Homo sapiens
gtccctggaaaagagctggtga

SEQ ID NO: 7100474 - DNA, 22 bp, Homo sapiens
gtcctgggaactggacagctaa

SEQ ID NO: 7100475 - DNA, 22 bp, Homo sapiens
gtcctgggaactggacagctaa

SEQ ID NO: 7100476 - DNA, 22 bp, Homo sapiens
gtccctgcatcaccacgggact

SEQ ID NO: 7100477 - DNA, 22 bp, Homo sapiens
gtccctgcatctgcaggccatg

SEQ ID NO: 7100478 - DNA, 22 bp, Homo sapiens
gtccctgcatctgcaggccatg

SEQ ID NO: 7100479 - DNA, 22 bp, Homo sapiens
gtccctgcatctgcaggccatg

SEQ ID NO: 7100480 - DNA, 22 bp, Homo sapiens
gtccctgccctcctgggactca

SEQ ID NO: 7100481 - DNA, 22 bp, Homo sapiens
gtccctgccctcctgggactca

SEQ ID NO: 7100482 - DNA, 17 bp, Homo sapiens
gtcctgggaggagagag

SEQ ID NO: 7100483 - DNA, 17 bp, Homo sapiens
gtcctgggaggagagag

SEQ ID NO: 7100484 - DNA, 17 bp, Homo sapiens
gtcctgggaggagagag

SEQ ID NO: 7100485 - DNA, 22 bp, Homo sapiens
gtcctgggaggggctggtcctg

SEQ ID NO: 7100486 - DNA, 22 bp, Homo sapiens
gtcctgggcccaggggctgcct

SEQ ID NO: 7100487 - DNA, 22 bp, Homo sapiens
gtcctgggcatgcagggctttc

SEQ ID NO: 7100488 - DNA, 22 bp, Homo sapiens
gtcctgggcatgcagggctttc

SEQ ID NO: 7100489 - DNA, 22 bp, Homo sapiens
gtcctgggaggggctggtcctg

SEQ ID NO: 7100490 - DNA, 22 bp, Homo sapiens
gtcctgggcctgctgaggctga

SEQ ID NO: 7100491 - DNA, 22 bp, Homo sapiens
gtcctgggcctgctgaggctga

SEQ ID NO: 7100492 - DNA, 22 bp, Homo sapiens
gtcctgggcctgctgaggctga

SEQ ID NO: 7100493 - DNA, 22 bp, Homo sapiens
gtcctgggcctgctgaggctga

SEQ ID NO: 7100494 - DNA, 22 bp, Homo sapiens
gtcctgggcccaggggctgcct

SEQ ID NO: 7100495 - DNA, 22 bp, Homo sapiens
gtcctgggcccaggggctgcct

SEQ ID NO: 7100496 - DNA, 22 bp, Homo sapiens
gtcccctggcccccagcgtcgg

SEQ ID NO: 7100497 - DNA, 22 bp, Homo sapiens
gtcccctgctggtgttgctgct

SEQ ID NO: 7100498 - DNA, 22 bp, Homo sapiens
gtcccctggtggctggagctgc

SEQ ID NO: 7100499 - DNA, 22 bp, Homo sapiens
gtccccttggtaaccttcagct

SEQ ID NO: 7100500 - DNA, 22 bp, Homo sapiens
gtccccttggtaaccttcagct

SEQ ID NO: 7100501 - DNA, 22 bp, Homo sapiens
gtccccagctgtgacgagagcc

SEQ ID NO: 7100502 - DNA, 22 bp, Homo sapiens
gtccccagctgtgacgagagcc

SEQ ID NO: 7100503 - DNA, 22 bp, Homo sapiens
gtccccagctgtgacgagagcc

SEQ ID NO: 7100504 - DNA, 22 bp, Homo sapiens
gtcccccacacttccatgtcac

SEQ ID NO: 7100505 - DNA, 22 bp, Homo sapiens
gtccccgacgtttggcttgatg

SEQ ID NO: 7100506 - DNA, 22 bp, Homo sapiens
gtccccgacgtttggcttgatg

SEQ ID NO: 7100507 - DNA, 22 bp, Homo sapiens
gtccctctgtgtccctgcagtc

SEQ ID NO: 7100508 - DNA, 22 bp, Homo sapiens
gtccctctgtgtccctgcagtc

SEQ ID NO: 7100509 - DNA, 22 bp, Homo sapiens
gtccctgcatcaccacgggact

SEQ ID NO: 7100510 - DNA, 22 bp, Homo sapiens
gtccctgcatcaccacgggact

SEQ ID NO: 7100511 - DNA, 22 bp, Homo sapiens
gtccctctgggccatcaggtcc

SEQ ID NO: 7100512 - DNA, 22 bp, Homo sapiens
gtccctctgtgtccctgcagtc

SEQ ID NO: 7100513 - DNA, 22 bp, Homo sapiens
gtccctctgtgtccctgcagtc

SEQ ID NO: 7100514 - DNA, 22 bp, Homo sapiens
gtccctctgctctagagagcca

SEQ ID NO: 7100515 - DNA, 22 bp, Homo sapiens
gtccctctgctctagagagcca

SEQ ID NO: 7100516 - DNA, 22 bp, Homo sapiens
gtccctctgctctagagagcca

SEQ ID NO: 7100517 - DNA, 22 bp, Homo sapiens
gtccctctgctctagagagcca

SEQ ID NO: 7100518 - DNA, 22 bp, Homo sapiens
gtccctctgggccatcaggtcc

SEQ ID NO: 7100519 - DNA, 23 bp, Homo sapiens
gtccctcacccctaggcaatgcc

SEQ ID NO: 7100520 - DNA, 22 bp, Homo sapiens
gtccctcaaggtccagtcatgg

SEQ ID NO: 7100521 - DNA, 22 bp, Homo sapiens
gtccctcactggaccatatgaa

SEQ ID NO: 7100522 - DNA, 22 bp, Homo sapiens
gtccctcagtagtgcacagtgg

SEQ ID NO: 7100523 - DNA, 22 bp, Homo sapiens
gtccctctcaaatttatatgct

SEQ ID NO: 7100524 - DNA, 22 bp, Homo sapiens
gtccctctgcctgtggttctct

SEQ ID NO: 7100525 - DNA, 22 bp, Homo sapiens
ggggctgggatttgaacccagg

SEQ ID NO: 7100526 - DNA, 22 bp, Homo sapiens
ggggctggtggtggtttctcca

SEQ ID NO: 7100527 - DNA, 22 bp, Homo sapiens
ggggctgggatttgaacccagg

SEQ ID NO: 7100528 - DNA, 22 bp, Homo sapiens
ggggctggtggtggtttctcca

SEQ ID NO: 7100529 - DNA, 22 bp, Homo sapiens
ggggctggtggtggtttctcca

SEQ ID NO: 7100530 - DNA, 22 bp, Homo sapiens
ggggctggtggtggtttctcca

SEQ ID NO: 7100531 - DNA, 22 bp, Homo sapiens
ggggtgggcgtgcagggacacc

SEQ ID NO: 7100532 - DNA, 22 bp, Homo sapiens
ggggtgggcgtgcagggacacc

SEQ ID NO: 7100533 - DNA, 22 bp, Homo sapiens
ggggctggtggtggtttctcca

SEQ ID NO: 7100534 - DNA, 22 bp, Homo sapiens
ggggtgggcgtgcagggacacc

SEQ ID NO: 7100535 - DNA, 22 bp, Homo sapiens
ggggtgggcgtgcagggacacc

SEQ ID NO: 7100536 - DNA, 22 bp, Homo sapiens
ggggtgggcgtgcagggacacc

SEQ ID NO: 7100537 - DNA, 22 bp, Homo sapiens
ggggtgggcgtgcagggacacc

SEQ ID NO: 7100538 - DNA, 22 bp, Homo sapiens
ggggtgggcgtgcagggacacc

SEQ ID NO: 7100539 - DNA, 22 bp, Homo sapiens
ggggtgggcgtgcagggacacc

SEQ ID NO: 7100540 - DNA, 22 bp, Homo sapiens
ggggtgggcgtgcagggacacc

SEQ ID NO: 7100541 - DNA, 22 bp, Homo sapiens
ggggtgggcgtgcagggacacc

SEQ ID NO: 7100542 - DNA, 22 bp, Homo sapiens
ggggtgggcgtgcagggacacc

SEQ ID NO: 7100543 - DNA, 22 bp, Homo sapiens
ggggtgggcgtgcagggacacc

SEQ ID NO: 7100544 - DNA, 22 bp, Homo sapiens
ggggtgggcgtgcagggacacc

SEQ ID NO: 7100545 - DNA, 22 bp, Homo sapiens
ggggtgggcgtgcagggacacc

SEQ ID NO: 7100546 - DNA, 22 bp, Homo sapiens
ggggtgggcgtgcagggacacc

SEQ ID NO: 7100547 - DNA, 22 bp, Homo sapiens
ggggtgggcgtgcagggacacc

SEQ ID NO: 7100548 - DNA, 22 bp, Homo sapiens
ggggtggggttactcattgtgc

SEQ ID NO: 7100549 - DNA, 22 bp, Homo sapiens
ggggtggggttactcattgtgc

SEQ ID NO: 7100550 - DNA, 22 bp, Homo sapiens
ggggtgggcgtgcagggacacc

SEQ ID NO: 7100551 - DNA, 22 bp, Homo sapiens
ggggtgggcgtgcagggacacc

SEQ ID NO: 7100552 - DNA, 22 bp, Homo sapiens
ggggtggggttactcattgtgc

SEQ ID NO: 7100553 - DNA, 22 bp, Homo sapiens
ggggtggggttactcattgtgc

SEQ ID NO: 7100554 - DNA, 22 bp, Homo sapiens
ggggtggggttactcattgtgc

SEQ ID NO: 7100555 - DNA, 22 bp, Homo sapiens
ggggtggggttactcattgtgc

SEQ ID NO: 7100556 - DNA, 22 bp, Homo sapiens
ggggtggggttactcattgtgc

SEQ ID NO: 7100557 - DNA, 22 bp, Homo sapiens
ggggtggggttactcattgtgc

SEQ ID NO: 7100558 - DNA, 22 bp, Homo sapiens
ggggtgtgagtagagctgggga

SEQ ID NO: 7100559 - DNA, 22 bp, Homo sapiens
ggggtgtgagtagagctgggga

SEQ ID NO: 7100560 - DNA, 22 bp, Homo sapiens
ggggtgtgagtagagctgggga

SEQ ID NO: 7100561 - DNA, 22 bp, Homo sapiens
ggggtgtgagtagagctgggga

SEQ ID NO: 7100562 - DNA, 22 bp, Homo sapiens
ggggtgtgagtagagctgggga

SEQ ID NO: 7100563 - DNA, 22 bp, Homo sapiens
ggggtgtgagtagagctgggga

SEQ ID NO: 7100564 - DNA, 22 bp, Homo sapiens
ggggtgtggacggctgtgccag

SEQ ID NO: 7100565 - DNA, 22 bp, Homo sapiens
ggggtgtggacggctgtgccag

SEQ ID NO: 7100566 - DNA, 22 bp, Homo sapiens
ggggtgtggacggctgtgccag

SEQ ID NO: 7100567 - DNA, 22 bp, Homo sapiens
ggggtgtgtctgacaatggtat

SEQ ID NO: 7100568 - DNA, 22 bp, Homo sapiens
ggggtgtgtctgacaatggtat

SEQ ID NO: 7100569 - DNA, 22 bp, Homo sapiens
ggggtgtgtctgacaatggtat

SEQ ID NO: 7100570 - DNA, 22 bp, Homo sapiens
ggggttaacagtattgctcatg

SEQ ID NO: 7100571 - DNA, 22 bp, Homo sapiens
ggggttgatcacagaggggtct

SEQ ID NO: 7100572 - DNA, 22 bp, Homo sapiens
ggggttgatcacagaggggtct

SEQ ID NO: 7100573 - DNA, 21 bp, Homo sapiens
ggggttggcaagagcagagac

SEQ ID NO: 7100574 - DNA, 21 bp, Homo sapiens
ggggttggcaagagcagagac

SEQ ID NO: 7100575 - DNA, 21 bp, Homo sapiens
ggggttggcaagagcagagac

SEQ ID NO: 7100576 - DNA, 22 bp, Homo sapiens
gggtaggaaatccagaggtggc

SEQ ID NO: 7100577 - DNA, 22 bp, Homo sapiens
gggtaggcaaagcaatgacgtt

SEQ ID NO: 7100578 - DNA, 22 bp, Homo sapiens
gggtaggcaaagcaatgacgtt

SEQ ID NO: 7100579 - DNA, 22 bp, Homo sapiens
gggtaggatggtagaagggacc

SEQ ID NO: 7100580 - DNA, 22 bp, Homo sapiens
gggtaggatggtagaagggacc

SEQ ID NO: 7100581 - DNA, 22 bp, Homo sapiens
gggtaggagaggtgtctgtgtg

SEQ ID NO: 7100582 - DNA, 22 bp, Homo sapiens
gggtaggagaggtgtctgtgtg

SEQ ID NO: 7100583 - DNA, 22 bp, Homo sapiens
gggtaggaaatccagaggtggc

SEQ ID NO: 7100584 - DNA, 22 bp, Homo sapiens
gggtaggagaggtgtctgtgtg

SEQ ID NO: 7100585 - DNA, 22 bp, Homo sapiens
gggtaggatggtagaagggacc

SEQ ID NO: 7100586 - DNA, 22 bp, Homo sapiens
gggtagggtgacttaggctggc

SEQ ID NO: 7100587 - DNA, 22 bp, Homo sapiens
gggtagggtgacttaggctggc

SEQ ID NO: 7100588 - DNA, 22 bp, Homo sapiens
gggtagggtgacttaggctggc

SEQ ID NO: 7100589 - DNA, 22 bp, Homo sapiens
gggtaggctgctcctggggccc

SEQ ID NO: 7100590 - DNA, 22 bp, Homo sapiens
gggtagggtgacttaggctggc

SEQ ID NO: 7100591 - DNA, 22 bp, Homo sapiens
gggtaggcagtgcgtcctgcct

SEQ ID NO: 7100592 - DNA, 22 bp, Homo sapiens
gggtaggccagaagggcctgga

SEQ ID NO: 7100593 - DNA, 22 bp, Homo sapiens
gggtaggctctgcaggctgggt

SEQ ID NO: 7100594 - DNA, 22 bp, Homo sapiens
gggtaggctctgcaggctgggt

SEQ ID NO: 7100595 - DNA, 22 bp, Homo sapiens
gggtaggctctgcaggctgggt

SEQ ID NO: 7100596 - DNA, 22 bp, Homo sapiens
gggtaggctgctcctggggccc

SEQ ID NO: 7100597 - DNA, 22 bp, Homo sapiens
gggtggaggagaacaggcccca

SEQ ID NO: 7100598 - DNA, 22 bp, Homo sapiens
gggtggaggagaacaggcccca

SEQ ID NO: 7100599 - DNA, 22 bp, Homo sapiens
gggtggagcttggacaccagta

SEQ ID NO: 7100600 - DNA, 22 bp, Homo sapiens
gggtggagcttggacaccagta

SEQ ID NO: 7100601 - DNA, 22 bp, Homo sapiens
gggtggagcttggacaccagta

SEQ ID NO: 7100602 - DNA, 22 bp, Homo sapiens
gggtggagcttggacaccagta

SEQ ID NO: 7100603 - DNA, 22 bp, Homo sapiens
gggtggagcttggacaccagta

SEQ ID NO: 7100604 - DNA, 22 bp, Homo sapiens
gggtggagccagttgactctgt

SEQ ID NO: 7100605 - DNA, 22 bp, Homo sapiens
gggtggagcctgagaatttgca

SEQ ID NO: 7100606 - DNA, 22 bp, Homo sapiens
gggtggagtagaaagatgaatt

SEQ ID NO: 7100607 - DNA, 22 bp, Homo sapiens
gggtggaggagaacaggcccca

SEQ ID NO: 7100608 - DNA, 22 bp, Homo sapiens
gggtggaggtgggttttgagat

SEQ ID NO: 7100609 - DNA, 22 bp, Homo sapiens
gggtggaggtgggttttgagat

SEQ ID NO: 7100610 - DNA, 22 bp, Homo sapiens
gggtggagtagaaagatgaatt

SEQ ID NO: 7100611 - DNA, 22 bp, Homo sapiens
gggtggagtagaaagatgaatt

SEQ ID NO: 7100612 - DNA, 22 bp, Homo sapiens
gggtggagtagaaagatgaatt

SEQ ID NO: 7100613 - DNA, 22 bp, Homo sapiens
gggtggagtgtgaaatctggct

SEQ ID NO: 7100614 - DNA, 22 bp, Homo sapiens
gggtggagtgtgaaatctggct

SEQ ID NO: 7100615 - DNA, 20 bp, Homo sapiens
gggtggagttgcggtctgtg

SEQ ID NO: 7100616 - DNA, 20 bp, Homo sapiens
gggtggagttgcggtctgtg

SEQ ID NO: 7100617 - DNA, 22 bp, Homo sapiens
ggggaagacctggcactacagc

SEQ ID NO: 7100618 - DNA, 22 bp, Homo sapiens
ggggaagacctggcactacagc

SEQ ID NO: 7100619 - DNA, 22 bp, Homo sapiens
ggggaagaggcgtgatggatcc

SEQ ID NO: 7100620 - DNA, 22 bp, Homo sapiens
ggggaagaggcgtgatggatcc

SEQ ID NO: 7100621 - DNA, 22 bp, Homo sapiens
ggggaagaggcgtgatggatcc

SEQ ID NO: 7100622 - DNA, 22 bp, Homo sapiens
ggggaagaggcgtgatggatcc

SEQ ID NO: 7100623 - DNA, 22 bp, Homo sapiens
ggggaagatggccctccatgtg

SEQ ID NO: 7100624 - DNA, 22 bp, Homo sapiens
ggggaagatggccctccatgtg

SEQ ID NO: 7100625 - DNA, 22 bp, Homo sapiens
ggggaagatggccctccatgtg

SEQ ID NO: 7100626 - DNA, 22 bp, Homo sapiens
gggcttggtggagagaatgctg

SEQ ID NO: 7100627 - DNA, 22 bp, Homo sapiens
ggggaagaatgctctctagaga

SEQ ID NO: 7100628 - DNA, 22 bp, Homo sapiens
ggggaagaatggcagaaaacat

SEQ ID NO: 7100629 - DNA, 22 bp, Homo sapiens
ggggaagaatggcagaaaacat

SEQ ID NO: 7100630 - DNA, 22 bp, Homo sapiens
ggggccgaccgcggttcaggcc

SEQ ID NO: 7100631 - DNA, 22 bp, Homo sapiens
ggggccgaccgcggttcaggcc

SEQ ID NO: 7100632 - DNA, 22 bp, Homo sapiens
ggggccgaccgcggttcaggcc

SEQ ID NO: 7100633 - DNA, 22 bp, Homo sapiens
ggggaaggattgagttgaccca

SEQ ID NO: 7100634 - DNA, 22 bp, Homo sapiens
ggggaaggatatgattagacta

SEQ ID NO: 7100635 - DNA, 22 bp, Homo sapiens
ggggaagatggccctccatgtg

SEQ ID NO: 7100636 - DNA, 22 bp, Homo sapiens
ggggaagatggccctccatgtg

SEQ ID NO: 7100637 - DNA, 22 bp, Homo sapiens
ggggaagatttttaattagtaa

SEQ ID NO: 7100638 - DNA, 22 bp, Homo sapiens
ggggaaggaaagttattagcag

SEQ ID NO: 7100639 - DNA, 22 bp, Homo sapiens
ggggaaggaaagttattagcag

SEQ ID NO: 7100640 - DNA, 22 bp, Homo sapiens
ggggaaggatatgattagacta

SEQ ID NO: 7100641 - DNA, 22 bp, Homo sapiens
ggggaaggatatgattagacta

SEQ ID NO: 7100642 - DNA, 22 bp, Homo sapiens
ggggccgaccgcggttcaggcc

SEQ ID NO: 7100643 - DNA, 22 bp, Homo sapiens
ggggccgaccgcggttcaggcc

SEQ ID NO: 7100644 - DNA, 22 bp, Homo sapiens
ggggccgaccgcggttcaggcc

SEQ ID NO: 7100645 - DNA, 22 bp, Homo sapiens
ggggccgaccgcggttcaggcc

SEQ ID NO: 7100646 - DNA, 22 bp, Homo sapiens
ggggcctccagcactaggcagc

SEQ ID NO: 7100647 - DNA, 22 bp, Homo sapiens
ggggctaactttctgagggtag

SEQ ID NO: 7100648 - DNA, 22 bp, Homo sapiens
ggggctcaggggaagtgtccag

SEQ ID NO: 7100649 - DNA, 22 bp, Homo sapiens
ggggctcaggggaagtgtccag

SEQ ID NO: 7100650 - DNA, 22 bp, Homo sapiens
ggggctcaggggaagtgtccag

SEQ ID NO: 7100651 - DNA, 22 bp, Homo sapiens
ggggcggggctctgagaagcat

SEQ ID NO: 7100652 - DNA, 22 bp, Homo sapiens
ggggcggggctctgagaagcat

SEQ ID NO: 7100653 - DNA, 22 bp, Homo sapiens
ggggcggggctctgagaagcat

SEQ ID NO: 7100654 - DNA, 22 bp, Homo sapiens
ggggcggggctctgagaagcat

SEQ ID NO: 7100655 - DNA, 22 bp, Homo sapiens
ggggctggctcactaagagact

SEQ ID NO: 7100656 - DNA, 22 bp, Homo sapiens
ggggctgggatttgaacccagg

SEQ ID NO: 7100657 - DNA, 22 bp, Homo sapiens
ggggctgggatttgaacccagg

SEQ ID NO: 7100658 - DNA, 22 bp, Homo sapiens
ggggctgggatttgaacccagg

SEQ ID NO: 7100659 - DNA, 22 bp, Homo sapiens
ggggctgcttcacctttttacg

SEQ ID NO: 7100660 - DNA, 22 bp, Homo sapiens
ggggctggctcactaagagact

SEQ ID NO: 7100661 - DNA, 22 bp, Homo sapiens
ggggctggctcactaagagact

SEQ ID NO: 7100662 - DNA, 22 bp, Homo sapiens
ggggctggctcactaagagact

SEQ ID NO: 7100663 - DNA, 22 bp, Homo sapiens
ggggctggctcactaagagact

SEQ ID NO: 7100664 - DNA, 22 bp, Homo sapiens
ggggctgctcgccgcgcgtttc

SEQ ID NO: 7100665 - DNA, 22 bp, Homo sapiens
ggggctgctggtatttccagtt

SEQ ID NO: 7100666 - DNA, 22 bp, Homo sapiens
ggggctgctggtatttccagtt

SEQ ID NO: 7100667 - DNA, 22 bp, Homo sapiens
ggggctgatggaactcaggcct

SEQ ID NO: 7100668 - DNA, 22 bp, Homo sapiens
ggggctgatggaactcaggcct

SEQ ID NO: 7100669 - DNA, 22 bp, Homo sapiens
ggggctgagaattcagtctcgg

SEQ ID NO: 7100670 - DNA, 22 bp, Homo sapiens
ggggctgagtcagtgggaagag

SEQ ID NO: 7100671 - DNA, 22 bp, Homo sapiens
ggggctgagtcagtgggaagag

SEQ ID NO: 7100672 - DNA, 20 bp, Homo sapiens
ggggctgcatgcagagaaga

SEQ ID NO: 7100673 - DNA, 20 bp, Homo sapiens
ggggctgcatgcagagaaga

SEQ ID NO: 7100674 - DNA, 22 bp, Homo sapiens
ggggctgatggaactcaggcct

SEQ ID NO: 7100675 - DNA, 22 bp, Homo sapiens
ggggctgctcccacccctgagg

SEQ ID NO: 7100676 - DNA, 20 bp, Homo sapiens
ggggctgcatgcagagaaga

SEQ ID NO: 7100677 - DNA, 22 bp, Homo sapiens
ggggctcagttcggacagcctg

SEQ ID NO: 7100678 - DNA, 22 bp, Homo sapiens
ggggctcaggggaagtgtccag

SEQ ID NO: 7100679 - DNA, 22 bp, Homo sapiens
ggggctcagttcggacagcctg

SEQ ID NO: 7100680 - DNA, 22 bp, Homo sapiens
ggggctcagttcggacagcctg

SEQ ID NO: 7100681 - DNA, 22 bp, Homo sapiens
ggggctctaggtaaagcaacat

SEQ ID NO: 7100682 - DNA, 22 bp, Homo sapiens
ggggctctaggtaaagcaacat

SEQ ID NO: 7100683 - DNA, 22 bp, Homo sapiens
ggggctctcaggtctccccaaa

SEQ ID NO: 7100684 - DNA, 22 bp, Homo sapiens
ggggctctcaggtctccccaaa

SEQ ID NO: 7100685 - DNA, 22 bp, Homo sapiens
ggggctctcaggtctccccaaa

SEQ ID NO: 7100686 - DNA, 22 bp, Homo sapiens
ggggctctgcctctcccacgcc

SEQ ID NO: 7100687 - DNA, 22 bp, Homo sapiens
ggggctctgcctctcccacgcc

SEQ ID NO: 7100688 - DNA, 22 bp, Homo sapiens
ggggctctgctctgagccgtgt

SEQ ID NO: 7100689 - DNA, 22 bp, Homo sapiens
ggggctctggagaaaggccagt

SEQ ID NO: 7100690 - DNA, 22 bp, Homo sapiens
ggggctctggagaaaggccagt

SEQ ID NO: 7100691 - DNA, 22 bp, Homo sapiens
ggggctctggagaaaggccagt

SEQ ID NO: 7100692 - DNA, 22 bp, Homo sapiens
ggggctctgtgacagtaaccct

SEQ ID NO: 7100693 - DNA, 22 bp, Homo sapiens
ggggctcttagagagcctagtg

SEQ ID NO: 7100694 - DNA, 22 bp, Homo sapiens
ggggctctgtgacagtaaccct

SEQ ID NO: 7100695 - DNA, 22 bp, Homo sapiens
ggggctgaacctggaggtggtc

SEQ ID NO: 7100696 - DNA, 22 bp, Homo sapiens
ggggctgaacctggaggtggtc

SEQ ID NO: 7100697 - DNA, 22 bp, Homo sapiens
ggggctgaacctggaggtggtc

SEQ ID NO: 7100698 - DNA, 22 bp, Homo sapiens
ggggctgacgggcatgtggctt

SEQ ID NO: 7100699 - DNA, 22 bp, Homo sapiens
ggggctgacgggcatgtggctt

SEQ ID NO: 7100700 - DNA, 22 bp, Homo sapiens
ggggctgagaattcagtctcgg

SEQ ID NO: 7100701 - DNA, 22 bp, Homo sapiens
gggcatggtggtgcacacctgt

SEQ ID NO: 7100702 - DNA, 22 bp, Homo sapiens
gggcatgtacataatctagaaa

SEQ ID NO: 7100703 - DNA, 22 bp, Homo sapiens
gggcatgtaggaatccatggag

SEQ ID NO: 7100704 - DNA, 22 bp, Homo sapiens
gggcatgtctctaggctggcta

SEQ ID NO: 7100705 - DNA, 22 bp, Homo sapiens
gggccaaggggagctggaaggg

SEQ ID NO: 7100706 - DNA, 22 bp, Homo sapiens
gggccaaggggagctggaaggg

SEQ ID NO: 7100707 - DNA, 22 bp, Homo sapiens
gggccaaggggagctggaaggg

SEQ ID NO: 7100708 - DNA, 22 bp, Homo sapiens
gggccaaggggagctggaaggg

SEQ ID NO: 7100709 - DNA, 22 bp, Homo sapiens
gggccaaggggagctggaaggg

SEQ ID NO: 7100710 - DNA, 22 bp, Homo sapiens
gggccacacagaacctcctggt

SEQ ID NO: 7100711 - DNA, 22 bp, Homo sapiens
gggccacacagggcagctccct

SEQ ID NO: 7100712 - DNA, 22 bp, Homo sapiens
gggccacacagggcagctccct

SEQ ID NO: 7100713 - DNA, 22 bp, Homo sapiens
gggccaaggggagctggaaggg

SEQ ID NO: 7100714 - DNA, 22 bp, Homo sapiens
gggccaaggggagctggaaggg

SEQ ID NO: 7100715 - DNA, 22 bp, Homo sapiens
gggccaaggggagctggaaggg

SEQ ID NO: 7100716 - DNA, 22 bp, Homo sapiens
gggccaagggtgcgtggcagga

SEQ ID NO: 7100717 - DNA, 22 bp, Homo sapiens
gggccaagggtgcgtggcagga

SEQ ID NO: 7100718 - DNA, 22 bp, Homo sapiens
gggccaagggtgcgtggcagga

SEQ ID NO: 7100719 - DNA, 22 bp, Homo sapiens
gggcatggggcggacctggttc

SEQ ID NO: 7100720 - DNA, 22 bp, Homo sapiens
gggcatggtgagggatatgaag

SEQ ID NO: 7100721 - DNA, 22 bp, Homo sapiens
gggcatggtgagggatatgaag

SEQ ID NO: 7100722 - DNA, 22 bp, Homo sapiens
gggcatggcgtgtgctggattc

SEQ ID NO: 7100723 - DNA, 22 bp, Homo sapiens
gggcatggcgtgtgctggattc

SEQ ID NO: 7100724 - DNA, 22 bp, Homo sapiens
gggcatggggcggacctggttc

SEQ ID NO: 7100725 - DNA, 22 bp, Homo sapiens
gggcatggtgatgtgcacctgt

SEQ ID NO: 7100726 - DNA, 22 bp, Homo sapiens
gggcatggtgctggtgttcatg

SEQ ID NO: 7100727 - DNA, 22 bp, Homo sapiens
gggcatggtgctggtgttcatg

SEQ ID NO: 7100728 - DNA, 22 bp, Homo sapiens
gggcatggccaggtgaggggtc

SEQ ID NO: 7100729 - DNA, 22 bp, Homo sapiens
gggcatggcgtgtgctggattc

SEQ ID NO: 7100730 - DNA, 22 bp, Homo sapiens
gggcatggcgtgtgctggattc

SEQ ID NO: 7100731 - DNA, 22 bp, Homo sapiens
gggcatggccaggtgaggggtc

SEQ ID NO: 7100732 - DNA, 22 bp, Homo sapiens
gggcatggcgtgtgctggattc

SEQ ID NO: 7100733 - DNA, 22 bp, Homo sapiens
gggcatggccaggtgaggggtc

SEQ ID NO: 7100734 - DNA, 22 bp, Homo sapiens
gggcatggccaggtgaggggtc

SEQ ID NO: 7100735 - DNA, 18 bp, Homo sapiens
gggcatggatgcagcatc

SEQ ID NO: 7100736 - DNA, 18 bp, Homo sapiens
gggcatggatgcagcatc

SEQ ID NO: 7100737 - DNA, 22 bp, Homo sapiens
gggcatggccaggtgaggggtc

SEQ ID NO: 7100738 - DNA, 22 bp, Homo sapiens
gggcatggccaggtgaggggtc

SEQ ID NO: 7100739 - DNA, 22 bp, Homo sapiens
gggcatggccaggtgaggggtc

SEQ ID NO: 7100740 - DNA, 22 bp, Homo sapiens
gggcatggccaggtgaggggtc

SEQ ID NO: 7100741 - DNA, 22 bp, Homo sapiens
gggcatggccaggtgaggggtc

SEQ ID NO: 7100742 - DNA, 22 bp, Homo sapiens
gggctgagagctggaatctgag

SEQ ID NO: 7100743 - DNA, 22 bp, Homo sapiens
gggctgagagctggaatctgag

SEQ ID NO: 7100744 - DNA, 21 bp, Homo sapiens
gggccacaccttctgcagacc

SEQ ID NO: 7100745 - DNA, 22 bp, Homo sapiens
gggctgagagtgactgttctgt

SEQ ID NO: 7100746 - DNA, 22 bp, Homo sapiens
gggctgagagctggaatctgag

SEQ ID NO: 7100747 - DNA, 22 bp, Homo sapiens
gggctgagagctggaatctgag

SEQ ID NO: 7100748 - DNA, 22 bp, Homo sapiens
gggctgagagctggaatctgag

SEQ ID NO: 7100749 - DNA, 22 bp, Homo sapiens
gggctgagagctggaatctgag

SEQ ID NO: 7100750 - DNA, 22 bp, Homo sapiens
gggctgagcacatactgacagc

SEQ ID NO: 7100751 - DNA, 22 bp, Homo sapiens
gggctgagcacatactgacagc

SEQ ID NO: 7100752 - DNA, 22 bp, Homo sapiens
gggctgagattggtgccctgtc

SEQ ID NO: 7100753 - DNA, 22 bp, Homo sapiens
gggctgagattggtgccctgtc

SEQ ID NO: 7100754 - DNA, 22 bp, Homo sapiens
gggctgagagtgactgttctgt

SEQ ID NO: 7100755 - DNA, 22 bp, Homo sapiens
gggctgagccacagcttttgtt

SEQ ID NO: 7100756 - DNA, 22 bp, Homo sapiens
gggctgagccacagcttttgtt

SEQ ID NO: 7100757 - DNA, 22 bp, Homo sapiens
gggctgagctaagctgggttga

SEQ ID NO: 7100758 - DNA, 22 bp, Homo sapiens
gggctgagccatttgaaccttg

SEQ ID NO: 7100759 - DNA, 22 bp, Homo sapiens
gggctgagccatttgaaccttg

SEQ ID NO: 7100760 - DNA, 22 bp, Homo sapiens
gggctgagctgttctgagttta

SEQ ID NO: 7100761 - DNA, 22 bp, Homo sapiens
gggctgagctaagctgggttga

SEQ ID NO: 7100762 - DNA, 22 bp, Homo sapiens
gggctgagctgttctgagttta

SEQ ID NO: 7100763 - DNA, 22 bp, Homo sapiens
gggctgagctaagctgggttga

SEQ ID NO: 7100764 - DNA, 22 bp, Homo sapiens
gggctgaggaacatattttgtt

SEQ ID NO: 7100765 - DNA, 22 bp, Homo sapiens
gggctgaggctaccactggtct

SEQ ID NO: 7100766 - DNA, 22 bp, Homo sapiens
gggctgaggctaccactggtct

SEQ ID NO: 7100767 - DNA, 22 bp, Homo sapiens
gggcttggccccagaagagcta

SEQ ID NO: 7100768 - DNA, 22 bp, Homo sapiens
gggcttggccccagaagagcta

SEQ ID NO: 7100769 - DNA, 22 bp, Homo sapiens
gggcttggctcataagtggatg

SEQ ID NO: 7100770 - DNA, 22 bp, Homo sapiens
gggcttggctcataagtggatg

SEQ ID NO: 7100771 - DNA, 22 bp, Homo sapiens
gggcttggctggggccaccaga

SEQ ID NO: 7100772 - DNA, 22 bp, Homo sapiens
gggcttggctggggccaccaga

SEQ ID NO: 7100773 - DNA, 22 bp, Homo sapiens
gggcttgggtattgtgagaggt

SEQ ID NO: 7100774 - DNA, 22 bp, Homo sapiens
gggcttgggtattgtgagaggt

SEQ ID NO: 7100775 - DNA, 22 bp, Homo sapiens
gggcttgggtattgtgagaggt

SEQ ID NO: 7100776 - DNA, 22 bp, Homo sapiens
gggcttgggtattgtgagaggt

SEQ ID NO: 7100777 - DNA, 19 bp, Homo sapiens
gggcttggggctgaagcct

SEQ ID NO: 7100778 - DNA, 22 bp, Homo sapiens
gggcttgctgtttagttccatt

SEQ ID NO: 7100779 - DNA, 20 bp, Homo sapiens
gggcttggaggactcgaggg

SEQ ID NO: 7100780 - DNA, 20 bp, Homo sapiens
gggcttggaggactcgaggg

SEQ ID NO: 7100781 - DNA, 22 bp, Homo sapiens
gggcttggagtaggctgatgaa

SEQ ID NO: 7100782 - DNA, 22 bp, Homo sapiens
gggcttggagtaggctgatgaa

SEQ ID NO: 7100783 - DNA, 22 bp, Homo sapiens
gggcttggagtaggctgatgaa

SEQ ID NO: 7100784 - DNA, 22 bp, Homo sapiens
gggcttggagtaggctgatgaa

SEQ ID NO: 7100785 - DNA, 22 bp, Homo sapiens
gggcttggcacatgggctcagc

SEQ ID NO: 7100786 - DNA, 22 bp, Homo sapiens
gggctgctgccaccaggtggat

SEQ ID NO: 7100787 - DNA, 22 bp, Homo sapiens
gggctgctgcccaggaggcacc

SEQ ID NO: 7100788 - DNA, 22 bp, Homo sapiens
gggctgctgcccaggaggcacc

SEQ ID NO: 7100789 - DNA, 22 bp, Homo sapiens
gggctgctgcccaggaggcacc

SEQ ID NO: 7100790 - DNA, 22 bp, Homo sapiens
gggctgctgctgccagcgacac

SEQ ID NO: 7100791 - DNA, 22 bp, Homo sapiens
gggctgctgctgccagcgacac

SEQ ID NO: 7100792 - DNA, 22 bp, Homo sapiens
gggctgctgggcaagaaacatt

SEQ ID NO: 7100793 - DNA, 22 bp, Homo sapiens
gggctgctgtagagaacatgtt

SEQ ID NO: 7100794 - DNA, 22 bp, Homo sapiens
gggctgctgtagagaacatgtt

SEQ ID NO: 7100795 - DNA, 22 bp, Homo sapiens
gggctgctgtgttcctgaggca

SEQ ID NO: 7100796 - DNA, 22 bp, Homo sapiens
gggctgctgtgttcctgaggca

SEQ ID NO: 7100797 - DNA, 22 bp, Homo sapiens
gggctgctgtagagaacatgtt

SEQ ID NO: 7100798 - DNA, 22 bp, Homo sapiens
gggcttcttgcaggggcaacat

SEQ ID NO: 7100799 - DNA, 22 bp, Homo sapiens
gggcttgaggtgaaggtaggga

SEQ ID NO: 7100800 - DNA, 22 bp, Homo sapiens
gggcttgctaagaagagcgcat

SEQ ID NO: 7100801 - DNA, 22 bp, Homo sapiens
gggcttgctaagaagagcgcat

SEQ ID NO: 7100802 - DNA, 17 bp, Homo sapiens
gggcttgctgagtgtgt

SEQ ID NO: 7100803 - DNA, 22 bp, Homo sapiens
gggcttgctgatttgggcagga

SEQ ID NO: 7100804 - DNA, 22 bp, Homo sapiens
gggctgaggctaccactggtct

SEQ ID NO: 7100805 - DNA, 22 bp, Homo sapiens
gggctgagggccaattcctact

SEQ ID NO: 7100806 - DNA, 22 bp, Homo sapiens
gggctgagggccaattcctact

SEQ ID NO: 7100807 - DNA, 22 bp, Homo sapiens
gggctgagggccaattcctact

SEQ ID NO: 7100808 - DNA, 22 bp, Homo sapiens
gggctgagtgtcccaggccgaa

SEQ ID NO: 7100809 - DNA, 22 bp, Homo sapiens
gggctgagggccaattcctact

SEQ ID NO: 7100810 - DNA, 22 bp, Homo sapiens
gggctgagtgtcccaggccgaa

SEQ ID NO: 7100811 - DNA, 22 bp, Homo sapiens
gggctgagtgtcccaggccgaa

SEQ ID NO: 7100812 - DNA, 22 bp, Homo sapiens
gggctgagtgtcccaggccgaa

SEQ ID NO: 7100813 - DNA, 22 bp, Homo sapiens
gggctgagttcctgcctcactc

SEQ ID NO: 7100814 - DNA, 22 bp, Homo sapiens
gggctgagtgtcccaggccgaa

SEQ ID NO: 7100815 - DNA, 22 bp, Homo sapiens
gggctgagtgtcccaggccgaa

SEQ ID NO: 7100816 - DNA, 22 bp, Homo sapiens
gggctgagttcctgcctcactc

SEQ ID NO: 7100817 - DNA, 22 bp, Homo sapiens
gggctgagttcctgcctcactc

SEQ ID NO: 7100818 - DNA, 22 bp, Homo sapiens
gggctgcatcagcaggacccgg

SEQ ID NO: 7100819 - DNA, 22 bp, Homo sapiens
gggctgcacgtattctgctcac

SEQ ID NO: 7100820 - DNA, 22 bp, Homo sapiens
gggctgcactagggcaaggtga

SEQ ID NO: 7100821 - DNA, 22 bp, Homo sapiens
gggctgccaagcctgcctgcct

SEQ ID NO: 7100822 - DNA, 22 bp, Homo sapiens
gggctgccaagcctgcctgcct

SEQ ID NO: 7100823 - DNA, 22 bp, Homo sapiens
gggctgcacagatcttcaaggg

SEQ ID NO: 7100824 - DNA, 22 bp, Homo sapiens
gggctgattcgatgggggtaga

SEQ ID NO: 7100825 - DNA, 22 bp, Homo sapiens
gggctgcacgtattctgctcac

SEQ ID NO: 7100826 - DNA, 22 bp, Homo sapiens
gggctgcacgtattctgctcac

SEQ ID NO: 7100827 - DNA, 22 bp, Homo sapiens
gggctgccaagcctgcctgcct

SEQ ID NO: 7100828 - DNA, 22 bp, Homo sapiens
gggctgcctgagcatctcctcc

SEQ ID NO: 7100829 - DNA, 22 bp, Homo sapiens
gggctgcctgagcatctcctcc

SEQ ID NO: 7100830 - DNA, 22 bp, Homo sapiens
gggctgcctttcttctgggagc

SEQ ID NO: 7100831 - DNA, 22 bp, Homo sapiens
gggctgccttttaattcttccc

SEQ ID NO: 7100832 - DNA, 22 bp, Homo sapiens
gggctgcgtgtggaggatgtaa

SEQ ID NO: 7100833 - DNA, 22 bp, Homo sapiens
gggctgctacgagaactgaata

SEQ ID NO: 7100834 - DNA, 23 bp, Homo sapiens
gggctgctccaggccaaggctgg

SEQ ID NO: 7100835 - DNA, 23 bp, Homo sapiens
gggctgctccaggccaaggctgg

SEQ ID NO: 7100836 - DNA, 23 bp, Homo sapiens
gggctgctccaggccaaggctgg

SEQ ID NO: 7100837 - DNA, 22 bp, Homo sapiens
gggctgctgccaatcacagcct

SEQ ID NO: 7100838 - DNA, 22 bp, Homo sapiens
ggtcagaagtgcaaaatcagtt

SEQ ID NO: 7100839 - DNA, 22 bp, Homo sapiens
ggtcagaattaggtctagagta

SEQ ID NO: 7100840 - DNA, 22 bp, Homo sapiens
ggtcagaacaagcaaataatag

SEQ ID NO: 7100841 - DNA, 22 bp, Homo sapiens
ggtcagaacaagggtaaataaa

SEQ ID NO: 7100842 - DNA, 22 bp, Homo sapiens
ggtcagaaggcagttaaacaaa

SEQ ID NO: 7100843 - DNA, 22 bp, Homo sapiens
ggtcagagaaaagtagggtgtt

SEQ ID NO: 7100844 - DNA, 22 bp, Homo sapiens
ggtcagagaaagtggtagtaga

SEQ ID NO: 7100845 - DNA, 19 bp, Homo sapiens
ggtcagagagatccaggct

SEQ ID NO: 7100846 - DNA, 22 bp, Homo sapiens
ggtcagagccatggagcaactg

SEQ ID NO: 7100847 - DNA, 22 bp, Homo sapiens
ggtcagagccgttagcattcag

SEQ ID NO: 7100848 - DNA, 19 bp, Homo sapiens
ggtcacaggggttacaagg

SEQ ID NO: 7100849 - DNA, 22 bp, Homo sapiens
ggtaggggcagggccaagctgt

SEQ ID NO: 7100850 - DNA, 22 bp, Homo sapiens
ggtagtcatggatagctatgag

SEQ ID NO: 7100851 - DNA, 22 bp, Homo sapiens
ggtcacgtgacggttacgactg

SEQ ID NO: 7100852 - DNA, 22 bp, Homo sapiens
ggtcactgagctgtaattctgt

SEQ ID NO: 7100853 - DNA, 22 bp, Homo sapiens
ggtcactgcaggtttaacagag

SEQ ID NO: 7100854 - DNA, 22 bp, Homo sapiens
ggtcactggtctctgcttccat

SEQ ID NO: 7100855 - DNA, 20 bp, Homo sapiens
ggtcactgtggctgcaggat

SEQ ID NO: 7100856 - DNA, 22 bp, Homo sapiens
gggtggccttcatagctcaggg

SEQ ID NO: 7100857 - DNA, 22 bp, Homo sapiens
gggtggccttcatagctcaggg

SEQ ID NO: 7100858 - DNA, 22 bp, Homo sapiens
gggtggctaggtatcccccatt

SEQ ID NO: 7100859 - DNA, 22 bp, Homo sapiens
gggtggctcctatgggcatagc

SEQ ID NO: 7100860 - DNA, 22 bp, Homo sapiens
gggtggctcctatgggcatagc

SEQ ID NO: 7100861 - DNA, 22 bp, Homo sapiens
gggtggctgagaacaggacccc

SEQ ID NO: 7100862 - DNA, 22 bp, Homo sapiens
ggtagggcaaagtagggcacct

SEQ ID NO: 7100863 - DNA, 22 bp, Homo sapiens
ggtaggggaagacaagtgaaaa

SEQ ID NO: 7100864 - DNA, 22 bp, Homo sapiens
ggtaggggaagacaagtgaaaa

SEQ ID NO: 7100865 - DNA, 22 bp, Homo sapiens
ggtaggggaagacaagtgaaaa

SEQ ID NO: 7100866 - DNA, 22 bp, Homo sapiens
ggtaggggcagggccaagctgt

SEQ ID NO: 7100867 - DNA, 22 bp, Homo sapiens
gggtggcatagggtgatggctt

SEQ ID NO: 7100868 - DNA, 22 bp, Homo sapiens
gggtggcatagggtgatggctt

SEQ ID NO: 7100869 - DNA, 22 bp, Homo sapiens
gggtggcatagggtgatggctt

SEQ ID NO: 7100870 - DNA, 22 bp, Homo sapiens
gggtggcatagggtgatggctt

SEQ ID NO: 7100871 - DNA, 22 bp, Homo sapiens
gggtggcatagggtgatggctt

SEQ ID NO: 7100872 - DNA, 22 bp, Homo sapiens
gggtggcatctctctgagctgt

SEQ ID NO: 7100873 - DNA, 21 bp, Homo sapiens
gggtggccgcatgggtgcgtg

SEQ ID NO: 7100874 - DNA, 21 bp, Homo sapiens
gggtggccgcatgggtgcgtg

SEQ ID NO: 7100875 - DNA, 21 bp, Homo sapiens
gggtggccgcatgggtgcgtg

SEQ ID NO: 7100876 - DNA, 22 bp, Homo sapiens
gggtggccttaggcaagtcact

SEQ ID NO: 7100877 - DNA, 22 bp, Homo sapiens
gggtggccttaggcaagtcact

SEQ ID NO: 7100878 - DNA, 22 bp, Homo sapiens
gggtggccttcatagctcaggg

SEQ ID NO: 7100879 - DNA, 22 bp, Homo sapiens
gggtggccttcatagctcaggg

SEQ ID NO: 7100880 - DNA, 22 bp, Homo sapiens
gggtggccttcatagctcaggg

SEQ ID NO: 7100881 - DNA, 22 bp, Homo sapiens
gggtggcacaggtgcagagggt

SEQ ID NO: 7100882 - DNA, 22 bp, Homo sapiens
gggtggcacaggtgcagagggt

SEQ ID NO: 7100883 - DNA, 22 bp, Homo sapiens
gggtggcacaggtgcagagggt

SEQ ID NO: 7100884 - DNA, 22 bp, Homo sapiens
gggtggcacaggtgcagagggt

SEQ ID NO: 7100885 - DNA, 22 bp, Homo sapiens
gggtggcacaggtgcagagggt

SEQ ID NO: 7100886 - DNA, 22 bp, Homo sapiens
gggtggcacaggtgcagagggt

SEQ ID NO: 7100887 - DNA, 20 bp, Homo sapiens
gggtggagttgcggtctgtg

SEQ ID NO: 7100888 - DNA, 20 bp, Homo sapiens
gggtggagttgcggtctgtg

SEQ ID NO: 7100889 - DNA, 22 bp, Homo sapiens
gggtggcaaaggcgctgaaagg

SEQ ID NO: 7100890 - DNA, 22 bp, Homo sapiens
gggtggcaaaggcgctgaaagg

SEQ ID NO: 7100891 - DNA, 20 bp, Homo sapiens
gggtggagttgcggtctgtg

SEQ ID NO: 7100892 - DNA, 22 bp, Homo sapiens
gggtggcaggattggcaggagt

SEQ ID NO: 7100893 - DNA, 22 bp, Homo sapiens
gggtggcaggattggcaggagt

SEQ ID NO: 7100894 - DNA, 22 bp, Homo sapiens
gggtggcaggattggcaggagt

SEQ ID NO: 7100895 - DNA, 22 bp, Homo sapiens
gggtggcagctgttgccaaggt

SEQ ID NO: 7100896 - DNA, 22 bp, Homo sapiens
gggtggcaggattggcaggagt

SEQ ID NO: 7100897 - DNA, 22 bp, Homo sapiens
gggtggcaggattggcaggagt

SEQ ID NO: 7100898 - DNA, 22 bp, Homo sapiens
gggtggcacaggtgcagagggt

SEQ ID NO: 7100899 - DNA, 22 bp, Homo sapiens
gggtggcacaggtgcagagggt

SEQ ID NO: 7100900 - DNA, 22 bp, Homo sapiens
gggtggcacaggtgcagagggt

SEQ ID NO: 7100901 - DNA, 22 bp, Homo sapiens
gggtggcactgataatgagacg

SEQ ID NO: 7100902 - DNA, 22 bp, Homo sapiens
gggtggcagctgttgccaaggt

SEQ ID NO: 7100903 - DNA, 22 bp, Homo sapiens
gggtggcagctgttgccaaggt

SEQ ID NO: 7100904 - DNA, 22 bp, Homo sapiens
ggtcgggcactctccagggctg

SEQ ID NO: 7100905 - DNA, 22 bp, Homo sapiens
ggtcgctgtgtaggttcagcta

SEQ ID NO: 7100906 - DNA, 22 bp, Homo sapiens
ggtcgccagccctagtctgctg

SEQ ID NO: 7100907 - DNA, 22 bp, Homo sapiens
ggtcgctgagctagcatctgca

SEQ ID NO: 7100908 - DNA, 22 bp, Homo sapiens
ggtcgctgtgtaggttcagcta

SEQ ID NO: 7100909 - DNA, 20 bp, Homo sapiens
ggtccttgtcacaaggagag

SEQ ID NO: 7100910 - DNA, 22 bp, Homo sapiens
ggtcgagtcacttgttgccttt

SEQ ID NO: 7100911 - DNA, 22 bp, Homo sapiens
ggtcggggatggccaggctccc

SEQ ID NO: 7100912 - DNA, 22 bp, Homo sapiens
ggtcggggatggccaggctccc

SEQ ID NO: 7100913 - DNA, 22 bp, Homo sapiens
ggtctagacgaattcctatcag

SEQ ID NO: 7100914 - DNA, 22 bp, Homo sapiens
ggtctagagcttgattggcagc

SEQ ID NO: 7100915 - DNA, 22 bp, Homo sapiens
ggtctagaggatgttcctttcc

SEQ ID NO: 7100916 - DNA, 22 bp, Homo sapiens
ggtctagagtggggcctggaaa

SEQ ID NO: 7100917 - DNA, 22 bp, Homo sapiens
ggtctagagtggggcctggaaa

SEQ ID NO: 7100918 - DNA, 22 bp, Homo sapiens
ggtctagatcaagaacagaact

SEQ ID NO: 7100919 - DNA, 22 bp, Homo sapiens
ggtctagatgaaattaaatgtt

SEQ ID NO: 7100920 - DNA, 22 bp, Homo sapiens
ggtctagatttctgttataggg

SEQ ID NO: 7100921 - DNA, 22 bp, Homo sapiens
ggtctaggtgtaattgtttact

SEQ ID NO: 7100922 - DNA, 22 bp, Homo sapiens
ggtctcagactggcaggcagtg

SEQ ID NO: 7100923 - DNA, 22 bp, Homo sapiens
ggtccctggttccctctgagct

SEQ ID NO: 7100924 - DNA, 22 bp, Homo sapiens
ggtccctggttccctctgagct

SEQ ID NO: 7100925 - DNA, 18 bp, Homo sapiens
ggtcctgggcctggctca

SEQ ID NO: 7100926 - DNA, 22 bp, Homo sapiens
ggtccttctgtaggggtcccct

SEQ ID NO: 7100927 - DNA, 22 bp, Homo sapiens
ggtccttgcttcggtccagtac

SEQ ID NO: 7100928 - DNA, 22 bp, Homo sapiens
ggtccttggcgaatcattccag

SEQ ID NO: 7100929 - DNA, 22 bp, Homo sapiens
ggtccttggcgaatcattccag

SEQ ID NO: 7100930 - DNA, 22 bp, Homo sapiens
ggtccctggggaactaggctgt

SEQ ID NO: 7100931 - DNA, 22 bp, Homo sapiens
ggtcagcagtgcagggcagagc

SEQ ID NO: 7100932 - DNA, 22 bp, Homo sapiens
ggtcagcaggtccagccagtgc

SEQ ID NO: 7100933 - DNA, 22 bp, Homo sapiens
ggtcagaggtcacaagctggca

SEQ ID NO: 7100934 - DNA, 22 bp, Homo sapiens
ggtcagaggtcacaagctggca

SEQ ID NO: 7100935 - DNA, 22 bp, Homo sapiens
ggtctcaggagactggagagca

SEQ ID NO: 7100936 - DNA, 22 bp, Homo sapiens
ggtctcagtgaaggagtgtgct

SEQ ID NO: 7100937 - DNA, 19 bp, Homo sapiens
ggtctcagtgcagctgcag

SEQ ID NO: 7100938 - DNA, 22 bp, Homo sapiens
ggtctcatctttcagcgtcgag

SEQ ID NO: 7100939 - DNA, 22 bp, Homo sapiens
ggtctcatgtcctatgtgctta

SEQ ID NO: 7100940 - DNA, 22 bp, Homo sapiens
ggtctccaaagctgcattgatg

SEQ ID NO: 7100941 - DNA, 22 bp, Homo sapiens
ggtctccaaagcttaggactac

SEQ ID NO: 7100942 - DNA, 22 bp, Homo sapiens
ggtctccagctgggaccctgca

SEQ ID NO: 7100943 - DNA, 22 bp, Homo sapiens
ggtctctgacttagagatggat

SEQ ID NO: 7100944 - DNA, 22 bp, Homo sapiens
ggtctctgagtgaggacctggg

SEQ ID NO: 7100945 - DNA, 22 bp, Homo sapiens
ggtctctgcagctcccggcccc

SEQ ID NO: 7100946 - DNA, 22 bp, Homo sapiens
ggtctctgctcagatgccactt

SEQ ID NO: 7100947 - DNA, 22 bp, Homo sapiens
ggtctctggccttggagattga

SEQ ID NO: 7100948 - DNA, 22 bp, Homo sapiens
ggtctctgtcactgagtggccc

SEQ ID NO: 7100949 - DNA, 22 bp, Homo sapiens
ggtctcctgggttgaccagctg

SEQ ID NO: 7100950 - DNA, 22 bp, Homo sapiens
ggtctcctgggttgaccagctg

SEQ ID NO: 7100951 - DNA, 22 bp, Homo sapiens
ggtctccttgggaaagcaggaa

SEQ ID NO: 7100952 - DNA, 22 bp, Homo sapiens
ggtctccttgggaaagcaggaa

SEQ ID NO: 7100953 - DNA, 22 bp, Homo sapiens
ggtctcctgacctttagtccct

SEQ ID NO: 7100954 - DNA, 22 bp, Homo sapiens
ggtctcctgaggctgccacacc

SEQ ID NO: 7100955 - DNA, 22 bp, Homo sapiens
ggtctcctgacctttagtccct

SEQ ID NO: 7100956 - DNA, 22 bp, Homo sapiens
ggtctcctgaggctgccacacc

SEQ ID NO: 7100957 - DNA, 22 bp, Homo sapiens
ggtctccagctgggaccctgca

SEQ ID NO: 7100958 - DNA, 22 bp, Homo sapiens
ggtctccattccttcatctcac

SEQ ID NO: 7100959 - DNA, 22 bp, Homo sapiens
ggtgtggatcatctgaggtcag

SEQ ID NO: 7100960 - DNA, 22 bp, Homo sapiens
ggtgtggatcatctgaggtcag

SEQ ID NO: 7100961 - DNA, 22 bp, Homo sapiens
ggtgtggatcatctgaggtcag

SEQ ID NO: 7100962 - DNA, 22 bp, Homo sapiens
ggtgtggcagtggacctgtgaa

SEQ ID NO: 7100963 - DNA, 22 bp, Homo sapiens
ggtgtggcagtggacctgtgaa

SEQ ID NO: 7100964 - DNA, 22 bp, Homo sapiens
ggtgtgggaactacaggttttt

SEQ ID NO: 7100965 - DNA, 22 bp, Homo sapiens
ggtgtgggaactacaggttttt

SEQ ID NO: 7100966 - DNA, 22 bp, Homo sapiens
ggtgtgggccctgatgtcagca

SEQ ID NO: 7100967 - DNA, 22 bp, Homo sapiens
ggtgtgggccctgatgtcagca

SEQ ID NO: 7100968 - DNA, 22 bp, Homo sapiens
ggtgtgggccctgatgtcagca

SEQ ID NO: 7100969 - DNA, 22 bp, Homo sapiens
ggtgtgggagagattctttcct

SEQ ID NO: 7100970 - DNA, 22 bp, Homo sapiens
ggtgtgggaactacaggttttt

SEQ ID NO: 7100971 - DNA, 21 bp, Homo sapiens
ggtgtgggatggactgaacca

SEQ ID NO: 7100972 - DNA, 22 bp, Homo sapiens
ggtgtgggcagatgccctactt

SEQ ID NO: 7100973 - DNA, 22 bp, Homo sapiens
ggtgtgggccctgatgtcagca

SEQ ID NO: 7100974 - DNA, 22 bp, Homo sapiens
ggtgtgggccctgatgtcagca

SEQ ID NO: 7100975 - DNA, 22 bp, Homo sapiens
ggtgtggggaggttctgcttct

SEQ ID NO: 7100976 - DNA, 22 bp, Homo sapiens
ggtgtggggaggttctgcttct

SEQ ID NO: 7100977 - DNA, 22 bp, Homo sapiens
ggtgtgggggcaagtttgagat

SEQ ID NO: 7100978 - DNA, 22 bp, Homo sapiens
ggtgtgggggcaagtttgagat

SEQ ID NO: 7100979 - DNA, 22 bp, Homo sapiens
ggtgtgggggcagctctgatat

SEQ ID NO: 7100980 - DNA, 22 bp, Homo sapiens
ggtgtgggtccttgtgcttgct

SEQ ID NO: 7100981 - DNA, 22 bp, Homo sapiens
ggtgtgggtccttgtgcttgct

SEQ ID NO: 7100982 - DNA, 22 bp, Homo sapiens
ggtgtgggtccttgtgcttgct

SEQ ID NO: 7100983 - DNA, 22 bp, Homo sapiens
ggtgtgggtccttgtgcttgct

SEQ ID NO: 7100984 - DNA, 22 bp, Homo sapiens
ggtgtgggtccttgtgcttgct

SEQ ID NO: 7100985 - DNA, 22 bp, Homo sapiens
ggtgtggtttgaagggagatgg

SEQ ID NO: 7100986 - DNA, 22 bp, Homo sapiens
ggtggctcggccagtgcaggcc

SEQ ID NO: 7100987 - DNA, 22 bp, Homo sapiens
ggtggctcggccagtgcaggcc

SEQ ID NO: 7100988 - DNA, 22 bp, Homo sapiens
ggtggctcggccagtgcaggcc

SEQ ID NO: 7100989 - DNA, 17 bp, Homo sapiens
ggtggctcgggcgcggc

SEQ ID NO: 7100990 - DNA, 17 bp, Homo sapiens
ggtggctcgggcgcggc

SEQ ID NO: 7100991 - DNA, 17 bp, Homo sapiens
ggtggctcgggcgcggc

SEQ ID NO: 7100992 - DNA, 22 bp, Homo sapiens
ggtggctctcaggcttctcgga

SEQ ID NO: 7100993 - DNA, 22 bp, Homo sapiens
ggtggctctcaggcttctcgga

SEQ ID NO: 7100994 - DNA, 22 bp, Homo sapiens
ggtggctctcaggcttctcgga

SEQ ID NO: 7100995 - DNA, 19 bp, Homo sapiens
ggtggctctccctcaggga

SEQ ID NO: 7100996 - DNA, 19 bp, Homo sapiens
ggtggctctccctcaggga

SEQ ID NO: 7100997 - DNA, 19 bp, Homo sapiens
ggtggctctccctcaggga

SEQ ID NO: 7100998 - DNA, 19 bp, Homo sapiens
ggtggctctccctcaggga

SEQ ID NO: 7100999 - DNA, 22 bp, Homo sapiens
ggtggctctccctggactcagc

SEQ ID NO: 7101000 - DNA, 22 bp, Homo sapiens
ggtggctctccctggactcagc

SEQ ID NO: 7101001 - DNA, 22 bp, Homo sapiens
ggtggctctctgtcagtgacag

SEQ ID NO: 7101002 - DNA, 22 bp, Homo sapiens
ggtggctctcttaagggcagcg

SEQ ID NO: 7101003 - DNA, 22 bp, Homo sapiens
ggtggctctcttaagggcagcg

SEQ ID NO: 7101004 - DNA, 22 bp, Homo sapiens
ggtggctctcttaagggcagcg

SEQ ID NO: 7101005 - DNA, 22 bp, Homo sapiens
ggtgtccttagaaagcagacct

SEQ ID NO: 7101006 - DNA, 22 bp, Homo sapiens
ggtgtccttcgtccgctggcat

SEQ ID NO: 7101007 - DNA, 22 bp, Homo sapiens
ggtgtccttgcagaaggcggcg

SEQ ID NO: 7101008 - DNA, 22 bp, Homo sapiens
ggtgtccttgctccttcagctt

SEQ ID NO: 7101009 - DNA, 22 bp, Homo sapiens
ggtgtgtgtggattagcatgcc

SEQ ID NO: 7101010 - DNA, 20 bp, Homo sapiens
ggtgtgttggttcagcatgg

SEQ ID NO: 7101011 - DNA, 20 bp, Homo sapiens
ggtgtgttggttcagcatgg

SEQ ID NO: 7101012 - DNA, 20 bp, Homo sapiens
ggtgtgttggttcagcatgg

SEQ ID NO: 7101013 - DNA, 22 bp, Homo sapiens
ggtgtgtggttttgatacagtc

SEQ ID NO: 7101014 - DNA, 22 bp, Homo sapiens
ggtgtgtgtggattagcatgcc

SEQ ID NO: 7101015 - DNA, 22 bp, Homo sapiens
ggtgtgtgtggattagcatgcc

SEQ ID NO: 7101016 - DNA, 22 bp, Homo sapiens
ggtgtgtgtggattagcatgcc

SEQ ID NO: 7101017 - DNA, 22 bp, Homo sapiens
ggtgtgtgtggattagcatgcc

SEQ ID NO: 7101018 - DNA, 22 bp, Homo sapiens
ggtgtgtggtcctctcacttag

SEQ ID NO: 7101019 - DNA, 22 bp, Homo sapiens
ggtgtgtggtcctctcacttag

SEQ ID NO: 7101020 - DNA, 22 bp, Homo sapiens
ggtgtgtggtcctctcacttag

SEQ ID NO: 7101021 - DNA, 22 bp, Homo sapiens
ggtgtgtggttttgatacagtc

SEQ ID NO: 7101022 - DNA, 22 bp, Homo sapiens
ggtgtgtggttttgatacagtc

SEQ ID NO: 7101023 - DNA, 22 bp, Homo sapiens
ggtgtgtggttttgatacagtc

SEQ ID NO: 7101024 - DNA, 19 bp, Homo sapiens
ggtgtgtgctggggcctgt

SEQ ID NO: 7101025 - DNA, 19 bp, Homo sapiens
ggtgtgtgctggggcctgt

SEQ ID NO: 7101026 - DNA, 19 bp, Homo sapiens
ggtgtgtgctggggcctgt

SEQ ID NO: 7101027 - DNA, 19 bp, Homo sapiens
ggtgtgtgctggggcctgt

SEQ ID NO: 7101028 - DNA, 19 bp, Homo sapiens
ggtgtgtgctggggcctgt

SEQ ID NO: 7101029 - DNA, 19 bp, Homo sapiens
ggtgtgtgctggggcctgt

SEQ ID NO: 7101030 - DNA, 19 bp, Homo sapiens
ggtgtgtgctggggcctgt

SEQ ID NO: 7101031 - DNA, 22 bp, Homo sapiens
ggtgtgtgaggagtcacttagt

SEQ ID NO: 7101032 - DNA, 22 bp, Homo sapiens
ggtgtgtgaggagtcacttagt

SEQ ID NO: 7101033 - DNA, 22 bp, Homo sapiens
ggtgtgtgaggagtcacttagt

SEQ ID NO: 7101034 - DNA, 22 bp, Homo sapiens
ggtgtgtgaggagtcacttagt

SEQ ID NO: 7101035 - DNA, 22 bp, Homo sapiens
ggtgtgtctgccaggaactgca

SEQ ID NO: 7101036 - DNA, 22 bp, Homo sapiens
ggtgttggaacatggtgagatt

SEQ ID NO: 7101037 - DNA, 22 bp, Homo sapiens
ggtgttgcagttgaagactggt

SEQ ID NO: 7101038 - DNA, 22 bp, Homo sapiens
ggtgttggaacatggtgagatt

SEQ ID NO: 7101039 - DNA, 22 bp, Homo sapiens
ggtgttggaacatggtgagatt

SEQ ID NO: 7101040 - DNA, 22 bp, Homo sapiens
ggtgttgggagagctggttttg

SEQ ID NO: 7101041 - DNA, 22 bp, Homo sapiens
ggtgttgggagagctggttttg

SEQ ID NO: 7101042 - DNA, 22 bp, Homo sapiens
ggtgttgggctcactggtcctt

SEQ ID NO: 7101043 - DNA, 22 bp, Homo sapiens
ggtgttgggctcactggtcctt

SEQ ID NO: 7101044 - DNA, 22 bp, Homo sapiens
ggtgttggtctacaccagcact

SEQ ID NO: 7101045 - DNA, 22 bp, Homo sapiens
ggtgttgtacattctgtggatt

SEQ ID NO: 7101046 - DNA, 22 bp, Homo sapiens
ggtgttgtacattctgtggatt

SEQ ID NO: 7101047 - DNA, 22 bp, Homo sapiens
ggtgtttaaaggctcagcagga

SEQ ID NO: 7101048 - DNA, 22 bp, Homo sapiens
ggtttaattacctgcatctcaa

SEQ ID NO: 7101049 - DNA, 22 bp, Homo sapiens
ggtttaattggtccaggatggg

SEQ ID NO: 7101050 - DNA, 22 bp, Homo sapiens
ggtttactcgtagtggcggttt

SEQ ID NO: 7101051 - DNA, 22 bp, Homo sapiens
ggtttattaatgtgaactgtat

SEQ ID NO: 7101052 - DNA, 22 bp, Homo sapiens
ggtttattaatgtgaactgtat

SEQ ID NO: 7101053 - DNA, 22 bp, Homo sapiens
ggtttattgaaggccaccccac

SEQ ID NO: 7101054 - DNA, 22 bp, Homo sapiens
ggtttattgaaggccaccccac

SEQ ID NO: 7101055 - DNA, 22 bp, Homo sapiens
ggtttattgttaataagtttga

SEQ ID NO: 7101056 - DNA, 22 bp, Homo sapiens
ggtttattgttaataagtttga

SEQ ID NO: 7101057 - DNA, 22 bp, Homo sapiens
ggtctgagagccactgaatccc

SEQ ID NO: 7101058 - DNA, 22 bp, Homo sapiens
ggtctggaataaggtccaggaa

SEQ ID NO: 7101059 - DNA, 22 bp, Homo sapiens
ggtctggaatggagtaggggtg

SEQ ID NO: 7101060 - DNA, 23 bp, Homo sapiens
ggtctggaattcgcggagttaac

SEQ ID NO: 7101061 - DNA, 22 bp, Homo sapiens
ggtctggacagaatgtgacact

SEQ ID NO: 7101062 - DNA, 22 bp, Homo sapiens
ggtctggaccatggacgccggg

SEQ ID NO: 7101063 - DNA, 22 bp, Homo sapiens
ggtctggaccatggacgccggg

SEQ ID NO: 7101064 - DNA, 22 bp, Homo sapiens
ggtctggaccctcctggagtgg

SEQ ID NO: 7101065 - DNA, 22 bp, Homo sapiens
ggtctggaccctcctggagtgg

SEQ ID NO: 7101066 - DNA, 22 bp, Homo sapiens
ggtctggaccctcctggagtgg

SEQ ID NO: 7101067 - DNA, 22 bp, Homo sapiens
ggtctggagctaatcttgttgg

SEQ ID NO: 7101068 - DNA, 22 bp, Homo sapiens
ggtctggagcttggctaaggga

SEQ ID NO: 7101069 - DNA, 22 bp, Homo sapiens
ggtctctgtttggggctggcaa

SEQ ID NO: 7101070 - DNA, 22 bp, Homo sapiens
ggtctcttcaggagcttgagcg

SEQ ID NO: 7101071 - DNA, 22 bp, Homo sapiens
ggtctcttcaggagcttgagcg

SEQ ID NO: 7101072 - DNA, 22 bp, Homo sapiens
ggtctctttgcttcagctacag

SEQ ID NO: 7101073 - DNA, 22 bp, Homo sapiens
ggtggcctagaggttaaagtag

SEQ ID NO: 7101074 - DNA, 22 bp, Homo sapiens
ggtggcctagggcccagcctgt

SEQ ID NO: 7101075 - DNA, 22 bp, Homo sapiens
ggtggcctcagcaaggctggca

SEQ ID NO: 7101076 - DNA, 20 bp, Homo sapiens
ggtggccgtagcgggcggcg

SEQ ID NO: 7101077 - DNA, 20 bp, Homo sapiens
ggtggccgtagcgggcggcg

SEQ ID NO: 7101078 - DNA, 22 bp, Homo sapiens
ggtggcctagaagataagggga

SEQ ID NO: 7101079 - DNA, 22 bp, Homo sapiens
ggtctggattttgaacaaaatt

SEQ ID NO: 7101080 - DNA, 22 bp, Homo sapiens
ggtctggattttgaacaaaatt

SEQ ID NO: 7101081 - DNA, 22 bp, Homo sapiens
ggtctggcctccgggcaggtgg

SEQ ID NO: 7101082 - DNA, 22 bp, Homo sapiens
ggtctggagcttggctaaggga

SEQ ID NO: 7101083 - DNA, 16 bp, Homo sapiens
ggtctggaggatgtct

SEQ ID NO: 7101084 - DNA, 22 bp, Homo sapiens
ggtctggagtagatgagtcatg

SEQ ID NO: 7101085 - DNA, 22 bp, Homo sapiens
ggtctggagtagatgagtcatg

SEQ ID NO: 7101086 - DNA, 22 bp, Homo sapiens
ggtctggagtagatgagtcatg

SEQ ID NO: 7101087 - DNA, 22 bp, Homo sapiens
ggtctggagtaggatgatggct

SEQ ID NO: 7101088 - DNA, 22 bp, Homo sapiens
ggtctggagtaggatgatggct

SEQ ID NO: 7101089 - DNA, 22 bp, Homo sapiens
ggtctggataattccagtacct

SEQ ID NO: 7101090 - DNA, 22 bp, Homo sapiens
ggtctggataattccagtacct

SEQ ID NO: 7101091 - DNA, 22 bp, Homo sapiens
ggtctggataattccagtacct

SEQ ID NO: 7101092 - DNA, 22 bp, Homo sapiens
ggtctggataattccagtacct

SEQ ID NO: 7101093 - DNA, 22 bp, Homo sapiens
ggtctggatattcaccagggcc

SEQ ID NO: 7101094 - DNA, 22 bp, Homo sapiens
ggtctggatgctgaggttccca

SEQ ID NO: 7101095 - DNA, 22 bp, Homo sapiens
ggtctggatttctgcttctttc

SEQ ID NO: 7101096 - DNA, 22 bp, Homo sapiens
ggtctggattttatctactgta

SEQ ID NO: 7101097 - DNA, 22 bp, Homo sapiens
ggtggctcaaagagagcacaga

SEQ ID NO: 7101098 - DNA, 18 bp, Homo sapiens
ggtggcggggatggaggt

SEQ ID NO: 7101099 - DNA, 18 bp, Homo sapiens
ggtggcggggatggaggt

SEQ ID NO: 7101100 - DNA, 22 bp, Homo sapiens
ggtggctcaaagagagcacaga

SEQ ID NO: 7101101 - DNA, 21 bp, Homo sapiens
ggtggctcacctgattggata

SEQ ID NO: 7101102 - DNA, 19 bp, Homo sapiens
ggtggctcagggcccagcc

SEQ ID NO: 7101103 - DNA, 19 bp, Homo sapiens
ggtggctcagggcccagcc

SEQ ID NO: 7101104 - DNA, 22 bp, Homo sapiens
ggtggctcagggctccaagcat

SEQ ID NO: 7101105 - DNA, 18 bp, Homo sapiens
ggtggctcagtcatgggg

SEQ ID NO: 7101106 - DNA, 18 bp, Homo sapiens
ggtggctcagtcatgggg

SEQ ID NO: 7101107 - DNA, 18 bp, Homo sapiens
ggtggctcagtcatgggg

SEQ ID NO: 7101108 - DNA, 22 bp, Homo sapiens
ggtggctcagtgtcaggccctg

SEQ ID NO: 7101109 - DNA, 22 bp, Homo sapiens
ggtggctcagtgtcaggccctg

SEQ ID NO: 7101110 - DNA, 22 bp, Homo sapiens
ggtggctcatttgatcttcata

SEQ ID NO: 7101111 - DNA, 22 bp, Homo sapiens
ggtggctccgcttccatgggct

SEQ ID NO: 7101112 - DNA, 22 bp, Homo sapiens
ggtggctccgcttccatgggct

SEQ ID NO: 7101113 - DNA, 22 bp, Homo sapiens
ggtggcctgttttcaggtttgc

SEQ ID NO: 7101114 - DNA, 18 bp, Homo sapiens
ggtggccttgacttctct

SEQ ID NO: 7101115 - DNA, 22 bp, Homo sapiens
ggtggccttggacaagtaacct

SEQ ID NO: 7101116 - DNA, 22 bp, Homo sapiens
ggtggcctgccctgatccctgg

SEQ ID NO: 7101117 - DNA, 22 bp, Homo sapiens
ggtggcctggctctcaccttgg

SEQ ID NO: 7101118 - DNA, 21 bp, Homo sapiens
ggtggccttggtgagagacct

SEQ ID NO: 7101119 - DNA, 22 bp, Homo sapiens
ggtggcctttcagtggatcagg

SEQ ID NO: 7101120 - DNA, 22 bp, Homo sapiens
ggtggccttttatgagcagggt

SEQ ID NO: 7101121 - DNA, 22 bp, Homo sapiens
ggtggccttttatgagcagggt

SEQ ID NO: 7101122 - DNA, 22 bp, Homo sapiens
ggtggcctgaattagctcaggg

SEQ ID NO: 7101123 - DNA, 22 bp, Homo sapiens
ggtggcctgaattagctcaggg

SEQ ID NO: 7101124 - DNA, 22 bp, Homo sapiens
ggtggcctgcaagtgcagatgg

SEQ ID NO: 7101125 - DNA, 17 bp, Homo sapiens
ggtggcctgcagtggct

SEQ ID NO: 7101126 - DNA, 17 bp, Homo sapiens
ggtggcctgcagtggct

SEQ ID NO: 7101127 - DNA, 17 bp, Homo sapiens
ggtggcctgcagtggct

SEQ ID NO: 7101128 - DNA, 17 bp, Homo sapiens
ggtggcctgcagtggct

SEQ ID NO: 7101129 - DNA, 22 bp, Homo sapiens
ggtggcctgccctgatccctgg

SEQ ID NO: 7101130 - DNA, 22 bp, Homo sapiens
ggtggcctcagcaaggctggca

SEQ ID NO: 7101131 - DNA, 22 bp, Homo sapiens
ggtggcctccagggcataggtg

SEQ ID NO: 7101132 - DNA, 22 bp, Homo sapiens
ggtggcctccagggcataggtg

SEQ ID NO: 7101133 - DNA, 22 bp, Homo sapiens
ggtggcctcgccgcggctctgc

SEQ ID NO: 7101134 - DNA, 22 bp, Homo sapiens
ggtggcctcgccgcggctctgc

SEQ ID NO: 7101135 - DNA, 22 bp, Homo sapiens
ggtggcctcggtggtgcacagg

SEQ ID NO: 7101136 - DNA, 22 bp, Homo sapiens
ggtggcctcggtggtgcacagg

SEQ ID NO: 7101137 - DNA, 22 bp, Homo sapiens
ggtggcctctcatgcaaggtag

SEQ ID NO: 7101138 - DNA, 22 bp, Homo sapiens
ggtggcctctcatgcaaggtag

SEQ ID NO: 7101139 - DNA, 22 bp, Homo sapiens
ggtggcctctgcaggcctcgac

SEQ ID NO: 7101140 - DNA, 22 bp, Homo sapiens
ggtggcctcttgtttagccagc

SEQ ID NO: 7101141 - DNA, 22 bp, Homo sapiens
ggtggcctgaattagctcaggg

SEQ ID NO: 7101142 - DNA, 22 bp, Homo sapiens
ggtggcctgaattagctcaggg

SEQ ID NO: 7101143 - DNA, 22 bp, Homo sapiens
ggtggcctgaattagctcaggg

SEQ ID NO: 7101144 - DNA, 22 bp, Homo sapiens
gggagagagaaaacgtggcgca

SEQ ID NO: 7101145 - DNA, 22 bp, Homo sapiens
gggagagagaaaacgtggcgca

SEQ ID NO: 7101146 - DNA, 22 bp, Homo sapiens
gggagagagaaaacgtggcgca

SEQ ID NO: 7101147 - DNA, 22 bp, Homo sapiens
gggagagagaaaacgtggcgca

SEQ ID NO: 7101148 - DNA, 22 bp, Homo sapiens
gggagagaattattgccagacc

SEQ ID NO: 7101149 - DNA, 22 bp, Homo sapiens
gggagagaattattgccagacc

SEQ ID NO: 7101150 - DNA, 22 bp, Homo sapiens
gggagagagaaaacgtggcgca

SEQ ID NO: 7101151 - DNA, 22 bp, Homo sapiens
gggagagagagctcatgttgaa

SEQ ID NO: 7101152 - DNA, 22 bp, Homo sapiens
gggagagatgctgattgccaat

SEQ ID NO: 7101153 - DNA, 22 bp, Homo sapiens
gggagagatgctgattgccaat

SEQ ID NO: 7101154 - DNA, 19 bp, Homo sapiens
gggagagccaggctcaccc

SEQ ID NO: 7101155 - DNA, 19 bp, Homo sapiens
gggagagccaggctcaccc

SEQ ID NO: 7101156 - DNA, 22 bp, Homo sapiens
gggagaggttacccgagcaact

SEQ ID NO: 7101157 - DNA, 22 bp, Homo sapiens
gggagaggttacccgagcaact

SEQ ID NO: 7101158 - DNA, 22 bp, Homo sapiens
gggagaggttacccgagcaact

SEQ ID NO: 7101159 - DNA, 22 bp, Homo sapiens
gggagaggttacccgagcaact

SEQ ID NO: 7101160 - DNA, 22 bp, Homo sapiens
gggagaggttacccgagcaact

SEQ ID NO: 7101161 - DNA, 22 bp, Homo sapiens
gggagagcgggaggtgccacag

SEQ ID NO: 7101162 - DNA, 22 bp, Homo sapiens
gggagagcgcgctagggccgag

SEQ ID NO: 7101163 - DNA, 22 bp, Homo sapiens
gggagagcgggaggtgccacag

SEQ ID NO: 7101164 - DNA, 19 bp, Homo sapiens
gggagagccaggctcaccc

SEQ ID NO: 7101165 - DNA, 22 bp, Homo sapiens
gggagagcgcgctagggccgag

SEQ ID NO: 7101166 - DNA, 22 bp, Homo sapiens
gggagagcgcgctagggccgag

SEQ ID NO: 7101167 - DNA, 22 bp, Homo sapiens
gggagacagttcagatagtttc

SEQ ID NO: 7101168 - DNA, 22 bp, Homo sapiens
gggagactagtgctatgttttc

SEQ ID NO: 7101169 - DNA, 20 bp, Homo sapiens
gggagacagggccagtgtcc

SEQ ID NO: 7101170 - DNA, 19 bp, Homo sapiens
gggagacagctctgggctg

SEQ ID NO: 7101171 - DNA, 20 bp, Homo sapiens
gggagacagggccagtgtcc

SEQ ID NO: 7101172 - DNA, 22 bp, Homo sapiens
gggagagaaattatagcaatga

SEQ ID NO: 7101173 - DNA, 22 bp, Homo sapiens
gggagagaagggcatgtacact

SEQ ID NO: 7101174 - DNA, 22 bp, Homo sapiens
gggagagaattattgccagacc

SEQ ID NO: 7101175 - DNA, 22 bp, Homo sapiens
gggagagaattattgccagacc

SEQ ID NO: 7101176 - DNA, 22 bp, Homo sapiens
gggagagaattattgccagacc

SEQ ID NO: 7101177 - DNA, 22 bp, Homo sapiens
gggagacacgctgcaggcataa

SEQ ID NO: 7101178 - DNA, 22 bp, Homo sapiens
gggagacacgctgcaggcataa

SEQ ID NO: 7101179 - DNA, 22 bp, Homo sapiens
gggagacaagaagtagcctgct

SEQ ID NO: 7101180 - DNA, 22 bp, Homo sapiens
gggagacacgctgcaggcataa

SEQ ID NO: 7101181 - DNA, 22 bp, Homo sapiens
gggagctgtaagggacaggtag

SEQ ID NO: 7101182 - DNA, 22 bp, Homo sapiens
gggagctgtaagggacaggtag

SEQ ID NO: 7101183 - DNA, 22 bp, Homo sapiens
gggagctgtaagggacaggtag

SEQ ID NO: 7101184 - DNA, 22 bp, Homo sapiens
gggagctgtagtccagataccg

SEQ ID NO: 7101185 - DNA, 22 bp, Homo sapiens
gggagctgtagtccagataccg

SEQ ID NO: 7101186 - DNA, 22 bp, Homo sapiens
gggagctgtcatcagtgttgtc

SEQ ID NO: 7101187 - DNA, 22 bp, Homo sapiens
gggagctgtcatcagtgttgtc

SEQ ID NO: 7101188 - DNA, 22 bp, Homo sapiens
gggagctgtcatcagtgttgtc

SEQ ID NO: 7101189 - DNA, 19 bp, Homo sapiens
gggagctgtctgcccgtgg

SEQ ID NO: 7101190 - DNA, 19 bp, Homo sapiens
gggagctgtctgcccgtgg

SEQ ID NO: 7101191 - DNA, 18 bp, Homo sapiens
gggagctgggaagctggt

SEQ ID NO: 7101192 - DNA, 22 bp, Homo sapiens
gggagctgggctggttttgctg

SEQ ID NO: 7101193 - DNA, 22 bp, Homo sapiens
gggagctgggctggttttgctg

SEQ ID NO: 7101194 - DNA, 22 bp, Homo sapiens
gggagctgggctggttttgctg

SEQ ID NO: 7101195 - DNA, 22 bp, Homo sapiens
gggagctggggcatttataccc

SEQ ID NO: 7101196 - DNA, 22 bp, Homo sapiens
gggagctggggcatttataccc

SEQ ID NO: 7101197 - DNA, 22 bp, Homo sapiens
gggagctggttcctgccctcca

SEQ ID NO: 7101198 - DNA, 22 bp, Homo sapiens
gggagctggttcctgccctcca

SEQ ID NO: 7101199 - DNA, 22 bp, Homo sapiens
gggagctggttcctgccctcca

SEQ ID NO: 7101200 - DNA, 22 bp, Homo sapiens
gggagctggttcctgccctcca

SEQ ID NO: 7101201 - DNA, 22 bp, Homo sapiens
gggagctggttcctgccctcca

SEQ ID NO: 7101202 - DNA, 22 bp, Homo sapiens
gggagctgtaagggacaggtag

SEQ ID NO: 7101203 - DNA, 22 bp, Homo sapiens
gggagaggttacccgagcaact

SEQ ID NO: 7101204 - DNA, 22 bp, Homo sapiens
gggagaggttacccgagcaact

SEQ ID NO: 7101205 - DNA, 22 bp, Homo sapiens
gggagaggttacccgagcaact

SEQ ID NO: 7101206 - DNA, 22 bp, Homo sapiens
gggagagtagctggaaggttct

SEQ ID NO: 7101207 - DNA, 22 bp, Homo sapiens
gggagagtagctggaaggttct

SEQ ID NO: 7101208 - DNA, 22 bp, Homo sapiens
gggagaggttacccgagcaact

SEQ ID NO: 7101209 - DNA, 22 bp, Homo sapiens
gggagaggttacccgagcaact

SEQ ID NO: 7101210 - DNA, 22 bp, Homo sapiens
gggagaggttacccgagcaact

SEQ ID NO: 7101211 - DNA, 22 bp, Homo sapiens
gggagaggttacccgagcaact

SEQ ID NO: 7101212 - DNA, 22 bp, Homo sapiens
gggagaggttacccgagcaact

SEQ ID NO: 7101213 - DNA, 22 bp, Homo sapiens
gggagaggttacccgagcaact

SEQ ID NO: 7101214 - DNA, 17 bp, Homo sapiens
gggagatgaagggatat

SEQ ID NO: 7101215 - DNA, 22 bp, Homo sapiens
gggagatgaatcagaagtgatc

SEQ ID NO: 7101216 - DNA, 22 bp, Homo sapiens
gggagatgaatcagaagtgatc

SEQ ID NO: 7101217 - DNA, 22 bp, Homo sapiens
gggagagtagctggaaggttct

SEQ ID NO: 7101218 - DNA, 22 bp, Homo sapiens
gggagagtagctggaaggttct

SEQ ID NO: 7101219 - DNA, 22 bp, Homo sapiens
gggagagtagctggaaggttct

SEQ ID NO: 7101220 - DNA, 17 bp, Homo sapiens
gggagatgaagggatat

SEQ ID NO: 7101221 - DNA, 17 bp, Homo sapiens
gggagatgaagggatat

SEQ ID NO: 7101222 - DNA, 17 bp, Homo sapiens
gggagatgaagggatat

SEQ ID NO: 7101223 - DNA, 22 bp, Homo sapiens
gggagatgaatcagaagtgatc

SEQ ID NO: 7101224 - DNA, 22 bp, Homo sapiens
gggagctggcggattccccagg

SEQ ID NO: 7101225 - DNA, 18 bp, Homo sapiens
gggagctgggaagctggt

SEQ ID NO: 7101226 - DNA, 18 bp, Homo sapiens
gggagctgggaagctggt

SEQ ID NO: 7101227 - DNA, 18 bp, Homo sapiens
gggagctgggaagctggt

SEQ ID NO: 7101228 - DNA, 22 bp, Homo sapiens
gggacaggctgagacttgagct

SEQ ID NO: 7101229 - DNA, 22 bp, Homo sapiens
gggacaggctgagacttgagct

SEQ ID NO: 7101230 - DNA, 22 bp, Homo sapiens
gggacaggctgagacttgagct

SEQ ID NO: 7101231 - DNA, 22 bp, Homo sapiens
gggacaggctgagacttgagct

SEQ ID NO: 7101232 - DNA, 22 bp, Homo sapiens
gggacaggcccctcgctagctt

SEQ ID NO: 7101233 - DNA, 22 bp, Homo sapiens
gggacaggcccctcgctagctt

SEQ ID NO: 7101234 - DNA, 22 bp, Homo sapiens
gggacaggcccctcgctagctt

SEQ ID NO: 7101235 - DNA, 22 bp, Homo sapiens
gggacaggcccctcgctagctt

SEQ ID NO: 7101236 - DNA, 22 bp, Homo sapiens
gggacaggcccctcgctagctt

SEQ ID NO: 7101237 - DNA, 22 bp, Homo sapiens
gggacaggcaaaggtatgcttc

SEQ ID NO: 7101238 - DNA, 22 bp, Homo sapiens
gggacaggcccctcgctagctt

SEQ ID NO: 7101239 - DNA, 22 bp, Homo sapiens
gggacaggcccctcgctagctt

SEQ ID NO: 7101240 - DNA, 22 bp, Homo sapiens
gggacatgaggccatagtgatt

SEQ ID NO: 7101241 - DNA, 22 bp, Homo sapiens
gggacatgcccctcagtgggtg

SEQ ID NO: 7101242 - DNA, 22 bp, Homo sapiens
gggacatgcccctcagtgggtg

SEQ ID NO: 7101243 - DNA, 22 bp, Homo sapiens
gggacatctttctagtcagggt

SEQ ID NO: 7101244 - DNA, 22 bp, Homo sapiens
gggacatgaagcatcggaggca

SEQ ID NO: 7101245 - DNA, 22 bp, Homo sapiens
gggacatgaagcatcggaggca

SEQ ID NO: 7101246 - DNA, 22 bp, Homo sapiens
gggacatctttctagtcagggt

SEQ ID NO: 7101247 - DNA, 22 bp, Homo sapiens
gggacatctttctagtcagggt

SEQ ID NO: 7101248 - DNA, 22 bp, Homo sapiens
gggacatctttctagtcagggt

SEQ ID NO: 7101249 - DNA, 22 bp, Homo sapiens
gggacaggctgagacttgagct

SEQ ID NO: 7101250 - DNA, 22 bp, Homo sapiens
gggacaggctgagacttgagct

SEQ ID NO: 7101251 - DNA, 22 bp, Homo sapiens
gggacaggctgagacttgagct

SEQ ID NO: 7101252 - DNA, 22 bp, Homo sapiens
gggacaggctgagacttgagct

SEQ ID NO: 7101253 - DNA, 22 bp, Homo sapiens
gggacagtggctgtgtcagttt

SEQ ID NO: 7101254 - DNA, 23 bp, Homo sapiens
gggaccagctagggctgtgacct

SEQ ID NO: 7101255 - DNA, 22 bp, Homo sapiens
gggaccagaggctgtgcacaat

SEQ ID NO: 7101256 - DNA, 23 bp, Homo sapiens
gggaccagctagggctgtgacct

SEQ ID NO: 7101257 - DNA, 23 bp, Homo sapiens
gggaccagctagggctgtgacct

SEQ ID NO: 7101258 - DNA, 23 bp, Homo sapiens
gggaccaggcccttcctggtttg

SEQ ID NO: 7101259 - DNA, 22 bp, Homo sapiens
gggagaagtggaaatctcatta

SEQ ID NO: 7101260 - DNA, 22 bp, Homo sapiens
gggagaagtggaaatctcatta

SEQ ID NO: 7101261 - DNA, 23 bp, Homo sapiens
gggagaatatgaggatgatggtg

SEQ ID NO: 7101262 - DNA, 22 bp, Homo sapiens
gggagacaaaggtgaggttctt

SEQ ID NO: 7101263 - DNA, 22 bp, Homo sapiens
gggagacaaaggtgaggttctt

SEQ ID NO: 7101264 - DNA, 22 bp, Homo sapiens
gggacatggaggcgcgcaggca

SEQ ID NO: 7101265 - DNA, 22 bp, Homo sapiens
gggacatggaggcgcgcaggca

SEQ ID NO: 7101266 - DNA, 22 bp, Homo sapiens
gggacatggctaggattccaat

SEQ ID NO: 7101267 - DNA, 22 bp, Homo sapiens
gggacattgagatacctccaaa

SEQ ID NO: 7101268 - DNA, 22 bp, Homo sapiens
gggacattgtcaatggtggtag

SEQ ID NO: 7101269 - DNA, 22 bp, Homo sapiens
gggacatttatcagatgaccat

SEQ ID NO: 7101270 - DNA, 22 bp, Homo sapiens
gggacatttatcagatgaccat

SEQ ID NO: 7101271 - DNA, 22 bp, Homo sapiens
gggacatttgctatcggagttc

SEQ ID NO: 7101272 - DNA, 22 bp, Homo sapiens
gggacatttgctatcggagttc

SEQ ID NO: 7101273 - DNA, 22 bp, Homo sapiens
gggaccagaggctgtgcacaat

SEQ ID NO: 7101274 - DNA, 22 bp, Homo sapiens
gggaccagaggctgtgcacaat

SEQ ID NO: 7101275 - DNA, 22 bp, Homo sapiens
ggcttgggagcaggcatgtgac

SEQ ID NO: 7101276 - DNA, 22 bp, Homo sapiens
ggcttggcttgggctcagaggc

SEQ ID NO: 7101277 - DNA, 22 bp, Homo sapiens
ggcttggcttgggctcagaggc

SEQ ID NO: 7101278 - DNA, 22 bp, Homo sapiens
ggcttgggagcaggcatgtgac

SEQ ID NO: 7101279 - DNA, 22 bp, Homo sapiens
ggcttgggagcaggcatgtgac

SEQ ID NO: 7101280 - DNA, 22 bp, Homo sapiens
ggcttcttagaatttgacttac

SEQ ID NO: 7101281 - DNA, 22 bp, Homo sapiens
ggcttggctacaagccatgggc

SEQ ID NO: 7101282 - DNA, 20 bp, Homo sapiens
ggcttggctgcctggggagg

SEQ ID NO: 7101283 - DNA, 22 bp, Homo sapiens
ggcttgggagcaggcatgtgac

SEQ ID NO: 7101284 - DNA, 22 bp, Homo sapiens
ggcttgggagcaggcatgtgac

SEQ ID NO: 7101285 - DNA, 22 bp, Homo sapiens
ggcttgtcatgttgatgttctt

SEQ ID NO: 7101286 - DNA, 22 bp, Homo sapiens
gggacagctggtctacctggta

SEQ ID NO: 7101287 - DNA, 22 bp, Homo sapiens
gggacagctgtagtgcttggct

SEQ ID NO: 7101288 - DNA, 22 bp, Homo sapiens
gggacagctgtagtgcttggct

SEQ ID NO: 7101289 - DNA, 22 bp, Homo sapiens
gggacagctgtagtgcttggct

SEQ ID NO: 7101290 - DNA, 22 bp, Homo sapiens
gggacaggcaaaggtatgcttc

SEQ ID NO: 7101291 - DNA, 22 bp, Homo sapiens
gggacaggcaaaggtatgcttc

SEQ ID NO: 7101292 - DNA, 22 bp, Homo sapiens
gggacaggcaaaggtatgcttc

SEQ ID NO: 7101293 - DNA, 22 bp, Homo sapiens
gggacaggcaaaggtatgcttc

SEQ ID NO: 7101294 - DNA, 22 bp, Homo sapiens
gggacaggcaaaggtatgcttc

SEQ ID NO: 7101295 - DNA, 22 bp, Homo sapiens
gggacaggcaaaggtatgcttc

SEQ ID NO: 7101296 - DNA, 22 bp, Homo sapiens
gggacagcagaaagaaggcaag

SEQ ID NO: 7101297 - DNA, 22 bp, Homo sapiens
gggacagcagaaagaaggcaag

SEQ ID NO: 7101298 - DNA, 22 bp, Homo sapiens
gggacagccatgtgcagatgcc

SEQ ID NO: 7101299 - DNA, 22 bp, Homo sapiens
gggacagccatgtgcagatgcc

SEQ ID NO: 7101300 - DNA, 22 bp, Homo sapiens
gggacagccatgtgcagatgcc

SEQ ID NO: 7101301 - DNA, 22 bp, Homo sapiens
gggacagccatgtgcagatgcc

SEQ ID NO: 7101302 - DNA, 22 bp, Homo sapiens
gggacagctggtctacctggta

SEQ ID NO: 7101303 - DNA, 22 bp, Homo sapiens
gggacagctggtctacctggta

SEQ ID NO: 7101304 - DNA, 22 bp, Homo sapiens
ggctttatagggtagaggatca

SEQ ID NO: 7101305 - DNA, 22 bp, Homo sapiens
ggctttagtgtaggtttctgtt

SEQ ID NO: 7101306 - DNA, 22 bp, Homo sapiens
gggaatgtaatcatggaatgct

SEQ ID NO: 7101307 - DNA, 22 bp, Homo sapiens
gggaatgtaatcatggaatgct

SEQ ID NO: 7101308 - DNA, 22 bp, Homo sapiens
gggaatgtaattaatctccttc

SEQ ID NO: 7101309 - DNA, 22 bp, Homo sapiens
gggaatgtaattaatctccttc

SEQ ID NO: 7101310 - DNA, 22 bp, Homo sapiens
gggaatgtacagaggacacagg

SEQ ID NO: 7101311 - DNA, 22 bp, Homo sapiens
gggaatgtacagaggacacagg

SEQ ID NO: 7101312 - DNA, 22 bp, Homo sapiens
gggaatgtagcaaatctgcaat

SEQ ID NO: 7101313 - DNA, 22 bp, Homo sapiens
gggaatgtagcaaatctgcaat

SEQ ID NO: 7101314 - DNA, 22 bp, Homo sapiens
gggaatgtgaaacagtaaggga

SEQ ID NO: 7101315 - DNA, 22 bp, Homo sapiens
gggaatgtgaaacagtaaggga

SEQ ID NO: 7101316 - DNA, 22 bp, Homo sapiens
gggaatgtagcaaatctgcaat

SEQ ID NO: 7101317 - DNA, 22 bp, Homo sapiens
gggaatgtgagtagggtgagtt

SEQ ID NO: 7101318 - DNA, 22 bp, Homo sapiens
gggaatgtgagtagggtgagtt

SEQ ID NO: 7101319 - DNA, 22 bp, Homo sapiens
gggaatgtgattgttgttttaa

SEQ ID NO: 7101320 - DNA, 22 bp, Homo sapiens
gggaatgtgattgttgttttaa

SEQ ID NO: 7101321 - DNA, 22 bp, Homo sapiens
gggaatgtgcagccacagtgag

SEQ ID NO: 7101322 - DNA, 22 bp, Homo sapiens
gggaatgtgcagccacagtgag

SEQ ID NO: 7101323 - DNA, 22 bp, Homo sapiens
gggaatgtgcaggatcgtgggc

SEQ ID NO: 7101324 - DNA, 22 bp, Homo sapiens
gggaatgtgcaggatcgtgggc

SEQ ID NO: 7101325 - DNA, 20 bp, Homo sapiens
gggaatgtgccccttacccc

SEQ ID NO: 7101326 - DNA, 20 bp, Homo sapiens
gggaatgtgccccttacccc

SEQ ID NO: 7101327 - DNA, 22 bp, Homo sapiens
gggaatgtgcctggagtgttca

SEQ ID NO: 7101328 - DNA, 22 bp, Homo sapiens
gggaatgtgcctggagtgttca

SEQ ID NO: 7101329 - DNA, 23 bp, Homo sapiens
gggcatggagtgtaggtggaagg

SEQ ID NO: 7101330 - DNA, 23 bp, Homo sapiens
gggcatggagtgtaggtggaagg

SEQ ID NO: 7101331 - DNA, 23 bp, Homo sapiens
gggcatggagtgtaggtggaagg

SEQ ID NO: 7101332 - DNA, 19 bp, Homo sapiens
gggcatgctggctctagag

SEQ ID NO: 7101333 - DNA, 23 bp, Homo sapiens
gggcatggagtgtaggtggaagg

SEQ ID NO: 7101334 - DNA, 23 bp, Homo sapiens
gggcatggagtgtaggtggaagg

SEQ ID NO: 7101335 - DNA, 23 bp, Homo sapiens
gggcatggagtgtaggtggaagg

SEQ ID NO: 7101336 - DNA, 18 bp, Homo sapiens
gggcatggatgcagcatc

SEQ ID NO: 7101337 - DNA, 19 bp, Homo sapiens
gggcatggatgagcttacc

SEQ ID NO: 7101338 - DNA, 22 bp, Homo sapiens
gggcaggatgcagtttcagaga

SEQ ID NO: 7101339 - DNA, 22 bp, Homo sapiens
gggcaggctgagcatgtcacct

SEQ ID NO: 7101340 - DNA, 22 bp, Homo sapiens
gggcaggctgagcatgtcacct

SEQ ID NO: 7101341 - DNA, 22 bp, Homo sapiens
gggcaggctgagcatgtcacct

SEQ ID NO: 7101342 - DNA, 22 bp, Homo sapiens
gggcatgcctgcgcagtgcatg

SEQ ID NO: 7101343 - DNA, 22 bp, Homo sapiens
gggcaggaggctaattctgcat

SEQ ID NO: 7101344 - DNA, 22 bp, Homo sapiens
gggcaggagagggccacctgga

SEQ ID NO: 7101345 - DNA, 22 bp, Homo sapiens
gggcaggagagaacagtcatgg

SEQ ID NO: 7101346 - DNA, 22 bp, Homo sapiens
gggcaggagagaacagtcatgg

SEQ ID NO: 7101347 - DNA, 22 bp, Homo sapiens
gggcaggagagggccacctgga

SEQ ID NO: 7101348 - DNA, 22 bp, Homo sapiens
gggcaggagagggccacctgga

SEQ ID NO: 7101349 - DNA, 22 bp, Homo sapiens
gggcaggagagaacagtcatgg

SEQ ID NO: 7101350 - DNA, 22 bp, Homo sapiens
gggcaggagagaacagtcatgg

SEQ ID NO: 7101351 - DNA, 22 bp, Homo sapiens
gggcaggagaaggtggatgtcc

SEQ ID NO: 7101352 - DNA, 22 bp, Homo sapiens
gggcaggagaaggtggatgtcc

SEQ ID NO: 7101353 - DNA, 16 bp, Homo sapiens
gggcaggaatcagggt

SEQ ID NO: 7101354 - DNA, 22 bp, Homo sapiens
gggcaggagaaggtggatgtcc

SEQ ID NO: 7101355 - DNA, 22 bp, Homo sapiens
gggcaggagaaggtggatgtcc

SEQ ID NO: 7101356 - DNA, 22 bp, Homo sapiens
gggcacaggagaaggatctggc

SEQ ID NO: 7101357 - DNA, 22 bp, Homo sapiens
gggcacaggagaaggatctggc

SEQ ID NO: 7101358 - DNA, 22 bp, Homo sapiens
gggcacagctgctacccagtgc

SEQ ID NO: 7101359 - DNA, 22 bp, Homo sapiens
gggcacaggaatttgggatgtg

SEQ ID NO: 7101360 - DNA, 22 bp, Homo sapiens
gggcacaggaatttgggatgtg

SEQ ID NO: 7101361 - DNA, 22 bp, Homo sapiens
gggcacaggaatttgggatgtg

SEQ ID NO: 7101362 - DNA, 22 bp, Homo sapiens
gggcagctctcacagcagccaa

SEQ ID NO: 7101363 - DNA, 22 bp, Homo sapiens
gggcagctctcacagcagccaa

SEQ ID NO: 7101364 - DNA, 22 bp, Homo sapiens
gggcagctctggctgtgggaag

SEQ ID NO: 7101365 - DNA, 22 bp, Homo sapiens
gggcagctctggctgtgggaag

SEQ ID NO: 7101366 - DNA, 22 bp, Homo sapiens
gggcagctctttggtatccttc

SEQ ID NO: 7101367 - DNA, 22 bp, Homo sapiens
gggcagctctttggtatccttc

SEQ ID NO: 7101368 - DNA, 22 bp, Homo sapiens
gggcagctgcagggatggtgac

SEQ ID NO: 7101369 - DNA, 22 bp, Homo sapiens
gggcagctgcagggatggtgac

SEQ ID NO: 7101370 - DNA, 22 bp, Homo sapiens
gggcagctgcagggatggtgac

SEQ ID NO: 7101371 - DNA, 22 bp, Homo sapiens
gggcagctgcagggatggtgac

SEQ ID NO: 7101372 - DNA, 22 bp, Homo sapiens
gggcagctgccagaggccatgg

SEQ ID NO: 7101373 - DNA, 22 bp, Homo sapiens
gggcagctgccagaggccatgg

SEQ ID NO: 7101374 - DNA, 22 bp, Homo sapiens
gggcagctgccagaggccatgg

SEQ ID NO: 7101375 - DNA, 22 bp, Homo sapiens
gggcagctgccagaggccatgg

SEQ ID NO: 7101376 - DNA, 22 bp, Homo sapiens
gggcagctgccagaggccatgg

SEQ ID NO: 7101377 - DNA, 22 bp, Homo sapiens
gggcagctgcccctctctgggc

SEQ ID NO: 7101378 - DNA, 22 bp, Homo sapiens
gggcagctgcccctctctgggc

SEQ ID NO: 7101379 - DNA, 22 bp, Homo sapiens
gggcagctggccaggtattctg

SEQ ID NO: 7101380 - DNA, 22 bp, Homo sapiens
gggcagctggcttataggtttg

SEQ ID NO: 7101381 - DNA, 22 bp, Homo sapiens
gggcagctgtatctgagcttat

SEQ ID NO: 7101382 - DNA, 22 bp, Homo sapiens
gggcaggaacaaatcaaatgat

SEQ ID NO: 7101383 - DNA, 22 bp, Homo sapiens
gggcaagcacagcgagcgtgcg

SEQ ID NO: 7101384 - DNA, 22 bp, Homo sapiens
gggcaaagtggtggaggcagtt

SEQ ID NO: 7101385 - DNA, 19 bp, Homo sapiens
gggcaaatcccttctttct

SEQ ID NO: 7101386 - DNA, 20 bp, Homo sapiens
gggcaaattgctatttcttt

SEQ ID NO: 7101387 - DNA, 22 bp, Homo sapiens
gggcacagcccagtggggtccc

SEQ ID NO: 7101388 - DNA, 22 bp, Homo sapiens
gggcacagcctaactatggaga

SEQ ID NO: 7101389 - DNA, 22 bp, Homo sapiens
gggcacagcctaactatggaga

SEQ ID NO: 7101390 - DNA, 22 bp, Homo sapiens
gggcacagcccagtggggtccc

SEQ ID NO: 7101391 - DNA, 22 bp, Homo sapiens
gggcacagcctaactatggaga

SEQ ID NO: 7101392 - DNA, 19 bp, Homo sapiens
gggcacagcctccccccag

SEQ ID NO: 7101393 - DNA, 19 bp, Homo sapiens
gggcacagcctccccccag

SEQ ID NO: 7101394 - DNA, 22 bp, Homo sapiens
gggcacagctgctacccagtgc

SEQ ID NO: 7101395 - DNA, 22 bp, Homo sapiens
gggcacagctgctacccagtgc

SEQ ID NO: 7101396 - DNA, 22 bp, Homo sapiens
gggcaaaggcagaaagcggtgt

SEQ ID NO: 7101397 - DNA, 22 bp, Homo sapiens
gggatttgtgggatggccagtg

SEQ ID NO: 7101398 - DNA, 22 bp, Homo sapiens
gggattaaacaccacttgaagg

SEQ ID NO: 7101399 - DNA, 15 bp, Homo sapiens
gggattaaagagccc

SEQ ID NO: 7101400 - DNA, 21 bp, Homo sapiens
gggattaagtgacttgcctga

SEQ ID NO: 7101401 - DNA, 22 bp, Homo sapiens
gggattaatgtctctttgaaag

SEQ ID NO: 7101402 - DNA, 22 bp, Homo sapiens
gggatggggtcgggaccctgct

SEQ ID NO: 7101403 - DNA, 22 bp, Homo sapiens
gggatggggtcaacatgtacct

SEQ ID NO: 7101404 - DNA, 22 bp, Homo sapiens
gggatggggtcgggaccctgct

SEQ ID NO: 7101405 - DNA, 22 bp, Homo sapiens
gggatggggtcgggaccctgct

SEQ ID NO: 7101406 - DNA, 22 bp, Homo sapiens
gggatggggtcgggaccctgct

SEQ ID NO: 7101407 - DNA, 22 bp, Homo sapiens
gggatggggtcgggaccctgct

SEQ ID NO: 7101408 - DNA, 22 bp, Homo sapiens
gggatggggtcgggaccctgct

SEQ ID NO: 7101409 - DNA, 22 bp, Homo sapiens
gggatggtggcttgcatctgta

SEQ ID NO: 7101410 - DNA, 22 bp, Homo sapiens
gggatgtcactgtgcctggcac

SEQ ID NO: 7101411 - DNA, 22 bp, Homo sapiens
gggatgtcgtgggtggcagctg

SEQ ID NO: 7101412 - DNA, 22 bp, Homo sapiens
gggaggaaggcttgggtgagta

SEQ ID NO: 7101413 - DNA, 22 bp, Homo sapiens
gggaggaaggcttgggtgagta

SEQ ID NO: 7101414 - DNA, 22 bp, Homo sapiens
gggaggacggtccagggcaaag

SEQ ID NO: 7101415 - DNA, 22 bp, Homo sapiens
gggaggaaggcttgggtgagta

SEQ ID NO: 7101416 - DNA, 22 bp, Homo sapiens
gggaggaaggcttgggtgagta

SEQ ID NO: 7101417 - DNA, 22 bp, Homo sapiens
gggaggaaggcttgggtgagta

SEQ ID NO: 7101418 - DNA, 22 bp, Homo sapiens
gggaggaaggcttgggtgagta

SEQ ID NO: 7101419 - DNA, 21 bp, Homo sapiens
gggaggaagctgcttctctct

SEQ ID NO: 7101420 - DNA, 22 bp, Homo sapiens
gggaggaaggcttgggtgagta

SEQ ID NO: 7101421 - DNA, 22 bp, Homo sapiens
gggaggaaatgtgcagcgaatt

SEQ ID NO: 7101422 - DNA, 22 bp, Homo sapiens
gggaggaaatgtgcagcgaatt

SEQ ID NO: 7101423 - DNA, 22 bp, Homo sapiens
gggaggaaatgtgcagcgaatt

SEQ ID NO: 7101424 - DNA, 22 bp, Homo sapiens
gggaggaaatgtgcagcgaatt

SEQ ID NO: 7101425 - DNA, 22 bp, Homo sapiens
gggaggaaagagaagtggtcca

SEQ ID NO: 7101426 - DNA, 22 bp, Homo sapiens
gggagcttctggaaggcaggaa

SEQ ID NO: 7101427 - DNA, 22 bp, Homo sapiens
gggagcttaagacagttccaat

SEQ ID NO: 7101428 - DNA, 19 bp, Homo sapiens
gggagctttccatctgtcc

SEQ ID NO: 7101429 - DNA, 19 bp, Homo sapiens
gggagctttccatctgtcc

SEQ ID NO: 7101430 - DNA, 22 bp, Homo sapiens
gggaggaaagagaagtggtcca

SEQ ID NO: 7101431 - DNA, 22 bp, Homo sapiens
gggaggaaagagaagtggtcca

SEQ ID NO: 7101432 - DNA, 19 bp, Homo sapiens
gggagctgtctgcccgtgg

SEQ ID NO: 7101433 - DNA, 22 bp, Homo sapiens
gggagctgtgggattggttgag

SEQ ID NO: 7101434 - DNA, 22 bp, Homo sapiens
gggagctgtgggattggttgag

SEQ ID NO: 7101435 - DNA, 23 bp, Homo sapiens
gggagctgtggtgaaaagaggtg

SEQ ID NO: 7101436 - DNA, 23 bp, Homo sapiens
gggagctgtggtgaaaagaggtg

SEQ ID NO: 7101437 - DNA, 22 bp, Homo sapiens
gggaggagctgagtgtgtgtgc

SEQ ID NO: 7101438 - DNA, 22 bp, Homo sapiens
gggaggagctgagtgtgtgtgc

SEQ ID NO: 7101439 - DNA, 22 bp, Homo sapiens
gggaggagctgagtgtgtgtgc

SEQ ID NO: 7101440 - DNA, 22 bp, Homo sapiens
gggaggacggtccagggcaaag

SEQ ID NO: 7101441 - DNA, 22 bp, Homo sapiens
gggaggacggtccagggcaaag

SEQ ID NO: 7101442 - DNA, 22 bp, Homo sapiens
gggatggggagctggaaagggg

SEQ ID NO: 7101443 - DNA, 22 bp, Homo sapiens
gggaggagctgagtgtgtgtgc

SEQ ID NO: 7101444 - DNA, 22 bp, Homo sapiens
gggaggagctgagtgtgtgtgc

SEQ ID NO: 7101445 - DNA, 22 bp, Homo sapiens
gggaggagctgagtgtgtgtgc

SEQ ID NO: 7101446 - DNA, 22 bp, Homo sapiens
gggaggagcttggagattcact

SEQ ID NO: 7101447 - DNA, 22 bp, Homo sapiens
gggatggggagctggaaagggg

SEQ ID NO: 7101448 - DNA, 22 bp, Homo sapiens
gggatggggagctggaaagggg

SEQ ID NO: 7101449 - DNA, 22 bp, Homo sapiens
gggatggggagctggaaagggg

SEQ ID NO: 7101450 - DNA, 22 bp, Homo sapiens
gggatggggagctggaaagggg

SEQ ID NO: 7101451 - DNA, 22 bp, Homo sapiens
gggatggggagctggaaagggg

SEQ ID NO: 7101452 - DNA, 22 bp, Homo sapiens
gggatggggagctggaaagggg

SEQ ID NO: 7101453 - DNA, 22 bp, Homo sapiens
gggatggggagctggaaagggg

SEQ ID NO: 7101454 - DNA, 22 bp, Homo sapiens
gggatggggagctggaaagggg

SEQ ID NO: 7101455 - DNA, 22 bp, Homo sapiens
gggatggggagctggaaagggg

SEQ ID NO: 7101456 - DNA, 22 bp, Homo sapiens
gggatggggggaagcgtccatg

SEQ ID NO: 7101457 - DNA, 22 bp, Homo sapiens
gggatggggggaagcgtccatg

SEQ ID NO: 7101458 - DNA, 22 bp, Homo sapiens
gggatggggtcaacatgtacct

SEQ ID NO: 7101459 - DNA, 22 bp, Homo sapiens
gggatggggtcaacatgtacct

SEQ ID NO: 7101460 - DNA, 22 bp, Homo sapiens
ggcggaggttgcagtaagccga

SEQ ID NO: 7101461 - DNA, 22 bp, Homo sapiens
ggcggaggttgcagtaagccga

SEQ ID NO: 7101462 - DNA, 22 bp, Homo sapiens
ggcggccgccttcggccacggc

SEQ ID NO: 7101463 - DNA, 21 bp, Homo sapiens
ggcggcgcagagctgcggctc

SEQ ID NO: 7101464 - DNA, 22 bp, Homo sapiens
ggcgggacggggcgtgcacaga

SEQ ID NO: 7101465 - DNA, 22 bp, Homo sapiens
ggcgggaagttcttgcccactt

SEQ ID NO: 7101466 - DNA, 22 bp, Homo sapiens
ggcgggaggctgaggagttggt

SEQ ID NO: 7101467 - DNA, 22 bp, Homo sapiens
ggcgggaggctgaggagttggt

SEQ ID NO: 7101468 - DNA, 22 bp, Homo sapiens
ggcgggagcagcagctctgagc

SEQ ID NO: 7101469 - DNA, 22 bp, Homo sapiens
ggcgggaggctgaggagttggt

SEQ ID NO: 7101470 - DNA, 22 bp, Homo sapiens
ggcgggcagatgcggacacgcg

SEQ ID NO: 7101471 - DNA, 22 bp, Homo sapiens
ggcgggcagcgtcttgctggcc

SEQ ID NO: 7101472 - DNA, 22 bp, Homo sapiens
ggcgggcagatgcggacacgcg

SEQ ID NO: 7101473 - DNA, 23 bp, Homo sapiens
ggcggggataacagccccttgtc

SEQ ID NO: 7101474 - DNA, 22 bp, Homo sapiens
ggcggggcctcgcgaacggcct

SEQ ID NO: 7101475 - DNA, 22 bp, Homo sapiens
ggcgggggtccaggagcctgca

SEQ ID NO: 7101476 - DNA, 22 bp, Homo sapiens
ggcggggcctcgcgaacggcct

SEQ ID NO: 7101477 - DNA, 22 bp, Homo sapiens
ggcgggggtccaggagcctgca

SEQ ID NO: 7101478 - DNA, 22 bp, Homo sapiens
ggctccaccctgcttccagaag

SEQ ID NO: 7101479 - DNA, 22 bp, Homo sapiens
ggctccaccctgcttccagaag

SEQ ID NO: 7101480 - DNA, 22 bp, Homo sapiens
ggctccaccctgcttccagaag

SEQ ID NO: 7101481 - DNA, 22 bp, Homo sapiens
ggctccaccctgcttccagaag

SEQ ID NO: 7101482 - DNA, 22 bp, Homo sapiens
ggctccagaaacttcagtccat

SEQ ID NO: 7101483 - DNA, 22 bp, Homo sapiens
ggctccagaaatcatagagcag

SEQ ID NO: 7101484 - DNA, 22 bp, Homo sapiens
ggctccagatgtcccctggcaa

SEQ ID NO: 7101485 - DNA, 22 bp, Homo sapiens
ggctccagatgtcccctggcaa

SEQ ID NO: 7101486 - DNA, 22 bp, Homo sapiens
ggctccagatgtcccctggcaa

SEQ ID NO: 7101487 - DNA, 22 bp, Homo sapiens
ggctccagatgtcccctggcaa

SEQ ID NO: 7101488 - DNA, 22 bp, Homo sapiens
ggctccagatgtctcctggcaa

SEQ ID NO: 7101489 - DNA, 22 bp, Homo sapiens
ggctccagatgtctcctggcaa

SEQ ID NO: 7101490 - DNA, 22 bp, Homo sapiens
ggctccagatgtctcctggcaa

SEQ ID NO: 7101491 - DNA, 22 bp, Homo sapiens
ggctccagccctggctcttcac

SEQ ID NO: 7101492 - DNA, 22 bp, Homo sapiens
ggctccaggaacctcctctcct

SEQ ID NO: 7101493 - DNA, 18 bp, Homo sapiens
ggctccaggacctaccca

SEQ ID NO: 7101494 - DNA, 18 bp, Homo sapiens
ggctccaggacctaccca

SEQ ID NO: 7101495 - DNA, 22 bp, Homo sapiens
ggctccaggagatgctgggcag

SEQ ID NO: 7101496 - DNA, 22 bp, Homo sapiens
ggctccaggagatgctgggcag

SEQ ID NO: 7101497 - DNA, 22 bp, Homo sapiens
ggctccaggagatgctgggcag

SEQ ID NO: 7101498 - DNA, 22 bp, Homo sapiens
ggctccaggagatgctgggcag

SEQ ID NO: 7101499 - DNA, 22 bp, Homo sapiens
ggctccaggagatgctgggcag

SEQ ID NO: 7101500 - DNA, 22 bp, Homo sapiens
ggctccaggagggccttggcca

SEQ ID NO: 7101501 - DNA, 22 bp, Homo sapiens
ggctccaggagggccttggcca

SEQ ID NO: 7101502 - DNA, 23 bp, Homo sapiens
ggctccaggcctgacgggcgcgg

SEQ ID NO: 7101503 - DNA, 23 bp, Homo sapiens
ggctccaggcctgacgggcgcgg

SEQ ID NO: 7101504 - DNA, 22 bp, Homo sapiens
ggctctggagacatgtggagag

SEQ ID NO: 7101505 - DNA, 22 bp, Homo sapiens
ggctctggagacatgtggagag

SEQ ID NO: 7101506 - DNA, 22 bp, Homo sapiens
ggctctgctgcaagtcttcctc

SEQ ID NO: 7101507 - DNA, 22 bp, Homo sapiens
ggctctgctgcacccttggctc

SEQ ID NO: 7101508 - DNA, 22 bp, Homo sapiens
ggctctgctgcacccttggctc

SEQ ID NO: 7101509 - DNA, 22 bp, Homo sapiens
ggctctggaatgtgtagtcagg

SEQ ID NO: 7101510 - DNA, 22 bp, Homo sapiens
ggctctgctcacagcccgcagc

SEQ ID NO: 7101511 - DNA, 22 bp, Homo sapiens
ggctctgctcacagcccgcagc

SEQ ID NO: 7101512 - DNA, 22 bp, Homo sapiens
ggctctgctcacagcccgcagc

SEQ ID NO: 7101513 - DNA, 22 bp, Homo sapiens
ggctctgctcctggtgccagtg

SEQ ID NO: 7101514 - DNA, 22 bp, Homo sapiens
ggctctgctcctggtgccagtg

SEQ ID NO: 7101515 - DNA, 22 bp, Homo sapiens
ggctctgctgcaagtcttcctc

SEQ ID NO: 7101516 - DNA, 22 bp, Homo sapiens
ggctctgctgcaagtcttcctc

SEQ ID NO: 7101517 - DNA, 22 bp, Homo sapiens
ggctgaagtgtagtggctcact

SEQ ID NO: 7101518 - DNA, 22 bp, Homo sapiens
ggctgaagtgtagtggctcact

SEQ ID NO: 7101519 - DNA, 22 bp, Homo sapiens
ggctgagaagacagtggggtgg

SEQ ID NO: 7101520 - DNA, 22 bp, Homo sapiens
ggctgagaaggagtgggtgagg

SEQ ID NO: 7101521 - DNA, 22 bp, Homo sapiens
ggctgagaaggagtgggtgagg

SEQ ID NO: 7101522 - DNA, 22 bp, Homo sapiens
ggctgagactagagtgaggcat

SEQ ID NO: 7101523 - DNA, 22 bp, Homo sapiens
ggctgagactagagtgaggcat

SEQ ID NO: 7101524 - DNA, 22 bp, Homo sapiens
ggctgagacaacctgggaccca

SEQ ID NO: 7101525 - DNA, 22 bp, Homo sapiens
ggctgaagaactgggagtctca

SEQ ID NO: 7101526 - DNA, 22 bp, Homo sapiens
ggctgaaggaactttttccatg

SEQ ID NO: 7101527 - DNA, 22 bp, Homo sapiens
ggctgaaggatgaaagctgcag

SEQ ID NO: 7101528 - DNA, 22 bp, Homo sapiens
ggctgaaggatgaaagctgcag

SEQ ID NO: 7101529 - DNA, 22 bp, Homo sapiens
ggctgaaacagatttcaagaca

SEQ ID NO: 7101530 - DNA, 22 bp, Homo sapiens
ggctctgggccagagttggctt

SEQ ID NO: 7101531 - DNA, 22 bp, Homo sapiens
ggctctgggccagagttggctt

SEQ ID NO: 7101532 - DNA, 22 bp, Homo sapiens
ggctctgggccagagttggctt

SEQ ID NO: 7101533 - DNA, 22 bp, Homo sapiens
ggctctgggccagagttggctt

SEQ ID NO: 7101534 - DNA, 22 bp, Homo sapiens
ggctcttctgtttcacaggcca

SEQ ID NO: 7101535 - DNA, 22 bp, Homo sapiens
ggctctggagcacagacgtctg

SEQ ID NO: 7101536 - DNA, 22 bp, Homo sapiens
ggctctggagatgtccgacctg

SEQ ID NO: 7101537 - DNA, 22 bp, Homo sapiens
ggctctggagatgtccgacctg

SEQ ID NO: 7101538 - DNA, 22 bp, Homo sapiens
ggctctggagcacagacgtctg

SEQ ID NO: 7101539 - DNA, 22 bp, Homo sapiens
ggctctggagacatgtggagag

SEQ ID NO: 7101540 - DNA, 22 bp, Homo sapiens
ggctctggagacatgtggagag

SEQ ID NO: 7101541 - DNA, 22 bp, Homo sapiens
ggctctggagatgtccgacctg

SEQ ID NO: 7101542 - DNA, 22 bp, Homo sapiens
ggctctggagacatgtggagag

SEQ ID NO: 7101543 - DNA, 22 bp, Homo sapiens
ggctctggagacatgtggagag

SEQ ID NO: 7101544 - DNA, 22 bp, Homo sapiens
ggctctggagacatgtggagag

SEQ ID NO: 7101545 - DNA, 22 bp, Homo sapiens
ggctctggcgagctttagtaca

SEQ ID NO: 7101546 - DNA, 22 bp, Homo sapiens
ggctctggcaaggggaggctac

SEQ ID NO: 7101547 - DNA, 22 bp, Homo sapiens
ggctctggcaaggggaggctac

SEQ ID NO: 7101548 - DNA, 22 bp, Homo sapiens
ggctctggcaaggggaggctac

SEQ ID NO: 7101549 - DNA, 22 bp, Homo sapiens
ggctctggcgagctttagtaca

SEQ ID NO: 7101550 - DNA, 22 bp, Homo sapiens
ggctctggcgagctttagtaca

SEQ ID NO: 7101551 - DNA, 22 bp, Homo sapiens
ggctctggcggctctttcaata

SEQ ID NO: 7101552 - DNA, 22 bp, Homo sapiens
ggctctggcggctctttcaata

SEQ ID NO: 7101553 - DNA, 22 bp, Homo sapiens
ggctctggcggctctttcaata

SEQ ID NO: 7101554 - DNA, 22 bp, Homo sapiens
ggctctggagcacagacgtctg

SEQ ID NO: 7101555 - DNA, 22 bp, Homo sapiens
ggctctggcaaggggaggctac

SEQ ID NO: 7101556 - DNA, 22 bp, Homo sapiens
ggctctggcaaggggaggctac

SEQ ID NO: 7101557 - DNA, 22 bp, Homo sapiens
ggctctggcaaggggaggctac

SEQ ID NO: 7101558 - DNA, 22 bp, Homo sapiens
ggctctggcaaggggaggctac

SEQ ID NO: 7101559 - DNA, 22 bp, Homo sapiens
ggctctggctactccaccctgt

SEQ ID NO: 7101560 - DNA, 22 bp, Homo sapiens
ggctctggcgtccaatggagcg

SEQ ID NO: 7101561 - DNA, 22 bp, Homo sapiens
ggctctggcgtccaatggagcg

SEQ ID NO: 7101562 - DNA, 22 bp, Homo sapiens
ggctctggcgtccaatggagcg

SEQ ID NO: 7101563 - DNA, 22 bp, Homo sapiens
ggctctggcgtccaatggagcg

SEQ ID NO: 7101564 - DNA, 22 bp, Homo sapiens
ggctctggcgtccaatggagcg

SEQ ID NO: 7101565 - DNA, 22 bp, Homo sapiens
ggctctggcgtccaatggagcg

SEQ ID NO: 7101566 - DNA, 22 bp, Homo sapiens
ggctctggcgtccaatggagcg

SEQ ID NO: 7101567 - DNA, 19 bp, Homo sapiens
ggctctggcggctgtagcc

SEQ ID NO: 7101568 - DNA, 19 bp, Homo sapiens
ggctctggcggctgtagcc

SEQ ID NO: 7101569 - DNA, 19 bp, Homo sapiens
ggctctggcggctgtagcc

SEQ ID NO: 7101570 - DNA, 19 bp, Homo sapiens
ggctctggcggctgtagcc

SEQ ID NO: 7101571 - DNA, 19 bp, Homo sapiens
ggctctggcggctgtagcc

SEQ ID NO: 7101572 - DNA, 19 bp, Homo sapiens
ggctctggcggctgtagcc

SEQ ID NO: 7101573 - DNA, 22 bp, Homo sapiens
ggctctgggccagagttggctt

SEQ ID NO: 7101574 - DNA, 22 bp, Homo sapiens
ggctctgggccagagttggctt

SEQ ID NO: 7101575 - DNA, 22 bp, Homo sapiens
ggctctgggcatagaaggaagc

SEQ ID NO: 7101576 - DNA, 22 bp, Homo sapiens
ggctctgggcatagaaggaagc

SEQ ID NO: 7101577 - DNA, 22 bp, Homo sapiens
ggctctgggcatagaaggaagc

SEQ ID NO: 7101578 - DNA, 22 bp, Homo sapiens
ggctctgggaaatggtcttcct

SEQ ID NO: 7101579 - DNA, 22 bp, Homo sapiens
ggctctgggaaatggtcttcct

SEQ ID NO: 7101580 - DNA, 22 bp, Homo sapiens
ggctctgggcatagaaggaagc

SEQ ID NO: 7101581 - DNA, 22 bp, Homo sapiens
ggctctgggaaatggtcttcct

SEQ ID NO: 7101582 - DNA, 22 bp, Homo sapiens
ggctctgggcatagaaggaagc

SEQ ID NO: 7101583 - DNA, 22 bp, Homo sapiens
ggctctggctactccaccctgt

SEQ ID NO: 7101584 - DNA, 22 bp, Homo sapiens
ggctctggctactccaccctgt

SEQ ID NO: 7101585 - DNA, 22 bp, Homo sapiens
ggctctggctcctggctttgtg

SEQ ID NO: 7101586 - DNA, 22 bp, Homo sapiens
ggctctggctcctggctttgtg

SEQ ID NO: 7101587 - DNA, 22 bp, Homo sapiens
ggctctggctcctggctttgtg

SEQ ID NO: 7101588 - DNA, 22 bp, Homo sapiens
ggctctggctcctggctttgtg

SEQ ID NO: 7101589 - DNA, 22 bp, Homo sapiens
ggctctgggaaatggtcttcct

SEQ ID NO: 7101590 - DNA, 22 bp, Homo sapiens
ggctgggaggccgtgctgacct

SEQ ID NO: 7101591 - DNA, 22 bp, Homo sapiens
ggctgggaggccgtgctgacct

SEQ ID NO: 7101592 - DNA, 22 bp, Homo sapiens
ggctgggcaaacaagactcttc

SEQ ID NO: 7101593 - DNA, 22 bp, Homo sapiens
ggctgggcaaacaagactcttc

SEQ ID NO: 7101594 - DNA, 22 bp, Homo sapiens
ggctgggaggccgtgctgacct

SEQ ID NO: 7101595 - DNA, 22 bp, Homo sapiens
ggctgggcagcagctgttaagc

SEQ ID NO: 7101596 - DNA, 22 bp, Homo sapiens
ggctgggcaaacaagactcttc

SEQ ID NO: 7101597 - DNA, 21 bp, Homo sapiens
ggctgggcaggacccacccct

SEQ ID NO: 7101598 - DNA, 22 bp, Homo sapiens
ggctgggcaaacaagactcttc

SEQ ID NO: 7101599 - DNA, 22 bp, Homo sapiens
ggctggcttgcggagtcacaga

SEQ ID NO: 7101600 - DNA, 22 bp, Homo sapiens
ggctggcttgcggagtcacaga

SEQ ID NO: 7101601 - DNA, 21 bp, Homo sapiens
ggctgctgggagagctgcgtg

SEQ ID NO: 7101602 - DNA, 22 bp, Homo sapiens
ggctgctggggacgtgggagag

SEQ ID NO: 7101603 - DNA, 21 bp, Homo sapiens
ggctgctgggagagctgcgtg

SEQ ID NO: 7101604 - DNA, 22 bp, Homo sapiens
ggctggcttggtgagctgtcac

SEQ ID NO: 7101605 - DNA, 22 bp, Homo sapiens
ggctggcttggtgagctgtcac

SEQ ID NO: 7101606 - DNA, 22 bp, Homo sapiens
ggctgctgggaatatgccagct

SEQ ID NO: 7101607 - DNA, 22 bp, Homo sapiens
ggctgctgggaatatgccagct

SEQ ID NO: 7101608 - DNA, 22 bp, Homo sapiens
ggctgctgggaatatgccagct

SEQ ID NO: 7101609 - DNA, 22 bp, Homo sapiens
ggctgctgggaatatgccagct

SEQ ID NO: 7101610 - DNA, 22 bp, Homo sapiens
ggctgctggccagcctaggagt

SEQ ID NO: 7101611 - DNA, 22 bp, Homo sapiens
ggctgctggccagcctaggagt

SEQ ID NO: 7101612 - DNA, 22 bp, Homo sapiens
ggctgctggccagcctaggagt

SEQ ID NO: 7101613 - DNA, 22 bp, Homo sapiens
ggctgctggcctctccccggcc

SEQ ID NO: 7101614 - DNA, 22 bp, Homo sapiens
ggctgctgggaatatgccagct

SEQ ID NO: 7101615 - DNA, 22 bp, Homo sapiens
ggctgctgggaatatgccagct

SEQ ID NO: 7101616 - DNA, 22 bp, Homo sapiens
ggctgctggcattgaggtaggt

SEQ ID NO: 7101617 - DNA, 22 bp, Homo sapiens
ggctgctggcattgaggtaggt

SEQ ID NO: 7101618 - DNA, 22 bp, Homo sapiens
ggctgctggcattgaggtaggt

SEQ ID NO: 7101619 - DNA, 22 bp, Homo sapiens
ggctgctggccagcctaggagt

SEQ ID NO: 7101620 - DNA, 22 bp, Homo sapiens
ggctgctggcattgaggtaggt

SEQ ID NO: 7101621 - DNA, 22 bp, Homo sapiens
ggctgctggcattgaggtaggt

SEQ ID NO: 7101622 - DNA, 22 bp, Homo sapiens
ggctgctggcattgaggtaggt

SEQ ID NO: 7101623 - DNA, 22 bp, Homo sapiens
ggctgctggagttgggtctctc

SEQ ID NO: 7101624 - DNA, 22 bp, Homo sapiens
ggctgctggagttgggtctctc

SEQ ID NO: 7101625 - DNA, 22 bp, Homo sapiens
ggctgctggagttgggtctctc

SEQ ID NO: 7101626 - DNA, 22 bp, Homo sapiens
ggctgctggagttgggtctctc

SEQ ID NO: 7101627 - DNA, 22 bp, Homo sapiens
ggctgctggattgtgtatctgt

SEQ ID NO: 7101628 - DNA, 22 bp, Homo sapiens
ggctgctggaagactgaacaag

SEQ ID NO: 7101629 - DNA, 22 bp, Homo sapiens
ggctgctggagttgggtctctc

SEQ ID NO: 7101630 - DNA, 22 bp, Homo sapiens
ggctgctgctgtgtaggcctgt

SEQ ID NO: 7101631 - DNA, 22 bp, Homo sapiens
ggctgctggaagactgaacaag

SEQ ID NO: 7101632 - DNA, 22 bp, Homo sapiens
ggctgctgctgtgtaggcctgt

SEQ ID NO: 7101633 - DNA, 22 bp, Homo sapiens
ggctgctgctgtgtaggcctgt

SEQ ID NO: 7101634 - DNA, 22 bp, Homo sapiens
ggctgctgctgtgtaggcctgt

SEQ ID NO: 7101635 - DNA, 22 bp, Homo sapiens
ggctgctgcccacccctgcatg

SEQ ID NO: 7101636 - DNA, 22 bp, Homo sapiens
ggctgctgccctcctaagtgca

SEQ ID NO: 7101637 - DNA, 22 bp, Homo sapiens
ggctgctgccctcctaagtgca

SEQ ID NO: 7101638 - DNA, 22 bp, Homo sapiens
ggctgctgccctcctaagtgca

SEQ ID NO: 7101639 - DNA, 22 bp, Homo sapiens
ggctgctgagttggccaggaga

SEQ ID NO: 7101640 - DNA, 22 bp, Homo sapiens
ggctgctgagttggccaggaga

SEQ ID NO: 7101641 - DNA, 22 bp, Homo sapiens
ggctgctgagttggccaggaga

SEQ ID NO: 7101642 - DNA, 22 bp, Homo sapiens
ggctgctgagttggccaggaga

SEQ ID NO: 7101643 - DNA, 22 bp, Homo sapiens
ggctgctgcccacccctgcatg

SEQ ID NO: 7101644 - DNA, 22 bp, Homo sapiens
ggctgctgacttcatccagctt

SEQ ID NO: 7101645 - DNA, 22 bp, Homo sapiens
ggctgctgagtcacgacagtga

SEQ ID NO: 7101646 - DNA, 22 bp, Homo sapiens
ggctgctgagttggccaggaga

SEQ ID NO: 7101647 - DNA, 22 bp, Homo sapiens
ggctgctgagttggccaggaga

SEQ ID NO: 7101648 - DNA, 22 bp, Homo sapiens
ggctgctgagttggccaggaga

SEQ ID NO: 7101649 - DNA, 22 bp, Homo sapiens
ggctgctgacaaacatgatcat

SEQ ID NO: 7101650 - DNA, 22 bp, Homo sapiens
ggctgctgacaaacatgatcat

SEQ ID NO: 7101651 - DNA, 22 bp, Homo sapiens
ggctgctgaagtgtggcaatct

SEQ ID NO: 7101652 - DNA, 22 bp, Homo sapiens
ggctgctgacaaacatgatcat

SEQ ID NO: 7101653 - DNA, 22 bp, Homo sapiens
ggctgctgacaaacatgatcat

SEQ ID NO: 7101654 - DNA, 22 bp, Homo sapiens
ggctgctgacttcatccagctt

SEQ ID NO: 7101655 - DNA, 22 bp, Homo sapiens
ggctgctgacttcatccagctt

SEQ ID NO: 7101656 - DNA, 22 bp, Homo sapiens
ggctgctgaagtgtggcaatct

SEQ ID NO: 7101657 - DNA, 22 bp, Homo sapiens
ggctgctgaagtgtggcaatct

SEQ ID NO: 7101658 - DNA, 19 bp, Homo sapiens
ggctgctgaagagaattac

SEQ ID NO: 7101659 - DNA, 19 bp, Homo sapiens
ggctgctgaagagaattac

SEQ ID NO: 7101660 - DNA, 22 bp, Homo sapiens
ggctgctgaagtgtggcaatct

SEQ ID NO: 7101661 - DNA, 22 bp, Homo sapiens
ggctgagcactttaggcaggag

SEQ ID NO: 7101662 - DNA, 22 bp, Homo sapiens
ggctgagcactttaggcaggag

SEQ ID NO: 7101663 - DNA, 22 bp, Homo sapiens
ggctgagcaattttgatgacat

SEQ ID NO: 7101664 - DNA, 22 bp, Homo sapiens
ggctgagagtggatcccaggga

SEQ ID NO: 7101665 - DNA, 22 bp, Homo sapiens
ggctgggcaggtctgcacaggg

SEQ ID NO: 7101666 - DNA, 22 bp, Homo sapiens
ggctgggcaggtctgcacaggg

SEQ ID NO: 7101667 - DNA, 22 bp, Homo sapiens
ggctgggcaggtctgcacaggg

SEQ ID NO: 7101668 - DNA, 22 bp, Homo sapiens
ggctgggcaggtctgcacaggg

SEQ ID NO: 7101669 - DNA, 22 bp, Homo sapiens
ggctgggcaggtctgcacaggg

SEQ ID NO: 7101670 - DNA, 21 bp, Homo sapiens
ggctgggcaggacccacccct

SEQ ID NO: 7101671 - DNA, 21 bp, Homo sapiens
ggctgggcaggacccacccct

SEQ ID NO: 7101672 - DNA, 22 bp, Homo sapiens
ggctgggcaggtctgcacaggg

SEQ ID NO: 7101673 - DNA, 22 bp, Homo sapiens
ggctgggcatccatccatgaga

SEQ ID NO: 7101674 - DNA, 22 bp, Homo sapiens
ggctgggcatccatccatgaga

SEQ ID NO: 7101675 - DNA, 22 bp, Homo sapiens
ggctgggcatccatccatgaga

SEQ ID NO: 7101676 - DNA, 22 bp, Homo sapiens
ggctgggcatccatccatgaga

SEQ ID NO: 7101677 - DNA, 22 bp, Homo sapiens
ggctgggccagggcctgtggac

SEQ ID NO: 7101678 - DNA, 22 bp, Homo sapiens
ggctgggccagggcctgtggac

SEQ ID NO: 7101679 - DNA, 22 bp, Homo sapiens
ggctgggccagggcctgtggac

SEQ ID NO: 7101680 - DNA, 22 bp, Homo sapiens
ggctgggccagggcctgtggac

SEQ ID NO: 7101681 - DNA, 22 bp, Homo sapiens
ggctgggccagggcctgtggac

SEQ ID NO: 7101682 - DNA, 19 bp, Homo sapiens
ggctgggccctgtttctcc

SEQ ID NO: 7101683 - DNA, 22 bp, Homo sapiens
ggctgggccagggcctgtggac

SEQ ID NO: 7101684 - DNA, 22 bp, Homo sapiens
ggctgggctccgggagcatgcg

SEQ ID NO: 7101685 - DNA, 22 bp, Homo sapiens
ggctgggctccgggagcatgcg

SEQ ID NO: 7101686 - DNA, 22 bp, Homo sapiens
ggctgggctccgggagcatgcg

SEQ ID NO: 7101687 - DNA, 22 bp, Homo sapiens
ggctgggcctctccctcagctg

SEQ ID NO: 7101688 - DNA, 22 bp, Homo sapiens
ggctgggcctctccctcagctg

SEQ ID NO: 7101689 - DNA, 22 bp, Homo sapiens
ggctgggcctctccctcagctg

SEQ ID NO: 7101690 - DNA, 19 bp, Homo sapiens
ggctgggccctgtttctcc

SEQ ID NO: 7101691 - DNA, 22 bp, Homo sapiens
ggctgggccgcggctacccaga

SEQ ID NO: 7101692 - DNA, 22 bp, Homo sapiens
ggctgggccgcggctacccaga

SEQ ID NO: 7101693 - DNA, 22 bp, Homo sapiens
ggctgggccgcggctacccaga

SEQ ID NO: 7101694 - DNA, 22 bp, Homo sapiens
ggctgggccgcggctacccaga

SEQ ID NO: 7101695 - DNA, 22 bp, Homo sapiens
ggctgggcctctccctcagctg

SEQ ID NO: 7101696 - DNA, 22 bp, Homo sapiens
ggctgggcctctccctcagctg

SEQ ID NO: 7101697 - DNA, 22 bp, Homo sapiens
ggctgggctcgctgattggctg

SEQ ID NO: 7101698 - DNA, 22 bp, Homo sapiens
ggctgggctcgctgattggctg

SEQ ID NO: 7101699 - DNA, 22 bp, Homo sapiens
ggctgggctcgctgattggctg

SEQ ID NO: 7101700 - DNA, 22 bp, Homo sapiens
ggctgggctcgctgattggctg

SEQ ID NO: 7101701 - DNA, 22 bp, Homo sapiens
ggctgggctccgggagcatgcg

SEQ ID NO: 7101702 - DNA, 22 bp, Homo sapiens
ggctgggctccgggagcatgcg

SEQ ID NO: 7101703 - DNA, 22 bp, Homo sapiens
ggctgggctccgggagcatgcg

SEQ ID NO: 7101704 - DNA, 22 bp, Homo sapiens
ggctgggctccgggagcatgcg

SEQ ID NO: 7101705 - DNA, 22 bp, Homo sapiens
ggctgggctccgggagcatgcg

SEQ ID NO: 7101706 - DNA, 22 bp, Homo sapiens
ggcttctgagtgctctgctgtt

SEQ ID NO: 7101707 - DNA, 22 bp, Homo sapiens
ggcttctgagtgctctgctgtt

SEQ ID NO: 7101708 - DNA, 22 bp, Homo sapiens
ggcttctgaaatctctgtgcgt

SEQ ID NO: 7101709 - DNA, 22 bp, Homo sapiens
ggcttctctgtctagtttctac

SEQ ID NO: 7101710 - DNA, 18 bp, Homo sapiens
ggcttctctgtttatttc

SEQ ID NO: 7101711 - DNA, 22 bp, Homo sapiens
ggcttctgccttgccagttctt

SEQ ID NO: 7101712 - DNA, 22 bp, Homo sapiens
ggcttctggtaaagaccacacc

SEQ ID NO: 7101713 - DNA, 22 bp, Homo sapiens
ggcttctggtgggagcatgact

SEQ ID NO: 7101714 - DNA, 22 bp, Homo sapiens
ggcttctgtcctctggatctgt

SEQ ID NO: 7101715 - DNA, 22 bp, Homo sapiens
ggcttctgtctcaagcaccagc

SEQ ID NO: 7101716 - DNA, 22 bp, Homo sapiens
ggcttctcccattcttcagggg

SEQ ID NO: 7101717 - DNA, 22 bp, Homo sapiens
ggcttctcctggaagtacagag

SEQ ID NO: 7101718 - DNA, 22 bp, Homo sapiens
ggctgggctgctgggtcagagc

SEQ ID NO: 7101719 - DNA, 22 bp, Homo sapiens
ggctgggctgctgggtcagagc

SEQ ID NO: 7101720 - DNA, 22 bp, Homo sapiens
ggctgggctgctgggtcagagc

SEQ ID NO: 7101721 - DNA, 22 bp, Homo sapiens
ggctgggctgctgggtcagagc

SEQ ID NO: 7101722 - DNA, 22 bp, Homo sapiens
ggctgggctgctgggtcagagc

SEQ ID NO: 7101723 - DNA, 22 bp, Homo sapiens
ggctgggctgctgggtcagagc

SEQ ID NO: 7101724 - DNA, 22 bp, Homo sapiens
ggctgggctgcggctgtacctg

SEQ ID NO: 7101725 - DNA, 22 bp, Homo sapiens
ggctgggctgcggctgtacctg

SEQ ID NO: 7101726 - DNA, 22 bp, Homo sapiens
ggctgggctgcggctgtacctg

SEQ ID NO: 7101727 - DNA, 22 bp, Homo sapiens
ggctgggctgcggctgtacctg

SEQ ID NO: 7101728 - DNA, 21 bp, Homo sapiens
ggcaagaaacacaatcaagta

SEQ ID NO: 7101729 - DNA, 22 bp, Homo sapiens
ggcaagagggcagatggagtgc

SEQ ID NO: 7101730 - DNA, 21 bp, Homo sapiens
ggcaacagatattttgcttag

SEQ ID NO: 7101731 - DNA, 17 bp, Homo sapiens
ggcaacatgttcttctg

SEQ ID NO: 7101732 - DNA, 17 bp, Homo sapiens
ggcaacatgttcttctg

SEQ ID NO: 7101733 - DNA, 22 bp, Homo sapiens
ggcaacattctccagatccttt

SEQ ID NO: 7101734 - DNA, 21 bp, Homo sapiens
ggcaagaaacacaatcaagta

SEQ ID NO: 7101735 - DNA, 22 bp, Homo sapiens
ggcaaaggaaaacgtctcagct

SEQ ID NO: 7101736 - DNA, 22 bp, Homo sapiens
ggcaaaggaaaacgtctcagct

SEQ ID NO: 7101737 - DNA, 21 bp, Homo sapiens
ggcaacagatattttgcttag

SEQ ID NO: 7101738 - DNA, 22 bp, Homo sapiens
ggcaacaactggacatagctgg

SEQ ID NO: 7101739 - DNA, 22 bp, Homo sapiens
ggcaaagttttcatctcataac

SEQ ID NO: 7101740 - DNA, 18 bp, Homo sapiens
ggcaaatgcaattcaaag

SEQ ID NO: 7101741 - DNA, 22 bp, Homo sapiens
ggcaaatgtggtggcttttctg

SEQ ID NO: 7101742 - DNA, 20 bp, Homo sapiens
ggcaagcaactgagggagga

SEQ ID NO: 7101743 - DNA, 20 bp, Homo sapiens
ggcaagcaactgagggagga

SEQ ID NO: 7101744 - DNA, 22 bp, Homo sapiens
ggcaaggaagaagccatgatgt

SEQ ID NO: 7101745 - DNA, 22 bp, Homo sapiens
ggcacagcaggagctatgtgaa

SEQ ID NO: 7101746 - DNA, 22 bp, Homo sapiens
ggcacagcaggagctatgtgaa

SEQ ID NO: 7101747 - DNA, 22 bp, Homo sapiens
ggcaagagttgaagctccagga

SEQ ID NO: 7101748 - DNA, 22 bp, Homo sapiens
ggcaagagttgaagctccagga

SEQ ID NO: 7101749 - DNA, 22 bp, Homo sapiens
ggcaagatccaaggggctagga

SEQ ID NO: 7101750 - DNA, 22 bp, Homo sapiens
ggcaagagtgaggagtgtctct

SEQ ID NO: 7101751 - DNA, 22 bp, Homo sapiens
ggcaagaggtccaagaggtctc

SEQ ID NO: 7101752 - DNA, 22 bp, Homo sapiens
ggcaagaggtccaagaggtctc

SEQ ID NO: 7101753 - DNA, 22 bp, Homo sapiens
ggcaagaggtccaagaggtctc

SEQ ID NO: 7101754 - DNA, 22 bp, Homo sapiens
ggcaagaggtccaagaggtctc

SEQ ID NO: 7101755 - DNA, 22 bp, Homo sapiens
ggcaagaggtccaagaggtctc

SEQ ID NO: 7101756 - DNA, 22 bp, Homo sapiens
ggcaagaggtccaagaggtctc

SEQ ID NO: 7101757 - DNA, 22 bp, Homo sapiens
ggcaaaagtattatctctttaa

SEQ ID NO: 7101758 - DNA, 22 bp, Homo sapiens
ggcaaactacatttttgaaata

SEQ ID NO: 7101759 - DNA, 22 bp, Homo sapiens
ggcaaagaaccacaccacgtgt

SEQ ID NO: 7101760 - DNA, 22 bp, Homo sapiens
ggcaaagagacatgcatcgggg

SEQ ID NO: 7101761 - DNA, 22 bp, Homo sapiens
ggcaaagagatgatctttgcaa

SEQ ID NO: 7101762 - DNA, 22 bp, Homo sapiens
ggcaaagagatgatctttgcaa

SEQ ID NO: 7101763 - DNA, 23 bp, Homo sapiens
ggagtgcaatggcgccatctcgg

SEQ ID NO: 7101764 - DNA, 23 bp, Homo sapiens
ggagtgcaatggcgccatctcgg

SEQ ID NO: 7101765 - DNA, 22 bp, Homo sapiens
ggagtgagtactggagtagctg

SEQ ID NO: 7101766 - DNA, 22 bp, Homo sapiens
ggagtgagtactggagtagctg

SEQ ID NO: 7101767 - DNA, 22 bp, Homo sapiens
ggagtgagtactggagtagctg

SEQ ID NO: 7101768 - DNA, 22 bp, Homo sapiens
ggagtgagtggccttgtcactg

SEQ ID NO: 7101769 - DNA, 22 bp, Homo sapiens
ggagtgcagctcacaggacatc

SEQ ID NO: 7101770 - DNA, 22 bp, Homo sapiens
ggagtgcagctcacaggacatc

SEQ ID NO: 7101771 - DNA, 22 bp, Homo sapiens
ggagtgcagtggctattaaccg

SEQ ID NO: 7101772 - DNA, 22 bp, Homo sapiens
ggagtgcagtggtgggatctca

SEQ ID NO: 7101773 - DNA, 22 bp, Homo sapiens
ggagtctgattttttatgggtg

SEQ ID NO: 7101774 - DNA, 22 bp, Homo sapiens
ggagtctgatactgagttcctc

SEQ ID NO: 7101775 - DNA, 22 bp, Homo sapiens
ggagtctgactctgaccctgga

SEQ ID NO: 7101776 - DNA, 22 bp, Homo sapiens
ggagtctgagcttgtgtcctgg

SEQ ID NO: 7101777 - DNA, 22 bp, Homo sapiens
ggagtctgagcttgtgtcctgg

SEQ ID NO: 7101778 - DNA, 22 bp, Homo sapiens
ggagtcctgtgtcttccaggaa

SEQ ID NO: 7101779 - DNA, 22 bp, Homo sapiens
ggagtctagggtcctgggcctg

SEQ ID NO: 7101780 - DNA, 22 bp, Homo sapiens
ggagtctgacccttagagatga

SEQ ID NO: 7101781 - DNA, 21 bp, Homo sapiens
ggagtcattagtcatttcctt

SEQ ID NO: 7101782 - DNA, 21 bp, Homo sapiens
ggagtcattagtcatttcctt

SEQ ID NO: 7101783 - DNA, 22 bp, Homo sapiens
ggagtccaacgtgcagccagga

SEQ ID NO: 7101784 - DNA, 22 bp, Homo sapiens
ggagtcaccaagtaggagtctt

SEQ ID NO: 7101785 - DNA, 22 bp, Homo sapiens
ggagtcacctgggaggactggg

SEQ ID NO: 7101786 - DNA, 22 bp, Homo sapiens
ggagtcacctgggaggactggg

SEQ ID NO: 7101787 - DNA, 22 bp, Homo sapiens
ggagtcaccaagtaggagtctt

SEQ ID NO: 7101788 - DNA, 22 bp, Homo sapiens
ggagtcaccaagtaggagtctt

SEQ ID NO: 7101789 - DNA, 20 bp, Homo sapiens
ggagtcacattctttactgc

SEQ ID NO: 7101790 - DNA, 20 bp, Homo sapiens
ggagtcaccaagagagaccc

SEQ ID NO: 7101791 - DNA, 22 bp, Homo sapiens
ggagtcagaatggcagggtggt

SEQ ID NO: 7101792 - DNA, 22 bp, Homo sapiens
ggagtcagaatggcagggtggt

SEQ ID NO: 7101793 - DNA, 22 bp, Homo sapiens
ggagtcagaatggcagggtggt

SEQ ID NO: 7101794 - DNA, 19 bp, Homo sapiens
ggagtcactagaagccatc

SEQ ID NO: 7101795 - DNA, 22 bp, Homo sapiens
ggagtcagaacccaggcttcta

SEQ ID NO: 7101796 - DNA, 22 bp, Homo sapiens
ggagtcagcctgtcagagtgta

SEQ ID NO: 7101797 - DNA, 22 bp, Homo sapiens
ggagtcagcctgtcagagtgta

SEQ ID NO: 7101798 - DNA, 21 bp, Homo sapiens
ggagtcagggtctggctgggg

SEQ ID NO: 7101799 - DNA, 22 bp, Homo sapiens
ggagtcacacagagaagataag

SEQ ID NO: 7101800 - DNA, 22 bp, Homo sapiens
ggagtaggccccgggagagagt

SEQ ID NO: 7101801 - DNA, 22 bp, Homo sapiens
ggagtaggccccgggagagagt

SEQ ID NO: 7101802 - DNA, 22 bp, Homo sapiens
ggagtaggccccgggagagagt

SEQ ID NO: 7101803 - DNA, 17 bp, Homo sapiens
ggagccaggagcccacc

SEQ ID NO: 7101804 - DNA, 17 bp, Homo sapiens
ggagccaggagcccacc

SEQ ID NO: 7101805 - DNA, 19 bp, Homo sapiens
ggagccagctgtggaaggc

SEQ ID NO: 7101806 - DNA, 19 bp, Homo sapiens
ggagccagctgtggaaggc

SEQ ID NO: 7101807 - DNA, 19 bp, Homo sapiens
ggagccagctgtggaaggc

SEQ ID NO: 7101808 - DNA, 23 bp, Homo sapiens
ggagccagcctgtggggagcggg

SEQ ID NO: 7101809 - DNA, 23 bp, Homo sapiens
ggagccagcctgtggggagcggg

SEQ ID NO: 7101810 - DNA, 23 bp, Homo sapiens
ggagccagcctgtggggagcggg

SEQ ID NO: 7101811 - DNA, 23 bp, Homo sapiens
ggagccagcctgtggggagcggg

SEQ ID NO: 7101812 - DNA, 22 bp, Homo sapiens
ggagccagcagggtgacactga

SEQ ID NO: 7101813 - DNA, 23 bp, Homo sapiens
ggagccagcctgtggggagcggg

SEQ ID NO: 7101814 - DNA, 22 bp, Homo sapiens
ggagccagctccctccttgtga

SEQ ID NO: 7101815 - DNA, 22 bp, Homo sapiens
ggagccagctccctccttgtga

SEQ ID NO: 7101816 - DNA, 22 bp, Homo sapiens
ggagccagagtctgcagtgtaa

SEQ ID NO: 7101817 - DNA, 22 bp, Homo sapiens
ggagccagagtctgcagtgtaa

SEQ ID NO: 7101818 - DNA, 22 bp, Homo sapiens
ggagccagagtctgcagtgtaa

SEQ ID NO: 7101819 - DNA, 22 bp, Homo sapiens
ggagccagaggctgctgctgtg

SEQ ID NO: 7101820 - DNA, 22 bp, Homo sapiens
ggagccagagggatgcagttga

SEQ ID NO: 7101821 - DNA, 22 bp, Homo sapiens
ggagccagagggatgcagttga

SEQ ID NO: 7101822 - DNA, 22 bp, Homo sapiens
ggagccagagtctgcagtgtaa

SEQ ID NO: 7101823 - DNA, 22 bp, Homo sapiens
ggagccagcagggtgacactga

SEQ ID NO: 7101824 - DNA, 22 bp, Homo sapiens
ggagccagcagggtgacactga

SEQ ID NO: 7101825 - DNA, 22 bp, Homo sapiens
ggagccagagtttaatgtggag

SEQ ID NO: 7101826 - DNA, 22 bp, Homo sapiens
ggagccagagcactggggagcc

SEQ ID NO: 7101827 - DNA, 22 bp, Homo sapiens
ggagccagagcactggggagcc

SEQ ID NO: 7101828 - DNA, 22 bp, Homo sapiens
ggagccagaggctgctgctgtg

SEQ ID NO: 7101829 - DNA, 22 bp, Homo sapiens
ggagccagaggctgctgctgtg

SEQ ID NO: 7101830 - DNA, 22 bp, Homo sapiens
ggagccagaggctgctgctgtg

SEQ ID NO: 7101831 - DNA, 22 bp, Homo sapiens
ggagccagaggctgctgctgtg

SEQ ID NO: 7101832 - DNA, 22 bp, Homo sapiens
ggagccagaggctgctgctgtg

SEQ ID NO: 7101833 - DNA, 20 bp, Homo sapiens
ggcagagggcctgggagaag

SEQ ID NO: 7101834 - DNA, 20 bp, Homo sapiens
ggcagagggcctgggagaag

SEQ ID NO: 7101835 - DNA, 20 bp, Homo sapiens
ggcagagggcctgggagaag

SEQ ID NO: 7101836 - DNA, 20 bp, Homo sapiens
ggcagagggcctgggagaag

SEQ ID NO: 7101837 - DNA, 20 bp, Homo sapiens
ggcagagggcctgggagaag

SEQ ID NO: 7101838 - DNA, 20 bp, Homo sapiens
ggcagagggcctgggagaag

SEQ ID NO: 7101839 - DNA, 20 bp, Homo sapiens
ggcagagggcctgggagaag

SEQ ID NO: 7101840 - DNA, 22 bp, Homo sapiens
ggcagaggaggggtgaatttgc

SEQ ID NO: 7101841 - DNA, 22 bp, Homo sapiens
ggcagaggaggggtgaatttgc

SEQ ID NO: 7101842 - DNA, 22 bp, Homo sapiens
ggcagaggaggggtgaatttgc

SEQ ID NO: 7101843 - DNA, 22 bp, Homo sapiens
ggcagaggaggggtgaatttgc

SEQ ID NO: 7101844 - DNA, 22 bp, Homo sapiens
ggcagaggagctggaaacatgg

SEQ ID NO: 7101845 - DNA, 22 bp, Homo sapiens
ggcagaggagctggaaacatgg

SEQ ID NO: 7101846 - DNA, 22 bp, Homo sapiens
ggcagaggagctggaaacatgg

SEQ ID NO: 7101847 - DNA, 22 bp, Homo sapiens
ggcagaggagctggaaacatgg

SEQ ID NO: 7101848 - DNA, 22 bp, Homo sapiens
ggcagaggagctggaaacatgg

SEQ ID NO: 7101849 - DNA, 22 bp, Homo sapiens
ggcagaggagctggaaacatgg

SEQ ID NO: 7101850 - DNA, 22 bp, Homo sapiens
ggcagaggagctggaaacatgg

SEQ ID NO: 7101851 - DNA, 22 bp, Homo sapiens
ggcagaggagctggaaacatgg

SEQ ID NO: 7101852 - DNA, 22 bp, Homo sapiens
ggcagaggagctggaaacatgg

SEQ ID NO: 7101853 - DNA, 22 bp, Homo sapiens
ggcagaggagctggaaacatgg

SEQ ID NO: 7101854 - DNA, 22 bp, Homo sapiens
ggcagaggagctggaaacatgg

SEQ ID NO: 7101855 - DNA, 23 bp, Homo sapiens
ggcaccaggccatggagcgggag

SEQ ID NO: 7101856 - DNA, 22 bp, Homo sapiens
ggcaccaggatcagtctgtcat

SEQ ID NO: 7101857 - DNA, 23 bp, Homo sapiens
ggcaccaggccatggagcgggag

SEQ ID NO: 7101858 - DNA, 22 bp, Homo sapiens
ggcaccaggacatgactcccag

SEQ ID NO: 7101859 - DNA, 22 bp, Homo sapiens
ggcaccaggacatgactcccag

SEQ ID NO: 7101860 - DNA, 22 bp, Homo sapiens
ggcaccaggacatgactcccag

SEQ ID NO: 7101861 - DNA, 22 bp, Homo sapiens
ggcaccaggatcagtctgtcat

SEQ ID NO: 7101862 - DNA, 22 bp, Homo sapiens
ggcaccaggctgggcataggcc

SEQ ID NO: 7101863 - DNA, 22 bp, Homo sapiens
ggcaccaggctgggcataggcc

SEQ ID NO: 7101864 - DNA, 22 bp, Homo sapiens
ggcaccaggctgggcataggcc

SEQ ID NO: 7101865 - DNA, 22 bp, Homo sapiens
ggcagaggaagctggaagtggg

SEQ ID NO: 7101866 - DNA, 20 bp, Homo sapiens
ggcaccaggctaggattgga

SEQ ID NO: 7101867 - DNA, 20 bp, Homo sapiens
ggcaccaggctaggattgga

SEQ ID NO: 7101868 - DNA, 20 bp, Homo sapiens
ggcaccaggctaggattgga

SEQ ID NO: 7101869 - DNA, 22 bp, Homo sapiens
ggcagaggaagctggaagtggg

SEQ ID NO: 7101870 - DNA, 22 bp, Homo sapiens
ggcagaggaaggatgaattcac

SEQ ID NO: 7101871 - DNA, 22 bp, Homo sapiens
ggcagaggaagctggaagtggg

SEQ ID NO: 7101872 - DNA, 22 bp, Homo sapiens
ggcagaggaagctggaagtggg

SEQ ID NO: 7101873 - DNA, 22 bp, Homo sapiens
ggcagaggaagctggaagtggg

SEQ ID NO: 7101874 - DNA, 22 bp, Homo sapiens
ggcagaggaaggatgaattcac

SEQ ID NO: 7101875 - DNA, 22 bp, Homo sapiens
ggcagaggaaggatgaattcac

SEQ ID NO: 7101876 - DNA, 22 bp, Homo sapiens
ggcagaggaaggatgaattcac

SEQ ID NO: 7101877 - DNA, 22 bp, Homo sapiens
ggcagaggaaggatgaattcac

SEQ ID NO: 7101878 - DNA, 22 bp, Homo sapiens
ggcacaggaatctgtgaagtgc

SEQ ID NO: 7101879 - DNA, 22 bp, Homo sapiens
ggcacagctgatgcagacacac

SEQ ID NO: 7101880 - DNA, 22 bp, Homo sapiens
ggcacaggaatctgtgaagtgc

SEQ ID NO: 7101881 - DNA, 22 bp, Homo sapiens
ggcacagctcaggtcccagctc

SEQ ID NO: 7101882 - DNA, 22 bp, Homo sapiens
ggcacagctgatgcagacacac

SEQ ID NO: 7101883 - DNA, 22 bp, Homo sapiens
ggcacagctgatgcagacacac

SEQ ID NO: 7101884 - DNA, 17 bp, Homo sapiens
ggcaccagacggagagt

SEQ ID NO: 7101885 - DNA, 22 bp, Homo sapiens
ggcacatttataagtggacata

SEQ ID NO: 7101886 - DNA, 17 bp, Homo sapiens
ggcaccagacggagagt

SEQ ID NO: 7101887 - DNA, 17 bp, Homo sapiens
ggcaccagacggagagt

SEQ ID NO: 7101888 - DNA, 22 bp, Homo sapiens
ggcacaggagctagtcaaagcc

SEQ ID NO: 7101889 - DNA, 22 bp, Homo sapiens
ggcacaggagctagtcaaagcc

SEQ ID NO: 7101890 - DNA, 22 bp, Homo sapiens
ggcacatttataagtggacata

SEQ ID NO: 7101891 - DNA, 22 bp, Homo sapiens
ggcaccagcaggcaccgatgcc

SEQ ID NO: 7101892 - DNA, 22 bp, Homo sapiens
ggcaccagccacctatttctag

SEQ ID NO: 7101893 - DNA, 22 bp, Homo sapiens
ggcaccagcacttgggatggct

SEQ ID NO: 7101894 - DNA, 22 bp, Homo sapiens
ggcacagccctctctgtggaca

SEQ ID NO: 7101895 - DNA, 22 bp, Homo sapiens
ggcacagccctctctgtggaca

SEQ ID NO: 7101896 - DNA, 22 bp, Homo sapiens
ggcacagccctctctgtggaca

SEQ ID NO: 7101897 - DNA, 22 bp, Homo sapiens
ggcacagccctctctgtggaca

SEQ ID NO: 7101898 - DNA, 22 bp, Homo sapiens
ggcacagccctctctgtggaca

SEQ ID NO: 7101899 - DNA, 21 bp, Homo sapiens
ggcacagcctgaaatgcctca

SEQ ID NO: 7101900 - DNA, 21 bp, Homo sapiens
ggcacagcctgaaatgcctca

SEQ ID NO: 7101901 - DNA, 21 bp, Homo sapiens
ggcacagcctgaaatgcctca

SEQ ID NO: 7101902 - DNA, 22 bp, Homo sapiens
ggcacagcaggagctatgtgaa

SEQ ID NO: 7101903 - DNA, 22 bp, Homo sapiens
ggcaaggaagaagccatgatgt

SEQ ID NO: 7101904 - DNA, 22 bp, Homo sapiens
ggcacagccactttggagaact

SEQ ID NO: 7101905 - DNA, 22 bp, Homo sapiens
ggcacagccactttggagaact

SEQ ID NO: 7101906 - DNA, 22 bp, Homo sapiens
ggcacagccactttggagaact

SEQ ID NO: 7101907 - DNA, 22 bp, Homo sapiens
ggcacagccactttggagaact

SEQ ID NO: 7101908 - DNA, 22 bp, Homo sapiens
ggcacagccactttggagaact

SEQ ID NO: 7101909 - DNA, 22 bp, Homo sapiens
ggcacagcgactaccatcgaaa

SEQ ID NO: 7101910 - DNA, 22 bp, Homo sapiens
ggcacagcgactaccatcgaaa

SEQ ID NO: 7101911 - DNA, 22 bp, Homo sapiens
ggcacagcgactaccatcgaaa

SEQ ID NO: 7101912 - DNA, 22 bp, Homo sapiens
ggcacagcgactaccatcgaaa

SEQ ID NO: 7101913 - DNA, 22 bp, Homo sapiens
ggcacagcgactaccatcgaaa

SEQ ID NO: 7101914 - DNA, 22 bp, Homo sapiens
ggcacagcgactaccatcgaaa

SEQ ID NO: 7101915 - DNA, 22 bp, Homo sapiens
ggcacagcgactaccatcgaaa

SEQ ID NO: 7101916 - DNA, 22 bp, Homo sapiens
ggcacagctacttgctcactct

SEQ ID NO: 7101917 - DNA, 22 bp, Homo sapiens
ggcacagctacttgctcactct

SEQ ID NO: 7101918 - DNA, 22 bp, Homo sapiens
ggcacagctacttgctcactct

SEQ ID NO: 7101919 - DNA, 22 bp, Homo sapiens
ggcacagctacttgctcactct

SEQ ID NO: 7101920 - DNA, 22 bp, Homo sapiens
ggcacagctcaggtcccagctc

SEQ ID NO: 7101921 - DNA, 22 bp, Homo sapiens
ggcacagctcaggtcccagctc

SEQ ID NO: 7101922 - DNA, 22 bp, Homo sapiens
ggcaggcagaggctgagacagg

SEQ ID NO: 7101923 - DNA, 22 bp, Homo sapiens
ggcaggcagaaaaatagaatat

SEQ ID NO: 7101924 - DNA, 22 bp, Homo sapiens
ggcaggcagaaaaatagaatat

SEQ ID NO: 7101925 - DNA, 22 bp, Homo sapiens
ggcaggcagaaaaatagaatat

SEQ ID NO: 7101926 - DNA, 22 bp, Homo sapiens
ggcaggcactgtgctaggcgct

SEQ ID NO: 7101927 - DNA, 22 bp, Homo sapiens
ggcaggcactgtgttttgtgtt

SEQ ID NO: 7101928 - DNA, 22 bp, Homo sapiens
ggcaggcactgtgttttgtgtt

SEQ ID NO: 7101929 - DNA, 22 bp, Homo sapiens
ggcaggcagaaaaatagaatat

SEQ ID NO: 7101930 - DNA, 22 bp, Homo sapiens
ggcaggcagaaaaatagaatat

SEQ ID NO: 7101931 - DNA, 22 bp, Homo sapiens
ggcaggcactgtgctaggcgct

SEQ ID NO: 7101932 - DNA, 22 bp, Homo sapiens
ggcaggcactgtgctaggcgct

SEQ ID NO: 7101933 - DNA, 22 bp, Homo sapiens
ggcaggcactgtgctaggcgct

SEQ ID NO: 7101934 - DNA, 22 bp, Homo sapiens
ggcaggcactgtgctaggcgct

SEQ ID NO: 7101935 - DNA, 22 bp, Homo sapiens
ggcaggcactgtgatagattct

SEQ ID NO: 7101936 - DNA, 22 bp, Homo sapiens
ggcaggcactgtgctaggcgct

SEQ ID NO: 7101937 - DNA, 22 bp, Homo sapiens
ggcaggcactgtgctaggcgct

SEQ ID NO: 7101938 - DNA, 22 bp, Homo sapiens
ggcaggcactgtgctaggcgct

SEQ ID NO: 7101939 - DNA, 22 bp, Homo sapiens
ggcaggcaatgaggatgggaag

SEQ ID NO: 7101940 - DNA, 22 bp, Homo sapiens
ggcaggcaatgaggatgggaag

SEQ ID NO: 7101941 - DNA, 22 bp, Homo sapiens
ggcaggcacagtaatacatgtt

SEQ ID NO: 7101942 - DNA, 22 bp, Homo sapiens
ggcaggcacagtaatacatgtt

SEQ ID NO: 7101943 - DNA, 22 bp, Homo sapiens
ggcaggcacagtaatacatgtt

SEQ ID NO: 7101944 - DNA, 22 bp, Homo sapiens
ggcaggcacatttgggggccgt

SEQ ID NO: 7101945 - DNA, 22 bp, Homo sapiens
ggcaggcacatttgggggccgt

SEQ ID NO: 7101946 - DNA, 22 bp, Homo sapiens
ggcaggcacatttgggggccgt

SEQ ID NO: 7101947 - DNA, 22 bp, Homo sapiens
ggcaggcacatttgggggccgt

SEQ ID NO: 7101948 - DNA, 22 bp, Homo sapiens
ggcaggcacatttgggggccgt

SEQ ID NO: 7101949 - DNA, 22 bp, Homo sapiens
ggcaggcaccagctcagcaata

SEQ ID NO: 7101950 - DNA, 22 bp, Homo sapiens
ggcaggcaccagctcagcaata

SEQ ID NO: 7101951 - DNA, 22 bp, Homo sapiens
ggcaggcaccagctcagcaata

SEQ ID NO: 7101952 - DNA, 22 bp, Homo sapiens
ggcaggcaccagctcagcaata

SEQ ID NO: 7101953 - DNA, 22 bp, Homo sapiens
ggcaggcactgtgatagattct

SEQ ID NO: 7101954 - DNA, 22 bp, Homo sapiens
ggcaggcactgtgatagattct

SEQ ID NO: 7101955 - DNA, 22 bp, Homo sapiens
ggcaggcactgtgatagattct

SEQ ID NO: 7101956 - DNA, 18 bp, Homo sapiens
ggcaggatttcaactttc

SEQ ID NO: 7101957 - DNA, 22 bp, Homo sapiens
ggcaggaggtgagtggcgggtg

SEQ ID NO: 7101958 - DNA, 21 bp, Homo sapiens
ggcaggatggcagtggacccc

SEQ ID NO: 7101959 - DNA, 22 bp, Homo sapiens
ggcaggaggtgagtggcgggtg

SEQ ID NO: 7101960 - DNA, 22 bp, Homo sapiens
ggcaggaggtgagtggcgggtg

SEQ ID NO: 7101961 - DNA, 21 bp, Homo sapiens
ggcaggatggcagtggacccc

SEQ ID NO: 7101962 - DNA, 21 bp, Homo sapiens
ggcaggatggcagtggacccc

SEQ ID NO: 7101963 - DNA, 22 bp, Homo sapiens
ggcaggcaacggaccactagtc

SEQ ID NO: 7101964 - DNA, 22 bp, Homo sapiens
ggcaggcaacggaccactagtc

SEQ ID NO: 7101965 - DNA, 22 bp, Homo sapiens
ggcaggcaacggaccactagtc

SEQ ID NO: 7101966 - DNA, 22 bp, Homo sapiens
ggcaggcaacggaccactagtc

SEQ ID NO: 7101967 - DNA, 22 bp, Homo sapiens
ggcaggcaacggaccactagtc

SEQ ID NO: 7101968 - DNA, 22 bp, Homo sapiens
ggcaggcaacggaccactagtc

SEQ ID NO: 7101969 - DNA, 22 bp, Homo sapiens
ggcaggcaaggcagcctggtga

SEQ ID NO: 7101970 - DNA, 22 bp, Homo sapiens
ggcaggcaaggcagcctggtga

SEQ ID NO: 7101971 - DNA, 22 bp, Homo sapiens
ggcaggcaaggcagcctggtga

SEQ ID NO: 7101972 - DNA, 22 bp, Homo sapiens
ggcaggcaaggcagcctggtga

SEQ ID NO: 7101973 - DNA, 22 bp, Homo sapiens
ggcaggcaaggcagcctggtga

SEQ ID NO: 7101974 - DNA, 22 bp, Homo sapiens
ggcaggcaagtctgctctgtga

SEQ ID NO: 7101975 - DNA, 22 bp, Homo sapiens
ggcaggcaaggcagcctggtga

SEQ ID NO: 7101976 - DNA, 22 bp, Homo sapiens
ggcaggcaagtctgctctgtga

SEQ ID NO: 7101977 - DNA, 22 bp, Homo sapiens
ggcaggcaagtctgctctgtga

SEQ ID NO: 7101978 - DNA, 22 bp, Homo sapiens
ggcaggcaatgaggatgggaag

SEQ ID NO: 7101979 - DNA, 22 bp, Homo sapiens
ggcaggcaatgaggatgggaag

SEQ ID NO: 7101980 - DNA, 22 bp, Homo sapiens
ggcaggcaatgaggatgggaag

SEQ ID NO: 7101981 - DNA, 22 bp, Homo sapiens
ggcaggcaatgaggatgggaag

SEQ ID NO: 7101982 - DNA, 22 bp, Homo sapiens
ggcaggcaatgaggatgggaag

SEQ ID NO: 7101983 - DNA, 22 bp, Homo sapiens
ggcaggcaatgaggatgggaag

SEQ ID NO: 7101984 - DNA, 22 bp, Homo sapiens
ggcaggcaatgaggatgggaag

SEQ ID NO: 7101985 - DNA, 22 bp, Homo sapiens
ggcagaggtagctggaaccagg

SEQ ID NO: 7101986 - DNA, 22 bp, Homo sapiens
ggcagaggtagctggaaccagg

SEQ ID NO: 7101987 - DNA, 22 bp, Homo sapiens
ggcagaggtagctggaaccagg

SEQ ID NO: 7101988 - DNA, 22 bp, Homo sapiens
ggcagaggtagctggaaccagg

SEQ ID NO: 7101989 - DNA, 22 bp, Homo sapiens
ggcagaggtagctggaaccagg

SEQ ID NO: 7101990 - DNA, 22 bp, Homo sapiens
ggcagaggtagctggaaccagg

SEQ ID NO: 7101991 - DNA, 20 bp, Homo sapiens
ggcagagggcctgggagaag

SEQ ID NO: 7101992 - DNA, 20 bp, Homo sapiens
ggcagagggcctgggagaag

SEQ ID NO: 7101993 - DNA, 22 bp, Homo sapiens
ggcagaggtagctggaaccagg

SEQ ID NO: 7101994 - DNA, 22 bp, Homo sapiens
ggcagaggtagctggaaccagg

SEQ ID NO: 7101995 - DNA, 22 bp, Homo sapiens
ggcagaggtagctggaaccagg

SEQ ID NO: 7101996 - DNA, 22 bp, Homo sapiens
ggcagaggtagctggaaccagg

SEQ ID NO: 7101997 - DNA, 20 bp, Homo sapiens
ggcagagggcctgggagaag

SEQ ID NO: 7101998 - DNA, 20 bp, Homo sapiens
ggcagagggcctgggagaag

SEQ ID NO: 7101999 - DNA, 20 bp, Homo sapiens
ggcagagggcctgggagaag

SEQ ID NO: 7102000 - DNA, 20 bp, Homo sapiens
ggcagagggcctgggagaag

SEQ ID NO: 7102001 - DNA, 22 bp, Homo sapiens
ggcaggaggtgagtggcgggtg

SEQ ID NO: 7102002 - DNA, 22 bp, Homo sapiens
ggcaggaggtgagtggcgggtg

SEQ ID NO: 7102003 - DNA, 22 bp, Homo sapiens
ggcaggaggtgagtggcgggtg

SEQ ID NO: 7102004 - DNA, 22 bp, Homo sapiens
ggcaggaggtgagtggcgggtg

SEQ ID NO: 7102005 - DNA, 22 bp, Homo sapiens
ggcaggaggtgagtggcgggtg

SEQ ID NO: 7102006 - DNA, 22 bp, Homo sapiens
ggcaggaggtgagtggcgggtg

SEQ ID NO: 7102007 - DNA, 22 bp, Homo sapiens
ggcaggaggtgagtggcgggtg

SEQ ID NO: 7102008 - DNA, 22 bp, Homo sapiens
ggcaggagggcggacaatgacc

SEQ ID NO: 7102009 - DNA, 22 bp, Homo sapiens
ggcaggaggaagagttagcacc

SEQ ID NO: 7102010 - DNA, 22 bp, Homo sapiens
ggcagaggtagctggaaccagg

SEQ ID NO: 7102011 - DNA, 22 bp, Homo sapiens
ggcagaggtagctggaaccagg

SEQ ID NO: 7102012 - DNA, 22 bp, Homo sapiens
ggcagaggtagctggaaccagg

SEQ ID NO: 7102013 - DNA, 22 bp, Homo sapiens
ggcagaggtagctggaaccagg

SEQ ID NO: 7102014 - DNA, 22 bp, Homo sapiens
ggcagaggtagctggaaccagg

SEQ ID NO: 7102015 - DNA, 22 bp, Homo sapiens
ggcagaggtagctggaaccagg

SEQ ID NO: 7102016 - DNA, 22 bp, Homo sapiens
ggcaggaggaagagttagcacc

SEQ ID NO: 7102017 - DNA, 22 bp, Homo sapiens
ggcgaggccgggacaggctgga

SEQ ID NO: 7102018 - DNA, 20 bp, Homo sapiens
ggcgagctgggctctgtgca

SEQ ID NO: 7102019 - DNA, 22 bp, Homo sapiens
ggcgaggccgggacaggctgga

SEQ ID NO: 7102020 - DNA, 22 bp, Homo sapiens
ggcgaggccgggacaggctgga

SEQ ID NO: 7102021 - DNA, 22 bp, Homo sapiens
ggcgctggccacggtggctctg

SEQ ID NO: 7102022 - DNA, 22 bp, Homo sapiens
ggcgctggtggtcttgcgagcg

SEQ ID NO: 7102023 - DNA, 22 bp, Homo sapiens
ggcgctggtggtcttgcgagcg

SEQ ID NO: 7102024 - DNA, 22 bp, Homo sapiens
ggccttggttccaaagcaggca

SEQ ID NO: 7102025 - DNA, 22 bp, Homo sapiens
ggccttggttccaaagcaggca

SEQ ID NO: 7102026 - DNA, 22 bp, Homo sapiens
ggccttggtggctttgctgatg

SEQ ID NO: 7102027 - DNA, 22 bp, Homo sapiens
ggccttggttccaaagcaggca

SEQ ID NO: 7102028 - DNA, 22 bp, Homo sapiens
ggccttggttctgtcacagccg

SEQ ID NO: 7102029 - DNA, 21 bp, Homo sapiens
ggccttgtaacagagttgacc

SEQ ID NO: 7102030 - DNA, 22 bp, Homo sapiens
ggccttgtggaaggtatgagca

SEQ ID NO: 7102031 - DNA, 22 bp, Homo sapiens
ggccttttgtgtccttgcccgt

SEQ ID NO: 7102032 - DNA, 19 bp, Homo sapiens
ggcgaagcgcttggagtag

SEQ ID NO: 7102033 - DNA, 17 bp, Homo sapiens
ggccttgggctgctctt

SEQ ID NO: 7102034 - DNA, 22 bp, Homo sapiens
ggccttgggctggctgcagtat

SEQ ID NO: 7102035 - DNA, 22 bp, Homo sapiens
ggccttgggctggctgcagtat

SEQ ID NO: 7102036 - DNA, 22 bp, Homo sapiens
ggccttggggaggatggtgtcc

SEQ ID NO: 7102037 - DNA, 22 bp, Homo sapiens
ggccttggggtggccttgtccc

SEQ ID NO: 7102038 - DNA, 22 bp, Homo sapiens
ggccttgggtataggtgggtat

SEQ ID NO: 7102039 - DNA, 22 bp, Homo sapiens
ggccttgggtataggtgggtat

SEQ ID NO: 7102040 - DNA, 20 bp, Homo sapiens
ggccttgggtttcgcctgtt

SEQ ID NO: 7102041 - DNA, 22 bp, Homo sapiens
ggccttggtaaagggatgcatg

SEQ ID NO: 7102042 - DNA, 22 bp, Homo sapiens
ggccttggtaaagggatgcatg

SEQ ID NO: 7102043 - DNA, 20 bp, Homo sapiens
ggccttgggtttcgcctgtt

SEQ ID NO: 7102044 - DNA, 22 bp, Homo sapiens
ggccttggtaaagggatgcatg

SEQ ID NO: 7102045 - DNA, 22 bp, Homo sapiens
ggccttggtaaagggatgcatg

SEQ ID NO: 7102046 - DNA, 22 bp, Homo sapiens
ggccttggtaaattggcatttg

SEQ ID NO: 7102047 - DNA, 22 bp, Homo sapiens
ggccttggtaaattggcatttg

SEQ ID NO: 7102048 - DNA, 22 bp, Homo sapiens
ggccttggtaatgggggactgt

SEQ ID NO: 7102049 - DNA, 22 bp, Homo sapiens
ggccttggtaatgggggactgt

SEQ ID NO: 7102050 - DNA, 22 bp, Homo sapiens
ggccttggtaatgggggactgt

SEQ ID NO: 7102051 - DNA, 22 bp, Homo sapiens
ggccttggtgccatggccagtt

SEQ ID NO: 7102052 - DNA, 22 bp, Homo sapiens
ggccttggtgccatggccagtt

SEQ ID NO: 7102053 - DNA, 22 bp, Homo sapiens
ggccttggtgccatggccagtt

SEQ ID NO: 7102054 - DNA, 22 bp, Homo sapiens
ggccttggtgccatggccagtt

SEQ ID NO: 7102055 - DNA, 22 bp, Homo sapiens
ggccttggtgctctgtgttgca

SEQ ID NO: 7102056 - DNA, 22 bp, Homo sapiens
ggccttggtggctttgctgatg

SEQ ID NO: 7102057 - DNA, 22 bp, Homo sapiens
ggcctgagggtgggctctcagt

SEQ ID NO: 7102058 - DNA, 21 bp, Homo sapiens
ggcctgagtataggacaggcc

SEQ ID NO: 7102059 - DNA, 21 bp, Homo sapiens
ggcctgagtataggacaggcc

SEQ ID NO: 7102060 - DNA, 22 bp, Homo sapiens
ggcctgagggtgggctctcagt

SEQ ID NO: 7102061 - DNA, 22 bp, Homo sapiens
ggcctgagggtgggctctcagt

SEQ ID NO: 7102062 - DNA, 22 bp, Homo sapiens
ggcctgagggtgggctctcagt

SEQ ID NO: 7102063 - DNA, 22 bp, Homo sapiens
ggcctgagaatgtaccagatct

SEQ ID NO: 7102064 - DNA, 22 bp, Homo sapiens
ggcctgagaatgtaccagatct

SEQ ID NO: 7102065 - DNA, 22 bp, Homo sapiens
ggcctgagaaccatggggccaa

SEQ ID NO: 7102066 - DNA, 21 bp, Homo sapiens
ggcctgagcacctgtccacct

SEQ ID NO: 7102067 - DNA, 22 bp, Homo sapiens
ggcctgagaaccatggggccaa

SEQ ID NO: 7102068 - DNA, 22 bp, Homo sapiens
ggcctgagaaccatggggccaa

SEQ ID NO: 7102069 - DNA, 22 bp, Homo sapiens
ggcctgagaaccatggggccaa

SEQ ID NO: 7102070 - DNA, 22 bp, Homo sapiens
ggcctgaatgcctgagtgtggg

SEQ ID NO: 7102071 - DNA, 22 bp, Homo sapiens
ggcctgacaagtgggaagaggc

SEQ ID NO: 7102072 - DNA, 22 bp, Homo sapiens
ggcctgactaatcaggatgaat

SEQ ID NO: 7102073 - DNA, 22 bp, Homo sapiens
ggcctgaaataaagtagcagaa

SEQ ID NO: 7102074 - DNA, 22 bp, Homo sapiens
ggcctgaaatagctctgaggtt

SEQ ID NO: 7102075 - DNA, 22 bp, Homo sapiens
ggcctgaaatagctctgaggtt

SEQ ID NO: 7102076 - DNA, 22 bp, Homo sapiens
ggcctgagtcccacctggctgt

SEQ ID NO: 7102077 - DNA, 22 bp, Homo sapiens
ggcctgagtcccacctggctgt

SEQ ID NO: 7102078 - DNA, 22 bp, Homo sapiens
ggcctgagtcccacctggctgt

SEQ ID NO: 7102079 - DNA, 22 bp, Homo sapiens
ggcctgagtcccacctggctgt

SEQ ID NO: 7102080 - DNA, 22 bp, Homo sapiens
ggcctgagtcacatcaggagag

SEQ ID NO: 7102081 - DNA, 21 bp, Homo sapiens
ggcctgagtataggacaggcc

SEQ ID NO: 7102082 - DNA, 21 bp, Homo sapiens
ggcctgagtataggacaggcc

SEQ ID NO: 7102083 - DNA, 22 bp, Homo sapiens
ggcctgagtcacatcaggagag

SEQ ID NO: 7102084 - DNA, 22 bp, Homo sapiens
ggcctgagtcacatcaggagag

SEQ ID NO: 7102085 - DNA, 22 bp, Homo sapiens
ggcctgagtcacatcaggagag

SEQ ID NO: 7102086 - DNA, 17 bp, Homo sapiens
ggcctgcacctcctgct

SEQ ID NO: 7102087 - DNA, 17 bp, Homo sapiens
ggcctgcacctcctgct

SEQ ID NO: 7102088 - DNA, 22 bp, Homo sapiens
ggcctgcacagaggtggctcta

SEQ ID NO: 7102089 - DNA, 22 bp, Homo sapiens
ggcctgcacagaggtggctcta

SEQ ID NO: 7102090 - DNA, 22 bp, Homo sapiens
ggcctgcacagaggtggctcta

SEQ ID NO: 7102091 - DNA, 17 bp, Homo sapiens
ggcctgcacctcctgct

SEQ ID NO: 7102092 - DNA, 17 bp, Homo sapiens
ggcctgcacctcctgct

SEQ ID NO: 7102093 - DNA, 18 bp, Homo sapiens
ggcctgcagtgaagcaag

SEQ ID NO: 7102094 - DNA, 19 bp, Homo sapiens
ggcctgcccaatgtctgct

SEQ ID NO: 7102095 - DNA, 22 bp, Homo sapiens
ggccatggcgggagccggcgtc

SEQ ID NO: 7102096 - DNA, 19 bp, Homo sapiens
ggccatggcgggggtcaca

SEQ ID NO: 7102097 - DNA, 19 bp, Homo sapiens
ggccatggcgggggtcaca

SEQ ID NO: 7102098 - DNA, 19 bp, Homo sapiens
ggccatggcgggggtcaca

SEQ ID NO: 7102099 - DNA, 19 bp, Homo sapiens
ggccatggcgggggtcaca

SEQ ID NO: 7102100 - DNA, 22 bp, Homo sapiens
ggcctcagagaaggctgtgcgg

SEQ ID NO: 7102101 - DNA, 22 bp, Homo sapiens
ggcctcagagaaggctgtgcgg

SEQ ID NO: 7102102 - DNA, 22 bp, Homo sapiens
ggcctcagagaaggctgtgcgg

SEQ ID NO: 7102103 - DNA, 23 bp, Homo sapiens
ggccatggagacttagaatgggc

SEQ ID NO: 7102104 - DNA, 23 bp, Homo sapiens
ggccatggagacttagaatgggc

SEQ ID NO: 7102105 - DNA, 23 bp, Homo sapiens
ggccatggagacttagaatgggc

SEQ ID NO: 7102106 - DNA, 23 bp, Homo sapiens
ggccatggagacttagaatgggc

SEQ ID NO: 7102107 - DNA, 23 bp, Homo sapiens
ggccatggagacttagaatgggc

SEQ ID NO: 7102108 - DNA, 22 bp, Homo sapiens
ggccatggaccccgagctgacc

SEQ ID NO: 7102109 - DNA, 22 bp, Homo sapiens
ggccatgcctgtgggtgcaggc

SEQ ID NO: 7102110 - DNA, 22 bp, Homo sapiens
ggccatgctcgtggctggactg

SEQ ID NO: 7102111 - DNA, 22 bp, Homo sapiens
ggccatgctcgtggctggactg

SEQ ID NO: 7102112 - DNA, 22 bp, Homo sapiens
ggccatgctcgtggctggactg

SEQ ID NO: 7102113 - DNA, 22 bp, Homo sapiens
ggccatgctgttgcctgctggt

SEQ ID NO: 7102114 - DNA, 22 bp, Homo sapiens
ggccatgctgttgcctgctggt

SEQ ID NO: 7102115 - DNA, 22 bp, Homo sapiens
ggccatgctgttgcctgctggt

SEQ ID NO: 7102116 - DNA, 22 bp, Homo sapiens
ggccatggaccccgagctgacc

SEQ ID NO: 7102117 - DNA, 22 bp, Homo sapiens
ggccatggaccccgagctgacc

SEQ ID NO: 7102118 - DNA, 21 bp, Homo sapiens
ggcctcagccacctggctctg

SEQ ID NO: 7102119 - DNA, 21 bp, Homo sapiens
ggcctcagccacctggctctg

SEQ ID NO: 7102120 - DNA, 22 bp, Homo sapiens
ggcctcagaggaggtgtgagtc

SEQ ID NO: 7102121 - DNA, 22 bp, Homo sapiens
ggcctcagaggaggtgtgagtc

SEQ ID NO: 7102122 - DNA, 22 bp, Homo sapiens
ggcctcagagaaggctgtgcgg

SEQ ID NO: 7102123 - DNA, 22 bp, Homo sapiens
ggcctcagaggaggtgtgagtc

SEQ ID NO: 7102124 - DNA, 22 bp, Homo sapiens
ggcctcagaggaggtgtgagtc

SEQ ID NO: 7102125 - DNA, 22 bp, Homo sapiens
ggcctcagaggaggtgtgagtc

SEQ ID NO: 7102126 - DNA, 21 bp, Homo sapiens
ggcctcagccacctggctctg

SEQ ID NO: 7102127 - DNA, 18 bp, Homo sapiens
ggcctcagcctggccgga

SEQ ID NO: 7102128 - DNA, 18 bp, Homo sapiens
ggcctcagcctggccgga

SEQ ID NO: 7102129 - DNA, 18 bp, Homo sapiens
ggcctcagcctggccgga

SEQ ID NO: 7102130 - DNA, 23 bp, Homo sapiens
ggcctcagcgcacagaaactgct

SEQ ID NO: 7102131 - DNA, 22 bp, Homo sapiens
ggcctcagggtcactctgtaga

SEQ ID NO: 7102132 - DNA, 22 bp, Homo sapiens
ggcctcagggtcactctgtaga

SEQ ID NO: 7102133 - DNA, 22 bp, Homo sapiens
ggcctcagggtcactctgtaga

SEQ ID NO: 7102134 - DNA, 22 bp, Homo sapiens
ggcctcagggtcactctgtaga

SEQ ID NO: 7102135 - DNA, 22 bp, Homo sapiens
ggcctcagggttgggcccatta

SEQ ID NO: 7102136 - DNA, 22 bp, Homo sapiens
ggcctcagggttgggcccatta

SEQ ID NO: 7102137 - DNA, 22 bp, Homo sapiens
ggcctcagggttgggcccatta

SEQ ID NO: 7102138 - DNA, 22 bp, Homo sapiens
ggcctcatcacagtgcattagt

SEQ ID NO: 7102139 - DNA, 22 bp, Homo sapiens
ggcctcagtttcttcaactgta

SEQ ID NO: 7102140 - DNA, 22 bp, Homo sapiens
ggcctcagtttctccatgggtt

SEQ ID NO: 7102141 - DNA, 22 bp, Homo sapiens
ggcctcagtttctccatgggtt

SEQ ID NO: 7102142 - DNA, 22 bp, Homo sapiens
ggcctcagtttctccatgggtt

SEQ ID NO: 7102143 - DNA, 22 bp, Homo sapiens
ggcctcagtgggccgctgcagg

SEQ ID NO: 7102144 - DNA, 22 bp, Homo sapiens
ggcctcagtgggccgctgcagg

SEQ ID NO: 7102145 - DNA, 22 bp, Homo sapiens
ggcctcagtgggccgctgcagg

SEQ ID NO: 7102146 - DNA, 22 bp, Homo sapiens
ggcctcagtgggccgctgcagg

SEQ ID NO: 7102147 - DNA, 20 bp, Homo sapiens
ggcctcagtgtccttgtttg

SEQ ID NO: 7102148 - DNA, 22 bp, Homo sapiens
ggcctctgttctgcattcctcc

SEQ ID NO: 7102149 - DNA, 22 bp, Homo sapiens
ggcctctgtttggagccaggat

SEQ ID NO: 7102150 - DNA, 22 bp, Homo sapiens
ggcctctgtttggagccaggat

SEQ ID NO: 7102151 - DNA, 22 bp, Homo sapiens
ggcctctgtttggagccaggat

SEQ ID NO: 7102152 - DNA, 22 bp, Homo sapiens
ggcctctgtttggagccaggat

SEQ ID NO: 7102153 - DNA, 22 bp, Homo sapiens
ggcctcttatctggctcctgca

SEQ ID NO: 7102154 - DNA, 21 bp, Homo sapiens
ggcctctgtcatcctgggaag

SEQ ID NO: 7102155 - DNA, 22 bp, Homo sapiens
ggcctctggttcgtggtgacct

SEQ ID NO: 7102156 - DNA, 22 bp, Homo sapiens
ggcctctggttcgtggtgacct

SEQ ID NO: 7102157 - DNA, 22 bp, Homo sapiens
ggcctctggttcgtggtgacct

SEQ ID NO: 7102158 - DNA, 22 bp, Homo sapiens
ggcctctggttcacagggagga

SEQ ID NO: 7102159 - DNA, 22 bp, Homo sapiens
ggcctctggttcacagggagga

SEQ ID NO: 7102160 - DNA, 19 bp, Homo sapiens
ggcatggtcggaagagctc

SEQ ID NO: 7102161 - DNA, 20 bp, Homo sapiens
ggcatgggtggggctcccag

SEQ ID NO: 7102162 - DNA, 22 bp, Homo sapiens
ggcatggtctttgcttgcagga

SEQ ID NO: 7102163 - DNA, 22 bp, Homo sapiens
ggcatggggtgtatgtggcacg

SEQ ID NO: 7102164 - DNA, 18 bp, Homo sapiens
ggcatgtgagtgctgagg

SEQ ID NO: 7102165 - DNA, 18 bp, Homo sapiens
ggcatgtgagtgctgagg

SEQ ID NO: 7102166 - DNA, 22 bp, Homo sapiens
ggcatggtttaagtggtgggga

SEQ ID NO: 7102167 - DNA, 22 bp, Homo sapiens
ggcatggtttaagtggtgggga

SEQ ID NO: 7102168 - DNA, 18 bp, Homo sapiens
ggcatgtataagaagtag

SEQ ID NO: 7102169 - DNA, 18 bp, Homo sapiens
ggcatgtgagtgctgagg

SEQ ID NO: 7102170 - DNA, 22 bp, Homo sapiens
ggcatgtttcatcacatcaaga

SEQ ID NO: 7102171 - DNA, 22 bp, Homo sapiens
ggcatgtgcctgaggtcacaca

SEQ ID NO: 7102172 - DNA, 22 bp, Homo sapiens
ggccaaggatggtggctctggt

SEQ ID NO: 7102173 - DNA, 22 bp, Homo sapiens
ggccaaggtggagaaggcactg

SEQ ID NO: 7102174 - DNA, 22 bp, Homo sapiens
ggccaaggctcttgagggctga

SEQ ID NO: 7102175 - DNA, 22 bp, Homo sapiens
ggccaaggtggagaaggcactg

SEQ ID NO: 7102176 - DNA, 22 bp, Homo sapiens
ggccaaggtggagaaggcactg

SEQ ID NO: 7102177 - DNA, 22 bp, Homo sapiens
ggccaaggctcttgagggctga

SEQ ID NO: 7102178 - DNA, 22 bp, Homo sapiens
ggccaaggctcttgagggctga

SEQ ID NO: 7102179 - DNA, 22 bp, Homo sapiens
ggccacacagatgactgctttc

SEQ ID NO: 7102180 - DNA, 22 bp, Homo sapiens
ggccacaacttgctcctagccc

SEQ ID NO: 7102181 - DNA, 21 bp, Homo sapiens
ggccacaagcggaggagccgc

SEQ ID NO: 7102182 - DNA, 22 bp, Homo sapiens
ggccacacagatgactgctttc

SEQ ID NO: 7102183 - DNA, 22 bp, Homo sapiens
ggccacacggagaggctggtct

SEQ ID NO: 7102184 - DNA, 22 bp, Homo sapiens
ggccaaggtggagaaggcactg

SEQ ID NO: 7102185 - DNA, 22 bp, Homo sapiens
ggccaaggtgttctgatatgcc

SEQ ID NO: 7102186 - DNA, 22 bp, Homo sapiens
ggccaaggtgttctgatatgcc

SEQ ID NO: 7102187 - DNA, 22 bp, Homo sapiens
ggccaatgggaatggccagtag

SEQ ID NO: 7102188 - DNA, 22 bp, Homo sapiens
ggccaattccaggagccggcgg

SEQ ID NO: 7102189 - DNA, 19 bp, Homo sapiens
ggccaggctgactgtggtc

SEQ ID NO: 7102190 - DNA, 19 bp, Homo sapiens
ggccaggctgactgtggtc

SEQ ID NO: 7102191 - DNA, 22 bp, Homo sapiens
ggccacagaacagctacaggac

SEQ ID NO: 7102192 - DNA, 22 bp, Homo sapiens
ggccacagaacagctacaggac

SEQ ID NO: 7102193 - DNA, 22 bp, Homo sapiens
ggccacactctggtagaggtga

SEQ ID NO: 7102194 - DNA, 22 bp, Homo sapiens
ggccacagaacagctacaggac

SEQ ID NO: 7102195 - DNA, 22 bp, Homo sapiens
ggccacagaacagctacaggac

SEQ ID NO: 7102196 - DNA, 22 bp, Homo sapiens
ggccacagaacagctacaggac

SEQ ID NO: 7102197 - DNA, 22 bp, Homo sapiens
ggccaggtggctgtcctggcgt

SEQ ID NO: 7102198 - DNA, 23 bp, Homo sapiens
ggccaggtgcaccttagagagcc

SEQ ID NO: 7102199 - DNA, 22 bp, Homo sapiens
ggccaggtgcggtggctcacac

SEQ ID NO: 7102200 - DNA, 22 bp, Homo sapiens
ggccaggtccagtggaaggccc

SEQ ID NO: 7102201 - DNA, 22 bp, Homo sapiens
ggccaggtccagtggaaggccc

SEQ ID NO: 7102202 - DNA, 22 bp, Homo sapiens
ggccagggggcttcagactcca

SEQ ID NO: 7102203 - DNA, 22 bp, Homo sapiens
ggccagggcctggggactgtcc

SEQ ID NO: 7102204 - DNA, 22 bp, Homo sapiens
ggccaggctgccctgggagcag

SEQ ID NO: 7102205 - DNA, 19 bp, Homo sapiens
ggccaggctgactgtggtc

SEQ ID NO: 7102206 - DNA, 19 bp, Homo sapiens
ggccaggctgactgtggtc

SEQ ID NO: 7102207 - DNA, 22 bp, Homo sapiens
ggccagggggcttcagactcca

SEQ ID NO: 7102208 - DNA, 22 bp, Homo sapiens
ggccagggggcttcagactcca

SEQ ID NO: 7102209 - DNA, 22 bp, Homo sapiens
ggccagggggcttcagactcca

SEQ ID NO: 7102210 - DNA, 22 bp, Homo sapiens
ggccagggcctggggactgtcc

SEQ ID NO: 7102211 - DNA, 22 bp, Homo sapiens
ggccaggttgggtggaagtggc

SEQ ID NO: 7102212 - DNA, 22 bp, Homo sapiens
ggccaggttgggtggaagtggc

SEQ ID NO: 7102213 - DNA, 22 bp, Homo sapiens
ggccagtcccctaatccagggc

SEQ ID NO: 7102214 - DNA, 22 bp, Homo sapiens
ggccagtctgggccacggtcgg

SEQ ID NO: 7102215 - DNA, 22 bp, Homo sapiens
ggccagtctgggccacggtcgg

SEQ ID NO: 7102216 - DNA, 21 bp, Homo sapiens
ggccagtggccttgactttcc

SEQ ID NO: 7102217 - DNA, 22 bp, Homo sapiens
ggccagtggctctgtgcttggg

SEQ ID NO: 7102218 - DNA, 22 bp, Homo sapiens
ggccagtggctctgtgcttggg

SEQ ID NO: 7102219 - DNA, 22 bp, Homo sapiens
ggccagtgtgcaggtcagagat

SEQ ID NO: 7102220 - DNA, 22 bp, Homo sapiens
ggccagtgtgggagtagttctt

SEQ ID NO: 7102221 - DNA, 22 bp, Homo sapiens
ggccagtgtgggagtagttctt

SEQ ID NO: 7102222 - DNA, 22 bp, Homo sapiens
ggccagtgtgcaggtcagagat

SEQ ID NO: 7102223 - DNA, 22 bp, Homo sapiens
ggccagtgtgcaggtcagagat

SEQ ID NO: 7102224 - DNA, 19 bp, Homo sapiens
ggccatctctgccccagca

SEQ ID NO: 7102225 - DNA, 22 bp, Homo sapiens
ggccatgagaatgtgcaggtcc

SEQ ID NO: 7102226 - DNA, 22 bp, Homo sapiens
ggccatgagaatgtgcaggtcc

SEQ ID NO: 7102227 - DNA, 22 bp, Homo sapiens
ggccatgcaggtcagaggtggg

SEQ ID NO: 7102228 - DNA, 22 bp, Homo sapiens
ggccatgcaggtcagaggtggg

SEQ ID NO: 7102229 - DNA, 22 bp, Homo sapiens
ggccatgcaggtcagaggtggg

SEQ ID NO: 7102230 - DNA, 22 bp, Homo sapiens
ggccatgcaggtctggtaggtc

SEQ ID NO: 7102231 - DNA, 22 bp, Homo sapiens
ggccatgccaggctgcctggga

SEQ ID NO: 7102232 - DNA, 22 bp, Homo sapiens
ggccatgccaggctgcctggga

SEQ ID NO: 7102233 - DNA, 22 bp, Homo sapiens
ggccatgccaggctgcctggga

SEQ ID NO: 7102234 - DNA, 22 bp, Homo sapiens
ggccatgcctggtctggcacca

SEQ ID NO: 7102235 - DNA, 22 bp, Homo sapiens
ggccatgcctggtctggcacca

SEQ ID NO: 7102236 - DNA, 22 bp, Homo sapiens
ggccatgcctggtctggcacca

SEQ ID NO: 7102237 - DNA, 22 bp, Homo sapiens
ggccatgcctgtgggtgcaggc

SEQ ID NO: 7102238 - DNA, 22 bp, Homo sapiens
ggccatgcctgtgggtgcaggc

SEQ ID NO: 7102239 - DNA, 22 bp, Homo sapiens
ggcatggctgttggggatagag

SEQ ID NO: 7102240 - DNA, 22 bp, Homo sapiens
ggcatgggagtgagcaacctta

SEQ ID NO: 7102241 - DNA, 22 bp, Homo sapiens
ggcatgggccgaggtgcctcct

SEQ ID NO: 7102242 - DNA, 22 bp, Homo sapiens
ggcatgggccgaggtgcctcct

SEQ ID NO: 7102243 - DNA, 22 bp, Homo sapiens
ggcatggctgggttctggtgag

SEQ ID NO: 7102244 - DNA, 22 bp, Homo sapiens
ggcatggctgttggggatagag

SEQ ID NO: 7102245 - DNA, 22 bp, Homo sapiens
ggcatggctgttggggatagag

SEQ ID NO: 7102246 - DNA, 22 bp, Homo sapiens
ggcatggcctgtaagacggaga

SEQ ID NO: 7102247 - DNA, 22 bp, Homo sapiens
ggcatggcacgggaaacaccag

SEQ ID NO: 7102248 - DNA, 22 bp, Homo sapiens
ggcatggcctgtaagacggaga

SEQ ID NO: 7102249 - DNA, 22 bp, Homo sapiens
ggcatggctcggagtcagaaca

SEQ ID NO: 7102250 - DNA, 21 bp, Homo sapiens
ggcatggcacctctgggcagg

SEQ ID NO: 7102251 - DNA, 22 bp, Homo sapiens
ggcatggggtgtatgtggcacg

SEQ ID NO: 7102252 - DNA, 22 bp, Homo sapiens
ggcatggggtgtatgtggcacg

SEQ ID NO: 7102253 - DNA, 22 bp, Homo sapiens
ggcatggggtgtatgtggcacg

SEQ ID NO: 7102254 - DNA, 22 bp, Homo sapiens
ggcatgggccgaggtgcctcct

SEQ ID NO: 7102255 - DNA, 22 bp, Homo sapiens
ggcatgggagtgagcaacctta

SEQ ID NO: 7102256 - DNA, 22 bp, Homo sapiens
ggcatgggccgaggtgcctcct

SEQ ID NO: 7102257 - DNA, 22 bp, Homo sapiens
ggcatgggccgaggtgcctcct

SEQ ID NO: 7102258 - DNA, 19 bp, Homo sapiens
ggcatggggtccggggacc

SEQ ID NO: 7102259 - DNA, 22 bp, Homo sapiens
ggcatgggccgaggtgcctcct

SEQ ID NO: 7102260 - DNA, 20 bp, Homo sapiens
ggcatggcaaatgttcttgc

SEQ ID NO: 7102261 - DNA, 21 bp, Homo sapiens
ggcatggcacctctgggcagg

SEQ ID NO: 7102262 - DNA, 22 bp, Homo sapiens
ggcatggacgtctctgaggcca

SEQ ID NO: 7102263 - DNA, 20 bp, Homo sapiens
ggcatggcaaatgttcttgc

SEQ ID NO: 7102264 - DNA, 22 bp, Homo sapiens
ggcagtgaatgaaacagaggct

SEQ ID NO: 7102265 - DNA, 22 bp, Homo sapiens
ggcatggacgtctctgaggcca

SEQ ID NO: 7102266 - DNA, 22 bp, Homo sapiens
ggcatggacgtctctgaggcca

SEQ ID NO: 7102267 - DNA, 22 bp, Homo sapiens
ggcatggacgtctctgaggcca

SEQ ID NO: 7102268 - DNA, 22 bp, Homo sapiens
ggcagtgaatgaaacagaggct

SEQ ID NO: 7102269 - DNA, 22 bp, Homo sapiens
ggcagtgaatgaaacagaggct

SEQ ID NO: 7102270 - DNA, 22 bp, Homo sapiens
ggcagtgaatctgagagcctgg

SEQ ID NO: 7102271 - DNA, 22 bp, Homo sapiens
ggcagtgaatctgagagcctgg

SEQ ID NO: 7102272 - DNA, 22 bp, Homo sapiens
ggcagtgaatctgagagcctgg

SEQ ID NO: 7102273 - DNA, 22 bp, Homo sapiens
ggcagtgaacagaaatgcagaa

SEQ ID NO: 7102274 - DNA, 22 bp, Homo sapiens
ggcagtgaacagaaatgcagaa

SEQ ID NO: 7102275 - DNA, 22 bp, Homo sapiens
ggcagtgaacagaaatgcagaa

SEQ ID NO: 7102276 - DNA, 22 bp, Homo sapiens
ggcagtctagctaggatgtcac

SEQ ID NO: 7102277 - DNA, 22 bp, Homo sapiens
ggcagtccccatttggtgtttt

SEQ ID NO: 7102278 - DNA, 21 bp, Homo sapiens
ggcaggtgggtctctgttgct

SEQ ID NO: 7102279 - DNA, 22 bp, Homo sapiens
ggcaggtggtaaggatttcata

SEQ ID NO: 7102280 - DNA, 22 bp, Homo sapiens
ggcaggtgggaaccctccccac

SEQ ID NO: 7102281 - DNA, 22 bp, Homo sapiens
ggcaggtgggaaccctccccac

SEQ ID NO: 7102282 - DNA, 22 bp, Homo sapiens
ggcaggtgggaaccctccccac

SEQ ID NO: 7102283 - DNA, 22 bp, Homo sapiens
ggcaggtggcactgctgctccc

SEQ ID NO: 7102284 - DNA, 22 bp, Homo sapiens
ggcaggtggccaagtgtctaag

SEQ ID NO: 7102285 - DNA, 22 bp, Homo sapiens
ggcaggtggcactgctgctccc

SEQ ID NO: 7102286 - DNA, 22 bp, Homo sapiens
ggcaggtggccaagtgtctaag

SEQ ID NO: 7102287 - DNA, 22 bp, Homo sapiens
ggcaggtgtgagatcgaggcca

SEQ ID NO: 7102288 - DNA, 22 bp, Homo sapiens
ggcaggtgtgagatcgaggcca

SEQ ID NO: 7102289 - DNA, 22 bp, Homo sapiens
ggcagtcagtgtggttcataaa

SEQ ID NO: 7102290 - DNA, 22 bp, Homo sapiens
ggcagtcagtttggagatggat

SEQ ID NO: 7102291 - DNA, 22 bp, Homo sapiens
ggcagtcatttaatccctgcat

SEQ ID NO: 7102292 - DNA, 22 bp, Homo sapiens
ggcagtcccaggctgcatgttg

SEQ ID NO: 7102293 - DNA, 22 bp, Homo sapiens
ggcaggtggcactgctgctccc

SEQ ID NO: 7102294 - DNA, 22 bp, Homo sapiens
ggcaggtggcactgctgctccc

SEQ ID NO: 7102295 - DNA, 22 bp, Homo sapiens
ggcaggtggcactgctgctccc

SEQ ID NO: 7102296 - DNA, 22 bp, Homo sapiens
ggcaggtggattttctactcta

SEQ ID NO: 7102297 - DNA, 22 bp, Homo sapiens
ggcaggtggattttctactcta

SEQ ID NO: 7102298 - DNA, 22 bp, Homo sapiens
ggcaggtggattttctactcta

SEQ ID NO: 7102299 - DNA, 22 bp, Homo sapiens
ggcaggtggacgtgctaaagct

SEQ ID NO: 7102300 - DNA, 15 bp, Homo sapiens
ggcaggtggatcact

SEQ ID NO: 7102301 - DNA, 22 bp, Homo sapiens
ggcaggtggaagttggcagagc

SEQ ID NO: 7102302 - DNA, 22 bp, Homo sapiens
ggcaggcagatggctgcaccaa

SEQ ID NO: 7102303 - DNA, 22 bp, Homo sapiens
ggcaggcagatggctgcaccaa

SEQ ID NO: 7102304 - DNA, 22 bp, Homo sapiens
ggcaggcagatggctgcaccaa

SEQ ID NO: 7102305 - DNA, 22 bp, Homo sapiens
ggcaggcagaggctgagacagg

SEQ ID NO: 7102306 - DNA, 22 bp, Homo sapiens
ggcaggcagaggctgagacagg

SEQ ID NO: 7102307 - DNA, 22 bp, Homo sapiens
ggcaggcagaggctgagacagg

SEQ ID NO: 7102308 - DNA, 22 bp, Homo sapiens
ggcaggcagaggctgagacagg

SEQ ID NO: 7102309 - DNA, 22 bp, Homo sapiens
ggcaggcagaggctgagacagg

SEQ ID NO: 7102310 - DNA, 22 bp, Homo sapiens
gctttattttgtgagggattac

SEQ ID NO: 7102311 - DNA, 22 bp, Homo sapiens
gctttattttgtgagggattac

SEQ ID NO: 7102312 - DNA, 22 bp, Homo sapiens
gctttattttgtgagggattac

SEQ ID NO: 7102313 - DNA, 18 bp, Homo sapiens
gctttcaatttctttcct

SEQ ID NO: 7102314 - DNA, 20 bp, Homo sapiens
gctttcaagcttgtcattgt

SEQ ID NO: 7102315 - DNA, 22 bp, Homo sapiens
gctttgctgggtgcttcatgta

SEQ ID NO: 7102316 - DNA, 22 bp, Homo sapiens
gctttgcttcctgttctagcct

SEQ ID NO: 7102317 - DNA, 22 bp, Homo sapiens
ggaagaggctgaggccatgctg

SEQ ID NO: 7102318 - DNA, 22 bp, Homo sapiens
ggaagaggctgaggccatgctg

SEQ ID NO: 7102319 - DNA, 22 bp, Homo sapiens
ggaagaggctgagccaggtccc

SEQ ID NO: 7102320 - DNA, 22 bp, Homo sapiens
ggaagaggctgagccaggtccc

SEQ ID NO: 7102321 - DNA, 22 bp, Homo sapiens
ggaagaggctgagccaggtccc

SEQ ID NO: 7102322 - DNA, 22 bp, Homo sapiens
ggaagaggctgaggccatgctg

SEQ ID NO: 7102323 - DNA, 22 bp, Homo sapiens
ggaagaggctggtagtgcccgt

SEQ ID NO: 7102324 - DNA, 22 bp, Homo sapiens
ggaagaggctggtagtgcccgt

SEQ ID NO: 7102325 - DNA, 22 bp, Homo sapiens
ggaagaggctctcattgagggc

SEQ ID NO: 7102326 - DNA, 22 bp, Homo sapiens
ggaagaggctctcattgagggc

SEQ ID NO: 7102327 - DNA, 22 bp, Homo sapiens
ggaagaggctctcattgagggc

SEQ ID NO: 7102328 - DNA, 22 bp, Homo sapiens
ggaagaggctctcattgagggc

SEQ ID NO: 7102329 - DNA, 22 bp, Homo sapiens
ggaagaggctctcattgagggc

SEQ ID NO: 7102330 - DNA, 22 bp, Homo sapiens
ggaagaggctctcattgagggc

SEQ ID NO: 7102331 - DNA, 22 bp, Homo sapiens
ggaagaggctctcattgagggc

SEQ ID NO: 7102332 - DNA, 22 bp, Homo sapiens
ggaagaggctctcattgagggc

SEQ ID NO: 7102333 - DNA, 22 bp, Homo sapiens
ggaagacagaagcctacagctt

SEQ ID NO: 7102334 - DNA, 22 bp, Homo sapiens
ggaagacaagcagtggctgagc

SEQ ID NO: 7102335 - DNA, 22 bp, Homo sapiens
ggaagacaagcagtggctgagc

SEQ ID NO: 7102336 - DNA, 22 bp, Homo sapiens
ggaagacaagcagtggctgagc

SEQ ID NO: 7102337 - DNA, 22 bp, Homo sapiens
ggaagacaagcagtggctgagc

SEQ ID NO: 7102338 - DNA, 22 bp, Homo sapiens
ggaagacagaagcctacagctt

SEQ ID NO: 7102339 - DNA, 22 bp, Homo sapiens
ggaagacagaagcctacagctt

SEQ ID NO: 7102340 - DNA, 22 bp, Homo sapiens
ggaagaggaggagccaggcttt

SEQ ID NO: 7102341 - DNA, 22 bp, Homo sapiens
ggaagaggaggagccaggcttt

SEQ ID NO: 7102342 - DNA, 22 bp, Homo sapiens
ggaagaagcagggcatttgaat

SEQ ID NO: 7102343 - DNA, 22 bp, Homo sapiens
ggaagaagggtcattggcagcc

SEQ ID NO: 7102344 - DNA, 22 bp, Homo sapiens
ggaagaagggtcattggcagcc

SEQ ID NO: 7102345 - DNA, 22 bp, Homo sapiens
ggacacagccacttagggtacc

SEQ ID NO: 7102346 - DNA, 22 bp, Homo sapiens
ggacaaagcctggtggcaggtg

SEQ ID NO: 7102347 - DNA, 18 bp, Homo sapiens
ggacacagataggtacag

SEQ ID NO: 7102348 - DNA, 17 bp, Homo sapiens
ggacacagctcatggct

SEQ ID NO: 7102349 - DNA, 17 bp, Homo sapiens
ggacacagctcatggct

SEQ ID NO: 7102350 - DNA, 17 bp, Homo sapiens
ggacacagctcatggct

SEQ ID NO: 7102351 - DNA, 22 bp, Homo sapiens
ggacacagctgcagccacaccc

SEQ ID NO: 7102352 - DNA, 22 bp, Homo sapiens
ggacacagctgcagccacaccc

SEQ ID NO: 7102353 - DNA, 22 bp, Homo sapiens
ggacacagctgcagccacaccc

SEQ ID NO: 7102354 - DNA, 22 bp, Homo sapiens
ggaattggtttcaagggaaagt

SEQ ID NO: 7102355 - DNA, 22 bp, Homo sapiens
ggaattgtctagtactcacggc

SEQ ID NO: 7102356 - DNA, 22 bp, Homo sapiens
ggaattctgaattaaggaggct

SEQ ID NO: 7102357 - DNA, 22 bp, Homo sapiens
ggaatgttttccagacctagat

SEQ ID NO: 7102358 - DNA, 22 bp, Homo sapiens
ggaatgtttttcattgctctct

SEQ ID NO: 7102359 - DNA, 22 bp, Homo sapiens
ggaattcagggaagtcaaaaag

SEQ ID NO: 7102360 - DNA, 22 bp, Homo sapiens
ggaatgctcagttcttggtgct

SEQ ID NO: 7102361 - DNA, 22 bp, Homo sapiens
ggaatgcactgaaaattgtgct

SEQ ID NO: 7102362 - DNA, 22 bp, Homo sapiens
ggaatgcaattttacaattctg

SEQ ID NO: 7102363 - DNA, 22 bp, Homo sapiens
ggaatgcaattttacaattctg

SEQ ID NO: 7102364 - DNA, 22 bp, Homo sapiens
ggaatgagctcggagcagaagg

SEQ ID NO: 7102365 - DNA, 22 bp, Homo sapiens
ggaatgatggtgcctagattat

SEQ ID NO: 7102366 - DNA, 22 bp, Homo sapiens
ggaatctttgaaggattttaag

SEQ ID NO: 7102367 - DNA, 22 bp, Homo sapiens
ggaatgaagaaatagatggtgt

SEQ ID NO: 7102368 - DNA, 22 bp, Homo sapiens
ggaatgaatttccagctgggtc

SEQ ID NO: 7102369 - DNA, 22 bp, Homo sapiens
ggaatgtaaatttactgttgta

SEQ ID NO: 7102370 - DNA, 22 bp, Homo sapiens
ggaatgtaccacctattgttag

SEQ ID NO: 7102371 - DNA, 22 bp, Homo sapiens
ggaatgtagtttgtgcactgta

SEQ ID NO: 7102372 - DNA, 22 bp, Homo sapiens
ggaatgtgcgtactcagtgtca

SEQ ID NO: 7102373 - DNA, 22 bp, Homo sapiens
ggaatgtgcgtactcagtgtca

SEQ ID NO: 7102374 - DNA, 22 bp, Homo sapiens
ggaatgtgcgtactcagtgtca

SEQ ID NO: 7102375 - DNA, 22 bp, Homo sapiens
ggaatgtgctgacacgcgagag

SEQ ID NO: 7102376 - DNA, 22 bp, Homo sapiens
ggaatgtgctgacacgcgagag

SEQ ID NO: 7102377 - DNA, 18 bp, Homo sapiens
ggaatgtggacaggctgg

SEQ ID NO: 7102378 - DNA, 22 bp, Homo sapiens
ggaatgttctggaacaccgctt

SEQ ID NO: 7102379 - DNA, 22 bp, Homo sapiens
ggaatgttctggaacaccgctt

SEQ ID NO: 7102380 - DNA, 22 bp, Homo sapiens
ggaatgtgttcttactgtattt

SEQ ID NO: 7102381 - DNA, 22 bp, Homo sapiens
ggaatgttctggtctggttcat

SEQ ID NO: 7102382 - DNA, 22 bp, Homo sapiens
ggaatgttgtcatttacattat

SEQ ID NO: 7102383 - DNA, 23 bp, Homo sapiens
ggaatgtttacctgtgaatgtca

SEQ ID NO: 7102384 - DNA, 22 bp, Homo sapiens
ggaatgttctggtctggttcat

SEQ ID NO: 7102385 - DNA, 22 bp, Homo sapiens
ggaatgtttgctcccttcaggg

SEQ ID NO: 7102386 - DNA, 22 bp, Homo sapiens
ggaatgttttagcttgactttt

SEQ ID NO: 7102387 - DNA, 22 bp, Homo sapiens
ggaatgttttagcttgactttt

SEQ ID NO: 7102388 - DNA, 22 bp, Homo sapiens
ggaagcaggaggctggggtaaa

SEQ ID NO: 7102389 - DNA, 22 bp, Homo sapiens
ggaatcctcattacatcagggt

SEQ ID NO: 7102390 - DNA, 22 bp, Homo sapiens
ggaatcatgccatttatgacgt

SEQ ID NO: 7102391 - DNA, 22 bp, Homo sapiens
ggaatccacgaatgtgcatttc

SEQ ID NO: 7102392 - DNA, 22 bp, Homo sapiens
ggaatcctgccagctctgcccc

SEQ ID NO: 7102393 - DNA, 22 bp, Homo sapiens
ggaatcctggtgttttctgcct

SEQ ID NO: 7102394 - DNA, 22 bp, Homo sapiens
ggaatcctgtgagggctgagag

SEQ ID NO: 7102395 - DNA, 22 bp, Homo sapiens
ggaatcctgtgagggctgagag

SEQ ID NO: 7102396 - DNA, 22 bp, Homo sapiens
ggaatccttgggtctgaacgtg

SEQ ID NO: 7102397 - DNA, 22 bp, Homo sapiens
ggaatccttgggtctgaacgtg

SEQ ID NO: 7102398 - DNA, 22 bp, Homo sapiens
ggaatcgttaggtaagcaggga

SEQ ID NO: 7102399 - DNA, 22 bp, Homo sapiens
ggaatctagaaagggagcaagg

SEQ ID NO: 7102400 - DNA, 22 bp, Homo sapiens
ggaatctcagtggagctgttag

SEQ ID NO: 7102401 - DNA, 22 bp, Homo sapiens
ggaagcaaattccagaaccaca

SEQ ID NO: 7102402 - DNA, 22 bp, Homo sapiens
ggaagcactgaggcagagaggg

SEQ ID NO: 7102403 - DNA, 20 bp, Homo sapiens
ggaagcagagaactgttttc

SEQ ID NO: 7102404 - DNA, 22 bp, Homo sapiens
ggaagcagcctgaagccaaggg

SEQ ID NO: 7102405 - DNA, 22 bp, Homo sapiens
ggaagcagcctgaagccaaggg

SEQ ID NO: 7102406 - DNA, 22 bp, Homo sapiens
ggaagcagcctgaagccaaggg

SEQ ID NO: 7102407 - DNA, 22 bp, Homo sapiens
ggaagcagcctgaagccaaggg

SEQ ID NO: 7102408 - DNA, 22 bp, Homo sapiens
ggaagcagcctgaagccaaggg

SEQ ID NO: 7102409 - DNA, 22 bp, Homo sapiens
ggaagcaggaggctggggtaaa

SEQ ID NO: 7102410 - DNA, 22 bp, Homo sapiens
ggaagcaggaggctggggtaaa

SEQ ID NO: 7102411 - DNA, 22 bp, Homo sapiens
ggaagaggctggtagtgcccgt

SEQ ID NO: 7102412 - DNA, 22 bp, Homo sapiens
ggaagaggctggtagtgcccgt

SEQ ID NO: 7102413 - DNA, 22 bp, Homo sapiens
ggaagagggaaccacgactgta

SEQ ID NO: 7102414 - DNA, 22 bp, Homo sapiens
ggaagagggaaccacgactgta

SEQ ID NO: 7102415 - DNA, 22 bp, Homo sapiens
ggaagagggaaccacgactgta

SEQ ID NO: 7102416 - DNA, 22 bp, Homo sapiens
ggaagagtaacaggaggtggaa

SEQ ID NO: 7102417 - DNA, 22 bp, Homo sapiens
ggaagagtaacaggaggtggaa

SEQ ID NO: 7102418 - DNA, 22 bp, Homo sapiens
ggaagagtaacaggaggtggaa

SEQ ID NO: 7102419 - DNA, 22 bp, Homo sapiens
ggaagagtaacaggaggtggaa

SEQ ID NO: 7102420 - DNA, 22 bp, Homo sapiens
ggaagagtaacaggaggtggaa

SEQ ID NO: 7102421 - DNA, 22 bp, Homo sapiens
ggaagagtgcaggtttgtttca

SEQ ID NO: 7102422 - DNA, 22 bp, Homo sapiens
ggaagagtgcaggtttgtttca

SEQ ID NO: 7102423 - DNA, 22 bp, Homo sapiens
ggaagatgagaagtggggctcc

SEQ ID NO: 7102424 - DNA, 22 bp, Homo sapiens
ggaagattcagcatatatgagt

SEQ ID NO: 7102425 - DNA, 22 bp, Homo sapiens
ggaagattcagttatctcatga

SEQ ID NO: 7102426 - DNA, 22 bp, Homo sapiens
ggaagatttcccgtagctgtgc

SEQ ID NO: 7102427 - DNA, 22 bp, Homo sapiens
ggaagattttccattcctcttt

SEQ ID NO: 7102428 - DNA, 22 bp, Homo sapiens
ggaagcaaaatcatcagtcatt

SEQ ID NO: 7102429 - DNA, 22 bp, Homo sapiens
ggagcaggctctgtggtttcca

SEQ ID NO: 7102430 - DNA, 22 bp, Homo sapiens
ggagcaggcagggccgtgtctg

SEQ ID NO: 7102431 - DNA, 22 bp, Homo sapiens
ggagcagcactgccacacagag

SEQ ID NO: 7102432 - DNA, 22 bp, Homo sapiens
ggagcaggctctgtggtttcca

SEQ ID NO: 7102433 - DNA, 22 bp, Homo sapiens
ggagcagggaattacagcgcag

SEQ ID NO: 7102434 - DNA, 22 bp, Homo sapiens
ggagcagcactgccacacagag

SEQ ID NO: 7102435 - DNA, 22 bp, Homo sapiens
ggagcagatgtcttcatggcct

SEQ ID NO: 7102436 - DNA, 22 bp, Homo sapiens
ggagagagacctccatgcccag

SEQ ID NO: 7102437 - DNA, 22 bp, Homo sapiens
ggagagagacctccatgcccag

SEQ ID NO: 7102438 - DNA, 22 bp, Homo sapiens
ggagagagacctccatgcccag

SEQ ID NO: 7102439 - DNA, 22 bp, Homo sapiens
ggagagagacctccatgcccag

SEQ ID NO: 7102440 - DNA, 22 bp, Homo sapiens
ggagagagacctccatgcccag

SEQ ID NO: 7102441 - DNA, 22 bp, Homo sapiens
ggagagagagattgtgtttatt

SEQ ID NO: 7102442 - DNA, 22 bp, Homo sapiens
ggagagagagattgtgtttatt

SEQ ID NO: 7102443 - DNA, 22 bp, Homo sapiens
ggagagagagctcattagctgc

SEQ ID NO: 7102444 - DNA, 22 bp, Homo sapiens
ggagagagagctcattagctgc

SEQ ID NO: 7102445 - DNA, 22 bp, Homo sapiens
ggagcagggcagtgaattctgg

SEQ ID NO: 7102446 - DNA, 22 bp, Homo sapiens
ggagcagggaattacagcgcag

SEQ ID NO: 7102447 - DNA, 22 bp, Homo sapiens
ggagcagggaattacagcgcag

SEQ ID NO: 7102448 - DNA, 22 bp, Homo sapiens
ggagcagggaattacagcgcag

SEQ ID NO: 7102449 - DNA, 22 bp, Homo sapiens
ggagcatctgaacagggagaag

SEQ ID NO: 7102450 - DNA, 22 bp, Homo sapiens
ggagcatctgaacagggagaag

SEQ ID NO: 7102451 - DNA, 22 bp, Homo sapiens
ggagcatctgaacagggagaag

SEQ ID NO: 7102452 - DNA, 22 bp, Homo sapiens
ggagcatgcgctctgtgaccga

SEQ ID NO: 7102453 - DNA, 22 bp, Homo sapiens
ggagccagagcactggggagcc

SEQ ID NO: 7102454 - DNA, 22 bp, Homo sapiens
ggagccagagcactggggagcc

SEQ ID NO: 7102455 - DNA, 22 bp, Homo sapiens
ggagccagagcactggggagcc

SEQ ID NO: 7102456 - DNA, 22 bp, Homo sapiens
ggagccagaaatgctgtggttg

SEQ ID NO: 7102457 - DNA, 22 bp, Homo sapiens
ggagccagaaatgctgtggttg

SEQ ID NO: 7102458 - DNA, 22 bp, Homo sapiens
ggagccagaaatgctgtggttg

SEQ ID NO: 7102459 - DNA, 22 bp, Homo sapiens
ggagcatgggtcagaactcagt

SEQ ID NO: 7102460 - DNA, 22 bp, Homo sapiens
ggagcatgtggggtgagcaggg

SEQ ID NO: 7102461 - DNA, 22 bp, Homo sapiens
ggagcatgtggggtgagcaggg

SEQ ID NO: 7102462 - DNA, 22 bp, Homo sapiens
ggagacagtgacttagagactg

SEQ ID NO: 7102463 - DNA, 22 bp, Homo sapiens
ggagacagtgacttagagactg

SEQ ID NO: 7102464 - DNA, 22 bp, Homo sapiens
ggagacagtgacttagagactg

SEQ ID NO: 7102465 - DNA, 22 bp, Homo sapiens
ggagacagtggtagggcctaag

SEQ ID NO: 7102466 - DNA, 22 bp, Homo sapiens
ggagacagtggtagggcctaag

SEQ ID NO: 7102467 - DNA, 22 bp, Homo sapiens
ggagacagtggtagggcctaag

SEQ ID NO: 7102468 - DNA, 22 bp, Homo sapiens
ggagacagtggtagggcctaag

SEQ ID NO: 7102469 - DNA, 22 bp, Homo sapiens
ggagactcaccccgcattctag

SEQ ID NO: 7102470 - DNA, 22 bp, Homo sapiens
ggagactacctagcaggctgtt

SEQ ID NO: 7102471 - DNA, 22 bp, Homo sapiens
ggagactacctagcaggctgtt

SEQ ID NO: 7102472 - DNA, 22 bp, Homo sapiens
ggagacatattccagagctggg

SEQ ID NO: 7102473 - DNA, 22 bp, Homo sapiens
ggagaccagaaggaagcttcga

SEQ ID NO: 7102474 - DNA, 22 bp, Homo sapiens
ggagaccagaaggaagcttcga

SEQ ID NO: 7102475 - DNA, 22 bp, Homo sapiens
ggagaccaggtcagagatggtg

SEQ ID NO: 7102476 - DNA, 22 bp, Homo sapiens
ggagagaactggctccttctag

SEQ ID NO: 7102477 - DNA, 22 bp, Homo sapiens
ggagagaatctgaacctgctcc

SEQ ID NO: 7102478 - DNA, 22 bp, Homo sapiens
ggagagaattcagcttaagatt

SEQ ID NO: 7102479 - DNA, 22 bp, Homo sapiens
ggagagaattcagcttaagatt

SEQ ID NO: 7102480 - DNA, 22 bp, Homo sapiens
ggagagaattccatggacatgt

SEQ ID NO: 7102481 - DNA, 22 bp, Homo sapiens
ggagagaattccatggacatgt

SEQ ID NO: 7102482 - DNA, 22 bp, Homo sapiens
ggagagaattccatggacatgt

SEQ ID NO: 7102483 - DNA, 22 bp, Homo sapiens
ggagagaattccatggacatgt

SEQ ID NO: 7102484 - DNA, 22 bp, Homo sapiens
ggagagaaattgaggtagcaag

SEQ ID NO: 7102485 - DNA, 22 bp, Homo sapiens
ggagagaaattgaggtagcaag

SEQ ID NO: 7102486 - DNA, 22 bp, Homo sapiens
ggagagaaattgaggtagcaag

SEQ ID NO: 7102487 - DNA, 22 bp, Homo sapiens
ggagagaaattgaggtagcaag

SEQ ID NO: 7102488 - DNA, 22 bp, Homo sapiens
ggagagaaattgaggtagcaag

SEQ ID NO: 7102489 - DNA, 22 bp, Homo sapiens
ggagagaaattgaggtagcaag

SEQ ID NO: 7102490 - DNA, 22 bp, Homo sapiens
ggagagaactgacctgaaagga

SEQ ID NO: 7102491 - DNA, 22 bp, Homo sapiens
ggagagaactgacctgaaagga

SEQ ID NO: 7102492 - DNA, 22 bp, Homo sapiens
ggagagaactgacctgaaagga

SEQ ID NO: 7102493 - DNA, 22 bp, Homo sapiens
ggagagaactgacctgaaagga

SEQ ID NO: 7102494 - DNA, 22 bp, Homo sapiens
ggagagaactgacctgaaagga

SEQ ID NO: 7102495 - DNA, 22 bp, Homo sapiens
ggacagtgaatgtggggatgca

SEQ ID NO: 7102496 - DNA, 19 bp, Homo sapiens
ggacagtctcagcctcatg

SEQ ID NO: 7102497 - DNA, 19 bp, Homo sapiens
ggacagtctcagcctcatg

SEQ ID NO: 7102498 - DNA, 22 bp, Homo sapiens
ggacagtctttcctcattcctt

SEQ ID NO: 7102499 - DNA, 22 bp, Homo sapiens
ggacagtctttcctcattcctt

SEQ ID NO: 7102500 - DNA, 22 bp, Homo sapiens
ggacagtgaatctggaggtata

SEQ ID NO: 7102501 - DNA, 22 bp, Homo sapiens
ggacagtgcgagacacagtaac

SEQ ID NO: 7102502 - DNA, 22 bp, Homo sapiens
ggacagtgcgagacacagtaac

SEQ ID NO: 7102503 - DNA, 22 bp, Homo sapiens
ggacagtgcgagacacagtaac

SEQ ID NO: 7102504 - DNA, 22 bp, Homo sapiens
ggacagtgtctgcttcaggccc

SEQ ID NO: 7102505 - DNA, 22 bp, Homo sapiens
ggacagtgtgggccatctcact

SEQ ID NO: 7102506 - DNA, 22 bp, Homo sapiens
ggacagtgtgggccatctcact

SEQ ID NO: 7102507 - DNA, 22 bp, Homo sapiens
ggacatagaggccctgcatggc

SEQ ID NO: 7102508 - DNA, 22 bp, Homo sapiens
ggacataacactttgaaagaga

SEQ ID NO: 7102509 - DNA, 22 bp, Homo sapiens
ggacatagaggccctgcatggc

SEQ ID NO: 7102510 - DNA, 22 bp, Homo sapiens
ggacagtccacctcagtgaaga

SEQ ID NO: 7102511 - DNA, 22 bp, Homo sapiens
ggacagtattctcttgaaataa

SEQ ID NO: 7102512 - DNA, 22 bp, Homo sapiens
ggacagtagtcactaaactaga

SEQ ID NO: 7102513 - DNA, 23 bp, Homo sapiens
ggacagtagtgtggtatttagaa

SEQ ID NO: 7102514 - DNA, 22 bp, Homo sapiens
ggacagtattcattggagagaa

SEQ ID NO: 7102515 - DNA, 22 bp, Homo sapiens
ggacaggttcagcagtttataa

SEQ ID NO: 7102516 - DNA, 21 bp, Homo sapiens
ggacagtagtagtcaggagag

SEQ ID NO: 7102517 - DNA, 22 bp, Homo sapiens
ggacaggtgactgcccagagtg

SEQ ID NO: 7102518 - DNA, 22 bp, Homo sapiens
ggacagggttggggcatataaa

SEQ ID NO: 7102519 - DNA, 22 bp, Homo sapiens
ggacaggtgactgcccagagtg

SEQ ID NO: 7102520 - DNA, 22 bp, Homo sapiens
ggacaggtgactgcccagagtg

SEQ ID NO: 7102521 - DNA, 22 bp, Homo sapiens
ggacaggtgcaaagggcacatg

SEQ ID NO: 7102522 - DNA, 22 bp, Homo sapiens
ggacaggtgcaaagggcacatg

SEQ ID NO: 7102523 - DNA, 22 bp, Homo sapiens
ggacaggtgtgaggctggcaca

SEQ ID NO: 7102524 - DNA, 22 bp, Homo sapiens
ggacaggtgcaaagggcacatg

SEQ ID NO: 7102525 - DNA, 23 bp, Homo sapiens
ggacacaggccttgtctgcgcct

SEQ ID NO: 7102526 - DNA, 22 bp, Homo sapiens
ggacacagggctcactctctct

SEQ ID NO: 7102527 - DNA, 22 bp, Homo sapiens
ggacacagggctcactctctct

SEQ ID NO: 7102528 - DNA, 22 bp, Homo sapiens
ggacacaggtaaataccactga

SEQ ID NO: 7102529 - DNA, 22 bp, Homo sapiens
ggacacagctgcagccacaccc

SEQ ID NO: 7102530 - DNA, 23 bp, Homo sapiens
ggacacaggccttgtctgcgcct

SEQ ID NO: 7102531 - DNA, 22 bp, Homo sapiens
ggacagggttggggcatataaa

SEQ ID NO: 7102532 - DNA, 22 bp, Homo sapiens
ggacaggtgactgcccagagtg

SEQ ID NO: 7102533 - DNA, 22 bp, Homo sapiens
ggacagggtaagtactagtgtg

SEQ ID NO: 7102534 - DNA, 22 bp, Homo sapiens
ggacagggtaagtactagtgtg

SEQ ID NO: 7102535 - DNA, 22 bp, Homo sapiens
ggacagggtaagtactagtgtg

SEQ ID NO: 7102536 - DNA, 22 bp, Homo sapiens
ggacagggtaagtactagtgtg

SEQ ID NO: 7102537 - DNA, 22 bp, Homo sapiens
ggacacagtggaagacagcttg

SEQ ID NO: 7102538 - DNA, 22 bp, Homo sapiens
ggacacagtggaagacagcttg

SEQ ID NO: 7102539 - DNA, 22 bp, Homo sapiens
ggacacaggtaaataccactga

SEQ ID NO: 7102540 - DNA, 22 bp, Homo sapiens
ggacacagtggaagacagcttg

SEQ ID NO: 7102541 - DNA, 22 bp, Homo sapiens
ggacagggtaagtactagtgtg

SEQ ID NO: 7102542 - DNA, 22 bp, Homo sapiens
ggacatggaagtatggagtgga

SEQ ID NO: 7102543 - DNA, 22 bp, Homo sapiens
ggacatgattagcagggagagc

SEQ ID NO: 7102544 - DNA, 19 bp, Homo sapiens
ggacatcactctaagcctt

SEQ ID NO: 7102545 - DNA, 22 bp, Homo sapiens
ggacatctcttgccagggctgc

SEQ ID NO: 7102546 - DNA, 22 bp, Homo sapiens
ggacatctgggccccaggtcta

SEQ ID NO: 7102547 - DNA, 22 bp, Homo sapiens
ggacatcttccagctgcttgcc

SEQ ID NO: 7102548 - DNA, 22 bp, Homo sapiens
ggacatcttggttgcttccaag

SEQ ID NO: 7102549 - DNA, 21 bp, Homo sapiens
ggacatgaggcaggagaggct

SEQ ID NO: 7102550 - DNA, 22 bp, Homo sapiens
ggaccaggccagcctccctgcg

SEQ ID NO: 7102551 - DNA, 22 bp, Homo sapiens
ggaccaggccagcctccctgcg

SEQ ID NO: 7102552 - DNA, 22 bp, Homo sapiens
ggaccaggcaagctgaggcggg

SEQ ID NO: 7102553 - DNA, 22 bp, Homo sapiens
ggaccaggccagcctccctgcg

SEQ ID NO: 7102554 - DNA, 22 bp, Homo sapiens
ggaccaggctgagcacctgcct

SEQ ID NO: 7102555 - DNA, 22 bp, Homo sapiens
ggaccaggccagcctccctgcg

SEQ ID NO: 7102556 - DNA, 22 bp, Homo sapiens
ggaccaggctgagcacctgcct

SEQ ID NO: 7102557 - DNA, 22 bp, Homo sapiens
ggaccagtttcaaactgtacca

SEQ ID NO: 7102558 - DNA, 22 bp, Homo sapiens
ggaccagtggcagggtgctgtg

SEQ ID NO: 7102559 - DNA, 22 bp, Homo sapiens
ggaccagtttcaaactgtacca

SEQ ID NO: 7102560 - DNA, 20 bp, Homo sapiens
ggaccaggtggggcggtggc

SEQ ID NO: 7102561 - DNA, 19 bp, Homo sapiens
ggaccaggtcctgggcagc

SEQ ID NO: 7102562 - DNA, 17 bp, Homo sapiens
ggaccaggggttgccat

SEQ ID NO: 7102563 - DNA, 19 bp, Homo sapiens
ggaccaggtcctgggcagc

SEQ ID NO: 7102564 - DNA, 22 bp, Homo sapiens
ggaccaggggcgcactccctgc

SEQ ID NO: 7102565 - DNA, 22 bp, Homo sapiens
ggagacagggttgaaccacgca

SEQ ID NO: 7102566 - DNA, 22 bp, Homo sapiens
ggagacagtatggcttgtagct

SEQ ID NO: 7102567 - DNA, 22 bp, Homo sapiens
ggaccatctctagccagagctt

SEQ ID NO: 7102568 - DNA, 22 bp, Homo sapiens
ggagacagtatggcttgtagct

SEQ ID NO: 7102569 - DNA, 22 bp, Homo sapiens
ggagacagtgacttagagactg

SEQ ID NO: 7102570 - DNA, 18 bp, Homo sapiens
gctttatttcttggggaa

SEQ ID NO: 7102571 - DNA, 22 bp, Homo sapiens
gctttatgtgagtagcactgtc

SEQ ID NO: 7102572 - DNA, 18 bp, Homo sapiens
gctttatttcttggggaa

SEQ ID NO: 7102573 - DNA, 18 bp, Homo sapiens
gctttatttcttggggaa

SEQ ID NO: 7102574 - DNA, 22 bp, Homo sapiens
gcttggaagtaggattgggaga

SEQ ID NO: 7102575 - DNA, 22 bp, Homo sapiens
gcttgctttgtaaatatctgtg

SEQ ID NO: 7102576 - DNA, 19 bp, Homo sapiens
gcttgctttatgaaggggg

SEQ ID NO: 7102577 - DNA, 21 bp, Homo sapiens
gcttgcttggagtttaggagt

SEQ ID NO: 7102578 - DNA, 20 bp, Homo sapiens
gcttgctttgtctgatgggc

SEQ ID NO: 7102579 - DNA, 20 bp, Homo sapiens
gcttgctttgtctgatgggc

SEQ ID NO: 7102580 - DNA, 22 bp, Homo sapiens
gcttggaagtaggattgggaga

SEQ ID NO: 7102581 - DNA, 22 bp, Homo sapiens
gcttggaagtaggattgggaga

SEQ ID NO: 7102582 - DNA, 19 bp, Homo sapiens
gcttgctgctaggtaggga

SEQ ID NO: 7102583 - DNA, 19 bp, Homo sapiens
gcttgctggcgggggtctg

SEQ ID NO: 7102584 - DNA, 22 bp, Homo sapiens
gcttgctggtgcctgcaggctc

SEQ ID NO: 7102585 - DNA, 22 bp, Homo sapiens
gcttgctagaagcttaaaggta

SEQ ID NO: 7102586 - DNA, 23 bp, Homo sapiens
gcttgctcattctatcacacagc

SEQ ID NO: 7102587 - DNA, 22 bp, Homo sapiens
gcttgctctttagccatggcca

SEQ ID NO: 7102588 - DNA, 22 bp, Homo sapiens
gcttgctctttagccatggcca

SEQ ID NO: 7102589 - DNA, 17 bp, Homo sapiens
gcttgccttgtcttcct

SEQ ID NO: 7102590 - DNA, 23 bp, Homo sapiens
gcttgcctggtgtgtggctgacc

SEQ ID NO: 7102591 - DNA, 22 bp, Homo sapiens
gcttgcctggcatttctggggc

SEQ ID NO: 7102592 - DNA, 22 bp, Homo sapiens
gcttgcatcttctagttcctag

SEQ ID NO: 7102593 - DNA, 22 bp, Homo sapiens
gcttgcatgatatggcatctgg

SEQ ID NO: 7102594 - DNA, 22 bp, Homo sapiens
gcttgcatgattggagtgggtg

SEQ ID NO: 7102595 - DNA, 22 bp, Homo sapiens
gcttgcatgattggagtgggtg

SEQ ID NO: 7102596 - DNA, 22 bp, Homo sapiens
gcttgcattaggagttatgact

SEQ ID NO: 7102597 - DNA, 22 bp, Homo sapiens
gcttgcattctggatctatggt

SEQ ID NO: 7102598 - DNA, 22 bp, Homo sapiens
gcttgcattgtcagaatgacta

SEQ ID NO: 7102599 - DNA, 22 bp, Homo sapiens
gcttgcatttggaatagattaa

SEQ ID NO: 7102600 - DNA, 22 bp, Homo sapiens
gcttgcctatctggtggtcgtt

SEQ ID NO: 7102601 - DNA, 22 bp, Homo sapiens
gcttgagtcatttagatcatca

SEQ ID NO: 7102602 - DNA, 22 bp, Homo sapiens
gcttgcacataagcacacactt

SEQ ID NO: 7102603 - DNA, 22 bp, Homo sapiens
gcttgcatagctctgtcctgtt

SEQ ID NO: 7102604 - DNA, 22 bp, Homo sapiens
gcttgcatattggaaagactca

SEQ ID NO: 7102605 - DNA, 22 bp, Homo sapiens
gcttgcatcatcttgagagtcc

SEQ ID NO: 7102606 - DNA, 22 bp, Homo sapiens
gcttgagaacttcaactcagtg

SEQ ID NO: 7102607 - DNA, 22 bp, Homo sapiens
gctgtgtgaccctagccagtag

SEQ ID NO: 7102608 - DNA, 22 bp, Homo sapiens
gctgtgtgaaaactgggcctgg

SEQ ID NO: 7102609 - DNA, 22 bp, Homo sapiens
gctgtgtgaccctagccagtag

SEQ ID NO: 7102610 - DNA, 22 bp, Homo sapiens
gctgtgtctgttttacgtcaag

SEQ ID NO: 7102611 - DNA, 22 bp, Homo sapiens
gctgtgtgaaaactgggcctgg

SEQ ID NO: 7102612 - DNA, 22 bp, Homo sapiens
gctgtgtcctcacacagccttt

SEQ ID NO: 7102613 - DNA, 22 bp, Homo sapiens
gctgtgtcctcacacagccttt

SEQ ID NO: 7102614 - DNA, 22 bp, Homo sapiens
gctgtgtcctcacacagccttt

SEQ ID NO: 7102615 - DNA, 22 bp, Homo sapiens
gctgtgtccaggtgggggtgac

SEQ ID NO: 7102616 - DNA, 22 bp, Homo sapiens
gctgtgtccaggtgggggtgac

SEQ ID NO: 7102617 - DNA, 22 bp, Homo sapiens
gctgtgtcagaaactctgggga

SEQ ID NO: 7102618 - DNA, 22 bp, Homo sapiens
gctgtgtcagaaactctgggga

SEQ ID NO: 7102619 - DNA, 19 bp, Homo sapiens
gctgtgtcatttcttagga

SEQ ID NO: 7102620 - DNA, 20 bp, Homo sapiens
gctgtgtagcagtgtgcagt

SEQ ID NO: 7102621 - DNA, 19 bp, Homo sapiens
gcttctgtttgggcttaga

SEQ ID NO: 7102622 - DNA, 22 bp, Homo sapiens
gcttcttgcctgtgtagagaat

SEQ ID NO: 7102623 - DNA, 22 bp, Homo sapiens
gcttctgttcaaggatataagg

SEQ ID NO: 7102624 - DNA, 22 bp, Homo sapiens
gcttctgttaacttatgttccc

SEQ ID NO: 7102625 - DNA, 22 bp, Homo sapiens
gcttctgtggttgtcacgacta

SEQ ID NO: 7102626 - DNA, 22 bp, Homo sapiens
gcttctgtggtgcatctttgct

SEQ ID NO: 7102627 - DNA, 22 bp, Homo sapiens
gcttctgtggtgcatctttgct

SEQ ID NO: 7102628 - DNA, 22 bp, Homo sapiens
gcttctgtggtgaggtcacctt

SEQ ID NO: 7102629 - DNA, 22 bp, Homo sapiens
gcttctgtggattggctggctt

SEQ ID NO: 7102630 - DNA, 22 bp, Homo sapiens
gcttctgtgagtgcagatgctg

SEQ ID NO: 7102631 - DNA, 22 bp, Homo sapiens
gcttctgtcttagctacctccc

SEQ ID NO: 7102632 - DNA, 22 bp, Homo sapiens
gcttctgtatttattgtccttt

SEQ ID NO: 7102633 - DNA, 21 bp, Homo sapiens
gcttctgtatctagcaggaac

SEQ ID NO: 7102634 - DNA, 22 bp, Homo sapiens
gctgtggcttgcagctggggct

SEQ ID NO: 7102635 - DNA, 22 bp, Homo sapiens
gctgtggcttgcagctggggct

SEQ ID NO: 7102636 - DNA, 22 bp, Homo sapiens
gctgtggcttgcagctggggct

SEQ ID NO: 7102637 - DNA, 22 bp, Homo sapiens
gctgtggctgaccaccaggggg

SEQ ID NO: 7102638 - DNA, 22 bp, Homo sapiens
gctgtggctgtacagagaccat

SEQ ID NO: 7102639 - DNA, 22 bp, Homo sapiens
gctgtggctgtacagagaccat

SEQ ID NO: 7102640 - DNA, 22 bp, Homo sapiens
gctgtggctgtacagagaccat

SEQ ID NO: 7102641 - DNA, 19 bp, Homo sapiens
gctgtgggacagcagggtg

SEQ ID NO: 7102642 - DNA, 19 bp, Homo sapiens
gctgtgggacagcagggtg

SEQ ID NO: 7102643 - DNA, 19 bp, Homo sapiens
gctgtgggacagcagggtg

SEQ ID NO: 7102644 - DNA, 19 bp, Homo sapiens
gctgtgggacagcagggtg

SEQ ID NO: 7102645 - DNA, 19 bp, Homo sapiens
gctgtgggacagcagggtg

SEQ ID NO: 7102646 - DNA, 22 bp, Homo sapiens
gctgtggctttctgtttctgtt

SEQ ID NO: 7102647 - DNA, 22 bp, Homo sapiens
gctgtggctttctgtttctgtt

SEQ ID NO: 7102648 - DNA, 22 bp, Homo sapiens
gctgtggctgaagatgcaggga

SEQ ID NO: 7102649 - DNA, 22 bp, Homo sapiens
gctgtggctgaagatgcaggga

SEQ ID NO: 7102650 - DNA, 22 bp, Homo sapiens
gctgtggctgaagatgcaggga

SEQ ID NO: 7102651 - DNA, 22 bp, Homo sapiens
gctgtggctgaagatgcaggga

SEQ ID NO: 7102652 - DNA, 22 bp, Homo sapiens
gctgtggctgacattgcagaca

SEQ ID NO: 7102653 - DNA, 22 bp, Homo sapiens
gctgtggcggcagcagctggtg

SEQ ID NO: 7102654 - DNA, 22 bp, Homo sapiens
gctgtggctccaatggtgagcc

SEQ ID NO: 7102655 - DNA, 22 bp, Homo sapiens
gctgtggcggcagcagctggtg

SEQ ID NO: 7102656 - DNA, 22 bp, Homo sapiens
gctgtggctccaatggtgagcc

SEQ ID NO: 7102657 - DNA, 22 bp, Homo sapiens
gctgtggctccaatggtgagcc

SEQ ID NO: 7102658 - DNA, 22 bp, Homo sapiens
gctgtggctccaatggtgagcc

SEQ ID NO: 7102659 - DNA, 22 bp, Homo sapiens
gctgtggctctcacaagcaaat

SEQ ID NO: 7102660 - DNA, 22 bp, Homo sapiens
gctgtggctctcacaagcaaat

SEQ ID NO: 7102661 - DNA, 22 bp, Homo sapiens
gctgtgggccacacggctgagt

SEQ ID NO: 7102662 - DNA, 22 bp, Homo sapiens
gctgtgggccacacggctgagt

SEQ ID NO: 7102663 - DNA, 22 bp, Homo sapiens
gctgtgggacaggtccagccag

SEQ ID NO: 7102664 - DNA, 19 bp, Homo sapiens
gctgtgggacagcagggtg

SEQ ID NO: 7102665 - DNA, 22 bp, Homo sapiens
gctgtgggccacacggctgagt

SEQ ID NO: 7102666 - DNA, 22 bp, Homo sapiens
gctgtgggtaaacgctgagggt

SEQ ID NO: 7102667 - DNA, 22 bp, Homo sapiens
gctgtgggtaaacgctgagggt

SEQ ID NO: 7102668 - DNA, 22 bp, Homo sapiens
gctgtgggtaaacgctgagggt

SEQ ID NO: 7102669 - DNA, 22 bp, Homo sapiens
gctgtgggtaaacgctgagggt

SEQ ID NO: 7102670 - DNA, 22 bp, Homo sapiens
gctgtgggccatggccaagtga

SEQ ID NO: 7102671 - DNA, 22 bp, Homo sapiens
gctgtggggagagaacacacaa

SEQ ID NO: 7102672 - DNA, 22 bp, Homo sapiens
gctgtgggttcctggcatttga

SEQ ID NO: 7102673 - DNA, 22 bp, Homo sapiens
gctgtgggttcctggcatttga

SEQ ID NO: 7102674 - DNA, 22 bp, Homo sapiens
gctgtgggtttccaatcctgga

SEQ ID NO: 7102675 - DNA, 22 bp, Homo sapiens
gctgtgggtaaacgctgagggt

SEQ ID NO: 7102676 - DNA, 22 bp, Homo sapiens
gctgtgggtaaacgctgagggt

SEQ ID NO: 7102677 - DNA, 22 bp, Homo sapiens
gctgtgggtaaacgctgagggt

SEQ ID NO: 7102678 - DNA, 22 bp, Homo sapiens
gctgtgggtccggaccccacgg

SEQ ID NO: 7102679 - DNA, 22 bp, Homo sapiens
gctgtgggtacaaatacacaat

SEQ ID NO: 7102680 - DNA, 22 bp, Homo sapiens
gctgtgggtgctggctccaccc

SEQ ID NO: 7102681 - DNA, 22 bp, Homo sapiens
gctgtgggtgctggctccaccc

SEQ ID NO: 7102682 - DNA, 22 bp, Homo sapiens
gctggggctgggctgaggaaga

SEQ ID NO: 7102683 - DNA, 19 bp, Homo sapiens
gctggggcctgaccagaca

SEQ ID NO: 7102684 - DNA, 19 bp, Homo sapiens
gctggggcctgaccagaca

SEQ ID NO: 7102685 - DNA, 22 bp, Homo sapiens
gctggggctgggctgaggaaga

SEQ ID NO: 7102686 - DNA, 22 bp, Homo sapiens
gctggggctgggctgaggaaga

SEQ ID NO: 7102687 - DNA, 22 bp, Homo sapiens
gctggggcctgaacagtcagct

SEQ ID NO: 7102688 - DNA, 22 bp, Homo sapiens
gctggggcctgaacagtcagct

SEQ ID NO: 7102689 - DNA, 19 bp, Homo sapiens
gctggggcctgaccagaca

SEQ ID NO: 7102690 - DNA, 19 bp, Homo sapiens
gctggggcctgaccagaca

SEQ ID NO: 7102691 - DNA, 22 bp, Homo sapiens
gctgtgctcaacgtgccttcct

SEQ ID NO: 7102692 - DNA, 22 bp, Homo sapiens
gctgtgctatatctctgagtgt

SEQ ID NO: 7102693 - DNA, 22 bp, Homo sapiens
gctggggctgggctgaggaaga

SEQ ID NO: 7102694 - DNA, 22 bp, Homo sapiens
gctggggctgggctgaggaaga

SEQ ID NO: 7102695 - DNA, 20 bp, Homo sapiens
gctgtgcctccagctggtgg

SEQ ID NO: 7102696 - DNA, 20 bp, Homo sapiens
gctgtgcctccagctggtgg

SEQ ID NO: 7102697 - DNA, 22 bp, Homo sapiens
gctggggagggcgtcaaggcca

SEQ ID NO: 7102698 - DNA, 22 bp, Homo sapiens
gctggggaggcagcagagaaca

SEQ ID NO: 7102699 - DNA, 22 bp, Homo sapiens
gctggggagggcgtcaaggcca

SEQ ID NO: 7102700 - DNA, 22 bp, Homo sapiens
gctggggcctctgtgaggttaa

SEQ ID NO: 7102701 - DNA, 22 bp, Homo sapiens
gctggggcctctgtgaggttaa

SEQ ID NO: 7102702 - DNA, 22 bp, Homo sapiens
gctggggcctctgtgaggttaa

SEQ ID NO: 7102703 - DNA, 22 bp, Homo sapiens
gctggggcctgaacagtcagct

SEQ ID NO: 7102704 - DNA, 22 bp, Homo sapiens
gctggggaggcagcagagaaca

SEQ ID NO: 7102705 - DNA, 22 bp, Homo sapiens
gctggggaggcagcagagaaca

SEQ ID NO: 7102706 - DNA, 22 bp, Homo sapiens
gctgggcttggtttccctgctt

SEQ ID NO: 7102707 - DNA, 22 bp, Homo sapiens
gctgggcttggtttccctgctt

SEQ ID NO: 7102708 - DNA, 22 bp, Homo sapiens
gctgggcttggtttccctgctt

SEQ ID NO: 7102709 - DNA, 19 bp, Homo sapiens
gctgggcttgggtttgtag

SEQ ID NO: 7102710 - DNA, 22 bp, Homo sapiens
gctgggcttctcaatgctgcct

SEQ ID NO: 7102711 - DNA, 22 bp, Homo sapiens
gctggctggagtaaggagggag

SEQ ID NO: 7102712 - DNA, 22 bp, Homo sapiens
gctggctggagtaaggagggag

SEQ ID NO: 7102713 - DNA, 22 bp, Homo sapiens
gctggctggagtaaggagggag

SEQ ID NO: 7102714 - DNA, 22 bp, Homo sapiens
gctggctggagtaaggagggag

SEQ ID NO: 7102715 - DNA, 22 bp, Homo sapiens
gctggctggaggtgaggaagaa

SEQ ID NO: 7102716 - DNA, 22 bp, Homo sapiens
gctggctggagtaaggagggag

SEQ ID NO: 7102717 - DNA, 22 bp, Homo sapiens
gctggctggagtgagctaccct

SEQ ID NO: 7102718 - DNA, 22 bp, Homo sapiens
gctggctggagtgagctaccct

SEQ ID NO: 7102719 - DNA, 22 bp, Homo sapiens
gctggctggcgggtgcgtcctc

SEQ ID NO: 7102720 - DNA, 22 bp, Homo sapiens
gctggctggcgggtgcgtcctc

SEQ ID NO: 7102721 - DNA, 19 bp, Homo sapiens
gctggctggaggagggaca

SEQ ID NO: 7102722 - DNA, 22 bp, Homo sapiens
gctggctggaatgggagaagaa

SEQ ID NO: 7102723 - DNA, 22 bp, Homo sapiens
gctggctggaactagcagttgg

SEQ ID NO: 7102724 - DNA, 22 bp, Homo sapiens
gctggctggaatgggagaagaa

SEQ ID NO: 7102725 - DNA, 22 bp, Homo sapiens
gctggctggaatgggagaagaa

SEQ ID NO: 7102726 - DNA, 22 bp, Homo sapiens
gctggctggaatgggagaagaa

SEQ ID NO: 7102727 - DNA, 22 bp, Homo sapiens
gctggctggaggagggaggttg

SEQ ID NO: 7102728 - DNA, 22 bp, Homo sapiens
gctggctggaggagggaggttg

SEQ ID NO: 7102729 - DNA, 22 bp, Homo sapiens
gctggctggaggtgaggaagaa

SEQ ID NO: 7102730 - DNA, 22 bp, Homo sapiens
gctggctggaggtgaggaagaa

SEQ ID NO: 7102731 - DNA, 22 bp, Homo sapiens
gctggctggaggtgaggaagaa

SEQ ID NO: 7102732 - DNA, 22 bp, Homo sapiens
gctggctggaggtgaggaagaa

SEQ ID NO: 7102733 - DNA, 19 bp, Homo sapiens
gctggctggaggagggaca

SEQ ID NO: 7102734 - DNA, 19 bp, Homo sapiens
gctggctggaggagggaca

SEQ ID NO: 7102735 - DNA, 22 bp, Homo sapiens
gctggctggaggagggaggttg

SEQ ID NO: 7102736 - DNA, 22 bp, Homo sapiens
gctggctggaggagggaggttg

SEQ ID NO: 7102737 - DNA, 22 bp, Homo sapiens
gctggagaaactgcagctgagg

SEQ ID NO: 7102738 - DNA, 22 bp, Homo sapiens
gctggagaaactgcagctgagg

SEQ ID NO: 7102739 - DNA, 22 bp, Homo sapiens
gctggagaaactgcagctgagg

SEQ ID NO: 7102740 - DNA, 22 bp, Homo sapiens
gctggagaacccaggaggaaga

SEQ ID NO: 7102741 - DNA, 22 bp, Homo sapiens
gctggagaacccaggaggaaga

SEQ ID NO: 7102742 - DNA, 22 bp, Homo sapiens
gctggagaacccaggaggaaga

SEQ ID NO: 7102743 - DNA, 22 bp, Homo sapiens
gctggagacctcagagaaccca

SEQ ID NO: 7102744 - DNA, 22 bp, Homo sapiens
gctggagacctcagagaaccca

SEQ ID NO: 7102745 - DNA, 20 bp, Homo sapiens
gctgctttcaaatgacacgt

SEQ ID NO: 7102746 - DNA, 20 bp, Homo sapiens
gctgctttcaaatgacacgt

SEQ ID NO: 7102747 - DNA, 22 bp, Homo sapiens
gctgctttataatctcggcaga

SEQ ID NO: 7102748 - DNA, 22 bp, Homo sapiens
gctggagaaacaggaggaggaa

SEQ ID NO: 7102749 - DNA, 22 bp, Homo sapiens
gctggagaaacaggaggaggaa

SEQ ID NO: 7102750 - DNA, 22 bp, Homo sapiens
gctgctttagaattgaaacaga

SEQ ID NO: 7102751 - DNA, 22 bp, Homo sapiens
gctgctttagacaggagaagca

SEQ ID NO: 7102752 - DNA, 22 bp, Homo sapiens
gctgctttaggttgagctcagc

SEQ ID NO: 7102753 - DNA, 22 bp, Homo sapiens
gctgctttactgaagagatatg

SEQ ID NO: 7102754 - DNA, 22 bp, Homo sapiens
gctgctttactgaagagatatg

SEQ ID NO: 7102755 - DNA, 22 bp, Homo sapiens
gctgctttactgaagagatatg

SEQ ID NO: 7102756 - DNA, 22 bp, Homo sapiens
gctgctttagaattgaaacaga

SEQ ID NO: 7102757 - DNA, 22 bp, Homo sapiens
gctgctttagaattgaaacaga

SEQ ID NO: 7102758 - DNA, 22 bp, Homo sapiens
gctgctttagaattgaaacaga

SEQ ID NO: 7102759 - DNA, 22 bp, Homo sapiens
gctggagagataggcatggggt

SEQ ID NO: 7102760 - DNA, 22 bp, Homo sapiens
gctggagagataggcatggggt

SEQ ID NO: 7102761 - DNA, 22 bp, Homo sapiens
gctggagagataggcatggggt

SEQ ID NO: 7102762 - DNA, 22 bp, Homo sapiens
gctggagagataggcatggggt

SEQ ID NO: 7102763 - DNA, 22 bp, Homo sapiens
gctggctgcgtcatcacagggc

SEQ ID NO: 7102764 - DNA, 22 bp, Homo sapiens
gctggctgcgtcatcacagggc

SEQ ID NO: 7102765 - DNA, 22 bp, Homo sapiens
gctggctgcgtcatcacagggc

SEQ ID NO: 7102766 - DNA, 22 bp, Homo sapiens
gctggctgctaggacagctaca

SEQ ID NO: 7102767 - DNA, 22 bp, Homo sapiens
gctggctgctaggacagctaca

SEQ ID NO: 7102768 - DNA, 22 bp, Homo sapiens
gctggctgctgttgagacttgt

SEQ ID NO: 7102769 - DNA, 17 bp, Homo sapiens
gctggcttctccttgct

SEQ ID NO: 7102770 - DNA, 17 bp, Homo sapiens
gctggcttctccttgct

SEQ ID NO: 7102771 - DNA, 22 bp, Homo sapiens
gctggcttccctacctgcacct

SEQ ID NO: 7102772 - DNA, 22 bp, Homo sapiens
gctggcttccatgcggacatca

SEQ ID NO: 7102773 - DNA, 22 bp, Homo sapiens
gctggcttaatagggatgggct

SEQ ID NO: 7102774 - DNA, 22 bp, Homo sapiens
gctggctggctgtgcaaaggca

SEQ ID NO: 7102775 - DNA, 21 bp, Homo sapiens
gctggctggctgaccggcctt

SEQ ID NO: 7102776 - DNA, 22 bp, Homo sapiens
gctggctgtgggctccacgctc

SEQ ID NO: 7102777 - DNA, 22 bp, Homo sapiens
gctggctgttgaataatggcat

SEQ ID NO: 7102778 - DNA, 22 bp, Homo sapiens
gctggctgtgttccttctgcca

SEQ ID NO: 7102779 - DNA, 22 bp, Homo sapiens
gctgggctgtagtttgctgacc

SEQ ID NO: 7102780 - DNA, 22 bp, Homo sapiens
gctgggctgtagtttgctgacc

SEQ ID NO: 7102781 - DNA, 22 bp, Homo sapiens
gctgggcttcacctccagagtt

SEQ ID NO: 7102782 - DNA, 22 bp, Homo sapiens
gctgggcttcacctccagagtt

SEQ ID NO: 7102783 - DNA, 22 bp, Homo sapiens
gctgggcttcacctccagagtt

SEQ ID NO: 7102784 - DNA, 22 bp, Homo sapiens
gctgggcttctcaatgctgcct

SEQ ID NO: 7102785 - DNA, 22 bp, Homo sapiens
gctgggcttctcaatgctgcct

SEQ ID NO: 7102786 - DNA, 22 bp, Homo sapiens
gctggctttgtggtctctcctc

SEQ ID NO: 7102787 - DNA, 22 bp, Homo sapiens
gctggctttgtggtctctcctc

SEQ ID NO: 7102788 - DNA, 22 bp, Homo sapiens
gctggctttgcactgggtgcat

SEQ ID NO: 7102789 - DNA, 21 bp, Homo sapiens
gctggctttattctgcgtttg

SEQ ID NO: 7102790 - DNA, 22 bp, Homo sapiens
gctgggaaatggagtttggctt

SEQ ID NO: 7102791 - DNA, 22 bp, Homo sapiens
gctgggaaatggagtttggctt

SEQ ID NO: 7102792 - DNA, 22 bp, Homo sapiens
gctggcttttgaagtctagcta

SEQ ID NO: 7102793 - DNA, 22 bp, Homo sapiens
gctgggaacacagccatgagag

SEQ ID NO: 7102794 - DNA, 20 bp, Homo sapiens
gctgggaacaggattgaatc

SEQ ID NO: 7102795 - DNA, 20 bp, Homo sapiens
gctgggaacaggattgaatc

SEQ ID NO: 7102796 - DNA, 22 bp, Homo sapiens
gctgggctggccgccgagatcg

SEQ ID NO: 7102797 - DNA, 20 bp, Homo sapiens
gctgggaacaggattgaatc

SEQ ID NO: 7102798 - DNA, 22 bp, Homo sapiens
gctgagggcatgtgtggcgact

SEQ ID NO: 7102799 - DNA, 22 bp, Homo sapiens
gctgagggcatgtgtggcgact

SEQ ID NO: 7102800 - DNA, 22 bp, Homo sapiens
gctgagggcatgtgtggcgact

SEQ ID NO: 7102801 - DNA, 19 bp, Homo sapiens
gctgagggccacccagccc

SEQ ID NO: 7102802 - DNA, 19 bp, Homo sapiens
gctgagggccacccagccc

SEQ ID NO: 7102803 - DNA, 22 bp, Homo sapiens
gctgcccaatggtagtgtcttt

SEQ ID NO: 7102804 - DNA, 22 bp, Homo sapiens
gctgcccaattacagggccgtg

SEQ ID NO: 7102805 - DNA, 22 bp, Homo sapiens
gctgcccaattacagggccgtg

SEQ ID NO: 7102806 - DNA, 22 bp, Homo sapiens
gctgcccaattacagggccgtg

SEQ ID NO: 7102807 - DNA, 22 bp, Homo sapiens
gctgagggctgtaacagcagag

SEQ ID NO: 7102808 - DNA, 22 bp, Homo sapiens
gctgagggctgtaacagcagag

SEQ ID NO: 7102809 - DNA, 22 bp, Homo sapiens
gctgagggccgcatagggtcat

SEQ ID NO: 7102810 - DNA, 22 bp, Homo sapiens
gctgagggccgcatagggtcat

SEQ ID NO: 7102811 - DNA, 22 bp, Homo sapiens
gctgagggccgcatagggtcat

SEQ ID NO: 7102812 - DNA, 22 bp, Homo sapiens
gctgcccagcaggccccagggg

SEQ ID NO: 7102813 - DNA, 22 bp, Homo sapiens
gctgcccaggaagcctggggtt

SEQ ID NO: 7102814 - DNA, 22 bp, Homo sapiens
gctgcccaggaagcctggggtt

SEQ ID NO: 7102815 - DNA, 22 bp, Homo sapiens
gctgcccaggagaggtggggct

SEQ ID NO: 7102816 - DNA, 22 bp, Homo sapiens
gctgcccaggagaggtggggct

SEQ ID NO: 7102817 - DNA, 22 bp, Homo sapiens
gctgcccaggagaggtggggct

SEQ ID NO: 7102818 - DNA, 22 bp, Homo sapiens
gctgcccacaaccccgtgtcta

SEQ ID NO: 7102819 - DNA, 22 bp, Homo sapiens
gctgcccacaaccccgtgtcta

SEQ ID NO: 7102820 - DNA, 22 bp, Homo sapiens
gctgcccacaaccccgtgtcta

SEQ ID NO: 7102821 - DNA, 22 bp, Homo sapiens
gctgcccacaatgattacatgg

SEQ ID NO: 7102822 - DNA, 22 bp, Homo sapiens
gctgcccacagcgggtgtttcg

SEQ ID NO: 7102823 - DNA, 22 bp, Homo sapiens
gctgcccagacattgaatcagg

SEQ ID NO: 7102824 - DNA, 22 bp, Homo sapiens
gctgcccagcaggccccagggg

SEQ ID NO: 7102825 - DNA, 22 bp, Homo sapiens
gctgcccagggtggagccggct

SEQ ID NO: 7102826 - DNA, 22 bp, Homo sapiens
gctgcccaggcaacattgactt

SEQ ID NO: 7102827 - DNA, 22 bp, Homo sapiens
gctgcccagggctgagtgtcct

SEQ ID NO: 7102828 - DNA, 22 bp, Homo sapiens
gctgcccagggctgagtgtcct

SEQ ID NO: 7102829 - DNA, 22 bp, Homo sapiens
gctgcccagtgtgctcatgcag

SEQ ID NO: 7102830 - DNA, 22 bp, Homo sapiens
gctgcccagtgtgctcatgcag

SEQ ID NO: 7102831 - DNA, 22 bp, Homo sapiens
gctgcccagtgtgctcatgcag

SEQ ID NO: 7102832 - DNA, 22 bp, Homo sapiens
gctgcccagttctgctgctgcc

SEQ ID NO: 7102833 - DNA, 22 bp, Homo sapiens
gctgcccagttctgctgctgcc

SEQ ID NO: 7102834 - DNA, 22 bp, Homo sapiens
gctgcccagttctgctgctgcc

SEQ ID NO: 7102835 - DNA, 22 bp, Homo sapiens
gctgcccattccactggatggt

SEQ ID NO: 7102836 - DNA, 22 bp, Homo sapiens
gctgcctagtctgctgagcaga

SEQ ID NO: 7102837 - DNA, 22 bp, Homo sapiens
gctgccctgtggtccagcaggt

SEQ ID NO: 7102838 - DNA, 22 bp, Homo sapiens
gctgccctgtttagccagggtt

SEQ ID NO: 7102839 - DNA, 22 bp, Homo sapiens
gctgcctccaatctgtgccccg

SEQ ID NO: 7102840 - DNA, 22 bp, Homo sapiens
gctgcctgtcctgaggagtccg

SEQ ID NO: 7102841 - DNA, 22 bp, Homo sapiens
gctgcctgtcctgaggagtccg

SEQ ID NO: 7102842 - DNA, 22 bp, Homo sapiens
gctgcctgtcctgaggagtccg

SEQ ID NO: 7102843 - DNA, 22 bp, Homo sapiens
gctgcctgtcctgaggagtccg

SEQ ID NO: 7102844 - DNA, 22 bp, Homo sapiens
gctgcctcaggcacctcctggc

SEQ ID NO: 7102845 - DNA, 22 bp, Homo sapiens
gctgcctccaatctgtgccccg

SEQ ID NO: 7102846 - DNA, 22 bp, Homo sapiens
gctgcctccaatctgtgccccg

SEQ ID NO: 7102847 - DNA, 22 bp, Homo sapiens
gctgcctcaggcacctcctggc

SEQ ID NO: 7102848 - DNA, 22 bp, Homo sapiens
gctgcctcactccagcccaata

SEQ ID NO: 7102849 - DNA, 22 bp, Homo sapiens
gctgcctcaggcacctcctggc

SEQ ID NO: 7102850 - DNA, 22 bp, Homo sapiens
gctgcctcaggcacctcctggc

SEQ ID NO: 7102851 - DNA, 22 bp, Homo sapiens
gctgcccattgctctcccactc

SEQ ID NO: 7102852 - DNA, 22 bp, Homo sapiens
gctgccccagctgggggctgga

SEQ ID NO: 7102853 - DNA, 22 bp, Homo sapiens
gctgcccattccactggatggt

SEQ ID NO: 7102854 - DNA, 22 bp, Homo sapiens
gctgcccattgcacgttgtggc

SEQ ID NO: 7102855 - DNA, 22 bp, Homo sapiens
gctgcccattgcacgttgtggc

SEQ ID NO: 7102856 - DNA, 22 bp, Homo sapiens
gctgcccattgctctcccactc

SEQ ID NO: 7102857 - DNA, 22 bp, Homo sapiens
gctgccccccggactcggcggg

SEQ ID NO: 7102858 - DNA, 22 bp, Homo sapiens
gctgccccgagccatccttcag

SEQ ID NO: 7102859 - DNA, 22 bp, Homo sapiens
gctgccccgagccatccttcag

SEQ ID NO: 7102860 - DNA, 22 bp, Homo sapiens
gctgccctacccgaggcactct

SEQ ID NO: 7102861 - DNA, 22 bp, Homo sapiens
gctgccctacccgaggcactct

SEQ ID NO: 7102862 - DNA, 22 bp, Homo sapiens
gctgccctagaagtacagagag

SEQ ID NO: 7102863 - DNA, 22 bp, Homo sapiens
gctgccctgtctgcagcaggac

SEQ ID NO: 7102864 - DNA, 22 bp, Homo sapiens
gctgccctgtctgcagcaggac

SEQ ID NO: 7102865 - DNA, 22 bp, Homo sapiens
gctgccctgtggtagagggtgg

SEQ ID NO: 7102866 - DNA, 22 bp, Homo sapiens
gctgccctgtggtagagggtgg

SEQ ID NO: 7102867 - DNA, 22 bp, Homo sapiens
gctgccctgtggtccagcaggt

SEQ ID NO: 7102868 - DNA, 22 bp, Homo sapiens
gctgcgccggatcccacgttcc

SEQ ID NO: 7102869 - DNA, 22 bp, Homo sapiens
gctgcgccggatcccacgttcc

SEQ ID NO: 7102870 - DNA, 22 bp, Homo sapiens
gctgcgccggatcccacgttcc

SEQ ID NO: 7102871 - DNA, 22 bp, Homo sapiens
gctgctaagcgtttctgttcca

SEQ ID NO: 7102872 - DNA, 18 bp, Homo sapiens
gctgcgtgggatgtgacc

SEQ ID NO: 7102873 - DNA, 18 bp, Homo sapiens
gctgcgtgggatgtgacc

SEQ ID NO: 7102874 - DNA, 18 bp, Homo sapiens
gctgcgtgggatgtgacc

SEQ ID NO: 7102875 - DNA, 22 bp, Homo sapiens
gctgccttaacttcttcgctgt

SEQ ID NO: 7102876 - DNA, 20 bp, Homo sapiens
gctgcctgtttctgtaagta

SEQ ID NO: 7102877 - DNA, 22 bp, Homo sapiens
gctgcctgttgaagggtctgtg

SEQ ID NO: 7102878 - DNA, 20 bp, Homo sapiens
gctgcctgtttctgtaagta

SEQ ID NO: 7102879 - DNA, 20 bp, Homo sapiens
gctgcctgtttctgtaagta

SEQ ID NO: 7102880 - DNA, 22 bp, Homo sapiens
gctgccttcagttctgattcat

SEQ ID NO: 7102881 - DNA, 22 bp, Homo sapiens
gctgcctgtcctgaggagtccg

SEQ ID NO: 7102882 - DNA, 22 bp, Homo sapiens
gctgcctgtctgctgacccagg

SEQ ID NO: 7102883 - DNA, 22 bp, Homo sapiens
gctgcctgtctgctgacccagg

SEQ ID NO: 7102884 - DNA, 22 bp, Homo sapiens
gctgcctgtgcactttctcgta

SEQ ID NO: 7102885 - DNA, 22 bp, Homo sapiens
gctgcctgtggcccttctgggt

SEQ ID NO: 7102886 - DNA, 22 bp, Homo sapiens
gctgcctgtggcccttctgggt

SEQ ID NO: 7102887 - DNA, 22 bp, Homo sapiens
gctgcctgtggcccttctgggt

SEQ ID NO: 7102888 - DNA, 22 bp, Homo sapiens
gctgcctgttgaagggtctgtg

SEQ ID NO: 7102889 - DNA, 22 bp, Homo sapiens
gctgctccgtctgagctctggt

SEQ ID NO: 7102890 - DNA, 22 bp, Homo sapiens
gctgctccgtctgagctctggt

SEQ ID NO: 7102891 - DNA, 22 bp, Homo sapiens
gctgctcctgagtcccgcgcgc

SEQ ID NO: 7102892 - DNA, 22 bp, Homo sapiens
gctgctccgcagagtgtgtgtg

SEQ ID NO: 7102893 - DNA, 22 bp, Homo sapiens
gctgctccgtctgagctctggt

SEQ ID NO: 7102894 - DNA, 22 bp, Homo sapiens
gctgctcagtgggcctgagcct

SEQ ID NO: 7102895 - DNA, 22 bp, Homo sapiens
gctgctcatttgtatcctttgt

SEQ ID NO: 7102896 - DNA, 22 bp, Homo sapiens
gctgctccagctgtgctgcaga

SEQ ID NO: 7102897 - DNA, 22 bp, Homo sapiens
gctgctccagctgtgctgcaga

SEQ ID NO: 7102898 - DNA, 22 bp, Homo sapiens
gctgctccagtgttctgtctag

SEQ ID NO: 7102899 - DNA, 22 bp, Homo sapiens
gctgctccagtgttctgtctag

SEQ ID NO: 7102900 - DNA, 21 bp, Homo sapiens
gctgctgtgggccagggaggc

SEQ ID NO: 7102901 - DNA, 22 bp, Homo sapiens
gctgctgtgaattttttaaatg

SEQ ID NO: 7102902 - DNA, 21 bp, Homo sapiens
gctgctcgagatccagtgctt

SEQ ID NO: 7102903 - DNA, 21 bp, Homo sapiens
gctgctcgagatccagtgctt

SEQ ID NO: 7102904 - DNA, 21 bp, Homo sapiens
gctgctcgagatccagtgctt

SEQ ID NO: 7102905 - DNA, 19 bp, Homo sapiens
gctgctcctggctgaccac

SEQ ID NO: 7102906 - DNA, 22 bp, Homo sapiens
gctgctgtgttggccactgctt

SEQ ID NO: 7102907 - DNA, 22 bp, Homo sapiens
gctgctgtgttggagagggact

SEQ ID NO: 7102908 - DNA, 22 bp, Homo sapiens
gctgctgtgttggccactgctt

SEQ ID NO: 7102909 - DNA, 22 bp, Homo sapiens
gctgctgtgtgggagacaggcg

SEQ ID NO: 7102910 - DNA, 21 bp, Homo sapiens
gctgctgtgggccagggaggc

SEQ ID NO: 7102911 - DNA, 21 bp, Homo sapiens
gctgctgtgggccagggaggc

SEQ ID NO: 7102912 - DNA, 22 bp, Homo sapiens
gctgcttcctagaaggcccagt

SEQ ID NO: 7102913 - DNA, 22 bp, Homo sapiens
gctgctttaaaatcagcatagc

SEQ ID NO: 7102914 - DNA, 22 bp, Homo sapiens
gctgctttaactggacggctcc

SEQ ID NO: 7102915 - DNA, 22 bp, Homo sapiens
gctgctttacaggtgggggagc

SEQ ID NO: 7102916 - DNA, 22 bp, Homo sapiens
gctctggcttggggcactcgtc

SEQ ID NO: 7102917 - DNA, 22 bp, Homo sapiens
gctctgggaactgactgccttc

SEQ ID NO: 7102918 - DNA, 18 bp, Homo sapiens
gctctggctcacctccag

SEQ ID NO: 7102919 - DNA, 18 bp, Homo sapiens
gctctggctcacctccag

SEQ ID NO: 7102920 - DNA, 22 bp, Homo sapiens
gctctggctcaaaccaccggct

SEQ ID NO: 7102921 - DNA, 22 bp, Homo sapiens
gctctggctcaaaccaccggct

SEQ ID NO: 7102922 - DNA, 18 bp, Homo sapiens
gctctggctcacctccag

SEQ ID NO: 7102923 - DNA, 22 bp, Homo sapiens
gctctgggaactgactgccttc

SEQ ID NO: 7102924 - DNA, 22 bp, Homo sapiens
gctctgggaactgactgccttc

SEQ ID NO: 7102925 - DNA, 22 bp, Homo sapiens
gctctgggaactgactgccttc

SEQ ID NO: 7102926 - DNA, 22 bp, Homo sapiens
gctctgggaactgactgccttc

SEQ ID NO: 7102927 - DNA, 22 bp, Homo sapiens
gctctgggaaggatcgtagtga

SEQ ID NO: 7102928 - DNA, 22 bp, Homo sapiens
gctctgggaaggatcgtagtga

SEQ ID NO: 7102929 - DNA, 22 bp, Homo sapiens
gctctgggaaggatcgtagtga

SEQ ID NO: 7102930 - DNA, 22 bp, Homo sapiens
gctctgggaagtcctttaccat

SEQ ID NO: 7102931 - DNA, 22 bp, Homo sapiens
gctctgggaagtcctttaccat

SEQ ID NO: 7102932 - DNA, 22 bp, Homo sapiens
gctctgggaattcagaaagcct

SEQ ID NO: 7102933 - DNA, 22 bp, Homo sapiens
gctctgggaattcagaaagcct

SEQ ID NO: 7102934 - DNA, 22 bp, Homo sapiens
gctctggctagttacctcttac

SEQ ID NO: 7102935 - DNA, 22 bp, Homo sapiens
gctctggctcaaaccaccggct

SEQ ID NO: 7102936 - DNA, 22 bp, Homo sapiens
gctctggctcaaaccaccggct

SEQ ID NO: 7102937 - DNA, 22 bp, Homo sapiens
gctcctctcccagagctgcagg

SEQ ID NO: 7102938 - DNA, 22 bp, Homo sapiens
gctcctccaatatggactcctc

SEQ ID NO: 7102939 - DNA, 22 bp, Homo sapiens
gctcctccaatatggactcctc

SEQ ID NO: 7102940 - DNA, 22 bp, Homo sapiens
gctcctccaatatggactcctc

SEQ ID NO: 7102941 - DNA, 22 bp, Homo sapiens
gctcctccctgtgcagacccag

SEQ ID NO: 7102942 - DNA, 22 bp, Homo sapiens
gctcctccctgtgcagacccag

SEQ ID NO: 7102943 - DNA, 22 bp, Homo sapiens
gctcctctattccccacatttt

SEQ ID NO: 7102944 - DNA, 22 bp, Homo sapiens
gctcctccctgtgcagacccag

SEQ ID NO: 7102945 - DNA, 22 bp, Homo sapiens
gctccctgtgctctgagtgata

SEQ ID NO: 7102946 - DNA, 22 bp, Homo sapiens
gctccctgttctcagccatgat

SEQ ID NO: 7102947 - DNA, 22 bp, Homo sapiens
gctccctgttctcagccatgat

SEQ ID NO: 7102948 - DNA, 22 bp, Homo sapiens
gctccggcttggtgtgcagggt

SEQ ID NO: 7102949 - DNA, 22 bp, Homo sapiens
gctccgggggttccagatcatc

SEQ ID NO: 7102950 - DNA, 20 bp, Homo sapiens
gctctgggagggatgtgatg

SEQ ID NO: 7102951 - DNA, 22 bp, Homo sapiens
gctctgggattaccagccttag

SEQ ID NO: 7102952 - DNA, 22 bp, Homo sapiens
gctctgggattaccagccttag

SEQ ID NO: 7102953 - DNA, 22 bp, Homo sapiens
gctctgggattaccagccttag

SEQ ID NO: 7102954 - DNA, 22 bp, Homo sapiens
gctctgggattaccagccttag

SEQ ID NO: 7102955 - DNA, 22 bp, Homo sapiens
gctctgggaattcagaaagcct

SEQ ID NO: 7102956 - DNA, 22 bp, Homo sapiens
gctctgggaattcagaaagcct

SEQ ID NO: 7102957 - DNA, 20 bp, Homo sapiens
gctctgggagggatgtgatg

SEQ ID NO: 7102958 - DNA, 20 bp, Homo sapiens
gctctgggagggatgtgatg

SEQ ID NO: 7102959 - DNA, 20 bp, Homo sapiens
gctctgggagggatgtgatg

SEQ ID NO: 7102960 - DNA, 22 bp, Homo sapiens
gctctgggccatcctggccggg

SEQ ID NO: 7102961 - DNA, 22 bp, Homo sapiens
gctctgggccatcctggccggg

SEQ ID NO: 7102962 - DNA, 22 bp, Homo sapiens
gctctgggattaccagccttag

SEQ ID NO: 7102963 - DNA, 22 bp, Homo sapiens
gctctgggccatcctggccggg

SEQ ID NO: 7102964 - DNA, 22 bp, Homo sapiens
gctctgggccatcctggccggg

SEQ ID NO: 7102965 - DNA, 22 bp, Homo sapiens
gctctgggccgggcaccagcct

SEQ ID NO: 7102966 - DNA, 22 bp, Homo sapiens
gctctgggccgggcaccagcct

SEQ ID NO: 7102967 - DNA, 22 bp, Homo sapiens
gctctgggccgggcaccagcct

SEQ ID NO: 7102968 - DNA, 22 bp, Homo sapiens
gctctgggccgggcaccagcct

SEQ ID NO: 7102969 - DNA, 22 bp, Homo sapiens
gctctgggccgggcaccagcct

SEQ ID NO: 7102970 - DNA, 22 bp, Homo sapiens
gctctgggccgggcaccagcct

SEQ ID NO: 7102971 - DNA, 22 bp, Homo sapiens
gctctgggctgaatcatttatc

SEQ ID NO: 7102972 - DNA, 22 bp, Homo sapiens
gctctgggctgccctctggaca

SEQ ID NO: 7102973 - DNA, 22 bp, Homo sapiens
gctctgggctgccctctggaca

SEQ ID NO: 7102974 - DNA, 22 bp, Homo sapiens
gctctgggccgggcaccagcct

SEQ ID NO: 7102975 - DNA, 22 bp, Homo sapiens
gctctgggctgaatcatttatc

SEQ ID NO: 7102976 - DNA, 22 bp, Homo sapiens
gctctgggctgccctctggaca

SEQ ID NO: 7102977 - DNA, 22 bp, Homo sapiens
gctctgggctgccctctggaca

SEQ ID NO: 7102978 - DNA, 22 bp, Homo sapiens
gctctgggctgccctctggaca

SEQ ID NO: 7102979 - DNA, 22 bp, Homo sapiens
gctctggggatgcttctgccgt

SEQ ID NO: 7102980 - DNA, 22 bp, Homo sapiens
gctgaatgaatgtattttaaaa

SEQ ID NO: 7102981 - DNA, 23 bp, Homo sapiens
gctgaatgtaatgttctttgggt

SEQ ID NO: 7102982 - DNA, 18 bp, Homo sapiens
gctgaatgtctgctttgc

SEQ ID NO: 7102983 - DNA, 22 bp, Homo sapiens
gctctggggttggaaagtgatc

SEQ ID NO: 7102984 - DNA, 22 bp, Homo sapiens
gctctggggttggaaagtgatc

SEQ ID NO: 7102985 - DNA, 22 bp, Homo sapiens
gctgaataggggtcccaaagat

SEQ ID NO: 7102986 - DNA, 22 bp, Homo sapiens
gctctggggatgcttctgccgt

SEQ ID NO: 7102987 - DNA, 22 bp, Homo sapiens
gctctggggatgcttctgccgt

SEQ ID NO: 7102988 - DNA, 22 bp, Homo sapiens
gctctggggatgcttctgccgt

SEQ ID NO: 7102989 - DNA, 22 bp, Homo sapiens
gctctggggcccagggatcaca

SEQ ID NO: 7102990 - DNA, 22 bp, Homo sapiens
gctctggggcccagggatcaca

SEQ ID NO: 7102991 - DNA, 22 bp, Homo sapiens
gctctggggcccagggatcaca

SEQ ID NO: 7102992 - DNA, 22 bp, Homo sapiens
gctgagggaggctgaactgagt

SEQ ID NO: 7102993 - DNA, 22 bp, Homo sapiens
gctgagggaggctgaactgagt

SEQ ID NO: 7102994 - DNA, 22 bp, Homo sapiens
gctgagggaggctgaactgagt

SEQ ID NO: 7102995 - DNA, 22 bp, Homo sapiens
gctgagggatagctgctcactg

SEQ ID NO: 7102996 - DNA, 22 bp, Homo sapiens
gctgagggatagctgctcactg

SEQ ID NO: 7102997 - DNA, 22 bp, Homo sapiens
gctgaggctgggagcagcctgt

SEQ ID NO: 7102998 - DNA, 22 bp, Homo sapiens
gctgaggctcctcgggaggaca

SEQ ID NO: 7102999 - DNA, 22 bp, Homo sapiens
gctgaggctcctcgggaggaca

SEQ ID NO: 7103000 - DNA, 22 bp, Homo sapiens
gctgaggctgggagcagcctgt

SEQ ID NO: 7103001 - DNA, 22 bp, Homo sapiens
gctgaggctgggagcagcctgt

SEQ ID NO: 7103002 - DNA, 22 bp, Homo sapiens
gctgaggctcaagtcatgggtc

SEQ ID NO: 7103003 - DNA, 22 bp, Homo sapiens
gctgaggcctcagaaggctgag

SEQ ID NO: 7103004 - DNA, 22 bp, Homo sapiens
gctgagagtgggtgcagtgctt

SEQ ID NO: 7103005 - DNA, 22 bp, Homo sapiens
gctgaggccaggccccaccgga

SEQ ID NO: 7103006 - DNA, 22 bp, Homo sapiens
gctgaggccagtttaatgagga

SEQ ID NO: 7103007 - DNA, 22 bp, Homo sapiens
gctgagagtgagcactggatat

SEQ ID NO: 7103008 - DNA, 22 bp, Homo sapiens
gctgagagtgagcactggatat

SEQ ID NO: 7103009 - DNA, 22 bp, Homo sapiens
gctgagagtgagcactggatat

SEQ ID NO: 7103010 - DNA, 22 bp, Homo sapiens
gctgagagtccaggaaaacatc

SEQ ID NO: 7103011 - DNA, 22 bp, Homo sapiens
gctgagagtccaggaaaacatc

SEQ ID NO: 7103012 - DNA, 22 bp, Homo sapiens
gctgagagtccaggaaaacatc

SEQ ID NO: 7103013 - DNA, 22 bp, Homo sapiens
gctgagaggcagccagaccctc

SEQ ID NO: 7103014 - DNA, 21 bp, Homo sapiens
gctgagaggttgggaagttca

SEQ ID NO: 7103015 - DNA, 22 bp, Homo sapiens
gctgagaggcagccagaccctc

SEQ ID NO: 7103016 - DNA, 17 bp, Homo sapiens
gctgagaggcagcacag

SEQ ID NO: 7103017 - DNA, 17 bp, Homo sapiens
gctgagaggcagcacag

SEQ ID NO: 7103018 - DNA, 17 bp, Homo sapiens
gctgagaggcagcacag

SEQ ID NO: 7103019 - DNA, 22 bp, Homo sapiens
gctgagaggcactatctccgga

SEQ ID NO: 7103020 - DNA, 22 bp, Homo sapiens
gctgagagcggccagctgggaa

SEQ ID NO: 7103021 - DNA, 22 bp, Homo sapiens
gctgagagcacatagaaggggc

SEQ ID NO: 7103022 - DNA, 22 bp, Homo sapiens
gctgagagcagtgtggccttaa

SEQ ID NO: 7103023 - DNA, 22 bp, Homo sapiens
gctgagagcagtgtggccttaa

SEQ ID NO: 7103024 - DNA, 22 bp, Homo sapiens
gctgagagcggccagctgggaa

SEQ ID NO: 7103025 - DNA, 22 bp, Homo sapiens
gctgagagcacatagaaggggc

SEQ ID NO: 7103026 - DNA, 22 bp, Homo sapiens
gctgagagcacatagaaggggc

SEQ ID NO: 7103027 - DNA, 22 bp, Homo sapiens
gctgagagcaaggacaaagcat

SEQ ID NO: 7103028 - DNA, 22 bp, Homo sapiens
gctgagagcaaggacaaagcat

SEQ ID NO: 7103029 - DNA, 22 bp, Homo sapiens
gctgagagcaaagcatgtctag

SEQ ID NO: 7103030 - DNA, 22 bp, Homo sapiens
gctgagagcaaagcatgtctag

SEQ ID NO: 7103031 - DNA, 22 bp, Homo sapiens
gctgagagcaaagcatgtctag

SEQ ID NO: 7103032 - DNA, 22 bp, Homo sapiens
gctgagagatcaaggcaggatt

SEQ ID NO: 7103033 - DNA, 22 bp, Homo sapiens
gctgagagatcaaggcaggatt

SEQ ID NO: 7103034 - DNA, 22 bp, Homo sapiens
gctgagagatcaaggcaggatt

SEQ ID NO: 7103035 - DNA, 22 bp, Homo sapiens
gctgagagatcaaggcaggatt

SEQ ID NO: 7103036 - DNA, 22 bp, Homo sapiens
gctgagactggcagcaggaagt

SEQ ID NO: 7103037 - DNA, 22 bp, Homo sapiens
gctgagactggcagcaggaagt

SEQ ID NO: 7103038 - DNA, 22 bp, Homo sapiens
gctgagagaaaagtgaggttct

SEQ ID NO: 7103039 - DNA, 22 bp, Homo sapiens
gctgacacttagaagtgccctg

SEQ ID NO: 7103040 - DNA, 22 bp, Homo sapiens
gctgagaatcaagatggagagg

SEQ ID NO: 7103041 - DNA, 22 bp, Homo sapiens
gcctttatatccctgatatcta

SEQ ID NO: 7103042 - DNA, 22 bp, Homo sapiens
gcctttatattacatttggaag

SEQ ID NO: 7103043 - DNA, 22 bp, Homo sapiens
gcctttaaagccccgagagccc

SEQ ID NO: 7103044 - DNA, 22 bp, Homo sapiens
gcctttcactggtgccggctgt

SEQ ID NO: 7103045 - DNA, 22 bp, Homo sapiens
gcctttcatctcagctggccgg

SEQ ID NO: 7103046 - DNA, 22 bp, Homo sapiens
gccttttgaaatagaaatctga

SEQ ID NO: 7103047 - DNA, 22 bp, Homo sapiens
gcggggggcagcagtcgctcag

SEQ ID NO: 7103048 - DNA, 22 bp, Homo sapiens
gcggggttccgtgccccagagt

SEQ ID NO: 7103049 - DNA, 22 bp, Homo sapiens
gcggggttccgtgccccagagt

SEQ ID NO: 7103050 - DNA, 22 bp, Homo sapiens
gcgggtggaacggctccacgtg

SEQ ID NO: 7103051 - DNA, 22 bp, Homo sapiens
gcgggtggatcatgaggtcagg

SEQ ID NO: 7103052 - DNA, 22 bp, Homo sapiens
gcgggtggatcatgaggtcagg

SEQ ID NO: 7103053 - DNA, 22 bp, Homo sapiens
gcgggtggatcatgaggtcagg

SEQ ID NO: 7103054 - DNA, 22 bp, Homo sapiens
gcgggtggatcatgaggtcagg

SEQ ID NO: 7103055 - DNA, 22 bp, Homo sapiens
gcgggtggatcatgaggtcagg

SEQ ID NO: 7103056 - DNA, 22 bp, Homo sapiens
gcgggtggatcatgaggtcagg

SEQ ID NO: 7103057 - DNA, 22 bp, Homo sapiens
gcgggtggtgtccctgctcctc

SEQ ID NO: 7103058 - DNA, 22 bp, Homo sapiens
gcgggttgaagggcgcatcgaa

SEQ ID NO: 7103059 - DNA, 22 bp, Homo sapiens
gcctttggagatgtcataggat

SEQ ID NO: 7103060 - DNA, 22 bp, Homo sapiens
gcctttcctgctctggcattca

SEQ ID NO: 7103061 - DNA, 22 bp, Homo sapiens
gcgtgggctggactgggatgaa

SEQ ID NO: 7103062 - DNA, 22 bp, Homo sapiens
gcgtgggctggactgggatgaa

SEQ ID NO: 7103063 - DNA, 22 bp, Homo sapiens
gcgtgggctggactgggatgaa

SEQ ID NO: 7103064 - DNA, 22 bp, Homo sapiens
gcgtggggcagcccagggcttc

SEQ ID NO: 7103065 - DNA, 22 bp, Homo sapiens
gcgtggggcagcccagggcttc

SEQ ID NO: 7103066 - DNA, 22 bp, Homo sapiens
gcgtggggcagcccagggcttc

SEQ ID NO: 7103067 - DNA, 22 bp, Homo sapiens
gcgtggcttagagtggggtacc

SEQ ID NO: 7103068 - DNA, 22 bp, Homo sapiens
gcgtggcttagagtggggtacc

SEQ ID NO: 7103069 - DNA, 18 bp, Homo sapiens
gcgtggagcgggctcggt

SEQ ID NO: 7103070 - DNA, 20 bp, Homo sapiens
gcgtggcctgggatcccaag

SEQ ID NO: 7103071 - DNA, 22 bp, Homo sapiens
gctacaggtgacagcctctgca

SEQ ID NO: 7103072 - DNA, 22 bp, Homo sapiens
gctacaggtatatagatgaaac

SEQ ID NO: 7103073 - DNA, 22 bp, Homo sapiens
gctacaggtgacagcctctgca

SEQ ID NO: 7103074 - DNA, 22 bp, Homo sapiens
gctacaggtgacagcctctgca

SEQ ID NO: 7103075 - DNA, 22 bp, Homo sapiens
gctacaggtatatagatgaaac

SEQ ID NO: 7103076 - DNA, 22 bp, Homo sapiens
gctacaggggtcagtcctttgc

SEQ ID NO: 7103077 - DNA, 22 bp, Homo sapiens
gctacaggggtcagtcctttgc

SEQ ID NO: 7103078 - DNA, 22 bp, Homo sapiens
gctacaggagctgtcacatgct

SEQ ID NO: 7103079 - DNA, 22 bp, Homo sapiens
gctacagatttatcatgttata

SEQ ID NO: 7103080 - DNA, 22 bp, Homo sapiens
gctacagagctctgtgaagaga

SEQ ID NO: 7103081 - DNA, 22 bp, Homo sapiens
gctacagagctctgtgaagaga

SEQ ID NO: 7103082 - DNA, 22 bp, Homo sapiens
gctacaggagctgtcacatgct

SEQ ID NO: 7103083 - DNA, 22 bp, Homo sapiens
gctacaggagataaaggcctct

SEQ ID NO: 7103084 - DNA, 22 bp, Homo sapiens
gctacaggagataaaggcctct

SEQ ID NO: 7103085 - DNA, 23 bp, Homo sapiens
gctacagctgactgtcattccct

SEQ ID NO: 7103086 - DNA, 22 bp, Homo sapiens
gcggtgggggaaaggagcggtt

SEQ ID NO: 7103087 - DNA, 22 bp, Homo sapiens
gcggtgggggaaaggagcggtt

SEQ ID NO: 7103088 - DNA, 22 bp, Homo sapiens
gcggtggggaaaggaggtgctg

SEQ ID NO: 7103089 - DNA, 22 bp, Homo sapiens
gcggtagctcaagcttgtaatc

SEQ ID NO: 7103090 - DNA, 22 bp, Homo sapiens
gcggtatttgtgtgggtgtcga

SEQ ID NO: 7103091 - DNA, 22 bp, Homo sapiens
gcggtggggaaaggaggtgctg

SEQ ID NO: 7103092 - DNA, 22 bp, Homo sapiens
gcggtggggaaaggaggtgctg

SEQ ID NO: 7103093 - DNA, 22 bp, Homo sapiens
gcggtgggggaaaggagcggtt

SEQ ID NO: 7103094 - DNA, 22 bp, Homo sapiens
gcgtaaggcctctggtctcgga

SEQ ID NO: 7103095 - DNA, 23 bp, Homo sapiens
gcgtccggcctctctcgctcccg

SEQ ID NO: 7103096 - DNA, 22 bp, Homo sapiens
gcgtctcaaggcccccaggcca

SEQ ID NO: 7103097 - DNA, 22 bp, Homo sapiens
gcgtctcaaggcccccaggcca

SEQ ID NO: 7103098 - DNA, 22 bp, Homo sapiens
gcgtctgagttgcgggggctca

SEQ ID NO: 7103099 - DNA, 22 bp, Homo sapiens
gcgtgaggcccacattctttag

SEQ ID NO: 7103100 - DNA, 22 bp, Homo sapiens
gcgtgcatggccgtgtgtatgc

SEQ ID NO: 7103101 - DNA, 22 bp, Homo sapiens
gcctgagccgcctgagcggcgg

SEQ ID NO: 7103102 - DNA, 22 bp, Homo sapiens
gcctgagccgcctgagcggcgg

SEQ ID NO: 7103103 - DNA, 19 bp, Homo sapiens
gcctgagccagccatgcaa

SEQ ID NO: 7103104 - DNA, 22 bp, Homo sapiens
gcctgagcccaggtgtgcagag

SEQ ID NO: 7103105 - DNA, 22 bp, Homo sapiens
gcctgagcaggcgtggaccatg

SEQ ID NO: 7103106 - DNA, 22 bp, Homo sapiens
gcctgagcaggcgtggaccatg

SEQ ID NO: 7103107 - DNA, 21 bp, Homo sapiens
gcctgagcatgtcttcaggtc

SEQ ID NO: 7103108 - DNA, 19 bp, Homo sapiens
gcctgagccagccatgcaa

SEQ ID NO: 7103109 - DNA, 19 bp, Homo sapiens
gcctgagccagccatgcaa

SEQ ID NO: 7103110 - DNA, 22 bp, Homo sapiens
gcctgagcaggcgtggaccatg

SEQ ID NO: 7103111 - DNA, 22 bp, Homo sapiens
gcctgagcaggcgtggaccatg

SEQ ID NO: 7103112 - DNA, 22 bp, Homo sapiens
gcctctgtcatagctcatgtga

SEQ ID NO: 7103113 - DNA, 22 bp, Homo sapiens
gcctctgggggctcagacctgt

SEQ ID NO: 7103114 - DNA, 22 bp, Homo sapiens
gcctctggggcagctgagtcat

SEQ ID NO: 7103115 - DNA, 22 bp, Homo sapiens
gcctctggggcagctgagtcat

SEQ ID NO: 7103116 - DNA, 22 bp, Homo sapiens
gcctctggggtggagcccagca

SEQ ID NO: 7103117 - DNA, 22 bp, Homo sapiens
gcctctggtccctcatgctgtg

SEQ ID NO: 7103118 - DNA, 22 bp, Homo sapiens
gcctctgggttggtgacaggct

SEQ ID NO: 7103119 - DNA, 22 bp, Homo sapiens
gcctctgggtgacgaaaggtga

SEQ ID NO: 7103120 - DNA, 22 bp, Homo sapiens
gcctctgggttggtgacaggct

SEQ ID NO: 7103121 - DNA, 22 bp, Homo sapiens
gcctctggtccctcatgctgtg

SEQ ID NO: 7103122 - DNA, 22 bp, Homo sapiens
gcctctggtccctcatgctgtg

SEQ ID NO: 7103123 - DNA, 20 bp, Homo sapiens
gcctgagctccgcctcctgt

SEQ ID NO: 7103124 - DNA, 20 bp, Homo sapiens
gcctgagctccgcctcctgt

SEQ ID NO: 7103125 - DNA, 20 bp, Homo sapiens
gcctgagctccgcctcctgt

SEQ ID NO: 7103126 - DNA, 20 bp, Homo sapiens
gcctgagctattgccaggat

SEQ ID NO: 7103127 - DNA, 22 bp, Homo sapiens
gcctgagctactagggagtctg

SEQ ID NO: 7103128 - DNA, 22 bp, Homo sapiens
gcctgagctactagggagtctg

SEQ ID NO: 7103129 - DNA, 22 bp, Homo sapiens
gcctgagctactagggagtctg

SEQ ID NO: 7103130 - DNA, 22 bp, Homo sapiens
gccttgccgctcagcagtgggg

SEQ ID NO: 7103131 - DNA, 21 bp, Homo sapiens
gccttgccgtgaaagcccttt

SEQ ID NO: 7103132 - DNA, 22 bp, Homo sapiens
gccttgcctcagccatggaaac

SEQ ID NO: 7103133 - DNA, 22 bp, Homo sapiens
gccttgcctcagccatggaaac

SEQ ID NO: 7103134 - DNA, 22 bp, Homo sapiens
gccttgctaatttctcctcaac

SEQ ID NO: 7103135 - DNA, 22 bp, Homo sapiens
gccttggaaagctggagcagtt

SEQ ID NO: 7103136 - DNA, 22 bp, Homo sapiens
gccttggactaccactcccaca

SEQ ID NO: 7103137 - DNA, 22 bp, Homo sapiens
gccttggactcgggtggactca

SEQ ID NO: 7103138 - DNA, 22 bp, Homo sapiens
gccttggactcgggtggactca

SEQ ID NO: 7103139 - DNA, 23 bp, Homo sapiens
gccttggagaagtcactcaggga

SEQ ID NO: 7103140 - DNA, 23 bp, Homo sapiens
gccttggagaagtcactcaggga

SEQ ID NO: 7103141 - DNA, 22 bp, Homo sapiens
gccttgggggtgaaagaggcta

SEQ ID NO: 7103142 - DNA, 22 bp, Homo sapiens
gccttgggggtgaaagaggcta

SEQ ID NO: 7103143 - DNA, 22 bp, Homo sapiens
gccttgggcacaggcagggccc

SEQ ID NO: 7103144 - DNA, 22 bp, Homo sapiens
gccttgggcacaggcagggccc

SEQ ID NO: 7103145 - DNA, 22 bp, Homo sapiens
gccttggctgttggagcttgat

SEQ ID NO: 7103146 - DNA, 22 bp, Homo sapiens
gccttgggaaagtgggaggaga

SEQ ID NO: 7103147 - DNA, 22 bp, Homo sapiens
gccttgggacggaggggtcacc

SEQ ID NO: 7103148 - DNA, 22 bp, Homo sapiens
gccttggccttcctaggcctga

SEQ ID NO: 7103149 - DNA, 22 bp, Homo sapiens
gccttggccttcctaggcctga

SEQ ID NO: 7103150 - DNA, 22 bp, Homo sapiens
gccttggcaggctgataacatg

SEQ ID NO: 7103151 - DNA, 23 bp, Homo sapiens
gccttggcgatccgtggggcatc

SEQ ID NO: 7103152 - DNA, 22 bp, Homo sapiens
gccttggctgatgtgcgaatga

SEQ ID NO: 7103153 - DNA, 22 bp, Homo sapiens
gccttggctgccaagctgctga

SEQ ID NO: 7103154 - DNA, 22 bp, Homo sapiens
gccttggctgttggagcttgat

SEQ ID NO: 7103155 - DNA, 22 bp, Homo sapiens
gctcagagttaattggatgggt

SEQ ID NO: 7103156 - DNA, 22 bp, Homo sapiens
gctcagagttaattggatgggt

SEQ ID NO: 7103157 - DNA, 21 bp, Homo sapiens
gctcagcaaaggtgaggtgca

SEQ ID NO: 7103158 - DNA, 19 bp, Homo sapiens
gctcagcagacccagtgct

SEQ ID NO: 7103159 - DNA, 22 bp, Homo sapiens
gctcagccgaacttcagagcag

SEQ ID NO: 7103160 - DNA, 22 bp, Homo sapiens
gctcagccgaacttcagagcag

SEQ ID NO: 7103161 - DNA, 22 bp, Homo sapiens
gctcagccgaacttcagagcag

SEQ ID NO: 7103162 - DNA, 22 bp, Homo sapiens
gctcagccgaacttcagagcag

SEQ ID NO: 7103163 - DNA, 23 bp, Homo sapiens
gctcagcctcagcaggcccagga

SEQ ID NO: 7103164 - DNA, 22 bp, Homo sapiens
gctcagcgtggacctggagctt

SEQ ID NO: 7103165 - DNA, 22 bp, Homo sapiens
gctcagctacttacaggtggct

SEQ ID NO: 7103166 - DNA, 22 bp, Homo sapiens
gctcagctatcagtgttcctga

SEQ ID NO: 7103167 - DNA, 22 bp, Homo sapiens
gctcagctatcagtgttcctga

SEQ ID NO: 7103168 - DNA, 18 bp, Homo sapiens
gctcagctatgggaggtt

SEQ ID NO: 7103169 - DNA, 22 bp, Homo sapiens
gctccaggcagagcctctttcg

SEQ ID NO: 7103170 - DNA, 22 bp, Homo sapiens
gctccagggacccaagagaaaa

SEQ ID NO: 7103171 - DNA, 22 bp, Homo sapiens
gctccaggataataaagttgtt

SEQ ID NO: 7103172 - DNA, 22 bp, Homo sapiens
gctcagctgagcgaaggacatg

SEQ ID NO: 7103173 - DNA, 22 bp, Homo sapiens
gctccagggtcagctcagaact

SEQ ID NO: 7103174 - DNA, 22 bp, Homo sapiens
gctccagggtcagctcagaact

SEQ ID NO: 7103175 - DNA, 22 bp, Homo sapiens
gctccagggtggatgacaattc

SEQ ID NO: 7103176 - DNA, 22 bp, Homo sapiens
gctccagggtggatgacaattc

SEQ ID NO: 7103177 - DNA, 22 bp, Homo sapiens
gctccagggtggatgacaattc

SEQ ID NO: 7103178 - DNA, 22 bp, Homo sapiens
gctccagggacccaagagaaaa

SEQ ID NO: 7103179 - DNA, 22 bp, Homo sapiens
gctccagggagtacatttatca

SEQ ID NO: 7103180 - DNA, 22 bp, Homo sapiens
gctccagggtcagctcagaact

SEQ ID NO: 7103181 - DNA, 19 bp, Homo sapiens
gctcagagggccctgtgct

SEQ ID NO: 7103182 - DNA, 19 bp, Homo sapiens
gctcagagggccctgtgct

SEQ ID NO: 7103183 - DNA, 22 bp, Homo sapiens
gctcagaggccactgttggaaa

SEQ ID NO: 7103184 - DNA, 22 bp, Homo sapiens
gctacagtagataaggacggtc

SEQ ID NO: 7103185 - DNA, 22 bp, Homo sapiens
gctaccaagaaaatctaggaga

SEQ ID NO: 7103186 - DNA, 20 bp, Homo sapiens
gctaccagaacaaggccatt

SEQ ID NO: 7103187 - DNA, 19 bp, Homo sapiens
gctactgaggcccaggacc

SEQ ID NO: 7103188 - DNA, 22 bp, Homo sapiens
gctactgattgaccttggagag

SEQ ID NO: 7103189 - DNA, 22 bp, Homo sapiens
gctactgattgaccttggagag

SEQ ID NO: 7103190 - DNA, 22 bp, Homo sapiens
gctactgattgaccttggagag

SEQ ID NO: 7103191 - DNA, 17 bp, Homo sapiens
gctactggttacctcta

SEQ ID NO: 7103192 - DNA, 22 bp, Homo sapiens
gctactgtgaaggagtctttct

SEQ ID NO: 7103193 - DNA, 19 bp, Homo sapiens
gctcagagggccctgtgct

SEQ ID NO: 7103194 - DNA, 22 bp, Homo sapiens
gctcagagggttttggccaagt

SEQ ID NO: 7103195 - DNA, 19 bp, Homo sapiens
gctcagagtccccctgcgg

SEQ ID NO: 7103196 - DNA, 19 bp, Homo sapiens
gctcagagtccccctgcgg

SEQ ID NO: 7103197 - DNA, 19 bp, Homo sapiens
gctcagagtccccctgcgg

SEQ ID NO: 7103198 - DNA, 22 bp, Homo sapiens
gctcagagtggcctggctaggg

SEQ ID NO: 7103199 - DNA, 22 bp, Homo sapiens
gctcagagtggcctggctaggg

SEQ ID NO: 7103200 - DNA, 19 bp, Homo sapiens
gctcagagtccccctgcgg

SEQ ID NO: 7103201 - DNA, 19 bp, Homo sapiens
gctcagagtccccctgcgg

SEQ ID NO: 7103202 - DNA, 22 bp, Homo sapiens
gctcccagaaccaaggctgggg

SEQ ID NO: 7103203 - DNA, 22 bp, Homo sapiens
gctcccagaaccaaggctgggg

SEQ ID NO: 7103204 - DNA, 22 bp, Homo sapiens
gctcccagaaccaaggctgggg

SEQ ID NO: 7103205 - DNA, 22 bp, Homo sapiens
gctcccagaaccaaggctgggg

SEQ ID NO: 7103206 - DNA, 22 bp, Homo sapiens
gctcccactgcagccctgagcc

SEQ ID NO: 7103207 - DNA, 22 bp, Homo sapiens
gctcccacctttgctatcagta

SEQ ID NO: 7103208 - DNA, 22 bp, Homo sapiens
gctcccaccttaaccttcacat

SEQ ID NO: 7103209 - DNA, 22 bp, Homo sapiens
gctcccaccttaaccttcacat

SEQ ID NO: 7103210 - DNA, 22 bp, Homo sapiens
gctcccacctccagcctgagtt

SEQ ID NO: 7103211 - DNA, 22 bp, Homo sapiens
gctcccaccaggcagacctacc

SEQ ID NO: 7103212 - DNA, 22 bp, Homo sapiens
gctcccacaaccttcttgctcc

SEQ ID NO: 7103213 - DNA, 22 bp, Homo sapiens
gctcccaactcaggcctcctcc

SEQ ID NO: 7103214 - DNA, 22 bp, Homo sapiens
gctcccaactcaggcctcctcc

SEQ ID NO: 7103215 - DNA, 22 bp, Homo sapiens
gctccaggtgtcccaggtaaaa

SEQ ID NO: 7103216 - DNA, 22 bp, Homo sapiens
gctccaggtgtcccaggtaaaa

SEQ ID NO: 7103217 - DNA, 22 bp, Homo sapiens
gctccaggtgtcccaggtaaaa

SEQ ID NO: 7103218 - DNA, 22 bp, Homo sapiens
gctccaggtatttgccctttta

SEQ ID NO: 7103219 - DNA, 20 bp, Homo sapiens
gctccaggtcagagaggacg

SEQ ID NO: 7103220 - DNA, 20 bp, Homo sapiens
gctccaggtcagagaggacg

SEQ ID NO: 7103221 - DNA, 20 bp, Homo sapiens
gctccaggtcagagaggacg

SEQ ID NO: 7103222 - DNA, 20 bp, Homo sapiens
gctccaggtcagagaggacg

SEQ ID NO: 7103223 - DNA, 22 bp, Homo sapiens
gctccaggtgaatcctctcacc

SEQ ID NO: 7103224 - DNA, 22 bp, Homo sapiens
gctccctggtagccatgctctc

SEQ ID NO: 7103225 - DNA, 22 bp, Homo sapiens
gctccctggtattgctgccact

SEQ ID NO: 7103226 - DNA, 22 bp, Homo sapiens
gctccctggtattgctgccact

SEQ ID NO: 7103227 - DNA, 22 bp, Homo sapiens
gctccctggtattgctgccact

SEQ ID NO: 7103228 - DNA, 22 bp, Homo sapiens
gctccctggtattgctgccact

SEQ ID NO: 7103229 - DNA, 22 bp, Homo sapiens
gctccctggtattgctgccact

SEQ ID NO: 7103230 - DNA, 22 bp, Homo sapiens
gctccctggtattgctgccact

SEQ ID NO: 7103231 - DNA, 22 bp, Homo sapiens
gctccctgtctctggggtccat

SEQ ID NO: 7103232 - DNA, 22 bp, Homo sapiens
gctccctgtctctggggtccat

SEQ ID NO: 7103233 - DNA, 23 bp, Homo sapiens
gctccctgtgctccaggagatgc

SEQ ID NO: 7103234 - DNA, 22 bp, Homo sapiens
gctccctgtctctggggtccat

SEQ ID NO: 7103235 - DNA, 23 bp, Homo sapiens
gctccctgtgctccaggagatgc

SEQ ID NO: 7103236 - DNA, 23 bp, Homo sapiens
gctccctgtgctccaggagatgc

SEQ ID NO: 7103237 - DNA, 22 bp, Homo sapiens
gctccctggcttttacagtgta

SEQ ID NO: 7103238 - DNA, 22 bp, Homo sapiens
gctccctggtagccatgctctc

SEQ ID NO: 7103239 - DNA, 22 bp, Homo sapiens
gctccctggtagccatgctctc

SEQ ID NO: 7103240 - DNA, 22 bp, Homo sapiens
gctccctgcactctgcagccct

SEQ ID NO: 7103241 - DNA, 22 bp, Homo sapiens
gctccctgcagctgagagttcc

SEQ ID NO: 7103242 - DNA, 22 bp, Homo sapiens
gctccctgcatttcccaccctt

SEQ ID NO: 7103243 - DNA, 22 bp, Homo sapiens
gctccctgcatttcccaccctt

SEQ ID NO: 7103244 - DNA, 21 bp, Homo sapiens
gctccctgctcagctcctggg

SEQ ID NO: 7103245 - DNA, 21 bp, Homo sapiens
gctccctgctcagctcctggg

SEQ ID NO: 7103246 - DNA, 22 bp, Homo sapiens
gctccctgactcagttcctgag

SEQ ID NO: 7103247 - DNA, 22 bp, Homo sapiens
gctccctgactcagttcctgag

SEQ ID NO: 7103248 - DNA, 17 bp, Homo sapiens
gctccctgaggacagct

SEQ ID NO: 7103249 - DNA, 17 bp, Homo sapiens
gctccctgaggacagct

SEQ ID NO: 7103250 - DNA, 22 bp, Homo sapiens
gctccctgcactctgcagccct

SEQ ID NO: 7103251 - DNA, 22 bp, Homo sapiens
gctccctgcactctgcagccct

SEQ ID NO: 7103252 - DNA, 22 bp, Homo sapiens
gcagggaagacccggagcagcg

SEQ ID NO: 7103253 - DNA, 22 bp, Homo sapiens
gcagggaagacccggagcagcg

SEQ ID NO: 7103254 - DNA, 22 bp, Homo sapiens
gcagggaagacccggagcagcg

SEQ ID NO: 7103255 - DNA, 22 bp, Homo sapiens
gcagggaagatcttggagctgc

SEQ ID NO: 7103256 - DNA, 22 bp, Homo sapiens
gcagggaagatcttggagctgc

SEQ ID NO: 7103257 - DNA, 22 bp, Homo sapiens
gcagggaagatcttggagctgc

SEQ ID NO: 7103258 - DNA, 22 bp, Homo sapiens
gcagggaagggaaacagagacc

SEQ ID NO: 7103259 - DNA, 22 bp, Homo sapiens
gcagggaagggaaacagagacc

SEQ ID NO: 7103260 - DNA, 22 bp, Homo sapiens
gcagggaagggaaacagagacc

SEQ ID NO: 7103261 - DNA, 22 bp, Homo sapiens
gcagggaaggggacggaaccag

SEQ ID NO: 7103262 - DNA, 22 bp, Homo sapiens
gcagggaaggggacggaaccag

SEQ ID NO: 7103263 - DNA, 22 bp, Homo sapiens
gcagggaagatcttggagctgc

SEQ ID NO: 7103264 - DNA, 21 bp, Homo sapiens
gcagggacaaagcttcaggag

SEQ ID NO: 7103265 - DNA, 22 bp, Homo sapiens
gcagggacaactgtgcacctga

SEQ ID NO: 7103266 - DNA, 21 bp, Homo sapiens
gcagggacaaagcttcaggag

SEQ ID NO: 7103267 - DNA, 21 bp, Homo sapiens
gcagggacaaagcttcaggag

SEQ ID NO: 7103268 - DNA, 21 bp, Homo sapiens
gcagggacaaagcttcaggag

SEQ ID NO: 7103269 - DNA, 21 bp, Homo sapiens
gcagggacaaagcttcaggag

SEQ ID NO: 7103270 - DNA, 22 bp, Homo sapiens
gcagggaaggggcatgctggag

SEQ ID NO: 7103271 - DNA, 22 bp, Homo sapiens
gcagggaaggggcatgctggag

SEQ ID NO: 7103272 - DNA, 22 bp, Homo sapiens
gcagggaagttgtaatgtaatg

SEQ ID NO: 7103273 - DNA, 22 bp, Homo sapiens
gcagggaagttgtaatgtaatg

SEQ ID NO: 7103274 - DNA, 22 bp, Homo sapiens
gcagggaagtttgatctttttc

SEQ ID NO: 7103275 - DNA, 22 bp, Homo sapiens
gcagggaagtttgatctttttc

SEQ ID NO: 7103276 - DNA, 22 bp, Homo sapiens
gcagggaagacccggagcagcg

SEQ ID NO: 7103277 - DNA, 22 bp, Homo sapiens
gcaggcagttgcagttttctag

SEQ ID NO: 7103278 - DNA, 22 bp, Homo sapiens
gcaggcagttgcagttttctag

SEQ ID NO: 7103279 - DNA, 22 bp, Homo sapiens
gcaggcagttgcagttttctag

SEQ ID NO: 7103280 - DNA, 22 bp, Homo sapiens
gcaggcagttatttagtagaat

SEQ ID NO: 7103281 - DNA, 22 bp, Homo sapiens
gcaggcagttatttagtagaat

SEQ ID NO: 7103282 - DNA, 22 bp, Homo sapiens
gcaggcagttatttagtagaat

SEQ ID NO: 7103283 - DNA, 22 bp, Homo sapiens
gcaggcagttatttagtagaat

SEQ ID NO: 7103284 - DNA, 22 bp, Homo sapiens
gcaggcagttatttagtagaat

SEQ ID NO: 7103285 - DNA, 19 bp, Homo sapiens
gcaggcagtggcattcgga

SEQ ID NO: 7103286 - DNA, 22 bp, Homo sapiens
gcaggcagtcatctttcatatt

SEQ ID NO: 7103287 - DNA, 19 bp, Homo sapiens
gcaggcagtggcattcgga

SEQ ID NO: 7103288 - DNA, 19 bp, Homo sapiens
gcaggcagtggcattcgga

SEQ ID NO: 7103289 - DNA, 22 bp, Homo sapiens
gcaggcagtcatctttcatatt

SEQ ID NO: 7103290 - DNA, 22 bp, Homo sapiens
gcaggcaggtggcatcttgtga

SEQ ID NO: 7103291 - DNA, 22 bp, Homo sapiens
gcaggcaggtggcatcttgtga

SEQ ID NO: 7103292 - DNA, 22 bp, Homo sapiens
gcaggcagtcatctttcatatt

SEQ ID NO: 7103293 - DNA, 22 bp, Homo sapiens
gcaggcaggtggcatcttgtga

SEQ ID NO: 7103294 - DNA, 19 bp, Homo sapiens
gcaggcagctggggtatcc

SEQ ID NO: 7103295 - DNA, 19 bp, Homo sapiens
gcaggcagctggggtatcc

SEQ ID NO: 7103296 - DNA, 19 bp, Homo sapiens
gcaggcagctggggtatcc

SEQ ID NO: 7103297 - DNA, 14 bp, Homo sapiens
gcaggcagatcact

SEQ ID NO: 7103298 - DNA, 14 bp, Homo sapiens
gcaggcagatcatt

SEQ ID NO: 7103299 - DNA, 22 bp, Homo sapiens
gcaggcagccacgattcccttg

SEQ ID NO: 7103300 - DNA, 22 bp, Homo sapiens
gcaggcagccacgattcccttg

SEQ ID NO: 7103301 - DNA, 22 bp, Homo sapiens
gcaggcagccacgattcccttg

SEQ ID NO: 7103302 - DNA, 22 bp, Homo sapiens
gcaggcagccacgattcccttg

SEQ ID NO: 7103303 - DNA, 22 bp, Homo sapiens
gcaggcagatcacctgtcagga

SEQ ID NO: 7103304 - DNA, 22 bp, Homo sapiens
gcaggcagatcacctgtcagga

SEQ ID NO: 7103305 - DNA, 22 bp, Homo sapiens
gcaggcagatcacctgtcagga

SEQ ID NO: 7103306 - DNA, 22 bp, Homo sapiens
gcaggcagatcacctgtcagga

SEQ ID NO: 7103307 - DNA, 22 bp, Homo sapiens
gcaggcagatcacctgtcagga

SEQ ID NO: 7103308 - DNA, 15 bp, Homo sapiens
gcaggcagatcaccg

SEQ ID NO: 7103309 - DNA, 22 bp, Homo sapiens
gcaggcagatcacctgtcagga

SEQ ID NO: 7103310 - DNA, 22 bp, Homo sapiens
gcaggcagatcacctgtcagga

SEQ ID NO: 7103311 - DNA, 22 bp, Homo sapiens
gcaggcagatcacctgtcagga

SEQ ID NO: 7103312 - DNA, 14 bp, Homo sapiens
gcaggcagatcacc

SEQ ID NO: 7103313 - DNA, 16 bp, Homo sapiens
gcaggcagatcacatg

SEQ ID NO: 7103314 - DNA, 16 bp, Homo sapiens
gcaggcagatcacatg

SEQ ID NO: 7103315 - DNA, 22 bp, Homo sapiens
gcaggcagagtcaatttgatcc

SEQ ID NO: 7103316 - DNA, 22 bp, Homo sapiens
gcaggcagagtcaatttgatcc

SEQ ID NO: 7103317 - DNA, 16 bp, Homo sapiens
gcaggcagatcacatg

SEQ ID NO: 7103318 - DNA, 16 bp, Homo sapiens
gcaggcagatcacatg

SEQ ID NO: 7103319 - DNA, 22 bp, Homo sapiens
gcaggcagaggtggaggagaca

SEQ ID NO: 7103320 - DNA, 22 bp, Homo sapiens
gcaggcagagtcaatttgatcc

SEQ ID NO: 7103321 - DNA, 22 bp, Homo sapiens
gcaggcagaggtggaggagaca

SEQ ID NO: 7103322 - DNA, 22 bp, Homo sapiens
gcaggcagaggtggaggagaca

SEQ ID NO: 7103323 - DNA, 22 bp, Homo sapiens
gcaggcagaggtggaggagaca

SEQ ID NO: 7103324 - DNA, 22 bp, Homo sapiens
gcaggcagaggtggaggagaca

SEQ ID NO: 7103325 - DNA, 22 bp, Homo sapiens
gcaggcagaggtggaggagaca

SEQ ID NO: 7103326 - DNA, 22 bp, Homo sapiens
gcaggacacagatgcaaggcca

SEQ ID NO: 7103327 - DNA, 22 bp, Homo sapiens
gcaggacacagatgcaaggcca

SEQ ID NO: 7103328 - DNA, 16 bp, Homo sapiens
gcaggacactcagaca

SEQ ID NO: 7103329 - DNA, 22 bp, Homo sapiens
gcaggggagtccactctatgca

SEQ ID NO: 7103330 - DNA, 22 bp, Homo sapiens
gcagggcttgcagcagctagac

SEQ ID NO: 7103331 - DNA, 22 bp, Homo sapiens
gcagggcttagaaatggtggct

SEQ ID NO: 7103332 - DNA, 22 bp, Homo sapiens
gcagggcttagaaatggtggct

SEQ ID NO: 7103333 - DNA, 22 bp, Homo sapiens
gcagggctgttcaggagggtgg

SEQ ID NO: 7103334 - DNA, 22 bp, Homo sapiens
gcagggctgttcaggagggtgg

SEQ ID NO: 7103335 - DNA, 22 bp, Homo sapiens
gcagggctgttcaggagggtgg

SEQ ID NO: 7103336 - DNA, 22 bp, Homo sapiens
gcagggctgtttagtgaatagg

SEQ ID NO: 7103337 - DNA, 22 bp, Homo sapiens
gcagggctgttcaggagggtgg

SEQ ID NO: 7103338 - DNA, 22 bp, Homo sapiens
gcagggctgttcaggagggtgg

SEQ ID NO: 7103339 - DNA, 22 bp, Homo sapiens
gcagggctggggctgctcctga

SEQ ID NO: 7103340 - DNA, 22 bp, Homo sapiens
gcagggctgggtcctgtctcat

SEQ ID NO: 7103341 - DNA, 22 bp, Homo sapiens
gcagggctgggtcctgtctcat

SEQ ID NO: 7103342 - DNA, 22 bp, Homo sapiens
gcagggctgggtgggagacaga

SEQ ID NO: 7103343 - DNA, 22 bp, Homo sapiens
gcagggctgggtgggagacaga

SEQ ID NO: 7103344 - DNA, 22 bp, Homo sapiens
gcagggctgggtgggagacaga

SEQ ID NO: 7103345 - DNA, 22 bp, Homo sapiens
gcagggctgggtgggagacaga

SEQ ID NO: 7103346 - DNA, 22 bp, Homo sapiens
gcagggctgtaatttgagcctg

SEQ ID NO: 7103347 - DNA, 22 bp, Homo sapiens
gcagggctgtaatttgagcctg

SEQ ID NO: 7103348 - DNA, 22 bp, Homo sapiens
gcagggctgtggacactttggt

SEQ ID NO: 7103349 - DNA, 22 bp, Homo sapiens
gcagggctgaaggtcccaggcc

SEQ ID NO: 7103350 - DNA, 22 bp, Homo sapiens
gcagggacctgccactgctgtc

SEQ ID NO: 7103351 - DNA, 22 bp, Homo sapiens
gcagggacctatgacgatggaa

SEQ ID NO: 7103352 - DNA, 22 bp, Homo sapiens
gcagggacctcactacccccag

SEQ ID NO: 7103353 - DNA, 22 bp, Homo sapiens
gcagggacctcactacccccag

SEQ ID NO: 7103354 - DNA, 22 bp, Homo sapiens
gcagggacctgccactgctgtc

SEQ ID NO: 7103355 - DNA, 22 bp, Homo sapiens
gcagggacctgccactgctgtc

SEQ ID NO: 7103356 - DNA, 22 bp, Homo sapiens
gcagggacctgccactgctgtc

SEQ ID NO: 7103357 - DNA, 22 bp, Homo sapiens
gcagggacctgccactgctgtc

SEQ ID NO: 7103358 - DNA, 22 bp, Homo sapiens
gcagggaccaaaagaggcagta

SEQ ID NO: 7103359 - DNA, 22 bp, Homo sapiens
gcagggaccaaaagaggcagta

SEQ ID NO: 7103360 - DNA, 22 bp, Homo sapiens
gcagggaccaaaagaggcagta

SEQ ID NO: 7103361 - DNA, 22 bp, Homo sapiens
gcagggaccaaaagaggcagta

SEQ ID NO: 7103362 - DNA, 22 bp, Homo sapiens
gcagggacctatgacgatggaa

SEQ ID NO: 7103363 - DNA, 21 bp, Homo sapiens
gcagggaccgcgacttctggg

SEQ ID NO: 7103364 - DNA, 21 bp, Homo sapiens
gcagggaccgcgacttctggg

SEQ ID NO: 7103365 - DNA, 21 bp, Homo sapiens
gcagggaccgcgacttctggg

SEQ ID NO: 7103366 - DNA, 21 bp, Homo sapiens
gcagggaccgcgacttctggg

SEQ ID NO: 7103367 - DNA, 22 bp, Homo sapiens
gcagggaccaaaagaggcagta

SEQ ID NO: 7103368 - DNA, 22 bp, Homo sapiens
gcagggaccaaaagaggcagta

SEQ ID NO: 7103369 - DNA, 22 bp, Homo sapiens
gcagggaccagggccagatcca

SEQ ID NO: 7103370 - DNA, 22 bp, Homo sapiens
gcagggaccagggccagatcca

SEQ ID NO: 7103371 - DNA, 22 bp, Homo sapiens
gcagggacaactgtgcacctga

SEQ ID NO: 7103372 - DNA, 22 bp, Homo sapiens
gcagggacaactgtgcacctga

SEQ ID NO: 7103373 - DNA, 22 bp, Homo sapiens
gcagggacaactgtgcacctga

SEQ ID NO: 7103374 - DNA, 22 bp, Homo sapiens
gcagggacaaggcaggtgttct

SEQ ID NO: 7103375 - DNA, 22 bp, Homo sapiens
gcagggacaaggcaggtgttct

SEQ ID NO: 7103376 - DNA, 22 bp, Homo sapiens
gcagggacaaggcaggtgttct

SEQ ID NO: 7103377 - DNA, 18 bp, Homo sapiens
gcagggacacagggtcac

SEQ ID NO: 7103378 - DNA, 18 bp, Homo sapiens
gcagggacacagggtcac

SEQ ID NO: 7103379 - DNA, 18 bp, Homo sapiens
gcagggacacagggtcac

SEQ ID NO: 7103380 - DNA, 18 bp, Homo sapiens
gcagggacacagggtcac

SEQ ID NO: 7103381 - DNA, 18 bp, Homo sapiens
gcagggacacagggtcac

SEQ ID NO: 7103382 - DNA, 22 bp, Homo sapiens
gcagggacacctttgtgaagct

SEQ ID NO: 7103383 - DNA, 22 bp, Homo sapiens
gcagggacacctttgtgaagct

SEQ ID NO: 7103384 - DNA, 22 bp, Homo sapiens
gcagggacacctttgtgaagct

SEQ ID NO: 7103385 - DNA, 22 bp, Homo sapiens
gcagggacacctttgtgaagct

SEQ ID NO: 7103386 - DNA, 22 bp, Homo sapiens
gcagggacagggcagggccttt

SEQ ID NO: 7103387 - DNA, 22 bp, Homo sapiens
gcagggacagggcagggccttt

SEQ ID NO: 7103388 - DNA, 22 bp, Homo sapiens
gcagggacatcttcagatcact

SEQ ID NO: 7103389 - DNA, 22 bp, Homo sapiens
gcagggacatcttcagatcact

SEQ ID NO: 7103390 - DNA, 22 bp, Homo sapiens
gcagggacatcttcagatcact

SEQ ID NO: 7103391 - DNA, 22 bp, Homo sapiens
gcagggacatctttgtctagta

SEQ ID NO: 7103392 - DNA, 22 bp, Homo sapiens
gcagggaccaaaagaggcagta

SEQ ID NO: 7103393 - DNA, 22 bp, Homo sapiens
gcagccctaacctgtcatagtg

SEQ ID NO: 7103394 - DNA, 22 bp, Homo sapiens
gcagccctaacctgtcatagtg

SEQ ID NO: 7103395 - DNA, 18 bp, Homo sapiens
gcagcccctcttccttcc

SEQ ID NO: 7103396 - DNA, 22 bp, Homo sapiens
gcagcccataacatttgaggcc

SEQ ID NO: 7103397 - DNA, 22 bp, Homo sapiens
gcagcccaggtgtagctctttg

SEQ ID NO: 7103398 - DNA, 22 bp, Homo sapiens
gcagcccataacatttgaggcc

SEQ ID NO: 7103399 - DNA, 22 bp, Homo sapiens
gcagccctcgctagctctcccc

SEQ ID NO: 7103400 - DNA, 22 bp, Homo sapiens
gcagccctcgctagctctcccc

SEQ ID NO: 7103401 - DNA, 22 bp, Homo sapiens
gcagccctcgctagctctcccc

SEQ ID NO: 7103402 - DNA, 22 bp, Homo sapiens
gcagccctgcagctccacaccg

SEQ ID NO: 7103403 - DNA, 22 bp, Homo sapiens
gcagccctgcagctccacaccg

SEQ ID NO: 7103404 - DNA, 22 bp, Homo sapiens
gcagcccaggtctctctcactc

SEQ ID NO: 7103405 - DNA, 22 bp, Homo sapiens
gcagcccaggtctctctcactc

SEQ ID NO: 7103406 - DNA, 22 bp, Homo sapiens
gcagcccaggctcgctcactgc

SEQ ID NO: 7103407 - DNA, 22 bp, Homo sapiens
gcagcccaggctcgctcactgc

SEQ ID NO: 7103408 - DNA, 22 bp, Homo sapiens
gcagcccaggtctctctcactc

SEQ ID NO: 7103409 - DNA, 22 bp, Homo sapiens
gcagcccaggtggagtaatcta

SEQ ID NO: 7103410 - DNA, 22 bp, Homo sapiens
gcagcccaggaggcgggagccc

SEQ ID NO: 7103411 - DNA, 22 bp, Homo sapiens
gcagcccaggaccctggacaga

SEQ ID NO: 7103412 - DNA, 22 bp, Homo sapiens
gcagcccaggagcaggcgaccc

SEQ ID NO: 7103413 - DNA, 22 bp, Homo sapiens
gcagatgtaatggctggaggtc

SEQ ID NO: 7103414 - DNA, 22 bp, Homo sapiens
gcagcccagcagggcccggagc

SEQ ID NO: 7103415 - DNA, 22 bp, Homo sapiens
gcagatggtggggcaggaaaat

SEQ ID NO: 7103416 - DNA, 22 bp, Homo sapiens
gcagatggtggggcaggaaaat

SEQ ID NO: 7103417 - DNA, 22 bp, Homo sapiens
gcagatggtggggcaggaaaat

SEQ ID NO: 7103418 - DNA, 22 bp, Homo sapiens
gcagatggtggaggcaagaggc

SEQ ID NO: 7103419 - DNA, 22 bp, Homo sapiens
gcagatggtggggcaggaaaat

SEQ ID NO: 7103420 - DNA, 22 bp, Homo sapiens
gcagatggtggggcaggaaaat

SEQ ID NO: 7103421 - DNA, 21 bp, Homo sapiens
gcagatgggagtcatcaggct

SEQ ID NO: 7103422 - DNA, 22 bp, Homo sapiens
gcagatggtggaggcaagaggc

SEQ ID NO: 7103423 - DNA, 22 bp, Homo sapiens
gcagatggctcagacactgggg

SEQ ID NO: 7103424 - DNA, 22 bp, Homo sapiens
gcagatggctcagacactgggg

SEQ ID NO: 7103425 - DNA, 22 bp, Homo sapiens
gcagatggctgagcctgcagat

SEQ ID NO: 7103426 - DNA, 21 bp, Homo sapiens
gcagatgggaagagacgaggc

SEQ ID NO: 7103427 - DNA, 22 bp, Homo sapiens
gcagatgggagccccaggggag

SEQ ID NO: 7103428 - DNA, 22 bp, Homo sapiens
gcagatgggagccccaggggag

SEQ ID NO: 7103429 - DNA, 22 bp, Homo sapiens
gcagatgggagccccaggggag

SEQ ID NO: 7103430 - DNA, 21 bp, Homo sapiens
gcagatgggagtcatcaggct

SEQ ID NO: 7103431 - DNA, 23 bp, Homo sapiens
gcagatggccccagagtgctgcc

SEQ ID NO: 7103432 - DNA, 23 bp, Homo sapiens
gcagatggccccagagtgctgcc

SEQ ID NO: 7103433 - DNA, 22 bp, Homo sapiens
gcagatggcagcccaggctggg

SEQ ID NO: 7103434 - DNA, 23 bp, Homo sapiens
gcagatggccccagagtgctgcc

SEQ ID NO: 7103435 - DNA, 23 bp, Homo sapiens
gcagatggccccagagtgctgcc

SEQ ID NO: 7103436 - DNA, 22 bp, Homo sapiens
gcagatggatcacctgaggtcg

SEQ ID NO: 7103437 - DNA, 22 bp, Homo sapiens
gcagatggatgtggacggcgcc

SEQ ID NO: 7103438 - DNA, 22 bp, Homo sapiens
gcagatggcagcccaggctggg

SEQ ID NO: 7103439 - DNA, 22 bp, Homo sapiens
gcagatggcagcccaggctggg

SEQ ID NO: 7103440 - DNA, 22 bp, Homo sapiens
gcagatggcagcccaggctggg

SEQ ID NO: 7103441 - DNA, 22 bp, Homo sapiens
gcagcctccgcactgcgagtcc

SEQ ID NO: 7103442 - DNA, 22 bp, Homo sapiens
gcagcctcagggcactcagatg

SEQ ID NO: 7103443 - DNA, 22 bp, Homo sapiens
gcagcctcagggcactcagatg

SEQ ID NO: 7103444 - DNA, 22 bp, Homo sapiens
gcagcctccgcactgcgagtcc

SEQ ID NO: 7103445 - DNA, 22 bp, Homo sapiens
gcagcctctgatgatggccgta

SEQ ID NO: 7103446 - DNA, 22 bp, Homo sapiens
gcagcctctgatgatggccgta

SEQ ID NO: 7103447 - DNA, 22 bp, Homo sapiens
gcagctgtcatttacaacaggg

SEQ ID NO: 7103448 - DNA, 22 bp, Homo sapiens
gcagctgtcggaaagctaagtg

SEQ ID NO: 7103449 - DNA, 19 bp, Homo sapiens
gcagctgtgggaagagcca

SEQ ID NO: 7103450 - DNA, 22 bp, Homo sapiens
gcagctttctgggacagaaagg

SEQ ID NO: 7103451 - DNA, 22 bp, Homo sapiens
gcagctttcttgccctaatctt

SEQ ID NO: 7103452 - DNA, 22 bp, Homo sapiens
gcagctttggaggtggaactct

SEQ ID NO: 7103453 - DNA, 22 bp, Homo sapiens
gcagcctcagggcactcagatg

SEQ ID NO: 7103454 - DNA, 20 bp, Homo sapiens
gcagcctcaacaggcacagc

SEQ ID NO: 7103455 - DNA, 20 bp, Homo sapiens
gcagcctcaacaggcacagc

SEQ ID NO: 7103456 - DNA, 20 bp, Homo sapiens
gcagcctcaacaggcacagc

SEQ ID NO: 7103457 - DNA, 20 bp, Homo sapiens
gcagcctcaacaggcacagc

SEQ ID NO: 7103458 - DNA, 20 bp, Homo sapiens
gcagcctcaacaggcacagc

SEQ ID NO: 7103459 - DNA, 22 bp, Homo sapiens
gcagcctcaaactccccagctc

SEQ ID NO: 7103460 - DNA, 22 bp, Homo sapiens
gcagcctcaaactccccagctc

SEQ ID NO: 7103461 - DNA, 22 bp, Homo sapiens
gcagcctcaaactccccagctc

SEQ ID NO: 7103462 - DNA, 22 bp, Homo sapiens
gcagccctttctgggcagggga

SEQ ID NO: 7103463 - DNA, 22 bp, Homo sapiens
gcagccctttctgggcagggga

SEQ ID NO: 7103464 - DNA, 22 bp, Homo sapiens
gcagcccttcaggtgaggggca

SEQ ID NO: 7103465 - DNA, 22 bp, Homo sapiens
gcagcccttcaggtgaggggca

SEQ ID NO: 7103466 - DNA, 22 bp, Homo sapiens
gcagcccttcaggtgaggggca

SEQ ID NO: 7103467 - DNA, 22 bp, Homo sapiens
gcagccctgcaggcagctccag

SEQ ID NO: 7103468 - DNA, 22 bp, Homo sapiens
gcagccctggcctggcctactt

SEQ ID NO: 7103469 - DNA, 22 bp, Homo sapiens
gcagccctgcaggcagctccag

SEQ ID NO: 7103470 - DNA, 22 bp, Homo sapiens
gcagccctggcctggcctactt

SEQ ID NO: 7103471 - DNA, 22 bp, Homo sapiens
gcagccctgcagctccacaccg

SEQ ID NO: 7103472 - DNA, 22 bp, Homo sapiens
gcaggaagatgagctcaggtaa

SEQ ID NO: 7103473 - DNA, 22 bp, Homo sapiens
gcaggaagaggctcgaagcccc

SEQ ID NO: 7103474 - DNA, 22 bp, Homo sapiens
gcaggaagaggctcgaagcccc

SEQ ID NO: 7103475 - DNA, 22 bp, Homo sapiens
gcaggaagaggctcgaagcccc

SEQ ID NO: 7103476 - DNA, 22 bp, Homo sapiens
gcaggaacttgcaaaatgagca

SEQ ID NO: 7103477 - DNA, 22 bp, Homo sapiens
gcagctttgtcacggagtgtcg

SEQ ID NO: 7103478 - DNA, 22 bp, Homo sapiens
gcagctttgtggagaggcccat

SEQ ID NO: 7103479 - DNA, 22 bp, Homo sapiens
gcagctttgtggagaggcccat

SEQ ID NO: 7103480 - DNA, 22 bp, Homo sapiens
gcaggaagcatagaagaatgcc

SEQ ID NO: 7103481 - DNA, 22 bp, Homo sapiens
gcaggaagcatagaagaatgcc

SEQ ID NO: 7103482 - DNA, 22 bp, Homo sapiens
gcaggaagcatagaagaatgcc

SEQ ID NO: 7103483 - DNA, 22 bp, Homo sapiens
gcaggaagcatagaagaatgcc

SEQ ID NO: 7103484 - DNA, 22 bp, Homo sapiens
gcaggaagcatagaagaatgcc

SEQ ID NO: 7103485 - DNA, 22 bp, Homo sapiens
gcaggaagccttaccaagccca

SEQ ID NO: 7103486 - DNA, 22 bp, Homo sapiens
gcaggacaaaatttccagggtg

SEQ ID NO: 7103487 - DNA, 22 bp, Homo sapiens
gcaggaagggaaaggttgactc

SEQ ID NO: 7103488 - DNA, 22 bp, Homo sapiens
gcaggacaaaatttccagggtg

SEQ ID NO: 7103489 - DNA, 22 bp, Homo sapiens
gcaggacaaaatttccagggtg

SEQ ID NO: 7103490 - DNA, 22 bp, Homo sapiens
gcaggacaaaatttccagggtg

SEQ ID NO: 7103491 - DNA, 23 bp, Homo sapiens
gcaggacaacagagtgggaaggc

SEQ ID NO: 7103492 - DNA, 23 bp, Homo sapiens
gcaggacaacagagtgggaaggc

SEQ ID NO: 7103493 - DNA, 23 bp, Homo sapiens
gcaggacaacagagtgggaaggc

SEQ ID NO: 7103494 - DNA, 22 bp, Homo sapiens
gcaggacacagatgcaaggcca

SEQ ID NO: 7103495 - DNA, 22 bp, Homo sapiens
gcaggacacagatgcaaggcca

SEQ ID NO: 7103496 - DNA, 22 bp, Homo sapiens
gcagactgtatcaatgtcagta

SEQ ID NO: 7103497 - DNA, 22 bp, Homo sapiens
gcagagaaagttttgtcctcag

SEQ ID NO: 7103498 - DNA, 22 bp, Homo sapiens
gcagagaaagttttgtcctcag

SEQ ID NO: 7103499 - DNA, 22 bp, Homo sapiens
gcagagaagatgcccaggcttc

SEQ ID NO: 7103500 - DNA, 22 bp, Homo sapiens
gcagagaacccagcagattggc

SEQ ID NO: 7103501 - DNA, 22 bp, Homo sapiens
gcagagcaccctgcagtggtat

SEQ ID NO: 7103502 - DNA, 22 bp, Homo sapiens
gcagagcaccaaagtgaaagat

SEQ ID NO: 7103503 - DNA, 22 bp, Homo sapiens
gcagagcaccaaagtgaaagat

SEQ ID NO: 7103504 - DNA, 22 bp, Homo sapiens
gcagagcaccctgcagtggtat

SEQ ID NO: 7103505 - DNA, 22 bp, Homo sapiens
gcagagcaccctgcagtggtat

SEQ ID NO: 7103506 - DNA, 18 bp, Homo sapiens
gcagagcagaagctcaag

SEQ ID NO: 7103507 - DNA, 18 bp, Homo sapiens
gcagagcagaagctcaag

SEQ ID NO: 7103508 - DNA, 22 bp, Homo sapiens
gcagagaagatgcccaggcttc

SEQ ID NO: 7103509 - DNA, 22 bp, Homo sapiens
gcagagaaggattgaaaccaga

SEQ ID NO: 7103510 - DNA, 22 bp, Homo sapiens
gcagagattgtaatgatacctg

SEQ ID NO: 7103511 - DNA, 22 bp, Homo sapiens
gcagagatttcagtaacagcag

SEQ ID NO: 7103512 - DNA, 22 bp, Homo sapiens
gcagaccctgaactgggcatgg

SEQ ID NO: 7103513 - DNA, 22 bp, Homo sapiens
gcagacctgaccttgggcagca

SEQ ID NO: 7103514 - DNA, 21 bp, Homo sapiens
gcagactgccctgctgtcccc

SEQ ID NO: 7103515 - DNA, 22 bp, Homo sapiens
gcagactctgagagtgagtgcc

SEQ ID NO: 7103516 - DNA, 22 bp, Homo sapiens
gcagacctcaggacatcattag

SEQ ID NO: 7103517 - DNA, 22 bp, Homo sapiens
gcagacctgaccttgggcagca

SEQ ID NO: 7103518 - DNA, 19 bp, Homo sapiens
gcagacaggtccagagagg

SEQ ID NO: 7103519 - DNA, 19 bp, Homo sapiens
gcagacaggtccagagagg

SEQ ID NO: 7103520 - DNA, 22 bp, Homo sapiens
gcagacatgggatctattcaca

SEQ ID NO: 7103521 - DNA, 22 bp, Homo sapiens
gcagacatgtgttctaacagga

SEQ ID NO: 7103522 - DNA, 22 bp, Homo sapiens
gcagactgcgagcgtgctggtg

SEQ ID NO: 7103523 - DNA, 22 bp, Homo sapiens
gcagactgcgagcgtgctggtg

SEQ ID NO: 7103524 - DNA, 22 bp, Homo sapiens
gcagactgcgagcgtgctggtg

SEQ ID NO: 7103525 - DNA, 22 bp, Homo sapiens
gcagactgcgtgaggcgccgcc

SEQ ID NO: 7103526 - DNA, 22 bp, Homo sapiens
gcagactggataggtttggtag

SEQ ID NO: 7103527 - DNA, 22 bp, Homo sapiens
gcagactgtacctggaagaggg

SEQ ID NO: 7103528 - DNA, 22 bp, Homo sapiens
gcagactgtatcaatgtcagta

SEQ ID NO: 7103529 - DNA, 22 bp, Homo sapiens
gcagactgtatcaatgtcagta

SEQ ID NO: 7103530 - DNA, 22 bp, Homo sapiens
gcacatatgctgtaagcacatg

SEQ ID NO: 7103531 - DNA, 22 bp, Homo sapiens
gcacatatgctgtaagcacatg

SEQ ID NO: 7103532 - DNA, 22 bp, Homo sapiens
gcacatatgctgtaagcacatg

SEQ ID NO: 7103533 - DNA, 22 bp, Homo sapiens
gcacatatgtaaatagctgcct

SEQ ID NO: 7103534 - DNA, 22 bp, Homo sapiens
gcacatcagccactttgaatgg

SEQ ID NO: 7103535 - DNA, 22 bp, Homo sapiens
gcacatccaatgattgttttga

SEQ ID NO: 7103536 - DNA, 22 bp, Homo sapiens
gcacatccaatgattgttttga

SEQ ID NO: 7103537 - DNA, 22 bp, Homo sapiens
gcacatccaatgattgttttga

SEQ ID NO: 7103538 - DNA, 23 bp, Homo sapiens
gcacatactacacagaaaatggc

SEQ ID NO: 7103539 - DNA, 22 bp, Homo sapiens
gcacatacccactgtcaagcac

SEQ ID NO: 7103540 - DNA, 22 bp, Homo sapiens
gcacataccccaggaatggtag

SEQ ID NO: 7103541 - DNA, 22 bp, Homo sapiens
gcacatacgtcagtggctgtca

SEQ ID NO: 7103542 - DNA, 22 bp, Homo sapiens
gcacatacatattagtgtcaca

SEQ ID NO: 7103543 - DNA, 22 bp, Homo sapiens
gcacatgacagtaagtagagca

SEQ ID NO: 7103544 - DNA, 22 bp, Homo sapiens
gcacatgaggctgtctttgtct

SEQ ID NO: 7103545 - DNA, 22 bp, Homo sapiens
gcacatgaggctgtctttgtct

SEQ ID NO: 7103546 - DNA, 22 bp, Homo sapiens
gcacatgagaagctggcgatgc

SEQ ID NO: 7103547 - DNA, 22 bp, Homo sapiens
gcacatgagctgctgggatggg

SEQ ID NO: 7103548 - DNA, 22 bp, Homo sapiens
gcacatgagctgctgggatggg

SEQ ID NO: 7103549 - DNA, 22 bp, Homo sapiens
gcacatgactttgaggaaacca

SEQ ID NO: 7103550 - DNA, 22 bp, Homo sapiens
gcacatgactttgaggaaacca

SEQ ID NO: 7103551 - DNA, 21 bp, Homo sapiens
gcacatgagggagggcatgcc

SEQ ID NO: 7103552 - DNA, 22 bp, Homo sapiens
gcacatgagttaagctggggca

SEQ ID NO: 7103553 - DNA, 22 bp, Homo sapiens
gcacatgcaacagagattttca

SEQ ID NO: 7103554 - DNA, 20 bp, Homo sapiens
gcacatgcaacttttattta

SEQ ID NO: 7103555 - DNA, 19 bp, Homo sapiens
gcagacaggtccagagagg

SEQ ID NO: 7103556 - DNA, 19 bp, Homo sapiens
gcagacaggtccagagagg

SEQ ID NO: 7103557 - DNA, 19 bp, Homo sapiens
gcagacaggtccagagagg

SEQ ID NO: 7103558 - DNA, 19 bp, Homo sapiens
gcagacaggtccagagagg

SEQ ID NO: 7103559 - DNA, 22 bp, Homo sapiens
gcacagttctctcagtctccag

SEQ ID NO: 7103560 - DNA, 22 bp, Homo sapiens
gcacagttaaagggtcatgtga

SEQ ID NO: 7103561 - DNA, 22 bp, Homo sapiens
gcacagttgacaatgattaaga

SEQ ID NO: 7103562 - DNA, 22 bp, Homo sapiens
gcacagttgagacttcacagct

SEQ ID NO: 7103563 - DNA, 22 bp, Homo sapiens
gcacagttgagacttcacagct

SEQ ID NO: 7103564 - DNA, 22 bp, Homo sapiens
gcacagttaaagggtcatgtga

SEQ ID NO: 7103565 - DNA, 22 bp, Homo sapiens
gcacagttgatttatgctggtg

SEQ ID NO: 7103566 - DNA, 22 bp, Homo sapiens
gcacagttgccattagccacat

SEQ ID NO: 7103567 - DNA, 22 bp, Homo sapiens
gcacagttgtgacaaccatcgc

SEQ ID NO: 7103568 - DNA, 20 bp, Homo sapiens
gcacagtttgggaaccatgg

SEQ ID NO: 7103569 - DNA, 22 bp, Homo sapiens
gcacagtgggtggtcatgtaca

SEQ ID NO: 7103570 - DNA, 22 bp, Homo sapiens
gcacagtggtgaaagcatgggt

SEQ ID NO: 7103571 - DNA, 22 bp, Homo sapiens
gcacagtgctgctaagattgag

SEQ ID NO: 7103572 - DNA, 22 bp, Homo sapiens
gcacagtggagtgtgtccaggg

SEQ ID NO: 7103573 - DNA, 22 bp, Homo sapiens
gcacagtgggtggtcatgtaca

SEQ ID NO: 7103574 - DNA, 17 bp, Homo sapiens
gcacagtgatattattt

SEQ ID NO: 7103575 - DNA, 22 bp, Homo sapiens
gcacagtgatgtcagaattgga

SEQ ID NO: 7103576 - DNA, 22 bp, Homo sapiens
gcacagtgcaccactttgaaaa

SEQ ID NO: 7103577 - DNA, 22 bp, Homo sapiens
gcacagtgcaccactttgaaaa

SEQ ID NO: 7103578 - DNA, 21 bp, Homo sapiens
gcacagtgccaggcacacagt

SEQ ID NO: 7103579 - DNA, 22 bp, Homo sapiens
gcagaggagtgattatgccgtg

SEQ ID NO: 7103580 - DNA, 22 bp, Homo sapiens
gcagaggatagcatatgaacct

SEQ ID NO: 7103581 - DNA, 22 bp, Homo sapiens
gcagaggagtgattatgccgtg

SEQ ID NO: 7103582 - DNA, 22 bp, Homo sapiens
gcagaggaggacccaggaatta

SEQ ID NO: 7103583 - DNA, 22 bp, Homo sapiens
gcagagcagggattttgccata

SEQ ID NO: 7103584 - DNA, 22 bp, Homo sapiens
gcagagcagtactctcttgact

SEQ ID NO: 7103585 - DNA, 22 bp, Homo sapiens
gcagagcagtactctcttgact

SEQ ID NO: 7103586 - DNA, 22 bp, Homo sapiens
gcagagcaggaaggaagtcagg

SEQ ID NO: 7103587 - DNA, 22 bp, Homo sapiens
gcagagcaggaaggaagtcagg

SEQ ID NO: 7103588 - DNA, 22 bp, Homo sapiens
gcagagcagcaaatggaaagga

SEQ ID NO: 7103589 - DNA, 22 bp, Homo sapiens
gcagagcagcaaatggaaagga

SEQ ID NO: 7103590 - DNA, 22 bp, Homo sapiens
gcagagcaggaaggaagtcagg

SEQ ID NO: 7103591 - DNA, 22 bp, Homo sapiens
gcagagcagaggtgcaggttgg

SEQ ID NO: 7103592 - DNA, 22 bp, Homo sapiens
gcagagcagaggtgcaggttgg

SEQ ID NO: 7103593 - DNA, 22 bp, Homo sapiens
gcagagcagagcctgcattggc

SEQ ID NO: 7103594 - DNA, 22 bp, Homo sapiens
gcagagcagagcctgcattggc

SEQ ID NO: 7103595 - DNA, 22 bp, Homo sapiens
gcagagcagagcctgcattggc

SEQ ID NO: 7103596 - DNA, 22 bp, Homo sapiens
gcagaggatcaggctctggaaa

SEQ ID NO: 7103597 - DNA, 22 bp, Homo sapiens
gcagaggatcaggctctggaaa

SEQ ID NO: 7103598 - DNA, 22 bp, Homo sapiens
gcagaggatcaggctctggaaa

SEQ ID NO: 7103599 - DNA, 22 bp, Homo sapiens
gcagaggcacagccccagatga

SEQ ID NO: 7103600 - DNA, 22 bp, Homo sapiens
gcagaggatcaggctctggaaa

SEQ ID NO: 7103601 - DNA, 22 bp, Homo sapiens
gcagaggatagcatatgaacct

SEQ ID NO: 7103602 - DNA, 22 bp, Homo sapiens
gcagaggatagcatatgaacct

SEQ ID NO: 7103603 - DNA, 22 bp, Homo sapiens
gcagaggatcaggctctggaaa

SEQ ID NO: 7103604 - DNA, 22 bp, Homo sapiens
gcagaggatcaggctctggaaa

SEQ ID NO: 7103605 - DNA, 22 bp, Homo sapiens
gcagaggcatttctgacgctgc

SEQ ID NO: 7103606 - DNA, 22 bp, Homo sapiens
gcagaggcatttctgacgctgc

SEQ ID NO: 7103607 - DNA, 22 bp, Homo sapiens
gcagaggcagggccctcctcca

SEQ ID NO: 7103608 - DNA, 22 bp, Homo sapiens
gcagaggcagggccctcctcca

SEQ ID NO: 7103609 - DNA, 22 bp, Homo sapiens
gcagaggcagggccctcctcca

SEQ ID NO: 7103610 - DNA, 21 bp, Homo sapiens
gcagaggcacggcaccaaggg

SEQ ID NO: 7103611 - DNA, 21 bp, Homo sapiens
gcagaggcacggcaccaaggg

SEQ ID NO: 7103612 - DNA, 21 bp, Homo sapiens
gcagaggcacggcaccaaggg

SEQ ID NO: 7103613 - DNA, 21 bp, Homo sapiens
gcagaggcacggcaccaaggg

SEQ ID NO: 7103614 - DNA, 22 bp, Homo sapiens
gcagaggtgagaagggcctccc

SEQ ID NO: 7103615 - DNA, 22 bp, Homo sapiens
gcagaggtgaccagcagcaggg

SEQ ID NO: 7103616 - DNA, 22 bp, Homo sapiens
gcagaggtctcttcaaaataat

SEQ ID NO: 7103617 - DNA, 22 bp, Homo sapiens
gcagaggtctagcaccaagaat

SEQ ID NO: 7103618 - DNA, 22 bp, Homo sapiens
gcagaggtcctagccaggagtc

SEQ ID NO: 7103619 - DNA, 20 bp, Homo sapiens
gcagagtgtgagagggtgaa

SEQ ID NO: 7103620 - DNA, 20 bp, Homo sapiens
gcagagtgtgagagggtgaa

SEQ ID NO: 7103621 - DNA, 20 bp, Homo sapiens
gcagagtgtgagagggtgaa

SEQ ID NO: 7103622 - DNA, 20 bp, Homo sapiens
gcagagtgtgagagggtgaa

SEQ ID NO: 7103623 - DNA, 22 bp, Homo sapiens
gcagagttcctggaaagcaacc

SEQ ID NO: 7103624 - DNA, 22 bp, Homo sapiens
gcagagggtcctgtgccagcag

SEQ ID NO: 7103625 - DNA, 22 bp, Homo sapiens
gcagagggggtacttcggccct

SEQ ID NO: 7103626 - DNA, 22 bp, Homo sapiens
gcagagggtcctgtgccagcag

SEQ ID NO: 7103627 - DNA, 22 bp, Homo sapiens
gcagagggtcctgtgccagcag

SEQ ID NO: 7103628 - DNA, 22 bp, Homo sapiens
gcagaggtcctagccaggagtc

SEQ ID NO: 7103629 - DNA, 22 bp, Homo sapiens
gcagagggtcctgtgccagcag

SEQ ID NO: 7103630 - DNA, 22 bp, Homo sapiens
gcagagggtcctgtgccagcag

SEQ ID NO: 7103631 - DNA, 22 bp, Homo sapiens
gcagaggggaagctgaggaatt

SEQ ID NO: 7103632 - DNA, 22 bp, Homo sapiens
gcagaggggaagctgaggaatt

SEQ ID NO: 7103633 - DNA, 22 bp, Homo sapiens
gcagagggggtacttcggccct

SEQ ID NO: 7103634 - DNA, 22 bp, Homo sapiens
gcagagggggtacttcggccct

SEQ ID NO: 7103635 - DNA, 22 bp, Homo sapiens
gcagaggcatttctgacgctgc

SEQ ID NO: 7103636 - DNA, 22 bp, Homo sapiens
gcagaggccaggccaccagcaa

SEQ ID NO: 7103637 - DNA, 22 bp, Homo sapiens
gcagaggccaggccaccagcaa

SEQ ID NO: 7103638 - DNA, 22 bp, Homo sapiens
gcaaagacggactcaggagtgc

SEQ ID NO: 7103639 - DNA, 22 bp, Homo sapiens
gcaaagaaatgtcagtgagagg

SEQ ID NO: 7103640 - DNA, 22 bp, Homo sapiens
gcaaagaatgcagatttgcctc

SEQ ID NO: 7103641 - DNA, 22 bp, Homo sapiens
gaggcccagcagcgcaggtctt

SEQ ID NO: 7103642 - DNA, 22 bp, Homo sapiens
gaggcccagcagcgcaggtctt

SEQ ID NO: 7103643 - DNA, 22 bp, Homo sapiens
gcaaactgttggagtagagtct

SEQ ID NO: 7103644 - DNA, 22 bp, Homo sapiens
gcaaactggtagctcgcctgcc

SEQ ID NO: 7103645 - DNA, 22 bp, Homo sapiens
gcaaagaaagccaaggtctaac

SEQ ID NO: 7103646 - DNA, 22 bp, Homo sapiens
gcaaagaaagccaaggtctaac

SEQ ID NO: 7103647 - DNA, 22 bp, Homo sapiens
gcaaagaaagttttaatgaggt

SEQ ID NO: 7103648 - DNA, 22 bp, Homo sapiens
gcaaagaaatgtcagtgagagg

SEQ ID NO: 7103649 - DNA, 22 bp, Homo sapiens
gcaaagaaatgtcagtgagagg

SEQ ID NO: 7103650 - DNA, 22 bp, Homo sapiens
gaggcccagagaggttgcatga

SEQ ID NO: 7103651 - DNA, 22 bp, Homo sapiens
gaggcccagcagcgcaggtctt

SEQ ID NO: 7103652 - DNA, 22 bp, Homo sapiens
gaggcccagcagcgcaggtctt

SEQ ID NO: 7103653 - DNA, 22 bp, Homo sapiens
gaggcccagcagcgcaggtctt

SEQ ID NO: 7103654 - DNA, 22 bp, Homo sapiens
gaggcccagcagcgcaggtctt

SEQ ID NO: 7103655 - DNA, 20 bp, Homo sapiens
gaggcccagagaggtgaagc

SEQ ID NO: 7103656 - DNA, 20 bp, Homo sapiens
gaggcccagagaggtgaagc

SEQ ID NO: 7103657 - DNA, 22 bp, Homo sapiens
gaggcccaatgcttccctcctt

SEQ ID NO: 7103658 - DNA, 22 bp, Homo sapiens
gaggcccacagggagtaccaag

SEQ ID NO: 7103659 - DNA, 22 bp, Homo sapiens
gaggcccacagggagtaccaag

SEQ ID NO: 7103660 - DNA, 22 bp, Homo sapiens
gaggcccacagggagtaccaag

SEQ ID NO: 7103661 - DNA, 22 bp, Homo sapiens
gaggccaggaggatctctctaa

SEQ ID NO: 7103662 - DNA, 22 bp, Homo sapiens
gaggccaggaggatctctctaa

SEQ ID NO: 7103663 - DNA, 22 bp, Homo sapiens
gaggccagtgtgctgtgttttc

SEQ ID NO: 7103664 - DNA, 22 bp, Homo sapiens
gaggccatgaatggatgttcct

SEQ ID NO: 7103665 - DNA, 22 bp, Homo sapiens
gaggccattcagctgggcagca

SEQ ID NO: 7103666 - DNA, 22 bp, Homo sapiens
gaggccattcagctgggcagca

SEQ ID NO: 7103667 - DNA, 22 bp, Homo sapiens
gaggcccaaggactctgtcccg

SEQ ID NO: 7103668 - DNA, 22 bp, Homo sapiens
gaggcccaaggactctgtcccg

SEQ ID NO: 7103669 - DNA, 22 bp, Homo sapiens
gcaaagcattctgtggagtcta

SEQ ID NO: 7103670 - DNA, 22 bp, Homo sapiens
gcaaagcatcagtagaaatgtt

SEQ ID NO: 7103671 - DNA, 22 bp, Homo sapiens
gcaaagcagaaccctctctatc

SEQ ID NO: 7103672 - DNA, 22 bp, Homo sapiens
gcaaagcagaaccctctctatc

SEQ ID NO: 7103673 - DNA, 22 bp, Homo sapiens
gcaaagcagtcttctgtgccta

SEQ ID NO: 7103674 - DNA, 22 bp, Homo sapiens
gcaaagcatcagtagaaatgtt

SEQ ID NO: 7103675 - DNA, 22 bp, Homo sapiens
gcaaagcatcagtagaaatgtt

SEQ ID NO: 7103676 - DNA, 22 bp, Homo sapiens
gcaaagcaaatgcctgaaggcg

SEQ ID NO: 7103677 - DNA, 22 bp, Homo sapiens
gcaaagcaagattcagatgtag

SEQ ID NO: 7103678 - DNA, 22 bp, Homo sapiens
gcaaagcaagctgtcagcctca

SEQ ID NO: 7103679 - DNA, 22 bp, Homo sapiens
gcaaataatatactttgatctc

SEQ ID NO: 7103680 - DNA, 22 bp, Homo sapiens
gcaaataaatgctcactgctgt

SEQ ID NO: 7103681 - DNA, 22 bp, Homo sapiens
gcaaatacatgttgagcaccta

SEQ ID NO: 7103682 - DNA, 22 bp, Homo sapiens
gcaaagtgaaatggggcagaga

SEQ ID NO: 7103683 - DNA, 22 bp, Homo sapiens
gcaaagtgaaatggggcagaga

SEQ ID NO: 7103684 - DNA, 22 bp, Homo sapiens
gcaaagtgcttcagtgggagct

SEQ ID NO: 7103685 - DNA, 22 bp, Homo sapiens
gcaaaggccactggggcgatgg

SEQ ID NO: 7103686 - DNA, 22 bp, Homo sapiens
gcaaaggccactggggcgatgg

SEQ ID NO: 7103687 - DNA, 22 bp, Homo sapiens
gcaaaggctagagacacaggga

SEQ ID NO: 7103688 - DNA, 22 bp, Homo sapiens
gcaaaggctagagacacaggga

SEQ ID NO: 7103689 - DNA, 22 bp, Homo sapiens
gcaaaggcttcttttattctcc

SEQ ID NO: 7103690 - DNA, 22 bp, Homo sapiens
gcaaaggcttcttttattctcc

SEQ ID NO: 7103691 - DNA, 22 bp, Homo sapiens
gcaaagggaaagtggcagggtc

SEQ ID NO: 7103692 - DNA, 22 bp, Homo sapiens
gcaaagggaaagtggcagggtc

SEQ ID NO: 7103693 - DNA, 20 bp, Homo sapiens
gcacagtagcagtgcaaatg

SEQ ID NO: 7103694 - DNA, 22 bp, Homo sapiens
gcacagtaggctcagctctatc

SEQ ID NO: 7103695 - DNA, 21 bp, Homo sapiens
gcacagtaagaaaagctgcct

SEQ ID NO: 7103696 - DNA, 22 bp, Homo sapiens
gcacagtacctgtcacagaggc

SEQ ID NO: 7103697 - DNA, 22 bp, Homo sapiens
gcacagtacctgtcacagaggc

SEQ ID NO: 7103698 - DNA, 22 bp, Homo sapiens
gcacaggttgcaaaagttcaca

SEQ ID NO: 7103699 - DNA, 22 bp, Homo sapiens
gcacaggttgtacttgggcacc

SEQ ID NO: 7103700 - DNA, 22 bp, Homo sapiens
gcacagtaggtatttacccagt

SEQ ID NO: 7103701 - DNA, 22 bp, Homo sapiens
gcacagtattgcacaactctag

SEQ ID NO: 7103702 - DNA, 22 bp, Homo sapiens
gcacagtatttagtagaatgag

SEQ ID NO: 7103703 - DNA, 22 bp, Homo sapiens
gcacagtcaacacttattcacc

SEQ ID NO: 7103704 - DNA, 22 bp, Homo sapiens
gcacaggctccggaggagagct

SEQ ID NO: 7103705 - DNA, 22 bp, Homo sapiens
gcacaggctctcttggggacac

SEQ ID NO: 7103706 - DNA, 22 bp, Homo sapiens
gcacaggctctcttggggacac

SEQ ID NO: 7103707 - DNA, 22 bp, Homo sapiens
gcacagggctgccaggcggctt

SEQ ID NO: 7103708 - DNA, 22 bp, Homo sapiens
gcacagggctgccaggcggctt

SEQ ID NO: 7103709 - DNA, 22 bp, Homo sapiens
gcacagggctgccaggcggctt

SEQ ID NO: 7103710 - DNA, 22 bp, Homo sapiens
gcacagggctgccaggcggctt

SEQ ID NO: 7103711 - DNA, 22 bp, Homo sapiens
gcacagggctgccaggcggctt

SEQ ID NO: 7103712 - DNA, 22 bp, Homo sapiens
gcacagggctgccaggcggctt

SEQ ID NO: 7103713 - DNA, 22 bp, Homo sapiens
gcacaggtaatccgaatcattc

SEQ ID NO: 7103714 - DNA, 22 bp, Homo sapiens
gcacaccctctcaccagcactg

SEQ ID NO: 7103715 - DNA, 19 bp, Homo sapiens
gcacaccctgcaccaccat

SEQ ID NO: 7103716 - DNA, 22 bp, Homo sapiens
gcacactcctggatcctagaga

SEQ ID NO: 7103717 - DNA, 22 bp, Homo sapiens
gcacactggagcctggaagatt

SEQ ID NO: 7103718 - DNA, 22 bp, Homo sapiens
gcacactgtgaatttgcatatg

SEQ ID NO: 7103719 - DNA, 22 bp, Homo sapiens
gcacacttaatactcactgtgc

SEQ ID NO: 7103720 - DNA, 22 bp, Homo sapiens
gcacagaaatgtctacacatgt

SEQ ID NO: 7103721 - DNA, 22 bp, Homo sapiens
gcacagaaccagacatgaggca

SEQ ID NO: 7103722 - DNA, 22 bp, Homo sapiens
gcacagaaccagacatgaggca

SEQ ID NO: 7103723 - DNA, 22 bp, Homo sapiens
gcacaggccatgggaggacagc

SEQ ID NO: 7103724 - DNA, 22 bp, Homo sapiens
gcacaggccatgggaggacagc

SEQ ID NO: 7103725 - DNA, 22 bp, Homo sapiens
gcacaggctccggaggagagct

SEQ ID NO: 7103726 - DNA, 22 bp, Homo sapiens
gcacaggctccggaggagagct

SEQ ID NO: 7103727 - DNA, 22 bp, Homo sapiens
gcacacattctagccttttgtg

SEQ ID NO: 7103728 - DNA, 22 bp, Homo sapiens
gcacacattcggattcttaacc

SEQ ID NO: 7103729 - DNA, 22 bp, Homo sapiens
gcacacatgcatgtgtgcatcc

SEQ ID NO: 7103730 - DNA, 22 bp, Homo sapiens
gcacacatgcatgtgtgcatcc

SEQ ID NO: 7103731 - DNA, 22 bp, Homo sapiens
gcacacatgcatgtgtgcatcc

SEQ ID NO: 7103732 - DNA, 22 bp, Homo sapiens
gcacacatgcatgtgtgcatcc

SEQ ID NO: 7103733 - DNA, 22 bp, Homo sapiens
gcacacatgcatgcacaggagt

SEQ ID NO: 7103734 - DNA, 19 bp, Homo sapiens
gcacacatacaccctttgg

SEQ ID NO: 7103735 - DNA, 22 bp, Homo sapiens
gcacacagtatatgctcattaa

SEQ ID NO: 7103736 - DNA, 19 bp, Homo sapiens
gcacacagtagggctggca

SEQ ID NO: 7103737 - DNA, 22 bp, Homo sapiens
gcacacagtatatgctcattaa

SEQ ID NO: 7103738 - DNA, 22 bp, Homo sapiens
gcacacagtatatgctcattaa

SEQ ID NO: 7103739 - DNA, 20 bp, Homo sapiens
gcacacatagaaatgcatat

SEQ ID NO: 7103740 - DNA, 22 bp, Homo sapiens
gcacacatatatatgagcatgt

SEQ ID NO: 7103741 - DNA, 22 bp, Homo sapiens
gcacacatcttgtaatcctgag

SEQ ID NO: 7103742 - DNA, 22 bp, Homo sapiens
gcacacagtagggattcaatga

SEQ ID NO: 7103743 - DNA, 22 bp, Homo sapiens
gcacacagtactatatgctaca

SEQ ID NO: 7103744 - DNA, 22 bp, Homo sapiens
gcacacagtactatatgctaca

SEQ ID NO: 7103745 - DNA, 22 bp, Homo sapiens
gcacacagtactatatgctaca

SEQ ID NO: 7103746 - DNA, 22 bp, Homo sapiens
gcacacagaatcagtgggcata

SEQ ID NO: 7103747 - DNA, 22 bp, Homo sapiens
gcacacagtagggattcaatga

SEQ ID NO: 7103748 - DNA, 19 bp, Homo sapiens
gcacacagtagggctggca

SEQ ID NO: 7103749 - DNA, 19 bp, Homo sapiens
gcacacagtagggctggca

SEQ ID NO: 7103750 - DNA, 22 bp, Homo sapiens
gcacacagaacatttggatcct

SEQ ID NO: 7103751 - DNA, 22 bp, Homo sapiens
gcacacagaacatttggatcct

SEQ ID NO: 7103752 - DNA, 22 bp, Homo sapiens
gcacacagaacatttggatcct

SEQ ID NO: 7103753 - DNA, 22 bp, Homo sapiens
gcacacagaatcagtgggcata

SEQ ID NO: 7103754 - DNA, 22 bp, Homo sapiens
gcacacagaatcagtgggcata

SEQ ID NO: 7103755 - DNA, 22 bp, Homo sapiens
gcaaatagaagattctgttgac

SEQ ID NO: 7103756 - DNA, 22 bp, Homo sapiens
gccagcctgtgcttggccaggc

SEQ ID NO: 7103757 - DNA, 22 bp, Homo sapiens
gccagcctgtgcttggccaggc

SEQ ID NO: 7103758 - DNA, 22 bp, Homo sapiens
gccagcctgtgcttggccaggc

SEQ ID NO: 7103759 - DNA, 18 bp, Homo sapiens
gccagccctccaacctcc

SEQ ID NO: 7103760 - DNA, 18 bp, Homo sapiens
gccagccctccaacctcc

SEQ ID NO: 7103761 - DNA, 20 bp, Homo sapiens
gccagccctgacacaggagc

SEQ ID NO: 7103762 - DNA, 18 bp, Homo sapiens
gccagccctccaacctcc

SEQ ID NO: 7103763 - DNA, 22 bp, Homo sapiens
gccaccatgtattgacttggcc

SEQ ID NO: 7103764 - DNA, 22 bp, Homo sapiens
gccaccccaacctccctaagtt

SEQ ID NO: 7103765 - DNA, 22 bp, Homo sapiens
gccaccccataggtgttaggtg

SEQ ID NO: 7103766 - DNA, 22 bp, Homo sapiens
gccaccccataggtgttaggtg

SEQ ID NO: 7103767 - DNA, 22 bp, Homo sapiens
gccagcctgtgcttggccaggc

SEQ ID NO: 7103768 - DNA, 22 bp, Homo sapiens
gccagcctgtgggggctctgtg

SEQ ID NO: 7103769 - DNA, 22 bp, Homo sapiens
gccagcctgtgggggctctgtg

SEQ ID NO: 7103770 - DNA, 22 bp, Homo sapiens
gccagcctgtgggggctctgtg

SEQ ID NO: 7103771 - DNA, 21 bp, Homo sapiens
gccagcctgtttacctgtggt

SEQ ID NO: 7103772 - DNA, 22 bp, Homo sapiens
gccagccttctgtggcctgcaa

SEQ ID NO: 7103773 - DNA, 22 bp, Homo sapiens
gccagccttctgtggcctgcaa

SEQ ID NO: 7103774 - DNA, 22 bp, Homo sapiens
gccagccttctgtggcctgcaa

SEQ ID NO: 7103775 - DNA, 23 bp, Homo sapiens
gccagccttgctctcctgcagcc

SEQ ID NO: 7103776 - DNA, 23 bp, Homo sapiens
gccagccttgctctcctgcagcc

SEQ ID NO: 7103777 - DNA, 23 bp, Homo sapiens
gccagccttgctctcctgcagcc

SEQ ID NO: 7103778 - DNA, 23 bp, Homo sapiens
gccagccttgctctcctgcagcc

SEQ ID NO: 7103779 - DNA, 23 bp, Homo sapiens
gccagccttgctctcctgcagcc

SEQ ID NO: 7103780 - DNA, 22 bp, Homo sapiens
gccagctcttgatgggtgggta

SEQ ID NO: 7103781 - DNA, 22 bp, Homo sapiens
gccagctcttgatgggtgggta

SEQ ID NO: 7103782 - DNA, 22 bp, Homo sapiens
gccagctcttgatgggtgggta

SEQ ID NO: 7103783 - DNA, 22 bp, Homo sapiens
gccagctctgtggctgtacttg

SEQ ID NO: 7103784 - DNA, 22 bp, Homo sapiens
gccagctccgcaggatggcgcg

SEQ ID NO: 7103785 - DNA, 22 bp, Homo sapiens
gccagctctcattgtataggct

SEQ ID NO: 7103786 - DNA, 22 bp, Homo sapiens
gccagctctcattgtataggct

SEQ ID NO: 7103787 - DNA, 22 bp, Homo sapiens
gccagctctgtggctgtacttg

SEQ ID NO: 7103788 - DNA, 22 bp, Homo sapiens
gccagctcagtttcaaagtagg

SEQ ID NO: 7103789 - DNA, 22 bp, Homo sapiens
gccagctcccaagtgagcccct

SEQ ID NO: 7103790 - DNA, 22 bp, Homo sapiens
gccagctcccaagtgagcccct

SEQ ID NO: 7103791 - DNA, 22 bp, Homo sapiens
gccagctcccaagtgagcccct

SEQ ID NO: 7103792 - DNA, 22 bp, Homo sapiens
gccagctccgcaggatggcgcg

SEQ ID NO: 7103793 - DNA, 22 bp, Homo sapiens
gccagctcagatgcaggaagga

SEQ ID NO: 7103794 - DNA, 22 bp, Homo sapiens
gccagctcagatgcaggaagga

SEQ ID NO: 7103795 - DNA, 22 bp, Homo sapiens
gccagctcagatgcaggaagga

SEQ ID NO: 7103796 - DNA, 22 bp, Homo sapiens
gccagctcagatgcaggaagga

SEQ ID NO: 7103797 - DNA, 22 bp, Homo sapiens
gccagctcagtgccaggcccct

SEQ ID NO: 7103798 - DNA, 22 bp, Homo sapiens
gccagctcagtgccaggcccct

SEQ ID NO: 7103799 - DNA, 22 bp, Homo sapiens
gccagctcagtttcaaagtagg

SEQ ID NO: 7103800 - DNA, 22 bp, Homo sapiens
gccagctgaaatttcagttctg

SEQ ID NO: 7103801 - DNA, 22 bp, Homo sapiens
gccagctgaagccctggtggaa

SEQ ID NO: 7103802 - DNA, 22 bp, Homo sapiens
gccagctgaagccctggtggaa

SEQ ID NO: 7103803 - DNA, 22 bp, Homo sapiens
gccagctgaatttccaactgtt

SEQ ID NO: 7103804 - DNA, 22 bp, Homo sapiens
gccagctgaatttccaactgtt

SEQ ID NO: 7103805 - DNA, 22 bp, Homo sapiens
gccaggcactgctctaagccct

SEQ ID NO: 7103806 - DNA, 20 bp, Homo sapiens
gccaggcactgttctcaata

SEQ ID NO: 7103807 - DNA, 22 bp, Homo sapiens
gccaggcagagccccgtgcagc

SEQ ID NO: 7103808 - DNA, 22 bp, Homo sapiens
gccaggcagctgggagggtgcc

SEQ ID NO: 7103809 - DNA, 22 bp, Homo sapiens
gccaggcaggccacgctgtgtt

SEQ ID NO: 7103810 - DNA, 22 bp, Homo sapiens
gccaggcagctagcaacccctg

SEQ ID NO: 7103811 - DNA, 22 bp, Homo sapiens
gccaggcagctgggagggtgcc

SEQ ID NO: 7103812 - DNA, 22 bp, Homo sapiens
gccaggcagctgggagggtgcc

SEQ ID NO: 7103813 - DNA, 22 bp, Homo sapiens
gccaggcagctgggagggtgcc

SEQ ID NO: 7103814 - DNA, 18 bp, Homo sapiens
gccaggcagggtggggaa

SEQ ID NO: 7103815 - DNA, 18 bp, Homo sapiens
gccaggcagggtggggaa

SEQ ID NO: 7103816 - DNA, 18 bp, Homo sapiens
gccaggcagggtggggaa

SEQ ID NO: 7103817 - DNA, 18 bp, Homo sapiens
gccaggcagggtggggaa

SEQ ID NO: 7103818 - DNA, 22 bp, Homo sapiens
gccaggcaggtgtcggagccct

SEQ ID NO: 7103819 - DNA, 22 bp, Homo sapiens
gccaggcaggtgtcggagccct

SEQ ID NO: 7103820 - DNA, 22 bp, Homo sapiens
gccaggcagatatgtgagctta

SEQ ID NO: 7103821 - DNA, 22 bp, Homo sapiens
gccaggcagatatgtgagctta

SEQ ID NO: 7103822 - DNA, 22 bp, Homo sapiens
gccaggcagcagcgaggatggt

SEQ ID NO: 7103823 - DNA, 22 bp, Homo sapiens
gccaggcagcagcgaggatggt

SEQ ID NO: 7103824 - DNA, 22 bp, Homo sapiens
gccaggcagatatgtgagctta

SEQ ID NO: 7103825 - DNA, 22 bp, Homo sapiens
gccaggcagcagcgaggatggt

SEQ ID NO: 7103826 - DNA, 22 bp, Homo sapiens
gccaggcagagccccgtgcagc

SEQ ID NO: 7103827 - DNA, 22 bp, Homo sapiens
gccaggcagatatgtgagctta

SEQ ID NO: 7103828 - DNA, 22 bp, Homo sapiens
gccaggcagcagcgaggatggt

SEQ ID NO: 7103829 - DNA, 22 bp, Homo sapiens
gccaggcagccaccctctgcga

SEQ ID NO: 7103830 - DNA, 22 bp, Homo sapiens
gccagggctgtgcaggtttgtt

SEQ ID NO: 7103831 - DNA, 22 bp, Homo sapiens
gccagggctgtgcaggtttgtt

SEQ ID NO: 7103832 - DNA, 22 bp, Homo sapiens
gccagggctgtgcaggtttgtt

SEQ ID NO: 7103833 - DNA, 22 bp, Homo sapiens
gccagggctcgcggtccctcgt

SEQ ID NO: 7103834 - DNA, 22 bp, Homo sapiens
gccagggctcgcggtccctcgt

SEQ ID NO: 7103835 - DNA, 22 bp, Homo sapiens
gccagggctcgcggtccctcgt

SEQ ID NO: 7103836 - DNA, 22 bp, Homo sapiens
gccagggcaggggagcatctgc

SEQ ID NO: 7103837 - DNA, 22 bp, Homo sapiens
gccagggcaggggagcatctgc

SEQ ID NO: 7103838 - DNA, 22 bp, Homo sapiens
gccagggcaggggagcatctgc

SEQ ID NO: 7103839 - DNA, 22 bp, Homo sapiens
gccagggcaggggagcatctgc

SEQ ID NO: 7103840 - DNA, 22 bp, Homo sapiens
gccagggcaggggagcatctgc

SEQ ID NO: 7103841 - DNA, 21 bp, Homo sapiens
gccagggagttaaagagtctt

SEQ ID NO: 7103842 - DNA, 22 bp, Homo sapiens
gccagggagtctgggccacaga

SEQ ID NO: 7103843 - DNA, 21 bp, Homo sapiens
gccagggagttaaagagtctt

SEQ ID NO: 7103844 - DNA, 22 bp, Homo sapiens
gccagggagtctgggccacaga

SEQ ID NO: 7103845 - DNA, 22 bp, Homo sapiens
gccagggagtctgggccacaga

SEQ ID NO: 7103846 - DNA, 22 bp, Homo sapiens
gccagggagtctgggccacaga

SEQ ID NO: 7103847 - DNA, 22 bp, Homo sapiens
gccagggaacccaagggcctca

SEQ ID NO: 7103848 - DNA, 22 bp, Homo sapiens
gccagggaacccaagggcctca

SEQ ID NO: 7103849 - DNA, 22 bp, Homo sapiens
gccagggaacccaagggcctca

SEQ ID NO: 7103850 - DNA, 22 bp, Homo sapiens
gccagggaacccaagggcctca

SEQ ID NO: 7103851 - DNA, 22 bp, Homo sapiens
gccaggcatgggcttctgggcg

SEQ ID NO: 7103852 - DNA, 22 bp, Homo sapiens
gccaggcatgtcctctgcagaa

SEQ ID NO: 7103853 - DNA, 22 bp, Homo sapiens
gccagggaggctgtagggtcct

SEQ ID NO: 7103854 - DNA, 22 bp, Homo sapiens
gccagggaggctgtagggtcct

SEQ ID NO: 7103855 - DNA, 22 bp, Homo sapiens
gccagggaggctgtagggtcct

SEQ ID NO: 7103856 - DNA, 17 bp, Homo sapiens
gccagggagaggaagcc

SEQ ID NO: 7103857 - DNA, 17 bp, Homo sapiens
gccagggagaggaagcc

SEQ ID NO: 7103858 - DNA, 17 bp, Homo sapiens
gccagggagaggaagcc

SEQ ID NO: 7103859 - DNA, 17 bp, Homo sapiens
gccagggagaggaagcc

SEQ ID NO: 7103860 - DNA, 17 bp, Homo sapiens
gccagggagaggaagcc

SEQ ID NO: 7103861 - DNA, 21 bp, Homo sapiens
gccagggaagagagttggctg

SEQ ID NO: 7103862 - DNA, 21 bp, Homo sapiens
gccagggaagagagttggctg

SEQ ID NO: 7103863 - DNA, 21 bp, Homo sapiens
gccagggaagagagttggctg

SEQ ID NO: 7103864 - DNA, 22 bp, Homo sapiens
gcatggcttccaaaagtgctaa

SEQ ID NO: 7103865 - DNA, 22 bp, Homo sapiens
gcatggcttacagaggctgcag

SEQ ID NO: 7103866 - DNA, 22 bp, Homo sapiens
gcatggctgtgagcaccctgcc

SEQ ID NO: 7103867 - DNA, 22 bp, Homo sapiens
gcatggctgttgaagtcagctc

SEQ ID NO: 7103868 - DNA, 22 bp, Homo sapiens
gcatggctggtgtcctgaggga

SEQ ID NO: 7103869 - DNA, 22 bp, Homo sapiens
gcatggctgctccctggctgca

SEQ ID NO: 7103870 - DNA, 22 bp, Homo sapiens
gcatggctcctgtcttactccc

SEQ ID NO: 7103871 - DNA, 22 bp, Homo sapiens
gcatggctctggcctcagtgtg

SEQ ID NO: 7103872 - DNA, 22 bp, Homo sapiens
gcatggctattatgaggcagaa

SEQ ID NO: 7103873 - DNA, 22 bp, Homo sapiens
gcatggctattatgaggcagaa

SEQ ID NO: 7103874 - DNA, 22 bp, Homo sapiens
gcatggctattatgaggcagaa

SEQ ID NO: 7103875 - DNA, 20 bp, Homo sapiens
gcatggctaatctgtactga

SEQ ID NO: 7103876 - DNA, 20 bp, Homo sapiens
gcatggctaatctgtactga

SEQ ID NO: 7103877 - DNA, 22 bp, Homo sapiens
gcatggccttgctgtagtggta

SEQ ID NO: 7103878 - DNA, 22 bp, Homo sapiens
gcatggccttcagggacagctg

SEQ ID NO: 7103879 - DNA, 22 bp, Homo sapiens
gcatgctgctgaggctggaata

SEQ ID NO: 7103880 - DNA, 22 bp, Homo sapiens
gcatgctgcaccagagcctctc

SEQ ID NO: 7103881 - DNA, 22 bp, Homo sapiens
gcatgctgcagggaatgcttgt

SEQ ID NO: 7103882 - DNA, 22 bp, Homo sapiens
gcatgctgcagggaatgcttgt

SEQ ID NO: 7103883 - DNA, 22 bp, Homo sapiens
gcatgctgcccagggactctct

SEQ ID NO: 7103884 - DNA, 22 bp, Homo sapiens
gcatgcatttccattctcacat

SEQ ID NO: 7103885 - DNA, 22 bp, Homo sapiens
gcatgcatttgtacttgatttt

SEQ ID NO: 7103886 - DNA, 22 bp, Homo sapiens
gcatgcatttgtacttgatttt

SEQ ID NO: 7103887 - DNA, 22 bp, Homo sapiens
gcatgcatttgtacttgatttt

SEQ ID NO: 7103888 - DNA, 22 bp, Homo sapiens
gcatgcattttctgagagtcag

SEQ ID NO: 7103889 - DNA, 22 bp, Homo sapiens
gcatgcattttctgagagtcag

SEQ ID NO: 7103890 - DNA, 21 bp, Homo sapiens
gcatgcctgcatcttagtgtt

SEQ ID NO: 7103891 - DNA, 22 bp, Homo sapiens
gcatgcattttctgagagtcag

SEQ ID NO: 7103892 - DNA, 22 bp, Homo sapiens
gcatgctctgcaaaggcttttg

SEQ ID NO: 7103893 - DNA, 22 bp, Homo sapiens
gcatgctgagcccacgcctggg

SEQ ID NO: 7103894 - DNA, 22 bp, Homo sapiens
gcatgctgagcccacgcctggg

SEQ ID NO: 7103895 - DNA, 22 bp, Homo sapiens
gcatgctgcaccagagcctctc

SEQ ID NO: 7103896 - DNA, 22 bp, Homo sapiens
gcatgcagtaaaattcagcaac

SEQ ID NO: 7103897 - DNA, 22 bp, Homo sapiens
gcatgcatctagatatgcagac

SEQ ID NO: 7103898 - DNA, 22 bp, Homo sapiens
gcatgcatctagatatgcagac

SEQ ID NO: 7103899 - DNA, 22 bp, Homo sapiens
gcatgcatctagatatgcagac

SEQ ID NO: 7103900 - DNA, 22 bp, Homo sapiens
gcatgcatgatgttggcagtgg

SEQ ID NO: 7103901 - DNA, 22 bp, Homo sapiens
gcatgcatgatgttggcagtgg

SEQ ID NO: 7103902 - DNA, 22 bp, Homo sapiens
gcatgcatgatgttggcagtgg

SEQ ID NO: 7103903 - DNA, 22 bp, Homo sapiens
gcatgcatgatgttggcagtgg

SEQ ID NO: 7103904 - DNA, 22 bp, Homo sapiens
gcatgcatggtttgtgactgtg

SEQ ID NO: 7103905 - DNA, 22 bp, Homo sapiens
gcatgcatggtttgtgactgtg

SEQ ID NO: 7103906 - DNA, 22 bp, Homo sapiens
gcatgcatggtttgtgactgtg

SEQ ID NO: 7103907 - DNA, 22 bp, Homo sapiens
gcatgcatgtgtgcagacagtc

SEQ ID NO: 7103908 - DNA, 22 bp, Homo sapiens
gcatgcatgtgtgcagacagtc

SEQ ID NO: 7103909 - DNA, 22 bp, Homo sapiens
gcatgcatgtgtgcagacagtc

SEQ ID NO: 7103910 - DNA, 22 bp, Homo sapiens
gcatgcattacatgggatatgc

SEQ ID NO: 7103911 - DNA, 22 bp, Homo sapiens
gcatgcattacatgggatatgc

SEQ ID NO: 7103912 - DNA, 22 bp, Homo sapiens
gcatgcattacatgggatatgc

SEQ ID NO: 7103913 - DNA, 22 bp, Homo sapiens
gcatgcatttcactaggtatgt

SEQ ID NO: 7103914 - DNA, 22 bp, Homo sapiens
gcatgcatttcactaggtatgt

SEQ ID NO: 7103915 - DNA, 22 bp, Homo sapiens
gcatgcatttcactaggtatgt

SEQ ID NO: 7103916 - DNA, 22 bp, Homo sapiens
gcatgcatttcactaggtatgt

SEQ ID NO: 7103917 - DNA, 22 bp, Homo sapiens
gcatgcatttccattctcacat

SEQ ID NO: 7103918 - DNA, 22 bp, Homo sapiens
gcatgcatttccattctcacat

SEQ ID NO: 7103919 - DNA, 22 bp, Homo sapiens
gccaccaggttctgggttaagc

SEQ ID NO: 7103920 - DNA, 22 bp, Homo sapiens
gccaccagtagctaacaacagt

SEQ ID NO: 7103921 - DNA, 22 bp, Homo sapiens
gccaccagtagctaacaacagt

SEQ ID NO: 7103922 - DNA, 22 bp, Homo sapiens
gccaccagtgggggcctgggca

SEQ ID NO: 7103923 - DNA, 22 bp, Homo sapiens
gccaccagtgggggcctgggca

SEQ ID NO: 7103924 - DNA, 22 bp, Homo sapiens
gccaccagtgggggcctgggca

SEQ ID NO: 7103925 - DNA, 22 bp, Homo sapiens
gccaccagtgggggcctgggca

SEQ ID NO: 7103926 - DNA, 22 bp, Homo sapiens
gccaccagggggtgcaaggtcc

SEQ ID NO: 7103927 - DNA, 22 bp, Homo sapiens
gccaccagggggtgcaaggtcc

SEQ ID NO: 7103928 - DNA, 22 bp, Homo sapiens
gccaccaggttagatccagcct

SEQ ID NO: 7103929 - DNA, 22 bp, Homo sapiens
gccaccaggttagatccagcct

SEQ ID NO: 7103930 - DNA, 22 bp, Homo sapiens
gccaccagggggctccagtgag

SEQ ID NO: 7103931 - DNA, 22 bp, Homo sapiens
gccaccagggggctccagtgag

SEQ ID NO: 7103932 - DNA, 22 bp, Homo sapiens
gccaccagggggctccagtgag

SEQ ID NO: 7103933 - DNA, 22 bp, Homo sapiens
gccaccaggagcccagtccaaa

SEQ ID NO: 7103934 - DNA, 22 bp, Homo sapiens
gccaccagggggctccagtgag

SEQ ID NO: 7103935 - DNA, 22 bp, Homo sapiens
gccaccagggggctccagtgag

SEQ ID NO: 7103936 - DNA, 22 bp, Homo sapiens
gccaccagggggctccagtgag

SEQ ID NO: 7103937 - DNA, 22 bp, Homo sapiens
gccaccaggagcccagtccaaa

SEQ ID NO: 7103938 - DNA, 22 bp, Homo sapiens
gccaccagcagaaaaggggcca

SEQ ID NO: 7103939 - DNA, 22 bp, Homo sapiens
gccaccagccccatgcgctgtg

SEQ ID NO: 7103940 - DNA, 22 bp, Homo sapiens
gccaccagccccatgcgctgtg

SEQ ID NO: 7103941 - DNA, 22 bp, Homo sapiens
gccaccagccccatgcgctgtg

SEQ ID NO: 7103942 - DNA, 22 bp, Homo sapiens
gccaccaggagcccagtccaaa

SEQ ID NO: 7103943 - DNA, 22 bp, Homo sapiens
gccaccaggagcccagtccaaa

SEQ ID NO: 7103944 - DNA, 22 bp, Homo sapiens
gccaccaggagcccagtccaaa

SEQ ID NO: 7103945 - DNA, 22 bp, Homo sapiens
gccaccagcagaaaaggggcca

SEQ ID NO: 7103946 - DNA, 22 bp, Homo sapiens
gccacatgtcatgtgctcagta

SEQ ID NO: 7103947 - DNA, 22 bp, Homo sapiens
gccaccagccccatgcgctgtg

SEQ ID NO: 7103948 - DNA, 22 bp, Homo sapiens
gccacatgtcatgtgctcagta

SEQ ID NO: 7103949 - DNA, 22 bp, Homo sapiens
gccacatgtcatgtgctcagta

SEQ ID NO: 7103950 - DNA, 22 bp, Homo sapiens
gccacatgcaattgcagcacgt

SEQ ID NO: 7103951 - DNA, 22 bp, Homo sapiens
gccacatgcaattgcagcacgt

SEQ ID NO: 7103952 - DNA, 22 bp, Homo sapiens
gccacagggaggcgttttcagg

SEQ ID NO: 7103953 - DNA, 22 bp, Homo sapiens
gccacagggaggcgttttcagg

SEQ ID NO: 7103954 - DNA, 22 bp, Homo sapiens
gccacaggcttaggagggaggt

SEQ ID NO: 7103955 - DNA, 19 bp, Homo sapiens
gccacatctgtaccccttt

SEQ ID NO: 7103956 - DNA, 19 bp, Homo sapiens
gccacatcttttccagagt

SEQ ID NO: 7103957 - DNA, 19 bp, Homo sapiens
gccacatcttttccagagt

SEQ ID NO: 7103958 - DNA, 22 bp, Homo sapiens
gcatggcttcggggtgctgcct

SEQ ID NO: 7103959 - DNA, 22 bp, Homo sapiens
gccacaggcttaggagggaggt

SEQ ID NO: 7103960 - DNA, 22 bp, Homo sapiens
gccacaggcttaggagggaggt

SEQ ID NO: 7103961 - DNA, 22 bp, Homo sapiens
gccacaggcttaggagggaggt

SEQ ID NO: 7103962 - DNA, 22 bp, Homo sapiens
gcagtgggagcttaggcagtgc

SEQ ID NO: 7103963 - DNA, 22 bp, Homo sapiens
gcagtgggaaggttggcacatg

SEQ ID NO: 7103964 - DNA, 22 bp, Homo sapiens
gcagtgggaaggttggcacatg

SEQ ID NO: 7103965 - DNA, 22 bp, Homo sapiens
gcagtgggagcttaggcagtgc

SEQ ID NO: 7103966 - DNA, 22 bp, Homo sapiens
gcagtgggaaggttggcacatg

SEQ ID NO: 7103967 - DNA, 22 bp, Homo sapiens
gcagtgggaaggttggcacatg

SEQ ID NO: 7103968 - DNA, 22 bp, Homo sapiens
gcagtgggaaggttggcacatg

SEQ ID NO: 7103969 - DNA, 22 bp, Homo sapiens
gcagtggccacatggaggagga

SEQ ID NO: 7103970 - DNA, 22 bp, Homo sapiens
gcagtggccacatggaggagga

SEQ ID NO: 7103971 - DNA, 22 bp, Homo sapiens
gcagtggccacatggaggagga

SEQ ID NO: 7103972 - DNA, 22 bp, Homo sapiens
gcagtggcccagcttgcaggct

SEQ ID NO: 7103973 - DNA, 22 bp, Homo sapiens
gcagtggcccagcttgcaggct

SEQ ID NO: 7103974 - DNA, 22 bp, Homo sapiens
gcagtggctaagctcgcatgca

SEQ ID NO: 7103975 - DNA, 22 bp, Homo sapiens
gcagtggctaagctcgcatgca

SEQ ID NO: 7103976 - DNA, 22 bp, Homo sapiens
gcagtggctaggagtctggcgt

SEQ ID NO: 7103977 - DNA, 22 bp, Homo sapiens
gcagtggcccagcttgcaggct

SEQ ID NO: 7103978 - DNA, 22 bp, Homo sapiens
gcatgcaggaagggcttgggga

SEQ ID NO: 7103979 - DNA, 22 bp, Homo sapiens
gcatgcaggagagaaagacggc

SEQ ID NO: 7103980 - DNA, 22 bp, Homo sapiens
gcatgcaggataggttgagctc

SEQ ID NO: 7103981 - DNA, 22 bp, Homo sapiens
gcatgcaggataggttgagctc

SEQ ID NO: 7103982 - DNA, 23 bp, Homo sapiens
gcatgcaacttgcagtagtattc

SEQ ID NO: 7103983 - DNA, 23 bp, Homo sapiens
gcatgcaacttgcagtagtattc

SEQ ID NO: 7103984 - DNA, 22 bp, Homo sapiens
gcatgcaattatggtattagat

SEQ ID NO: 7103985 - DNA, 22 bp, Homo sapiens
gcatgcacacctgtgcacattt

SEQ ID NO: 7103986 - DNA, 22 bp, Homo sapiens
gcatgcacggggcatatgggac

SEQ ID NO: 7103987 - DNA, 22 bp, Homo sapiens
gcatgcagaaaatgaacaacga

SEQ ID NO: 7103988 - DNA, 22 bp, Homo sapiens
gcagtggaagcctctttaagca

SEQ ID NO: 7103989 - DNA, 22 bp, Homo sapiens
gcagtgattggatcagagatgg

SEQ ID NO: 7103990 - DNA, 22 bp, Homo sapiens
gcagtgagttatgatcatgcca

SEQ ID NO: 7103991 - DNA, 22 bp, Homo sapiens
gcagtgaatctggcaagaattt

SEQ ID NO: 7103992 - DNA, 22 bp, Homo sapiens
gcagtgaatctggcaagaattt

SEQ ID NO: 7103993 - DNA, 22 bp, Homo sapiens
gcagtgaatctggcaagaattt

SEQ ID NO: 7103994 - DNA, 22 bp, Homo sapiens
gcagtgaatctggcaagaattt

SEQ ID NO: 7103995 - DNA, 22 bp, Homo sapiens
gcagtgaatttaacactcagat

SEQ ID NO: 7103996 - DNA, 22 bp, Homo sapiens
gcagtgaatttaacactcagat

SEQ ID NO: 7103997 - DNA, 22 bp, Homo sapiens
gcaggggagtggcaggcccgga

SEQ ID NO: 7103998 - DNA, 22 bp, Homo sapiens
gcaggggagtggcaggcccgga

SEQ ID NO: 7103999 - DNA, 22 bp, Homo sapiens
gcaggggagtggatgatggatt

SEQ ID NO: 7104000 - DNA, 22 bp, Homo sapiens
gcaggggagtggatgatggatt

SEQ ID NO: 7104001 - DNA, 22 bp, Homo sapiens
gcaggggagtggcaggcccgga

SEQ ID NO: 7104002 - DNA, 22 bp, Homo sapiens
gcaggggagtccactctatgca

SEQ ID NO: 7104003 - DNA, 22 bp, Homo sapiens
gcaggggagtccactctatgca

SEQ ID NO: 7104004 - DNA, 22 bp, Homo sapiens
gcaggggagtggatgatggatt

SEQ ID NO: 7104005 - DNA, 22 bp, Homo sapiens
gcaggggagtggatgatggatt

SEQ ID NO: 7104006 - DNA, 22 bp, Homo sapiens
gcaggggagtggatgatggatt

SEQ ID NO: 7104007 - DNA, 22 bp, Homo sapiens
gcaggggagtggatgatggatt

SEQ ID NO: 7104008 - DNA, 22 bp, Homo sapiens
gcagtggatggccagcaggggc

SEQ ID NO: 7104009 - DNA, 22 bp, Homo sapiens
gcagtggatccaatggtatctt

SEQ ID NO: 7104010 - DNA, 17 bp, Homo sapiens
gcagtggaggggtagtt

SEQ ID NO: 7104011 - DNA, 17 bp, Homo sapiens
gcagtggaggggtagtt

SEQ ID NO: 7104012 - DNA, 23 bp, Homo sapiens
gcagtggaatgtctctgtttgga

SEQ ID NO: 7104013 - DNA, 22 bp, Homo sapiens
gcagtggcaccgctggctctgg

SEQ ID NO: 7104014 - DNA, 22 bp, Homo sapiens
gcagtggcaccgctggctctgg

SEQ ID NO: 7104015 - DNA, 22 bp, Homo sapiens
gcagtggatggccagcaggggc

SEQ ID NO: 7104016 - DNA, 22 bp, Homo sapiens
gcagtggcagctgagggggtat

SEQ ID NO: 7104017 - DNA, 22 bp, Homo sapiens
gcagtggcagctgagggggtat

SEQ ID NO: 7104018 - DNA, 22 bp, Homo sapiens
gcagtggcaccgctggctctgg

SEQ ID NO: 7104019 - DNA, 22 bp, Homo sapiens
gcagtggcagagacagcaccaa

SEQ ID NO: 7104020 - DNA, 22 bp, Homo sapiens
gcagtggcagagacagcaccaa

SEQ ID NO: 7104021 - DNA, 22 bp, Homo sapiens
gcagtggcagagacagcaccaa

SEQ ID NO: 7104022 - DNA, 22 bp, Homo sapiens
gcagtggcatgatgtgggctca

SEQ ID NO: 7104023 - DNA, 22 bp, Homo sapiens
gcagtggcatgatgtgggctca

SEQ ID NO: 7104024 - DNA, 22 bp, Homo sapiens
gcagtggcatgatgtgggctca

SEQ ID NO: 7104025 - DNA, 22 bp, Homo sapiens
gcagtggcatgatgtgggctca

SEQ ID NO: 7104026 - DNA, 22 bp, Homo sapiens
gccccagacataagtagggggt

SEQ ID NO: 7104027 - DNA, 22 bp, Homo sapiens
gccccagatggaggaagctggg

SEQ ID NO: 7104028 - DNA, 22 bp, Homo sapiens
gccccagatggaggaagctggg

SEQ ID NO: 7104029 - DNA, 22 bp, Homo sapiens
gccccagaaagttcaaggcaca

SEQ ID NO: 7104030 - DNA, 22 bp, Homo sapiens
gccccagaaagttcaaggcaca

SEQ ID NO: 7104031 - DNA, 22 bp, Homo sapiens
gccccagaaagttcaaggcaca

SEQ ID NO: 7104032 - DNA, 22 bp, Homo sapiens
gccccagaaagttcaaggcaca

SEQ ID NO: 7104033 - DNA, 22 bp, Homo sapiens
gccccagaaggggaaagcctgg

SEQ ID NO: 7104034 - DNA, 22 bp, Homo sapiens
gccccagcagcaatgcggttga

SEQ ID NO: 7104035 - DNA, 22 bp, Homo sapiens
gccccagcagcaatgcggttga

SEQ ID NO: 7104036 - DNA, 22 bp, Homo sapiens
gccccagccaaggtgacacgaa

SEQ ID NO: 7104037 - DNA, 22 bp, Homo sapiens
gccccagccaaggtgacacgaa

SEQ ID NO: 7104038 - DNA, 22 bp, Homo sapiens
gccccagccaaggtgacacgaa

SEQ ID NO: 7104039 - DNA, 22 bp, Homo sapiens
gccccagccctgtggaccatgg

SEQ ID NO: 7104040 - DNA, 22 bp, Homo sapiens
gccccagccctgtggaccatgg

SEQ ID NO: 7104041 - DNA, 22 bp, Homo sapiens
gccccagcctagttttctttca

SEQ ID NO: 7104042 - DNA, 22 bp, Homo sapiens
gccccagcctcccgagtagctg

SEQ ID NO: 7104043 - DNA, 22 bp, Homo sapiens
gccccagccctgtggaccatgg

SEQ ID NO: 7104044 - DNA, 22 bp, Homo sapiens
gccccagcctcccgagtagctg

SEQ ID NO: 7104045 - DNA, 22 bp, Homo sapiens
gccccagcctcccgagtagctg

SEQ ID NO: 7104046 - DNA, 22 bp, Homo sapiens
gccccagcctcccgagtagctg

SEQ ID NO: 7104047 - DNA, 22 bp, Homo sapiens
gccccagcctgggaactggagg

SEQ ID NO: 7104048 - DNA, 22 bp, Homo sapiens
gccctggagggccagcgactgg

SEQ ID NO: 7104049 - DNA, 22 bp, Homo sapiens
gccctggagggccagcgactgg

SEQ ID NO: 7104050 - DNA, 22 bp, Homo sapiens
gccctggagggccagcgactgg

SEQ ID NO: 7104051 - DNA, 22 bp, Homo sapiens
gccctggagctagactaggaca

SEQ ID NO: 7104052 - DNA, 22 bp, Homo sapiens
gccccaggggaggtgccctgca

SEQ ID NO: 7104053 - DNA, 17 bp, Homo sapiens
gccctggagccaggcta

SEQ ID NO: 7104054 - DNA, 17 bp, Homo sapiens
gccctggagccaggcta

SEQ ID NO: 7104055 - DNA, 17 bp, Homo sapiens
gccctggagccaggcta

SEQ ID NO: 7104056 - DNA, 22 bp, Homo sapiens
gccccaggataaatttgtaaga

SEQ ID NO: 7104057 - DNA, 22 bp, Homo sapiens
gccccaggggaggtgccctgca

SEQ ID NO: 7104058 - DNA, 15 bp, Homo sapiens
gccccaggaatcaaa

SEQ ID NO: 7104059 - DNA, 15 bp, Homo sapiens
gccccaggaatcaaa

SEQ ID NO: 7104060 - DNA, 22 bp, Homo sapiens
gccccaggataaatttgtaaga

SEQ ID NO: 7104061 - DNA, 22 bp, Homo sapiens
gccccagcgtggctgtgttagg

SEQ ID NO: 7104062 - DNA, 22 bp, Homo sapiens
gccccagcgtggctgtgttagg

SEQ ID NO: 7104063 - DNA, 22 bp, Homo sapiens
gccccagctctgccacaactag

SEQ ID NO: 7104064 - DNA, 22 bp, Homo sapiens
gccctgtggacagtgagaagtg

SEQ ID NO: 7104065 - DNA, 22 bp, Homo sapiens
gccctgtggacagtgagaagtg

SEQ ID NO: 7104066 - DNA, 22 bp, Homo sapiens
gccctgtgctcatgggaacatc

SEQ ID NO: 7104067 - DNA, 22 bp, Homo sapiens
gccctgtgctataggttagggc

SEQ ID NO: 7104068 - DNA, 22 bp, Homo sapiens
gccctgtggattaatgagcagg

SEQ ID NO: 7104069 - DNA, 22 bp, Homo sapiens
gccctgtggacccaggaactct

SEQ ID NO: 7104070 - DNA, 22 bp, Homo sapiens
gccctgtggacccaggaactct

SEQ ID NO: 7104071 - DNA, 22 bp, Homo sapiens
gccctgtggacccaggaactct

SEQ ID NO: 7104072 - DNA, 22 bp, Homo sapiens
gccctgtgcgactctagaggtt

SEQ ID NO: 7104073 - DNA, 22 bp, Homo sapiens
gccctgtgcgactctagaggtt

SEQ ID NO: 7104074 - DNA, 22 bp, Homo sapiens
gccctgtgcgctgagttcaggg

SEQ ID NO: 7104075 - DNA, 22 bp, Homo sapiens
gccctgtgcgactctagaggtt

SEQ ID NO: 7104076 - DNA, 22 bp, Homo sapiens
gccctgggctccctgctccaca

SEQ ID NO: 7104077 - DNA, 22 bp, Homo sapiens
gccctgggcaaggttctggcca

SEQ ID NO: 7104078 - DNA, 22 bp, Homo sapiens
gccctgggattgggtggaggct

SEQ ID NO: 7104079 - DNA, 22 bp, Homo sapiens
gccctgggattgggtggaggct

SEQ ID NO: 7104080 - DNA, 22 bp, Homo sapiens
gccctggcctggcgcgttgtca

SEQ ID NO: 7104081 - DNA, 22 bp, Homo sapiens
gccctggccttcatctcagaca

SEQ ID NO: 7104082 - DNA, 22 bp, Homo sapiens
gccctggccttcatctcagaca

SEQ ID NO: 7104083 - DNA, 22 bp, Homo sapiens
gccctggcctcctggaacaggc

SEQ ID NO: 7104084 - DNA, 22 bp, Homo sapiens
gccctggcctggcgcgttgtca

SEQ ID NO: 7104085 - DNA, 22 bp, Homo sapiens
gccctggcacctcgttgcccag

SEQ ID NO: 7104086 - DNA, 22 bp, Homo sapiens
gccctggccttcatctcagaca

SEQ ID NO: 7104087 - DNA, 22 bp, Homo sapiens
gccctgggattgggtggaggct

SEQ ID NO: 7104088 - DNA, 22 bp, Homo sapiens
gccctggatgctcatggcatca

SEQ ID NO: 7104089 - DNA, 22 bp, Homo sapiens
gccctggatgctcatggcatca

SEQ ID NO: 7104090 - DNA, 22 bp, Homo sapiens
gccctggatggcaggagccatc

SEQ ID NO: 7104091 - DNA, 22 bp, Homo sapiens
gccctggatggcaggagccatc

SEQ ID NO: 7104092 - DNA, 22 bp, Homo sapiens
gccctggatggcaggagccatc

SEQ ID NO: 7104093 - DNA, 22 bp, Homo sapiens
gccctggatgtacaggcatgtt

SEQ ID NO: 7104094 - DNA, 22 bp, Homo sapiens
gccctggatgtacaggcatgtt

SEQ ID NO: 7104095 - DNA, 22 bp, Homo sapiens
gccctggatgtacaggcatgtt

SEQ ID NO: 7104096 - DNA, 22 bp, Homo sapiens
gccctggatgtacaggcatgtt

SEQ ID NO: 7104097 - DNA, 22 bp, Homo sapiens
gccctgtgtatcccctgtgctt

SEQ ID NO: 7104098 - DNA, 22 bp, Homo sapiens
gccctgtggttccaggaagcaa

SEQ ID NO: 7104099 - DNA, 22 bp, Homo sapiens
gccctgtggttccaggaagcaa

SEQ ID NO: 7104100 - DNA, 22 bp, Homo sapiens
gccctgtgtgtttgcactgatt

SEQ ID NO: 7104101 - DNA, 22 bp, Homo sapiens
gccctgtgtgatcacatgaaca

SEQ ID NO: 7104102 - DNA, 22 bp, Homo sapiens
gcctcccttggtgtctcccggg

SEQ ID NO: 7104103 - DNA, 22 bp, Homo sapiens
gcctccggagttgcagtgtctt

SEQ ID NO: 7104104 - DNA, 22 bp, Homo sapiens
gcctccggagttgcagtgtctt

SEQ ID NO: 7104105 - DNA, 22 bp, Homo sapiens
gcctccggagttgcagtgtctt

SEQ ID NO: 7104106 - DNA, 22 bp, Homo sapiens
gcctccggagttgcagtgtctt

SEQ ID NO: 7104107 - DNA, 22 bp, Homo sapiens
gcctccggagttgcagtgtctt

SEQ ID NO: 7104108 - DNA, 22 bp, Homo sapiens
gcctccggagtcacagtgtctt

SEQ ID NO: 7104109 - DNA, 22 bp, Homo sapiens
gcctccggagtcacagtgtctt

SEQ ID NO: 7104110 - DNA, 22 bp, Homo sapiens
gcctccggagtcacagtgtctt

SEQ ID NO: 7104111 - DNA, 22 bp, Homo sapiens
gcctccggagtcacagtgtctt

SEQ ID NO: 7104112 - DNA, 22 bp, Homo sapiens
gcctccggagtcacagtgtctt

SEQ ID NO: 7104113 - DNA, 22 bp, Homo sapiens
gcctcctaccacaccctcagtc

SEQ ID NO: 7104114 - DNA, 22 bp, Homo sapiens
gcctcctaccacaccctcagtc

SEQ ID NO: 7104115 - DNA, 22 bp, Homo sapiens
gcctcctaccacaccctcagtc

SEQ ID NO: 7104116 - DNA, 22 bp, Homo sapiens
gcctcctagagctccagggact

SEQ ID NO: 7104117 - DNA, 22 bp, Homo sapiens
gcctcctatggggccatcgcag

SEQ ID NO: 7104118 - DNA, 22 bp, Homo sapiens
gcctcctcacaatgtacccacg

SEQ ID NO: 7104119 - DNA, 22 bp, Homo sapiens
gcctcctcacaatgtacccacg

SEQ ID NO: 7104120 - DNA, 22 bp, Homo sapiens
gcctcctcacaatgtacccacg

SEQ ID NO: 7104121 - DNA, 22 bp, Homo sapiens
gcctcctccttcccgagggtct

SEQ ID NO: 7104122 - DNA, 22 bp, Homo sapiens
gcctcctcacaatgtacccacg

SEQ ID NO: 7104123 - DNA, 22 bp, Homo sapiens
gcctcctcacaatgtacccacg

SEQ ID NO: 7104124 - DNA, 22 bp, Homo sapiens
gcctcctgaagtgctgggatta

SEQ ID NO: 7104125 - DNA, 22 bp, Homo sapiens
gcctcctgacttacactgagct

SEQ ID NO: 7104126 - DNA, 22 bp, Homo sapiens
gcctcctcttgagggtcaggga

SEQ ID NO: 7104127 - DNA, 22 bp, Homo sapiens
gcctcctgaaaggaagagctcc

SEQ ID NO: 7104128 - DNA, 22 bp, Homo sapiens
gcctcctggaagtcacatgttt

SEQ ID NO: 7104129 - DNA, 22 bp, Homo sapiens
gcctcctggaagtcacatgttt

SEQ ID NO: 7104130 - DNA, 22 bp, Homo sapiens
gcctcctgcccagatgagtgat

SEQ ID NO: 7104131 - DNA, 22 bp, Homo sapiens
gcctcctgcccagatgagtgat

SEQ ID NO: 7104132 - DNA, 22 bp, Homo sapiens
gcctcctgcccagatgagtgat

SEQ ID NO: 7104133 - DNA, 22 bp, Homo sapiens
gcctcctggaagtcacatgttt

SEQ ID NO: 7104134 - DNA, 22 bp, Homo sapiens
gcctcctgagtagctgggattg

SEQ ID NO: 7104135 - DNA, 22 bp, Homo sapiens
gcctcctgagaagccacaggct

SEQ ID NO: 7104136 - DNA, 22 bp, Homo sapiens
gcctcctgacttacactgagct

SEQ ID NO: 7104137 - DNA, 22 bp, Homo sapiens
gcctcctgacttacactgagct

SEQ ID NO: 7104138 - DNA, 22 bp, Homo sapiens
gcctcctgacttacactgagct

SEQ ID NO: 7104139 - DNA, 22 bp, Homo sapiens
gcctcctgagaagccacaggct

SEQ ID NO: 7104140 - DNA, 22 bp, Homo sapiens
gcctcctggttgcttctccaac

SEQ ID NO: 7104141 - DNA, 22 bp, Homo sapiens
gcctcctggttgcttctccaac

SEQ ID NO: 7104142 - DNA, 22 bp, Homo sapiens
gcctctggagtcgcagcgtctt

SEQ ID NO: 7104143 - DNA, 22 bp, Homo sapiens
gcctcctggttgcttctccaac

SEQ ID NO: 7104144 - DNA, 22 bp, Homo sapiens
gcctcctggggtgccatcatct

SEQ ID NO: 7104145 - DNA, 22 bp, Homo sapiens
gcctcctggggtgccatcatct

SEQ ID NO: 7104146 - DNA, 22 bp, Homo sapiens
gcctcctggcctttgctcctca

SEQ ID NO: 7104147 - DNA, 22 bp, Homo sapiens
gcctcctggcctttgctcctca

SEQ ID NO: 7104148 - DNA, 22 bp, Homo sapiens
gcctcctggcctttgctcctca

SEQ ID NO: 7104149 - DNA, 22 bp, Homo sapiens
gcctctgggctctgcccctggc

SEQ ID NO: 7104150 - DNA, 22 bp, Homo sapiens
gcctctgggctctgcccctggc

SEQ ID NO: 7104151 - DNA, 22 bp, Homo sapiens
gcctctgggctctgcccctggc

SEQ ID NO: 7104152 - DNA, 22 bp, Homo sapiens
gcctctggagttgcttgtaaat

SEQ ID NO: 7104153 - DNA, 22 bp, Homo sapiens
gcctctggagttgcttgtaaat

SEQ ID NO: 7104154 - DNA, 22 bp, Homo sapiens
gcctctggcttctgcatcagtg

SEQ ID NO: 7104155 - DNA, 22 bp, Homo sapiens
gcctctggcttctgcatcagtg

SEQ ID NO: 7104156 - DNA, 22 bp, Homo sapiens
gcctctggcttctgcatcagtg

SEQ ID NO: 7104157 - DNA, 23 bp, Homo sapiens
gccaggtattctgataggcactg

SEQ ID NO: 7104158 - DNA, 22 bp, Homo sapiens
gcccagcaaggaccaagggccg

SEQ ID NO: 7104159 - DNA, 21 bp, Homo sapiens
gcccagcaaggtgagaaggcc

SEQ ID NO: 7104160 - DNA, 21 bp, Homo sapiens
gcccagcaaggtgagaaggcc

SEQ ID NO: 7104161 - DNA, 21 bp, Homo sapiens
gcccagcaaggtgagaaggcc

SEQ ID NO: 7104162 - DNA, 22 bp, Homo sapiens
gcccagcacagctggaagagtc

SEQ ID NO: 7104163 - DNA, 22 bp, Homo sapiens
gcccagcacagctggaagagtc

SEQ ID NO: 7104164 - DNA, 22 bp, Homo sapiens
gcccagcacagctggaagagtc

SEQ ID NO: 7104165 - DNA, 22 bp, Homo sapiens
gcccagcacatctggccttgaa

SEQ ID NO: 7104166 - DNA, 22 bp, Homo sapiens
gcccagcacatctggccttgaa

SEQ ID NO: 7104167 - DNA, 22 bp, Homo sapiens
gcccagcacatctggccttgaa

SEQ ID NO: 7104168 - DNA, 22 bp, Homo sapiens
gcccagcacattgctgaggacc

SEQ ID NO: 7104169 - DNA, 22 bp, Homo sapiens
gcccagcacattgctgaggacc

SEQ ID NO: 7104170 - DNA, 22 bp, Homo sapiens
gcccagcacattgctgaggacc

SEQ ID NO: 7104171 - DNA, 22 bp, Homo sapiens
gcccagcacattgctgaggacc

SEQ ID NO: 7104172 - DNA, 22 bp, Homo sapiens
gcccagcacattgctgaggacc

SEQ ID NO: 7104173 - DNA, 22 bp, Homo sapiens
gcccagcacattgctgaggacc

SEQ ID NO: 7104174 - DNA, 22 bp, Homo sapiens
gccaggggacgcggagcgacga

SEQ ID NO: 7104175 - DNA, 22 bp, Homo sapiens
gccaggggacgcggagcgacga

SEQ ID NO: 7104176 - DNA, 22 bp, Homo sapiens
gccaggggacgcggagcgacga

SEQ ID NO: 7104177 - DNA, 22 bp, Homo sapiens
gccaggggacgcggagcgacga

SEQ ID NO: 7104178 - DNA, 22 bp, Homo sapiens
gccagggggtcagcaggcactt

SEQ ID NO: 7104179 - DNA, 22 bp, Homo sapiens
gccagggggtcagcaggcactt

SEQ ID NO: 7104180 - DNA, 22 bp, Homo sapiens
gccagggggtcagcaggcactt

SEQ ID NO: 7104181 - DNA, 22 bp, Homo sapiens
gccagggggtcagcaggcactt

SEQ ID NO: 7104182 - DNA, 22 bp, Homo sapiens
gccagggggtcagcaggcactt

SEQ ID NO: 7104183 - DNA, 22 bp, Homo sapiens
gccagggtggcagaaggcccca

SEQ ID NO: 7104184 - DNA, 22 bp, Homo sapiens
gccagggtgtgcagggacagga

SEQ ID NO: 7104185 - DNA, 22 bp, Homo sapiens
gccagggtgtgcagggacagga

SEQ ID NO: 7104186 - DNA, 22 bp, Homo sapiens
gccaggggtgcccacccaagga

SEQ ID NO: 7104187 - DNA, 22 bp, Homo sapiens
gccagggtgtgcagggacagga

SEQ ID NO: 7104188 - DNA, 22 bp, Homo sapiens
gccagggtgtgcagggacagga

SEQ ID NO: 7104189 - DNA, 22 bp, Homo sapiens
gccagggttcgaatccgtatgg

SEQ ID NO: 7104190 - DNA, 22 bp, Homo sapiens
gccagggttcgaatccgtatgg

SEQ ID NO: 7104191 - DNA, 22 bp, Homo sapiens
gcccagccctgaggtcacagct

SEQ ID NO: 7104192 - DNA, 22 bp, Homo sapiens
gcccagccctgaggtcacagct

SEQ ID NO: 7104193 - DNA, 22 bp, Homo sapiens
gcccagccctgaggtcacagct

SEQ ID NO: 7104194 - DNA, 22 bp, Homo sapiens
gcccagcccctgggtggacgtg

SEQ ID NO: 7104195 - DNA, 22 bp, Homo sapiens
gcccagcagctggtggagaagg

SEQ ID NO: 7104196 - DNA, 22 bp, Homo sapiens
gcccagcagctggtggagaagg

SEQ ID NO: 7104197 - DNA, 22 bp, Homo sapiens
gcccagcagatctcagtgtctc

SEQ ID NO: 7104198 - DNA, 22 bp, Homo sapiens
gcccagcagatctcagtgtctc

SEQ ID NO: 7104199 - DNA, 22 bp, Homo sapiens
gcccagcagatctcagtgtctc

SEQ ID NO: 7104200 - DNA, 22 bp, Homo sapiens
gcccagcagatctcagtgtctc

SEQ ID NO: 7104201 - DNA, 22 bp, Homo sapiens
gcccagcagctccacttggctt

SEQ ID NO: 7104202 - DNA, 22 bp, Homo sapiens
gcccagcagctccacttggctt

SEQ ID NO: 7104203 - DNA, 22 bp, Homo sapiens
gcccagcacattgctgaggacc

SEQ ID NO: 7104204 - DNA, 22 bp, Homo sapiens
gcccagcacctctctcagggtt

SEQ ID NO: 7104205 - DNA, 22 bp, Homo sapiens
gcccagcacctctctcagggtt

SEQ ID NO: 7104206 - DNA, 22 bp, Homo sapiens
gcccagcacctctctcagggtt

SEQ ID NO: 7104207 - DNA, 22 bp, Homo sapiens
gcccagcacctctctcagggtt

SEQ ID NO: 7104208 - DNA, 22 bp, Homo sapiens
gcccagcactaaaagctttgct

SEQ ID NO: 7104209 - DNA, 22 bp, Homo sapiens
gcccagcactcctctctgacat

SEQ ID NO: 7104210 - DNA, 22 bp, Homo sapiens
gcccagcactcctctctgacat

SEQ ID NO: 7104211 - DNA, 22 bp, Homo sapiens
gcccagctgagaagcgcggggc

SEQ ID NO: 7104212 - DNA, 22 bp, Homo sapiens
gcccagctgcaccctggtgggt

SEQ ID NO: 7104213 - DNA, 22 bp, Homo sapiens
gcccagctgagaagcgcggggc

SEQ ID NO: 7104214 - DNA, 22 bp, Homo sapiens
gcccagctccattcttggtgag

SEQ ID NO: 7104215 - DNA, 22 bp, Homo sapiens
gcccagcgagcagaggtggacg

SEQ ID NO: 7104216 - DNA, 22 bp, Homo sapiens
gcccagcctccaagctccaagg

SEQ ID NO: 7104217 - DNA, 22 bp, Homo sapiens
gcccagcctccaagctccaagg

SEQ ID NO: 7104218 - DNA, 22 bp, Homo sapiens
gcccagccctgaggtcacagct

SEQ ID NO: 7104219 - DNA, 22 bp, Homo sapiens
gcccagccctgaggtcacagct

SEQ ID NO: 7104220 - DNA, 22 bp, Homo sapiens
gcccagcctccaagctccaagg

SEQ ID NO: 7104221 - DNA, 22 bp, Homo sapiens
gcccatggtcagggaggcaggg

SEQ ID NO: 7104222 - DNA, 22 bp, Homo sapiens
gcccatggtcagggaggcaggg

SEQ ID NO: 7104223 - DNA, 22 bp, Homo sapiens
gcccatggcttccctaggcaca

SEQ ID NO: 7104224 - DNA, 22 bp, Homo sapiens
gcccatggcttccctaggcaca

SEQ ID NO: 7104225 - DNA, 22 bp, Homo sapiens
gcccatggcttccctaggcaca

SEQ ID NO: 7104226 - DNA, 22 bp, Homo sapiens
gcccaggaggagaggctgcagt

SEQ ID NO: 7104227 - DNA, 22 bp, Homo sapiens
gcccaggagcctggagatgtgt

SEQ ID NO: 7104228 - DNA, 22 bp, Homo sapiens
gcccaggagcctggagatgtgt

SEQ ID NO: 7104229 - DNA, 22 bp, Homo sapiens
gcccaggagcctggagatgtgt

SEQ ID NO: 7104230 - DNA, 22 bp, Homo sapiens
gcccaggagaggccagggctga

SEQ ID NO: 7104231 - DNA, 22 bp, Homo sapiens
gcccaggagaggccagggctga

SEQ ID NO: 7104232 - DNA, 22 bp, Homo sapiens
gcccaggagcctggagatgtgt

SEQ ID NO: 7104233 - DNA, 22 bp, Homo sapiens
gcccaggagaggccagggctga

SEQ ID NO: 7104234 - DNA, 22 bp, Homo sapiens
gcccaggagaggccagggctga

SEQ ID NO: 7104235 - DNA, 22 bp, Homo sapiens
gcccaggactcagggtgtcgcg

SEQ ID NO: 7104236 - DNA, 16 bp, Homo sapiens
gcccaggacgggaggc

SEQ ID NO: 7104237 - DNA, 22 bp, Homo sapiens
gcccaggactcagggtgtcgcg

SEQ ID NO: 7104238 - DNA, 22 bp, Homo sapiens
gcccatgtgatttcctgggagt

SEQ ID NO: 7104239 - DNA, 22 bp, Homo sapiens
gcccattgagtgcccgtgagcc

SEQ ID NO: 7104240 - DNA, 22 bp, Homo sapiens
gcccatttagagggtgaagaag

SEQ ID NO: 7104241 - DNA, 22 bp, Homo sapiens
gcccatttgtttatatactgtc

SEQ ID NO: 7104242 - DNA, 22 bp, Homo sapiens
gcccatttttagtagatttagt

SEQ ID NO: 7104243 - DNA, 22 bp, Homo sapiens
gccccaagggagcccagcacac

SEQ ID NO: 7104244 - DNA, 22 bp, Homo sapiens
gccccaagggagcccagcacac

SEQ ID NO: 7104245 - DNA, 22 bp, Homo sapiens
gcccatggtcagggaggcaggg

SEQ ID NO: 7104246 - DNA, 22 bp, Homo sapiens
gcccatggtcagggaggcaggg

SEQ ID NO: 7104247 - DNA, 22 bp, Homo sapiens
gcccatggtccaggaagacaga

SEQ ID NO: 7104248 - DNA, 22 bp, Homo sapiens
gcccatggtccaggaagacaga

SEQ ID NO: 7104249 - DNA, 22 bp, Homo sapiens
gccccacagcctgcggtctcag

SEQ ID NO: 7104250 - DNA, 22 bp, Homo sapiens
gccccaccgagggtgcagtcct

SEQ ID NO: 7104251 - DNA, 22 bp, Homo sapiens
gccccaccgagggtgcagtcct

SEQ ID NO: 7104252 - DNA, 22 bp, Homo sapiens
gccccaccgagggtgcagtcct

SEQ ID NO: 7104253 - DNA, 22 bp, Homo sapiens
gccccaccgagggtgcagtcct

SEQ ID NO: 7104254 - DNA, 22 bp, Homo sapiens
gccccacctgctaccttccagc

SEQ ID NO: 7104255 - DNA, 22 bp, Homo sapiens
gccccacctgctaccttccagc

SEQ ID NO: 7104256 - DNA, 22 bp, Homo sapiens
gccccacctgctaccttccagc

SEQ ID NO: 7104257 - DNA, 22 bp, Homo sapiens
gccccaccttgagagcagaaac

SEQ ID NO: 7104258 - DNA, 22 bp, Homo sapiens
gccccaccttgagagcagaaac

SEQ ID NO: 7104259 - DNA, 22 bp, Homo sapiens
gccccaccttgagagcagaaac

SEQ ID NO: 7104260 - DNA, 22 bp, Homo sapiens
gccccactgtggaacctaagtc

SEQ ID NO: 7104261 - DNA, 22 bp, Homo sapiens
gccccactgtggaacctaagtc

SEQ ID NO: 7104262 - DNA, 22 bp, Homo sapiens
gccccactgtggaacctaagtc

SEQ ID NO: 7104263 - DNA, 22 bp, Homo sapiens
gccccactgtggaacctaagtc

SEQ ID NO: 7104264 - DNA, 22 bp, Homo sapiens
gccccactttcctaggcagtat

SEQ ID NO: 7104265 - DNA, 22 bp, Homo sapiens
gccccactttcctaggcagtat

SEQ ID NO: 7104266 - DNA, 22 bp, Homo sapiens
gccccactttcctaggcagtat

SEQ ID NO: 7104267 - DNA, 16 bp, Homo sapiens
gcccaggacgggaggc

SEQ ID NO: 7104268 - DNA, 20 bp, Homo sapiens
gcccaggaatttgcatttct

SEQ ID NO: 7104269 - DNA, 20 bp, Homo sapiens
gcccaggaatttgcatttct

SEQ ID NO: 7104270 - DNA, 20 bp, Homo sapiens
gcccaggaatttgcatttct

SEQ ID NO: 7104271 - DNA, 22 bp, Homo sapiens
gcccaggaagttgaggctgccg

SEQ ID NO: 7104272 - DNA, 22 bp, Homo sapiens
gcccaggaagttgaggctgccg

SEQ ID NO: 7104273 - DNA, 22 bp, Homo sapiens
gcccaggaagtgactcagatgt

SEQ ID NO: 7104274 - DNA, 22 bp, Homo sapiens
gcccaggaagttgaggctgccg

SEQ ID NO: 7104275 - DNA, 22 bp, Homo sapiens
gcccaggaagttgaggctgccg

SEQ ID NO: 7104276 - DNA, 22 bp, Homo sapiens
gcccaggaagttgaggctgccg

SEQ ID NO: 7104277 - DNA, 22 bp, Homo sapiens
gcccaggaagttgaggctgccg

SEQ ID NO: 7104278 - DNA, 22 bp, Homo sapiens
gcccaggaagtgactcagatgt

SEQ ID NO: 7104279 - DNA, 17 bp, Homo sapiens
gcccaggaaggacggcc

SEQ ID NO: 7104280 - DNA, 17 bp, Homo sapiens
gcccaggaaggacggcc

SEQ ID NO: 7104281 - DNA, 22 bp, Homo sapiens
gcccaggaaatgccccgtggtg

SEQ ID NO: 7104282 - DNA, 22 bp, Homo sapiens
gcccaggaagccaccgggaagt

SEQ ID NO: 7104283 - DNA, 22 bp, Homo sapiens
gcccaggaagccaccgggaagt

SEQ ID NO: 7104284 - DNA, 17 bp, Homo sapiens
gcccaggaaggacggcc

SEQ ID NO: 7104285 - DNA, 17 bp, Homo sapiens
gcccaggaaggacggcc

SEQ ID NO: 7104286 - DNA, 17 bp, Homo sapiens
gcccaggaaggacggcc

SEQ ID NO: 7104287 - DNA, 17 bp, Homo sapiens
gcccaggaaggacggcc

SEQ ID NO: 7104288 - DNA, 22 bp, Homo sapiens
gcccagctttttgaggcaggca

SEQ ID NO: 7104289 - DNA, 22 bp, Homo sapiens
gcccagctttttgaggcaggca

SEQ ID NO: 7104290 - DNA, 22 bp, Homo sapiens
gcccagctttttgaggcaggca

SEQ ID NO: 7104291 - DNA, 22 bp, Homo sapiens
gcccagcttttcacttccacac

SEQ ID NO: 7104292 - DNA, 22 bp, Homo sapiens
gcccagctgtctggcagggatg

SEQ ID NO: 7104293 - DNA, 22 bp, Homo sapiens
gcccagctttttgaggcaggca

SEQ ID NO: 7104294 - DNA, 22 bp, Homo sapiens
gcccaggaaagatagggcctca

SEQ ID NO: 7104295 - DNA, 22 bp, Homo sapiens
gcccaggaaagatagggcctca

SEQ ID NO: 7104296 - DNA, 22 bp, Homo sapiens
gcccaggaaataaaagtgggct

SEQ ID NO: 7104297 - DNA, 22 bp, Homo sapiens
gcccaggaaataaaagtgggct

SEQ ID NO: 7104298 - DNA, 22 bp, Homo sapiens
gcccaggaaataaaagtgggct

SEQ ID NO: 7104299 - DNA, 22 bp, Homo sapiens
gcccaggaaataaaagtgggct

SEQ ID NO: 7104300 - DNA, 22 bp, Homo sapiens
gcccaggaaatgccccgtggtg

SEQ ID NO: 7104301 - DNA, 22 bp, Homo sapiens
gcccaggaaatgccccgtggtg

SEQ ID NO: 7104302 - DNA, 23 bp, Homo sapiens
ctttcattgtggtttcacagagc

SEQ ID NO: 7104303 - DNA, 23 bp, Homo sapiens
ctttcattgtggtttcacagagc

SEQ ID NO: 7104304 - DNA, 22 bp, Homo sapiens
ctttcatttgataagaatgcca

SEQ ID NO: 7104305 - DNA, 22 bp, Homo sapiens
ctttcatttgataagaatgcca

SEQ ID NO: 7104306 - DNA, 22 bp, Homo sapiens
ctttcattcttagatattagtg

SEQ ID NO: 7104307 - DNA, 22 bp, Homo sapiens
ctttcattcttagatattagtg

SEQ ID NO: 7104308 - DNA, 22 bp, Homo sapiens
ctttcatagttaaaatagtttg

SEQ ID NO: 7104309 - DNA, 22 bp, Homo sapiens
ctttcataattcagcacattga

SEQ ID NO: 7104310 - DNA, 22 bp, Homo sapiens
gaaatatttctcttgagcccct

SEQ ID NO: 7104311 - DNA, 22 bp, Homo sapiens
ctttccaactgggtgggcagct

SEQ ID NO: 7104312 - DNA, 22 bp, Homo sapiens
gaaatatttctcttgagcccct

SEQ ID NO: 7104313 - DNA, 22 bp, Homo sapiens
gaaatcaaacccttttctgata

SEQ ID NO: 7104314 - DNA, 22 bp, Homo sapiens
gaaatcaaacccttttctgata

SEQ ID NO: 7104315 - DNA, 20 bp, Homo sapiens
gaaatcagttaatgatggtt

SEQ ID NO: 7104316 - DNA, 22 bp, Homo sapiens
gaaatcacttttttcatagttg

SEQ ID NO: 7104317 - DNA, 22 bp, Homo sapiens
gaaatcaggatgatgttccaga

SEQ ID NO: 7104318 - DNA, 22 bp, Homo sapiens
gaaatcaaggctacattcaggt

SEQ ID NO: 7104319 - DNA, 22 bp, Homo sapiens
gaaatcaaggctacattcaggt

SEQ ID NO: 7104320 - DNA, 22 bp, Homo sapiens
ctttcacagccttcgttctgaa

SEQ ID NO: 7104321 - DNA, 22 bp, Homo sapiens
ctttcacagctgtgcttatgat

SEQ ID NO: 7104322 - DNA, 22 bp, Homo sapiens
ctttcacagcttgaaaagtatt

SEQ ID NO: 7104323 - DNA, 22 bp, Homo sapiens
ctttcacataattgaccttgaa

SEQ ID NO: 7104324 - DNA, 22 bp, Homo sapiens
ctttcactcgagctcctgcagc

SEQ ID NO: 7104325 - DNA, 22 bp, Homo sapiens
ctttcacagtcctgactgagcg

SEQ ID NO: 7104326 - DNA, 22 bp, Homo sapiens
ctttcacagtcctgactgagcg

SEQ ID NO: 7104327 - DNA, 22 bp, Homo sapiens
ctttcacagtcctgactgagcg

SEQ ID NO: 7104328 - DNA, 22 bp, Homo sapiens
ctttcacagctactcacctctg

SEQ ID NO: 7104329 - DNA, 22 bp, Homo sapiens
ctttcacagtcatatgatgaat

SEQ ID NO: 7104330 - DNA, 22 bp, Homo sapiens
ctttatgtgctgggcattaagg

SEQ ID NO: 7104331 - DNA, 22 bp, Homo sapiens
ctttatgtgctgggcattaagg

SEQ ID NO: 7104332 - DNA, 22 bp, Homo sapiens
ctttcaatcaaagtttctagtg

SEQ ID NO: 7104333 - DNA, 18 bp, Homo sapiens
ctttatgtgcagagcttt

SEQ ID NO: 7104334 - DNA, 22 bp, Homo sapiens
ctttcaatgtcatctgtgaatg

SEQ ID NO: 7104335 - DNA, 22 bp, Homo sapiens
ctttcacaagatttgagatgct

SEQ ID NO: 7104336 - DNA, 22 bp, Homo sapiens
ctttcacaagatttgagatgct

SEQ ID NO: 7104337 - DNA, 22 bp, Homo sapiens
ctttcagttacagttacacaca

SEQ ID NO: 7104338 - DNA, 22 bp, Homo sapiens
ctttcataaggggttttataat

SEQ ID NO: 7104339 - DNA, 22 bp, Homo sapiens
ctttcaggtcacataacgccaa

SEQ ID NO: 7104340 - DNA, 22 bp, Homo sapiens
ctttcagggcagacaacgagca

SEQ ID NO: 7104341 - DNA, 18 bp, Homo sapiens
ctttcagatggatatgct

SEQ ID NO: 7104342 - DNA, 22 bp, Homo sapiens
ctttcagaagaggacctttcca

SEQ ID NO: 7104343 - DNA, 22 bp, Homo sapiens
ctttcagaagccggaagggcag

SEQ ID NO: 7104344 - DNA, 22 bp, Homo sapiens
ctttcagaggggcgtacacagc

SEQ ID NO: 7104345 - DNA, 22 bp, Homo sapiens
ctttcagaggttactcaggaaa

SEQ ID NO: 7104346 - DNA, 22 bp, Homo sapiens
gaaatgtactttaaagccatcc

SEQ ID NO: 7104347 - DNA, 22 bp, Homo sapiens
gaaatgtagaattgcttaactg

SEQ ID NO: 7104348 - DNA, 17 bp, Homo sapiens
gaacagcagaggggaca

SEQ ID NO: 7104349 - DNA, 17 bp, Homo sapiens
gaacagcagaggggaca

SEQ ID NO: 7104350 - DNA, 22 bp, Homo sapiens
gaacagcagctcgttctcgatg

SEQ ID NO: 7104351 - DNA, 22 bp, Homo sapiens
gaaatgtactttaaagccatcc

SEQ ID NO: 7104352 - DNA, 20 bp, Homo sapiens
gaaatgtacacattaccaca

SEQ ID NO: 7104353 - DNA, 22 bp, Homo sapiens
gaaatgtactttaaagccatcc

SEQ ID NO: 7104354 - DNA, 20 bp, Homo sapiens
gaaatgtacacattaccaca

SEQ ID NO: 7104355 - DNA, 22 bp, Homo sapiens
gaaatgtaattctcttgaagat

SEQ ID NO: 7104356 - DNA, 20 bp, Homo sapiens
gaaatgtacacattaccaca

SEQ ID NO: 7104357 - DNA, 20 bp, Homo sapiens
gaaatgtacacattaccaca

SEQ ID NO: 7104358 - DNA, 22 bp, Homo sapiens
gaaatgtaattctcttgaagat

SEQ ID NO: 7104359 - DNA, 22 bp, Homo sapiens
gaaatgtaattctcttgaagat

SEQ ID NO: 7104360 - DNA, 22 bp, Homo sapiens
gaaatgctcaggggttttccag

SEQ ID NO: 7104361 - DNA, 22 bp, Homo sapiens
gaaatggtaaacattttaatgg

SEQ ID NO: 7104362 - DNA, 22 bp, Homo sapiens
gaaatgcatggatcttggcaga

SEQ ID NO: 7104363 - DNA, 22 bp, Homo sapiens
gaaatgcataatcttagtagat

SEQ ID NO: 7104364 - DNA, 22 bp, Homo sapiens
gaaatcattagcaaagatatgt

SEQ ID NO: 7104365 - DNA, 22 bp, Homo sapiens
gaaatcattagcaaagatatgt

SEQ ID NO: 7104366 - DNA, 22 bp, Homo sapiens
gaaatcattatatggtattgct

SEQ ID NO: 7104367 - DNA, 22 bp, Homo sapiens
gaaatcatctgagtaataatct

SEQ ID NO: 7104368 - DNA, 22 bp, Homo sapiens
gaaatcatgagatctcttggac

SEQ ID NO: 7104369 - DNA, 22 bp, Homo sapiens
gaaatcattagcaaagatatgt

SEQ ID NO: 7104370 - DNA, 22 bp, Homo sapiens
gaaatcatagcacatggggctg

SEQ ID NO: 7104371 - DNA, 22 bp, Homo sapiens
gaaatcatattctcagtccttc

SEQ ID NO: 7104372 - DNA, 22 bp, Homo sapiens
gaaatcatctgagtaataatct

SEQ ID NO: 7104373 - DNA, 22 bp, Homo sapiens
gaaatctacgattagtgaaaat

SEQ ID NO: 7104374 - DNA, 22 bp, Homo sapiens
gaaatgattttagtttatcatg

SEQ ID NO: 7104375 - DNA, 22 bp, Homo sapiens
gaaatctacgattagtgaaaat

SEQ ID NO: 7104376 - DNA, 22 bp, Homo sapiens
gaaatgcagattctgattctgt

SEQ ID NO: 7104377 - DNA, 22 bp, Homo sapiens
gaaatgcagaacctgagaccat

SEQ ID NO: 7104378 - DNA, 22 bp, Homo sapiens
gaacagggtttgagaggcttag

SEQ ID NO: 7104379 - DNA, 22 bp, Homo sapiens
gaacagggttgggtgagagagg

SEQ ID NO: 7104380 - DNA, 22 bp, Homo sapiens
gaacagggttgggtgagagagg

SEQ ID NO: 7104381 - DNA, 22 bp, Homo sapiens
gaacagggttgggtgagagagg

SEQ ID NO: 7104382 - DNA, 22 bp, Homo sapiens
gaacagggttgggtgagagagg

SEQ ID NO: 7104383 - DNA, 22 bp, Homo sapiens
gaacagcttcttgggagctggg

SEQ ID NO: 7104384 - DNA, 21 bp, Homo sapiens
gaacaggaaaagctggcttca

SEQ ID NO: 7104385 - DNA, 21 bp, Homo sapiens
gaacaggaaaagctggcttca

SEQ ID NO: 7104386 - DNA, 22 bp, Homo sapiens
gaacaggaacatattggctctc

SEQ ID NO: 7104387 - DNA, 22 bp, Homo sapiens
gaacaggaacatattggctctc

SEQ ID NO: 7104388 - DNA, 22 bp, Homo sapiens
gaacaggcataagcatttgcat

SEQ ID NO: 7104389 - DNA, 22 bp, Homo sapiens
gaacaggctggagtagcacaga

SEQ ID NO: 7104390 - DNA, 22 bp, Homo sapiens
gaacagggagtacggcacattt

SEQ ID NO: 7104391 - DNA, 22 bp, Homo sapiens
gaacagggagtacggcacattt

SEQ ID NO: 7104392 - DNA, 22 bp, Homo sapiens
gaacagctataatcatctgtcc

SEQ ID NO: 7104393 - DNA, 22 bp, Homo sapiens
gaacagctgctagagatctgtg

SEQ ID NO: 7104394 - DNA, 22 bp, Homo sapiens
gaacagctctgaagcagtaaat

SEQ ID NO: 7104395 - DNA, 22 bp, Homo sapiens
gaacagctataatcatctgtcc

SEQ ID NO: 7104396 - DNA, 22 bp, Homo sapiens
gaacagctataatcatctgtcc

SEQ ID NO: 7104397 - DNA, 22 bp, Homo sapiens
gaacagcatgcatgcaagacta

SEQ ID NO: 7104398 - DNA, 22 bp, Homo sapiens
gaacagcatgcatgcaagacta

SEQ ID NO: 7104399 - DNA, 22 bp, Homo sapiens
gaacagcatgtaagaagctact

SEQ ID NO: 7104400 - DNA, 22 bp, Homo sapiens
gaacagcatgtaagaagctact

SEQ ID NO: 7104401 - DNA, 22 bp, Homo sapiens
gaacagcatgtaagaagctact

SEQ ID NO: 7104402 - DNA, 22 bp, Homo sapiens
gaacagcatgtaagaagctact

SEQ ID NO: 7104403 - DNA, 22 bp, Homo sapiens
gaacagcatgtaagaagctact

SEQ ID NO: 7104404 - DNA, 22 bp, Homo sapiens
gaacagcatgtaagaagctact

SEQ ID NO: 7104405 - DNA, 22 bp, Homo sapiens
gaacagtgaactgatttgtaaa

SEQ ID NO: 7104406 - DNA, 22 bp, Homo sapiens
gaacagtatttccaggaatccc

SEQ ID NO: 7104407 - DNA, 22 bp, Homo sapiens
gaacagtatcagtagtgccagt

SEQ ID NO: 7104408 - DNA, 22 bp, Homo sapiens
gaacagtgccagcacacaataa

SEQ ID NO: 7104409 - DNA, 22 bp, Homo sapiens
gaacagtttccctgtagaaaat

SEQ ID NO: 7104410 - DNA, 22 bp, Homo sapiens
gaacataactattgtgaatagt

SEQ ID NO: 7104411 - DNA, 22 bp, Homo sapiens
gaacatttggatttgtaaattt

SEQ ID NO: 7104412 - DNA, 22 bp, Homo sapiens
gaacatttggatttgtaaattt

SEQ ID NO: 7104413 - DNA, 22 bp, Homo sapiens
gaagacgagataaaatggtgtc

SEQ ID NO: 7104414 - DNA, 22 bp, Homo sapiens
gaagacattttatgcatactct

SEQ ID NO: 7104415 - DNA, 22 bp, Homo sapiens
gaagacatgtttttaatatgta

SEQ ID NO: 7104416 - DNA, 22 bp, Homo sapiens
gaagacatgtggattctagttt

SEQ ID NO: 7104417 - DNA, 22 bp, Homo sapiens
gaagacatgtttttaatatgta

SEQ ID NO: 7104418 - DNA, 22 bp, Homo sapiens
gaagacatgtttttaatatgta

SEQ ID NO: 7104419 - DNA, 22 bp, Homo sapiens
gaagacagaaacctgtttggct

SEQ ID NO: 7104420 - DNA, 22 bp, Homo sapiens
gaagacatcatggagaggatag

SEQ ID NO: 7104421 - DNA, 22 bp, Homo sapiens
gaagacatcatggagaggatag

SEQ ID NO: 7104422 - DNA, 22 bp, Homo sapiens
gaagacatcgtgtggactaaca

SEQ ID NO: 7104423 - DNA, 22 bp, Homo sapiens
gaagacatcgtgtggactaaca

SEQ ID NO: 7104424 - DNA, 21 bp, Homo sapiens
gaacatttgggttgtttctac

SEQ ID NO: 7104425 - DNA, 21 bp, Homo sapiens
gaacatttgggttgtttctac

SEQ ID NO: 7104426 - DNA, 22 bp, Homo sapiens
gaaccaagtaggatacaaggag

SEQ ID NO: 7104427 - DNA, 22 bp, Homo sapiens
gaaccacaagattcaaaggggt

SEQ ID NO: 7104428 - DNA, 22 bp, Homo sapiens
gaaccacaagattcaaaggggt

SEQ ID NO: 7104429 - DNA, 22 bp, Homo sapiens
gaaccacaatgtgaagaaggag

SEQ ID NO: 7104430 - DNA, 22 bp, Homo sapiens
gaaccacaatgtgaagaaggag

SEQ ID NO: 7104431 - DNA, 22 bp, Homo sapiens
gaaccacacagtgcagtcagga

SEQ ID NO: 7104432 - DNA, 20 bp, Homo sapiens
gaacatttggccatactgag

SEQ ID NO: 7104433 - DNA, 20 bp, Homo sapiens
gaacatttggccatactgag

SEQ ID NO: 7104434 - DNA, 21 bp, Homo sapiens
gaacatttgggttgtttctac

SEQ ID NO: 7104435 - DNA, 22 bp, Homo sapiens
gaaccatgagaaattgctattt

SEQ ID NO: 7104436 - DNA, 22 bp, Homo sapiens
gaacccagaggatatgggaaag

SEQ ID NO: 7104437 - DNA, 21 bp, Homo sapiens
gaacccagcagcagtgctctg

SEQ ID NO: 7104438 - DNA, 22 bp, Homo sapiens
gaagaggcaattgaataagcta

SEQ ID NO: 7104439 - DNA, 22 bp, Homo sapiens
gaagaggatgacaggagccggt

SEQ ID NO: 7104440 - DNA, 22 bp, Homo sapiens
gaagaggctttcctagggcaag

SEQ ID NO: 7104441 - DNA, 22 bp, Homo sapiens
gaagaggctttcctagggcaag

SEQ ID NO: 7104442 - DNA, 22 bp, Homo sapiens
gaagaggctttcctagggcaag

SEQ ID NO: 7104443 - DNA, 22 bp, Homo sapiens
gaagaggctttcctagggcaag

SEQ ID NO: 7104444 - DNA, 22 bp, Homo sapiens
gaagaggatgacaggagccggt

SEQ ID NO: 7104445 - DNA, 22 bp, Homo sapiens
gaagaggatgacaggagccggt

SEQ ID NO: 7104446 - DNA, 22 bp, Homo sapiens
gaagaggatgacaggagccggt

SEQ ID NO: 7104447 - DNA, 22 bp, Homo sapiens
gaagaggatgacaggagccggt

SEQ ID NO: 7104448 - DNA, 22 bp, Homo sapiens
gaagaggatgacaggagccggt

SEQ ID NO: 7104449 - DNA, 22 bp, Homo sapiens
gaagaggactgtggcatcctag

SEQ ID NO: 7104450 - DNA, 22 bp, Homo sapiens
gaagaggactgtggcatcctag

SEQ ID NO: 7104451 - DNA, 22 bp, Homo sapiens
gaagagctgtcagaaaagctaa

SEQ ID NO: 7104452 - DNA, 22 bp, Homo sapiens
gaagagctccaaaaacagtgag

SEQ ID NO: 7104453 - DNA, 22 bp, Homo sapiens
gaagagctatgtccagggagca

SEQ ID NO: 7104454 - DNA, 22 bp, Homo sapiens
gaagagctgcacactggggact

SEQ ID NO: 7104455 - DNA, 22 bp, Homo sapiens
gaagagctgcagtttcctgggc

SEQ ID NO: 7104456 - DNA, 22 bp, Homo sapiens
gaagactactgttgcactcata

SEQ ID NO: 7104457 - DNA, 22 bp, Homo sapiens
gaagagaaaggcaaggagtttt

SEQ ID NO: 7104458 - DNA, 22 bp, Homo sapiens
gaagagaaaggcaaggagtttt

SEQ ID NO: 7104459 - DNA, 22 bp, Homo sapiens
gaagagaagcatcaataggtaa

SEQ ID NO: 7104460 - DNA, 22 bp, Homo sapiens
gaagagaagcatcaataggtaa

SEQ ID NO: 7104461 - DNA, 22 bp, Homo sapiens
gaagagaagcatcaataggtaa

SEQ ID NO: 7104462 - DNA, 22 bp, Homo sapiens
gaagagaaggtgtaggccatcc

SEQ ID NO: 7104463 - DNA, 22 bp, Homo sapiens
gaagccagcagtggagaaagga

SEQ ID NO: 7104464 - DNA, 22 bp, Homo sapiens
gaagccagcagtggagaaagga

SEQ ID NO: 7104465 - DNA, 22 bp, Homo sapiens
gaagccagattatcacaagcca

SEQ ID NO: 7104466 - DNA, 22 bp, Homo sapiens
gaagccagattatcacaagcca

SEQ ID NO: 7104467 - DNA, 22 bp, Homo sapiens
gaagccagatttggggcatatc

SEQ ID NO: 7104468 - DNA, 22 bp, Homo sapiens
gaagccaggggcctgacaggca

SEQ ID NO: 7104469 - DNA, 22 bp, Homo sapiens
gaagccaggggcctgacaggca

SEQ ID NO: 7104470 - DNA, 22 bp, Homo sapiens
gaagccaggggcctgacaggca

SEQ ID NO: 7104471 - DNA, 22 bp, Homo sapiens
gaagccagccttgtctgcctct

SEQ ID NO: 7104472 - DNA, 22 bp, Homo sapiens
gaagccagcatccctctcccat

SEQ ID NO: 7104473 - DNA, 22 bp, Homo sapiens
gaagccagcatccctctcccat

SEQ ID NO: 7104474 - DNA, 22 bp, Homo sapiens
gaagccagcatccctctcccat

SEQ ID NO: 7104475 - DNA, 22 bp, Homo sapiens
gaagatttgcccatgcactttt

SEQ ID NO: 7104476 - DNA, 22 bp, Homo sapiens
gaagatttgttgtaatttttag

SEQ ID NO: 7104477 - DNA, 22 bp, Homo sapiens
gaagatttgaaacacatagaca

SEQ ID NO: 7104478 - DNA, 22 bp, Homo sapiens
gaagatttgaaacacatagaca

SEQ ID NO: 7104479 - DNA, 22 bp, Homo sapiens
gaagatttgcccatgcactttt

SEQ ID NO: 7104480 - DNA, 22 bp, Homo sapiens
gaagattttctcctttaaatga

SEQ ID NO: 7104481 - DNA, 22 bp, Homo sapiens
gaagattttctcctttaaatga

SEQ ID NO: 7104482 - DNA, 22 bp, Homo sapiens
gaagattttctcctttaaatga

SEQ ID NO: 7104483 - DNA, 22 bp, Homo sapiens
gaagcaaaatgtctgcacatat

SEQ ID NO: 7104484 - DNA, 22 bp, Homo sapiens
gaagcaaaatgtctgcacatat

SEQ ID NO: 7104485 - DNA, 22 bp, Homo sapiens
gaagcaaaatgtctgcacatat

SEQ ID NO: 7104486 - DNA, 22 bp, Homo sapiens
gaagatttttcttaatgctccg

SEQ ID NO: 7104487 - DNA, 22 bp, Homo sapiens
gaagccagtgtttgaagaattt

SEQ ID NO: 7104488 - DNA, 22 bp, Homo sapiens
gaagccagtgtttgaagaattt

SEQ ID NO: 7104489 - DNA, 22 bp, Homo sapiens
gaagccagtactgtgctctgca

SEQ ID NO: 7104490 - DNA, 22 bp, Homo sapiens
gaagccagtactgtgctctgca

SEQ ID NO: 7104491 - DNA, 22 bp, Homo sapiens
gaagccaggggcctgacaggca

SEQ ID NO: 7104492 - DNA, 22 bp, Homo sapiens
gaagccagtactgtgctctgca

SEQ ID NO: 7104493 - DNA, 22 bp, Homo sapiens
gaagccaggggcctgacaggca

SEQ ID NO: 7104494 - DNA, 22 bp, Homo sapiens
gaagcccagcaaactgtgatca

SEQ ID NO: 7104495 - DNA, 22 bp, Homo sapiens
gaagcccaggcttccttggctt

SEQ ID NO: 7104496 - DNA, 22 bp, Homo sapiens
gaagccctaagagaatagagct

SEQ ID NO: 7104497 - DNA, 22 bp, Homo sapiens
gaagcccagggcgtggccgggc

SEQ ID NO: 7104498 - DNA, 22 bp, Homo sapiens
gaagcccttagcagagtctgac

SEQ ID NO: 7104499 - DNA, 22 bp, Homo sapiens
gaagcctcaacatctctgcgtc

SEQ ID NO: 7104500 - DNA, 22 bp, Homo sapiens
gaagcctcaacatctctgcgtc

SEQ ID NO: 7104501 - DNA, 23 bp, Homo sapiens
gaagccctcattggttctccaga

SEQ ID NO: 7104502 - DNA, 19 bp, Homo sapiens
gaagccctgcattctccgc

SEQ ID NO: 7104503 - DNA, 22 bp, Homo sapiens
gaagaggctttcctagggcaag

SEQ ID NO: 7104504 - DNA, 22 bp, Homo sapiens
gaagaggctttcctagggcaag

SEQ ID NO: 7104505 - DNA, 22 bp, Homo sapiens
gaagaggtagcattggcaggtg

SEQ ID NO: 7104506 - DNA, 22 bp, Homo sapiens
gaagaggtagcattggcaggtg

SEQ ID NO: 7104507 - DNA, 22 bp, Homo sapiens
gaagaggttcaacgtggtcatc

SEQ ID NO: 7104508 - DNA, 22 bp, Homo sapiens
gaagataattcctacttataac

SEQ ID NO: 7104509 - DNA, 22 bp, Homo sapiens
gaagataactttaaaaagtggc

SEQ ID NO: 7104510 - DNA, 22 bp, Homo sapiens
gaagaggttcaacgtggtcatc

SEQ ID NO: 7104511 - DNA, 22 bp, Homo sapiens
gaagagtatatttagtgaaatc

SEQ ID NO: 7104512 - DNA, 22 bp, Homo sapiens
gaagagtatatttagtgaaatc

SEQ ID NO: 7104513 - DNA, 23 bp, Homo sapiens
gaagagttgcaaagacgggacag

SEQ ID NO: 7104514 - DNA, 22 bp, Homo sapiens
gaagatacaaatttcttagatg

SEQ ID NO: 7104515 - DNA, 22 bp, Homo sapiens
gaagatacaaatttcttagatg

SEQ ID NO: 7104516 - DNA, 22 bp, Homo sapiens
gaagatacacagagctgtcttt

SEQ ID NO: 7104517 - DNA, 22 bp, Homo sapiens
gaagatacacagagctgtcttt

SEQ ID NO: 7104518 - DNA, 22 bp, Homo sapiens
gaagatacctcaattctttgaa

SEQ ID NO: 7104519 - DNA, 22 bp, Homo sapiens
gaagatattctctaaatacttt

SEQ ID NO: 7104520 - DNA, 22 bp, Homo sapiens
gaagatattctctaaatacttt

SEQ ID NO: 7104521 - DNA, 22 bp, Homo sapiens
gaagatgggaatgatgagtggg

SEQ ID NO: 7104522 - DNA, 22 bp, Homo sapiens
gaagatgggaatgatgagtggg

SEQ ID NO: 7104523 - DNA, 22 bp, Homo sapiens
gaagatgggaatgatgagtggg

SEQ ID NO: 7104524 - DNA, 22 bp, Homo sapiens
gaagatgggaatgatgagtggg

SEQ ID NO: 7104525 - DNA, 22 bp, Homo sapiens
gaagatttaagcacaatagtct

SEQ ID NO: 7104526 - DNA, 22 bp, Homo sapiens
gaagatttataaggaccttatt

SEQ ID NO: 7104527 - DNA, 22 bp, Homo sapiens
gaagatttaagcacaatagtct

SEQ ID NO: 7104528 - DNA, 22 bp, Homo sapiens
gaagatttaagcacaatagtct

SEQ ID NO: 7104529 - DNA, 22 bp, Homo sapiens
gaagatttaagcacaatagtct

SEQ ID NO: 7104530 - DNA, 22 bp, Homo sapiens
gaagatttcagttaagtatcta

SEQ ID NO: 7104531 - DNA, 22 bp, Homo sapiens
gaagatttcagttaagtatcta

SEQ ID NO: 7104532 - DNA, 22 bp, Homo sapiens
gaagatttctgatgagttactt

SEQ ID NO: 7104533 - DNA, 22 bp, Homo sapiens
gaagatttctgatgagttactt

SEQ ID NO: 7104534 - DNA, 22 bp, Homo sapiens
gaagatttctttatgaaagatg

SEQ ID NO: 7104535 - DNA, 22 bp, Homo sapiens
gaagatttctttatgaaagatg

SEQ ID NO: 7104536 - DNA, 22 bp, Homo sapiens
gaagattagggttagcataagt

SEQ ID NO: 7104537 - DNA, 22 bp, Homo sapiens
gaagattagggttagcataagt

SEQ ID NO: 7104538 - DNA, 22 bp, Homo sapiens
gaagattacctgagaccacttg

SEQ ID NO: 7104539 - DNA, 22 bp, Homo sapiens
gaagattagaccatttccagct

SEQ ID NO: 7104540 - DNA, 22 bp, Homo sapiens
gaagattaaatggctcccatat

SEQ ID NO: 7104541 - DNA, 22 bp, Homo sapiens
gaagattaatgagaaacctgct

SEQ ID NO: 7104542 - DNA, 22 bp, Homo sapiens
gaagattaatgagaaacctgct

SEQ ID NO: 7104543 - DNA, 22 bp, Homo sapiens
gaagattacctgagaccacttg

SEQ ID NO: 7104544 - DNA, 22 bp, Homo sapiens
gaagattaaatgaagtgacctg

SEQ ID NO: 7104545 - DNA, 22 bp, Homo sapiens
gaagattaaatgaagtgacctg

SEQ ID NO: 7104546 - DNA, 22 bp, Homo sapiens
gaagattaaatggctcccatat

SEQ ID NO: 7104547 - DNA, 20 bp, Homo sapiens
gaagatgggtagaggcacag

SEQ ID NO: 7104548 - DNA, 20 bp, Homo sapiens
gaagatgggtagaggcacag

SEQ ID NO: 7104549 - DNA, 22 bp, Homo sapiens
gaagatgtgcaatacaaagaaa

SEQ ID NO: 7104550 - DNA, 22 bp, Homo sapiens
gaagatgtgcaatacaaagaaa

SEQ ID NO: 7104551 - DNA, 22 bp, Homo sapiens
gaagatgtgggaactgctgaaa

SEQ ID NO: 7104552 - DNA, 22 bp, Homo sapiens
gaagatgtgggaactgctgaaa

SEQ ID NO: 7104553 - DNA, 22 bp, Homo sapiens
gaagatgtgggcccactccaga

SEQ ID NO: 7104554 - DNA, 22 bp, Homo sapiens
gaagatgttatggagagctcag

SEQ ID NO: 7104555 - DNA, 22 bp, Homo sapiens
gaagattaaacatatttagtgt

SEQ ID NO: 7104556 - DNA, 22 bp, Homo sapiens
gaaggaagattctgttggaatc

SEQ ID NO: 7104557 - DNA, 22 bp, Homo sapiens
gaaggaagattctgttggaatc

SEQ ID NO: 7104558 - DNA, 22 bp, Homo sapiens
gaaggaaatctgtgatttatgc

SEQ ID NO: 7104559 - DNA, 22 bp, Homo sapiens
gaaggaaaggtctcatgccttt

SEQ ID NO: 7104560 - DNA, 22 bp, Homo sapiens
gaagttgatagagtacatgatt

SEQ ID NO: 7104561 - DNA, 22 bp, Homo sapiens
gaagttgatagagtacatgatt

SEQ ID NO: 7104562 - DNA, 22 bp, Homo sapiens
gaagtttacctctgccttgctt

SEQ ID NO: 7104563 - DNA, 22 bp, Homo sapiens
gaagtttagaagtgacaggttt

SEQ ID NO: 7104564 - DNA, 22 bp, Homo sapiens
gaagttcttagtctcatttgca

SEQ ID NO: 7104565 - DNA, 23 bp, Homo sapiens
gaagttctgttcagccagacaag

SEQ ID NO: 7104566 - DNA, 22 bp, Homo sapiens
gaagttgatagagtacatgatt

SEQ ID NO: 7104567 - DNA, 22 bp, Homo sapiens
gaaggaaaacagatctgcctga

SEQ ID NO: 7104568 - DNA, 22 bp, Homo sapiens
gaaggaaaacagatctgcctga

SEQ ID NO: 7104569 - DNA, 22 bp, Homo sapiens
gaaggaaaacagatctgcctga

SEQ ID NO: 7104570 - DNA, 22 bp, Homo sapiens
gaaggaaaggtctcatgccttt

SEQ ID NO: 7104571 - DNA, 22 bp, Homo sapiens
gaaggaaaggtctcatgccttt

SEQ ID NO: 7104572 - DNA, 22 bp, Homo sapiens
gaaggaaaaatactctgtaagg

SEQ ID NO: 7104573 - DNA, 22 bp, Homo sapiens
gaaggaaaaatactctgtaagg

SEQ ID NO: 7104574 - DNA, 22 bp, Homo sapiens
gaaggaaaaatactctgtaagg

SEQ ID NO: 7104575 - DNA, 22 bp, Homo sapiens
gaaggaaaaatactctgtaagg

SEQ ID NO: 7104576 - DNA, 22 bp, Homo sapiens
gaagcttcgtggctcttcaaat

SEQ ID NO: 7104577 - DNA, 22 bp, Homo sapiens
gaagcttagggataataggctg

SEQ ID NO: 7104578 - DNA, 22 bp, Homo sapiens
gaagcttcgtggctcttcaaat

SEQ ID NO: 7104579 - DNA, 22 bp, Homo sapiens
gaagcttcgtggctcttcaaat

SEQ ID NO: 7104580 - DNA, 22 bp, Homo sapiens
gaagcttggtgttgtcttaagt

SEQ ID NO: 7104581 - DNA, 22 bp, Homo sapiens
gaagcctcaacatctctgcgtc

SEQ ID NO: 7104582 - DNA, 22 bp, Homo sapiens
gaagcctcaacatctctgcgtc

SEQ ID NO: 7104583 - DNA, 22 bp, Homo sapiens
gaagcctcaacatctctgcgtc

SEQ ID NO: 7104584 - DNA, 22 bp, Homo sapiens
gaagtttatggtgcttgtaagg

SEQ ID NO: 7104585 - DNA, 22 bp, Homo sapiens
gaagtttaggttcttatgttta

SEQ ID NO: 7104586 - DNA, 22 bp, Homo sapiens
gaagtttatttcaatctattca

SEQ ID NO: 7104587 - DNA, 22 bp, Homo sapiens
gaagtttagagtgttgtaattt

SEQ ID NO: 7104588 - DNA, 22 bp, Homo sapiens
gaagtttagagtttggagtcct

SEQ ID NO: 7104589 - DNA, 22 bp, Homo sapiens
gaataaactcctcagcttcctt

SEQ ID NO: 7104590 - DNA, 22 bp, Homo sapiens
gaagtttttgtagagacagggt

SEQ ID NO: 7104591 - DNA, 22 bp, Homo sapiens
gaagttttagtcaaaatgtaga

SEQ ID NO: 7104592 - DNA, 22 bp, Homo sapiens
gaagttttctgaggctgtagct

SEQ ID NO: 7104593 - DNA, 22 bp, Homo sapiens
gaagtttattttacacatccat

SEQ ID NO: 7104594 - DNA, 22 bp, Homo sapiens
gaagttttagtcaaaatgtaga

SEQ ID NO: 7104595 - DNA, 22 bp, Homo sapiens
gaagttttagtcaaaatgtaga

SEQ ID NO: 7104596 - DNA, 22 bp, Homo sapiens
gaataacattggaaccctgaag

SEQ ID NO: 7104597 - DNA, 22 bp, Homo sapiens
gaataacagcaagtttgcaggc

SEQ ID NO: 7104598 - DNA, 22 bp, Homo sapiens
gaataacagcaagtttgcaggc

SEQ ID NO: 7104599 - DNA, 22 bp, Homo sapiens
gaatacaagccaggcacaaggc

SEQ ID NO: 7104600 - DNA, 22 bp, Homo sapiens
gaatacaagccaggcacaaggc

SEQ ID NO: 7104601 - DNA, 22 bp, Homo sapiens
gaataacattggaaccctgaag

SEQ ID NO: 7104602 - DNA, 22 bp, Homo sapiens
gaataacattggaaccctgaag

SEQ ID NO: 7104603 - DNA, 22 bp, Homo sapiens
gaataacattttttcctttaca

SEQ ID NO: 7104604 - DNA, 19 bp, Homo sapiens
gaatacagataataagcag

SEQ ID NO: 7104605 - DNA, 22 bp, Homo sapiens
gaatacaagcctgccacctgga

SEQ ID NO: 7104606 - DNA, 22 bp, Homo sapiens
gaatacaagcctgccacctgga

SEQ ID NO: 7104607 - DNA, 22 bp, Homo sapiens
gaatacaagcctgccacctgga

SEQ ID NO: 7104608 - DNA, 22 bp, Homo sapiens
gaatacaagcctgccacctgga

SEQ ID NO: 7104609 - DNA, 19 bp, Homo sapiens
gaatacagataataagcag

SEQ ID NO: 7104610 - DNA, 22 bp, Homo sapiens
gaatacaggcaggtggctgtgc

SEQ ID NO: 7104611 - DNA, 22 bp, Homo sapiens
gaatacaggcaggtggctgtgc

SEQ ID NO: 7104612 - DNA, 22 bp, Homo sapiens
gaatacaggcaggtggctgtgc

SEQ ID NO: 7104613 - DNA, 22 bp, Homo sapiens
gaatacatccagagcagggctg

SEQ ID NO: 7104614 - DNA, 22 bp, Homo sapiens
gaatacatgatacatgaactgc

SEQ ID NO: 7104615 - DNA, 22 bp, Homo sapiens
gaatacattggaaatcagaata

SEQ ID NO: 7104616 - DNA, 22 bp, Homo sapiens
gaatacattggaaatcagaata

SEQ ID NO: 7104617 - DNA, 22 bp, Homo sapiens
gaatacattggaaatcagaata

SEQ ID NO: 7104618 - DNA, 22 bp, Homo sapiens
gaatactgacactcaggtggga

SEQ ID NO: 7104619 - DNA, 18 bp, Homo sapiens
gaatactgagagcacaaa

SEQ ID NO: 7104620 - DNA, 22 bp, Homo sapiens
gaatactgatgctcagccccct

SEQ ID NO: 7104621 - DNA, 22 bp, Homo sapiens
gaatactggaaaactcatttta

SEQ ID NO: 7104622 - DNA, 22 bp, Homo sapiens
gaatacttgggtctggagtcaa

SEQ ID NO: 7104623 - DNA, 22 bp, Homo sapiens
gaatacttttgttaggaaaacg

SEQ ID NO: 7104624 - DNA, 22 bp, Homo sapiens
gaatacatgtgtgtatagaggt

SEQ ID NO: 7104625 - DNA, 22 bp, Homo sapiens
gaatacattggaaatcagaata

SEQ ID NO: 7104626 - DNA, 22 bp, Homo sapiens
gaatacattggaaatcagaata

SEQ ID NO: 7104627 - DNA, 22 bp, Homo sapiens
gaatacatgattaaagtttgat

SEQ ID NO: 7104628 - DNA, 22 bp, Homo sapiens
gaatagttctatggctgcaggg

SEQ ID NO: 7104629 - DNA, 22 bp, Homo sapiens
gaatagattatacttgaagcat

SEQ ID NO: 7104630 - DNA, 22 bp, Homo sapiens
gaatagctgtaggctagtgtct

SEQ ID NO: 7104631 - DNA, 22 bp, Homo sapiens
gaatagatagcttggatggttg

SEQ ID NO: 7104632 - DNA, 22 bp, Homo sapiens
gaatagatatccttgagggtct

SEQ ID NO: 7104633 - DNA, 22 bp, Homo sapiens
gaatagatcctcatttattgat

SEQ ID NO: 7104634 - DNA, 22 bp, Homo sapiens
gaatagatcctcatttattgat

SEQ ID NO: 7104635 - DNA, 22 bp, Homo sapiens
gaatagataagtgactatttgg

SEQ ID NO: 7104636 - DNA, 22 bp, Homo sapiens
gaatagatgaaagtgtctctta

SEQ ID NO: 7104637 - DNA, 22 bp, Homo sapiens
gaatagattagaaagagtatgt

SEQ ID NO: 7104638 - DNA, 22 bp, Homo sapiens
gaatagattatacttgaagcat

SEQ ID NO: 7104639 - DNA, 22 bp, Homo sapiens
gaatatattggtgaaaatagtt

SEQ ID NO: 7104640 - DNA, 22 bp, Homo sapiens
gaatatatttctcttaccttta

SEQ ID NO: 7104641 - DNA, 22 bp, Homo sapiens
gaatatattggtgaaaatagtt

SEQ ID NO: 7104642 - DNA, 22 bp, Homo sapiens
gaatatattggtgaaaatagtt

SEQ ID NO: 7104643 - DNA, 22 bp, Homo sapiens
gaatatattggtgaaaatagtt

SEQ ID NO: 7104644 - DNA, 22 bp, Homo sapiens
gaatatattggtgaaaatagtt

SEQ ID NO: 7104645 - DNA, 22 bp, Homo sapiens
gaatatattattcagcttttca

SEQ ID NO: 7104646 - DNA, 21 bp, Homo sapiens
gaatagttctgtggcagcagt

SEQ ID NO: 7104647 - DNA, 23 bp, Homo sapiens
gaatagttttagaaattggagaa

SEQ ID NO: 7104648 - DNA, 22 bp, Homo sapiens
gaatatattattcagcttttca

SEQ ID NO: 7104649 - DNA, 22 bp, Homo sapiens
gacaagctcttgtttcatggtt

SEQ ID NO: 7104650 - DNA, 22 bp, Homo sapiens
gacaagctcccggtggccctcc

SEQ ID NO: 7104651 - DNA, 22 bp, Homo sapiens
gacaagatttagagtctgctaa

SEQ ID NO: 7104652 - DNA, 22 bp, Homo sapiens
gacaagatttagagtctgctaa

SEQ ID NO: 7104653 - DNA, 22 bp, Homo sapiens
gacaagataatgaagtgcaatt

SEQ ID NO: 7104654 - DNA, 22 bp, Homo sapiens
gacaagataatgaagtgcaatt

SEQ ID NO: 7104655 - DNA, 22 bp, Homo sapiens
gacaagatgacatcatggcttc

SEQ ID NO: 7104656 - DNA, 22 bp, Homo sapiens
gacaagatgagcagctcagtgt

SEQ ID NO: 7104657 - DNA, 22 bp, Homo sapiens
gacaagatgagcagctcagtgt

SEQ ID NO: 7104658 - DNA, 22 bp, Homo sapiens
gacaagattaaccatagttaag

SEQ ID NO: 7104659 - DNA, 22 bp, Homo sapiens
gacaagattaaccatagttaag

SEQ ID NO: 7104660 - DNA, 17 bp, Homo sapiens
gacaagacagaattcat

SEQ ID NO: 7104661 - DNA, 22 bp, Homo sapiens
gacaactgccccattttaaatg

SEQ ID NO: 7104662 - DNA, 22 bp, Homo sapiens
gaatatatttctcttaccttta

SEQ ID NO: 7104663 - DNA, 22 bp, Homo sapiens
gaatatatttctcttaccttta

SEQ ID NO: 7104664 - DNA, 22 bp, Homo sapiens
gaatatatttctcttaccttta

SEQ ID NO: 7104665 - DNA, 22 bp, Homo sapiens
gaatatcccgctatgcaaagta

SEQ ID NO: 7104666 - DNA, 22 bp, Homo sapiens
gaatattagtatcagttatacc

SEQ ID NO: 7104667 - DNA, 22 bp, Homo sapiens
gacaacaggcagacgtcagaaa

SEQ ID NO: 7104668 - DNA, 22 bp, Homo sapiens
gacaacaggcagacgtcagaaa

SEQ ID NO: 7104669 - DNA, 22 bp, Homo sapiens
gaatatgaccttatttggagat

SEQ ID NO: 7104670 - DNA, 22 bp, Homo sapiens
gaatatgagtgtccctgaggtc

SEQ ID NO: 7104671 - DNA, 22 bp, Homo sapiens
gaatatgtgcatttatgagtgt

SEQ ID NO: 7104672 - DNA, 22 bp, Homo sapiens
gaatatgttctggaagttcttg

SEQ ID NO: 7104673 - DNA, 22 bp, Homo sapiens
gacagggtggctgatagggctc

SEQ ID NO: 7104674 - DNA, 22 bp, Homo sapiens
gacagggtggctgatagggctc

SEQ ID NO: 7104675 - DNA, 22 bp, Homo sapiens
gacagggtggctgatagggctc

SEQ ID NO: 7104676 - DNA, 22 bp, Homo sapiens
gacaggtaaagatggtggcagg

SEQ ID NO: 7104677 - DNA, 22 bp, Homo sapiens
gacaggtaaagatggtggcagg

SEQ ID NO: 7104678 - DNA, 22 bp, Homo sapiens
gacaggtaaagatggtggcagg

SEQ ID NO: 7104679 - DNA, 22 bp, Homo sapiens
gacaggtaaagtactgggtttt

SEQ ID NO: 7104680 - DNA, 23 bp, Homo sapiens
gacaggtaagggttgggagaatc

SEQ ID NO: 7104681 - DNA, 23 bp, Homo sapiens
gacaggtaagggttgggagaatc

SEQ ID NO: 7104682 - DNA, 23 bp, Homo sapiens
gacaggtaagggttgggagaatc

SEQ ID NO: 7104683 - DNA, 22 bp, Homo sapiens
gacaggtaccggtcagactacg

SEQ ID NO: 7104684 - DNA, 22 bp, Homo sapiens
gacagggtccaaaggcagggga

SEQ ID NO: 7104685 - DNA, 22 bp, Homo sapiens
gacagggtccaaaggcagggga

SEQ ID NO: 7104686 - DNA, 22 bp, Homo sapiens
gacagggtccaaaggcagggga

SEQ ID NO: 7104687 - DNA, 22 bp, Homo sapiens
gacagggtccaaaggcagggga

SEQ ID NO: 7104688 - DNA, 21 bp, Homo sapiens
gacaggtgattcagagcaggg

SEQ ID NO: 7104689 - DNA, 21 bp, Homo sapiens
gacaggtgattcagagcaggg

SEQ ID NO: 7104690 - DNA, 22 bp, Homo sapiens
gacaggtgagatgaggaacacc

SEQ ID NO: 7104691 - DNA, 21 bp, Homo sapiens
gacaggtgattcagagcaggg

SEQ ID NO: 7104692 - DNA, 20 bp, Homo sapiens
gacaggtgctaaagaggggc

SEQ ID NO: 7104693 - DNA, 20 bp, Homo sapiens
gacaggtgctaaagaggggc

SEQ ID NO: 7104694 - DNA, 22 bp, Homo sapiens
gacaggtgaaacagcaaggtaa

SEQ ID NO: 7104695 - DNA, 22 bp, Homo sapiens
gacaggtactatgtgcagacac

SEQ ID NO: 7104696 - DNA, 22 bp, Homo sapiens
gacaggtatttgagagctggga

SEQ ID NO: 7104697 - DNA, 22 bp, Homo sapiens
gacaggtatttgagagctggga

SEQ ID NO: 7104698 - DNA, 22 bp, Homo sapiens
gacaggtgaaacagcaaggtaa

SEQ ID NO: 7104699 - DNA, 22 bp, Homo sapiens
gacaggtgaaacagcaaggtaa

SEQ ID NO: 7104700 - DNA, 22 bp, Homo sapiens
gacaggtgagatgaggaacacc

SEQ ID NO: 7104701 - DNA, 22 bp, Homo sapiens
gacaggtgagatgaggaacacc

SEQ ID NO: 7104702 - DNA, 22 bp, Homo sapiens
gacaggtgggttctcgtatctg

SEQ ID NO: 7104703 - DNA, 18 bp, Homo sapiens
gacaggtgggtgagacca

SEQ ID NO: 7104704 - DNA, 22 bp, Homo sapiens
gacaggtgtgatgatttaggct

SEQ ID NO: 7104705 - DNA, 22 bp, Homo sapiens
gacaggtgggttctcgtatctg

SEQ ID NO: 7104706 - DNA, 22 bp, Homo sapiens
gacaggtgtgatgatttaggct

SEQ ID NO: 7104707 - DNA, 22 bp, Homo sapiens
gacaggtgtgtgtatattaggg

SEQ ID NO: 7104708 - DNA, 22 bp, Homo sapiens
gacaggtgtgtgtatattaggg

SEQ ID NO: 7104709 - DNA, 18 bp, Homo sapiens
gacagtaaacttccccat

SEQ ID NO: 7104710 - DNA, 22 bp, Homo sapiens
gacagtaaatgcagtctagcac

SEQ ID NO: 7104711 - DNA, 22 bp, Homo sapiens
gacagtaactacagttctgtgg

SEQ ID NO: 7104712 - DNA, 22 bp, Homo sapiens
gacaggtgctaagggacctggc

SEQ ID NO: 7104713 - DNA, 22 bp, Homo sapiens
gacaggtgctaagggacctggc

SEQ ID NO: 7104714 - DNA, 22 bp, Homo sapiens
gacaggtgctaagggacctggc

SEQ ID NO: 7104715 - DNA, 20 bp, Homo sapiens
gacaggtgctaaagaggggc

SEQ ID NO: 7104716 - DNA, 22 bp, Homo sapiens
gacaggtggggaaactaaggta

SEQ ID NO: 7104717 - DNA, 22 bp, Homo sapiens
gacaggtggggaaactaaggta

SEQ ID NO: 7104718 - DNA, 22 bp, Homo sapiens
gacaggtggggaaactaaggta

SEQ ID NO: 7104719 - DNA, 22 bp, Homo sapiens
gacaggtggggaaactaaggta

SEQ ID NO: 7104720 - DNA, 22 bp, Homo sapiens
gacaggtgggtacctttatgga

SEQ ID NO: 7104721 - DNA, 22 bp, Homo sapiens
gacaggtgggtacctttatgga

SEQ ID NO: 7104722 - DNA, 18 bp, Homo sapiens
gacaggtgggtgagacca

SEQ ID NO: 7104723 - DNA, 18 bp, Homo sapiens
gacaggtgggtgagacca

SEQ ID NO: 7104724 - DNA, 18 bp, Homo sapiens
gacaggtgggtgagacca

SEQ ID NO: 7104725 - DNA, 22 bp, Homo sapiens
gacagtcccccagcagcaaacc

SEQ ID NO: 7104726 - DNA, 22 bp, Homo sapiens
gacccagtgactcgtctctgtg

SEQ ID NO: 7104727 - DNA, 22 bp, Homo sapiens
gacccagtgggggcctgatctg

SEQ ID NO: 7104728 - DNA, 22 bp, Homo sapiens
gacccagtgggggcctgatctg

SEQ ID NO: 7104729 - DNA, 22 bp, Homo sapiens
gacccataggaatctgttgtcc

SEQ ID NO: 7104730 - DNA, 22 bp, Homo sapiens
gacccatataggaccctccaaa

SEQ ID NO: 7104731 - DNA, 22 bp, Homo sapiens
gacccatatatacgtaatttgt

SEQ ID NO: 7104732 - DNA, 22 bp, Homo sapiens
gaccctggcaggtagcctcaca

SEQ ID NO: 7104733 - DNA, 22 bp, Homo sapiens
gaccctggctgccgcggtctgg

SEQ ID NO: 7104734 - DNA, 22 bp, Homo sapiens
gaccctggctggagctggcctg

SEQ ID NO: 7104735 - DNA, 22 bp, Homo sapiens
gacagtaactgagagatgtaat

SEQ ID NO: 7104736 - DNA, 22 bp, Homo sapiens
gacagtaagaccttaccagcct

SEQ ID NO: 7104737 - DNA, 22 bp, Homo sapiens
gacagtaagagtgtctgggttc

SEQ ID NO: 7104738 - DNA, 22 bp, Homo sapiens
gacagtaaggtggcttcttctt

SEQ ID NO: 7104739 - DNA, 22 bp, Homo sapiens
gacagtaagtcagagacttggt

SEQ ID NO: 7104740 - DNA, 22 bp, Homo sapiens
gacagtacaggtagaagtcact

SEQ ID NO: 7104741 - DNA, 22 bp, Homo sapiens
gacagtagtaaagctaggacca

SEQ ID NO: 7104742 - DNA, 22 bp, Homo sapiens
gacctatttaagtgtagttcaa

SEQ ID NO: 7104743 - DNA, 22 bp, Homo sapiens
gaccctttggaggtagtcacca

SEQ ID NO: 7104744 - DNA, 22 bp, Homo sapiens
gaccctgtttctacaaataatt

SEQ ID NO: 7104745 - DNA, 22 bp, Homo sapiens
gacccttagaatgtgatcttat

SEQ ID NO: 7104746 - DNA, 22 bp, Homo sapiens
gaccctggtgggcactggcacc

SEQ ID NO: 7104747 - DNA, 22 bp, Homo sapiens
gaccctggtgggcactggcacc

SEQ ID NO: 7104748 - DNA, 22 bp, Homo sapiens
gaccctggtgggcactggcacc

SEQ ID NO: 7104749 - DNA, 22 bp, Homo sapiens
gaccctggctggagctggcctg

SEQ ID NO: 7104750 - DNA, 22 bp, Homo sapiens
gaccctggctggagctggcctg

SEQ ID NO: 7104751 - DNA, 22 bp, Homo sapiens
gaccctgtttctacaaataatt

SEQ ID NO: 7104752 - DNA, 22 bp, Homo sapiens
gaccctggtgggcactggcacc

SEQ ID NO: 7104753 - DNA, 22 bp, Homo sapiens
gaccctggtgtccaggtcctgc

SEQ ID NO: 7104754 - DNA, 22 bp, Homo sapiens
gaccctggtgtccaggtcctgc

SEQ ID NO: 7104755 - DNA, 22 bp, Homo sapiens
gacaggctttgagtcccagaac

SEQ ID NO: 7104756 - DNA, 22 bp, Homo sapiens
gacaggctttctcaggatgagc

SEQ ID NO: 7104757 - DNA, 22 bp, Homo sapiens
gacaggctttctcaggatgagc

SEQ ID NO: 7104758 - DNA, 22 bp, Homo sapiens
gacaggctttgagtcccagaac

SEQ ID NO: 7104759 - DNA, 22 bp, Homo sapiens
gacagggaaacattgaagtgtc

SEQ ID NO: 7104760 - DNA, 22 bp, Homo sapiens
gacagggaacttcattagctgt

SEQ ID NO: 7104761 - DNA, 22 bp, Homo sapiens
gacaggcttcctaagtgccaga

SEQ ID NO: 7104762 - DNA, 22 bp, Homo sapiens
gacaggcttcatgatggcagga

SEQ ID NO: 7104763 - DNA, 22 bp, Homo sapiens
gacaggcttccactatgttgcc

SEQ ID NO: 7104764 - DNA, 22 bp, Homo sapiens
gacaggcttccactatgttgcc

SEQ ID NO: 7104765 - DNA, 22 bp, Homo sapiens
gacaggcttcctaagtgccaga

SEQ ID NO: 7104766 - DNA, 22 bp, Homo sapiens
gacaggcttcctaagtgccaga

SEQ ID NO: 7104767 - DNA, 22 bp, Homo sapiens
gacaggcttcatcctcagagtt

SEQ ID NO: 7104768 - DNA, 22 bp, Homo sapiens
gacaggcttcatcctcagagtt

SEQ ID NO: 7104769 - DNA, 22 bp, Homo sapiens
gacaggcttcatgatggcagga

SEQ ID NO: 7104770 - DNA, 22 bp, Homo sapiens
gacaggcttcatcctcagagtt

SEQ ID NO: 7104771 - DNA, 22 bp, Homo sapiens
gacaggcttagggagggtgctc

SEQ ID NO: 7104772 - DNA, 22 bp, Homo sapiens
gacaggcttagggagggtgctc

SEQ ID NO: 7104773 - DNA, 22 bp, Homo sapiens
gacaggctgtgatggccgggag

SEQ ID NO: 7104774 - DNA, 22 bp, Homo sapiens
gacaggctgtgatggccgggag

SEQ ID NO: 7104775 - DNA, 17 bp, Homo sapiens
gacaggctcagtgacga

SEQ ID NO: 7104776 - DNA, 22 bp, Homo sapiens
gacaggctggcaatgccctgct

SEQ ID NO: 7104777 - DNA, 21 bp, Homo sapiens
gacaggggaagaagcaaggag

SEQ ID NO: 7104778 - DNA, 22 bp, Homo sapiens
gacagggctgtgggaggagcag

SEQ ID NO: 7104779 - DNA, 22 bp, Homo sapiens
gacagggctgtgggaggagcag

SEQ ID NO: 7104780 - DNA, 22 bp, Homo sapiens
gacagggctgtgggaggagcag

SEQ ID NO: 7104781 - DNA, 22 bp, Homo sapiens
gacagggctgtgggaggagcag

SEQ ID NO: 7104782 - DNA, 22 bp, Homo sapiens
gacagggacacagccagtgagg

SEQ ID NO: 7104783 - DNA, 22 bp, Homo sapiens
gacagggaacttcattagctgt

SEQ ID NO: 7104784 - DNA, 23 bp, Homo sapiens
gacagggctgacttggcagctgc

SEQ ID NO: 7104785 - DNA, 23 bp, Homo sapiens
gacagggctgacttggcagctgc

SEQ ID NO: 7104786 - DNA, 22 bp, Homo sapiens
gacagggctgtgggaggagcag

SEQ ID NO: 7104787 - DNA, 22 bp, Homo sapiens
gacagggctgtgggaggagcag

SEQ ID NO: 7104788 - DNA, 22 bp, Homo sapiens
gacaggggctttgcatgcttta

SEQ ID NO: 7104789 - DNA, 21 bp, Homo sapiens
gacaggggccatgggtttcta

SEQ ID NO: 7104790 - DNA, 21 bp, Homo sapiens
gacaggggccatgggtttcta

SEQ ID NO: 7104791 - DNA, 21 bp, Homo sapiens
gacaggggaagaagcaaggag

SEQ ID NO: 7104792 - DNA, 21 bp, Homo sapiens
gacaggggaagaagcaaggag

SEQ ID NO: 7104793 - DNA, 22 bp, Homo sapiens
gacaggggctttgcatgcttta

SEQ ID NO: 7104794 - DNA, 22 bp, Homo sapiens
gacaggggtccctctgggctgt

SEQ ID NO: 7104795 - DNA, 22 bp, Homo sapiens
gacaggggtccctctgggctgt

SEQ ID NO: 7104796 - DNA, 22 bp, Homo sapiens
gacaggggtccctctgggctgt

SEQ ID NO: 7104797 - DNA, 22 bp, Homo sapiens
gacaggggtccctctgggctgt

SEQ ID NO: 7104798 - DNA, 22 bp, Homo sapiens
gacacagaatgggtgctcagta

SEQ ID NO: 7104799 - DNA, 22 bp, Homo sapiens
gacaataaaatgatcttacagt

SEQ ID NO: 7104800 - DNA, 18 bp, Homo sapiens
gacacacttgcagtagtc

SEQ ID NO: 7104801 - DNA, 18 bp, Homo sapiens
gacacacttgcagtagtc

SEQ ID NO: 7104802 - DNA, 22 bp, Homo sapiens
gacacagaaggtcacatgttca

SEQ ID NO: 7104803 - DNA, 22 bp, Homo sapiens
gacaaggcaaccagggaggctt

SEQ ID NO: 7104804 - DNA, 22 bp, Homo sapiens
gacaagggttctgcagagcctg

SEQ ID NO: 7104805 - DNA, 22 bp, Homo sapiens
gacaagggttctgcagagcctg

SEQ ID NO: 7104806 - DNA, 22 bp, Homo sapiens
gacaaggtgataatagcttctg

SEQ ID NO: 7104807 - DNA, 22 bp, Homo sapiens
gacaagtcatctggggcctgtg

SEQ ID NO: 7104808 - DNA, 22 bp, Homo sapiens
gacaagtgctgatttatctccc

SEQ ID NO: 7104809 - DNA, 16 bp, Homo sapiens
gacaagtggaggggcc

SEQ ID NO: 7104810 - DNA, 17 bp, Homo sapiens
gacaggctcagtgacga

SEQ ID NO: 7104811 - DNA, 22 bp, Homo sapiens
gacaggctaggttgctgtcctc

SEQ ID NO: 7104812 - DNA, 22 bp, Homo sapiens
gacaggctaggttgctgtcctc

SEQ ID NO: 7104813 - DNA, 22 bp, Homo sapiens
gacaggcccgagtagctgatga

SEQ ID NO: 7104814 - DNA, 22 bp, Homo sapiens
gacaggccaggggctgaggtgg

SEQ ID NO: 7104815 - DNA, 22 bp, Homo sapiens
gacaggccaggggctgaggtgg

SEQ ID NO: 7104816 - DNA, 22 bp, Homo sapiens
gacaggccccctcaggactgat

SEQ ID NO: 7104817 - DNA, 22 bp, Homo sapiens
gacacagaattcccctccaagt

SEQ ID NO: 7104818 - DNA, 22 bp, Homo sapiens
gacacagacagttagaggtaat

SEQ ID NO: 7104819 - DNA, 22 bp, Homo sapiens
gacacagaccaccaggccctgg

SEQ ID NO: 7104820 - DNA, 22 bp, Homo sapiens
gacacagagataggcctgtgtt

SEQ ID NO: 7104821 - DNA, 22 bp, Homo sapiens
gagaagggggctcgagtgtcct

SEQ ID NO: 7104822 - DNA, 22 bp, Homo sapiens
gagaagggggctcgagtgtcct

SEQ ID NO: 7104823 - DNA, 22 bp, Homo sapiens
gagaagggggctcgagtgtcct

SEQ ID NO: 7104824 - DNA, 22 bp, Homo sapiens
gagaagggcttgggagtcaaca

SEQ ID NO: 7104825 - DNA, 22 bp, Homo sapiens
gagaagggatatgccactctcg

SEQ ID NO: 7104826 - DNA, 22 bp, Homo sapiens
gagaagggatatggcttcttga

SEQ ID NO: 7104827 - DNA, 22 bp, Homo sapiens
gagaagggcttgggagtcaaca

SEQ ID NO: 7104828 - DNA, 22 bp, Homo sapiens
gagaaggctggtcttaagtcga

SEQ ID NO: 7104829 - DNA, 22 bp, Homo sapiens
gagaaggctgatccttggagtt

SEQ ID NO: 7104830 - DNA, 22 bp, Homo sapiens
gagaagggatatgccactctcg

SEQ ID NO: 7104831 - DNA, 22 bp, Homo sapiens
gagaaggctgatccttggagtt

SEQ ID NO: 7104832 - DNA, 22 bp, Homo sapiens
gagaaggctgatccttggagtt

SEQ ID NO: 7104833 - DNA, 22 bp, Homo sapiens
gagaaggatgtggctcatagct

SEQ ID NO: 7104834 - DNA, 22 bp, Homo sapiens
gagaaggatgtggctcatagct

SEQ ID NO: 7104835 - DNA, 22 bp, Homo sapiens
gagaatttgctggcttcattgt

SEQ ID NO: 7104836 - DNA, 22 bp, Homo sapiens
gagaattttctagtagtttcat

SEQ ID NO: 7104837 - DNA, 22 bp, Homo sapiens
gagacaaaagttggagtgcaag

SEQ ID NO: 7104838 - DNA, 22 bp, Homo sapiens
gagacaaaagttggagtgcaag

SEQ ID NO: 7104839 - DNA, 22 bp, Homo sapiens
gagacaaaagttggagtgcaag

SEQ ID NO: 7104840 - DNA, 22 bp, Homo sapiens
gagaattactgtttttataaca

SEQ ID NO: 7104841 - DNA, 22 bp, Homo sapiens
gagaattactgtttttataaca

SEQ ID NO: 7104842 - DNA, 22 bp, Homo sapiens
gagaattactgtttttataaca

SEQ ID NO: 7104843 - DNA, 22 bp, Homo sapiens
gagaattactgtttttataaca

SEQ ID NO: 7104844 - DNA, 22 bp, Homo sapiens
gagaattagggcgtaattcaga

SEQ ID NO: 7104845 - DNA, 22 bp, Homo sapiens
gagaattagggcgtaattcaga

SEQ ID NO: 7104846 - DNA, 22 bp, Homo sapiens
gagaatgtttctgtctgccctt

SEQ ID NO: 7104847 - DNA, 22 bp, Homo sapiens
gagaattagggcgtaattcaga

SEQ ID NO: 7104848 - DNA, 22 bp, Homo sapiens
gagaattagggcgtaattcaga

SEQ ID NO: 7104849 - DNA, 22 bp, Homo sapiens
gagaagggggctcgagtgtcct

SEQ ID NO: 7104850 - DNA, 22 bp, Homo sapiens
gagaagggggctcgagtgtcct

SEQ ID NO: 7104851 - DNA, 22 bp, Homo sapiens
gagaagggggctcgagtgtcct

SEQ ID NO: 7104852 - DNA, 22 bp, Homo sapiens
gagaatgccttggaagaagtcc

SEQ ID NO: 7104853 - DNA, 22 bp, Homo sapiens
gagaatgggaatgaaagtagca

SEQ ID NO: 7104854 - DNA, 22 bp, Homo sapiens
gagaatgggaatgaaagtagca

SEQ ID NO: 7104855 - DNA, 22 bp, Homo sapiens
gagaatgtggagcctgtggttg

SEQ ID NO: 7104856 - DNA, 22 bp, Homo sapiens
gacctccagcggccctgcagag

SEQ ID NO: 7104857 - DNA, 22 bp, Homo sapiens
gacctcatgatccacctgcctt

SEQ ID NO: 7104858 - DNA, 22 bp, Homo sapiens
gacctcgtgatccgccctcctt

SEQ ID NO: 7104859 - DNA, 22 bp, Homo sapiens
gacctcatgatccacctgcctt

SEQ ID NO: 7104860 - DNA, 22 bp, Homo sapiens
gagaaggactacacatctggcc

SEQ ID NO: 7104861 - DNA, 22 bp, Homo sapiens
gagaaggactacacatctggcc

SEQ ID NO: 7104862 - DNA, 22 bp, Homo sapiens
gagaaggactacacatctggcc

SEQ ID NO: 7104863 - DNA, 22 bp, Homo sapiens
gagaaggactacacatctggcc

SEQ ID NO: 7104864 - DNA, 22 bp, Homo sapiens
gagaaggactacggaaaacaga

SEQ ID NO: 7104865 - DNA, 22 bp, Homo sapiens
gagaaggactacggaaaacaga

SEQ ID NO: 7104866 - DNA, 22 bp, Homo sapiens
gagaaggactacggaaaacaga

SEQ ID NO: 7104867 - DNA, 22 bp, Homo sapiens
gagaaggactacggaaaacaga

SEQ ID NO: 7104868 - DNA, 22 bp, Homo sapiens
gacctctgttggacccctgggg

SEQ ID NO: 7104869 - DNA, 22 bp, Homo sapiens
gacctctcaggaatctcacatg

SEQ ID NO: 7104870 - DNA, 22 bp, Homo sapiens
gacctctgaaggcagagcaggg

SEQ ID NO: 7104871 - DNA, 22 bp, Homo sapiens
gagaaggaggcgaagcgtgtgc

SEQ ID NO: 7104872 - DNA, 22 bp, Homo sapiens
gagaaggaggcgaagcgtgtgc

SEQ ID NO: 7104873 - DNA, 22 bp, Homo sapiens
gagaaggaggcgaagcgtgtgc

SEQ ID NO: 7104874 - DNA, 22 bp, Homo sapiens
gagaaggaggcgaagcgtgtgc

SEQ ID NO: 7104875 - DNA, 22 bp, Homo sapiens
gagaaggagctcaaatatggct

SEQ ID NO: 7104876 - DNA, 22 bp, Homo sapiens
gagaaggagctcaaatatggct

SEQ ID NO: 7104877 - DNA, 22 bp, Homo sapiens
gagaaggagctcaaatatggct

SEQ ID NO: 7104878 - DNA, 22 bp, Homo sapiens
gagaaggagctccttggggtct

SEQ ID NO: 7104879 - DNA, 22 bp, Homo sapiens
gagaaggagctccttggggtct

SEQ ID NO: 7104880 - DNA, 22 bp, Homo sapiens
gagaaggatgtggctcatagct

SEQ ID NO: 7104881 - DNA, 22 bp, Homo sapiens
gagaaggatgtggctcatagct

SEQ ID NO: 7104882 - DNA, 22 bp, Homo sapiens
gagaaggatgaggaaatggtat

SEQ ID NO: 7104883 - DNA, 22 bp, Homo sapiens
gagaaggatgaggaaatggtat

SEQ ID NO: 7104884 - DNA, 22 bp, Homo sapiens
gagaaggatgaggaaatggtat

SEQ ID NO: 7104885 - DNA, 22 bp, Homo sapiens
gagaaggagtagctgacctggg

SEQ ID NO: 7104886 - DNA, 22 bp, Homo sapiens
gagaaggagtagctgacctggg

SEQ ID NO: 7104887 - DNA, 22 bp, Homo sapiens
gagaggcatggaacagattctt

SEQ ID NO: 7104888 - DNA, 22 bp, Homo sapiens
gagaggcatggaacagattctt

SEQ ID NO: 7104889 - DNA, 22 bp, Homo sapiens
gagaggcatggaacagattctt

SEQ ID NO: 7104890 - DNA, 22 bp, Homo sapiens
gagaggcatggaacagattctt

SEQ ID NO: 7104891 - DNA, 22 bp, Homo sapiens
gagacacaaacatttattccac

SEQ ID NO: 7104892 - DNA, 22 bp, Homo sapiens
gagacacaaacatttattccac

SEQ ID NO: 7104893 - DNA, 22 bp, Homo sapiens
gagaggcatggaacagattctt

SEQ ID NO: 7104894 - DNA, 22 bp, Homo sapiens
gagacaaagcttcctgtgggta

SEQ ID NO: 7104895 - DNA, 22 bp, Homo sapiens
gagacaaagcttcctgtgggta

SEQ ID NO: 7104896 - DNA, 22 bp, Homo sapiens
gagacacaaacacatttagagg

SEQ ID NO: 7104897 - DNA, 22 bp, Homo sapiens
gagacacaaacacatttagagg

SEQ ID NO: 7104898 - DNA, 22 bp, Homo sapiens
gagacacaaacacatttagagg

SEQ ID NO: 7104899 - DNA, 22 bp, Homo sapiens
gagaggccaaaatccctgcccc

SEQ ID NO: 7104900 - DNA, 22 bp, Homo sapiens
gagaggccaaaatccctgcccc

SEQ ID NO: 7104901 - DNA, 22 bp, Homo sapiens
gagaggccaagggatccgtgag

SEQ ID NO: 7104902 - DNA, 22 bp, Homo sapiens
gagaggccaagggatccgtgag

SEQ ID NO: 7104903 - DNA, 22 bp, Homo sapiens
gagaggccacctgacgagcagt

SEQ ID NO: 7104904 - DNA, 22 bp, Homo sapiens
gagaggccatggctgtgcagtg

SEQ ID NO: 7104905 - DNA, 22 bp, Homo sapiens
gagaggccatggctgtgcagtg

SEQ ID NO: 7104906 - DNA, 22 bp, Homo sapiens
gagaggccacctgacgagcagt

SEQ ID NO: 7104907 - DNA, 22 bp, Homo sapiens
gagaggccatggctgtgcagtg

SEQ ID NO: 7104908 - DNA, 22 bp, Homo sapiens
gagaggccatggctgtgcagtg

SEQ ID NO: 7104909 - DNA, 22 bp, Homo sapiens
gagaggccatggctgtgcagtg

SEQ ID NO: 7104910 - DNA, 22 bp, Homo sapiens
gagaggccatggctgtgcagtg

SEQ ID NO: 7104911 - DNA, 22 bp, Homo sapiens
gagaggccatggctgtgcagtg

SEQ ID NO: 7104912 - DNA, 22 bp, Homo sapiens
gagaggccatggggtgggatgc

SEQ ID NO: 7104913 - DNA, 22 bp, Homo sapiens
gagaggccatggggtgggatgc

SEQ ID NO: 7104914 - DNA, 22 bp, Homo sapiens
gagaggccatggggtgggatgc

SEQ ID NO: 7104915 - DNA, 18 bp, Homo sapiens
gagaggcccggctgtgcc

SEQ ID NO: 7104916 - DNA, 18 bp, Homo sapiens
gagaggcccggctgtgcc

SEQ ID NO: 7104917 - DNA, 18 bp, Homo sapiens
gagaggcccggctgtgcc

SEQ ID NO: 7104918 - DNA, 22 bp, Homo sapiens
gagaggccatggggtgggatgc

SEQ ID NO: 7104919 - DNA, 18 bp, Homo sapiens
gagaggcccggctgtgcc

SEQ ID NO: 7104920 - DNA, 22 bp, Homo sapiens
gagaggccatggggtgggatgc

SEQ ID NO: 7104921 - DNA, 22 bp, Homo sapiens
gagaggccctgaagcccacaga

SEQ ID NO: 7104922 - DNA, 22 bp, Homo sapiens
gagaggccctgtggtcccagct

SEQ ID NO: 7104923 - DNA, 22 bp, Homo sapiens
gagaggccggcgtcgctgcggc

SEQ ID NO: 7104924 - DNA, 22 bp, Homo sapiens
gagaggcctgagaggctgcgga

SEQ ID NO: 7104925 - DNA, 22 bp, Homo sapiens
gagaggcctgagaggctgcgga

SEQ ID NO: 7104926 - DNA, 22 bp, Homo sapiens
gagaggcctgagaggctgcgga

SEQ ID NO: 7104927 - DNA, 22 bp, Homo sapiens
gagaggcctgagaggctgcgga

SEQ ID NO: 7104928 - DNA, 21 bp, Homo sapiens
gagaggcctgggcccgtgagc

SEQ ID NO: 7104929 - DNA, 22 bp, Homo sapiens
gagaggcctgggcccgtgagct

SEQ ID NO: 7104930 - DNA, 19 bp, Homo sapiens
gagaggcctgtgcttgaag

SEQ ID NO: 7104931 - DNA, 22 bp, Homo sapiens
gagaggctatgaggttctgtgt

SEQ ID NO: 7104932 - DNA, 22 bp, Homo sapiens
gagaggctatgaggttctgtgt

SEQ ID NO: 7104933 - DNA, 19 bp, Homo sapiens
gagaggcctgtgcttgaag

SEQ ID NO: 7104934 - DNA, 22 bp, Homo sapiens
gagaggctcagggacttgctga

SEQ ID NO: 7104935 - DNA, 22 bp, Homo sapiens
gagaggctatgaggttctgtgt

SEQ ID NO: 7104936 - DNA, 22 bp, Homo sapiens
gagaggctcagggacttgctga

SEQ ID NO: 7104937 - DNA, 22 bp, Homo sapiens
gagaggctccatgaccccggca

SEQ ID NO: 7104938 - DNA, 22 bp, Homo sapiens
gagaggctgggttggagatcga

SEQ ID NO: 7104939 - DNA, 22 bp, Homo sapiens
gagaggctgggttggagatcga

SEQ ID NO: 7104940 - DNA, 22 bp, Homo sapiens
gagaggctggtaaagtctgaac

SEQ ID NO: 7104941 - DNA, 22 bp, Homo sapiens
gagaggctgggttggagatcga

SEQ ID NO: 7104942 - DNA, 22 bp, Homo sapiens
gagaggctgggttggagatcga

SEQ ID NO: 7104943 - DNA, 22 bp, Homo sapiens
gagaggctgtgtgccattgttg

SEQ ID NO: 7104944 - DNA, 22 bp, Homo sapiens
gagaggctggtaaagtctgaac

SEQ ID NO: 7104945 - DNA, 22 bp, Homo sapiens
gagaggctgtgtgccattgttg

SEQ ID NO: 7104946 - DNA, 22 bp, Homo sapiens
gagaggctggtaaagtctgaac

SEQ ID NO: 7104947 - DNA, 22 bp, Homo sapiens
gagaggcttaagggctgtgaag

SEQ ID NO: 7104948 - DNA, 22 bp, Homo sapiens
gagaggcttgtgtgaagaacaa

SEQ ID NO: 7104949 - DNA, 22 bp, Homo sapiens
gagaggcttaagggctgtgaag

SEQ ID NO: 7104950 - DNA, 22 bp, Homo sapiens
gagaggcttaagggctgtgaag

SEQ ID NO: 7104951 - DNA, 22 bp, Homo sapiens
gagaggcttgtgtgaagaacaa

SEQ ID NO: 7104952 - DNA, 22 bp, Homo sapiens
gagaggcttgtgtgaagaacaa

SEQ ID NO: 7104953 - DNA, 22 bp, Homo sapiens
gagagggagccagccaggaacc

SEQ ID NO: 7104954 - DNA, 22 bp, Homo sapiens
gagagggagccagccaggaacc

SEQ ID NO: 7104955 - DNA, 22 bp, Homo sapiens
gagagggatactgagttttggt

SEQ ID NO: 7104956 - DNA, 18 bp, Homo sapiens
gagagggatccctcagga

SEQ ID NO: 7104957 - DNA, 22 bp, Homo sapiens
gagatcggtaaagagcatgcac

SEQ ID NO: 7104958 - DNA, 22 bp, Homo sapiens
gagatctctagcacttcctgta

SEQ ID NO: 7104959 - DNA, 22 bp, Homo sapiens
gagatcttcaaggttttagata

SEQ ID NO: 7104960 - DNA, 22 bp, Homo sapiens
gagatcttcctgagattcattt

SEQ ID NO: 7104961 - DNA, 22 bp, Homo sapiens
gagatcttcctgagattcattt

SEQ ID NO: 7104962 - DNA, 22 bp, Homo sapiens
gagatgaagaggcccttggagt

SEQ ID NO: 7104963 - DNA, 22 bp, Homo sapiens
gagatgaatgtaaacaaaggca

SEQ ID NO: 7104964 - DNA, 22 bp, Homo sapiens
gagatgaatgtaaacaaaggca

SEQ ID NO: 7104965 - DNA, 22 bp, Homo sapiens
gagatgagtgggggatctctca

SEQ ID NO: 7104966 - DNA, 22 bp, Homo sapiens
gagatgcaagcaagtctatttt

SEQ ID NO: 7104967 - DNA, 22 bp, Homo sapiens
gagatgcagaaccctcaggagc

SEQ ID NO: 7104968 - DNA, 22 bp, Homo sapiens
gagatgcttgtctgtcttatca

SEQ ID NO: 7104969 - DNA, 22 bp, Homo sapiens
gagccaccttcaactcaggaat

SEQ ID NO: 7104970 - DNA, 22 bp, Homo sapiens
gagccagacaggctagagcggg

SEQ ID NO: 7104971 - DNA, 22 bp, Homo sapiens
gagccagactgcctgaagctca

SEQ ID NO: 7104972 - DNA, 22 bp, Homo sapiens
gagccagactgcctgaagctca

SEQ ID NO: 7104973 - DNA, 22 bp, Homo sapiens
gagccagagatccaggatggct

SEQ ID NO: 7104974 - DNA, 22 bp, Homo sapiens
gagccagagatccaggatggct

SEQ ID NO: 7104975 - DNA, 22 bp, Homo sapiens
gagccagagatccaggatggct

SEQ ID NO: 7104976 - DNA, 22 bp, Homo sapiens
gagccagagatccaggatggct

SEQ ID NO: 7104977 - DNA, 22 bp, Homo sapiens
gagccagccgcaagagctgtga

SEQ ID NO: 7104978 - DNA, 22 bp, Homo sapiens
gagccagggctgtgagctgagc

SEQ ID NO: 7104979 - DNA, 22 bp, Homo sapiens
gagccagggctgtgagctgagc

SEQ ID NO: 7104980 - DNA, 22 bp, Homo sapiens
gagccagcagccggcaccacca

SEQ ID NO: 7104981 - DNA, 22 bp, Homo sapiens
gagccagattttatgcaagaca

SEQ ID NO: 7104982 - DNA, 22 bp, Homo sapiens
gagccaggggtcagctccgagg

SEQ ID NO: 7104983 - DNA, 22 bp, Homo sapiens
gagccaggggtcagctccgagg

SEQ ID NO: 7104984 - DNA, 22 bp, Homo sapiens
gagccaggggtcagctccgagg

SEQ ID NO: 7104985 - DNA, 22 bp, Homo sapiens
gagccaggggtcagctccgagg

SEQ ID NO: 7104986 - DNA, 22 bp, Homo sapiens
gagccaggggtcagctccgagg

SEQ ID NO: 7104987 - DNA, 22 bp, Homo sapiens
gagccagggtttgaaactagac

SEQ ID NO: 7104988 - DNA, 22 bp, Homo sapiens
gagccagggtttgaaactagac

SEQ ID NO: 7104989 - DNA, 22 bp, Homo sapiens
gagccagggtttgaaactagac

SEQ ID NO: 7104990 - DNA, 22 bp, Homo sapiens
gagccaggttggaggctgcagt

SEQ ID NO: 7104991 - DNA, 22 bp, Homo sapiens
gagccaggttggaggctgcagt

SEQ ID NO: 7104992 - DNA, 22 bp, Homo sapiens
gagccaggttggaggctgcagt

SEQ ID NO: 7104993 - DNA, 22 bp, Homo sapiens
gagccaggttggaggctgcagt

SEQ ID NO: 7104994 - DNA, 22 bp, Homo sapiens
gagccaggtcgggccgcggcga

SEQ ID NO: 7104995 - DNA, 22 bp, Homo sapiens
gagccaggtcgggccgcggcga

SEQ ID NO: 7104996 - DNA, 16 bp, Homo sapiens
gagccaggtgccttga

SEQ ID NO: 7104997 - DNA, 16 bp, Homo sapiens
gagccaggtgccttga

SEQ ID NO: 7104998 - DNA, 22 bp, Homo sapiens
gagccaggtcgggccgcggcga

SEQ ID NO: 7104999 - DNA, 22 bp, Homo sapiens
gagccaggttggaggctgcagt

SEQ ID NO: 7105000 - DNA, 22 bp, Homo sapiens
gagccaggttggaggctgcagt

SEQ ID NO: 7105001 - DNA, 22 bp, Homo sapiens
gagccaccttcaactcaggaat

SEQ ID NO: 7105002 - DNA, 22 bp, Homo sapiens
gagccacagtggtggcccacgt

SEQ ID NO: 7105003 - DNA, 22 bp, Homo sapiens
gagccacagcaacctcaaagga

SEQ ID NO: 7105004 - DNA, 22 bp, Homo sapiens
gagccacagtggattgattcca

SEQ ID NO: 7105005 - DNA, 22 bp, Homo sapiens
gagccaagggcgtgctggagag

SEQ ID NO: 7105006 - DNA, 22 bp, Homo sapiens
gagccaagggttgccatggaga

SEQ ID NO: 7105007 - DNA, 22 bp, Homo sapiens
gagccaagggttgccatggaga

SEQ ID NO: 7105008 - DNA, 22 bp, Homo sapiens
gagccaatctttgggctcttgg

SEQ ID NO: 7105009 - DNA, 22 bp, Homo sapiens
gagccacagaaggaaattgggg

SEQ ID NO: 7105010 - DNA, 22 bp, Homo sapiens
gagccacagaaggaaattgggg

SEQ ID NO: 7105011 - DNA, 22 bp, Homo sapiens
gagcatttttgtctgcatttta

SEQ ID NO: 7105012 - DNA, 22 bp, Homo sapiens
gagccaaatgtgcagacattgt

SEQ ID NO: 7105013 - DNA, 22 bp, Homo sapiens
gagccaaatgtgcagacattgt

SEQ ID NO: 7105014 - DNA, 22 bp, Homo sapiens
gagccaagatcgcaccactgca

SEQ ID NO: 7105015 - DNA, 22 bp, Homo sapiens
gagccaagattgtgtccctgca

SEQ ID NO: 7105016 - DNA, 22 bp, Homo sapiens
gagccaagctcttctccatgag

SEQ ID NO: 7105017 - DNA, 22 bp, Homo sapiens
gagccaagctcttctccatgag

SEQ ID NO: 7105018 - DNA, 22 bp, Homo sapiens
gagccaagggcgtgctggagag

SEQ ID NO: 7105019 - DNA, 22 bp, Homo sapiens
gagcagctggaggccttgttgg

SEQ ID NO: 7105020 - DNA, 22 bp, Homo sapiens
gagcagctggctgtattggttt

SEQ ID NO: 7105021 - DNA, 22 bp, Homo sapiens
gagcagctgtccccaaagcttc

SEQ ID NO: 7105022 - DNA, 22 bp, Homo sapiens
gagcagctgtccccaaagcttc

SEQ ID NO: 7105023 - DNA, 22 bp, Homo sapiens
gagcagctgtccccaaagcttc

SEQ ID NO: 7105024 - DNA, 22 bp, Homo sapiens
gagcagctgtggggttgaccat

SEQ ID NO: 7105025 - DNA, 22 bp, Homo sapiens
gagcagctgtggggttgaccat

SEQ ID NO: 7105026 - DNA, 22 bp, Homo sapiens
gagcagctgttctgacttgtct

SEQ ID NO: 7105027 - DNA, 22 bp, Homo sapiens
gagcagctgttctgacttgtct

SEQ ID NO: 7105028 - DNA, 20 bp, Homo sapiens
gagcagctgtttgcattgca

SEQ ID NO: 7105029 - DNA, 21 bp, Homo sapiens
gagatttagaaggatcaattt

SEQ ID NO: 7105030 - DNA, 22 bp, Homo sapiens
gagattctgtagtcaggcatct

SEQ ID NO: 7105031 - DNA, 22 bp, Homo sapiens
gagatgtttagatgtttgtcca

SEQ ID NO: 7105032 - DNA, 22 bp, Homo sapiens
gagatgtttagggtggggagag

SEQ ID NO: 7105033 - DNA, 22 bp, Homo sapiens
gagatgtttagggtggggagag

SEQ ID NO: 7105034 - DNA, 20 bp, Homo sapiens
gagattaactgagaatctag

SEQ ID NO: 7105035 - DNA, 21 bp, Homo sapiens
gagatgtgagctctgatagtc

SEQ ID NO: 7105036 - DNA, 22 bp, Homo sapiens
gagatgtgatcctttgctgtgt

SEQ ID NO: 7105037 - DNA, 22 bp, Homo sapiens
gagatgttattcttcagtgtgt

SEQ ID NO: 7105038 - DNA, 22 bp, Homo sapiens
gagatgtttagatgtttgtcca

SEQ ID NO: 7105039 - DNA, 22 bp, Homo sapiens
gagatggagtctttttctgtca

SEQ ID NO: 7105040 - DNA, 22 bp, Homo sapiens
gagatggagtctttttctgtca

SEQ ID NO: 7105041 - DNA, 22 bp, Homo sapiens
gagatggagaaggaagctgttt

SEQ ID NO: 7105042 - DNA, 22 bp, Homo sapiens
gagatggagtctttttctgtca

SEQ ID NO: 7105043 - DNA, 22 bp, Homo sapiens
gagatggttgcaatagtttaaa

SEQ ID NO: 7105044 - DNA, 22 bp, Homo sapiens
gagatggttgggttaacaacta

SEQ ID NO: 7105045 - DNA, 22 bp, Homo sapiens
gagatgtacaatgtgtattaat

SEQ ID NO: 7105046 - DNA, 20 bp, Homo sapiens
gagatggacagatgaagggg

SEQ ID NO: 7105047 - DNA, 22 bp, Homo sapiens
gagatggaatctgtgtggaggg

SEQ ID NO: 7105048 - DNA, 20 bp, Homo sapiens
gagatggacagatgaagggg

SEQ ID NO: 7105049 - DNA, 20 bp, Homo sapiens
gagatggacagatgaagggg

SEQ ID NO: 7105050 - DNA, 20 bp, Homo sapiens
gagatggacagatgaagggg

SEQ ID NO: 7105051 - DNA, 20 bp, Homo sapiens
gagatggacagatgaagggg

SEQ ID NO: 7105052 - DNA, 22 bp, Homo sapiens
gagatggaaaactgctggtagt

SEQ ID NO: 7105053 - DNA, 22 bp, Homo sapiens
gagatggaaaactgctggtagt

SEQ ID NO: 7105054 - DNA, 22 bp, Homo sapiens
gagatggaatctgtgtggaggg

SEQ ID NO: 7105055 - DNA, 18 bp, Homo sapiens
gagcagaggctcaactgg

SEQ ID NO: 7105056 - DNA, 22 bp, Homo sapiens
gagcagagtctatttccacact

SEQ ID NO: 7105057 - DNA, 22 bp, Homo sapiens
gagcagagtctatttccacact

SEQ ID NO: 7105058 - DNA, 22 bp, Homo sapiens
gagcagatgtgtgccaggatgc

SEQ ID NO: 7105059 - DNA, 22 bp, Homo sapiens
gagcagcaaagggagggtaaat

SEQ ID NO: 7105060 - DNA, 22 bp, Homo sapiens
gagcagcaagcactcaaaggct

SEQ ID NO: 7105061 - DNA, 22 bp, Homo sapiens
gagcagcactgagttagcagct

SEQ ID NO: 7105062 - DNA, 22 bp, Homo sapiens
gagcagcacttgaggcatgtca

SEQ ID NO: 7105063 - DNA, 22 bp, Homo sapiens
gagcagcacttgaggcatgtca

SEQ ID NO: 7105064 - DNA, 22 bp, Homo sapiens
gagcagcagattgtctccatgg

SEQ ID NO: 7105065 - DNA, 22 bp, Homo sapiens
gagcagcagattgtctccatgg

SEQ ID NO: 7105066 - DNA, 22 bp, Homo sapiens
gagcagcagattgtctccatgg

SEQ ID NO: 7105067 - DNA, 22 bp, Homo sapiens
gagcagcagctgggccaggttc

SEQ ID NO: 7105068 - DNA, 22 bp, Homo sapiens
gagcagcagctgggccaggttc

SEQ ID NO: 7105069 - DNA, 22 bp, Homo sapiens
gagcagcagctgggccaggttc

SEQ ID NO: 7105070 - DNA, 22 bp, Homo sapiens
gagcagcagctgggccaggttc

SEQ ID NO: 7105071 - DNA, 22 bp, Homo sapiens
gagcagcatctccggcttaaag

SEQ ID NO: 7105072 - DNA, 22 bp, Homo sapiens
gagcagcaggtggggctggctt

SEQ ID NO: 7105073 - DNA, 22 bp, Homo sapiens
gagcagcagttgttacaatgat

SEQ ID NO: 7105074 - DNA, 22 bp, Homo sapiens
gagcagcagttgttacaatgat

SEQ ID NO: 7105075 - DNA, 22 bp, Homo sapiens
gagcagcaggtggggctggctt

SEQ ID NO: 7105076 - DNA, 22 bp, Homo sapiens
gagcagcaggtggggctggctt

SEQ ID NO: 7105077 - DNA, 22 bp, Homo sapiens
gagcagcaggtggggctggctt

SEQ ID NO: 7105078 - DNA, 22 bp, Homo sapiens
gagcagcaggtggggctggctt

SEQ ID NO: 7105079 - DNA, 18 bp, Homo sapiens
gagcagcaggatcaagaa

SEQ ID NO: 7105080 - DNA, 18 bp, Homo sapiens
gagcagcaggatcaagaa

SEQ ID NO: 7105081 - DNA, 22 bp, Homo sapiens
gagcagcaggccaggttgcagg

SEQ ID NO: 7105082 - DNA, 22 bp, Homo sapiens
gagcagcaggccaggttgcagg

SEQ ID NO: 7105083 - DNA, 22 bp, Homo sapiens
gagcagcaggccaggttgcagg

SEQ ID NO: 7105084 - DNA, 22 bp, Homo sapiens
gagcagcaggccaggttgcagg

SEQ ID NO: 7105085 - DNA, 22 bp, Homo sapiens
gagcagcaggtggctgtgatgg

SEQ ID NO: 7105086 - DNA, 22 bp, Homo sapiens
gagcagcaggtggctgtgatgg

SEQ ID NO: 7105087 - DNA, 22 bp, Homo sapiens
gagcagcaggtggctgtgatgg

SEQ ID NO: 7105088 - DNA, 22 bp, Homo sapiens
gaggcacatcacttggtgcatt

SEQ ID NO: 7105089 - DNA, 22 bp, Homo sapiens
gaggcaatgggctatagcattg

SEQ ID NO: 7105090 - DNA, 22 bp, Homo sapiens
gaggcacaatacatgtctcaag

SEQ ID NO: 7105091 - DNA, 22 bp, Homo sapiens
gaggcaccagacatggcctcat

SEQ ID NO: 7105092 - DNA, 22 bp, Homo sapiens
gaggcaccagacatggcctcat

SEQ ID NO: 7105093 - DNA, 22 bp, Homo sapiens
gaggcacatgactcaccaatgg

SEQ ID NO: 7105094 - DNA, 22 bp, Homo sapiens
gaggcactgagagtgggggatg

SEQ ID NO: 7105095 - DNA, 22 bp, Homo sapiens
gaggcacctcgcgggaggaggc

SEQ ID NO: 7105096 - DNA, 23 bp, Homo sapiens
gaggcactcaggaaatgtgagtg

SEQ ID NO: 7105097 - DNA, 22 bp, Homo sapiens
gaggcagagactccaccttcag

SEQ ID NO: 7105098 - DNA, 22 bp, Homo sapiens
gaggcagagactccaccttcag

SEQ ID NO: 7105099 - DNA, 22 bp, Homo sapiens
gaggcagagactccaccttcag

SEQ ID NO: 7105100 - DNA, 22 bp, Homo sapiens
gaggcagagaccttcaggacct

SEQ ID NO: 7105101 - DNA, 22 bp, Homo sapiens
gaggcagagaccttcaggacct

SEQ ID NO: 7105102 - DNA, 22 bp, Homo sapiens
gaggcagagaccttcaggacct

SEQ ID NO: 7105103 - DNA, 22 bp, Homo sapiens
gaggcagaagttgcagtgagca

SEQ ID NO: 7105104 - DNA, 22 bp, Homo sapiens
gaggcagaagttgcagtgagca

SEQ ID NO: 7105105 - DNA, 22 bp, Homo sapiens
gaggcagaagttgcagtgagca

SEQ ID NO: 7105106 - DNA, 22 bp, Homo sapiens
gaggcagaagttgcagtgagca

SEQ ID NO: 7105107 - DNA, 22 bp, Homo sapiens
gaggcagaagttgcagtgagca

SEQ ID NO: 7105108 - DNA, 22 bp, Homo sapiens
gaggcagaagttgcagtgagca

SEQ ID NO: 7105109 - DNA, 22 bp, Homo sapiens
gaggcagaagttgcagtgagca

SEQ ID NO: 7105110 - DNA, 22 bp, Homo sapiens
gaggccagcccctcttgaaggc

SEQ ID NO: 7105111 - DNA, 22 bp, Homo sapiens
gaggccagcccctcttgaaggc

SEQ ID NO: 7105112 - DNA, 22 bp, Homo sapiens
gaggccagcccctcttgaaggc

SEQ ID NO: 7105113 - DNA, 22 bp, Homo sapiens
gaggccagcccctcttgaaggc

SEQ ID NO: 7105114 - DNA, 22 bp, Homo sapiens
gaggccagcccctcttgaaggc

SEQ ID NO: 7105115 - DNA, 22 bp, Homo sapiens
gaggccagcgcgcagcactttt

SEQ ID NO: 7105116 - DNA, 22 bp, Homo sapiens
gaggccagcgcgcagcactttt

SEQ ID NO: 7105117 - DNA, 22 bp, Homo sapiens
gaggccagcgcgcagcactttt

SEQ ID NO: 7105118 - DNA, 22 bp, Homo sapiens
gaggccagatgtcatgtcttat

SEQ ID NO: 7105119 - DNA, 22 bp, Homo sapiens
gaggccagatgtcatgtcttat

SEQ ID NO: 7105120 - DNA, 22 bp, Homo sapiens
gaggcagaggaaggtggtctct

SEQ ID NO: 7105121 - DNA, 22 bp, Homo sapiens
gaggcagaggttgcagtgagct

SEQ ID NO: 7105122 - DNA, 22 bp, Homo sapiens
gaggcagaggttgcagtgagct

SEQ ID NO: 7105123 - DNA, 22 bp, Homo sapiens
gaggcagaggaaggtggtctct

SEQ ID NO: 7105124 - DNA, 22 bp, Homo sapiens
gaggcagaggaaggtggtctct

SEQ ID NO: 7105125 - DNA, 22 bp, Homo sapiens
gaggccaggacatgaaagctga

SEQ ID NO: 7105126 - DNA, 22 bp, Homo sapiens
gaggccaggacatgaaagctga

SEQ ID NO: 7105127 - DNA, 22 bp, Homo sapiens
gaggccaggacatgaaagctga

SEQ ID NO: 7105128 - DNA, 22 bp, Homo sapiens
gaggccaggacatgaaagctga

SEQ ID NO: 7105129 - DNA, 22 bp, Homo sapiens
gaggccaggaggatctctctaa

SEQ ID NO: 7105130 - DNA, 22 bp, Homo sapiens
gaggccaggaagcccaagatca

SEQ ID NO: 7105131 - DNA, 22 bp, Homo sapiens
gaggccaggaagcccaagatca

SEQ ID NO: 7105132 - DNA, 22 bp, Homo sapiens
gaggccaggaagcccaagatca

SEQ ID NO: 7105133 - DNA, 22 bp, Homo sapiens
gaggccaggaagcccaagatca

SEQ ID NO: 7105134 - DNA, 22 bp, Homo sapiens
gaggccaggacatgaaagctga

SEQ ID NO: 7105135 - DNA, 22 bp, Homo sapiens
gaggccaggacatgaaagctga

SEQ ID NO: 7105136 - DNA, 22 bp, Homo sapiens
gaggccagctacccaagggtca

SEQ ID NO: 7105137 - DNA, 22 bp, Homo sapiens
gaggccagctagtccaggaagt

SEQ ID NO: 7105138 - DNA, 22 bp, Homo sapiens
gaggccagctagtccaggaagt

SEQ ID NO: 7105139 - DNA, 22 bp, Homo sapiens
gaggccagctagtccaggaagt

SEQ ID NO: 7105140 - DNA, 22 bp, Homo sapiens
gaggccagctagtccaggaagt

SEQ ID NO: 7105141 - DNA, 22 bp, Homo sapiens
gaggccagctacccaagggtca

SEQ ID NO: 7105142 - DNA, 22 bp, Homo sapiens
gaggccagcgcgcagcactttt

SEQ ID NO: 7105143 - DNA, 22 bp, Homo sapiens
gaggccagctacccaagggtca

SEQ ID NO: 7105144 - DNA, 22 bp, Homo sapiens
gaggaaaatgcaacaggaatgc

SEQ ID NO: 7105145 - DNA, 22 bp, Homo sapiens
gaggaaaatgcaacaggaatgc

SEQ ID NO: 7105146 - DNA, 22 bp, Homo sapiens
gaggaaaatgcaacaggaatgc

SEQ ID NO: 7105147 - DNA, 22 bp, Homo sapiens
gaggaaaatattcagggaggtt

SEQ ID NO: 7105148 - DNA, 22 bp, Homo sapiens
gaggaaaatattcagggaggtt

SEQ ID NO: 7105149 - DNA, 22 bp, Homo sapiens
gaggaaaatattcagggaggtt

SEQ ID NO: 7105150 - DNA, 22 bp, Homo sapiens
gaggaaaatattcagggaggtt

SEQ ID NO: 7105151 - DNA, 22 bp, Homo sapiens
gaggaaaataacaactaagggc

SEQ ID NO: 7105152 - DNA, 22 bp, Homo sapiens
gaggaaaataacaactaagggc

SEQ ID NO: 7105153 - DNA, 22 bp, Homo sapiens
gaggaaaataacaactaagggc

SEQ ID NO: 7105154 - DNA, 22 bp, Homo sapiens
gaggaaaataacaactaagggc

SEQ ID NO: 7105155 - DNA, 20 bp, Homo sapiens
gaggaaaagctgccaggcct

SEQ ID NO: 7105156 - DNA, 20 bp, Homo sapiens
gaggaaaagctgccaggcct

SEQ ID NO: 7105157 - DNA, 20 bp, Homo sapiens
gaggaaaagctgccaggcct

SEQ ID NO: 7105158 - DNA, 20 bp, Homo sapiens
gaggaaaagctgccaggcct

SEQ ID NO: 7105159 - DNA, 20 bp, Homo sapiens
gaggaaaagctgccaggcct

SEQ ID NO: 7105160 - DNA, 22 bp, Homo sapiens
gaggaaaagagacaggttattg

SEQ ID NO: 7105161 - DNA, 22 bp, Homo sapiens
gaggagcttgtgagaagatgtc

SEQ ID NO: 7105162 - DNA, 22 bp, Homo sapiens
gaggagctgtctttgtgatctt

SEQ ID NO: 7105163 - DNA, 22 bp, Homo sapiens
gaggagctgttccctcacctct

SEQ ID NO: 7105164 - DNA, 18 bp, Homo sapiens
gaggagccgtccctacta

SEQ ID NO: 7105165 - DNA, 22 bp, Homo sapiens
gaggaggctaagtgggctctgg

SEQ ID NO: 7105166 - DNA, 22 bp, Homo sapiens
gaggaggctatcagcaatcagg

SEQ ID NO: 7105167 - DNA, 22 bp, Homo sapiens
gaggaggctatcagcaatcagg

SEQ ID NO: 7105168 - DNA, 22 bp, Homo sapiens
gaggaggctatcagcaatcagg

SEQ ID NO: 7105169 - DNA, 19 bp, Homo sapiens
gaggcaaggagtttaagcc

SEQ ID NO: 7105170 - DNA, 22 bp, Homo sapiens
gaggaggccagtggaaggaagc

SEQ ID NO: 7105171 - DNA, 22 bp, Homo sapiens
gaggaggccagtggaaggaagc

SEQ ID NO: 7105172 - DNA, 22 bp, Homo sapiens
gaggaggctaagtgggctctgg

SEQ ID NO: 7105173 - DNA, 22 bp, Homo sapiens
gaggaggctaagtgggctctgg

SEQ ID NO: 7105174 - DNA, 22 bp, Homo sapiens
gaggaggctaagtgggctctgg

SEQ ID NO: 7105175 - DNA, 22 bp, Homo sapiens
gaggaggcacttgagcagatgt

SEQ ID NO: 7105176 - DNA, 22 bp, Homo sapiens
gaggaggcagcctatcccttag

SEQ ID NO: 7105177 - DNA, 22 bp, Homo sapiens
gaggaggcagcctatcccttag

SEQ ID NO: 7105178 - DNA, 22 bp, Homo sapiens
gaggaggccagtggaaggaagc

SEQ ID NO: 7105179 - DNA, 22 bp, Homo sapiens
gaggaggccagtggaaggaagc

SEQ ID NO: 7105180 - DNA, 22 bp, Homo sapiens
gaggaggaggaagtggaaccca

SEQ ID NO: 7105181 - DNA, 22 bp, Homo sapiens
gaggaggaagttctctgtaggc

SEQ ID NO: 7105182 - DNA, 22 bp, Homo sapiens
gaggaggaagttctctgtaggc

SEQ ID NO: 7105183 - DNA, 22 bp, Homo sapiens
gaggaggaggaagtggaaccca

SEQ ID NO: 7105184 - DNA, 22 bp, Homo sapiens
gaggaggaggaagtggaaccca

SEQ ID NO: 7105185 - DNA, 22 bp, Homo sapiens
gaggaggagtatatattagaat

SEQ ID NO: 7105186 - DNA, 22 bp, Homo sapiens
gaggaggcactagttagtgaca

SEQ ID NO: 7105187 - DNA, 22 bp, Homo sapiens
gaggaggcacttgagcagatgt

SEQ ID NO: 7105188 - DNA, 22 bp, Homo sapiens
gaggaggcacttgagcagatgt

SEQ ID NO: 7105189 - DNA, 22 bp, Homo sapiens
gaggaggcacttgagcagatgt

SEQ ID NO: 7105190 - DNA, 19 bp, Homo sapiens
gaggaggaaaactagtgta

SEQ ID NO: 7105191 - DNA, 19 bp, Homo sapiens
gaggaggaaaactagtgta

SEQ ID NO: 7105192 - DNA, 19 bp, Homo sapiens
gaggaggaaaactagtgta

SEQ ID NO: 7105193 - DNA, 19 bp, Homo sapiens
gaggaggaaaactagtgta

SEQ ID NO: 7105194 - DNA, 22 bp, Homo sapiens
gaggaggaaaccctgttcctct

SEQ ID NO: 7105195 - DNA, 22 bp, Homo sapiens
gaggaggaagttctctgtaggc

SEQ ID NO: 7105196 - DNA, 22 bp, Homo sapiens
gaggaggaaaccctgttcctct

SEQ ID NO: 7105197 - DNA, 22 bp, Homo sapiens
gaggaggaaaggagttgaaatg

SEQ ID NO: 7105198 - DNA, 22 bp, Homo sapiens
gaggaggaagttctctgtaggc

SEQ ID NO: 7105199 - DNA, 22 bp, Homo sapiens
gagctaggggtagtcaggagac

SEQ ID NO: 7105200 - DNA, 22 bp, Homo sapiens
gagctaggggtagtcaggagac

SEQ ID NO: 7105201 - DNA, 22 bp, Homo sapiens
gagctaggggtagtcaggagac

SEQ ID NO: 7105202 - DNA, 22 bp, Homo sapiens
gagctaggatatcatgagggta

SEQ ID NO: 7105203 - DNA, 22 bp, Homo sapiens
gagctactgaaatattgatttt

SEQ ID NO: 7105204 - DNA, 22 bp, Homo sapiens
gagctactgaaatattgatttt

SEQ ID NO: 7105205 - DNA, 22 bp, Homo sapiens
gagctactgaaatattgatttt

SEQ ID NO: 7105206 - DNA, 22 bp, Homo sapiens
gagctagagggagaagggcact

SEQ ID NO: 7105207 - DNA, 22 bp, Homo sapiens
gagctagagtttgtagggtaga

SEQ ID NO: 7105208 - DNA, 22 bp, Homo sapiens
gagcgggaggaacggctcgggc

SEQ ID NO: 7105209 - DNA, 22 bp, Homo sapiens
gagcgggggctgccgggatttg

SEQ ID NO: 7105210 - DNA, 22 bp, Homo sapiens
gagctacactgattcatttgtt

SEQ ID NO: 7105211 - DNA, 22 bp, Homo sapiens
gagctctgaaaaagcttgcctt

SEQ ID NO: 7105212 - DNA, 22 bp, Homo sapiens
gagctctgaaaaagcttgcctt

SEQ ID NO: 7105213 - DNA, 22 bp, Homo sapiens
gagctctgactgctgggtgaca

SEQ ID NO: 7105214 - DNA, 22 bp, Homo sapiens
gagctctgactgctgggtgaca

SEQ ID NO: 7105215 - DNA, 22 bp, Homo sapiens
gagctctgatgtttagtggaga

SEQ ID NO: 7105216 - DNA, 21 bp, Homo sapiens
gagctctcaggcaagaagcag

SEQ ID NO: 7105217 - DNA, 21 bp, Homo sapiens
gagctctctacttgcacattt

SEQ ID NO: 7105218 - DNA, 22 bp, Homo sapiens
gagctctctggggagatgggat

SEQ ID NO: 7105219 - DNA, 22 bp, Homo sapiens
gagctctgaaaaagcttgcctt

SEQ ID NO: 7105220 - DNA, 22 bp, Homo sapiens
gagctctgaaaaagcttgcctt

SEQ ID NO: 7105221 - DNA, 22 bp, Homo sapiens
gagctagtagaacaagtgagga

SEQ ID NO: 7105222 - DNA, 22 bp, Homo sapiens
gagctattgattactgaatcaa

SEQ ID NO: 7105223 - DNA, 22 bp, Homo sapiens
gagctattgattactgaatcaa

SEQ ID NO: 7105224 - DNA, 22 bp, Homo sapiens
gagctcagactcgggcctgggg

SEQ ID NO: 7105225 - DNA, 22 bp, Homo sapiens
gagctcagactcgggcctgggg

SEQ ID NO: 7105226 - DNA, 22 bp, Homo sapiens
gagctctgtgtagcctgagggt

SEQ ID NO: 7105227 - DNA, 22 bp, Homo sapiens
gagctctgtgtagcctgagggt

SEQ ID NO: 7105228 - DNA, 22 bp, Homo sapiens
gagctctgtgtagcctgagggt

SEQ ID NO: 7105229 - DNA, 22 bp, Homo sapiens
gagctctgtgtggcttgggtgg

SEQ ID NO: 7105230 - DNA, 22 bp, Homo sapiens
gagctctgtgtggcttgggtgg

SEQ ID NO: 7105231 - DNA, 22 bp, Homo sapiens
gagctctgttctcgtcctgctg

SEQ ID NO: 7105232 - DNA, 22 bp, Homo sapiens
gagctctgttctcgtcctgctg

SEQ ID NO: 7105233 - DNA, 22 bp, Homo sapiens
gagctctgttctcgtcctgctg

SEQ ID NO: 7105234 - DNA, 22 bp, Homo sapiens
gagctcttagatagggcaggaa

SEQ ID NO: 7105235 - DNA, 22 bp, Homo sapiens
gagctcttatagttctagcagt

SEQ ID NO: 7105236 - DNA, 22 bp, Homo sapiens
gagctcttatagttctagcagt

SEQ ID NO: 7105237 - DNA, 22 bp, Homo sapiens
gagctctgttctcgtcctgctg

SEQ ID NO: 7105238 - DNA, 22 bp, Homo sapiens
gagcctggacatctcaggccca

SEQ ID NO: 7105239 - DNA, 22 bp, Homo sapiens
gagcctggacatctcaggccca

SEQ ID NO: 7105240 - DNA, 22 bp, Homo sapiens
gagcctgcccctccaccaggat

SEQ ID NO: 7105241 - DNA, 22 bp, Homo sapiens
gagcctgcccctccaccaggat

SEQ ID NO: 7105242 - DNA, 22 bp, Homo sapiens
gagcctgcgagggagtaaggca

SEQ ID NO: 7105243 - DNA, 22 bp, Homo sapiens
gagcctggacatctcaggccca

SEQ ID NO: 7105244 - DNA, 22 bp, Homo sapiens
gagcctggagctggaacgaagc

SEQ ID NO: 7105245 - DNA, 22 bp, Homo sapiens
gagcctggagctggaacgaagc

SEQ ID NO: 7105246 - DNA, 22 bp, Homo sapiens
gagcctggagctggaacgaagc

SEQ ID NO: 7105247 - DNA, 22 bp, Homo sapiens
gagcctggattgtcaccgactt

SEQ ID NO: 7105248 - DNA, 22 bp, Homo sapiens
gagcctggattgtcaccgactt

SEQ ID NO: 7105249 - DNA, 22 bp, Homo sapiens
gagcctggattgtcaccgactt

SEQ ID NO: 7105250 - DNA, 22 bp, Homo sapiens
gagcggaggcttggaggccagc

SEQ ID NO: 7105251 - DNA, 22 bp, Homo sapiens
gagcctggattgaagtgggtgg

SEQ ID NO: 7105252 - DNA, 22 bp, Homo sapiens
gagcctggagctggaacgaagc

SEQ ID NO: 7105253 - DNA, 22 bp, Homo sapiens
gagcctggatagccttgttcca

SEQ ID NO: 7105254 - DNA, 22 bp, Homo sapiens
gagcctggattgaagtgggtgg

SEQ ID NO: 7105255 - DNA, 22 bp, Homo sapiens
gagcctggattgaagtgggtgg

SEQ ID NO: 7105256 - DNA, 22 bp, Homo sapiens
gagcctggattgaagtgggtgg

SEQ ID NO: 7105257 - DNA, 22 bp, Homo sapiens
gagcctggattgaagtgggtgg

SEQ ID NO: 7105258 - DNA, 22 bp, Homo sapiens
gagccctgttcaggcctcctca

SEQ ID NO: 7105259 - DNA, 22 bp, Homo sapiens
gagccaggtttgaatctcagtc

SEQ ID NO: 7105260 - DNA, 22 bp, Homo sapiens
gagccaggtttgaatctcagtc

SEQ ID NO: 7105261 - DNA, 22 bp, Homo sapiens
gagccaggtttgaatctcagtc

SEQ ID NO: 7105262 - DNA, 22 bp, Homo sapiens
gagccaggtttgaatctcagtc

SEQ ID NO: 7105263 - DNA, 22 bp, Homo sapiens
gagccaggtttgaatctcagtc

SEQ ID NO: 7105264 - DNA, 22 bp, Homo sapiens
gagccaggtttgaatctcagtc

SEQ ID NO: 7105265 - DNA, 22 bp, Homo sapiens
gagccctgttcaggcctcctca

SEQ ID NO: 7105266 - DNA, 22 bp, Homo sapiens
gagccctttccactgccctctg

SEQ ID NO: 7105267 - DNA, 22 bp, Homo sapiens
gagcccttttcctagatactgt

SEQ ID NO: 7105268 - DNA, 22 bp, Homo sapiens
gagcctcagggttttgttgaca

SEQ ID NO: 7105269 - DNA, 22 bp, Homo sapiens
gagcctcctcctggtgtgccga

SEQ ID NO: 7105270 - DNA, 22 bp, Homo sapiens
gagcctcctcctggtgtgccga

SEQ ID NO: 7105271 - DNA, 22 bp, Homo sapiens
gagcctcgtggcggccactgcg

SEQ ID NO: 7105272 - DNA, 22 bp, Homo sapiens
gagcctcgtggcggccactgcg

SEQ ID NO: 7105273 - DNA, 22 bp, Homo sapiens
gagcctgaatttgacctgctta

SEQ ID NO: 7105274 - DNA, 22 bp, Homo sapiens
gagcctgcagctttcacagcat

SEQ ID NO: 7105275 - DNA, 22 bp, Homo sapiens
gagctgaaatatgaagccaatt

SEQ ID NO: 7105276 - DNA, 22 bp, Homo sapiens
gagctctttgaacctgggcagt

SEQ ID NO: 7105277 - DNA, 22 bp, Homo sapiens
gagctgaacatcatggaaaggc

SEQ ID NO: 7105278 - DNA, 22 bp, Homo sapiens
gagctctttcctgcccatactg

SEQ ID NO: 7105279 - DNA, 22 bp, Homo sapiens
gagctcttttgccagtcactgc

SEQ ID NO: 7105280 - DNA, 22 bp, Homo sapiens
gagctcttccccatcttacatc

SEQ ID NO: 7105281 - DNA, 22 bp, Homo sapiens
gagctcttccccatcttacatc

SEQ ID NO: 7105282 - DNA, 22 bp, Homo sapiens
gagctcttcctttcaggaggcc

SEQ ID NO: 7105283 - DNA, 22 bp, Homo sapiens
gagctcttctaaagatggcaat

SEQ ID NO: 7105284 - DNA, 22 bp, Homo sapiens
gagctcttctggggtaagggac

SEQ ID NO: 7105285 - DNA, 22 bp, Homo sapiens
gagctcttgcttctagtccagg

SEQ ID NO: 7105286 - DNA, 22 bp, Homo sapiens
gagctctttaccaggtcaggac

SEQ ID NO: 7105287 - DNA, 18 bp, Homo sapiens
gagctgagaagaggatgc

SEQ ID NO: 7105288 - DNA, 22 bp, Homo sapiens
gagctgaattgctgccatttgc

SEQ ID NO: 7105289 - DNA, 18 bp, Homo sapiens
gagctgagaagaggatgc

SEQ ID NO: 7105290 - DNA, 18 bp, Homo sapiens
gagctgagaagaggatgc

SEQ ID NO: 7105291 - DNA, 22 bp, Homo sapiens
gagctgaatcagagatattatt

SEQ ID NO: 7105292 - DNA, 22 bp, Homo sapiens
gagctgaattgaagcaaggagc

SEQ ID NO: 7105293 - DNA, 19 bp, Homo sapiens
gagctgagagtagcactgg

SEQ ID NO: 7105294 - DNA, 22 bp, Homo sapiens
gagctgagatcatgtacactag

SEQ ID NO: 7105295 - DNA, 19 bp, Homo sapiens
gagctgagagtagcactgg

SEQ ID NO: 7105296 - DNA, 22 bp, Homo sapiens
gagcttcttgtttcttcatctg

SEQ ID NO: 7105297 - DNA, 22 bp, Homo sapiens
gagcttcctttttctgcatgac

SEQ ID NO: 7105298 - DNA, 22 bp, Homo sapiens
gagcttctcaacagttatctct

SEQ ID NO: 7105299 - DNA, 22 bp, Homo sapiens
gagcttcctgcaggtcactgtg

SEQ ID NO: 7105300 - DNA, 22 bp, Homo sapiens
gagcttcctgatgccgaccagt

SEQ ID NO: 7105301 - DNA, 22 bp, Homo sapiens
gagcttccctctgcagtccctg

SEQ ID NO: 7105302 - DNA, 22 bp, Homo sapiens
gagcttggaagcagatcctcac

SEQ ID NO: 7105303 - DNA, 22 bp, Homo sapiens
gagcttggacaagctctgaagg

SEQ ID NO: 7105304 - DNA, 22 bp, Homo sapiens
gagcttggatgtcttttgttca

SEQ ID NO: 7105305 - DNA, 22 bp, Homo sapiens
gagcttggcagtgtcactaggg

SEQ ID NO: 7105306 - DNA, 22 bp, Homo sapiens
gagcttggcagtgtcactaggg

SEQ ID NO: 7105307 - DNA, 22 bp, Homo sapiens
gagcttggcctcttgaacgtgg

SEQ ID NO: 7105308 - DNA, 22 bp, Homo sapiens
gagcttggctggacctcacgga

SEQ ID NO: 7105309 - DNA, 22 bp, Homo sapiens
gaggaaaagagacaggttattg

SEQ ID NO: 7105310 - DNA, 22 bp, Homo sapiens
gagcttaatagtcatgctttct

SEQ ID NO: 7105311 - DNA, 22 bp, Homo sapiens
gagcttagaactgtcctcgtaa

SEQ ID NO: 7105312 - DNA, 22 bp, Homo sapiens
gagcttagacttttcacttcca

SEQ ID NO: 7105313 - DNA, 20 bp, Homo sapiens
gagcttcaactcagcaaaca

SEQ ID NO: 7105314 - DNA, 20 bp, Homo sapiens
gagcttcaactcagcaaaca

SEQ ID NO: 7105315 - DNA, 22 bp, Homo sapiens
gagcttcacgggggacagcatt

SEQ ID NO: 7105316 - DNA, 22 bp, Homo sapiens
gagcttcacgggggacagcatt

SEQ ID NO: 7105317 - DNA, 22 bp, Homo sapiens
gagcttcagaatttaacagact

SEQ ID NO: 7105318 - DNA, 22 bp, Homo sapiens
gagcttcagagaccacttaact

SEQ ID NO: 7105319 - DNA, 22 bp, Homo sapiens
gagcttccatggacgccatctg

SEQ ID NO: 7105320 - DNA, 22 bp, Homo sapiens
gagcttccatccttactgtgtg

SEQ ID NO: 7105321 - DNA, 22 bp, Homo sapiens
gagcttccagagacatcagagt

SEQ ID NO: 7105322 - DNA, 22 bp, Homo sapiens
gagcttccagagacatcagagt

SEQ ID NO: 7105323 - DNA, 22 bp, Homo sapiens
gagcttcatgattgctttgctt

SEQ ID NO: 7105324 - DNA, 22 bp, Homo sapiens
gagcttcatatgttgcagagaa

SEQ ID NO: 7105325 - DNA, 22 bp, Homo sapiens
gagcttcagctgccatgactgt

SEQ ID NO: 7105326 - DNA, 22 bp, Homo sapiens
ctttatgtccaccagactgcaa

SEQ ID NO: 7105327 - DNA, 22 bp, Homo sapiens
ctttatgtccaccagactgcaa

SEQ ID NO: 7105328 - DNA, 22 bp, Homo sapiens
ctttatgtccttgaagagttgt

SEQ ID NO: 7105329 - DNA, 22 bp, Homo sapiens
ctttatgtccttgaagagttgt

SEQ ID NO: 7105330 - DNA, 22 bp, Homo sapiens
cttgtctttatttcatattcca

SEQ ID NO: 7105331 - DNA, 22 bp, Homo sapiens
ctttatgtactgtgtatttgaa

SEQ ID NO: 7105332 - DNA, 22 bp, Homo sapiens
cttgtctttatttcatattcca

SEQ ID NO: 7105333 - DNA, 22 bp, Homo sapiens
cttgtctgggcagcttgggagt

SEQ ID NO: 7105334 - DNA, 22 bp, Homo sapiens
cttgtctgtgtcggataaaact

SEQ ID NO: 7105335 - DNA, 23 bp, Homo sapiens
cttgtctaattcatggtgaaggc

SEQ ID NO: 7105336 - DNA, 22 bp, Homo sapiens
cttgtcagtgtactttcttttg

SEQ ID NO: 7105337 - DNA, 22 bp, Homo sapiens
cttgtcagccaattgtggattt

SEQ ID NO: 7105338 - DNA, 22 bp, Homo sapiens
cttgtccagatgtttgttaggt

SEQ ID NO: 7105339 - DNA, 22 bp, Homo sapiens
cttgtccccagcaggttggttt

SEQ ID NO: 7105340 - DNA, 22 bp, Homo sapiens
cttgtattcccctatctctaaa

SEQ ID NO: 7105341 - DNA, 23 bp, Homo sapiens
cttgtattcactcatttgggaac

SEQ ID NO: 7105342 - DNA, 22 bp, Homo sapiens
cttgtattcagagtggacatga

SEQ ID NO: 7105343 - DNA, 22 bp, Homo sapiens
cttgtattcagcatcttaacta

SEQ ID NO: 7105344 - DNA, 22 bp, Homo sapiens
cttgtattaagcttagagaggc

SEQ ID NO: 7105345 - DNA, 22 bp, Homo sapiens
cttgtattaggaagaatgcttt

SEQ ID NO: 7105346 - DNA, 22 bp, Homo sapiens
cttgtattaggaagaatgcttt

SEQ ID NO: 7105347 - DNA, 22 bp, Homo sapiens
cttgtcagccaattgtggattt

SEQ ID NO: 7105348 - DNA, 22 bp, Homo sapiens
cttgtcagccaattgtggattt

SEQ ID NO: 7105349 - DNA, 22 bp, Homo sapiens
cttgtcacagcacctcagtctc

SEQ ID NO: 7105350 - DNA, 21 bp, Homo sapiens
cttgtcacttcctcactgacc

SEQ ID NO: 7105351 - DNA, 22 bp, Homo sapiens
cttgtattctgcctaaccttca

SEQ ID NO: 7105352 - DNA, 22 bp, Homo sapiens
cttgtattctgcctaaccttca

SEQ ID NO: 7105353 - DNA, 22 bp, Homo sapiens
cttgtattcttccacttaagat

SEQ ID NO: 7105354 - DNA, 22 bp, Homo sapiens
cttgtattgctgttttgcatct

SEQ ID NO: 7105355 - DNA, 22 bp, Homo sapiens
cttgtagaattgaaatggtctc

SEQ ID NO: 7105356 - DNA, 22 bp, Homo sapiens
cttgtagacccctggactcacg

SEQ ID NO: 7105357 - DNA, 22 bp, Homo sapiens
cttgtagaattgaaatggtctc

SEQ ID NO: 7105358 - DNA, 22 bp, Homo sapiens
cttgtagaattgaaatggtctc

SEQ ID NO: 7105359 - DNA, 22 bp, Homo sapiens
cttgtacattgatttctgcatt

SEQ ID NO: 7105360 - DNA, 22 bp, Homo sapiens
cttgggtgctggaggctgccgc

SEQ ID NO: 7105361 - DNA, 22 bp, Homo sapiens
cttgggtgctggaggctgccgc

SEQ ID NO: 7105362 - DNA, 22 bp, Homo sapiens
cttgtacagggaggcctgtggt

SEQ ID NO: 7105363 - DNA, 20 bp, Homo sapiens
cttgtacatgataaagattt

SEQ ID NO: 7105364 - DNA, 20 bp, Homo sapiens
cttgtacatgataaagattt

SEQ ID NO: 7105365 - DNA, 22 bp, Homo sapiens
cttgggtcatctcttgcttctg

SEQ ID NO: 7105366 - DNA, 22 bp, Homo sapiens
cttgcccgcgaagaagctagga

SEQ ID NO: 7105367 - DNA, 22 bp, Homo sapiens
cttgggtaccttccatgtgtca

SEQ ID NO: 7105368 - DNA, 22 bp, Homo sapiens
cttgggtataaaacttggctat

SEQ ID NO: 7105369 - DNA, 22 bp, Homo sapiens
cttgggtataaaacttggctat

SEQ ID NO: 7105370 - DNA, 20 bp, Homo sapiens
cttgccagttccctggcaga

SEQ ID NO: 7105371 - DNA, 20 bp, Homo sapiens
cttgccagttccctggcaga

SEQ ID NO: 7105372 - DNA, 22 bp, Homo sapiens
cttgcccaccagtcagtggctt

SEQ ID NO: 7105373 - DNA, 20 bp, Homo sapiens
cttgcccagggtctcctgcc

SEQ ID NO: 7105374 - DNA, 20 bp, Homo sapiens
cttgcccagggtctcctgcc

SEQ ID NO: 7105375 - DNA, 22 bp, Homo sapiens
cttgcagtttaggtcctctgtg

SEQ ID NO: 7105376 - DNA, 22 bp, Homo sapiens
cttgcagtttaggtcctctgtg

SEQ ID NO: 7105377 - DNA, 18 bp, Homo sapiens
cttgcagtgtgtggagaa

SEQ ID NO: 7105378 - DNA, 20 bp, Homo sapiens
cttgcagtttcaccttcact

SEQ ID NO: 7105379 - DNA, 22 bp, Homo sapiens
cttgccagcacttggccagctg

SEQ ID NO: 7105380 - DNA, 22 bp, Homo sapiens
cttgccagggactcagtcaggg

SEQ ID NO: 7105381 - DNA, 22 bp, Homo sapiens
cttgccagggactcagtcaggg

SEQ ID NO: 7105382 - DNA, 22 bp, Homo sapiens
cttgccagtgttgcagaagctc

SEQ ID NO: 7105383 - DNA, 22 bp, Homo sapiens
cttgccagtgttgcagaagctc

SEQ ID NO: 7105384 - DNA, 22 bp, Homo sapiens
cttcctgcccacttcctgctgg

SEQ ID NO: 7105385 - DNA, 22 bp, Homo sapiens
cttcctgcccacttcctgctgg

SEQ ID NO: 7105386 - DNA, 22 bp, Homo sapiens
cttcctgcattgtgccagagtt

SEQ ID NO: 7105387 - DNA, 22 bp, Homo sapiens
cttcctgcattgtgccagagtt

SEQ ID NO: 7105388 - DNA, 22 bp, Homo sapiens
cttcctgcccacttcctgctgg

SEQ ID NO: 7105389 - DNA, 22 bp, Homo sapiens
cttcctgcccacttcctgctgg

SEQ ID NO: 7105390 - DNA, 22 bp, Homo sapiens
cttcctgcaggacagccatctg

SEQ ID NO: 7105391 - DNA, 22 bp, Homo sapiens
cttcctgcaggacagccatctg

SEQ ID NO: 7105392 - DNA, 18 bp, Homo sapiens
cttcctgactagctctgg

SEQ ID NO: 7105393 - DNA, 22 bp, Homo sapiens
cttcctgaggtgctgagcacag

SEQ ID NO: 7105394 - DNA, 22 bp, Homo sapiens
cttcctggatgaagcccagcat

SEQ ID NO: 7105395 - DNA, 22 bp, Homo sapiens
cttcctggatgagcaggctgat

SEQ ID NO: 7105396 - DNA, 22 bp, Homo sapiens
cttcctggatgagcaggctgat

SEQ ID NO: 7105397 - DNA, 22 bp, Homo sapiens
cttcctggatgagcaggctgat

SEQ ID NO: 7105398 - DNA, 22 bp, Homo sapiens
cttcctggcaaagcaatcagag

SEQ ID NO: 7105399 - DNA, 22 bp, Homo sapiens
cttcctggcaaagcaatcagag

SEQ ID NO: 7105400 - DNA, 22 bp, Homo sapiens
cttcctggcaaagcaatcagag

SEQ ID NO: 7105401 - DNA, 22 bp, Homo sapiens
cttcctggcaaagcaatcagag

SEQ ID NO: 7105402 - DNA, 22 bp, Homo sapiens
cttcctggatgaagcccagcat

SEQ ID NO: 7105403 - DNA, 22 bp, Homo sapiens
cttcctggatgaacagtagaaa

SEQ ID NO: 7105404 - DNA, 22 bp, Homo sapiens
cttcctggatgaacagtagaaa

SEQ ID NO: 7105405 - DNA, 22 bp, Homo sapiens
cttcctgctcccctgccaattc

SEQ ID NO: 7105406 - DNA, 19 bp, Homo sapiens
cttcctggaggagagcctc

SEQ ID NO: 7105407 - DNA, 19 bp, Homo sapiens
cttcctggaggagagcctc

SEQ ID NO: 7105408 - DNA, 19 bp, Homo sapiens
cttcctggaggagagcctc

SEQ ID NO: 7105409 - DNA, 19 bp, Homo sapiens
cttcctggaggagagcctc

SEQ ID NO: 7105410 - DNA, 22 bp, Homo sapiens
cttcctgggacacctaactcta

SEQ ID NO: 7105411 - DNA, 22 bp, Homo sapiens
cttcctgggacacctaactcta

SEQ ID NO: 7105412 - DNA, 22 bp, Homo sapiens
cttcctgggacacctaactcta

SEQ ID NO: 7105413 - DNA, 22 bp, Homo sapiens
cttcctggctcggtgcctcacc

SEQ ID NO: 7105414 - DNA, 22 bp, Homo sapiens
cttcctgggcaatgttctgctt

SEQ ID NO: 7105415 - DNA, 22 bp, Homo sapiens
cttcctgggcaatgttctgctt

SEQ ID NO: 7105416 - DNA, 22 bp, Homo sapiens
cttcctgggccctgcttaagca

SEQ ID NO: 7105417 - DNA, 22 bp, Homo sapiens
cttcctgggccctgcttaagca

SEQ ID NO: 7105418 - DNA, 22 bp, Homo sapiens
cttcctgggccctgcttaagca

SEQ ID NO: 7105419 - DNA, 22 bp, Homo sapiens
cttcctggctcggtgcctcacc

SEQ ID NO: 7105420 - DNA, 22 bp, Homo sapiens
cttcctggctcggtgcctcacc

SEQ ID NO: 7105421 - DNA, 22 bp, Homo sapiens
cttcctggctcggtgcctcacc

SEQ ID NO: 7105422 - DNA, 22 bp, Homo sapiens
cttcctggcatgggtctcatga

SEQ ID NO: 7105423 - DNA, 22 bp, Homo sapiens
cttcctggcatgggtctcatga

SEQ ID NO: 7105424 - DNA, 22 bp, Homo sapiens
cttcctggccattgccatggca

SEQ ID NO: 7105425 - DNA, 22 bp, Homo sapiens
cttcctggccattgccatggca

SEQ ID NO: 7105426 - DNA, 22 bp, Homo sapiens
cttgacactgtcactcaggcca

SEQ ID NO: 7105427 - DNA, 22 bp, Homo sapiens
cttgacacaatgaacatctgta

SEQ ID NO: 7105428 - DNA, 22 bp, Homo sapiens
cttcctgggtctggagactgga

SEQ ID NO: 7105429 - DNA, 22 bp, Homo sapiens
cttgacacaatgaacatctgta

SEQ ID NO: 7105430 - DNA, 22 bp, Homo sapiens
cttcctgggtcagcctggaggt

SEQ ID NO: 7105431 - DNA, 22 bp, Homo sapiens
cttcctgggccctgcttaagca

SEQ ID NO: 7105432 - DNA, 22 bp, Homo sapiens
cttcctgggtcagcctggaggt

SEQ ID NO: 7105433 - DNA, 22 bp, Homo sapiens
cttcctgggtcagcctggaggt

SEQ ID NO: 7105434 - DNA, 22 bp, Homo sapiens
cttcctgggtctggagactgga

SEQ ID NO: 7105435 - DNA, 22 bp, Homo sapiens
cttcctgggtctggagactgga

SEQ ID NO: 7105436 - DNA, 22 bp, Homo sapiens
cttgacagaaggttttatccta

SEQ ID NO: 7105437 - DNA, 22 bp, Homo sapiens
cttgacagtcccaggaaaatag

SEQ ID NO: 7105438 - DNA, 22 bp, Homo sapiens
cttgacattcttaataatttta

SEQ ID NO: 7105439 - DNA, 22 bp, Homo sapiens
cttgaccgaatatgatcacttc

SEQ ID NO: 7105440 - DNA, 22 bp, Homo sapiens
cttgaccgattctagtggacat

SEQ ID NO: 7105441 - DNA, 22 bp, Homo sapiens
cttgatggtggcagaagagtga

SEQ ID NO: 7105442 - DNA, 22 bp, Homo sapiens
cttgatttcagccttgtgatat

SEQ ID NO: 7105443 - DNA, 22 bp, Homo sapiens
cttgcacaaagtcacctagtca

SEQ ID NO: 7105444 - DNA, 22 bp, Homo sapiens
cttgcacaaagtcacctagtca

SEQ ID NO: 7105445 - DNA, 22 bp, Homo sapiens
cttgcacacatgtacatgtgta

SEQ ID NO: 7105446 - DNA, 22 bp, Homo sapiens
cttgcacacgtgtatgtacatg

SEQ ID NO: 7105447 - DNA, 22 bp, Homo sapiens
cttgcacagaactcttagaggt

SEQ ID NO: 7105448 - DNA, 22 bp, Homo sapiens
cttgcacaggatctgaagtggg

SEQ ID NO: 7105449 - DNA, 22 bp, Homo sapiens
cttgcacagtgactaacacgta

SEQ ID NO: 7105450 - DNA, 22 bp, Homo sapiens
cttgagaaaggaacaggaagct

SEQ ID NO: 7105451 - DNA, 22 bp, Homo sapiens
cttgagaaaggaacaggaagct

SEQ ID NO: 7105452 - DNA, 22 bp, Homo sapiens
cttgatctacatagtgaaaccc

SEQ ID NO: 7105453 - DNA, 22 bp, Homo sapiens
cttgatctacatagtgaaaccc

SEQ ID NO: 7105454 - DNA, 22 bp, Homo sapiens
cttgatgaggtatgaacctctc

SEQ ID NO: 7105455 - DNA, 22 bp, Homo sapiens
cttgatgagtcagaactgaagg

SEQ ID NO: 7105456 - DNA, 22 bp, Homo sapiens
cttgatggaggggccaggcttt

SEQ ID NO: 7105457 - DNA, 22 bp, Homo sapiens
cttgatggggtgatccagcacc

SEQ ID NO: 7105458 - DNA, 22 bp, Homo sapiens
cttgcagggctgatgggaagtg

SEQ ID NO: 7105459 - DNA, 22 bp, Homo sapiens
cttgcagtgtggccttgaagag

SEQ ID NO: 7105460 - DNA, 22 bp, Homo sapiens
cttgcaggcctttctagctcta

SEQ ID NO: 7105461 - DNA, 22 bp, Homo sapiens
cttgcagggctgatgggaagtg

SEQ ID NO: 7105462 - DNA, 22 bp, Homo sapiens
cttgcaggattttgctgctgta

SEQ ID NO: 7105463 - DNA, 22 bp, Homo sapiens
cttgcaggcagggcctcctgga

SEQ ID NO: 7105464 - DNA, 22 bp, Homo sapiens
cttgcaggcagggcctcctgga

SEQ ID NO: 7105465 - DNA, 22 bp, Homo sapiens
cttgcaggcagggcctcctgga

SEQ ID NO: 7105466 - DNA, 22 bp, Homo sapiens
cttgcaggcccagccttacaag

SEQ ID NO: 7105467 - DNA, 23 bp, Homo sapiens
cttgcaggaagcagatggcacac

SEQ ID NO: 7105468 - DNA, 23 bp, Homo sapiens
cttgcaggaagcagatggcacac

SEQ ID NO: 7105469 - DNA, 23 bp, Homo sapiens
cttgcaggaagcagatggcacac

SEQ ID NO: 7105470 - DNA, 20 bp, Homo sapiens
cttgcaggagtgggtagagt

SEQ ID NO: 7105471 - DNA, 22 bp, Homo sapiens
cttgcagaggctgttccagatg

SEQ ID NO: 7105472 - DNA, 22 bp, Homo sapiens
cttgcagaggctgttccagatg

SEQ ID NO: 7105473 - DNA, 22 bp, Homo sapiens
cttgcagatgtgactaaattaa

SEQ ID NO: 7105474 - DNA, 22 bp, Homo sapiens
cttgcacatggctgctttctcg

SEQ ID NO: 7105475 - DNA, 22 bp, Homo sapiens
cttgcacatgttttactctcca

SEQ ID NO: 7105476 - DNA, 22 bp, Homo sapiens
cttgcacatttcacacaatagg

SEQ ID NO: 7105477 - DNA, 22 bp, Homo sapiens
cttcagccagctggggatgcgg

SEQ ID NO: 7105478 - DNA, 22 bp, Homo sapiens
cttcagaagagttaagtgtgag

SEQ ID NO: 7105479 - DNA, 22 bp, Homo sapiens
cttcagaagcctgcagcctttg

SEQ ID NO: 7105480 - DNA, 22 bp, Homo sapiens
cttattttgctgatgacccagg

SEQ ID NO: 7105481 - DNA, 22 bp, Homo sapiens
cttattttgctgatgacccagg

SEQ ID NO: 7105482 - DNA, 22 bp, Homo sapiens
cttcaaaagccagaagcctgcg

SEQ ID NO: 7105483 - DNA, 22 bp, Homo sapiens
cttcaaaccacatgctgaaaat

SEQ ID NO: 7105484 - DNA, 19 bp, Homo sapiens
cttatttctggttttgggt

SEQ ID NO: 7105485 - DNA, 22 bp, Homo sapiens
cttatttgaatgtatgagtttt

SEQ ID NO: 7105486 - DNA, 22 bp, Homo sapiens
cttatttgagagaaaagaaact

SEQ ID NO: 7105487 - DNA, 22 bp, Homo sapiens
cttatttgagagaaaagaaact

SEQ ID NO: 7105488 - DNA, 22 bp, Homo sapiens
cttatttctccatccagagtca

SEQ ID NO: 7105489 - DNA, 22 bp, Homo sapiens
cttatttcctgacatggaaaga

SEQ ID NO: 7105490 - DNA, 22 bp, Homo sapiens
cttatttcagccctgggcaccc

SEQ ID NO: 7105491 - DNA, 22 bp, Homo sapiens
cttatttactgatccacagatg

SEQ ID NO: 7105492 - DNA, 22 bp, Homo sapiens
cttatttatgtctgtctctaat

SEQ ID NO: 7105493 - DNA, 22 bp, Homo sapiens
cttatttatgtctgtctctaat

SEQ ID NO: 7105494 - DNA, 22 bp, Homo sapiens
cttattttaagtcagtttgggt

SEQ ID NO: 7105495 - DNA, 22 bp, Homo sapiens
cttattttgctgatgacccagg

SEQ ID NO: 7105496 - DNA, 22 bp, Homo sapiens
cttattttgctgatgacccagg

SEQ ID NO: 7105497 - DNA, 22 bp, Homo sapiens
cttattttaagtcagtttgggt

SEQ ID NO: 7105498 - DNA, 22 bp, Homo sapiens
cttattttaagtcagtttgggt

SEQ ID NO: 7105499 - DNA, 22 bp, Homo sapiens
cttatttgtactaataaatctg

SEQ ID NO: 7105500 - DNA, 22 bp, Homo sapiens
cttatttgcccatgtttcttta

SEQ ID NO: 7105501 - DNA, 22 bp, Homo sapiens
cttatttgcccatgtttcttta

SEQ ID NO: 7105502 - DNA, 22 bp, Homo sapiens
cttatattttaggaacagacaa

SEQ ID NO: 7105503 - DNA, 23 bp, Homo sapiens
cttattcattcatgtagcccatt

SEQ ID NO: 7105504 - DNA, 22 bp, Homo sapiens
ctgtttaaccagatctcatatc

SEQ ID NO: 7105505 - DNA, 22 bp, Homo sapiens
ctgtttaaccagatctcatatc

SEQ ID NO: 7105506 - DNA, 22 bp, Homo sapiens
cttatattttaggaacagacaa

SEQ ID NO: 7105507 - DNA, 22 bp, Homo sapiens
cttatattttaggaacagacaa

SEQ ID NO: 7105508 - DNA, 22 bp, Homo sapiens
cttatattttaggaacagacaa

SEQ ID NO: 7105509 - DNA, 22 bp, Homo sapiens
cttatattttaggaacagacaa

SEQ ID NO: 7105510 - DNA, 22 bp, Homo sapiens
ctgttgtagctgcgctgcttca

SEQ ID NO: 7105511 - DNA, 22 bp, Homo sapiens
ctgttgtccctgggagctcagc

SEQ ID NO: 7105512 - DNA, 22 bp, Homo sapiens
ctgttgtctatataagtttttc

SEQ ID NO: 7105513 - DNA, 22 bp, Homo sapiens
cttattgaaagcccctgtgcct

SEQ ID NO: 7105514 - DNA, 22 bp, Homo sapiens
cttattgaaagcccctgtgcct

SEQ ID NO: 7105515 - DNA, 22 bp, Homo sapiens
cttattggagagttgggccctt

SEQ ID NO: 7105516 - DNA, 22 bp, Homo sapiens
cttattggagagttgggccctt

SEQ ID NO: 7105517 - DNA, 22 bp, Homo sapiens
cttattgggatgagaggatgca

SEQ ID NO: 7105518 - DNA, 22 bp, Homo sapiens
cttattgggatgagaggatgca

SEQ ID NO: 7105519 - DNA, 22 bp, Homo sapiens
cttattggtcccaggaggagaa

SEQ ID NO: 7105520 - DNA, 22 bp, Homo sapiens
cttattggtcccaggaggagaa

SEQ ID NO: 7105521 - DNA, 22 bp, Homo sapiens
cttattggtgctttttctcata

SEQ ID NO: 7105522 - DNA, 22 bp, Homo sapiens
cttattggtgctttttctcata

SEQ ID NO: 7105523 - DNA, 22 bp, Homo sapiens
cttattggtggagtcaggccct

SEQ ID NO: 7105524 - DNA, 22 bp, Homo sapiens
cttattggtggagtcaggccct

SEQ ID NO: 7105525 - DNA, 22 bp, Homo sapiens
cttattgtcctgactcatggcc

SEQ ID NO: 7105526 - DNA, 22 bp, Homo sapiens
cttattgtcttacagtaataga

SEQ ID NO: 7105527 - DNA, 22 bp, Homo sapiens
cttattgtgagatgcgataatt

SEQ ID NO: 7105528 - DNA, 22 bp, Homo sapiens
cttattgtgaggtattgagatt

SEQ ID NO: 7105529 - DNA, 22 bp, Homo sapiens
cttattgtgataccatgcagta

SEQ ID NO: 7105530 - DNA, 22 bp, Homo sapiens
cttattgtgattcctgcctctt

SEQ ID NO: 7105531 - DNA, 22 bp, Homo sapiens
cttattgtgtctttgaataagt

SEQ ID NO: 7105532 - DNA, 22 bp, Homo sapiens
cttattgtgtgtattttctagt

SEQ ID NO: 7105533 - DNA, 22 bp, Homo sapiens
cttattgttcagatagagatga

SEQ ID NO: 7105534 - DNA, 22 bp, Homo sapiens
cttattgttcctggaccctgag

SEQ ID NO: 7105535 - DNA, 18 bp, Homo sapiens
cttattgtttaaatggcc

SEQ ID NO: 7105536 - DNA, 22 bp, Homo sapiens
cttatttaatgagggttagaat

SEQ ID NO: 7105537 - DNA, 22 bp, Homo sapiens
cttatttaatgagggttagaat

SEQ ID NO: 7105538 - DNA, 22 bp, Homo sapiens
cttatttactgatccacagatg

SEQ ID NO: 7105539 - DNA, 22 bp, Homo sapiens
cttatttactgatccacagatg

SEQ ID NO: 7105540 - DNA, 22 bp, Homo sapiens
cttatttactgatccacagatg

SEQ ID NO: 7105541 - DNA, 22 bp, Homo sapiens
cttatttactgatccacagatg

SEQ ID NO: 7105542 - DNA, 22 bp, Homo sapiens
cttcagcctcatctcagcccgt

SEQ ID NO: 7105543 - DNA, 22 bp, Homo sapiens
cttcagccctgagtgccagcag

SEQ ID NO: 7105544 - DNA, 22 bp, Homo sapiens
cttcagctgcagttatgtttag

SEQ ID NO: 7105545 - DNA, 22 bp, Homo sapiens
cttcagctgcagttatgtttag

SEQ ID NO: 7105546 - DNA, 22 bp, Homo sapiens
cttcaggatttaggaagatgaa

SEQ ID NO: 7105547 - DNA, 22 bp, Homo sapiens
cttcagtgattgcagaaagcct

SEQ ID NO: 7105548 - DNA, 22 bp, Homo sapiens
cttcagtgaatgttgagtaagg

SEQ ID NO: 7105549 - DNA, 22 bp, Homo sapiens
cttcagtctagggtgcacttga

SEQ ID NO: 7105550 - DNA, 22 bp, Homo sapiens
cttcagtctccaatgctctgtg

SEQ ID NO: 7105551 - DNA, 22 bp, Homo sapiens
cttcagtctccaatgctctgtg

SEQ ID NO: 7105552 - DNA, 19 bp, Homo sapiens
cttcagggaggggccaggc

SEQ ID NO: 7105553 - DNA, 22 bp, Homo sapiens
cttcctgaggtgctgagcacag

SEQ ID NO: 7105554 - DNA, 18 bp, Homo sapiens
cttcctgactagctctgg

SEQ ID NO: 7105555 - DNA, 22 bp, Homo sapiens
cttcctgagcaaggaactatag

SEQ ID NO: 7105556 - DNA, 22 bp, Homo sapiens
cttcctgaaggatggcagcctc

SEQ ID NO: 7105557 - DNA, 22 bp, Homo sapiens
cttcctgaaggatggcagcctc

SEQ ID NO: 7105558 - DNA, 22 bp, Homo sapiens
cttcctgaatcttccatgtata

SEQ ID NO: 7105559 - DNA, 18 bp, Homo sapiens
cttcctcttctggagaaa

SEQ ID NO: 7105560 - DNA, 22 bp, Homo sapiens
cttcctgaaagtagtaggttga

SEQ ID NO: 7105561 - DNA, 22 bp, Homo sapiens
cttcctgaaatgtctcaccagt

SEQ ID NO: 7105562 - DNA, 22 bp, Homo sapiens
cttcctgaaatgtctcaccagt

SEQ ID NO: 7105563 - DNA, 22 bp, Homo sapiens
cttcctgaacaatgccatcaat

SEQ ID NO: 7105564 - DNA, 22 bp, Homo sapiens
cttcctgaacaatgccatcaat

SEQ ID NO: 7105565 - DNA, 22 bp, Homo sapiens
cttcctgaacaatgccatcaat

SEQ ID NO: 7105566 - DNA, 22 bp, Homo sapiens
cttcctgaagaggttggtcagg

SEQ ID NO: 7105567 - DNA, 22 bp, Homo sapiens
cttcctgaacaatgccatcaat

SEQ ID NO: 7105568 - DNA, 22 bp, Homo sapiens
cttcctgaaggatggcagcctc

SEQ ID NO: 7105569 - DNA, 18 bp, Homo sapiens
cttcctcttctggagaaa

SEQ ID NO: 7105570 - DNA, 22 bp, Homo sapiens
cttcctctgtgtcctgggcttg

SEQ ID NO: 7105571 - DNA, 22 bp, Homo sapiens
cttcctctgtggccagagtgta

SEQ ID NO: 7105572 - DNA, 22 bp, Homo sapiens
cttcctctgtggccagagtgta

SEQ ID NO: 7105573 - DNA, 22 bp, Homo sapiens
cttcctctgtgtcctgggcttc

SEQ ID NO: 7105574 - DNA, 22 bp, Homo sapiens
cttcctctgcctcccgtgctca

SEQ ID NO: 7105575 - DNA, 22 bp, Homo sapiens
cttcctctgcctcccgtgctca

SEQ ID NO: 7105576 - DNA, 22 bp, Homo sapiens
cttcctctgcctcccgtgctca

SEQ ID NO: 7105577 - DNA, 22 bp, Homo sapiens
cttcctctgaggcttctgagtc

SEQ ID NO: 7105578 - DNA, 22 bp, Homo sapiens
cttcctaaaagcttcaagagaa

SEQ ID NO: 7105579 - DNA, 22 bp, Homo sapiens
cttcctaaaagcttcaagagaa

SEQ ID NO: 7105580 - DNA, 22 bp, Homo sapiens
cttccgtgtcagttccaggtgg

SEQ ID NO: 7105581 - DNA, 22 bp, Homo sapiens
cttcctctcttgcccataagag

SEQ ID NO: 7105582 - DNA, 22 bp, Homo sapiens
cttcctctgaggcttctgagtc

SEQ ID NO: 7105583 - DNA, 22 bp, Homo sapiens
cttccgtgtcagttccaggtgg

SEQ ID NO: 7105584 - DNA, 22 bp, Homo sapiens
cttccctttttatgtcttcagc

SEQ ID NO: 7105585 - DNA, 22 bp, Homo sapiens
ctgtgccatctttttgctacct

SEQ ID NO: 7105586 - DNA, 22 bp, Homo sapiens
ctgtgccattctttgtagcatg

SEQ ID NO: 7105587 - DNA, 22 bp, Homo sapiens
ctgtgcccagctccctgactgc

SEQ ID NO: 7105588 - DNA, 22 bp, Homo sapiens
ctgtgcccacctggctctgagg

SEQ ID NO: 7105589 - DNA, 22 bp, Homo sapiens
ctgtgcccagctccctgactgc

SEQ ID NO: 7105590 - DNA, 22 bp, Homo sapiens
ctgtgccagggtctattccaga

SEQ ID NO: 7105591 - DNA, 22 bp, Homo sapiens
ctgtgccatcctagggctgctg

SEQ ID NO: 7105592 - DNA, 22 bp, Homo sapiens
ctgtgccaggcccgggtgggtg

SEQ ID NO: 7105593 - DNA, 23 bp, Homo sapiens
ctgtggccctgcttcatgcagcc

SEQ ID NO: 7105594 - DNA, 23 bp, Homo sapiens
ctgtggccctgcttcatgcagcc

SEQ ID NO: 7105595 - DNA, 23 bp, Homo sapiens
ctgtggccctgcttcatgcagcc

SEQ ID NO: 7105596 - DNA, 22 bp, Homo sapiens
ctgtggctcatatctgtaatct

SEQ ID NO: 7105597 - DNA, 22 bp, Homo sapiens
ctgtggccagtcccacacctcc

SEQ ID NO: 7105598 - DNA, 22 bp, Homo sapiens
ctgtggccccaccctcttggcc

SEQ ID NO: 7105599 - DNA, 22 bp, Homo sapiens
ctgtggccccaccctcttggcc

SEQ ID NO: 7105600 - DNA, 22 bp, Homo sapiens
ctgtggccagagcgccgttgac

SEQ ID NO: 7105601 - DNA, 22 bp, Homo sapiens
ctgtggccagatggtgccagtt

SEQ ID NO: 7105602 - DNA, 22 bp, Homo sapiens
ctgtggccagatggtgccagtt

SEQ ID NO: 7105603 - DNA, 22 bp, Homo sapiens
ctgtggccagtcccacacctcc

SEQ ID NO: 7105604 - DNA, 19 bp, Homo sapiens
ctgtgccctatgacttgta

SEQ ID NO: 7105605 - DNA, 22 bp, Homo sapiens
ctgtgccctctttgctggcctt

SEQ ID NO: 7105606 - DNA, 23 bp, Homo sapiens
ctgtgcccggggctccacctgat

SEQ ID NO: 7105607 - DNA, 23 bp, Homo sapiens
ctgtgcccggggctccacctgat

SEQ ID NO: 7105608 - DNA, 23 bp, Homo sapiens
ctgtgcccggggctccacctgat

SEQ ID NO: 7105609 - DNA, 22 bp, Homo sapiens
ctgtgccccacagagctccaca

SEQ ID NO: 7105610 - DNA, 22 bp, Homo sapiens
ctgtgcccataatctggtattt

SEQ ID NO: 7105611 - DNA, 22 bp, Homo sapiens
ctgtgcccataatctggtattt

SEQ ID NO: 7105612 - DNA, 22 bp, Homo sapiens
ctgtgcattgttgagtgtttag

SEQ ID NO: 7105613 - DNA, 22 bp, Homo sapiens
ctgtgcatgtgttctctggtaa

SEQ ID NO: 7105614 - DNA, 22 bp, Homo sapiens
ctgtgcattgtcttgtctgtag

SEQ ID NO: 7105615 - DNA, 22 bp, Homo sapiens
ctgtgcattgtcttgtctgtag

SEQ ID NO: 7105616 - DNA, 22 bp, Homo sapiens
ctgtgcattgttgagtgtttag

SEQ ID NO: 7105617 - DNA, 22 bp, Homo sapiens
ctgtgcagtgtggggtaggcct

SEQ ID NO: 7105618 - DNA, 22 bp, Homo sapiens
ctgtgcagtgtggggtaggcct

SEQ ID NO: 7105619 - DNA, 22 bp, Homo sapiens
ctgtgcagtgtggggtaggcct

SEQ ID NO: 7105620 - DNA, 22 bp, Homo sapiens
ctgtgcagtgtggggtaggcct

SEQ ID NO: 7105621 - DNA, 22 bp, Homo sapiens
ctgtgcatggcagatgctgtta

SEQ ID NO: 7105622 - DNA, 22 bp, Homo sapiens
ctgtgcatggccatcagtgccc

SEQ ID NO: 7105623 - DNA, 22 bp, Homo sapiens
ctgtgcatggccatcagtgccc

SEQ ID NO: 7105624 - DNA, 22 bp, Homo sapiens
ctgtgccacctgagggactcta

SEQ ID NO: 7105625 - DNA, 22 bp, Homo sapiens
ctgtgccacctgagggactcta

SEQ ID NO: 7105626 - DNA, 22 bp, Homo sapiens
ctgtgccactgccctgccacgc

SEQ ID NO: 7105627 - DNA, 22 bp, Homo sapiens
ctgtgccactgccctgccacgc

SEQ ID NO: 7105628 - DNA, 22 bp, Homo sapiens
ctgtgccagcctgtcccaggag

SEQ ID NO: 7105629 - DNA, 22 bp, Homo sapiens
ctgtgccaggcccagctgactt

SEQ ID NO: 7105630 - DNA, 22 bp, Homo sapiens
ctgtgccaggcccagctgactt

SEQ ID NO: 7105631 - DNA, 22 bp, Homo sapiens
ctgtgcagtggcagcgtgtggg

SEQ ID NO: 7105632 - DNA, 22 bp, Homo sapiens
ctgtgcagtaggtcagggctgg

SEQ ID NO: 7105633 - DNA, 19 bp, Homo sapiens
ctgtgagtcttgtggcctc

SEQ ID NO: 7105634 - DNA, 22 bp, Homo sapiens
ctgtgcagtggcagcgtgtggg

SEQ ID NO: 7105635 - DNA, 22 bp, Homo sapiens
ctgtgcagtggcagcgtgtggg

SEQ ID NO: 7105636 - DNA, 22 bp, Homo sapiens
ctgtgcagtggcagcgtgtggg

SEQ ID NO: 7105637 - DNA, 22 bp, Homo sapiens
ctgtgcagtggcagcgtgtggg

SEQ ID NO: 7105638 - DNA, 19 bp, Homo sapiens
ctgtgagtcttgtggcctc

SEQ ID NO: 7105639 - DNA, 22 bp, Homo sapiens
ctgtgagtcttcagcaagtgtt

SEQ ID NO: 7105640 - DNA, 22 bp, Homo sapiens
ctgtgagggccagagtcagggc

SEQ ID NO: 7105641 - DNA, 22 bp, Homo sapiens
ctgtgagggccagagtcagggc

SEQ ID NO: 7105642 - DNA, 22 bp, Homo sapiens
ctgtgagggccagagtcagggc

SEQ ID NO: 7105643 - DNA, 23 bp, Homo sapiens
ctgtcctgtagttcacgttggcc

SEQ ID NO: 7105644 - DNA, 22 bp, Homo sapiens
ctgtcctgtgcattgtcagatg

SEQ ID NO: 7105645 - DNA, 22 bp, Homo sapiens
ctgtcctgtgcattgtcagatg

SEQ ID NO: 7105646 - DNA, 22 bp, Homo sapiens
ctgtcctgtgctttttactgtc

SEQ ID NO: 7105647 - DNA, 22 bp, Homo sapiens
ctgtcctgtggacctgaggacg

SEQ ID NO: 7105648 - DNA, 22 bp, Homo sapiens
ctgtcctgtagctccatcagtc

SEQ ID NO: 7105649 - DNA, 19 bp, Homo sapiens
ctgtcctggtttggtccct

SEQ ID NO: 7105650 - DNA, 22 bp, Homo sapiens
ctgtcctgtactttgaggccct

SEQ ID NO: 7105651 - DNA, 21 bp, Homo sapiens
ctgtcctggtctagaggcaca

SEQ ID NO: 7105652 - DNA, 21 bp, Homo sapiens
ctgtcctggtctagaggcaca

SEQ ID NO: 7105653 - DNA, 22 bp, Homo sapiens
ctgtcctggccgcccttgtgag

SEQ ID NO: 7105654 - DNA, 22 bp, Homo sapiens
ctgtcctggggaaagccagccc

SEQ ID NO: 7105655 - DNA, 22 bp, Homo sapiens
ctgtcctgggggtggtccttgc

SEQ ID NO: 7105656 - DNA, 22 bp, Homo sapiens
ctgtcctggagggcataggacg

SEQ ID NO: 7105657 - DNA, 22 bp, Homo sapiens
ctgtcctggagggcataggacg

SEQ ID NO: 7105658 - DNA, 22 bp, Homo sapiens
ctgtcctggagggcataggacg

SEQ ID NO: 7105659 - DNA, 22 bp, Homo sapiens
ctgtcctgcccaccctgcaggg

SEQ ID NO: 7105660 - DNA, 23 bp, Homo sapiens
ctgtcctgccatccacagcggcc

SEQ ID NO: 7105661 - DNA, 22 bp, Homo sapiens
ctgtcctgcccaccctgcaggg

SEQ ID NO: 7105662 - DNA, 22 bp, Homo sapiens
ctgtcctgcccaccctgcaggg

SEQ ID NO: 7105663 - DNA, 22 bp, Homo sapiens
ctgtcctgccagtcctggactc

SEQ ID NO: 7105664 - DNA, 23 bp, Homo sapiens
ctgtcctgccatccacagcggcc

SEQ ID NO: 7105665 - DNA, 22 bp, Homo sapiens
ctgtcctgccagtcctggactc

SEQ ID NO: 7105666 - DNA, 22 bp, Homo sapiens
ctgtcctgcagttgggggcagg

SEQ ID NO: 7105667 - DNA, 22 bp, Homo sapiens
ctgtcctgatggtgccactggt

SEQ ID NO: 7105668 - DNA, 22 bp, Homo sapiens
ctgtcctgatggtgccactggt

SEQ ID NO: 7105669 - DNA, 22 bp, Homo sapiens
ctgtcctgatggtgccactggt

SEQ ID NO: 7105670 - DNA, 22 bp, Homo sapiens
ctgtcctctgtcctcagcagga

SEQ ID NO: 7105671 - DNA, 22 bp, Homo sapiens
ctgtcctgaagttttcatgaga

SEQ ID NO: 7105672 - DNA, 22 bp, Homo sapiens
ctgtcctgaagttttcatgaga

SEQ ID NO: 7105673 - DNA, 22 bp, Homo sapiens
ctgtccctgagcaactcctgtt

SEQ ID NO: 7105674 - DNA, 22 bp, Homo sapiens
ctgtcccttcattattcactac

SEQ ID NO: 7105675 - DNA, 22 bp, Homo sapiens
ctgggtgccacgggcaccctgg

SEQ ID NO: 7105676 - DNA, 22 bp, Homo sapiens
ctgggtgccagcatggctgagt

SEQ ID NO: 7105677 - DNA, 22 bp, Homo sapiens
ctgggtgcgtgagcgcatgcgt

SEQ ID NO: 7105678 - DNA, 22 bp, Homo sapiens
ctgggtgaatttgaaggaaagg

SEQ ID NO: 7105679 - DNA, 22 bp, Homo sapiens
ctgggtgaatttgaaggaaagg

SEQ ID NO: 7105680 - DNA, 22 bp, Homo sapiens
ctgggtcttcagcagcaggcgg

SEQ ID NO: 7105681 - DNA, 19 bp, Homo sapiens
ctgggtcttattctgtgaa

SEQ ID NO: 7105682 - DNA, 22 bp, Homo sapiens
ctgggtgattcctgtccaggca

SEQ ID NO: 7105683 - DNA, 22 bp, Homo sapiens
ctgggtgattcctgtccaggca

SEQ ID NO: 7105684 - DNA, 22 bp, Homo sapiens
ctgggtgagttgatgaaggaga

SEQ ID NO: 7105685 - DNA, 22 bp, Homo sapiens
ctgggtgagttgatgaaggaga

SEQ ID NO: 7105686 - DNA, 22 bp, Homo sapiens
ctgggtgacagagtgagatggt

SEQ ID NO: 7105687 - DNA, 22 bp, Homo sapiens
ctgggtgacagagtgagatggt

SEQ ID NO: 7105688 - DNA, 22 bp, Homo sapiens
ctgggtgagtataggaaaggga

SEQ ID NO: 7105689 - DNA, 18 bp, Homo sapiens
ctgttcagctgaactaca

SEQ ID NO: 7105690 - DNA, 22 bp, Homo sapiens
ctgttcagaaaaaatcttcatg

SEQ ID NO: 7105691 - DNA, 22 bp, Homo sapiens
ctgttctgaactgcctgcatgc

SEQ ID NO: 7105692 - DNA, 22 bp, Homo sapiens
ctgttctgaactgcctgcatgc

SEQ ID NO: 7105693 - DNA, 22 bp, Homo sapiens
ctgttctgaccagtgcagggat

SEQ ID NO: 7105694 - DNA, 22 bp, Homo sapiens
ctgttctgaccagtgcagggat

SEQ ID NO: 7105695 - DNA, 22 bp, Homo sapiens
ctgttcctgtagagtccaagtc

SEQ ID NO: 7105696 - DNA, 22 bp, Homo sapiens
ctgttctccggccagtccagag

SEQ ID NO: 7105697 - DNA, 22 bp, Homo sapiens
ctgttgctccagggaacacaga

SEQ ID NO: 7105698 - DNA, 22 bp, Homo sapiens
ctgttgcagaggggcggagagg

SEQ ID NO: 7105699 - DNA, 22 bp, Homo sapiens
ctgttctgaccagtgcagggat

SEQ ID NO: 7105700 - DNA, 22 bp, Homo sapiens
ctgttctgctgcataaaaactt

SEQ ID NO: 7105701 - DNA, 22 bp, Homo sapiens
ctgttctgtctcatgttgcaca

SEQ ID NO: 7105702 - DNA, 22 bp, Homo sapiens
ctgttcttatcgtcttaatatc

SEQ ID NO: 7105703 - DNA, 22 bp, Homo sapiens
ctgttcttatcgtcttaatatc

SEQ ID NO: 7105704 - DNA, 18 bp, Homo sapiens
ctgttgagatgtggctga

SEQ ID NO: 7105705 - DNA, 22 bp, Homo sapiens
ctgttaatggaggactacagga

SEQ ID NO: 7105706 - DNA, 22 bp, Homo sapiens
ctgtgtcttctgcttacagtct

SEQ ID NO: 7105707 - DNA, 22 bp, Homo sapiens
ctgtgtcttctgttttgaagtt

SEQ ID NO: 7105708 - DNA, 22 bp, Homo sapiens
ctgtgtcttctgttttgaagtt

SEQ ID NO: 7105709 - DNA, 22 bp, Homo sapiens
ctgttacaagagagagacatga

SEQ ID NO: 7105710 - DNA, 22 bp, Homo sapiens
ctgtgtcttcaatgtactggga

SEQ ID NO: 7105711 - DNA, 22 bp, Homo sapiens
ctgtgtcttcaatgtactggga

SEQ ID NO: 7105712 - DNA, 22 bp, Homo sapiens
ctgtgtctgtggaatagcgaat

SEQ ID NO: 7105713 - DNA, 22 bp, Homo sapiens
ctgtgtctgtggaatagcgaat

SEQ ID NO: 7105714 - DNA, 22 bp, Homo sapiens
ctgtgtctgtggaatagcgaat

SEQ ID NO: 7105715 - DNA, 22 bp, Homo sapiens
ctgtgtcttcaatgtactggga

SEQ ID NO: 7105716 - DNA, 22 bp, Homo sapiens
ctgtgtcttcacatttgtgtgc

SEQ ID NO: 7105717 - DNA, 22 bp, Homo sapiens
ctgtgtcttcacatttgtgtgc

SEQ ID NO: 7105718 - DNA, 22 bp, Homo sapiens
ctgtgtcttcctctgcccaggc

SEQ ID NO: 7105719 - DNA, 22 bp, Homo sapiens
ctgtgtcttcctctgcccaggc

SEQ ID NO: 7105720 - DNA, 22 bp, Homo sapiens
ctgtgtcttcctctgcccaggc

SEQ ID NO: 7105721 - DNA, 22 bp, Homo sapiens
ctgtgtcttctgcttacagtct

SEQ ID NO: 7105722 - DNA, 22 bp, Homo sapiens
ctgtgtcttctgcttacagtct

SEQ ID NO: 7105723 - DNA, 22 bp, Homo sapiens
ctgtgtcttctgcttacagtct

SEQ ID NO: 7105724 - DNA, 22 bp, Homo sapiens
ctgtgtctgcctgggatccatt

SEQ ID NO: 7105725 - DNA, 22 bp, Homo sapiens
ctgtgtctgcctgggatccatt

SEQ ID NO: 7105726 - DNA, 22 bp, Homo sapiens
ctgtgtctgcctgggatccatt

SEQ ID NO: 7105727 - DNA, 22 bp, Homo sapiens
ctgtgtctctccttacaagact

SEQ ID NO: 7105728 - DNA, 22 bp, Homo sapiens
ctgtgtctctccttacaagact

SEQ ID NO: 7105729 - DNA, 22 bp, Homo sapiens
ctgtgtctctccttacaagact

SEQ ID NO: 7105730 - DNA, 22 bp, Homo sapiens
ctgtgtctctccttacaagact

SEQ ID NO: 7105731 - DNA, 22 bp, Homo sapiens
ctgtgtctgaataactctgtgt

SEQ ID NO: 7105732 - DNA, 22 bp, Homo sapiens
ctgtgtctgaataactctgtgt

SEQ ID NO: 7105733 - DNA, 22 bp, Homo sapiens
ctgtgtctgaataactctgtgt

SEQ ID NO: 7105734 - DNA, 22 bp, Homo sapiens
ctgtgtctcatccgcctctggc

SEQ ID NO: 7105735 - DNA, 22 bp, Homo sapiens
ctgtgtctcccaaggagggtca

SEQ ID NO: 7105736 - DNA, 22 bp, Homo sapiens
ctgtgtctcccaaggagggtca

SEQ ID NO: 7105737 - DNA, 22 bp, Homo sapiens
ctgtgtctcccaaggagggtca

SEQ ID NO: 7105738 - DNA, 22 bp, Homo sapiens
ctgtgtctccttggtgggatat

SEQ ID NO: 7105739 - DNA, 22 bp, Homo sapiens
ctgtgtctccttggtgggatat

SEQ ID NO: 7105740 - DNA, 22 bp, Homo sapiens
ctgtgtctcgttaaagcattgg

SEQ ID NO: 7105741 - DNA, 22 bp, Homo sapiens
ctgtgtctcgttaaagcattgg

SEQ ID NO: 7105742 - DNA, 22 bp, Homo sapiens
ctgtgtctcgttaaagcattgg

SEQ ID NO: 7105743 - DNA, 22 bp, Homo sapiens
ctgtgtctctacctccccatcc

SEQ ID NO: 7105744 - DNA, 22 bp, Homo sapiens
ctgtgtctctacctccccatcc

SEQ ID NO: 7105745 - DNA, 22 bp, Homo sapiens
ctgtgtctctacctccccatcc

SEQ ID NO: 7105746 - DNA, 22 bp, Homo sapiens
ctgtggctggccttattgctgc

SEQ ID NO: 7105747 - DNA, 22 bp, Homo sapiens
ctgtggctggcctgtctgacat

SEQ ID NO: 7105748 - DNA, 22 bp, Homo sapiens
ctgtggctgcgtaggtctggca

SEQ ID NO: 7105749 - DNA, 22 bp, Homo sapiens
ctgtggctggcctgtctgacat

SEQ ID NO: 7105750 - DNA, 22 bp, Homo sapiens
ctgtggctgtatttggccagag

SEQ ID NO: 7105751 - DNA, 22 bp, Homo sapiens
ctgtggctgtgaaacttctcag

SEQ ID NO: 7105752 - DNA, 22 bp, Homo sapiens
ctgtggctgtctctttcccatg

SEQ ID NO: 7105753 - DNA, 22 bp, Homo sapiens
ctgtggctgtctctttcccatg

SEQ ID NO: 7105754 - DNA, 22 bp, Homo sapiens
ctgtgtacccacgtgggcaccc

SEQ ID NO: 7105755 - DNA, 22 bp, Homo sapiens
ctgtgtagcctcatgtgggctt

SEQ ID NO: 7105756 - DNA, 22 bp, Homo sapiens
ctgtggtggcctccctgccatg

SEQ ID NO: 7105757 - DNA, 22 bp, Homo sapiens
ctgtggtggcctccctgccatg

SEQ ID NO: 7105758 - DNA, 22 bp, Homo sapiens
ctgtggtgggccctgggcttca

SEQ ID NO: 7105759 - DNA, 22 bp, Homo sapiens
ctgtggtgggccctgggcttca

SEQ ID NO: 7105760 - DNA, 22 bp, Homo sapiens
ctgtgtagtcaggtggtcccac

SEQ ID NO: 7105761 - DNA, 22 bp, Homo sapiens
ctgtgtcctccccatcacttct

SEQ ID NO: 7105762 - DNA, 22 bp, Homo sapiens
ctgtgtcctcccgctgcaccca

SEQ ID NO: 7105763 - DNA, 22 bp, Homo sapiens
ctgtgtcctcccgctgcaccca

SEQ ID NO: 7105764 - DNA, 22 bp, Homo sapiens
ctgtgtcctgcgtcaagccaat

SEQ ID NO: 7105765 - DNA, 22 bp, Homo sapiens
ctgtgtcctgtctcctaaggtg

SEQ ID NO: 7105766 - DNA, 22 bp, Homo sapiens
ctgtgtcctgtctcctaaggtg

SEQ ID NO: 7105767 - DNA, 22 bp, Homo sapiens
ctgtgtcctttaaaaaagacac

SEQ ID NO: 7105768 - DNA, 22 bp, Homo sapiens
ctgtgtccttttagttgctgtg

SEQ ID NO: 7105769 - DNA, 22 bp, Homo sapiens
ctgtgtcctgtctcctaaggtg

SEQ ID NO: 7105770 - DNA, 22 bp, Homo sapiens
ctgtgtctaatcaggtcagtca

SEQ ID NO: 7105771 - DNA, 22 bp, Homo sapiens
ctgtgtctaatcaggtcagtca

SEQ ID NO: 7105772 - DNA, 22 bp, Homo sapiens
ctgtgtctaatcaggtcagtca

SEQ ID NO: 7105773 - DNA, 22 bp, Homo sapiens
ctgtgtctaatcaggtcagtca

SEQ ID NO: 7105774 - DNA, 22 bp, Homo sapiens
ctgtgtctaatcttatacatca

SEQ ID NO: 7105775 - DNA, 22 bp, Homo sapiens
ctgtgtctaatcttatacatca

SEQ ID NO: 7105776 - DNA, 22 bp, Homo sapiens
ctgtgtctaatcttatacatca

SEQ ID NO: 7105777 - DNA, 23 bp, Homo sapiens
ctgtgtctatgcagccatatcca

SEQ ID NO: 7105778 - DNA, 23 bp, Homo sapiens
ctgtgtctatgcagccatatcca

SEQ ID NO: 7105779 - DNA, 22 bp, Homo sapiens
ctgtgtctcatccgcctctggc

SEQ ID NO: 7105780 - DNA, 22 bp, Homo sapiens
ctgtgtctcatccgcctctggc

SEQ ID NO: 7105781 - DNA, 19 bp, Homo sapiens
ctgtggctgacctctggcc

SEQ ID NO: 7105782 - DNA, 22 bp, Homo sapiens
ctgtggctgaactctgaagagg

SEQ ID NO: 7105783 - DNA, 22 bp, Homo sapiens
ctgtggctctgcagtcccaaca

SEQ ID NO: 7105784 - DNA, 22 bp, Homo sapiens
ctgtggctgcgtaggtctggca

SEQ ID NO: 7105785 - DNA, 22 bp, Homo sapiens
ctgtggctgcgccatcgaaaac

SEQ ID NO: 7105786 - DNA, 22 bp, Homo sapiens
ctgtggctgcgccctgggggag

SEQ ID NO: 7105787 - DNA, 22 bp, Homo sapiens
ctgtggctctcagaggctgctg

SEQ ID NO: 7105788 - DNA, 22 bp, Homo sapiens
ctgtggctccatagaagttgca

SEQ ID NO: 7105789 - DNA, 20 bp, Homo sapiens
ctgtggctcatgcatctgcc

SEQ ID NO: 7105790 - DNA, 23 bp, Homo sapiens
ctggggctcattgcagtagccat

SEQ ID NO: 7105791 - DNA, 22 bp, Homo sapiens
ctggggctcactttggtcaggc

SEQ ID NO: 7105792 - DNA, 22 bp, Homo sapiens
ctggggctcactttggtcaggc

SEQ ID NO: 7105793 - DNA, 22 bp, Homo sapiens
ctggggctcactttggtcaggc

SEQ ID NO: 7105794 - DNA, 22 bp, Homo sapiens
ctggggctctctggaatgcttg

SEQ ID NO: 7105795 - DNA, 22 bp, Homo sapiens
ctggggctctctggaatgcttg

SEQ ID NO: 7105796 - DNA, 23 bp, Homo sapiens
ctggggctcattgcagtagccat

SEQ ID NO: 7105797 - DNA, 22 bp, Homo sapiens
ctggggctgcagcgatcttcat

SEQ ID NO: 7105798 - DNA, 22 bp, Homo sapiens
ctggggctcactttggtcaggc

SEQ ID NO: 7105799 - DNA, 22 bp, Homo sapiens
ctggggctcactttggtcaggc

SEQ ID NO: 7105800 - DNA, 22 bp, Homo sapiens
ctggggctcactttggtcaggc

SEQ ID NO: 7105801 - DNA, 22 bp, Homo sapiens
ctggggctcactttggtcaggc

SEQ ID NO: 7105802 - DNA, 22 bp, Homo sapiens
ctggggctcactccagccctgg

SEQ ID NO: 7105803 - DNA, 22 bp, Homo sapiens
ctggggcccgagccttgggcca

SEQ ID NO: 7105804 - DNA, 22 bp, Homo sapiens
ctggggcccgagccttgggcca

SEQ ID NO: 7105805 - DNA, 22 bp, Homo sapiens
ctggggctcactccagccctgg

SEQ ID NO: 7105806 - DNA, 22 bp, Homo sapiens
ctggggccctgggtctgccctc

SEQ ID NO: 7105807 - DNA, 22 bp, Homo sapiens
ctggggccctgggtctgccctc

SEQ ID NO: 7105808 - DNA, 22 bp, Homo sapiens
ctggggcccatcgagggctgag

SEQ ID NO: 7105809 - DNA, 22 bp, Homo sapiens
ctggggcccatcgagggctgag

SEQ ID NO: 7105810 - DNA, 22 bp, Homo sapiens
ctggggcccgagccttgggcca

SEQ ID NO: 7105811 - DNA, 22 bp, Homo sapiens
ctggggcccgagccttgggcca

SEQ ID NO: 7105812 - DNA, 22 bp, Homo sapiens
ctggggcccatcgagggctgag

SEQ ID NO: 7105813 - DNA, 22 bp, Homo sapiens
ctggggccagtgaggaggcttt

SEQ ID NO: 7105814 - DNA, 22 bp, Homo sapiens
ctggggccagtgaggaggcttt

SEQ ID NO: 7105815 - DNA, 22 bp, Homo sapiens
ctggggccagtgaggaggcttt

SEQ ID NO: 7105816 - DNA, 22 bp, Homo sapiens
ctggggccagtgaggaggcttt

SEQ ID NO: 7105817 - DNA, 22 bp, Homo sapiens
ctggggcccatcgagggctgag

SEQ ID NO: 7105818 - DNA, 22 bp, Homo sapiens
ctggggccacaacggcgcacgc

SEQ ID NO: 7105819 - DNA, 22 bp, Homo sapiens
ctggggccagtgaggaggcttt

SEQ ID NO: 7105820 - DNA, 22 bp, Homo sapiens
ctggggccagtgaggaggcttt

SEQ ID NO: 7105821 - DNA, 22 bp, Homo sapiens
ctggggcattgggagaggcctg

SEQ ID NO: 7105822 - DNA, 22 bp, Homo sapiens
ctggggcattgggagaggcctg

SEQ ID NO: 7105823 - DNA, 22 bp, Homo sapiens
ctggggccacaacggcgcacgc

SEQ ID NO: 7105824 - DNA, 22 bp, Homo sapiens
ctggggccacaacggcgcacgc

SEQ ID NO: 7105825 - DNA, 20 bp, Homo sapiens
ctggggaggaggatgtgttc

SEQ ID NO: 7105826 - DNA, 20 bp, Homo sapiens
ctggggaggaggatgtgttc

SEQ ID NO: 7105827 - DNA, 22 bp, Homo sapiens
ctggggcattgggagaggcctg

SEQ ID NO: 7105828 - DNA, 22 bp, Homo sapiens
ctggggcattgggagaggcctg

SEQ ID NO: 7105829 - DNA, 22 bp, Homo sapiens
ctggggcattgggagaggcctg

SEQ ID NO: 7105830 - DNA, 22 bp, Homo sapiens
ctggggcattgggagaggcctg

SEQ ID NO: 7105831 - DNA, 22 bp, Homo sapiens
ctggggcattgggagaggcctg

SEQ ID NO: 7105832 - DNA, 22 bp, Homo sapiens
ctggggctgcggtggaggagcc

SEQ ID NO: 7105833 - DNA, 22 bp, Homo sapiens
ctggggctgcggtggaggagcc

SEQ ID NO: 7105834 - DNA, 22 bp, Homo sapiens
ctggggctgcggacgggagccc

SEQ ID NO: 7105835 - DNA, 22 bp, Homo sapiens
ctggggctgcggtggaggagcc

SEQ ID NO: 7105836 - DNA, 22 bp, Homo sapiens
ctggggctgcggtggaggagcc

SEQ ID NO: 7105837 - DNA, 22 bp, Homo sapiens
ctggggctgcggtggaggagcc

SEQ ID NO: 7105838 - DNA, 22 bp, Homo sapiens
ctggggctgcggtggaggagcc

SEQ ID NO: 7105839 - DNA, 22 bp, Homo sapiens
ctggggctgcggacgggagccc

SEQ ID NO: 7105840 - DNA, 22 bp, Homo sapiens
ctggggctgcagcgatcttcat

SEQ ID NO: 7105841 - DNA, 22 bp, Homo sapiens
ctggggctgcagcgatcttcat

SEQ ID NO: 7105842 - DNA, 22 bp, Homo sapiens
ctggggctgcagcgatcttcat

SEQ ID NO: 7105843 - DNA, 22 bp, Homo sapiens
ctggggctgcggacgggagccc

SEQ ID NO: 7105844 - DNA, 22 bp, Homo sapiens
ctggggctgcggacgggagccc

SEQ ID NO: 7105845 - DNA, 22 bp, Homo sapiens
ctggggctgcagcgatcttcat

SEQ ID NO: 7105846 - DNA, 22 bp, Homo sapiens
ctggggtgtgctcagagcaggg

SEQ ID NO: 7105847 - DNA, 22 bp, Homo sapiens
ctggggtgtgctcagagcaggg

SEQ ID NO: 7105848 - DNA, 22 bp, Homo sapiens
ctggggctgcggtggaggagcc

SEQ ID NO: 7105849 - DNA, 22 bp, Homo sapiens
ctggggctggtgaggcaggctc

SEQ ID NO: 7105850 - DNA, 22 bp, Homo sapiens
ctggggctgcggtggaggagcc

SEQ ID NO: 7105851 - DNA, 22 bp, Homo sapiens
ctggggctggtgaggcaggctc

SEQ ID NO: 7105852 - DNA, 22 bp, Homo sapiens
ctggggctggtgaggcaggctc

SEQ ID NO: 7105853 - DNA, 22 bp, Homo sapiens
ctgggtctgggcctcctggagt

SEQ ID NO: 7105854 - DNA, 22 bp, Homo sapiens
ctgggtctggccacaggaagta

SEQ ID NO: 7105855 - DNA, 22 bp, Homo sapiens
ctgggtctggccacaggaagta

SEQ ID NO: 7105856 - DNA, 22 bp, Homo sapiens
ctgggtctggctactgcttcct

SEQ ID NO: 7105857 - DNA, 20 bp, Homo sapiens
ctgggtctccttctgcttaa

SEQ ID NO: 7105858 - DNA, 22 bp, Homo sapiens
ctgggtctcttaccatgtgact

SEQ ID NO: 7105859 - DNA, 22 bp, Homo sapiens
ctgggctgccaggtaggcacac

SEQ ID NO: 7105860 - DNA, 22 bp, Homo sapiens
ctgggctgccaggtaggcacac

SEQ ID NO: 7105861 - DNA, 22 bp, Homo sapiens
ctgggctgccaggtaggcacac

SEQ ID NO: 7105862 - DNA, 22 bp, Homo sapiens
ctgggctgccaggtaggcacac

SEQ ID NO: 7105863 - DNA, 20 bp, Homo sapiens
ctgggctgcccagctatggg

SEQ ID NO: 7105864 - DNA, 20 bp, Homo sapiens
ctgggctgcccagctatggg

SEQ ID NO: 7105865 - DNA, 20 bp, Homo sapiens
ctgggctgcccagctatggg

SEQ ID NO: 7105866 - DNA, 20 bp, Homo sapiens
ctgggctgcccagctatggg

SEQ ID NO: 7105867 - DNA, 20 bp, Homo sapiens
ctgggctgcccagctatggg

SEQ ID NO: 7105868 - DNA, 22 bp, Homo sapiens
ctgggctgcgggcgcccctcca

SEQ ID NO: 7105869 - DNA, 22 bp, Homo sapiens
ctgggctgcgggcgcccctcca

SEQ ID NO: 7105870 - DNA, 22 bp, Homo sapiens
ctgggctgctcagccccctcgc

SEQ ID NO: 7105871 - DNA, 22 bp, Homo sapiens
ctgggctgcggttctctgaagc

SEQ ID NO: 7105872 - DNA, 22 bp, Homo sapiens
ctgggctgcggttctctgaagc

SEQ ID NO: 7105873 - DNA, 22 bp, Homo sapiens
ctgggctgcggttctctgaagc

SEQ ID NO: 7105874 - DNA, 22 bp, Homo sapiens
ctgggctgcggtggtaggttgt

SEQ ID NO: 7105875 - DNA, 22 bp, Homo sapiens
ctgggctgcggtggtaggttgt

SEQ ID NO: 7105876 - DNA, 22 bp, Homo sapiens
ctgggctgcggtggtaggttgt

SEQ ID NO: 7105877 - DNA, 22 bp, Homo sapiens
ctgggctgcggtggtaggttgt

SEQ ID NO: 7105878 - DNA, 22 bp, Homo sapiens
ctgggctgcttgctgaaggggt

SEQ ID NO: 7105879 - DNA, 22 bp, Homo sapiens
ctgggctgcttgctgaaggggt

SEQ ID NO: 7105880 - DNA, 22 bp, Homo sapiens
ctgggctgcttgctgaaggggt

SEQ ID NO: 7105881 - DNA, 23 bp, Homo sapiens
ctgggctgcttgagtccctggct

SEQ ID NO: 7105882 - DNA, 23 bp, Homo sapiens
ctgggctgcttgagtccctggct

SEQ ID NO: 7105883 - DNA, 22 bp, Homo sapiens
ctgggctgctgtccactagggt

SEQ ID NO: 7105884 - DNA, 22 bp, Homo sapiens
ctgggctgctgtccactagggt

SEQ ID NO: 7105885 - DNA, 22 bp, Homo sapiens
ctgggctgctgtccactagggt

SEQ ID NO: 7105886 - DNA, 20 bp, Homo sapiens
ctggggagctgctcccacga

SEQ ID NO: 7105887 - DNA, 20 bp, Homo sapiens
ctggggaggaggatgtgttc

SEQ ID NO: 7105888 - DNA, 20 bp, Homo sapiens
ctggggaggaggatgtgttc

SEQ ID NO: 7105889 - DNA, 20 bp, Homo sapiens
ctggggaggaggatgtgttc

SEQ ID NO: 7105890 - DNA, 20 bp, Homo sapiens
ctggggaggaggatgtgttc

SEQ ID NO: 7105891 - DNA, 22 bp, Homo sapiens
ctgggctgcttgctgaaggggt

SEQ ID NO: 7105892 - DNA, 22 bp, Homo sapiens
ctgggctgcttgctgaaggggt

SEQ ID NO: 7105893 - DNA, 22 bp, Homo sapiens
ctgggctgcttgctgaaggggt

SEQ ID NO: 7105894 - DNA, 22 bp, Homo sapiens
ctgggctggagtgcaatggcgc

SEQ ID NO: 7105895 - DNA, 22 bp, Homo sapiens
ctgggctggagtgcaatggcgc

SEQ ID NO: 7105896 - DNA, 20 bp, Homo sapiens
ctggggagctgctcccacga

SEQ ID NO: 7105897 - DNA, 22 bp, Homo sapiens
ctgggctggacacacttaacct

SEQ ID NO: 7105898 - DNA, 19 bp, Homo sapiens
ctgggccagagctgtcctc

SEQ ID NO: 7105899 - DNA, 19 bp, Homo sapiens
ctgggccagagctgtcctc

SEQ ID NO: 7105900 - DNA, 22 bp, Homo sapiens
ctgggccagaccttgtggtctt

SEQ ID NO: 7105901 - DNA, 22 bp, Homo sapiens
ctgggccagaccttgtggtctt

SEQ ID NO: 7105902 - DNA, 19 bp, Homo sapiens
ctgggccagagctgtcctc

SEQ ID NO: 7105903 - DNA, 19 bp, Homo sapiens
ctgggccagagctgtcctc

SEQ ID NO: 7105904 - DNA, 19 bp, Homo sapiens
ctgggccagagctgtcctc

SEQ ID NO: 7105905 - DNA, 22 bp, Homo sapiens
ctgggccagatccagcctcaca

SEQ ID NO: 7105906 - DNA, 22 bp, Homo sapiens
ctgggccagatccagcctcaca

SEQ ID NO: 7105907 - DNA, 22 bp, Homo sapiens
ctgggctctaggaaccattcct

SEQ ID NO: 7105908 - DNA, 22 bp, Homo sapiens
ctgggctctaggaaccattcct

SEQ ID NO: 7105909 - DNA, 22 bp, Homo sapiens
ctgggctctaggaaccattcct

SEQ ID NO: 7105910 - DNA, 22 bp, Homo sapiens
ctgggctctgcagttgatgttt

SEQ ID NO: 7105911 - DNA, 22 bp, Homo sapiens
ctgggctctgcggtgtcgctct

SEQ ID NO: 7105912 - DNA, 22 bp, Homo sapiens
ctgggctctgcggtgtcgctct

SEQ ID NO: 7105913 - DNA, 22 bp, Homo sapiens
ctgggctgcaggagtggggcaa

SEQ ID NO: 7105914 - DNA, 22 bp, Homo sapiens
ctgggctgcaggagtggggcaa

SEQ ID NO: 7105915 - DNA, 22 bp, Homo sapiens
ctgggctgcaggagtggggcaa

SEQ ID NO: 7105916 - DNA, 22 bp, Homo sapiens
ctgggctgcaggagtggggcaa

SEQ ID NO: 7105917 - DNA, 22 bp, Homo sapiens
ctgggctgcaggagtggggcaa

SEQ ID NO: 7105918 - DNA, 22 bp, Homo sapiens
ctgggctgcaggagtggggcaa

SEQ ID NO: 7105919 - DNA, 22 bp, Homo sapiens
ctgggctgcaggcactaattgg

SEQ ID NO: 7105920 - DNA, 22 bp, Homo sapiens
ctgggctgcaggcactaattgg

SEQ ID NO: 7105921 - DNA, 22 bp, Homo sapiens
ctgggctgcagttcctggtcct

SEQ ID NO: 7105922 - DNA, 22 bp, Homo sapiens
ctgggctgcagttcctggtcct

SEQ ID NO: 7105923 - DNA, 22 bp, Homo sapiens
ctgggctgcagttcctggtcct

SEQ ID NO: 7105924 - DNA, 22 bp, Homo sapiens
ctgggctgcatcaaagaggcat

SEQ ID NO: 7105925 - DNA, 22 bp, Homo sapiens
ctgggctgcatcaaagaggcat

SEQ ID NO: 7105926 - DNA, 22 bp, Homo sapiens
ctgggctgcatcaaagaggcat

SEQ ID NO: 7105927 - DNA, 22 bp, Homo sapiens
ctgggctgcatcaaagaggcat

SEQ ID NO: 7105928 - DNA, 22 bp, Homo sapiens
ctgggaggcagaggttgcagtg

SEQ ID NO: 7105929 - DNA, 22 bp, Homo sapiens
ctgggaggcactattcaggagg

SEQ ID NO: 7105930 - DNA, 22 bp, Homo sapiens
ctgggaggcagaggttgcagtg

SEQ ID NO: 7105931 - DNA, 22 bp, Homo sapiens
ctgggaggcagaggttgcagtg

SEQ ID NO: 7105932 - DNA, 22 bp, Homo sapiens
ctgggaggcagaggttgcagtg

SEQ ID NO: 7105933 - DNA, 22 bp, Homo sapiens
ctgggaggcagaggttgcagtg

SEQ ID NO: 7105934 - DNA, 22 bp, Homo sapiens
ctgggaggcactattcaggagg

SEQ ID NO: 7105935 - DNA, 22 bp, Homo sapiens
ctgggaggcactattcaggagg

SEQ ID NO: 7105936 - DNA, 22 bp, Homo sapiens
ctgggaggcactattcaggagg

SEQ ID NO: 7105937 - DNA, 22 bp, Homo sapiens
ctgggaggcactattcaggagg

SEQ ID NO: 7105938 - DNA, 22 bp, Homo sapiens
ctgggaggcagaggttgtagtg

SEQ ID NO: 7105939 - DNA, 22 bp, Homo sapiens
ctgggaggcagaggttgcagtg

SEQ ID NO: 7105940 - DNA, 22 bp, Homo sapiens
ctgggaggcagaggttgcagtg

SEQ ID NO: 7105941 - DNA, 22 bp, Homo sapiens
ctgggaggcagaggttgtagtg

SEQ ID NO: 7105942 - DNA, 22 bp, Homo sapiens
ctgggaggcagtctctctagaa

SEQ ID NO: 7105943 - DNA, 22 bp, Homo sapiens
ctgggaggcagtctctctagaa

SEQ ID NO: 7105944 - DNA, 22 bp, Homo sapiens
ctgggaggcagtctctctagaa

SEQ ID NO: 7105945 - DNA, 22 bp, Homo sapiens
ctgggaggcagtctctctagaa

SEQ ID NO: 7105946 - DNA, 22 bp, Homo sapiens
ctgggaggcagaggttgtagtg

SEQ ID NO: 7105947 - DNA, 22 bp, Homo sapiens
ctgggaggcagaggttgtagtg

SEQ ID NO: 7105948 - DNA, 22 bp, Homo sapiens
ctgggaggcccacgttgggaag

SEQ ID NO: 7105949 - DNA, 22 bp, Homo sapiens
ctgggaggcccacgttgggaag

SEQ ID NO: 7105950 - DNA, 22 bp, Homo sapiens
ctgggaggcccacgttgggaag

SEQ ID NO: 7105951 - DNA, 22 bp, Homo sapiens
ctgggaggcagtctctctagaa

SEQ ID NO: 7105952 - DNA, 22 bp, Homo sapiens
ctgggaggcagtctctctagaa

SEQ ID NO: 7105953 - DNA, 22 bp, Homo sapiens
ctgggaggcagtctctctagaa

SEQ ID NO: 7105954 - DNA, 22 bp, Homo sapiens
ctgggaggcggagcttgcagtg

SEQ ID NO: 7105955 - DNA, 22 bp, Homo sapiens
ctgggaggcggagcttgcagtg

SEQ ID NO: 7105956 - DNA, 22 bp, Homo sapiens
ctgggaggcggagcttgcagtg

SEQ ID NO: 7105957 - DNA, 22 bp, Homo sapiens
ctgggaggcggagcttgcagtg

SEQ ID NO: 7105958 - DNA, 22 bp, Homo sapiens
ctgggaggcggagcttgcagtg

SEQ ID NO: 7105959 - DNA, 22 bp, Homo sapiens
ctgggaggcccacgttgggaag

SEQ ID NO: 7105960 - DNA, 22 bp, Homo sapiens
ctgggaggcggagcttgcagtg

SEQ ID NO: 7105961 - DNA, 22 bp, Homo sapiens
ctgggaggcggagcttgcagtg

SEQ ID NO: 7105962 - DNA, 22 bp, Homo sapiens
ctgggaggcggagcttgcagtg

SEQ ID NO: 7105963 - DNA, 22 bp, Homo sapiens
ctgggcaggagaggtggttgga

SEQ ID NO: 7105964 - DNA, 22 bp, Homo sapiens
ctgggcaggagaggtggttgga

SEQ ID NO: 7105965 - DNA, 22 bp, Homo sapiens
ctgggcaggagaggtggttgga

SEQ ID NO: 7105966 - DNA, 22 bp, Homo sapiens
ctgggcaggagaggtggttgga

SEQ ID NO: 7105967 - DNA, 22 bp, Homo sapiens
ctgggcagtttattcagttctg

SEQ ID NO: 7105968 - DNA, 22 bp, Homo sapiens
ctgggcagtttattcagttctg

SEQ ID NO: 7105969 - DNA, 22 bp, Homo sapiens
ctgggcaggagggctctatgga

SEQ ID NO: 7105970 - DNA, 22 bp, Homo sapiens
ctgggcaggagggctctatgga

SEQ ID NO: 7105971 - DNA, 22 bp, Homo sapiens
ctgggcaggagaggtggttgga

SEQ ID NO: 7105972 - DNA, 22 bp, Homo sapiens
ctgggcagtttattcagttctg

SEQ ID NO: 7105973 - DNA, 22 bp, Homo sapiens
ctgggcagttttacatcattgc

SEQ ID NO: 7105974 - DNA, 22 bp, Homo sapiens
ctgggcagttttacatcattgc

SEQ ID NO: 7105975 - DNA, 22 bp, Homo sapiens
ctgggcatatacgtgcaagtca

SEQ ID NO: 7105976 - DNA, 22 bp, Homo sapiens
ctgggcatgaaaaggatgccag

SEQ ID NO: 7105977 - DNA, 22 bp, Homo sapiens
ctgggcatggacagctgcacag

SEQ ID NO: 7105978 - DNA, 22 bp, Homo sapiens
ctgggccaaaagaagtgttctt

SEQ ID NO: 7105979 - DNA, 22 bp, Homo sapiens
ctgggccacaagcctgtgtgat

SEQ ID NO: 7105980 - DNA, 22 bp, Homo sapiens
ctgggccacaagcctgtgtgat

SEQ ID NO: 7105981 - DNA, 22 bp, Homo sapiens
ctgggccacaagcctgtgtgat

SEQ ID NO: 7105982 - DNA, 22 bp, Homo sapiens
ctgggccacatcagatgaagac

SEQ ID NO: 7105983 - DNA, 22 bp, Homo sapiens
ctgggccacatcagatgaagac

SEQ ID NO: 7105984 - DNA, 22 bp, Homo sapiens
ctgggccacatcagatgaagac

SEQ ID NO: 7105985 - DNA, 22 bp, Homo sapiens
ctgggccactccagatgcccac

SEQ ID NO: 7105986 - DNA, 22 bp, Homo sapiens
ctgggccactccagatgcccac

SEQ ID NO: 7105987 - DNA, 22 bp, Homo sapiens
ctgggccacatcagatgaagac

SEQ ID NO: 7105988 - DNA, 22 bp, Homo sapiens
ctgggccactccagatgcccac

SEQ ID NO: 7105989 - DNA, 22 bp, Homo sapiens
ctgggccacttcctcaggggaa

SEQ ID NO: 7105990 - DNA, 22 bp, Homo sapiens
ctgggccacttcctcaggggaa

SEQ ID NO: 7105991 - DNA, 22 bp, Homo sapiens
ctgggccagaagacatttagga

SEQ ID NO: 7105992 - DNA, 19 bp, Homo sapiens
ctgggccagaatcagctca

SEQ ID NO: 7105993 - DNA, 22 bp, Homo sapiens
ctggctttgctggactgggagt

SEQ ID NO: 7105994 - DNA, 22 bp, Homo sapiens
ctggctttgaggatcccctctt

SEQ ID NO: 7105995 - DNA, 22 bp, Homo sapiens
ctggctttgaaatgcatttcag

SEQ ID NO: 7105996 - DNA, 22 bp, Homo sapiens
ctggctttctgaacatcagtga

SEQ ID NO: 7105997 - DNA, 22 bp, Homo sapiens
ctggctttctgcaaatctccat

SEQ ID NO: 7105998 - DNA, 22 bp, Homo sapiens
ctggctttctgttataaagaca

SEQ ID NO: 7105999 - DNA, 22 bp, Homo sapiens
ctggctttctctgtggtgttca

SEQ ID NO: 7106000 - DNA, 22 bp, Homo sapiens
ctggctttctccagaaattttt

SEQ ID NO: 7106001 - DNA, 22 bp, Homo sapiens
ctggctttccctggacaacagc

SEQ ID NO: 7106002 - DNA, 22 bp, Homo sapiens
ctggctttcatttcaagcacgt

SEQ ID NO: 7106003 - DNA, 22 bp, Homo sapiens
ctggctttcattcattcaggcc

SEQ ID NO: 7106004 - DNA, 22 bp, Homo sapiens
ctggctttaggttggagagctg

SEQ ID NO: 7106005 - DNA, 22 bp, Homo sapiens
ctggctttacctcactggggct

SEQ ID NO: 7106006 - DNA, 22 bp, Homo sapiens
ctggctttaaccctacaaacct

SEQ ID NO: 7106007 - DNA, 22 bp, Homo sapiens
ctggctttaatgtcatctttct

SEQ ID NO: 7106008 - DNA, 22 bp, Homo sapiens
ctggcttgggtctacctgcctt

SEQ ID NO: 7106009 - DNA, 22 bp, Homo sapiens
ctggcttggcttattcatggaa

SEQ ID NO: 7106010 - DNA, 22 bp, Homo sapiens
ctggcttttcaaactgttcagt

SEQ ID NO: 7106011 - DNA, 22 bp, Homo sapiens
ctggcttttagtgtgaagactt

SEQ ID NO: 7106012 - DNA, 22 bp, Homo sapiens
ctggcttttcctaaactgggaa

SEQ ID NO: 7106013 - DNA, 22 bp, Homo sapiens
ctggctttggaacaaatcatag

SEQ ID NO: 7106014 - DNA, 22 bp, Homo sapiens
ctggcttttggaaacaggctca

SEQ ID NO: 7106015 - DNA, 22 bp, Homo sapiens
ctggcttttgcctgtaattcta

SEQ ID NO: 7106016 - DNA, 22 bp, Homo sapiens
ctggcttttggaaacaggctca

SEQ ID NO: 7106017 - DNA, 22 bp, Homo sapiens
ctggcttttggaaacaggctca

SEQ ID NO: 7106018 - DNA, 22 bp, Homo sapiens
ctggcttttggaggagggtcag

SEQ ID NO: 7106019 - DNA, 22 bp, Homo sapiens
ctgggaaaactgtgacccctgt

SEQ ID NO: 7106020 - DNA, 22 bp, Homo sapiens
ctgggaaagcaaggttgtggat

SEQ ID NO: 7106021 - DNA, 22 bp, Homo sapiens
ctgggaaagcaaggttgtggat

SEQ ID NO: 7106022 - DNA, 22 bp, Homo sapiens
ctgggaaagtgtgctcccctcc

SEQ ID NO: 7106023 - DNA, 22 bp, Homo sapiens
ctgggaaagtgtgctcccctcc

SEQ ID NO: 7106024 - DNA, 22 bp, Homo sapiens
ctgggaaatataataaagtggt

SEQ ID NO: 7106025 - DNA, 22 bp, Homo sapiens
ctgggaaatataataaagtggt

SEQ ID NO: 7106026 - DNA, 22 bp, Homo sapiens
ctgggaaatggcttcgagctca

SEQ ID NO: 7106027 - DNA, 22 bp, Homo sapiens
ctgggaaattgacactgataaa

SEQ ID NO: 7106028 - DNA, 22 bp, Homo sapiens
ctgggaacaggcactgctgtca

SEQ ID NO: 7106029 - DNA, 22 bp, Homo sapiens
ctgggaacgtgcttagctgact

SEQ ID NO: 7106030 - DNA, 22 bp, Homo sapiens
ctgggaacgtgcttagctgact

SEQ ID NO: 7106031 - DNA, 22 bp, Homo sapiens
ctgggaagaaattgtgggaggc

SEQ ID NO: 7106032 - DNA, 22 bp, Homo sapiens
ctgggaagaaattgtgggaggc

SEQ ID NO: 7106033 - DNA, 22 bp, Homo sapiens
ctgggaagaaattgtgggaggc

SEQ ID NO: 7106034 - DNA, 22 bp, Homo sapiens
ctgggaagaaattgtgggaggc

SEQ ID NO: 7106035 - DNA, 22 bp, Homo sapiens
ctgggagctagctctgagctga

SEQ ID NO: 7106036 - DNA, 22 bp, Homo sapiens
ctgggagctcagccctggggtg

SEQ ID NO: 7106037 - DNA, 22 bp, Homo sapiens
ctgggagctgaggctgacgctg

SEQ ID NO: 7106038 - DNA, 22 bp, Homo sapiens
ctgggaggcaccgcgtcgtgct

SEQ ID NO: 7106039 - DNA, 22 bp, Homo sapiens
ctgggaggcaccgcgtcgtgct

SEQ ID NO: 7106040 - DNA, 22 bp, Homo sapiens
ctgggaggattcattgaggtga

SEQ ID NO: 7106041 - DNA, 22 bp, Homo sapiens
ctgggaggcaccgcgtcgtgct

SEQ ID NO: 7106042 - DNA, 22 bp, Homo sapiens
ctggctcttcagtgcttggttc

SEQ ID NO: 7106043 - DNA, 21 bp, Homo sapiens
ctggctctgttgtcacccggc

SEQ ID NO: 7106044 - DNA, 22 bp, Homo sapiens
ctggctcttctgggttctgtgt

SEQ ID NO: 7106045 - DNA, 22 bp, Homo sapiens
ctggctcttgcgactcagcttg

SEQ ID NO: 7106046 - DNA, 22 bp, Homo sapiens
ctggctcattttagcatcaggt

SEQ ID NO: 7106047 - DNA, 22 bp, Homo sapiens
ctggctcattttagcatcaggt

SEQ ID NO: 7106048 - DNA, 22 bp, Homo sapiens
ctggctccaaattctgatgttc

SEQ ID NO: 7106049 - DNA, 22 bp, Homo sapiens
ctggctccaaggaagaggtttt

SEQ ID NO: 7106050 - DNA, 22 bp, Homo sapiens
ctggctccaaggaagaggtttt

SEQ ID NO: 7106051 - DNA, 22 bp, Homo sapiens
ctggctcttgcgactcagcttg

SEQ ID NO: 7106052 - DNA, 22 bp, Homo sapiens
ctggctgcaggaaggagtgggc

SEQ ID NO: 7106053 - DNA, 22 bp, Homo sapiens
ctggctgcaggatgaggctgcc

SEQ ID NO: 7106054 - DNA, 22 bp, Homo sapiens
ctggctgcaggatgaggctgcc

SEQ ID NO: 7106055 - DNA, 22 bp, Homo sapiens
ctggctgcaggatgaggctgcc

SEQ ID NO: 7106056 - DNA, 22 bp, Homo sapiens
ctggctgcagtagcaagagact

SEQ ID NO: 7106057 - DNA, 23 bp, Homo sapiens
ctggctcatcctggttgcagtgg

SEQ ID NO: 7106058 - DNA, 23 bp, Homo sapiens
ctggctcatcctggttgcagtgg

SEQ ID NO: 7106059 - DNA, 23 bp, Homo sapiens
ctggctcatcctggttgcagtgg

SEQ ID NO: 7106060 - DNA, 22 bp, Homo sapiens
ctggctcatgtgatgagggcaa

SEQ ID NO: 7106061 - DNA, 22 bp, Homo sapiens
ctggctcatgtgatgagggcaa

SEQ ID NO: 7106062 - DNA, 22 bp, Homo sapiens
ctggctcattttagcatcaggt

SEQ ID NO: 7106063 - DNA, 22 bp, Homo sapiens
ctggctcattttagcatcaggt

SEQ ID NO: 7106064 - DNA, 22 bp, Homo sapiens
ctggctcattttagcatcaggt

SEQ ID NO: 7106065 - DNA, 22 bp, Homo sapiens
ctggctcattttagcatcaggt

SEQ ID NO: 7106066 - DNA, 22 bp, Homo sapiens
ctggctcattttagcatcaggt

SEQ ID NO: 7106067 - DNA, 22 bp, Homo sapiens
ctggctcatagagcagctccaa

SEQ ID NO: 7106068 - DNA, 22 bp, Homo sapiens
ctggctcatccaggtgttgctc

SEQ ID NO: 7106069 - DNA, 22 bp, Homo sapiens
ctggctcatccaggtgttgctc

SEQ ID NO: 7106070 - DNA, 22 bp, Homo sapiens
ctggctcatccaggtgttgctc

SEQ ID NO: 7106071 - DNA, 22 bp, Homo sapiens
ctggctcatagagcagctccaa

SEQ ID NO: 7106072 - DNA, 22 bp, Homo sapiens
ctggctcatagagcagctccaa

SEQ ID NO: 7106073 - DNA, 22 bp, Homo sapiens
ctggctcatagagcagctccaa

SEQ ID NO: 7106074 - DNA, 22 bp, Homo sapiens
ctggctcagttcttggttttca

SEQ ID NO: 7106075 - DNA, 22 bp, Homo sapiens
ctggctcagttcttggttttca

SEQ ID NO: 7106076 - DNA, 22 bp, Homo sapiens
ctggctcagtgccttcagaagt

SEQ ID NO: 7106077 - DNA, 22 bp, Homo sapiens
ctggctcagtgccttcagaagt

SEQ ID NO: 7106078 - DNA, 22 bp, Homo sapiens
ctggctcagttcttggttttca

SEQ ID NO: 7106079 - DNA, 22 bp, Homo sapiens
ctggctgcgtctgctctgacag

SEQ ID NO: 7106080 - DNA, 22 bp, Homo sapiens
ctggctgcctggagtgagggag

SEQ ID NO: 7106081 - DNA, 22 bp, Homo sapiens
ctggctgcgtctgctctgacag

SEQ ID NO: 7106082 - DNA, 22 bp, Homo sapiens
ctggctgcgtctgctctgacag

SEQ ID NO: 7106083 - DNA, 22 bp, Homo sapiens
ctggctgcgtctgctctgacag

SEQ ID NO: 7106084 - DNA, 22 bp, Homo sapiens
ctggctgctggcctgaggatgc

SEQ ID NO: 7106085 - DNA, 22 bp, Homo sapiens
ctggctgcttgggacagccatg

SEQ ID NO: 7106086 - DNA, 22 bp, Homo sapiens
ctggctgcagtagcaagagact

SEQ ID NO: 7106087 - DNA, 22 bp, Homo sapiens
ctggctgcattggcaagtcaat

SEQ ID NO: 7106088 - DNA, 22 bp, Homo sapiens
ctggctgccacttcagggtctt

SEQ ID NO: 7106089 - DNA, 22 bp, Homo sapiens
ctggctgccagcatttggggga

SEQ ID NO: 7106090 - DNA, 22 bp, Homo sapiens
ctggctgcctatagtctccctt

SEQ ID NO: 7106091 - DNA, 22 bp, Homo sapiens
ctggctgcctggagtgagggag

SEQ ID NO: 7106092 - DNA, 22 bp, Homo sapiens
ctggctgtgcagtcttccagaa

SEQ ID NO: 7106093 - DNA, 22 bp, Homo sapiens
ctggctgtgcagtcttccagaa

SEQ ID NO: 7106094 - DNA, 22 bp, Homo sapiens
ctggctggacttgtgcatgtca

SEQ ID NO: 7106095 - DNA, 20 bp, Homo sapiens
ctggctggaaacttagcctt

SEQ ID NO: 7106096 - DNA, 20 bp, Homo sapiens
ctggctggaaacttagcctt

SEQ ID NO: 7106097 - DNA, 22 bp, Homo sapiens
ctggctggaagttagagaactt

SEQ ID NO: 7106098 - DNA, 22 bp, Homo sapiens
ctggctggaagttagagaactt

SEQ ID NO: 7106099 - DNA, 22 bp, Homo sapiens
ctggctcaggaaagttgctgct

SEQ ID NO: 7106100 - DNA, 22 bp, Homo sapiens
ctggctcaggaaagttgctgct

SEQ ID NO: 7106101 - DNA, 22 bp, Homo sapiens
ctggctcagggtggtctgggtc

SEQ ID NO: 7106102 - DNA, 22 bp, Homo sapiens
ctggctcagggtggtctgggtc

SEQ ID NO: 7106103 - DNA, 22 bp, Homo sapiens
ctggctcaggaaagttgctgct

SEQ ID NO: 7106104 - DNA, 22 bp, Homo sapiens
ctggctcactagccctgccctg

SEQ ID NO: 7106105 - DNA, 22 bp, Homo sapiens
ctggctcactagccctgccctg

SEQ ID NO: 7106106 - DNA, 22 bp, Homo sapiens
ctggctcagacagctgtgcagt

SEQ ID NO: 7106107 - DNA, 22 bp, Homo sapiens
ctggctcagacagctgtgcagt

SEQ ID NO: 7106108 - DNA, 22 bp, Homo sapiens
ctggctcagacagctgtgcagt

SEQ ID NO: 7106109 - DNA, 22 bp, Homo sapiens
ctggctcactagccctgccctg

SEQ ID NO: 7106110 - DNA, 22 bp, Homo sapiens
ctggctcactagccctgccctg

SEQ ID NO: 7106111 - DNA, 22 bp, Homo sapiens
ctggctcacctccgctccagca

SEQ ID NO: 7106112 - DNA, 22 bp, Homo sapiens
ctggctcacctccgctccagca

SEQ ID NO: 7106113 - DNA, 22 bp, Homo sapiens
ctggctcacctccgctccagca

SEQ ID NO: 7106114 - DNA, 22 bp, Homo sapiens
ctggctcacctccgctccagca

SEQ ID NO: 7106115 - DNA, 22 bp, Homo sapiens
ctggcctgtgggctgtctccgg

SEQ ID NO: 7106116 - DNA, 22 bp, Homo sapiens
ctggcctgtgggctgtctccgg

SEQ ID NO: 7106117 - DNA, 22 bp, Homo sapiens
ctggcctgtgggctgtctccgg

SEQ ID NO: 7106118 - DNA, 22 bp, Homo sapiens
ctggcctgtcctgacccagcct

SEQ ID NO: 7106119 - DNA, 22 bp, Homo sapiens
ctggcctgtcctgacccagcct

SEQ ID NO: 7106120 - DNA, 22 bp, Homo sapiens
ctggcctgtgggctgtctccgg

SEQ ID NO: 7106121 - DNA, 22 bp, Homo sapiens
ctggccctgtggaggcaggaac

SEQ ID NO: 7106122 - DNA, 22 bp, Homo sapiens
ctggccctgtggaggcaggaac

SEQ ID NO: 7106123 - DNA, 22 bp, Homo sapiens
ctggccctgtcagcacagaatc

SEQ ID NO: 7106124 - DNA, 22 bp, Homo sapiens
ctggccctgtcagcacagaatc

SEQ ID NO: 7106125 - DNA, 22 bp, Homo sapiens
ctggccctgtaggatgtgagtt

SEQ ID NO: 7106126 - DNA, 22 bp, Homo sapiens
ctggccctgtaggatgtgagtt

SEQ ID NO: 7106127 - DNA, 22 bp, Homo sapiens
ctggccctgtaggatgtgagtt

SEQ ID NO: 7106128 - DNA, 22 bp, Homo sapiens
ctggccctgtaggatgtgagtt

SEQ ID NO: 7106129 - DNA, 22 bp, Homo sapiens
ctggccctggctggagcccagg

SEQ ID NO: 7106130 - DNA, 22 bp, Homo sapiens
ctggccctggctggagcccagg

SEQ ID NO: 7106131 - DNA, 23 bp, Homo sapiens
ctggccctggctctgtgatcatg

SEQ ID NO: 7106132 - DNA, 23 bp, Homo sapiens
ctggccctggctctgtgatcatg

SEQ ID NO: 7106133 - DNA, 23 bp, Homo sapiens
ctggccctggctctgtgatcatg

SEQ ID NO: 7106134 - DNA, 22 bp, Homo sapiens
ctggccctggctggagcccagg

SEQ ID NO: 7106135 - DNA, 22 bp, Homo sapiens
ctggccctggtaaggacaccca

SEQ ID NO: 7106136 - DNA, 22 bp, Homo sapiens
ctggccctggtaaggacaccca

SEQ ID NO: 7106137 - DNA, 22 bp, Homo sapiens
ctggccctattccaggccttcc

SEQ ID NO: 7106138 - DNA, 22 bp, Homo sapiens
ctggccctatgagcctcctgat

SEQ ID NO: 7106139 - DNA, 22 bp, Homo sapiens
ctggccctattccaggccttcc

SEQ ID NO: 7106140 - DNA, 22 bp, Homo sapiens
ctggccctattccaggccttcc

SEQ ID NO: 7106141 - DNA, 22 bp, Homo sapiens
ctggccctcagactcatgggca

SEQ ID NO: 7106142 - DNA, 22 bp, Homo sapiens
ctggccctcagactcatgggca

SEQ ID NO: 7106143 - DNA, 22 bp, Homo sapiens
ctggccaggccccttgcagggc

SEQ ID NO: 7106144 - DNA, 22 bp, Homo sapiens
ctggccaggccccttgcagggc

SEQ ID NO: 7106145 - DNA, 19 bp, Homo sapiens
ctggccaggccaggggccc

SEQ ID NO: 7106146 - DNA, 19 bp, Homo sapiens
ctggccaggccaggggccc

SEQ ID NO: 7106147 - DNA, 19 bp, Homo sapiens
ctggccaggccaggggccc

SEQ ID NO: 7106148 - DNA, 19 bp, Homo sapiens
ctggccaggccaggggccc

SEQ ID NO: 7106149 - DNA, 19 bp, Homo sapiens
ctggccaggccaggggccc

SEQ ID NO: 7106150 - DNA, 19 bp, Homo sapiens
ctggccaggccaggggccc

SEQ ID NO: 7106151 - DNA, 22 bp, Homo sapiens
ctggccaggccccttgcagggc

SEQ ID NO: 7106152 - DNA, 22 bp, Homo sapiens
ctggccctggagggctgtgcga

SEQ ID NO: 7106153 - DNA, 16 bp, Homo sapiens
ctggccctggctctgg

SEQ ID NO: 7106154 - DNA, 16 bp, Homo sapiens
ctggccctggctctgg

SEQ ID NO: 7106155 - DNA, 22 bp, Homo sapiens
ctggccctggagggctgtgcga

SEQ ID NO: 7106156 - DNA, 22 bp, Homo sapiens
ctggccctggagggctgtgcga

SEQ ID NO: 7106157 - DNA, 22 bp, Homo sapiens
ctggccctgcctaatgtacttg

SEQ ID NO: 7106158 - DNA, 22 bp, Homo sapiens
ctggccctgctccgcgccgcgg

SEQ ID NO: 7106159 - DNA, 22 bp, Homo sapiens
ctggccctgctccgcgccgcgg

SEQ ID NO: 7106160 - DNA, 22 bp, Homo sapiens
ctggccctgccagagatcaaca

SEQ ID NO: 7106161 - DNA, 22 bp, Homo sapiens
ctggccctcgtcagtttcactg

SEQ ID NO: 7106162 - DNA, 22 bp, Homo sapiens
ctggccctcggagtccagctgc

SEQ ID NO: 7106163 - DNA, 22 bp, Homo sapiens
ctggccctcggagtccagctgc

SEQ ID NO: 7106164 - DNA, 22 bp, Homo sapiens
ctggccctcagactcatgggca

SEQ ID NO: 7106165 - DNA, 22 bp, Homo sapiens
ctggccctcagactcatgggca

SEQ ID NO: 7106166 - DNA, 22 bp, Homo sapiens
ctgccactttggagtgctcaga

SEQ ID NO: 7106167 - DNA, 22 bp, Homo sapiens
ctgccactttcacccagtgctc

SEQ ID NO: 7106168 - DNA, 22 bp, Homo sapiens
ctgccacttactaggcatggtg

SEQ ID NO: 7106169 - DNA, 22 bp, Homo sapiens
ctgccacttactaggcatggtg

SEQ ID NO: 7106170 - DNA, 22 bp, Homo sapiens
ctgccactttcacccagtgctc

SEQ ID NO: 7106171 - DNA, 22 bp, Homo sapiens
ctgccactagctttcacatctt

SEQ ID NO: 7106172 - DNA, 22 bp, Homo sapiens
ctgccagaagagaacaccagtt

SEQ ID NO: 7106173 - DNA, 22 bp, Homo sapiens
ctgccagaaggttcctgctgca

SEQ ID NO: 7106174 - DNA, 22 bp, Homo sapiens
ctgccagaaggttcctgctgca

SEQ ID NO: 7106175 - DNA, 22 bp, Homo sapiens
ctgccagagatctgggcagagt

SEQ ID NO: 7106176 - DNA, 22 bp, Homo sapiens
ctgccagatcattggattcaca

SEQ ID NO: 7106177 - DNA, 22 bp, Homo sapiens
ctgccagcaagctaccctggca

SEQ ID NO: 7106178 - DNA, 22 bp, Homo sapiens
ctgcatccatctcctagcacag

SEQ ID NO: 7106179 - DNA, 22 bp, Homo sapiens
ctgcatcattggtgattcagga

SEQ ID NO: 7106180 - DNA, 22 bp, Homo sapiens
ctgcatcattttcagacaatgg

SEQ ID NO: 7106181 - DNA, 22 bp, Homo sapiens
ctgcatcaggccaattaagaat

SEQ ID NO: 7106182 - DNA, 22 bp, Homo sapiens
ctgcatcagtggatatgatggt

SEQ ID NO: 7106183 - DNA, 22 bp, Homo sapiens
ctgcatcataaaatttagagtt

SEQ ID NO: 7106184 - DNA, 20 bp, Homo sapiens
ctgcatcatggttaagaaca

SEQ ID NO: 7106185 - DNA, 22 bp, Homo sapiens
ctgcatccatgttgctgcaaag

SEQ ID NO: 7106186 - DNA, 22 bp, Homo sapiens
ctgcatccatgttgctgcaaag

SEQ ID NO: 7106187 - DNA, 22 bp, Homo sapiens
ctgccacaagctggccctgtgt

SEQ ID NO: 7106188 - DNA, 22 bp, Homo sapiens
ctgccacaagctggccctgtgt

SEQ ID NO: 7106189 - DNA, 22 bp, Homo sapiens
ctgccacaggggagcaggcaga

SEQ ID NO: 7106190 - DNA, 22 bp, Homo sapiens
ctgccacaggggagcaggcaga

SEQ ID NO: 7106191 - DNA, 22 bp, Homo sapiens
ctgccaccaaatagctgcatga

SEQ ID NO: 7106192 - DNA, 22 bp, Homo sapiens
ctgccaccaaatagctgcatga

SEQ ID NO: 7106193 - DNA, 22 bp, Homo sapiens
ctgccaccatgccccagcagag

SEQ ID NO: 7106194 - DNA, 22 bp, Homo sapiens
ctgccagcagaggccagcgctg

SEQ ID NO: 7106195 - DNA, 22 bp, Homo sapiens
ctgccagcaatgtgaccatgct

SEQ ID NO: 7106196 - DNA, 22 bp, Homo sapiens
ctgccagcactgcctcctgagg

SEQ ID NO: 7106197 - DNA, 22 bp, Homo sapiens
ctgccagcactgcctcctgagg

SEQ ID NO: 7106198 - DNA, 22 bp, Homo sapiens
ctgccagcagaggccagcgctg

SEQ ID NO: 7106199 - DNA, 22 bp, Homo sapiens
ctgccagcagaggccagcgctg

SEQ ID NO: 7106200 - DNA, 22 bp, Homo sapiens
ctgccagccaggccaggtaggc

SEQ ID NO: 7106201 - DNA, 22 bp, Homo sapiens
ctgccagctcaaagcgcagcta

SEQ ID NO: 7106202 - DNA, 22 bp, Homo sapiens
ctgccagctcaaagcgcagcta

SEQ ID NO: 7106203 - DNA, 22 bp, Homo sapiens
ctgccagctcaaagcgcagcta

SEQ ID NO: 7106204 - DNA, 22 bp, Homo sapiens
ctgccagctcaccggctcagac

SEQ ID NO: 7106205 - DNA, 22 bp, Homo sapiens
ctgccagctcaccggctcagac

SEQ ID NO: 7106206 - DNA, 22 bp, Homo sapiens
ctgccagctcaccggctcagac

SEQ ID NO: 7106207 - DNA, 22 bp, Homo sapiens
ctgccagctctctggaggctct

SEQ ID NO: 7106208 - DNA, 22 bp, Homo sapiens
ctggcagcccaacctagagtct

SEQ ID NO: 7106209 - DNA, 22 bp, Homo sapiens
ctggcaggagcattcacagagg

SEQ ID NO: 7106210 - DNA, 22 bp, Homo sapiens
ctggcaggagcattcacagagg

SEQ ID NO: 7106211 - DNA, 22 bp, Homo sapiens
ctggcaggagcattcacagagg

SEQ ID NO: 7106212 - DNA, 22 bp, Homo sapiens
ctggcaggagcattcacagagg

SEQ ID NO: 7106213 - DNA, 22 bp, Homo sapiens
ctggcaggaagttagatggtaa

SEQ ID NO: 7106214 - DNA, 22 bp, Homo sapiens
ctggcaggaagaggaaaggtca

SEQ ID NO: 7106215 - DNA, 22 bp, Homo sapiens
ctggcaggaagaggaaaggtca

SEQ ID NO: 7106216 - DNA, 22 bp, Homo sapiens
ctggcaggaagaggaaaggtca

SEQ ID NO: 7106217 - DNA, 22 bp, Homo sapiens
ctggcaggaaggcatttagaca

SEQ ID NO: 7106218 - DNA, 22 bp, Homo sapiens
ctggcaggaagttagatggtaa

SEQ ID NO: 7106219 - DNA, 22 bp, Homo sapiens
ctggcaggaagttagatggtaa

SEQ ID NO: 7106220 - DNA, 22 bp, Homo sapiens
ctggcaggaagttagatggtaa

SEQ ID NO: 7106221 - DNA, 22 bp, Homo sapiens
ctggcaggaagttagatggtaa

SEQ ID NO: 7106222 - DNA, 22 bp, Homo sapiens
ctggcagcccaacctagagtct

SEQ ID NO: 7106223 - DNA, 19 bp, Homo sapiens
ctggcagcctgtctgtgtc

SEQ ID NO: 7106224 - DNA, 19 bp, Homo sapiens
ctggcagcctgtctgtgtc

SEQ ID NO: 7106225 - DNA, 22 bp, Homo sapiens
ctggcagcttcaggacactcgg

SEQ ID NO: 7106226 - DNA, 22 bp, Homo sapiens
ctggcagcttcctttgcatctg

SEQ ID NO: 7106227 - DNA, 22 bp, Homo sapiens
ctggcagcttcctttgcatctg

SEQ ID NO: 7106228 - DNA, 22 bp, Homo sapiens
ctggcaggaagaggaaaggtca

SEQ ID NO: 7106229 - DNA, 22 bp, Homo sapiens
ctggcaggaagaggaaaggtca

SEQ ID NO: 7106230 - DNA, 22 bp, Homo sapiens
ctggcaggcagacttctgcaag

SEQ ID NO: 7106231 - DNA, 22 bp, Homo sapiens
ctggcaggcagacttctgcaag

SEQ ID NO: 7106232 - DNA, 22 bp, Homo sapiens
ctggcaggcactcatgaaataa

SEQ ID NO: 7106233 - DNA, 22 bp, Homo sapiens
ctggcaggcactcatgaaataa

SEQ ID NO: 7106234 - DNA, 22 bp, Homo sapiens
ctggcaggcaaattggtgggag

SEQ ID NO: 7106235 - DNA, 22 bp, Homo sapiens
ctggcaggcaaattggtgggag

SEQ ID NO: 7106236 - DNA, 22 bp, Homo sapiens
ctggcaggcaaattggtgggag

SEQ ID NO: 7106237 - DNA, 22 bp, Homo sapiens
ctggcaggcaaattggtgggag

SEQ ID NO: 7106238 - DNA, 22 bp, Homo sapiens
ctggcaggcaaattggtgggag

SEQ ID NO: 7106239 - DNA, 22 bp, Homo sapiens
ctggcaggcaaattggtgggag

SEQ ID NO: 7106240 - DNA, 22 bp, Homo sapiens
ctggcaggcaaattggtgggag

SEQ ID NO: 7106241 - DNA, 22 bp, Homo sapiens
ctggcaggatctaaccagggaa

SEQ ID NO: 7106242 - DNA, 22 bp, Homo sapiens
ctggcaggatctaaccagggaa

SEQ ID NO: 7106243 - DNA, 22 bp, Homo sapiens
ctggcaggatctaaccagggaa

SEQ ID NO: 7106244 - DNA, 22 bp, Homo sapiens
ctggcaggatctaaccagggaa

SEQ ID NO: 7106245 - DNA, 22 bp, Homo sapiens
ctggcaggagttgggattttga

SEQ ID NO: 7106246 - DNA, 22 bp, Homo sapiens
ctggcaggagttgggattttga

SEQ ID NO: 7106247 - DNA, 22 bp, Homo sapiens
ctggcaggatctaaccagggaa

SEQ ID NO: 7106248 - DNA, 22 bp, Homo sapiens
ctggcaggatctaaccagggaa

SEQ ID NO: 7106249 - DNA, 22 bp, Homo sapiens
ctggcaggagctgtggccgtag

SEQ ID NO: 7106250 - DNA, 22 bp, Homo sapiens
ctggcaggagctgtggccgtag

SEQ ID NO: 7106251 - DNA, 22 bp, Homo sapiens
ctggcaggagctgtggccgtag

SEQ ID NO: 7106252 - DNA, 22 bp, Homo sapiens
ctggcaggagctgtggccgtag

SEQ ID NO: 7106253 - DNA, 20 bp, Homo sapiens
ctggcaggagcgagtctacc

SEQ ID NO: 7106254 - DNA, 20 bp, Homo sapiens
ctggcaggagcgagtctacc

SEQ ID NO: 7106255 - DNA, 20 bp, Homo sapiens
ctggcaggagcgagtctacc

SEQ ID NO: 7106256 - DNA, 20 bp, Homo sapiens
ctggcaggagcgagtctacc

SEQ ID NO: 7106257 - DNA, 20 bp, Homo sapiens
ctggcaggagcgagtctacc

SEQ ID NO: 7106258 - DNA, 22 bp, Homo sapiens
ctggcaggcggaggttgcagtg

SEQ ID NO: 7106259 - DNA, 22 bp, Homo sapiens
ctggcaggcggcagagcccagg

SEQ ID NO: 7106260 - DNA, 22 bp, Homo sapiens
ctggcaggcggcagagcccagg

SEQ ID NO: 7106261 - DNA, 22 bp, Homo sapiens
ctggcaggcggcagagcccagg

SEQ ID NO: 7106262 - DNA, 22 bp, Homo sapiens
ctggcaggcggcagagcccagg

SEQ ID NO: 7106263 - DNA, 22 bp, Homo sapiens
ctggcaggcggcagagcccagg

SEQ ID NO: 7106264 - DNA, 22 bp, Homo sapiens
ctggcaggcggcagagcccagg

SEQ ID NO: 7106265 - DNA, 22 bp, Homo sapiens
ctggcaggcggaggttgcagtg

SEQ ID NO: 7106266 - DNA, 22 bp, Homo sapiens
ctggcaggcggaggttgcagtg

SEQ ID NO: 7106267 - DNA, 22 bp, Homo sapiens
ctggcaggcggaggttgcagtg

SEQ ID NO: 7106268 - DNA, 22 bp, Homo sapiens
ctggcaggcggaggttgcagtg

SEQ ID NO: 7106269 - DNA, 22 bp, Homo sapiens
ctggcaggcggaggttgcagtg

SEQ ID NO: 7106270 - DNA, 22 bp, Homo sapiens
ctggcaggctctctggtcggtt

SEQ ID NO: 7106271 - DNA, 22 bp, Homo sapiens
ctggcaggctctctggtcggtt

SEQ ID NO: 7106272 - DNA, 22 bp, Homo sapiens
ctggcaggctctctggtcggtt

SEQ ID NO: 7106273 - DNA, 22 bp, Homo sapiens
ctggcaggctctctggtcggtt

SEQ ID NO: 7106274 - DNA, 22 bp, Homo sapiens
ctggcaggctctctggtcggtt

SEQ ID NO: 7106275 - DNA, 22 bp, Homo sapiens
ctggcaggctctctggtcggtt

SEQ ID NO: 7106276 - DNA, 22 bp, Homo sapiens
ctggcagggcaggggtttgtgc

SEQ ID NO: 7106277 - DNA, 22 bp, Homo sapiens
ctggcagggcaggggtttgtgc

SEQ ID NO: 7106278 - DNA, 22 bp, Homo sapiens
ctggcagggcaggggtttgtgc

SEQ ID NO: 7106279 - DNA, 22 bp, Homo sapiens
ctggcagggcaggggtttgtgc

SEQ ID NO: 7106280 - DNA, 22 bp, Homo sapiens
ctggcagggctctttgggtgct

SEQ ID NO: 7106281 - DNA, 22 bp, Homo sapiens
ctggcagggctctttgggtgct

SEQ ID NO: 7106282 - DNA, 22 bp, Homo sapiens
ctggccagctgacagcagggct

SEQ ID NO: 7106283 - DNA, 22 bp, Homo sapiens
ctggccagctgacagcagggct

SEQ ID NO: 7106284 - DNA, 22 bp, Homo sapiens
ctggccagctgacagcagggct

SEQ ID NO: 7106285 - DNA, 22 bp, Homo sapiens
ctggccagctgacagcagggct

SEQ ID NO: 7106286 - DNA, 22 bp, Homo sapiens
ctggccagctgacagcagggct

SEQ ID NO: 7106287 - DNA, 22 bp, Homo sapiens
ctggccagctgacagcagggct

SEQ ID NO: 7106288 - DNA, 22 bp, Homo sapiens
ctggccaggaggtaaccagatg

SEQ ID NO: 7106289 - DNA, 22 bp, Homo sapiens
ctggccaggaggtaaccagatg

SEQ ID NO: 7106290 - DNA, 22 bp, Homo sapiens
ctggccaggcatcccctgatcc

SEQ ID NO: 7106291 - DNA, 22 bp, Homo sapiens
ctggccagcctcccaggtaccc

SEQ ID NO: 7106292 - DNA, 22 bp, Homo sapiens
ctggccagcctcccaggtaccc

SEQ ID NO: 7106293 - DNA, 22 bp, Homo sapiens
ctggccagcctcccaggtaccc

SEQ ID NO: 7106294 - DNA, 22 bp, Homo sapiens
ctggccagcctcccaggtaccc

SEQ ID NO: 7106295 - DNA, 22 bp, Homo sapiens
ctggccagcctgtcgatgccct

SEQ ID NO: 7106296 - DNA, 22 bp, Homo sapiens
ctggccagcctgtcgatgccct

SEQ ID NO: 7106297 - DNA, 22 bp, Homo sapiens
ctggccagcctgtcgatgccct

SEQ ID NO: 7106298 - DNA, 22 bp, Homo sapiens
ctggccagctgacagcagggct

SEQ ID NO: 7106299 - DNA, 22 bp, Homo sapiens
ctggccagctgacagcagggct

SEQ ID NO: 7106300 - DNA, 22 bp, Homo sapiens
ctggccagctgacagcagggct

SEQ ID NO: 7106301 - DNA, 22 bp, Homo sapiens
ctggccagcctcccaggtaccc

SEQ ID NO: 7106302 - DNA, 22 bp, Homo sapiens
ctggccagcctcccaggtaccc

SEQ ID NO: 7106303 - DNA, 22 bp, Homo sapiens
ctggccagcatttttgctttag

SEQ ID NO: 7106304 - DNA, 22 bp, Homo sapiens
ctggccagcatttttgctttag

SEQ ID NO: 7106305 - DNA, 22 bp, Homo sapiens
ctggccagcatggctgaagtac

SEQ ID NO: 7106306 - DNA, 22 bp, Homo sapiens
ctggccagcatggctgaagtac

SEQ ID NO: 7106307 - DNA, 22 bp, Homo sapiens
ctggccagatgttacgtccaat

SEQ ID NO: 7106308 - DNA, 22 bp, Homo sapiens
ctggccagatgttacgtccaat

SEQ ID NO: 7106309 - DNA, 22 bp, Homo sapiens
ctggccagcatggctgaagtac

SEQ ID NO: 7106310 - DNA, 22 bp, Homo sapiens
ctggccagcatggctgaagtac

SEQ ID NO: 7106311 - DNA, 22 bp, Homo sapiens
ctggccagcatggctgaagtac

SEQ ID NO: 7106312 - DNA, 22 bp, Homo sapiens
ctggccactgcgggcctctgcc

SEQ ID NO: 7106313 - DNA, 22 bp, Homo sapiens
ctggccactgcgggcctctgcc

SEQ ID NO: 7106314 - DNA, 22 bp, Homo sapiens
ctggccagagttggagggtgtg

SEQ ID NO: 7106315 - DNA, 22 bp, Homo sapiens
ctggccagagttggagggtgtg

SEQ ID NO: 7106316 - DNA, 22 bp, Homo sapiens
ctggccagagttggagggtgtg

SEQ ID NO: 7106317 - DNA, 22 bp, Homo sapiens
ctggccagagttggagggtgtg

SEQ ID NO: 7106318 - DNA, 22 bp, Homo sapiens
ctggccagagttggagggtgtg

SEQ ID NO: 7106319 - DNA, 22 bp, Homo sapiens
ctggccagatgttacgtccaat

SEQ ID NO: 7106320 - DNA, 22 bp, Homo sapiens
ctcttattcctacagtaacagg

SEQ ID NO: 7106321 - DNA, 22 bp, Homo sapiens
ctcttattcctacagtaacagg

SEQ ID NO: 7106322 - DNA, 22 bp, Homo sapiens
ctcttattgatgaaggtgctaa

SEQ ID NO: 7106323 - DNA, 22 bp, Homo sapiens
ctcttattcctacagtaacagg

SEQ ID NO: 7106324 - DNA, 22 bp, Homo sapiens
ctcttattcctacagtaacagg

SEQ ID NO: 7106325 - DNA, 22 bp, Homo sapiens
ctcttattttatggcatttgtg

SEQ ID NO: 7106326 - DNA, 22 bp, Homo sapiens
ttttagtaccaaccagaagatg

SEQ ID NO: 7106327 - DNA, 22 bp, Homo sapiens
ttttagtaccaaccagaagatg

SEQ ID NO: 7106328 - DNA, 22 bp, Homo sapiens
ttttagttactgcagtagcaaa

SEQ ID NO: 7106329 - DNA, 22 bp, Homo sapiens
ttttagttactgcagtagcaaa

SEQ ID NO: 7106330 - DNA, 22 bp, Homo sapiens
ttttagttactgcagtagcaaa

SEQ ID NO: 7106331 - DNA, 18 bp, Homo sapiens
ctctgtgttggtgtgaag

SEQ ID NO: 7106332 - DNA, 22 bp, Homo sapiens
ttttagttactgcagtagcaaa

SEQ ID NO: 7106333 - DNA, 22 bp, Homo sapiens
ctcttcaatagattgttgaggg

SEQ ID NO: 7106334 - DNA, 22 bp, Homo sapiens
ctcttccacctccttcaggaga

SEQ ID NO: 7106335 - DNA, 22 bp, Homo sapiens
ctcttccatattactcagggta

SEQ ID NO: 7106336 - DNA, 22 bp, Homo sapiens
ctcttccatttctacttcacag

SEQ ID NO: 7106337 - DNA, 22 bp, Homo sapiens
ctctttagtcacagggcttcat

SEQ ID NO: 7106338 - DNA, 22 bp, Homo sapiens
ctctttagtctgtgtggagaag

SEQ ID NO: 7106339 - DNA, 22 bp, Homo sapiens
ctctttagtggtgatgatgcta

SEQ ID NO: 7106340 - DNA, 22 bp, Homo sapiens
ctctttagtggtgatgatgcta

SEQ ID NO: 7106341 - DNA, 22 bp, Homo sapiens
ctctttaactcccattctgtcc

SEQ ID NO: 7106342 - DNA, 22 bp, Homo sapiens
ctctttaagctcctaacagcca

SEQ ID NO: 7106343 - DNA, 22 bp, Homo sapiens
ctctttaagctcctaacagcca

SEQ ID NO: 7106344 - DNA, 22 bp, Homo sapiens
ctctttaaagtaaaatttgtct

SEQ ID NO: 7106345 - DNA, 22 bp, Homo sapiens
ttttcagttactgtttatgtga

SEQ ID NO: 7106346 - DNA, 22 bp, Homo sapiens
ttttcagttactgtttatgtga

SEQ ID NO: 7106347 - DNA, 22 bp, Homo sapiens
ctcttcttgctagactgagtgc

SEQ ID NO: 7106348 - DNA, 22 bp, Homo sapiens
ctcttcttgctagactgagtgc

SEQ ID NO: 7106349 - DNA, 22 bp, Homo sapiens
ctcttcttggaatgctgactgt

SEQ ID NO: 7106350 - DNA, 22 bp, Homo sapiens
ttttcagtaatgtctacataat

SEQ ID NO: 7106351 - DNA, 22 bp, Homo sapiens
ttttcagtaatgtctacataat

SEQ ID NO: 7106352 - DNA, 22 bp, Homo sapiens
ttttcagtggtatctttgtaaa

SEQ ID NO: 7106353 - DNA, 22 bp, Homo sapiens
ttttcaggccagaagatagacc

SEQ ID NO: 7106354 - DNA, 22 bp, Homo sapiens
ttttcagaggcctaagaggttt

SEQ ID NO: 7106355 - DNA, 22 bp, Homo sapiens
ttttcagaggcctaagaggttt

SEQ ID NO: 7106356 - DNA, 22 bp, Homo sapiens
ttttcagaggcctaagaggttt

SEQ ID NO: 7106357 - DNA, 22 bp, Homo sapiens
ttttcacttaaggaatttcatg

SEQ ID NO: 7106358 - DNA, 22 bp, Homo sapiens
ttttcaccatagacactggtcc

SEQ ID NO: 7106359 - DNA, 22 bp, Homo sapiens
ttttcacttaaggaatttcatg

SEQ ID NO: 7106360 - DNA, 22 bp, Homo sapiens
ttttcagaaagatgagaaatta

SEQ ID NO: 7106361 - DNA, 22 bp, Homo sapiens
ttttcagaaagatgagaaatta

SEQ ID NO: 7106362 - DNA, 22 bp, Homo sapiens
ttttcagaattagcataccatt

SEQ ID NO: 7106363 - DNA, 22 bp, Homo sapiens
ttttcagaattagcataccatt

SEQ ID NO: 7106364 - DNA, 22 bp, Homo sapiens
ttttcagagagcttttatgtcc

SEQ ID NO: 7106365 - DNA, 22 bp, Homo sapiens
ttttcagagagcttttatgtcc

SEQ ID NO: 7106366 - DNA, 22 bp, Homo sapiens
ttttcagaattagcataccatt

SEQ ID NO: 7106367 - DNA, 22 bp, Homo sapiens
tttgtacagtgatgttgtatgc

SEQ ID NO: 7106368 - DNA, 22 bp, Homo sapiens
tttgtacagtgaaagcgaggtt

SEQ ID NO: 7106369 - DNA, 22 bp, Homo sapiens
tttgtacactgtctactatgaa

SEQ ID NO: 7106370 - DNA, 22 bp, Homo sapiens
tttgtacactgtctactatgaa

SEQ ID NO: 7106371 - DNA, 22 bp, Homo sapiens
tttgtacactgtctactatgaa

SEQ ID NO: 7106372 - DNA, 22 bp, Homo sapiens
tttgtacactgtctactatgaa

SEQ ID NO: 7106373 - DNA, 22 bp, Homo sapiens
tttgtacactgtctactatgaa

SEQ ID NO: 7106374 - DNA, 22 bp, Homo sapiens
tttgtacacctacctaatacag

SEQ ID NO: 7106375 - DNA, 22 bp, Homo sapiens
tttgtacacaggatgttataat

SEQ ID NO: 7106376 - DNA, 22 bp, Homo sapiens
tttgggcagaagctgaatgtct

SEQ ID NO: 7106377 - DNA, 22 bp, Homo sapiens
tttgggcagaaacatgcgcccc

SEQ ID NO: 7106378 - DNA, 22 bp, Homo sapiens
tttgggcaattcagtgggacct

SEQ ID NO: 7106379 - DNA, 22 bp, Homo sapiens
tttgggcacacaaatattttat

SEQ ID NO: 7106380 - DNA, 22 bp, Homo sapiens
tttgggcacagatattaagtat

SEQ ID NO: 7106381 - DNA, 20 bp, Homo sapiens
tttgggcacggctagatttt

SEQ ID NO: 7106382 - DNA, 22 bp, Homo sapiens
tttgtacatatataaaatctgt

SEQ ID NO: 7106383 - DNA, 22 bp, Homo sapiens
tttgtacatataaatcttgtat

SEQ ID NO: 7106384 - DNA, 22 bp, Homo sapiens
tttgtacatataaatcttgtat

SEQ ID NO: 7106385 - DNA, 22 bp, Homo sapiens
tttgtacatcctaattctgagt

SEQ ID NO: 7106386 - DNA, 22 bp, Homo sapiens
tttgttctgaaaactcaagtcc

SEQ ID NO: 7106387 - DNA, 22 bp, Homo sapiens
tttgttctgaaaactcaagtcc

SEQ ID NO: 7106388 - DNA, 22 bp, Homo sapiens
tttgttctgaaaactcaagtcc

SEQ ID NO: 7106389 - DNA, 22 bp, Homo sapiens
tttgttctgaaaatcttccctt

SEQ ID NO: 7106390 - DNA, 22 bp, Homo sapiens
ttttaagatgctagtatttcag

SEQ ID NO: 7106391 - DNA, 22 bp, Homo sapiens
ttttaagtgcaatctgaatgcg

SEQ ID NO: 7106392 - DNA, 19 bp, Homo sapiens
ttttaagtcctctctattc

SEQ ID NO: 7106393 - DNA, 19 bp, Homo sapiens
ttttaagtcctctctattc

SEQ ID NO: 7106394 - DNA, 19 bp, Homo sapiens
ttttaagtgccctttcttc

SEQ ID NO: 7106395 - DNA, 22 bp, Homo sapiens
ttttaatactgctattgtagga

SEQ ID NO: 7106396 - DNA, 22 bp, Homo sapiens
ttttaatactgctattgtagga

SEQ ID NO: 7106397 - DNA, 22 bp, Homo sapiens
ttttaatactgctattgtagga

SEQ ID NO: 7106398 - DNA, 22 bp, Homo sapiens
ttttaagttggattgctaagta

SEQ ID NO: 7106399 - DNA, 22 bp, Homo sapiens
ttttaatactgctattgtagga

SEQ ID NO: 7106400 - DNA, 22 bp, Homo sapiens
ttttaatactgctattgtagga

SEQ ID NO: 7106401 - DNA, 22 bp, Homo sapiens
ttttaatactgctattgtagga

SEQ ID NO: 7106402 - DNA, 22 bp, Homo sapiens
ttttaatactgctattgtagga

SEQ ID NO: 7106403 - DNA, 22 bp, Homo sapiens
ttttagattataagtctaattc

SEQ ID NO: 7106404 - DNA, 22 bp, Homo sapiens
ttttagattataagtctaattc

SEQ ID NO: 7106405 - DNA, 22 bp, Homo sapiens
ttttagacttgtatgtaaagcc

SEQ ID NO: 7106406 - DNA, 22 bp, Homo sapiens
ttttagatagtttaactgcact

SEQ ID NO: 7106407 - DNA, 22 bp, Homo sapiens
ttttagactccatctgattcag

SEQ ID NO: 7106408 - DNA, 22 bp, Homo sapiens
ttttagaatcaggttgtctggg

SEQ ID NO: 7106409 - DNA, 22 bp, Homo sapiens
ttttagaatcaggttgtctggg

SEQ ID NO: 7106410 - DNA, 22 bp, Homo sapiens
ttttagcactaagtgatatgct

SEQ ID NO: 7106411 - DNA, 22 bp, Homo sapiens
ttttagcacactttctttagcg

SEQ ID NO: 7106412 - DNA, 22 bp, Homo sapiens
ttttagattgggaaatgtaaag

SEQ ID NO: 7106413 - DNA, 22 bp, Homo sapiens
ttttagattgggaaatgtaaag

SEQ ID NO: 7106414 - DNA, 20 bp, Homo sapiens
ttttagcacttgttatggtg

SEQ ID NO: 7106415 - DNA, 20 bp, Homo sapiens
ttttagcacttgttatggtg

SEQ ID NO: 7106416 - DNA, 22 bp, Homo sapiens
tttgggcaattcagtgggacct

SEQ ID NO: 7106417 - DNA, 22 bp, Homo sapiens
tttgggcaagctcactgattca

SEQ ID NO: 7106418 - DNA, 22 bp, Homo sapiens
tttgggcaaggtccagattcct

SEQ ID NO: 7106419 - DNA, 22 bp, Homo sapiens
tttgggatgctagacacctcag

SEQ ID NO: 7106420 - DNA, 22 bp, Homo sapiens
tttgggattttacattgtatgg

SEQ ID NO: 7106421 - DNA, 22 bp, Homo sapiens
tttgggattttacattgtatgg

SEQ ID NO: 7106422 - DNA, 21 bp, Homo sapiens
tttgggcaaaattaaatgaga

SEQ ID NO: 7106423 - DNA, 22 bp, Homo sapiens
tttgggcaaaggtagaaggaga

SEQ ID NO: 7106424 - DNA, 22 bp, Homo sapiens
tttgggaataattgcacagatt

SEQ ID NO: 7106425 - DNA, 22 bp, Homo sapiens
tttgggaagtttaaaataagta

SEQ ID NO: 7106426 - DNA, 22 bp, Homo sapiens
tttgggaagtttaaaataagta

SEQ ID NO: 7106427 - DNA, 22 bp, Homo sapiens
tttgggaataattgcacagatt

SEQ ID NO: 7106428 - DNA, 22 bp, Homo sapiens
tttgggaataattgcacagatt

SEQ ID NO: 7106429 - DNA, 18 bp, Homo sapiens
tttgggatcctcttttct

SEQ ID NO: 7106430 - DNA, 22 bp, Homo sapiens
tttgggaagaggaatctctgga

SEQ ID NO: 7106431 - DNA, 22 bp, Homo sapiens
tttgggaactctatcatggaaa

SEQ ID NO: 7106432 - DNA, 22 bp, Homo sapiens
tttgggaactggacttcctgct

SEQ ID NO: 7106433 - DNA, 19 bp, Homo sapiens
tttgggaagcccagagtgt

SEQ ID NO: 7106434 - DNA, 19 bp, Homo sapiens
tttgggaagcccagagtgt

SEQ ID NO: 7106435 - DNA, 22 bp, Homo sapiens
tttgggaaggcagacatcccac

SEQ ID NO: 7106436 - DNA, 23 bp, Homo sapiens
tttgggaagggagagagtaagca

SEQ ID NO: 7106437 - DNA, 23 bp, Homo sapiens
tttgggaagggagagagtaagca

SEQ ID NO: 7106438 - DNA, 22 bp, Homo sapiens
tttgggaagtgggagcaaggtg

SEQ ID NO: 7106439 - DNA, 22 bp, Homo sapiens
tttgggaagtgggagcaaggtg

SEQ ID NO: 7106440 - DNA, 22 bp, Homo sapiens
ctctggaattaaggaagcctgt

SEQ ID NO: 7106441 - DNA, 22 bp, Homo sapiens
ctctggaatgtttacatgccct

SEQ ID NO: 7106442 - DNA, 22 bp, Homo sapiens
ctctggaatgtttacatgccct

SEQ ID NO: 7106443 - DNA, 22 bp, Homo sapiens
ctctggaatgtttacatgccct

SEQ ID NO: 7106444 - DNA, 22 bp, Homo sapiens
ctctggaatgggtgtttctaac

SEQ ID NO: 7106445 - DNA, 22 bp, Homo sapiens
ctctggaatgggtgtttctaac

SEQ ID NO: 7106446 - DNA, 22 bp, Homo sapiens
ctctggaagaatacacttagaa

SEQ ID NO: 7106447 - DNA, 22 bp, Homo sapiens
ctctggaagaatacacttagaa

SEQ ID NO: 7106448 - DNA, 20 bp, Homo sapiens
ctctggaagagtttaaatgg

SEQ ID NO: 7106449 - DNA, 20 bp, Homo sapiens
ctctggaagagtttaaatgg

SEQ ID NO: 7106450 - DNA, 22 bp, Homo sapiens
ctctggaagatgacctgggtaa

SEQ ID NO: 7106451 - DNA, 22 bp, Homo sapiens
ctctggaagtgatggcaggtca

SEQ ID NO: 7106452 - DNA, 22 bp, Homo sapiens
ctctggaagtgatggcaggtca

SEQ ID NO: 7106453 - DNA, 22 bp, Homo sapiens
tttggaattggcattctattct

SEQ ID NO: 7106454 - DNA, 22 bp, Homo sapiens
tttggaattggtggaggaaggg

SEQ ID NO: 7106455 - DNA, 17 bp, Homo sapiens
tttggaatttaaaggca

SEQ ID NO: 7106456 - DNA, 22 bp, Homo sapiens
tttggacaaacagaatagagct

SEQ ID NO: 7106457 - DNA, 22 bp, Homo sapiens
tttggacaaacagaatagagct

SEQ ID NO: 7106458 - DNA, 22 bp, Homo sapiens
tttggacaaatgtctgactttc

SEQ ID NO: 7106459 - DNA, 22 bp, Homo sapiens
tttgggaaatattgtgttcaag

SEQ ID NO: 7106460 - DNA, 22 bp, Homo sapiens
tttgggaaatagtagaaaatgt

SEQ ID NO: 7106461 - DNA, 22 bp, Homo sapiens
tttgggaaatagtagaaaatgt

SEQ ID NO: 7106462 - DNA, 22 bp, Homo sapiens
tttgggaaataaacctagagga

SEQ ID NO: 7106463 - DNA, 22 bp, Homo sapiens
tttgggaaataaacctagagga

SEQ ID NO: 7106464 - DNA, 22 bp, Homo sapiens
tttgggaaatattgtgttcaag

SEQ ID NO: 7106465 - DNA, 20 bp, Homo sapiens
tttgggaaatgcaggtttca

SEQ ID NO: 7106466 - DNA, 22 bp, Homo sapiens
tttgggaacaatgaggatctga

SEQ ID NO: 7106467 - DNA, 22 bp, Homo sapiens
tttgggaaccagaagttcaaaa

SEQ ID NO: 7106468 - DNA, 22 bp, Homo sapiens
tttgggaaccagaagttcaaaa

SEQ ID NO: 7106469 - DNA, 22 bp, Homo sapiens
ctctgctttcctcttacacact

SEQ ID NO: 7106470 - DNA, 20 bp, Homo sapiens
ctctgctttccacctttcag

SEQ ID NO: 7106471 - DNA, 22 bp, Homo sapiens
tttgctcacttgtgtattttca

SEQ ID NO: 7106472 - DNA, 22 bp, Homo sapiens
tttgctcagttctctgtatttt

SEQ ID NO: 7106473 - DNA, 22 bp, Homo sapiens
tttgctcagttctctgtatttt

SEQ ID NO: 7106474 - DNA, 22 bp, Homo sapiens
tttgctcagtttgataatttga

SEQ ID NO: 7106475 - DNA, 22 bp, Homo sapiens
tttgctctgacagtgccagaga

SEQ ID NO: 7106476 - DNA, 22 bp, Homo sapiens
tttgctcttgctgcttggggca

SEQ ID NO: 7106477 - DNA, 22 bp, Homo sapiens
tttgctcttgctggaaaagttg

SEQ ID NO: 7106478 - DNA, 22 bp, Homo sapiens
ctctgctttttaaaaggagtcc

SEQ ID NO: 7106479 - DNA, 22 bp, Homo sapiens
ctctggaaaaccactagcagga

SEQ ID NO: 7106480 - DNA, 22 bp, Homo sapiens
ctctggaaaaccactagcagga

SEQ ID NO: 7106481 - DNA, 22 bp, Homo sapiens
ctctggaaaaccactagcagga

SEQ ID NO: 7106482 - DNA, 22 bp, Homo sapiens
ctctggaaaaccactagcagga

SEQ ID NO: 7106483 - DNA, 22 bp, Homo sapiens
ctctggaaatggccatagtcat

SEQ ID NO: 7106484 - DNA, 22 bp, Homo sapiens
ctctggaagaatacacttagaa

SEQ ID NO: 7106485 - DNA, 22 bp, Homo sapiens
ctctggaaaattgtgtgggggt

SEQ ID NO: 7106486 - DNA, 22 bp, Homo sapiens
ctctggaaaattgtgtgggggt

SEQ ID NO: 7106487 - DNA, 22 bp, Homo sapiens
tttgccaggcttgcatgaattt

SEQ ID NO: 7106488 - DNA, 19 bp, Homo sapiens
ctctgcctctggctgtggc

SEQ ID NO: 7106489 - DNA, 19 bp, Homo sapiens
ctctgcctctggctgtggc

SEQ ID NO: 7106490 - DNA, 19 bp, Homo sapiens
ctctgcctccctcctgggt

SEQ ID NO: 7106491 - DNA, 22 bp, Homo sapiens
ctctgcctcagtgatttcttta

SEQ ID NO: 7106492 - DNA, 19 bp, Homo sapiens
ctctgcctccctcctgggt

SEQ ID NO: 7106493 - DNA, 19 bp, Homo sapiens
ctctgcctccctcctgggt

SEQ ID NO: 7106494 - DNA, 19 bp, Homo sapiens
ctctgcctccctcctgggt

SEQ ID NO: 7106495 - DNA, 22 bp, Homo sapiens
ctctgcctcccaggttcaagcg

SEQ ID NO: 7106496 - DNA, 22 bp, Homo sapiens
ctctgcctcccaggttcaagcg

SEQ ID NO: 7106497 - DNA, 22 bp, Homo sapiens
ctctgcctcagtgatttcttta

SEQ ID NO: 7106498 - DNA, 22 bp, Homo sapiens
ctctgcctcagtgatttcttta

SEQ ID NO: 7106499 - DNA, 22 bp, Homo sapiens
ctctgccctcgcacatctgcca

SEQ ID NO: 7106500 - DNA, 22 bp, Homo sapiens
ctctgccctcgcacatctgcca

SEQ ID NO: 7106501 - DNA, 22 bp, Homo sapiens
ctctgcccgcggatgccacgtc

SEQ ID NO: 7106502 - DNA, 22 bp, Homo sapiens
ctctgcccagtgcccacaggag

SEQ ID NO: 7106503 - DNA, 22 bp, Homo sapiens
ctctgcccgcggatgccacgtc

SEQ ID NO: 7106504 - DNA, 22 bp, Homo sapiens
ctctgcccgcggatgccacgtc

SEQ ID NO: 7106505 - DNA, 21 bp, Homo sapiens
ctctgcccagggcctcctgcc

SEQ ID NO: 7106506 - DNA, 21 bp, Homo sapiens
ctctgcccagggcctcctgcc

SEQ ID NO: 7106507 - DNA, 21 bp, Homo sapiens
ctctgcccagggcctcctgcc

SEQ ID NO: 7106508 - DNA, 21 bp, Homo sapiens
ctctgcccagggcctcctgcc

SEQ ID NO: 7106509 - DNA, 22 bp, Homo sapiens
ctctgcccagtgcccacaggag

SEQ ID NO: 7106510 - DNA, 22 bp, Homo sapiens
ctctgcccagtgcccacaggag

SEQ ID NO: 7106511 - DNA, 22 bp, Homo sapiens
ctctgcccagtgcccacaggag

SEQ ID NO: 7106512 - DNA, 19 bp, Homo sapiens
ctctgccatttgctgcctg

SEQ ID NO: 7106513 - DNA, 19 bp, Homo sapiens
ctctgccatttgctgcctg

SEQ ID NO: 7106514 - DNA, 22 bp, Homo sapiens
ctctgcccacgtcttgcccaga

SEQ ID NO: 7106515 - DNA, 22 bp, Homo sapiens
ctctgcccacgtcttgcccaga

SEQ ID NO: 7106516 - DNA, 21 bp, Homo sapiens
ctctgcccagggcctcctgcc

SEQ ID NO: 7106517 - DNA, 22 bp, Homo sapiens
ctctgcccacgtcttgcccaga

SEQ ID NO: 7106518 - DNA, 21 bp, Homo sapiens
ctctgcccagggcctcctgcc

SEQ ID NO: 7106519 - DNA, 22 bp, Homo sapiens
ctctgccaggcagaacggcttt

SEQ ID NO: 7106520 - DNA, 22 bp, Homo sapiens
ctctgccagtttctggcctcag

SEQ ID NO: 7106521 - DNA, 22 bp, Homo sapiens
ctctgccagtttctggcctcag

SEQ ID NO: 7106522 - DNA, 22 bp, Homo sapiens
ctctgccatcttggagctcaag

SEQ ID NO: 7106523 - DNA, 22 bp, Homo sapiens
tttcctttatgacatcaccact

SEQ ID NO: 7106524 - DNA, 20 bp, Homo sapiens
tttcctttcattttagtacc

SEQ ID NO: 7106525 - DNA, 22 bp, Homo sapiens
tttcctttccaaaattctgcct

SEQ ID NO: 7106526 - DNA, 22 bp, Homo sapiens
tttcctttatgacatcaccact

SEQ ID NO: 7106527 - DNA, 22 bp, Homo sapiens
tttccttgttattatttgtcct

SEQ ID NO: 7106528 - DNA, 22 bp, Homo sapiens
tttcctttccaaaattctgcct

SEQ ID NO: 7106529 - DNA, 22 bp, Homo sapiens
tttcctttccaaaattctgcct

SEQ ID NO: 7106530 - DNA, 22 bp, Homo sapiens
ctctgcagaggcccaaggctga

SEQ ID NO: 7106531 - DNA, 22 bp, Homo sapiens
ctctgcagaggcccaaggctga

SEQ ID NO: 7106532 - DNA, 20 bp, Homo sapiens
ctctgcagcaaggcctgggt

SEQ ID NO: 7106533 - DNA, 20 bp, Homo sapiens
ctctgcagcaaggcctgggt

SEQ ID NO: 7106534 - DNA, 22 bp, Homo sapiens
ctctgcagaggcccaaggctga

SEQ ID NO: 7106535 - DNA, 20 bp, Homo sapiens
ctctgcagcaaggcctgggt

SEQ ID NO: 7106536 - DNA, 22 bp, Homo sapiens
ctctgccaccatgcttcctgac

SEQ ID NO: 7106537 - DNA, 22 bp, Homo sapiens
ctctgccaccatgcttcctgac

SEQ ID NO: 7106538 - DNA, 22 bp, Homo sapiens
ctgagcccaggcgggagctgag

SEQ ID NO: 7106539 - DNA, 22 bp, Homo sapiens
ctgagcccaggcgggagctgag

SEQ ID NO: 7106540 - DNA, 20 bp, Homo sapiens
ctgagcccagatcccaggtc

SEQ ID NO: 7106541 - DNA, 20 bp, Homo sapiens
ctgagcccccagcctgcagg

SEQ ID NO: 7106542 - DNA, 22 bp, Homo sapiens
ctgagccccatctgaggtgccc

SEQ ID NO: 7106543 - DNA, 17 bp, Homo sapiens
ctgagccccgggcagct

SEQ ID NO: 7106544 - DNA, 22 bp, Homo sapiens
ctgaggcagagggcagaccaga

SEQ ID NO: 7106545 - DNA, 22 bp, Homo sapiens
ctgagcctccatttcatcaggt

SEQ ID NO: 7106546 - DNA, 22 bp, Homo sapiens
ctgagcctcctgcttctatttc

SEQ ID NO: 7106547 - DNA, 19 bp, Homo sapiens
ctgagcctcagtttcctag

SEQ ID NO: 7106548 - DNA, 22 bp, Homo sapiens
ctgaggcagagggcagaccaga

SEQ ID NO: 7106549 - DNA, 21 bp, Homo sapiens
ctgaggcagcacagctagtca

SEQ ID NO: 7106550 - DNA, 22 bp, Homo sapiens
ctgagcccttgcttatgcttcc

SEQ ID NO: 7106551 - DNA, 22 bp, Homo sapiens
ctgagccatgagcctgcgccca

SEQ ID NO: 7106552 - DNA, 22 bp, Homo sapiens
ctgagccatgggtctaagcact

SEQ ID NO: 7106553 - DNA, 22 bp, Homo sapiens
ctgagccatccataccagctta

SEQ ID NO: 7106554 - DNA, 22 bp, Homo sapiens
ctgagccatccataccagctta

SEQ ID NO: 7106555 - DNA, 22 bp, Homo sapiens
ctgagccatccataccagctta

SEQ ID NO: 7106556 - DNA, 22 bp, Homo sapiens
ctgagccatgagcctgcgccca

SEQ ID NO: 7106557 - DNA, 22 bp, Homo sapiens
ctgagccataagggaggctggg

SEQ ID NO: 7106558 - DNA, 22 bp, Homo sapiens
ctgagccataagggaggctggg

SEQ ID NO: 7106559 - DNA, 22 bp, Homo sapiens
ctgagccatccataccagctta

SEQ ID NO: 7106560 - DNA, 22 bp, Homo sapiens
ctgagccataagggaggctggg

SEQ ID NO: 7106561 - DNA, 22 bp, Homo sapiens
ctgagccataagggaggctggg

SEQ ID NO: 7106562 - DNA, 22 bp, Homo sapiens
ctgagccagtagtcagggacaa

SEQ ID NO: 7106563 - DNA, 22 bp, Homo sapiens
ctgagccataagggaggctggg

SEQ ID NO: 7106564 - DNA, 22 bp, Homo sapiens
ctgagccataagggaggctggg

SEQ ID NO: 7106565 - DNA, 22 bp, Homo sapiens
ctgagccagtagtcagggacaa

SEQ ID NO: 7106566 - DNA, 22 bp, Homo sapiens
ctgagccagtagtcagggacaa

SEQ ID NO: 7106567 - DNA, 22 bp, Homo sapiens
ctgagccagtagtcagggacaa

SEQ ID NO: 7106568 - DNA, 20 bp, Homo sapiens
ctgagccaactctcttcttg

SEQ ID NO: 7106569 - DNA, 22 bp, Homo sapiens
ctgactgggttaagttcatgta

SEQ ID NO: 7106570 - DNA, 22 bp, Homo sapiens
ctgactctctgagctcaaggtt

SEQ ID NO: 7106571 - DNA, 22 bp, Homo sapiens
ctgactcctatcacagtgttct

SEQ ID NO: 7106572 - DNA, 22 bp, Homo sapiens
ctgactcctatgccccatgggc

SEQ ID NO: 7106573 - DNA, 22 bp, Homo sapiens
ctgactcctatgccccatgggc

SEQ ID NO: 7106574 - DNA, 22 bp, Homo sapiens
ctgactccttaccatatgcttt

SEQ ID NO: 7106575 - DNA, 18 bp, Homo sapiens
ctgactcctttgctgcca

SEQ ID NO: 7106576 - DNA, 18 bp, Homo sapiens
ctgacctctgagcccctc

SEQ ID NO: 7106577 - DNA, 18 bp, Homo sapiens
ctgacctctgagcccctc

SEQ ID NO: 7106578 - DNA, 22 bp, Homo sapiens
ctgacctgctaagcccctgtcc

SEQ ID NO: 7106579 - DNA, 22 bp, Homo sapiens
ctgacctggccttggtgggcca

SEQ ID NO: 7106580 - DNA, 23 bp, Homo sapiens
ctgactcatcccaccacctcctc

SEQ ID NO: 7106581 - DNA, 22 bp, Homo sapiens
ctgactcccaagctagtgctct

SEQ ID NO: 7106582 - DNA, 22 bp, Homo sapiens
ctctttctcgccgcccgcagtc

SEQ ID NO: 7106583 - DNA, 22 bp, Homo sapiens
ctctttctgattcgctgggacc

SEQ ID NO: 7106584 - DNA, 22 bp, Homo sapiens
ctctttcctcagccacagtcta

SEQ ID NO: 7106585 - DNA, 22 bp, Homo sapiens
ctctttctcattgtcagcagaa

SEQ ID NO: 7106586 - DNA, 22 bp, Homo sapiens
ctctttagtggtgatgatgcta

SEQ ID NO: 7106587 - DNA, 22 bp, Homo sapiens
ctctttagtttgaaatccacat

SEQ ID NO: 7106588 - DNA, 17 bp, Homo sapiens
ctctttataaagagtta

SEQ ID NO: 7106589 - DNA, 17 bp, Homo sapiens
ctctttataaagagtta

SEQ ID NO: 7106590 - DNA, 22 bp, Homo sapiens
ctgaatatcatttatcattggc

SEQ ID NO: 7106591 - DNA, 22 bp, Homo sapiens
ctctttggatgtttatgataag

SEQ ID NO: 7106592 - DNA, 22 bp, Homo sapiens
ctctttggatagaattacaaag

SEQ ID NO: 7106593 - DNA, 22 bp, Homo sapiens
ctctttgaaatccatcactgct

SEQ ID NO: 7106594 - DNA, 18 bp, Homo sapiens
ctctttctttggcacaaa

SEQ ID NO: 7106595 - DNA, 22 bp, Homo sapiens
ctctttgcctaactgttttcaa

SEQ ID NO: 7106596 - DNA, 22 bp, Homo sapiens
ctctttctggaaggcagagtgg

SEQ ID NO: 7106597 - DNA, 18 bp, Homo sapiens
ctgaccctggctctgggt

SEQ ID NO: 7106598 - DNA, 22 bp, Homo sapiens
ctgacccatataagagtggagg

SEQ ID NO: 7106599 - DNA, 20 bp, Homo sapiens
ctgaccagcagcctgtctcc

SEQ ID NO: 7106600 - DNA, 22 bp, Homo sapiens
ctgaccagccctgcccagggaa

SEQ ID NO: 7106601 - DNA, 22 bp, Homo sapiens
ctgaccagtccttagcacctgg

SEQ ID NO: 7106602 - DNA, 22 bp, Homo sapiens
ctgaccagccctgcccagggaa

SEQ ID NO: 7106603 - DNA, 22 bp, Homo sapiens
ctgacatgtataagctttaagt

SEQ ID NO: 7106604 - DNA, 22 bp, Homo sapiens
ctgacatttactgagcacttac

SEQ ID NO: 7106605 - DNA, 22 bp, Homo sapiens
ctgaccactgttctcctggggt

SEQ ID NO: 7106606 - DNA, 22 bp, Homo sapiens
ctgaccagaccccaggaggctg

SEQ ID NO: 7106607 - DNA, 22 bp, Homo sapiens
ctgacaggttggtagctttgga

SEQ ID NO: 7106608 - DNA, 22 bp, Homo sapiens
ctgacaggttggtagctttgga

SEQ ID NO: 7106609 - DNA, 22 bp, Homo sapiens
ctgacagtaactaatgtggaga

SEQ ID NO: 7106610 - DNA, 22 bp, Homo sapiens
ctgacagtcttgccaagtttct

SEQ ID NO: 7106611 - DNA, 22 bp, Homo sapiens
ctgacagtctcattgatttgct

SEQ ID NO: 7106612 - DNA, 22 bp, Homo sapiens
ctgacagtcttgccaagtttct

SEQ ID NO: 7106613 - DNA, 22 bp, Homo sapiens
ctgacagtgtacactgacagct

SEQ ID NO: 7106614 - DNA, 22 bp, Homo sapiens
ctgacagtttttgctgtattgt

SEQ ID NO: 7106615 - DNA, 22 bp, Homo sapiens
ctgacagtttttgctgtattgt

SEQ ID NO: 7106616 - DNA, 22 bp, Homo sapiens
ctgacagatacttatgacataa

SEQ ID NO: 7106617 - DNA, 22 bp, Homo sapiens
ctgaatcatgccattttgctta

SEQ ID NO: 7106618 - DNA, 22 bp, Homo sapiens
ctgaatcatggtcattagttta

SEQ ID NO: 7106619 - DNA, 22 bp, Homo sapiens
ctgaatatcatttatcattggc

SEQ ID NO: 7106620 - DNA, 22 bp, Homo sapiens
ctgaatattagtcatgtctgat

SEQ ID NO: 7106621 - DNA, 22 bp, Homo sapiens
ctgacagatacttatgacataa

SEQ ID NO: 7106622 - DNA, 22 bp, Homo sapiens
ctgacagatctggatctgaact

SEQ ID NO: 7106623 - DNA, 22 bp, Homo sapiens
ctgacagatgctgctggcagta

SEQ ID NO: 7106624 - DNA, 22 bp, Homo sapiens
ctgacagatgctgctggcagta

SEQ ID NO: 7106625 - DNA, 22 bp, Homo sapiens
ctgacagatgctgctggcagta

SEQ ID NO: 7106626 - DNA, 22 bp, Homo sapiens
ctgacagattagatgtgcatat

SEQ ID NO: 7106627 - DNA, 22 bp, Homo sapiens
ctgacagattagatgtgcatat

SEQ ID NO: 7106628 - DNA, 22 bp, Homo sapiens
ctgacagcaaaggccagtggct

SEQ ID NO: 7106629 - DNA, 22 bp, Homo sapiens
ctgacagctcctagtgctcact

SEQ ID NO: 7106630 - DNA, 22 bp, Homo sapiens
ctgacagctgaagggtcccaga

SEQ ID NO: 7106631 - DNA, 22 bp, Homo sapiens
ctgacaggctgagatccctggt

SEQ ID NO: 7106632 - DNA, 22 bp, Homo sapiens
ctgacagggtagacagagggca

SEQ ID NO: 7106633 - DNA, 22 bp, Homo sapiens
ctgacagggtagacagagggca

SEQ ID NO: 7106634 - DNA, 22 bp, Homo sapiens
ctgacagggtagacagagggca

SEQ ID NO: 7106635 - DNA, 22 bp, Homo sapiens
ctgacagggtagacagagggca

SEQ ID NO: 7106636 - DNA, 19 bp, Homo sapiens
ctgcagggatgtgcagagt

SEQ ID NO: 7106637 - DNA, 22 bp, Homo sapiens
ctgcagggatgtgaggcccgtt

SEQ ID NO: 7106638 - DNA, 22 bp, Homo sapiens
ctgcagggatgtgaggcccgtt

SEQ ID NO: 7106639 - DNA, 19 bp, Homo sapiens
ctgcagggatgtgcagagt

SEQ ID NO: 7106640 - DNA, 19 bp, Homo sapiens
ctgcagggatgtgcagagt

SEQ ID NO: 7106641 - DNA, 19 bp, Homo sapiens
ctgcagggatgtgcagagt

SEQ ID NO: 7106642 - DNA, 22 bp, Homo sapiens
ctgcagggcagggcctcctggc

SEQ ID NO: 7106643 - DNA, 22 bp, Homo sapiens
ctgcagggcagaagggcataga

SEQ ID NO: 7106644 - DNA, 22 bp, Homo sapiens
ctgcagggcagggcctcctggc

SEQ ID NO: 7106645 - DNA, 22 bp, Homo sapiens
ctgcagggcagggcctcctggc

SEQ ID NO: 7106646 - DNA, 22 bp, Homo sapiens
ctgcagggcattgtaactcttt

SEQ ID NO: 7106647 - DNA, 22 bp, Homo sapiens
ctgcagggcagggcctcctggc

SEQ ID NO: 7106648 - DNA, 22 bp, Homo sapiens
ctgcagggcagggcctcctggc

SEQ ID NO: 7106649 - DNA, 22 bp, Homo sapiens
ctgcagggcagaagggcataga

SEQ ID NO: 7106650 - DNA, 22 bp, Homo sapiens
ctgcagggattgcttctgtata

SEQ ID NO: 7106651 - DNA, 22 bp, Homo sapiens
ctgcagggattgcttctgtata

SEQ ID NO: 7106652 - DNA, 22 bp, Homo sapiens
ctgcaggggcctcgagcacagg

SEQ ID NO: 7106653 - DNA, 22 bp, Homo sapiens
ctgcaggggcagtccacttcct
